United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 195

SEQ ID NO: 8111287 - DNA, 22 bp, Homo sapiens
tgaggctcaaggtctggtggag

SEQ ID NO: 8111288 - DNA, 22 bp, Homo sapiens
tgaggccttttctgtctggcta

SEQ ID NO: 8111289 - DNA, 22 bp, Homo sapiens
tgaggcctgggcacataacctc

SEQ ID NO: 8111290 - DNA, 22 bp, Homo sapiens
tgaggcctgtcattgtcttgtt

SEQ ID NO: 8111291 - DNA, 22 bp, Homo sapiens
tgaggcctggactctgcatgga

SEQ ID NO: 8111292 - DNA, 22 bp, Homo sapiens
tgaggcctggagggaggagttt

SEQ ID NO: 8111293 - DNA, 22 bp, Homo sapiens
tgaggcctgccctggggaagtt

SEQ ID NO: 8111294 - DNA, 22 bp, Homo sapiens
tgaggcctgcttggaattgaat

SEQ ID NO: 8111295 - DNA, 22 bp, Homo sapiens
tgaggcttgatttgcccgagag

SEQ ID NO: 8111296 - DNA, 21 bp, Homo sapiens
tgaggctgttgtaccagggag

SEQ ID NO: 8111297 - DNA, 22 bp, Homo sapiens
tgaggctgttctaccagggcca

SEQ ID NO: 8111298 - DNA, 22 bp, Homo sapiens
tgaggctggcaaggctggtatt

SEQ ID NO: 8111299 - DNA, 22 bp, Homo sapiens
tgaggctggatgggatgcctcc

SEQ ID NO: 8111300 - DNA, 17 bp, Homo sapiens
tgaggctcggtgaggag

SEQ ID NO: 8111301 - DNA, 22 bp, Homo sapiens
tgaggaagtggttgtatggttt

SEQ ID NO: 8111302 - DNA, 22 bp, Homo sapiens
tgaggaagaacaagaatttaga

SEQ ID NO: 8111303 - DNA, 22 bp, Homo sapiens
tgaggaagcaaaggcttgtgtg

SEQ ID NO: 8111304 - DNA, 22 bp, Homo sapiens
tgaggaaggaattgaggtttta

SEQ ID NO: 8111305 - DNA, 22 bp, Homo sapiens
tgaggaagccaaacagctacac

SEQ ID NO: 8111306 - DNA, 22 bp, Homo sapiens
tgaggaggtcagagtctggctg

SEQ ID NO: 8111307 - DNA, 22 bp, Homo sapiens
tgaggaggcccaggttggggct

SEQ ID NO: 8111308 - DNA, 18 bp, Homo sapiens
tgaggcccgcagaggtgg

SEQ ID NO: 8111309 - DNA, 22 bp, Homo sapiens
tgaggccctagggcatgggaga

SEQ ID NO: 8111310 - DNA, 22 bp, Homo sapiens
tgaggcccgggtggaggaatgc

SEQ ID NO: 8111311 - DNA, 22 bp, Homo sapiens
tgaggccctctgggctggtcct

SEQ ID NO: 8111312 - DNA, 22 bp, Homo sapiens
tgaggcctcatttagggagagg

SEQ ID NO: 8111313 - DNA, 21 bp, Homo sapiens
tgaggcctctcctgggctggc

SEQ ID NO: 8111314 - DNA, 21 bp, Homo sapiens
tgaggcctctcctgggctggc

SEQ ID NO: 8111315 - DNA, 22 bp, Homo sapiens
tgaggcctcataatgagatttc

SEQ ID NO: 8111316 - DNA, 22 bp, Homo sapiens
tgaggcctcttggtatggtgtg

SEQ ID NO: 8111317 - DNA, 22 bp, Homo sapiens
tgaggcctgaagcctgaagtga

SEQ ID NO: 8111318 - DNA, 18 bp, Homo sapiens
tgaggcctctgctgggcc

SEQ ID NO: 8111319 - DNA, 22 bp, Homo sapiens
tgaggcctgcattgaactagaa

SEQ ID NO: 8111320 - DNA, 21 bp, Homo sapiens
tgaggcctgccagtctcagaa

SEQ ID NO: 8111321 - DNA, 17 bp, Homo sapiens
tgaggcctgcatcagtg

SEQ ID NO: 8111322 - DNA, 22 bp, Homo sapiens
tgaggcctgacagaccaagcct

SEQ ID NO: 8111323 - DNA, 22 bp, Homo sapiens
tgaggcctgaagcctggagcct

SEQ ID NO: 8111324 - DNA, 19 bp, Homo sapiens
tgaggccaaggtcacagat

SEQ ID NO: 8111325 - DNA, 22 bp, Homo sapiens
tgaggccaagcctcctctgcca

SEQ ID NO: 8111326 - DNA, 22 bp, Homo sapiens
tgaggcaggagttcaggctgcg

SEQ ID NO: 8111327 - DNA, 22 bp, Homo sapiens
tgagagagggatgcaccctcct

SEQ ID NO: 8111328 - DNA, 22 bp, Homo sapiens
tgagagaggggactgcctgctt

SEQ ID NO: 8111329 - DNA, 22 bp, Homo sapiens
tgagagagcgcctgggatcatt

SEQ ID NO: 8111330 - DNA, 18 bp, Homo sapiens
tgagagaatgttcatgct

SEQ ID NO: 8111331 - DNA, 22 bp, Homo sapiens
tgagagcagaggtgggcagcct

SEQ ID NO: 8111332 - DNA, 22 bp, Homo sapiens
tgagagctgccacgtgaccatg

SEQ ID NO: 8111333 - DNA, 22 bp, Homo sapiens
tgagagctgtccacctgtggga

SEQ ID NO: 8111334 - DNA, 22 bp, Homo sapiens
tgagagggttcccaggggtttc

SEQ ID NO: 8111335 - DNA, 22 bp, Homo sapiens
tgagagggcccagagcacacca

SEQ ID NO: 8111336 - DNA, 22 bp, Homo sapiens
tgagataatacttcttagctgg

SEQ ID NO: 8111337 - DNA, 22 bp, Homo sapiens
tgagatatctgttaattttctt

SEQ ID NO: 8111338 - DNA, 22 bp, Homo sapiens
tgagatcatatgtacaaggtct

SEQ ID NO: 8111339 - DNA, 22 bp, Homo sapiens
tgagaaatattgcacagtgagg

SEQ ID NO: 8111340 - DNA, 22 bp, Homo sapiens
tgagaaattacttcagtgatgg

SEQ ID NO: 8111341 - DNA, 22 bp, Homo sapiens
tgagaaagcctttagtcccagg

SEQ ID NO: 8111342 - DNA, 22 bp, Homo sapiens
tgagaaagacagacattcctaa

SEQ ID NO: 8111343 - DNA, 22 bp, Homo sapiens
tgagaaaagtgtggaggtcaat

SEQ ID NO: 8111344 - DNA, 22 bp, Homo sapiens
tgagaaaatccagaggctagtt

SEQ ID NO: 8111345 - DNA, 19 bp, Homo sapiens
tgagacagaagatgagcct

SEQ ID NO: 8111346 - DNA, 22 bp, Homo sapiens
tgagaattctacaatagatcaa

SEQ ID NO: 8111347 - DNA, 22 bp, Homo sapiens
tgagacagcctctgcactcatg

SEQ ID NO: 8111348 - DNA, 22 bp, Homo sapiens
tgagacagggtcttgctctgtt

SEQ ID NO: 8111349 - DNA, 22 bp, Homo sapiens
tgagacagggtcttgctctgtt

SEQ ID NO: 8111350 - DNA, 22 bp, Homo sapiens
tgagcaatatgtgaattttctt

SEQ ID NO: 8111351 - DNA, 22 bp, Homo sapiens
tgagcagaggaggctgccaact

SEQ ID NO: 8111352 - DNA, 18 bp, Homo sapiens
tgagcagagtaaggcttt

SEQ ID NO: 8111353 - DNA, 22 bp, Homo sapiens
tgagcaggctcccacttcagtg

SEQ ID NO: 8111354 - DNA, 22 bp, Homo sapiens
tgagcaggattcgcctcttgca

SEQ ID NO: 8111355 - DNA, 22 bp, Homo sapiens
tgagcagatgtgccaaactgta

SEQ ID NO: 8111356 - DNA, 23 bp, Homo sapiens
tgagcagctaaaggtgatgcggg

SEQ ID NO: 8111357 - DNA, 22 bp, Homo sapiens
tgagccagataagggctcacgc

SEQ ID NO: 8111358 - DNA, 22 bp, Homo sapiens
tgagcatagtgatttttctaga

SEQ ID NO: 8111359 - DNA, 19 bp, Homo sapiens
tgagccagggaggccatgc

SEQ ID NO: 8111360 - DNA, 22 bp, Homo sapiens
tgagccaggctccatgccacct

SEQ ID NO: 8111361 - DNA, 22 bp, Homo sapiens
tgagccaggcactgctcctgga

SEQ ID NO: 8111362 - DNA, 22 bp, Homo sapiens
tgagccagccttgcagctgtgc

SEQ ID NO: 8111363 - DNA, 22 bp, Homo sapiens
tgagccagcaggcctccagtgg

SEQ ID NO: 8111364 - DNA, 22 bp, Homo sapiens
tgagctcatagctcttattatg

SEQ ID NO: 8111365 - DNA, 22 bp, Homo sapiens
tgagctcaagcaattcacccgc

SEQ ID NO: 8111366 - DNA, 22 bp, Homo sapiens
tgagctcatagctcttattatg

SEQ ID NO: 8111367 - DNA, 22 bp, Homo sapiens
tgagctgcaagaaaatttcagt

SEQ ID NO: 8111368 - DNA, 19 bp, Homo sapiens
tgagctgccgtcttccctg

SEQ ID NO: 8111369 - DNA, 22 bp, Homo sapiens
tgagcttccctcctgcactaca

SEQ ID NO: 8111370 - DNA, 22 bp, Homo sapiens
tgagccctaagggtcaagcagg

SEQ ID NO: 8111371 - DNA, 23 bp, Homo sapiens
tgagcccagttttccctcttgcc

SEQ ID NO: 8111372 - DNA, 22 bp, Homo sapiens
tgagccccggagtttcaggctg

SEQ ID NO: 8111373 - DNA, 22 bp, Homo sapiens
tgagccccaggaaattgaggag

SEQ ID NO: 8111374 - DNA, 22 bp, Homo sapiens
tgagcccatgtagcacttccat

SEQ ID NO: 8111375 - DNA, 22 bp, Homo sapiens
tgagccaggttttccatcattc

SEQ ID NO: 8111376 - DNA, 22 bp, Homo sapiens
tgagcccagtctgtctgacatg

SEQ ID NO: 8111377 - DNA, 23 bp, Homo sapiens
tgagcctgttaatactggctctg

SEQ ID NO: 8111378 - DNA, 22 bp, Homo sapiens
tgagcctgggctttctctggag

SEQ ID NO: 8111379 - DNA, 22 bp, Homo sapiens
tgcagttttgccaggcaatgga

SEQ ID NO: 8111380 - DNA, 21 bp, Homo sapiens
tgcagttttgcttgatctctg

SEQ ID NO: 8111381 - DNA, 20 bp, Homo sapiens
tgcagtttgtcaaggttcct

SEQ ID NO: 8111382 - DNA, 21 bp, Homo sapiens
tgcagttcaagtcaatctact

SEQ ID NO: 8111383 - DNA, 22 bp, Homo sapiens
tgcatacacaagcatacatgta

SEQ ID NO: 8111384 - DNA, 22 bp, Homo sapiens
tgcatatacccgcatttacata

SEQ ID NO: 8111385 - DNA, 23 bp, Homo sapiens
tgcatggggctatactgctgttc

SEQ ID NO: 8111386 - DNA, 22 bp, Homo sapiens
tgcatgtgtgacaaggacagtt

SEQ ID NO: 8111387 - DNA, 22 bp, Homo sapiens
tgccagcacttctggctgtctg

SEQ ID NO: 8111388 - DNA, 22 bp, Homo sapiens
tgccagagttacatgagggtca

SEQ ID NO: 8111389 - DNA, 23 bp, Homo sapiens
tgccagaggcagtcacagtggtg

SEQ ID NO: 8111390 - DNA, 22 bp, Homo sapiens
tgccagcagtagcagtaggcca

SEQ ID NO: 8111391 - DNA, 19 bp, Homo sapiens
tgccagcattaggctgaag

SEQ ID NO: 8111392 - DNA, 21 bp, Homo sapiens
tgccagcattaaacagtcatt

SEQ ID NO: 8111393 - DNA, 22 bp, Homo sapiens
tgccagccaggttctgaggcta

SEQ ID NO: 8111394 - DNA, 22 bp, Homo sapiens
tgccacagtttcatggattctg

SEQ ID NO: 8111395 - DNA, 22 bp, Homo sapiens
tgccactggctcaatggtgcag

SEQ ID NO: 8111396 - DNA, 22 bp, Homo sapiens
tgccactgggcatgcagatgtc

SEQ ID NO: 8111397 - DNA, 22 bp, Homo sapiens
tgcaggctctctgctgccagat

SEQ ID NO: 8111398 - DNA, 22 bp, Homo sapiens
tgcaggctgctggcagtagctt

SEQ ID NO: 8111399 - DNA, 21 bp, Homo sapiens
tgcaggctgtgcgctcctgcc

SEQ ID NO: 8111400 - DNA, 22 bp, Homo sapiens
tgcagggcagatatgactgtag

SEQ ID NO: 8111401 - DNA, 21 bp, Homo sapiens
tgcagtgtccctaacagtggt

SEQ ID NO: 8111402 - DNA, 22 bp, Homo sapiens
tgcagtggtggtaaagatgctc

SEQ ID NO: 8111403 - DNA, 22 bp, Homo sapiens
tgcagtcagcattagcaaaata

SEQ ID NO: 8111404 - DNA, 22 bp, Homo sapiens
tgcctgaagaaaacttgcagca

SEQ ID NO: 8111405 - DNA, 22 bp, Homo sapiens
tgcctgagtgatgtggcagcca

SEQ ID NO: 8111406 - DNA, 22 bp, Homo sapiens
tgcctgaggagtcagggcaggt

SEQ ID NO: 8111407 - DNA, 22 bp, Homo sapiens
tgcctctgtgtgcaggtgagca

SEQ ID NO: 8111408 - DNA, 22 bp, Homo sapiens
tgcctctgtggaaatggtggtc

SEQ ID NO: 8111409 - DNA, 22 bp, Homo sapiens
tgcctcctctttgccaaggtca

SEQ ID NO: 8111410 - DNA, 22 bp, Homo sapiens
tgcctccttcaggagggcccgg

SEQ ID NO: 8111411 - DNA, 22 bp, Homo sapiens
tgcctcgtgtctgagtctgttc

SEQ ID NO: 8111412 - DNA, 22 bp, Homo sapiens
tgcctcaggcacctggcaggtt

SEQ ID NO: 8111413 - DNA, 22 bp, Homo sapiens
tgcctcagctgaggccgctcca

SEQ ID NO: 8111414 - DNA, 22 bp, Homo sapiens
tgcctcagagtgggcttgctat

SEQ ID NO: 8111415 - DNA, 22 bp, Homo sapiens
tgcctcagtctaaagtctctca

SEQ ID NO: 8111416 - DNA, 22 bp, Homo sapiens
tgcctgctgctaagctctttgt

SEQ ID NO: 8111417 - DNA, 22 bp, Homo sapiens
tgcctgctgccactgctgttac

SEQ ID NO: 8111418 - DNA, 22 bp, Homo sapiens
tgcctgccaggcaacctgggag

SEQ ID NO: 8111419 - DNA, 22 bp, Homo sapiens
tgcctgctgattggagttgaat

SEQ ID NO: 8111420 - DNA, 22 bp, Homo sapiens
tgcctgccccacaaggggttgc

SEQ ID NO: 8111421 - DNA, 22 bp, Homo sapiens
tgcctgcagcgtctccagcagg

SEQ ID NO: 8111422 - DNA, 22 bp, Homo sapiens
tgcctgccaatgatgcttgtgt

SEQ ID NO: 8111423 - DNA, 22 bp, Homo sapiens
tgcctgcattttgtggctggct

SEQ ID NO: 8111424 - DNA, 22 bp, Homo sapiens
tgcctgcccacgactacagcag

SEQ ID NO: 8111425 - DNA, 22 bp, Homo sapiens
tgcctgccatgcagaaagctga

SEQ ID NO: 8111426 - DNA, 22 bp, Homo sapiens
tgcctgccacgcttgctaccac

SEQ ID NO: 8111427 - DNA, 17 bp, Homo sapiens
tgcctgccagcattgga

SEQ ID NO: 8111428 - DNA, 22 bp, Homo sapiens
tgcctggcaactgtggtgggct

SEQ ID NO: 8111429 - DNA, 22 bp, Homo sapiens
tgcctggcaagaggggctggct

SEQ ID NO: 8111430 - DNA, 22 bp, Homo sapiens
tgcctggcactcctggagctca

SEQ ID NO: 8111431 - DNA, 22 bp, Homo sapiens
tgccgtggggctgaggctggag

SEQ ID NO: 8111432 - DNA, 22 bp, Homo sapiens
tgcctcagagacctgacagtac

SEQ ID NO: 8111433 - DNA, 22 bp, Homo sapiens
tgcctagaactttattctttat

SEQ ID NO: 8111434 - DNA, 22 bp, Homo sapiens
tgccctgggaggctttcctgtt

SEQ ID NO: 8111435 - DNA, 22 bp, Homo sapiens
tgccctgtctaagctgtcagta

SEQ ID NO: 8111436 - DNA, 22 bp, Homo sapiens
tgcccttgggtaacttgctgat

SEQ ID NO: 8111437 - DNA, 22 bp, Homo sapiens
tgcccttcctctggattgcctt

SEQ ID NO: 8111438 - DNA, 17 bp, Homo sapiens
tgccctgtgcctggtgt

SEQ ID NO: 8111439 - DNA, 22 bp, Homo sapiens
tgccctgtgccagacttcctgg

SEQ ID NO: 8111440 - DNA, 22 bp, Homo sapiens
tgccctgtgggtatctgatggc

SEQ ID NO: 8111441 - DNA, 22 bp, Homo sapiens
tgccctgttcctgcctccagct

SEQ ID NO: 8111442 - DNA, 22 bp, Homo sapiens
tgccctgcttctcttgggacag

SEQ ID NO: 8111443 - DNA, 22 bp, Homo sapiens
tgccctgcttctcttgggacag

SEQ ID NO: 8111444 - DNA, 22 bp, Homo sapiens
tgccctgctgtggctctgccca

SEQ ID NO: 8111445 - DNA, 22 bp, Homo sapiens
tgccctgctgtggctctgccca

SEQ ID NO: 8111446 - DNA, 22 bp, Homo sapiens
tgccctgcttggtttattttca

SEQ ID NO: 8111447 - DNA, 22 bp, Homo sapiens
tgccctgccaagactgagtggt

SEQ ID NO: 8111448 - DNA, 22 bp, Homo sapiens
tgccctgccaagactgagtggt

SEQ ID NO: 8111449 - DNA, 19 bp, Homo sapiens
tgccctgcccgcagccttg

SEQ ID NO: 8111450 - DNA, 19 bp, Homo sapiens
tgccctgcccgcagccttg

SEQ ID NO: 8111451 - DNA, 22 bp, Homo sapiens
tgccctgcccatctaccctgtc

SEQ ID NO: 8111452 - DNA, 22 bp, Homo sapiens
tgccctgccaagactcagtggt

SEQ ID NO: 8111453 - DNA, 22 bp, Homo sapiens
tgccctgcatgcagggagctgt

SEQ ID NO: 8111454 - DNA, 22 bp, Homo sapiens
tgccctgccaagaccaagtggt

SEQ ID NO: 8111455 - DNA, 22 bp, Homo sapiens
tgccctgctaaccttggttcca

SEQ ID NO: 8111456 - DNA, 22 bp, Homo sapiens
tgccctgctaaccttggttcca

SEQ ID NO: 8111457 - DNA, 22 bp, Homo sapiens
tgccctgctaaatataggtagc

SEQ ID NO: 8111458 - DNA, 22 bp, Homo sapiens
tgccctgctgtgcctggagcca

SEQ ID NO: 8111459 - DNA, 22 bp, Homo sapiens
tgccctgctgtgcctggagcca

SEQ ID NO: 8111460 - DNA, 22 bp, Homo sapiens
tgccctgcccttgctatttcta

SEQ ID NO: 8111461 - DNA, 22 bp, Homo sapiens
tgccctgcccttgctatttcta

SEQ ID NO: 8111462 - DNA, 22 bp, Homo sapiens
tgccctgcctgagagacagtaa

SEQ ID NO: 8111463 - DNA, 22 bp, Homo sapiens
tgccctgcggctatctagatga

SEQ ID NO: 8111464 - DNA, 22 bp, Homo sapiens
tgccctgcagtgagtgcgtctg

SEQ ID NO: 8111465 - DNA, 22 bp, Homo sapiens
tgccctgcatgcagggagctgt

SEQ ID NO: 8111466 - DNA, 22 bp, Homo sapiens
tgccctgcagaccctgcagtgt

SEQ ID NO: 8111467 - DNA, 22 bp, Homo sapiens
tgccctgcagaccctgcagtgt

SEQ ID NO: 8111468 - DNA, 22 bp, Homo sapiens
tgccctcaagcaacagagagga

SEQ ID NO: 8111469 - DNA, 22 bp, Homo sapiens
tgcccctgacctcaggcgaagg

SEQ ID NO: 8111470 - DNA, 22 bp, Homo sapiens
tgcccctcttgctggccctgtc

SEQ ID NO: 8111471 - DNA, 22 bp, Homo sapiens
tgcccctcgacgcaatgaaggg

SEQ ID NO: 8111472 - DNA, 22 bp, Homo sapiens
tgcccccagacagaatccagtt

SEQ ID NO: 8111473 - DNA, 22 bp, Homo sapiens
tgcccatgtttctctgtatccc

SEQ ID NO: 8111474 - DNA, 22 bp, Homo sapiens
tgcccatggcaggatttctgaa

SEQ ID NO: 8111475 - DNA, 22 bp, Homo sapiens
tgcccatgcatgacagatggct

SEQ ID NO: 8111476 - DNA, 22 bp, Homo sapiens
tgcccagaatagatgggctgtg

SEQ ID NO: 8111477 - DNA, 22 bp, Homo sapiens
tgcccagcactgtgccagtcac

SEQ ID NO: 8111478 - DNA, 22 bp, Homo sapiens
tgcccagcagggagctacctgg

SEQ ID NO: 8111479 - DNA, 22 bp, Homo sapiens
tgcccagccaatttgttatgtt

SEQ ID NO: 8111480 - DNA, 20 bp, Homo sapiens
tgcccagcaagagtgcagtt

SEQ ID NO: 8111481 - DNA, 22 bp, Homo sapiens
tgcccagcacccagcatgatgc

SEQ ID NO: 8111482 - DNA, 22 bp, Homo sapiens
tgcccagcactgtgccagtcac

SEQ ID NO: 8111483 - DNA, 22 bp, Homo sapiens
tgcccagcaataaaccagaaga

SEQ ID NO: 8111484 - DNA, 22 bp, Homo sapiens
tgccagtcagtggtttaaaagt

SEQ ID NO: 8111485 - DNA, 22 bp, Homo sapiens
tgccatcactgaacttctgaaa

SEQ ID NO: 8111486 - DNA, 22 bp, Homo sapiens
tgccagcctggcctgagtcttt

SEQ ID NO: 8111487 - DNA, 22 bp, Homo sapiens
tgccaggccacgtagcttcaag

SEQ ID NO: 8111488 - DNA, 16 bp, Homo sapiens
tgagtgggagaagggg

SEQ ID NO: 8111489 - DNA, 22 bp, Homo sapiens
tgagtgggatgagttagaggtg

SEQ ID NO: 8111490 - DNA, 19 bp, Homo sapiens
tgagtgggagcccaggtat

SEQ ID NO: 8111491 - DNA, 22 bp, Homo sapiens
tgagtgggacctgcgtgtgtca

SEQ ID NO: 8111492 - DNA, 22 bp, Homo sapiens
tgagtgaccagaagtccccctc

SEQ ID NO: 8111493 - DNA, 22 bp, Homo sapiens
tgagtgggttatcaggaaaggt

SEQ ID NO: 8111494 - DNA, 19 bp, Homo sapiens
tgagtgggcccctgcagac

SEQ ID NO: 8111495 - DNA, 22 bp, Homo sapiens
tgagtgggattaaatgaggtga

SEQ ID NO: 8111496 - DNA, 22 bp, Homo sapiens
tgagttaaatgagaacatgaaa

SEQ ID NO: 8111497 - DNA, 22 bp, Homo sapiens
tgagttcacatgaggtctggtc

SEQ ID NO: 8111498 - DNA, 22 bp, Homo sapiens
tgagttcatatagttcaagata

SEQ ID NO: 8111499 - DNA, 22 bp, Homo sapiens
tgagttatctaaaatagtcaaa

SEQ ID NO: 8111500 - DNA, 22 bp, Homo sapiens
tgatcaaaacattactccacca

SEQ ID NO: 8111501 - DNA, 22 bp, Homo sapiens
tgatattttatgagctttcata

SEQ ID NO: 8111502 - DNA, 22 bp, Homo sapiens
tgatattttatgagctttcata

SEQ ID NO: 8111503 - DNA, 22 bp, Homo sapiens
tgatcctatttcagtgtatgtt

SEQ ID NO: 8111504 - DNA, 22 bp, Homo sapiens
tgatctcctgaccttgtaatcc

SEQ ID NO: 8111505 - DNA, 22 bp, Homo sapiens
tgatctgaaggacatgggaccc

SEQ ID NO: 8111506 - DNA, 22 bp, Homo sapiens
tgatactttggagacttgagta

SEQ ID NO: 8111507 - DNA, 22 bp, Homo sapiens
tgatatgcatgtaagggagaca

SEQ ID NO: 8111508 - DNA, 22 bp, Homo sapiens
tgatatgtaactactccttata

SEQ ID NO: 8111509 - DNA, 22 bp, Homo sapiens
tgatgcttcacgctgaatatgc

SEQ ID NO: 8111510 - DNA, 22 bp, Homo sapiens
tgatgcaatgtttacatcttga

SEQ ID NO: 8111511 - DNA, 22 bp, Homo sapiens
tgatgcccccaaatctggctca

SEQ ID NO: 8111512 - DNA, 22 bp, Homo sapiens
tgatggagcatgtgtgcttcct

SEQ ID NO: 8111513 - DNA, 22 bp, Homo sapiens
tgatggaggacccagcgtggga

SEQ ID NO: 8111514 - DNA, 22 bp, Homo sapiens
tgattaaaatttaacttagtta

SEQ ID NO: 8111515 - DNA, 22 bp, Homo sapiens
tgattaagttcaaaatatagaa

SEQ ID NO: 8111516 - DNA, 22 bp, Homo sapiens
tgattaactgtctattaatcat

SEQ ID NO: 8111517 - DNA, 22 bp, Homo sapiens
tgattcagttggttttgttcag

SEQ ID NO: 8111518 - DNA, 22 bp, Homo sapiens
tgattcatcagaataggagttt

SEQ ID NO: 8111519 - DNA, 22 bp, Homo sapiens
tgattgatggaggtgatttacc

SEQ ID NO: 8111520 - DNA, 22 bp, Homo sapiens
tgattcctgtgcttattccagt

SEQ ID NO: 8111521 - DNA, 20 bp, Homo sapiens
tgcaatgtccatgttccagg

SEQ ID NO: 8111522 - DNA, 22 bp, Homo sapiens
tgcacaataccatgcaggggcc

SEQ ID NO: 8111523 - DNA, 22 bp, Homo sapiens
tgcaagcaatccaggaaggcta

SEQ ID NO: 8111524 - DNA, 21 bp, Homo sapiens
tgcaatccagcctgggcgaca

SEQ ID NO: 8111525 - DNA, 22 bp, Homo sapiens
tgcaagagcccaaactatatac

SEQ ID NO: 8111526 - DNA, 22 bp, Homo sapiens
tgcaagagattcaaaccataaa

SEQ ID NO: 8111527 - DNA, 22 bp, Homo sapiens
tgcaagaggattgtatcaataa

SEQ ID NO: 8111528 - DNA, 22 bp, Homo sapiens
tgcaagaggcatcttttaaaaa

SEQ ID NO: 8111529 - DNA, 22 bp, Homo sapiens
tgcaagaggttggattttaaga

SEQ ID NO: 8111530 - DNA, 22 bp, Homo sapiens
tgatttcaagtagtgacatgct

SEQ ID NO: 8111531 - DNA, 22 bp, Homo sapiens
tgatttcatagtatatacatga

SEQ ID NO: 8111532 - DNA, 22 bp, Homo sapiens
tgatttccctcatcataacaga

SEQ ID NO: 8111533 - DNA, 22 bp, Homo sapiens
tgcaaaataatgaacgattttt

SEQ ID NO: 8111534 - DNA, 22 bp, Homo sapiens
tgcaaacatccgactgaaagcc

SEQ ID NO: 8111535 - DNA, 22 bp, Homo sapiens
tgcaaagatgaaatattaaagg

SEQ ID NO: 8111536 - DNA, 22 bp, Homo sapiens
tgcaaatgcccatttattttct

SEQ ID NO: 8111537 - DNA, 22 bp, Homo sapiens
tgcaccaagtctggcactgaat

SEQ ID NO: 8111538 - DNA, 22 bp, Homo sapiens
tgcagaagtgagtcatgaggaa

SEQ ID NO: 8111539 - DNA, 22 bp, Homo sapiens
tgcagaagcagagccggtggcc

SEQ ID NO: 8111540 - DNA, 22 bp, Homo sapiens
tgcagaagaaaacagctgtgtg

SEQ ID NO: 8111541 - DNA, 19 bp, Homo sapiens
tgcagaagacacagtggtg

SEQ ID NO: 8111542 - DNA, 22 bp, Homo sapiens
tgcagaagaatgagcttggagt

SEQ ID NO: 8111543 - DNA, 22 bp, Homo sapiens
tgcacgtgggctctctgctctt

SEQ ID NO: 8111544 - DNA, 22 bp, Homo sapiens
tgcagaaataaagatattatca

SEQ ID NO: 8111545 - DNA, 22 bp, Homo sapiens
tgcagaaacagtcattaatgta

SEQ ID NO: 8111546 - DNA, 22 bp, Homo sapiens
tgcagcacttgccaaactaact

SEQ ID NO: 8111547 - DNA, 22 bp, Homo sapiens
tgcagcagaatatggctgcagg

SEQ ID NO: 8111548 - DNA, 22 bp, Homo sapiens
tgcagcaagtaaccatcttcct

SEQ ID NO: 8111549 - DNA, 22 bp, Homo sapiens
tgcagagggacagccacagctc

SEQ ID NO: 8111550 - DNA, 23 bp, Homo sapiens
tgcagagggactgaagccagctt

SEQ ID NO: 8111551 - DNA, 19 bp, Homo sapiens
tgcagagggtaggaaggcc

SEQ ID NO: 8111552 - DNA, 22 bp, Homo sapiens
tgcagagggagtgacggttcac

SEQ ID NO: 8111553 - DNA, 22 bp, Homo sapiens
tgcagagggaaaaggtgctcct

SEQ ID NO: 8111554 - DNA, 22 bp, Homo sapiens
tgcagaggagctggaaggctgg

SEQ ID NO: 8111555 - DNA, 22 bp, Homo sapiens
tgcagaggagtcagcctgggca

SEQ ID NO: 8111556 - DNA, 23 bp, Homo sapiens
tgcagaggcatgatcactgctca

SEQ ID NO: 8111557 - DNA, 21 bp, Homo sapiens
tgcagaggcacaaacaagccc

SEQ ID NO: 8111558 - DNA, 22 bp, Homo sapiens
tgcagaggcatttattgatgta

SEQ ID NO: 8111559 - DNA, 22 bp, Homo sapiens
tgcagaggctggctcgccgggt

SEQ ID NO: 8111560 - DNA, 22 bp, Homo sapiens
tgcagaggcgccgtgggtgggg

SEQ ID NO: 8111561 - DNA, 22 bp, Homo sapiens
tgcagaggcccagcggttcttc

SEQ ID NO: 8111562 - DNA, 22 bp, Homo sapiens
tgcagacagagaaatgaggccc

SEQ ID NO: 8111563 - DNA, 22 bp, Homo sapiens
tgcagacaagaagaaccaagga

SEQ ID NO: 8111564 - DNA, 22 bp, Homo sapiens
tgcagagatcctggactgagcg

SEQ ID NO: 8111565 - DNA, 21 bp, Homo sapiens
tgcagacagggacagaatgga

SEQ ID NO: 8111566 - DNA, 22 bp, Homo sapiens
tgcagaggaccattgtcctgga

SEQ ID NO: 8111567 - DNA, 22 bp, Homo sapiens
tgcagcagggcccaggcacaga

SEQ ID NO: 8111568 - DNA, 22 bp, Homo sapiens
tgcagcaggcacaggacggaag

SEQ ID NO: 8111569 - DNA, 22 bp, Homo sapiens
tgcagcaggagccaggcctggt

SEQ ID NO: 8111570 - DNA, 22 bp, Homo sapiens
tgcagcagagtgggcctgggtg

SEQ ID NO: 8111571 - DNA, 21 bp, Homo sapiens
tgcagcagatttgggggaaga

SEQ ID NO: 8111572 - DNA, 22 bp, Homo sapiens
tgcagcagcagggaggaggctc

SEQ ID NO: 8111573 - DNA, 21 bp, Homo sapiens
tgcagcagagtaagcagggga

SEQ ID NO: 8111574 - DNA, 22 bp, Homo sapiens
tgcagcagacataatgtggatt

SEQ ID NO: 8111575 - DNA, 22 bp, Homo sapiens
tgcagcagactgagtatgagaa

SEQ ID NO: 8111576 - DNA, 22 bp, Homo sapiens
tgcagcaggtatggcaagctcc

SEQ ID NO: 8111577 - DNA, 22 bp, Homo sapiens
tgcagctagcgtgcctagtgaa

SEQ ID NO: 8111578 - DNA, 21 bp, Homo sapiens
tgcaggagtctgtgagtcagg

SEQ ID NO: 8111579 - DNA, 22 bp, Homo sapiens
tgcaggaggccccatggaaccg

SEQ ID NO: 8111580 - DNA, 22 bp, Homo sapiens
tgcaggctcacctgccagggcc

SEQ ID NO: 8111581 - DNA, 22 bp, Homo sapiens
tgcaggctcacctgccagggcc

SEQ ID NO: 8111582 - DNA, 22 bp, Homo sapiens
tgcagctttaagctttcatcag

SEQ ID NO: 8111583 - DNA, 20 bp, Homo sapiens
tgcagcttctcatcttcaaa

SEQ ID NO: 8111584 - DNA, 22 bp, Homo sapiens
tcctgggaagactgtgaggaca

SEQ ID NO: 8111585 - DNA, 22 bp, Homo sapiens
tcctgggaagactgtgaggaca

SEQ ID NO: 8111586 - DNA, 22 bp, Homo sapiens
tcctgggaagagacctgagcat

SEQ ID NO: 8111587 - DNA, 22 bp, Homo sapiens
tcctgggaagagacctgagcat

SEQ ID NO: 8111588 - DNA, 18 bp, Homo sapiens
tcctgggaacttgctagc

SEQ ID NO: 8111589 - DNA, 22 bp, Homo sapiens
tcctgggaactcggaaagctct

SEQ ID NO: 8111590 - DNA, 18 bp, Homo sapiens
tcctgggaaaggcataca

SEQ ID NO: 8111591 - DNA, 22 bp, Homo sapiens
tcctggcttttcttggctcatc

SEQ ID NO: 8111592 - DNA, 22 bp, Homo sapiens
tcctgggaccaggcacctactg

SEQ ID NO: 8111593 - DNA, 22 bp, Homo sapiens
tcctgggacaccccaatatgag

SEQ ID NO: 8111594 - DNA, 22 bp, Homo sapiens
tcctgggacaagccgtggaagt

SEQ ID NO: 8111595 - DNA, 22 bp, Homo sapiens
tcctgggaagttgcatcaccgt

SEQ ID NO: 8111596 - DNA, 21 bp, Homo sapiens
tcctgggaagcactggggtgg

SEQ ID NO: 8111597 - DNA, 21 bp, Homo sapiens
tcctgggaagcactggggtgg

SEQ ID NO: 8111598 - DNA, 22 bp, Homo sapiens
tcctgggaagcgccggcctgcg

SEQ ID NO: 8111599 - DNA, 22 bp, Homo sapiens
tcctgggaagtggctggctgag

SEQ ID NO: 8111600 - DNA, 22 bp, Homo sapiens
tcctgggaagtggctggctgag

SEQ ID NO: 8111601 - DNA, 22 bp, Homo sapiens
tcctgggaagcgccggcctgcg

SEQ ID NO: 8111602 - DNA, 22 bp, Homo sapiens
tcctgggaccctgggtgcagag

SEQ ID NO: 8111603 - DNA, 22 bp, Homo sapiens
tcctgggaccgagggaagagct

SEQ ID NO: 8111604 - DNA, 22 bp, Homo sapiens
tcctgggactcaacttagaagg

SEQ ID NO: 8111605 - DNA, 22 bp, Homo sapiens
tcctgggactctgcctcaggct

SEQ ID NO: 8111606 - DNA, 22 bp, Homo sapiens
tcctgggaggaacatttaccta

SEQ ID NO: 8111607 - DNA, 22 bp, Homo sapiens
tcctgggaggcggaggttgcag

SEQ ID NO: 8111608 - DNA, 22 bp, Homo sapiens
tcctgggaggcggaggttgcag

SEQ ID NO: 8111609 - DNA, 22 bp, Homo sapiens
tcctgggaggcaggaccccttt

SEQ ID NO: 8111610 - DNA, 22 bp, Homo sapiens
tcctgggaggctgtgcctggct

SEQ ID NO: 8111611 - DNA, 22 bp, Homo sapiens
tcctgggaggctgtgcctggct

SEQ ID NO: 8111612 - DNA, 22 bp, Homo sapiens
tcctgggatactaagaaatttt

SEQ ID NO: 8111613 - DNA, 22 bp, Homo sapiens
tcctgggagtggccatgtaatg

SEQ ID NO: 8111614 - DNA, 22 bp, Homo sapiens
tcctgggatcaagtgatcctcc

SEQ ID NO: 8111615 - DNA, 22 bp, Homo sapiens
tcctgggatgcataaaatatgt

SEQ ID NO: 8111616 - DNA, 22 bp, Homo sapiens
tcctgggatgaggaaacaagga

SEQ ID NO: 8111617 - DNA, 22 bp, Homo sapiens
tcctgggatgacttttgaaatg

SEQ ID NO: 8111618 - DNA, 21 bp, Homo sapiens
tcctgggagtctgagatcctg

SEQ ID NO: 8111619 - DNA, 22 bp, Homo sapiens
tcctgggagtaattgagtcatg

SEQ ID NO: 8111620 - DNA, 22 bp, Homo sapiens
tcctgggaggtaaaccagcatc

SEQ ID NO: 8111621 - DNA, 22 bp, Homo sapiens
tcctgggagtaaaagctgccct

SEQ ID NO: 8111622 - DNA, 22 bp, Homo sapiens
tcctgggattctgcatttctaa

SEQ ID NO: 8111623 - DNA, 22 bp, Homo sapiens
tcctgggatttgcccttttctc

SEQ ID NO: 8111624 - DNA, 22 bp, Homo sapiens
tcctgggattaaggtggtgatt

SEQ ID NO: 8111625 - DNA, 22 bp, Homo sapiens
tcctgggcagcgggacgctcag

SEQ ID NO: 8111626 - DNA, 22 bp, Homo sapiens
tcctgtctgctcacagagctgg

SEQ ID NO: 8111627 - DNA, 22 bp, Homo sapiens
tcctgtctgtctttggtccctt

SEQ ID NO: 8111628 - DNA, 22 bp, Homo sapiens
tcctgtgatggcttgcgatgtg

SEQ ID NO: 8111629 - DNA, 22 bp, Homo sapiens
tcctgtctaaagacctgcaggc

SEQ ID NO: 8111630 - DNA, 19 bp, Homo sapiens
tcctggcacagtggaacca

SEQ ID NO: 8111631 - DNA, 22 bp, Homo sapiens
tcctggagtatttctgtggtgt

SEQ ID NO: 8111632 - DNA, 22 bp, Homo sapiens
tcctggccaagtagatgtggcg

SEQ ID NO: 8111633 - DNA, 23 bp, Homo sapiens
tcctggctctgcacttgctaatg

SEQ ID NO: 8111634 - DNA, 22 bp, Homo sapiens
taagaaggtagtttccaagtca

SEQ ID NO: 8111635 - DNA, 22 bp, Homo sapiens
tcctgctggtgatggttaaggt

SEQ ID NO: 8111636 - DNA, 22 bp, Homo sapiens
tcctgctgtgtctagctggttc

SEQ ID NO: 8111637 - DNA, 22 bp, Homo sapiens
tcctgctgtgcttattatcctg

SEQ ID NO: 8111638 - DNA, 19 bp, Homo sapiens
tcctgctgtgtgaagggga

SEQ ID NO: 8111639 - DNA, 22 bp, Homo sapiens
tcctgctggcaaggaagggact

SEQ ID NO: 8111640 - DNA, 22 bp, Homo sapiens
tcctgctgggtctaactctggt

SEQ ID NO: 8111641 - DNA, 22 bp, Homo sapiens
tcctgctgggcctgctttagga

SEQ ID NO: 8111642 - DNA, 21 bp, Homo sapiens
tcctgctgggtcaaccgtttt

SEQ ID NO: 8111643 - DNA, 22 bp, Homo sapiens
tcctgctgttttctggcccaca

SEQ ID NO: 8111644 - DNA, 22 bp, Homo sapiens
tcctgctgtttacctacaatgg

SEQ ID NO: 8111645 - DNA, 22 bp, Homo sapiens
taagaatattgggaatggatgg

SEQ ID NO: 8111646 - DNA, 22 bp, Homo sapiens
tcctgctggattgtgtctggtg

SEQ ID NO: 8111647 - DNA, 22 bp, Homo sapiens
tcgtgatctgtccacctcggcc

SEQ ID NO: 8111648 - DNA, 22 bp, Homo sapiens
tcgtgaggctctgcatcgcaca

SEQ ID NO: 8111649 - DNA, 22 bp, Homo sapiens
tcgcccaggctggaagtgcagt

SEQ ID NO: 8111650 - DNA, 22 bp, Homo sapiens
tcgcagaggcacgagtgcagaa

SEQ ID NO: 8111651 - DNA, 22 bp, Homo sapiens
tctaaactgctagctgactgag

SEQ ID NO: 8111652 - DNA, 22 bp, Homo sapiens
tctaaacattggtatggagcag

SEQ ID NO: 8111653 - DNA, 22 bp, Homo sapiens
tctaaacattgtgatagacctt

SEQ ID NO: 8111654 - DNA, 22 bp, Homo sapiens
tctaaactagggttaaaggaaa

SEQ ID NO: 8111655 - DNA, 19 bp, Homo sapiens
tctaaactctatactggta

SEQ ID NO: 8111656 - DNA, 19 bp, Homo sapiens
tctaaactagtcccataac

SEQ ID NO: 8111657 - DNA, 22 bp, Homo sapiens
tctaaactctctttgaattatg

SEQ ID NO: 8111658 - DNA, 22 bp, Homo sapiens
tctaaagccttccatataacgc

SEQ ID NO: 8111659 - DNA, 22 bp, Homo sapiens
tctaaagctccttccactaaaa

SEQ ID NO: 8111660 - DNA, 22 bp, Homo sapiens
tctaaagatgtttattgacata

SEQ ID NO: 8111661 - DNA, 22 bp, Homo sapiens
tctaaacactaagtcttgatgc

SEQ ID NO: 8111662 - DNA, 22 bp, Homo sapiens
tctaaacagcctcttaccaact

SEQ ID NO: 8111663 - DNA, 22 bp, Homo sapiens
tctaaacacgtctctttgaata

SEQ ID NO: 8111664 - DNA, 20 bp, Homo sapiens
tctaaacagttggcatgggg

SEQ ID NO: 8111665 - DNA, 22 bp, Homo sapiens
tctaaacagtttcactcttaat

SEQ ID NO: 8111666 - DNA, 22 bp, Homo sapiens
tctaaacataactttgtgtgat

SEQ ID NO: 8111667 - DNA, 22 bp, Homo sapiens
tctaaacattatgatagtagag

SEQ ID NO: 8111668 - DNA, 19 bp, Homo sapiens
tctaaacacagggacaagc

SEQ ID NO: 8111669 - DNA, 22 bp, Homo sapiens
tccttttccctgaaggtattta

SEQ ID NO: 8111670 - DNA, 22 bp, Homo sapiens
tcctttgttaaggaggtttgtt

SEQ ID NO: 8111671 - DNA, 22 bp, Homo sapiens
tcctttgttgagataaattggg

SEQ ID NO: 8111672 - DNA, 23 bp, Homo sapiens
tcctttgtctttgcatagatggt

SEQ ID NO: 8111673 - DNA, 22 bp, Homo sapiens
tcctttgtggaaatacttgtgg

SEQ ID NO: 8111674 - DNA, 22 bp, Homo sapiens
tcctttgcttctgtcattctcc

SEQ ID NO: 8111675 - DNA, 22 bp, Homo sapiens
tccttggcctaaggagaagagg

SEQ ID NO: 8111676 - DNA, 22 bp, Homo sapiens
tccttaggcaatttgggagagt

SEQ ID NO: 8111677 - DNA, 22 bp, Homo sapiens
tccttcaagatgccacagcttt

SEQ ID NO: 8111678 - DNA, 22 bp, Homo sapiens
tccttcaactttttacttgccc

SEQ ID NO: 8111679 - DNA, 21 bp, Homo sapiens
tccttatatttgaatacttta

SEQ ID NO: 8111680 - DNA, 22 bp, Homo sapiens
tccttatatctatagttttgca

SEQ ID NO: 8111681 - DNA, 22 bp, Homo sapiens
tccttacatgcttccttataca

SEQ ID NO: 8111682 - DNA, 22 bp, Homo sapiens
tccttacagaaagcagtagaca

SEQ ID NO: 8111683 - DNA, 22 bp, Homo sapiens
tccttacagttaaaatgggagt

SEQ ID NO: 8111684 - DNA, 22 bp, Homo sapiens
tccttaataagtacttcattgt

SEQ ID NO: 8111685 - DNA, 22 bp, Homo sapiens
tccttaaatgtgatctagattt

SEQ ID NO: 8111686 - DNA, 22 bp, Homo sapiens
tccttacactggggaaggtgta

SEQ ID NO: 8111687 - DNA, 22 bp, Homo sapiens
tccttacaacttgttatttttc

SEQ ID NO: 8111688 - DNA, 22 bp, Homo sapiens
tccttaaatccttcagagatta

SEQ ID NO: 8111689 - DNA, 22 bp, Homo sapiens
tccttaaatgaactctgcatga

SEQ ID NO: 8111690 - DNA, 22 bp, Homo sapiens
tccttggagaatcttgttttac

SEQ ID NO: 8111691 - DNA, 22 bp, Homo sapiens
tccttggagtagttgttcttta

SEQ ID NO: 8111692 - DNA, 22 bp, Homo sapiens
tccttgagcctcccagactcag

SEQ ID NO: 8111693 - DNA, 22 bp, Homo sapiens
tccttgagattaattaatcacc

SEQ ID NO: 8111694 - DNA, 22 bp, Homo sapiens
tccttgagaggacagagccata

SEQ ID NO: 8111695 - DNA, 22 bp, Homo sapiens
tccttgagagccactgtcttgg

SEQ ID NO: 8111696 - DNA, 21 bp, Homo sapiens
tccttctctatgattgtctga

SEQ ID NO: 8111697 - DNA, 22 bp, Homo sapiens
tccttctgtagtccctgtccct

SEQ ID NO: 8111698 - DNA, 22 bp, Homo sapiens
tccttctgtagtccctgtccct

SEQ ID NO: 8111699 - DNA, 22 bp, Homo sapiens
tctcaagttatgtaacagctgt

SEQ ID NO: 8111700 - DNA, 22 bp, Homo sapiens
tctcacagggctaggccctgcc

SEQ ID NO: 8111701 - DNA, 22 bp, Homo sapiens
tctcaaactacactgtaaattg

SEQ ID NO: 8111702 - DNA, 22 bp, Homo sapiens
tctcaaactaacaatgattata

SEQ ID NO: 8111703 - DNA, 22 bp, Homo sapiens
tctattttgtttccagctctac

SEQ ID NO: 8111704 - DNA, 22 bp, Homo sapiens
tctattttgtttccagctctac

SEQ ID NO: 8111705 - DNA, 22 bp, Homo sapiens
tctattttcttgccaaaactgc

SEQ ID NO: 8111706 - DNA, 22 bp, Homo sapiens
tctattttatactcaaatcttc

SEQ ID NO: 8111707 - DNA, 22 bp, Homo sapiens
tctattttatactcaaatcttc

SEQ ID NO: 8111708 - DNA, 22 bp, Homo sapiens
tctattatggtacttatcatga

SEQ ID NO: 8111709 - DNA, 22 bp, Homo sapiens
tctagggggacagctggctgtg

SEQ ID NO: 8111710 - DNA, 22 bp, Homo sapiens
tctataaagggccagatagtag

SEQ ID NO: 8111711 - DNA, 22 bp, Homo sapiens
tctacataaaaattcagaaggc

SEQ ID NO: 8111712 - DNA, 22 bp, Homo sapiens
tctacagctctggagcttttgg

SEQ ID NO: 8111713 - DNA, 22 bp, Homo sapiens
tctacagctgctgcttctcatg

SEQ ID NO: 8111714 - DNA, 22 bp, Homo sapiens
tctacacaagtgagtggcacaa

SEQ ID NO: 8111715 - DNA, 22 bp, Homo sapiens
tctacagaaactggctactctc

SEQ ID NO: 8111716 - DNA, 22 bp, Homo sapiens
tctacaaataaattactatgta

SEQ ID NO: 8111717 - DNA, 22 bp, Homo sapiens
tctaaatggaaagaaaatacct

SEQ ID NO: 8111718 - DNA, 22 bp, Homo sapiens
tctacaaagaagaattaatgtc

SEQ ID NO: 8111719 - DNA, 22 bp, Homo sapiens
tctaattttaggcatttgttca

SEQ ID NO: 8111720 - DNA, 22 bp, Homo sapiens
tctacaaactaaggagggtaat

SEQ ID NO: 8111721 - DNA, 23 bp, Homo sapiens
tctacaaagctgtgtcaggaccc

SEQ ID NO: 8111722 - DNA, 22 bp, Homo sapiens
tctacaaagccattcaggatct

SEQ ID NO: 8111723 - DNA, 22 bp, Homo sapiens
tctacaaagccattcaggatct

SEQ ID NO: 8111724 - DNA, 22 bp, Homo sapiens
tctagaaaaacaaagtatctga

SEQ ID NO: 8111725 - DNA, 22 bp, Homo sapiens
tctagaaaaaaactgctgtgga

SEQ ID NO: 8111726 - DNA, 22 bp, Homo sapiens
tctagaaacaggtttctagaaa

SEQ ID NO: 8111727 - DNA, 22 bp, Homo sapiens
tctagaaaaccaatattacatg

SEQ ID NO: 8111728 - DNA, 22 bp, Homo sapiens
tctagattcctcctgcatcctg

SEQ ID NO: 8111729 - DNA, 22 bp, Homo sapiens
tctagcatttctttcctgagga

SEQ ID NO: 8111730 - DNA, 22 bp, Homo sapiens
tctctggagctgcagatccagg

SEQ ID NO: 8111731 - DNA, 19 bp, Homo sapiens
tctctgccgatcagggccc

SEQ ID NO: 8111732 - DNA, 22 bp, Homo sapiens
tctctggccccatggctgagct

SEQ ID NO: 8111733 - DNA, 22 bp, Homo sapiens
tctctggctgatattcctctgc

SEQ ID NO: 8111734 - DNA, 22 bp, Homo sapiens
tctctgagctcaggagctgcag

SEQ ID NO: 8111735 - DNA, 22 bp, Homo sapiens
tctctgaggacttggggttgcc

SEQ ID NO: 8111736 - DNA, 22 bp, Homo sapiens
tctctgagaagctgaggctggg

SEQ ID NO: 8111737 - DNA, 22 bp, Homo sapiens
tctctcactggtgcctctgttg

SEQ ID NO: 8111738 - DNA, 22 bp, Homo sapiens
tctcttctgaaacctgtcttta

SEQ ID NO: 8111739 - DNA, 19 bp, Homo sapiens
tctcttctccctggtttta

SEQ ID NO: 8111740 - DNA, 19 bp, Homo sapiens
tctcttctccctggtttta

SEQ ID NO: 8111741 - DNA, 22 bp, Homo sapiens
tctcttaattcagaggcagtta

SEQ ID NO: 8111742 - DNA, 22 bp, Homo sapiens
tctcttcatagtgacacccatc

SEQ ID NO: 8111743 - DNA, 22 bp, Homo sapiens
tctctgtggtgggaggctgagt

SEQ ID NO: 8111744 - DNA, 22 bp, Homo sapiens
tctctgtggtttgagagccggg

SEQ ID NO: 8111745 - DNA, 22 bp, Homo sapiens
tctctgtggcaagcatgctgct

SEQ ID NO: 8111746 - DNA, 21 bp, Homo sapiens
tctctgtggcctaccctctac

SEQ ID NO: 8111747 - DNA, 23 bp, Homo sapiens
tctctttcaagagcttaatgtgc

SEQ ID NO: 8111748 - DNA, 22 bp, Homo sapiens
tctgaaagctagaaaatgctct

SEQ ID NO: 8111749 - DNA, 22 bp, Homo sapiens
tctgaaagggctaaataatttg

SEQ ID NO: 8111750 - DNA, 20 bp, Homo sapiens
tctcacaggggcttttctct

SEQ ID NO: 8111751 - DNA, 22 bp, Homo sapiens
tctcactgatttgagaccaagg

SEQ ID NO: 8111752 - DNA, 22 bp, Homo sapiens
tctcactgggtcacagcagagg

SEQ ID NO: 8111753 - DNA, 23 bp, Homo sapiens
tctcagaggattcctgggccttg

SEQ ID NO: 8111754 - DNA, 22 bp, Homo sapiens
tctcagagcctaactaacctaa

SEQ ID NO: 8111755 - DNA, 19 bp, Homo sapiens
tctcagagccctagaggcc

SEQ ID NO: 8111756 - DNA, 22 bp, Homo sapiens
tctcagagagatgaaacttcca

SEQ ID NO: 8111757 - DNA, 22 bp, Homo sapiens
tctcagagaggggccgggcctt

SEQ ID NO: 8111758 - DNA, 22 bp, Homo sapiens
tctcagagatgttagggaagag

SEQ ID NO: 8111759 - DNA, 22 bp, Homo sapiens
tctcagagatgtcaagagtcta

SEQ ID NO: 8111760 - DNA, 22 bp, Homo sapiens
tctcagaggtcttcagcctctg

SEQ ID NO: 8111761 - DNA, 22 bp, Homo sapiens
tctcagagtaattctttaaggt

SEQ ID NO: 8111762 - DNA, 22 bp, Homo sapiens
tctcagagtttttttccaggac

SEQ ID NO: 8111763 - DNA, 22 bp, Homo sapiens
tctcagagtttagagctgagcc

SEQ ID NO: 8111764 - DNA, 22 bp, Homo sapiens
tctcagagtttacggggctgaa

SEQ ID NO: 8111765 - DNA, 22 bp, Homo sapiens
tctcaggtttcaagacaggaaa

SEQ ID NO: 8111766 - DNA, 22 bp, Homo sapiens
tctcagtgacactcttcataca

SEQ ID NO: 8111767 - DNA, 23 bp, Homo sapiens
tctcagtgaatctcagaattcgc

SEQ ID NO: 8111768 - DNA, 22 bp, Homo sapiens
tctcagtgagcttttctatgtt

SEQ ID NO: 8111769 - DNA, 22 bp, Homo sapiens
tctcagtgacactcttcataca

SEQ ID NO: 8111770 - DNA, 22 bp, Homo sapiens
tctcagtgatggcccatttgga

SEQ ID NO: 8111771 - DNA, 22 bp, Homo sapiens
tctcagtgcagagaggctatct

SEQ ID NO: 8111772 - DNA, 22 bp, Homo sapiens
tctcagtgctatccatattcca

SEQ ID NO: 8111773 - DNA, 22 bp, Homo sapiens
tctcagtggacgtgtctgtctt

SEQ ID NO: 8111774 - DNA, 22 bp, Homo sapiens
tctccaggactgagctccagcc

SEQ ID NO: 8111775 - DNA, 22 bp, Homo sapiens
tctccaggagaaatatgaagga

SEQ ID NO: 8111776 - DNA, 22 bp, Homo sapiens
tctcatgtgattcccgtgcatg

SEQ ID NO: 8111777 - DNA, 22 bp, Homo sapiens
tctcatggtttgtgattcaaat

SEQ ID NO: 8111778 - DNA, 22 bp, Homo sapiens
tctcattcatccaaggatttat

SEQ ID NO: 8111779 - DNA, 22 bp, Homo sapiens
tctcctgctcccaactgctgca

SEQ ID NO: 8111780 - DNA, 22 bp, Homo sapiens
tctcctgcttcaactgatggac

SEQ ID NO: 8111781 - DNA, 22 bp, Homo sapiens
tctcctgcttcaactgatggac

SEQ ID NO: 8111782 - DNA, 22 bp, Homo sapiens
tctcctgcagtcagcagtctca

SEQ ID NO: 8111783 - DNA, 22 bp, Homo sapiens
tctcctgctcagaacagcctca

SEQ ID NO: 8111784 - DNA, 22 bp, Homo sapiens
tctcctgccactgcttcccatt

SEQ ID NO: 8111785 - DNA, 22 bp, Homo sapiens
tctcctcccaggctcttccagg

SEQ ID NO: 8111786 - DNA, 22 bp, Homo sapiens
tctcgatctcctgaccttgtga

SEQ ID NO: 8111787 - DNA, 22 bp, Homo sapiens
tctcctttcttttaaaatgtca

SEQ ID NO: 8111788 - DNA, 22 bp, Homo sapiens
tctcgctctgtcgcccaggctg

SEQ ID NO: 8111789 - DNA, 22 bp, Homo sapiens
tctctagtctcctttaacctga

SEQ ID NO: 8111790 - DNA, 22 bp, Homo sapiens
tctccctcattcctgcttccat

SEQ ID NO: 8111791 - DNA, 22 bp, Homo sapiens
tctccctagggccgctggctaa

SEQ ID NO: 8111792 - DNA, 22 bp, Homo sapiens
tctgggagagctgctgtcagag

SEQ ID NO: 8111793 - DNA, 22 bp, Homo sapiens
tctgggagagcacgtggctgac

SEQ ID NO: 8111794 - DNA, 22 bp, Homo sapiens
tctgggagtgtgtctggccatc

SEQ ID NO: 8111795 - DNA, 22 bp, Homo sapiens
tctgggagtgggtccaaggaat

SEQ ID NO: 8111796 - DNA, 22 bp, Homo sapiens
tctgggaggtgttttgagaact

SEQ ID NO: 8111797 - DNA, 22 bp, Homo sapiens
tctgggaggggctgccattgct

SEQ ID NO: 8111798 - DNA, 22 bp, Homo sapiens
tctgggagggagcctcagaatc

SEQ ID NO: 8111799 - DNA, 22 bp, Homo sapiens
tctgggaggtactgggaggtgt

SEQ ID NO: 8111800 - DNA, 22 bp, Homo sapiens
tctgggaggtaaccatgctgat

SEQ ID NO: 8111801 - DNA, 22 bp, Homo sapiens
tctgggctgctatgaggcagag

SEQ ID NO: 8111802 - DNA, 23 bp, Homo sapiens
tctgggctgagacttggaaggtc

SEQ ID NO: 8111803 - DNA, 22 bp, Homo sapiens
tctgggccaacccttccatggg

SEQ ID NO: 8111804 - DNA, 22 bp, Homo sapiens
tctgggcactgctgagcctgta

SEQ ID NO: 8111805 - DNA, 23 bp, Homo sapiens
tctgggcaccttgttgacatgat

SEQ ID NO: 8111806 - DNA, 18 bp, Homo sapiens
tctgggcaatctcagtat

SEQ ID NO: 8111807 - DNA, 22 bp, Homo sapiens
tctgggagtttctgtgggagct

SEQ ID NO: 8111808 - DNA, 20 bp, Homo sapiens
tctgggcagggcacatggaa

SEQ ID NO: 8111809 - DNA, 21 bp, Homo sapiens
tctgggcagcccagtcctgag

SEQ ID NO: 8111810 - DNA, 22 bp, Homo sapiens
tctgggcagccatgtgcctggc

SEQ ID NO: 8111811 - DNA, 22 bp, Homo sapiens
tctgggcagaagcagtgcaaag

SEQ ID NO: 8111812 - DNA, 22 bp, Homo sapiens
tctgggcagagggtcttagtca

SEQ ID NO: 8111813 - DNA, 23 bp, Homo sapiens
tctggctgctcctttcaatgctc

SEQ ID NO: 8111814 - DNA, 22 bp, Homo sapiens
tctggctgctgcgtgagtgctt

SEQ ID NO: 8111815 - DNA, 22 bp, Homo sapiens
tctggctgattccctgggactg

SEQ ID NO: 8111816 - DNA, 22 bp, Homo sapiens
tctgctggttccgaattaggcc

SEQ ID NO: 8111817 - DNA, 22 bp, Homo sapiens
tctgctggtcaaggctgggtcc

SEQ ID NO: 8111818 - DNA, 22 bp, Homo sapiens
tctgctggtgatgacctcataa

SEQ ID NO: 8111819 - DNA, 23 bp, Homo sapiens
tctgctggtgacacggtcacatt

SEQ ID NO: 8111820 - DNA, 23 bp, Homo sapiens
tctgctggtgacacggtcacatt

SEQ ID NO: 8111821 - DNA, 22 bp, Homo sapiens
tctgctgctgcagctacactat

SEQ ID NO: 8111822 - DNA, 22 bp, Homo sapiens
tctgctggaaaaccagggaatt

SEQ ID NO: 8111823 - DNA, 19 bp, Homo sapiens
tctgctggcagaattccct

SEQ ID NO: 8111824 - DNA, 22 bp, Homo sapiens
tctgctggccttagcaggtcta

SEQ ID NO: 8111825 - DNA, 20 bp, Homo sapiens
tctgctggccaaaacttcac

SEQ ID NO: 8111826 - DNA, 22 bp, Homo sapiens
tctgctggtgatgacctcataa

SEQ ID NO: 8111827 - DNA, 22 bp, Homo sapiens
tctgctgcagagctgcgggtgc

SEQ ID NO: 8111828 - DNA, 22 bp, Homo sapiens
tctgctgcctcggtgtgggtac

SEQ ID NO: 8111829 - DNA, 22 bp, Homo sapiens
tctgctgctacagactctctag

SEQ ID NO: 8111830 - DNA, 22 bp, Homo sapiens
tctggaagttagaggaggaaag

SEQ ID NO: 8111831 - DNA, 22 bp, Homo sapiens
tctggaagtgatgttcatagtg

SEQ ID NO: 8111832 - DNA, 16 bp, Homo sapiens
tctggaagtggagggg

SEQ ID NO: 8111833 - DNA, 22 bp, Homo sapiens
tctggaagctggagtccaggaa

SEQ ID NO: 8111834 - DNA, 22 bp, Homo sapiens
tctggaagaggtgggttgggag

SEQ ID NO: 8111835 - DNA, 22 bp, Homo sapiens
tctggaaggggatctgtggtca

SEQ ID NO: 8111836 - DNA, 22 bp, Homo sapiens
tctggaaggaacccttagagga

SEQ ID NO: 8111837 - DNA, 22 bp, Homo sapiens
tctggaccaacatagcttctgg

SEQ ID NO: 8111838 - DNA, 22 bp, Homo sapiens
tctggagtgtttctaattactg

SEQ ID NO: 8111839 - DNA, 22 bp, Homo sapiens
tctggagtgtgtgtattcagct

SEQ ID NO: 8111840 - DNA, 22 bp, Homo sapiens
tctggaggctctgagggtgagt

SEQ ID NO: 8111841 - DNA, 22 bp, Homo sapiens
tctggagtccagatccatttgg

SEQ ID NO: 8111842 - DNA, 22 bp, Homo sapiens
tctggagtgaatgaagtagtgt

SEQ ID NO: 8111843 - DNA, 21 bp, Homo sapiens
tctggagtcatctttaccata

SEQ ID NO: 8111844 - DNA, 22 bp, Homo sapiens
tctggccactaataggtctcac

SEQ ID NO: 8111845 - DNA, 22 bp, Homo sapiens
tctggccagcatgagacctggt

SEQ ID NO: 8111846 - DNA, 22 bp, Homo sapiens
tctggcagttgccgcttcagtc

SEQ ID NO: 8111847 - DNA, 22 bp, Homo sapiens
tctggcagtggatgagggcagc

SEQ ID NO: 8111848 - DNA, 22 bp, Homo sapiens
tctggcagtgatttctgtgatc

SEQ ID NO: 8111849 - DNA, 22 bp, Homo sapiens
tctggccacccgaggcccctgc

SEQ ID NO: 8111850 - DNA, 22 bp, Homo sapiens
tctggcagagtcagtgcacaca

SEQ ID NO: 8111851 - DNA, 22 bp, Homo sapiens
tctggcagaagtgctgtcagta

SEQ ID NO: 8111852 - DNA, 22 bp, Homo sapiens
tctggcagagatatccatccca

SEQ ID NO: 8111853 - DNA, 22 bp, Homo sapiens
tctggcaggttcccatgttatg

SEQ ID NO: 8111854 - DNA, 22 bp, Homo sapiens
tctggcagtgaagtcatgaggt

SEQ ID NO: 8111855 - DNA, 22 bp, Homo sapiens
tctgagctgggcacagaaggcg

SEQ ID NO: 8111856 - DNA, 22 bp, Homo sapiens
tctgagagatacaaggaggcaa

SEQ ID NO: 8111857 - DNA, 22 bp, Homo sapiens
tctgagagagggtcagatgcta

SEQ ID NO: 8111858 - DNA, 20 bp, Homo sapiens
tctgcaaacaagttttagac

SEQ ID NO: 8111859 - DNA, 22 bp, Homo sapiens
tctgcaaactggctcttactgc

SEQ ID NO: 8111860 - DNA, 22 bp, Homo sapiens
tctgcaaatattagcttagaca

SEQ ID NO: 8111861 - DNA, 21 bp, Homo sapiens
tctgatggtagatgagatgtg

SEQ ID NO: 8111862 - DNA, 22 bp, Homo sapiens
tctgccctcattgctgcctgga

SEQ ID NO: 8111863 - DNA, 19 bp, Homo sapiens
tctgccgagctagaccact

SEQ ID NO: 8111864 - DNA, 22 bp, Homo sapiens
tctgccctggggtcagcctcca

SEQ ID NO: 8111865 - DNA, 22 bp, Homo sapiens
tctgccctgccattcactggaa

SEQ ID NO: 8111866 - DNA, 22 bp, Homo sapiens
tctgcctgccagtctggtcctc

SEQ ID NO: 8111867 - DNA, 22 bp, Homo sapiens
tctgcctgcagtgtggcagggc

SEQ ID NO: 8111868 - DNA, 22 bp, Homo sapiens
tctgcctgtggatacatgctct

SEQ ID NO: 8111869 - DNA, 22 bp, Homo sapiens
tctgcctgttcaagtcttctag

SEQ ID NO: 8111870 - DNA, 22 bp, Homo sapiens
tctgcctgttgagcctaaggcc

SEQ ID NO: 8111871 - DNA, 22 bp, Homo sapiens
tctgcctgctaactcctgcacc

SEQ ID NO: 8111872 - DNA, 22 bp, Homo sapiens
tctgcctggatgatggcagggc

SEQ ID NO: 8111873 - DNA, 22 bp, Homo sapiens
tctgcctggattccattctcca

SEQ ID NO: 8111874 - DNA, 22 bp, Homo sapiens
tctgcctggcggactcccggaa

SEQ ID NO: 8111875 - DNA, 22 bp, Homo sapiens
tctgccagttagaaactggtta

SEQ ID NO: 8111876 - DNA, 22 bp, Homo sapiens
tctgccatgcacccggacagct

SEQ ID NO: 8111877 - DNA, 22 bp, Homo sapiens
tctgccatgctaacttcagtat

SEQ ID NO: 8111878 - DNA, 22 bp, Homo sapiens
tctgccacactggttcagtgga

SEQ ID NO: 8111879 - DNA, 22 bp, Homo sapiens
tctgccaggtggggagaggcca

SEQ ID NO: 8111880 - DNA, 22 bp, Homo sapiens
tctgccaggccacacagggcac

SEQ ID NO: 8111881 - DNA, 22 bp, Homo sapiens
tctgccagtggtttggccctga

SEQ ID NO: 8111882 - DNA, 22 bp, Homo sapiens
tctgccagtgagcggggaatta

SEQ ID NO: 8111883 - DNA, 22 bp, Homo sapiens
tctgcatctgtgttgagtgccc

SEQ ID NO: 8111884 - DNA, 22 bp, Homo sapiens
tctgcatcttctgcacatgcca

SEQ ID NO: 8111885 - DNA, 22 bp, Homo sapiens
tctgcatcatgatgtttgcaag

SEQ ID NO: 8111886 - DNA, 22 bp, Homo sapiens
tctgcagggcccttggctcctg

SEQ ID NO: 8111887 - DNA, 22 bp, Homo sapiens
tctgcaggaagctggcggctga

SEQ ID NO: 8111888 - DNA, 22 bp, Homo sapiens
tctttagaaacttttcttcatg

SEQ ID NO: 8111889 - DNA, 22 bp, Homo sapiens
tctttacagtcctctgtcaatc

SEQ ID NO: 8111890 - DNA, 22 bp, Homo sapiens
tctttacacaagacaagaataa

SEQ ID NO: 8111891 - DNA, 23 bp, Homo sapiens
tctttacatactgatgagttctc

SEQ ID NO: 8111892 - DNA, 22 bp, Homo sapiens
tctttacatagtgtggactact

SEQ ID NO: 8111893 - DNA, 22 bp, Homo sapiens
tctttacaagtcacattttctg

SEQ ID NO: 8111894 - DNA, 22 bp, Homo sapiens
tctttacaatctaagcatagtt

SEQ ID NO: 8111895 - DNA, 22 bp, Homo sapiens
tcttggccaggtgtggtgcctc

SEQ ID NO: 8111896 - DNA, 22 bp, Homo sapiens
tcttggaatctccatagagtga

SEQ ID NO: 8111897 - DNA, 20 bp, Homo sapiens
tcttggagagggtggactta

SEQ ID NO: 8111898 - DNA, 22 bp, Homo sapiens
tcttgattaataccttagccct

SEQ ID NO: 8111899 - DNA, 22 bp, Homo sapiens
tcttgattgttttctgacctta

SEQ ID NO: 8111900 - DNA, 22 bp, Homo sapiens
tcttgattcatgttccctgcat

SEQ ID NO: 8111901 - DNA, 21 bp, Homo sapiens
tcttgattattggcctcacac

SEQ ID NO: 8111902 - DNA, 22 bp, Homo sapiens
tcttgacattgttgttagcagg

SEQ ID NO: 8111903 - DNA, 22 bp, Homo sapiens
tcttgaagtcacacagaaagtg

SEQ ID NO: 8111904 - DNA, 22 bp, Homo sapiens
tctttcaatgagcattctttcc

SEQ ID NO: 8111905 - DNA, 22 bp, Homo sapiens
tctttcaatgagcattctttcc

SEQ ID NO: 8111906 - DNA, 22 bp, Homo sapiens
tctttccacattctctgtttag

SEQ ID NO: 8111907 - DNA, 22 bp, Homo sapiens
tctttccacattctctgtttag

SEQ ID NO: 8111908 - DNA, 22 bp, Homo sapiens
tctttccagaggaatttttaga

SEQ ID NO: 8111909 - DNA, 22 bp, Homo sapiens
tctttcttaaataggtggattg

SEQ ID NO: 8111910 - DNA, 22 bp, Homo sapiens
tctttcttattagccattgttc

SEQ ID NO: 8111911 - DNA, 22 bp, Homo sapiens
tctttgatgcttctgaaggtgt

SEQ ID NO: 8111912 - DNA, 22 bp, Homo sapiens
tctttgatggagagatagatat

SEQ ID NO: 8111913 - DNA, 22 bp, Homo sapiens
tctttgatacagatgtaagctg

SEQ ID NO: 8111914 - DNA, 21 bp, Homo sapiens
tctttgattaagcttgactag

SEQ ID NO: 8111915 - DNA, 22 bp, Homo sapiens
tctttgatgggagatctgagag

SEQ ID NO: 8111916 - DNA, 22 bp, Homo sapiens
tcttctttatgtcatatgccag

SEQ ID NO: 8111917 - DNA, 22 bp, Homo sapiens
tcttcttatgtgccattatctc

SEQ ID NO: 8111918 - DNA, 22 bp, Homo sapiens
tcttgaaagcattttcttcatc

SEQ ID NO: 8111919 - DNA, 21 bp, Homo sapiens
tcttccaagggctgctgagac

SEQ ID NO: 8111920 - DNA, 22 bp, Homo sapiens
tcttccacttgcaagtttatgg

SEQ ID NO: 8111921 - DNA, 22 bp, Homo sapiens
tcttcattttatagcatctgtg

SEQ ID NO: 8111922 - DNA, 23 bp, Homo sapiens
tcttcatgcccaggccttggtgc

SEQ ID NO: 8111923 - DNA, 23 bp, Homo sapiens
tcttcatggccatctggttcttc

SEQ ID NO: 8111924 - DNA, 22 bp, Homo sapiens
tcttcatggtctggttctccag

SEQ ID NO: 8111925 - DNA, 22 bp, Homo sapiens
tcttcatgcacctcacagctag

SEQ ID NO: 8111926 - DNA, 22 bp, Homo sapiens
tcttcatgccaaatgagttttg

SEQ ID NO: 8111927 - DNA, 22 bp, Homo sapiens
tcttcatgttgcttattctggg

SEQ ID NO: 8111928 - DNA, 22 bp, Homo sapiens
tcttcatgttgcttattctggg

SEQ ID NO: 8111929 - DNA, 22 bp, Homo sapiens
tcttcatgttgctgtagggaga

SEQ ID NO: 8111930 - DNA, 22 bp, Homo sapiens
tcttcatgttagttgggttttc

SEQ ID NO: 8111931 - DNA, 22 bp, Homo sapiens
tcttcatgtcttgcctgatata

SEQ ID NO: 8111932 - DNA, 22 bp, Homo sapiens
tcttcatgtctctgcttgagtc

SEQ ID NO: 8111933 - DNA, 22 bp, Homo sapiens
tcttcatgtcatggtatattga

SEQ ID NO: 8111934 - DNA, 22 bp, Homo sapiens
tcttcatgtatttgacaaccat

SEQ ID NO: 8111935 - DNA, 22 bp, Homo sapiens
tcttcatgtatactcatggtac

SEQ ID NO: 8111936 - DNA, 22 bp, Homo sapiens
tcttcatgaatgaatctttgac

SEQ ID NO: 8111937 - DNA, 22 bp, Homo sapiens
tcttcatgataccctaagccac

SEQ ID NO: 8111938 - DNA, 22 bp, Homo sapiens
tcttcatgacctctgtgtttta

SEQ ID NO: 8111939 - DNA, 22 bp, Homo sapiens
tcttcatgaaattgattgctta

SEQ ID NO: 8111940 - DNA, 22 bp, Homo sapiens
tcttcatacaatttcagacatc

SEQ ID NO: 8111941 - DNA, 22 bp, Homo sapiens
tcttcaagaatatattgctgtc

SEQ ID NO: 8111942 - DNA, 22 bp, Homo sapiens
tcttcaaatgctagtaatatca

SEQ ID NO: 8111943 - DNA, 22 bp, Homo sapiens
tcttcaaatacagtcatattga

SEQ ID NO: 8111944 - DNA, 22 bp, Homo sapiens
tcttcaatgcattctcttgttt

SEQ ID NO: 8111945 - DNA, 22 bp, Homo sapiens
tcttcaatatgtgtttaatatt

SEQ ID NO: 8111946 - DNA, 22 bp, Homo sapiens
tcttcaagttccaaagtgcagg

SEQ ID NO: 8111947 - DNA, 22 bp, Homo sapiens
tcttcacacacagtcctctttc

SEQ ID NO: 8111948 - DNA, 22 bp, Homo sapiens
tcttcacatgaccttcatgtct

SEQ ID NO: 8111949 - DNA, 22 bp, Homo sapiens
tcttcacaggagcctgcctgcc

SEQ ID NO: 8111950 - DNA, 22 bp, Homo sapiens
tcttcacagatgcatatacttc

SEQ ID NO: 8111951 - DNA, 22 bp, Homo sapiens
tcttattttttaatgacagaga

SEQ ID NO: 8111952 - DNA, 22 bp, Homo sapiens
tcttcaaactgaaaatttagaa

SEQ ID NO: 8111953 - DNA, 22 bp, Homo sapiens
tcttatgggaaagatgtaatta

SEQ ID NO: 8111954 - DNA, 22 bp, Homo sapiens
tctgtctgcgcttgccctggtg

SEQ ID NO: 8111955 - DNA, 22 bp, Homo sapiens
tctgtgccatgcccgtctacca

SEQ ID NO: 8111956 - DNA, 22 bp, Homo sapiens
tctgtgccagcagcctcctgga

SEQ ID NO: 8111957 - DNA, 22 bp, Homo sapiens
tctgtgccacctctccagtgtc

SEQ ID NO: 8111958 - DNA, 23 bp, Homo sapiens
tctgtgccagtttccatgtctgt

SEQ ID NO: 8111959 - DNA, 22 bp, Homo sapiens
tctgtgcagtcagggctcagtc

SEQ ID NO: 8111960 - DNA, 22 bp, Homo sapiens
tctgtgcagacatggggaagcc

SEQ ID NO: 8111961 - DNA, 22 bp, Homo sapiens
tctgtgtaagaccagtgctggg

SEQ ID NO: 8111962 - DNA, 22 bp, Homo sapiens
tctgtgtctgcagaagttcagc

SEQ ID NO: 8111963 - DNA, 22 bp, Homo sapiens
tctgttttggtcacctttatat

SEQ ID NO: 8111964 - DNA, 22 bp, Homo sapiens
tctgtttattcaatttctatat

SEQ ID NO: 8111965 - DNA, 22 bp, Homo sapiens
tctgttttctctgtattttgac

SEQ ID NO: 8111966 - DNA, 22 bp, Homo sapiens
tcttagcacagctatataagtt

SEQ ID NO: 8111967 - DNA, 22 bp, Homo sapiens
tcttatgaaaagcacttagaac

SEQ ID NO: 8111968 - DNA, 22 bp, Homo sapiens
tcttaaatgactgataagagga

SEQ ID NO: 8111969 - DNA, 22 bp, Homo sapiens
tcttaagcagagaagaagttga

SEQ ID NO: 8111970 - DNA, 22 bp, Homo sapiens
tctgttgcaatgtgcatggtga

SEQ ID NO: 8111971 - DNA, 22 bp, Homo sapiens
tctgtttatgtgtctaaataaa

SEQ ID NO: 8111972 - DNA, 22 bp, Homo sapiens
tctgttgactcctagcagccat

SEQ ID NO: 8111973 - DNA, 22 bp, Homo sapiens
tctgtgttttactccaattata

SEQ ID NO: 8111974 - DNA, 20 bp, Homo sapiens
tctgtgtttcagctgcttga

SEQ ID NO: 8111975 - DNA, 18 bp, Homo sapiens
tctgtgttctgtcattgc

SEQ ID NO: 8111976 - DNA, 22 bp, Homo sapiens
tctgtccattcagccatccatc

SEQ ID NO: 8111977 - DNA, 22 bp, Homo sapiens
tctgtccagtggctctcaggga

SEQ ID NO: 8111978 - DNA, 22 bp, Homo sapiens
tctgtccagaacgtacatcttg

SEQ ID NO: 8111979 - DNA, 22 bp, Homo sapiens
tctgtccacaagcacaggctct

SEQ ID NO: 8111980 - DNA, 22 bp, Homo sapiens
tctgtcattgcaataaaatttc

SEQ ID NO: 8111981 - DNA, 22 bp, Homo sapiens
tctgtcatgtttccattacatg

SEQ ID NO: 8111982 - DNA, 22 bp, Homo sapiens
tctgtctctttgttctgtgagt

SEQ ID NO: 8111983 - DNA, 18 bp, Homo sapiens
tctgtccttccattcttc

SEQ ID NO: 8111984 - DNA, 22 bp, Homo sapiens
tctgtaaagactccaaaagcca

SEQ ID NO: 8111985 - DNA, 20 bp, Homo sapiens
tctgtaaagactccagaagc

SEQ ID NO: 8111986 - DNA, 22 bp, Homo sapiens
tctgtaaagtctgtgtaaagtc

SEQ ID NO: 8111987 - DNA, 22 bp, Homo sapiens
tctgtacctcacatgcaccatc

SEQ ID NO: 8111988 - DNA, 22 bp, Homo sapiens
tctgtcaacatgtcaaagggct

SEQ ID NO: 8111989 - DNA, 22 bp, Homo sapiens
tctgtcaaatgagcaagtaact

SEQ ID NO: 8111990 - DNA, 22 bp, Homo sapiens
tctgtcaaatgggcataaggat

SEQ ID NO: 8111991 - DNA, 22 bp, Homo sapiens
tctgtattttaagatgctgttt

SEQ ID NO: 8111992 - DNA, 22 bp, Homo sapiens
tctgtcaattattcacataggc

SEQ ID NO: 8111993 - DNA, 22 bp, Homo sapiens
tctgtatatattaatgaaattc

SEQ ID NO: 8111994 - DNA, 22 bp, Homo sapiens
tctggggcagttactggggcct

SEQ ID NO: 8111995 - DNA, 22 bp, Homo sapiens
tctgggcttggttagggctgtt

SEQ ID NO: 8111996 - DNA, 21 bp, Homo sapiens
tctgggctttcttataaggca

SEQ ID NO: 8111997 - DNA, 22 bp, Homo sapiens
tctgggctgtgggaattcaaca

SEQ ID NO: 8111998 - DNA, 22 bp, Homo sapiens
tctgggctgtctacaggttggc

SEQ ID NO: 8111999 - DNA, 22 bp, Homo sapiens
tctgggctggtgctcatgaatt

SEQ ID NO: 8112000 - DNA, 22 bp, Homo sapiens
tctgtaaacaccatgttagagt

SEQ ID NO: 8112001 - DNA, 22 bp, Homo sapiens
tctgtaaaacaatattgtattc

SEQ ID NO: 8112002 - DNA, 22 bp, Homo sapiens
aagctcagtgatgcctccaggg

SEQ ID NO: 8112003 - DNA, 22 bp, Homo sapiens
aagctcaggctggacctggctt

SEQ ID NO: 8112004 - DNA, 22 bp, Homo sapiens
aagctcagcatgtctcctagaa

SEQ ID NO: 8112005 - DNA, 22 bp, Homo sapiens
aagctctggggtacacatctgc

SEQ ID NO: 8112006 - DNA, 22 bp, Homo sapiens
aagctgcctgccacgctagata

SEQ ID NO: 8112007 - DNA, 22 bp, Homo sapiens
aagctggaacatcttgaggaag

SEQ ID NO: 8112008 - DNA, 23 bp, Homo sapiens
aagctgccttcgcagttggtctg

SEQ ID NO: 8112009 - DNA, 22 bp, Homo sapiens
aagctgccttccatgtgaggaa

SEQ ID NO: 8112010 - DNA, 22 bp, Homo sapiens
aagctaagattacagatttggg

SEQ ID NO: 8112011 - DNA, 22 bp, Homo sapiens
aagccctggctcagctcaccag

SEQ ID NO: 8112012 - DNA, 22 bp, Homo sapiens
aagccctgggatgttcagcagt

SEQ ID NO: 8112013 - DNA, 22 bp, Homo sapiens
acatagaacctggcacatagta

SEQ ID NO: 8112014 - DNA, 22 bp, Homo sapiens
acatatgcgatcataggatgca

SEQ ID NO: 8112015 - DNA, 22 bp, Homo sapiens
aaggacaggctaacctgacatt

SEQ ID NO: 8112016 - DNA, 22 bp, Homo sapiens
aaggacaggcacagtggtggag

SEQ ID NO: 8112017 - DNA, 22 bp, Homo sapiens
accaggcttgataccaagaaat

SEQ ID NO: 8112018 - DNA, 19 bp, Homo sapiens
accaggcttatggtcagtg

SEQ ID NO: 8112019 - DNA, 22 bp, Homo sapiens
accaggcttaatcctttgctat

SEQ ID NO: 8112020 - DNA, 22 bp, Homo sapiens
accaggctgttgggcccagtgt

SEQ ID NO: 8112021 - DNA, 21 bp, Homo sapiens
acattttctgttttaggaagt

SEQ ID NO: 8112022 - DNA, 22 bp, Homo sapiens
aaggggaaaaagtgttaggagt

SEQ ID NO: 8112023 - DNA, 21 bp, Homo sapiens
accaggcttgtgggagggagc

SEQ ID NO: 8112024 - DNA, 22 bp, Homo sapiens
accaggcttgatgatttgctta

SEQ ID NO: 8112025 - DNA, 22 bp, Homo sapiens
accaggcttgatgatttgctta

SEQ ID NO: 8112026 - DNA, 21 bp, Homo sapiens
accaggcttgtgggagggagc

SEQ ID NO: 8112027 - DNA, 22 bp, Homo sapiens
aagggctgtaagccaagtaaag

SEQ ID NO: 8112028 - DNA, 22 bp, Homo sapiens
accgggaagtcctgcactgggc

SEQ ID NO: 8112029 - DNA, 22 bp, Homo sapiens
acccaggaggtgacacagggct

SEQ ID NO: 8112030 - DNA, 22 bp, Homo sapiens
acccaggaggtggaggctgcag

SEQ ID NO: 8112031 - DNA, 22 bp, Homo sapiens
acccaggagctctggggtcctc

SEQ ID NO: 8112032 - DNA, 22 bp, Homo sapiens
acccaggagccgtgagaggtta

SEQ ID NO: 8112033 - DNA, 22 bp, Homo sapiens
acccaggaggcaaggttgcagt

SEQ ID NO: 8112034 - DNA, 22 bp, Homo sapiens
acccaggaggcagaggttgcag

SEQ ID NO: 8112035 - DNA, 22 bp, Homo sapiens
acattgttcctgagaacttggg

SEQ ID NO: 8112036 - DNA, 22 bp, Homo sapiens
aaggctatattcattattctct

SEQ ID NO: 8112037 - DNA, 22 bp, Homo sapiens
acatttctggagtttctcaaca

SEQ ID NO: 8112038 - DNA, 22 bp, Homo sapiens
acatttcttccctttagcagaa

SEQ ID NO: 8112039 - DNA, 22 bp, Homo sapiens
actgttctgcatgctgtgaggg

SEQ ID NO: 8112040 - DNA, 22 bp, Homo sapiens
actttaaaactgatcatcagag

SEQ ID NO: 8112041 - DNA, 22 bp, Homo sapiens
actttcttcttatgcattaagg

SEQ ID NO: 8112042 - DNA, 22 bp, Homo sapiens
aatactatgtagccaaaataat

SEQ ID NO: 8112043 - DNA, 22 bp, Homo sapiens
aatactatgttgtgacacatga

SEQ ID NO: 8112044 - DNA, 22 bp, Homo sapiens
aatactatgttgtgacacatga

SEQ ID NO: 8112045 - DNA, 22 bp, Homo sapiens
agaaatagcagagtcaggcggg

SEQ ID NO: 8112046 - DNA, 22 bp, Homo sapiens
agaaatgacaagactgatcagg

SEQ ID NO: 8112047 - DNA, 22 bp, Homo sapiens
aatgagttctggttcattttat

SEQ ID NO: 8112048 - DNA, 22 bp, Homo sapiens
aatgatgagaactggagtaatt

SEQ ID NO: 8112049 - DNA, 22 bp, Homo sapiens
aatgagtttgttctattatttg

SEQ ID NO: 8112050 - DNA, 22 bp, Homo sapiens
aatgatggttaaacactggagg

SEQ ID NO: 8112051 - DNA, 22 bp, Homo sapiens
aatgatgggaaggagaaaagca

SEQ ID NO: 8112052 - DNA, 22 bp, Homo sapiens
aatgatttcccctacacagaag

SEQ ID NO: 8112053 - DNA, 22 bp, Homo sapiens
aatgatttggcaaaggaatcca

SEQ ID NO: 8112054 - DNA, 22 bp, Homo sapiens
actggaggattcctggaaggcg

SEQ ID NO: 8112055 - DNA, 19 bp, Homo sapiens
actggagcctgatggagga

SEQ ID NO: 8112056 - DNA, 22 bp, Homo sapiens
actggagctgagagcatgggta

SEQ ID NO: 8112057 - DNA, 22 bp, Homo sapiens
actggaggggaaaatggtagta

SEQ ID NO: 8112058 - DNA, 22 bp, Homo sapiens
actggaggcccctcccagtgaa

SEQ ID NO: 8112059 - DNA, 22 bp, Homo sapiens
aatacgtggttactctatagag

SEQ ID NO: 8112060 - DNA, 22 bp, Homo sapiens
aatacatgttttctactattct

SEQ ID NO: 8112061 - DNA, 22 bp, Homo sapiens
actctcccttatctaactttac

SEQ ID NO: 8112062 - DNA, 22 bp, Homo sapiens
actagtttgagtaattgtaatg

SEQ ID NO: 8112063 - DNA, 22 bp, Homo sapiens
actagtttgaaaatatctgatt

SEQ ID NO: 8112064 - DNA, 22 bp, Homo sapiens
actcactcttaatcagactccc

SEQ ID NO: 8112065 - DNA, 22 bp, Homo sapiens
actctcacagtctttgacttgg

SEQ ID NO: 8112066 - DNA, 22 bp, Homo sapiens
actctcactgcttggctcctgc

SEQ ID NO: 8112067 - DNA, 22 bp, Homo sapiens
actctcactagctctgtgacct

SEQ ID NO: 8112068 - DNA, 22 bp, Homo sapiens
actctccagggatttaggatgg

SEQ ID NO: 8112069 - DNA, 22 bp, Homo sapiens
actctccacccactcactctgt

SEQ ID NO: 8112070 - DNA, 22 bp, Homo sapiens
actctccacccactcactctgt

SEQ ID NO: 8112071 - DNA, 22 bp, Homo sapiens
actctcccacgttcgactctaa

SEQ ID NO: 8112072 - DNA, 22 bp, Homo sapiens
actctcccagctatatgtggtg

SEQ ID NO: 8112073 - DNA, 22 bp, Homo sapiens
actctccctgagagggaggcat

SEQ ID NO: 8112074 - DNA, 22 bp, Homo sapiens
actctccctgctatccacttcc

SEQ ID NO: 8112075 - DNA, 22 bp, Homo sapiens
actcagagaatatctagaagga

SEQ ID NO: 8112076 - DNA, 20 bp, Homo sapiens
acgtggccaccagtggctta

SEQ ID NO: 8112077 - DNA, 20 bp, Homo sapiens
acgtggccaccagtggctta

SEQ ID NO: 8112078 - DNA, 22 bp, Homo sapiens
acgtggagagaatagggcacca

SEQ ID NO: 8112079 - DNA, 22 bp, Homo sapiens
acgtagaaaccaaatagcatca

SEQ ID NO: 8112080 - DNA, 22 bp, Homo sapiens
acctagaatttaaaacattgct

SEQ ID NO: 8112081 - DNA, 22 bp, Homo sapiens
agaccccatacctcagcaggta

SEQ ID NO: 8112082 - DNA, 22 bp, Homo sapiens
agaccctggtaaacactccagg

SEQ ID NO: 8112083 - DNA, 22 bp, Homo sapiens
agaccctgttagttccagtctt

SEQ ID NO: 8112084 - DNA, 22 bp, Homo sapiens
aattaaaggtcatgttaaaggg

SEQ ID NO: 8112085 - DNA, 22 bp, Homo sapiens
aattaaaagataacccatgagt

SEQ ID NO: 8112086 - DNA, 22 bp, Homo sapiens
agagacagatctgagggacctc

SEQ ID NO: 8112087 - DNA, 22 bp, Homo sapiens
agagacagaggcaatatagctt

SEQ ID NO: 8112088 - DNA, 22 bp, Homo sapiens
aattaacagagggcttattact

SEQ ID NO: 8112089 - DNA, 18 bp, Homo sapiens
agagacagcagcaaaaga

SEQ ID NO: 8112090 - DNA, 22 bp, Homo sapiens
agagacaggaatggcattaaga

SEQ ID NO: 8112091 - DNA, 22 bp, Homo sapiens
agagacaggagttctgtttcca

SEQ ID NO: 8112092 - DNA, 22 bp, Homo sapiens
agagacaggatatctgctcatg

SEQ ID NO: 8112093 - DNA, 22 bp, Homo sapiens
agagccagttacaactgtggag

SEQ ID NO: 8112094 - DNA, 22 bp, Homo sapiens
aattccaggcagaaatgtgagt

SEQ ID NO: 8112095 - DNA, 22 bp, Homo sapiens
aattccatccatttgtttcaac

SEQ ID NO: 8112096 - DNA, 22 bp, Homo sapiens
aatggtttgtacctgtccttgg

SEQ ID NO: 8112097 - DNA, 22 bp, Homo sapiens
aatgtgagccaatgcccgtggg

SEQ ID NO: 8112098 - DNA, 22 bp, Homo sapiens
aatgtgctggtaactgctttgc

SEQ ID NO: 8112099 - DNA, 20 bp, Homo sapiens
agacaatgagtgacagagtt

SEQ ID NO: 8112100 - DNA, 22 bp, Homo sapiens
agacaatggagagcagagtact

SEQ ID NO: 8112101 - DNA, 22 bp, Homo sapiens
agaagcagctttcaaggtgatt

SEQ ID NO: 8112102 - DNA, 22 bp, Homo sapiens
agacaaaccttgttttatgatg

SEQ ID NO: 8112103 - DNA, 22 bp, Homo sapiens
agaagcagaaggaagcagggcc

SEQ ID NO: 8112104 - DNA, 22 bp, Homo sapiens
agacaatttcaaagtaatatta

SEQ ID NO: 8112105 - DNA, 22 bp, Homo sapiens
agacaattaaaaaattatgctt

SEQ ID NO: 8112106 - DNA, 22 bp, Homo sapiens
aatggagacttcaaaatggatt

SEQ ID NO: 8112107 - DNA, 22 bp, Homo sapiens
acaatgaagataatgttgcagt

SEQ ID NO: 8112108 - DNA, 22 bp, Homo sapiens
acaatgaagggagacacttgct

SEQ ID NO: 8112109 - DNA, 22 bp, Homo sapiens
acaatgcaataggagctagaaa

SEQ ID NO: 8112110 - DNA, 22 bp, Homo sapiens
acaatgattttttagagtagtt

SEQ ID NO: 8112111 - DNA, 22 bp, Homo sapiens
acaatgaaccaaatttaccaat

SEQ ID NO: 8112112 - DNA, 22 bp, Homo sapiens
agaggggttaagtgctagtccg

SEQ ID NO: 8112113 - DNA, 22 bp, Homo sapiens
acaacacatgtgtatatgtgtg

SEQ ID NO: 8112114 - DNA, 22 bp, Homo sapiens
acaagagattatctacagatga

SEQ ID NO: 8112115 - DNA, 22 bp, Homo sapiens
agataatgaatttattgaatgt

SEQ ID NO: 8112116 - DNA, 22 bp, Homo sapiens
agagggggaaaatagaggtgtt

SEQ ID NO: 8112117 - DNA, 22 bp, Homo sapiens
agagggggaaaatagaggtgtt

SEQ ID NO: 8112118 - DNA, 22 bp, Homo sapiens
agagggggtgttccagaagcat

SEQ ID NO: 8112119 - DNA, 22 bp, Homo sapiens
agagggggcagcggaccagtga

SEQ ID NO: 8112120 - DNA, 22 bp, Homo sapiens
acaaaggtgagcagaagacaca

SEQ ID NO: 8112121 - DNA, 18 bp, Homo sapiens
acaaaggtctgcaagacc

SEQ ID NO: 8112122 - DNA, 22 bp, Homo sapiens
agaggggctcatatcctgtcat

SEQ ID NO: 8112123 - DNA, 18 bp, Homo sapiens
acaaaggatcatgaggga

SEQ ID NO: 8112124 - DNA, 22 bp, Homo sapiens
aattcttaatcccataaagtga

SEQ ID NO: 8112125 - DNA, 22 bp, Homo sapiens
aattgatggacagagatgaaga

SEQ ID NO: 8112126 - DNA, 19 bp, Homo sapiens
acagcacagaaatatttca

SEQ ID NO: 8112127 - DNA, 22 bp, Homo sapiens
acagcacaggagttgaatgggc

SEQ ID NO: 8112128 - DNA, 22 bp, Homo sapiens
acagatggaggttattatgaac

SEQ ID NO: 8112129 - DNA, 22 bp, Homo sapiens
acagatggagctactaggtaaa

SEQ ID NO: 8112130 - DNA, 22 bp, Homo sapiens
acagatggccatattactatat

SEQ ID NO: 8112131 - DNA, 21 bp, Homo sapiens
acagatgggatgagcacactg

SEQ ID NO: 8112132 - DNA, 22 bp, Homo sapiens
acagatggcactttttaggact

SEQ ID NO: 8112133 - DNA, 20 bp, Homo sapiens
acagatggcagttattacat

SEQ ID NO: 8112134 - DNA, 22 bp, Homo sapiens
acagatggtgagccgctgatgt

SEQ ID NO: 8112135 - DNA, 22 bp, Homo sapiens
acagatggggcacaaagccaca

SEQ ID NO: 8112136 - DNA, 22 bp, Homo sapiens
acagagctaatgttgcataggc

SEQ ID NO: 8112137 - DNA, 22 bp, Homo sapiens
acagagcctccaggagtgctgg

SEQ ID NO: 8112138 - DNA, 22 bp, Homo sapiens
acagatgatgtgcacagataga

SEQ ID NO: 8112139 - DNA, 22 bp, Homo sapiens
acagatgatttttatgaaaaca

SEQ ID NO: 8112140 - DNA, 22 bp, Homo sapiens
acagatatttggggaaagacgt

SEQ ID NO: 8112141 - DNA, 22 bp, Homo sapiens
agcctctgactgtcagcaaggt

SEQ ID NO: 8112142 - DNA, 22 bp, Homo sapiens
acagagccactttggtgcctac

SEQ ID NO: 8112143 - DNA, 22 bp, Homo sapiens
agcctctcactgtcaccctccc

SEQ ID NO: 8112144 - DNA, 22 bp, Homo sapiens
agcctcctgtagccctcaccca

SEQ ID NO: 8112145 - DNA, 22 bp, Homo sapiens
agcctcctgtagccctcaccca

SEQ ID NO: 8112146 - DNA, 22 bp, Homo sapiens
agccctgttctgttttagtagc

SEQ ID NO: 8112147 - DNA, 22 bp, Homo sapiens
acagacagattttgtctgatgt

SEQ ID NO: 8112148 - DNA, 22 bp, Homo sapiens
acagacagaggctccatgagga

SEQ ID NO: 8112149 - DNA, 22 bp, Homo sapiens
acagacagaggctccatgagga

SEQ ID NO: 8112150 - DNA, 22 bp, Homo sapiens
acagacaagtagttcagacaag

SEQ ID NO: 8112151 - DNA, 20 bp, Homo sapiens
acagaaagagagaatgtcag

SEQ ID NO: 8112152 - DNA, 22 bp, Homo sapiens
acactttgctacatttcatatt

SEQ ID NO: 8112153 - DNA, 22 bp, Homo sapiens
acagagactgggagcaagaggc

SEQ ID NO: 8112154 - DNA, 22 bp, Homo sapiens
acagagactgggatgcctgcct

SEQ ID NO: 8112155 - DNA, 22 bp, Homo sapiens
acagagaaagtgggctgaagat

SEQ ID NO: 8112156 - DNA, 22 bp, Homo sapiens
acagagacctggccttgctttg

SEQ ID NO: 8112157 - DNA, 22 bp, Homo sapiens
acagagaccagcatcttctgcc

SEQ ID NO: 8112158 - DNA, 22 bp, Homo sapiens
acagagaaagtgggctgaagat

SEQ ID NO: 8112159 - DNA, 22 bp, Homo sapiens
acacatgtaaaacacttagcaa

SEQ ID NO: 8112160 - DNA, 20 bp, Homo sapiens
acacatgtgcgtgttcagta

SEQ ID NO: 8112161 - DNA, 22 bp, Homo sapiens
acacatgtatatgcttgtgtgt

SEQ ID NO: 8112162 - DNA, 22 bp, Homo sapiens
acacatgtatggcacttacatt

SEQ ID NO: 8112163 - DNA, 22 bp, Homo sapiens
acactgaatgtttaagaacttg

SEQ ID NO: 8112164 - DNA, 19 bp, Homo sapiens
acactgaatgtagaattgg

SEQ ID NO: 8112165 - DNA, 22 bp, Homo sapiens
acacttcagctccacaaacatt

SEQ ID NO: 8112166 - DNA, 22 bp, Homo sapiens
acacttcagctccacaaacatt

SEQ ID NO: 8112167 - DNA, 22 bp, Homo sapiens
acactcaccctcccactgcctg

SEQ ID NO: 8112168 - DNA, 22 bp, Homo sapiens
acactgaatatacaatgaatat

SEQ ID NO: 8112169 - DNA, 22 bp, Homo sapiens
acacagaagatctcttaatgct

SEQ ID NO: 8112170 - DNA, 23 bp, Homo sapiens
agcagcaaaaatttatctttctg

SEQ ID NO: 8112171 - DNA, 22 bp, Homo sapiens
acaatgcacctattttaaaact

SEQ ID NO: 8112172 - DNA, 22 bp, Homo sapiens
acaatgcacctattttaaaact

SEQ ID NO: 8112173 - DNA, 22 bp, Homo sapiens
acaatgctcatatttatgccaa

SEQ ID NO: 8112174 - DNA, 22 bp, Homo sapiens
acacagagtccttactgaggta

SEQ ID NO: 8112175 - DNA, 22 bp, Homo sapiens
aaacacattttaggaaaatcta

SEQ ID NO: 8112176 - DNA, 22 bp, Homo sapiens
aaacacattagccctgtggaaa

SEQ ID NO: 8112177 - DNA, 22 bp, Homo sapiens
aaagagctgagacctggtggag

SEQ ID NO: 8112178 - DNA, 22 bp, Homo sapiens
aaagagctcacagtccactgga

SEQ ID NO: 8112179 - DNA, 22 bp, Homo sapiens
aaagagctcttactctagtgta

SEQ ID NO: 8112180 - DNA, 22 bp, Homo sapiens
aaaaaggttgatccagattagg

SEQ ID NO: 8112181 - DNA, 22 bp, Homo sapiens
aaaaagtattggccatggttga

SEQ ID NO: 8112182 - DNA, 22 bp, Homo sapiens
aaacatgctggatttagaatat

SEQ ID NO: 8112183 - DNA, 20 bp, Homo sapiens
aaacattcatgtacaagtga

SEQ ID NO: 8112184 - DNA, 22 bp, Homo sapiens
aaacattccatatataccttgt

SEQ ID NO: 8112185 - DNA, 22 bp, Homo sapiens
aaacattgatgggaagtttaat

SEQ ID NO: 8112186 - DNA, 22 bp, Homo sapiens
aaacattgagcacttgctattt

SEQ ID NO: 8112187 - DNA, 22 bp, Homo sapiens
aaactgtaagagaataaactac

SEQ ID NO: 8112188 - DNA, 22 bp, Homo sapiens
aaagccactgcatgtgtagtat

SEQ ID NO: 8112189 - DNA, 22 bp, Homo sapiens
aaagccagctctgagctgcacc

SEQ ID NO: 8112190 - DNA, 22 bp, Homo sapiens
aaagccagcaaggtgagtttca

SEQ ID NO: 8112191 - DNA, 22 bp, Homo sapiens
aaagccagagtgtgttagagac

SEQ ID NO: 8112192 - DNA, 22 bp, Homo sapiens
aaagccagagcaagctgtcaca

SEQ ID NO: 8112193 - DNA, 20 bp, Homo sapiens
aaagccactggcaagagact

SEQ ID NO: 8112194 - DNA, 22 bp, Homo sapiens
aaacagcagctgtttaatttgc

SEQ ID NO: 8112195 - DNA, 21 bp, Homo sapiens
aaagaacaggcagatgttctt

SEQ ID NO: 8112196 - DNA, 22 bp, Homo sapiens
aaagacatgacacattggagag

SEQ ID NO: 8112197 - DNA, 22 bp, Homo sapiens
aaagacttgggagcagtatgct

SEQ ID NO: 8112198 - DNA, 22 bp, Homo sapiens
aaagactttcacctagcaaaga

SEQ ID NO: 8112199 - DNA, 22 bp, Homo sapiens
aaagactttcacctagcaaaga

SEQ ID NO: 8112200 - DNA, 22 bp, Homo sapiens
aaatagtttagctctcatttca

SEQ ID NO: 8112201 - DNA, 22 bp, Homo sapiens
aaacttccagtttaacatttac

SEQ ID NO: 8112202 - DNA, 22 bp, Homo sapiens
aaactgtgaagcaagtacaagg

SEQ ID NO: 8112203 - DNA, 22 bp, Homo sapiens
aagagggaggtgcgggtgcaga

SEQ ID NO: 8112204 - DNA, 22 bp, Homo sapiens
aagagggagggcaaaggcactg

SEQ ID NO: 8112205 - DNA, 22 bp, Homo sapiens
aagagggaagtcacctggaggt

SEQ ID NO: 8112206 - DNA, 22 bp, Homo sapiens
aaagtttggattagcagttaga

SEQ ID NO: 8112207 - DNA, 22 bp, Homo sapiens
aaagtttgaatgatatattagt

SEQ ID NO: 8112208 - DNA, 22 bp, Homo sapiens
aaagtttccaagttacaccatt

SEQ ID NO: 8112209 - DNA, 22 bp, Homo sapiens
aaatacatttacagtcgtggct

SEQ ID NO: 8112210 - DNA, 22 bp, Homo sapiens
aagatatattcgacgtgaatga

SEQ ID NO: 8112211 - DNA, 19 bp, Homo sapiens
aaagtgattttttctggca

SEQ ID NO: 8112212 - DNA, 22 bp, Homo sapiens
aaagtgcactctcagtgctgct

SEQ ID NO: 8112213 - DNA, 22 bp, Homo sapiens
aaagtgatgccaggagtctggt

SEQ ID NO: 8112214 - DNA, 22 bp, Homo sapiens
aagaccttgtctaaacatgtag

SEQ ID NO: 8112215 - DNA, 22 bp, Homo sapiens
aagactataccatcttagttac

SEQ ID NO: 8112216 - DNA, 22 bp, Homo sapiens
aagacccacaaggctgaatgtt

SEQ ID NO: 8112217 - DNA, 22 bp, Homo sapiens
aagacctctgaggtagaagttc

SEQ ID NO: 8112218 - DNA, 22 bp, Homo sapiens
aagacctctgaagtacctggtg

SEQ ID NO: 8112219 - DNA, 22 bp, Homo sapiens
aagacctctggagggcaatgtc

SEQ ID NO: 8112220 - DNA, 22 bp, Homo sapiens
aagcaggcattccagagacaat

SEQ ID NO: 8112221 - DNA, 22 bp, Homo sapiens
aaatctcagtgttctaagcatt

SEQ ID NO: 8112222 - DNA, 22 bp, Homo sapiens
aaatctcaggcctctatttact

SEQ ID NO: 8112223 - DNA, 22 bp, Homo sapiens
aaatctcagcccttattttaga

SEQ ID NO: 8112224 - DNA, 22 bp, Homo sapiens
aagcctcaccttttagaagcta

SEQ ID NO: 8112225 - DNA, 22 bp, Homo sapiens
aagcctggactatcgcgtgtgc

SEQ ID NO: 8112226 - DNA, 22 bp, Homo sapiens
aagcctaaatgatgctattatg

SEQ ID NO: 8112227 - DNA, 22 bp, Homo sapiens
aagccggctgggccgaggctgc

SEQ ID NO: 8112228 - DNA, 22 bp, Homo sapiens
aagcccttggcgcacaccgggc

SEQ ID NO: 8112229 - DNA, 22 bp, Homo sapiens
aagcccttggcgcacaccgggc

SEQ ID NO: 8112230 - DNA, 22 bp, Homo sapiens
aagccctggggttgcacaaggc

SEQ ID NO: 8112231 - DNA, 22 bp, Homo sapiens
aagccctgtcaccctgacttca

SEQ ID NO: 8112232 - DNA, 22 bp, Homo sapiens
aagccctgttaggcactgggga

SEQ ID NO: 8112233 - DNA, 22 bp, Homo sapiens
aagcaggatggatctagtgttc

SEQ ID NO: 8112234 - DNA, 22 bp, Homo sapiens
aagcaggcatgggaggccatcc

SEQ ID NO: 8112235 - DNA, 22 bp, Homo sapiens
aagcaggcatcttggaggtcaa

SEQ ID NO: 8112236 - DNA, 22 bp, Homo sapiens
aagatattttagaacattcact

SEQ ID NO: 8112237 - DNA, 22 bp, Homo sapiens
aagatccatgagggcagagatt

SEQ ID NO: 8112238 - DNA, 22 bp, Homo sapiens
aactgtgaggatgtgcaaattc

SEQ ID NO: 8112239 - DNA, 22 bp, Homo sapiens
aagaaataagacttctctgtcc

SEQ ID NO: 8112240 - DNA, 22 bp, Homo sapiens
aaaggcaggactgcagcatagg

SEQ ID NO: 8112241 - DNA, 22 bp, Homo sapiens
aaccccgctcaggctgggtgag

SEQ ID NO: 8112242 - DNA, 22 bp, Homo sapiens
aaccccaggctggaggagtctc

SEQ ID NO: 8112243 - DNA, 22 bp, Homo sapiens
aacccaggtctttggcttccag

SEQ ID NO: 8112244 - DNA, 22 bp, Homo sapiens
aacccattaatccttgcaagca

SEQ ID NO: 8112245 - DNA, 22 bp, Homo sapiens
aacatttgtttcgttatgtgaa

SEQ ID NO: 8112246 - DNA, 22 bp, Homo sapiens
aacccaggagacaggttgcagt

SEQ ID NO: 8112247 - DNA, 22 bp, Homo sapiens
aacccaggagatggaggttgtg

SEQ ID NO: 8112248 - DNA, 22 bp, Homo sapiens
aacccaggagccggaggttgtg

SEQ ID NO: 8112249 - DNA, 22 bp, Homo sapiens
aacccaggaggtggaggttgtg

SEQ ID NO: 8112250 - DNA, 22 bp, Homo sapiens
aacccaggaggcagaggctgca

SEQ ID NO: 8112251 - DNA, 22 bp, Homo sapiens
aacccaggaggcggaggttgtg

SEQ ID NO: 8112252 - DNA, 22 bp, Homo sapiens
aacccagggtggaggttgcagt

SEQ ID NO: 8112253 - DNA, 22 bp, Homo sapiens
aacccagggtgaggggagtcta

SEQ ID NO: 8112254 - DNA, 22 bp, Homo sapiens
aacccaggagttggaggctgtg

SEQ ID NO: 8112255 - DNA, 22 bp, Homo sapiens
aacactgtcttatacttcaatg

SEQ ID NO: 8112256 - DNA, 22 bp, Homo sapiens
aacacttctcatcactgcaagc

SEQ ID NO: 8112257 - DNA, 22 bp, Homo sapiens
aaagattatggcattgaaatac

SEQ ID NO: 8112258 - DNA, 22 bp, Homo sapiens
aaagattagataagatagattt

SEQ ID NO: 8112259 - DNA, 22 bp, Homo sapiens
aaagattgaaagagaatttgtc

SEQ ID NO: 8112260 - DNA, 22 bp, Homo sapiens
aaagattgatcatgaattgaca

SEQ ID NO: 8112261 - DNA, 22 bp, Homo sapiens
aacatataaactcttaagttca

SEQ ID NO: 8112262 - DNA, 22 bp, Homo sapiens
aacatataaactcttaagttca

SEQ ID NO: 8112263 - DNA, 22 bp, Homo sapiens
aacactgtatcagtcttcaata

SEQ ID NO: 8112264 - DNA, 22 bp, Homo sapiens
aacacagggggttacaaattgt

SEQ ID NO: 8112265 - DNA, 22 bp, Homo sapiens
aacagagatcttaattcctgta

SEQ ID NO: 8112266 - DNA, 22 bp, Homo sapiens
aagtgcttcgttctgtattggg

SEQ ID NO: 8112267 - DNA, 22 bp, Homo sapiens
aacagaaatcatttagggctct

SEQ ID NO: 8112268 - DNA, 22 bp, Homo sapiens
aacagaaaaggtaggtggcttt

SEQ ID NO: 8112269 - DNA, 22 bp, Homo sapiens
aacagaatcttgggttcttttc

SEQ ID NO: 8112270 - DNA, 22 bp, Homo sapiens
aaggctggttccatccctggtg

SEQ ID NO: 8112271 - DNA, 22 bp, Homo sapiens
aaggctggtggattatgaggtc

SEQ ID NO: 8112272 - DNA, 22 bp, Homo sapiens
aacacaggccagcctgtgcagt

SEQ ID NO: 8112273 - DNA, 20 bp, Homo sapiens
aacacagataccaaaggttg

SEQ ID NO: 8112274 - DNA, 22 bp, Homo sapiens
aacacagaagtgccaagagcca

SEQ ID NO: 8112275 - DNA, 22 bp, Homo sapiens
aaggaagacacagatgaagtga

SEQ ID NO: 8112276 - DNA, 22 bp, Homo sapiens
aaggaaagacaggacggaattc

SEQ ID NO: 8112277 - DNA, 22 bp, Homo sapiens
aaatgtcagaagctttacttct

SEQ ID NO: 8112278 - DNA, 22 bp, Homo sapiens
aaatgtcagaagctttacttct

SEQ ID NO: 8112279 - DNA, 22 bp, Homo sapiens
aaatgtcagaggaacatattga

SEQ ID NO: 8112280 - DNA, 22 bp, Homo sapiens
aaggcactgtactagttagtta

SEQ ID NO: 8112281 - DNA, 22 bp, Homo sapiens
aaggctgggtttgggatgtgat

SEQ ID NO: 8112282 - DNA, 22 bp, Homo sapiens
aagtggtttgagcacagtgctg

SEQ ID NO: 8112283 - DNA, 22 bp, Homo sapiens
aagtggttattttgatctagaa

SEQ ID NO: 8112284 - DNA, 22 bp, Homo sapiens
aagtgcttctgggattaggagt

SEQ ID NO: 8112285 - DNA, 22 bp, Homo sapiens
aagtgtataacgacctacagga

SEQ ID NO: 8112286 - DNA, 22 bp, Homo sapiens
aacatcttcagagaagctaagt

SEQ ID NO: 8112287 - DNA, 22 bp, Homo sapiens
aacatgaaaagcccagagaggt

SEQ ID NO: 8112288 - DNA, 22 bp, Homo sapiens
aatagacattatttctctatga

SEQ ID NO: 8112289 - DNA, 22 bp, Homo sapiens
aatagatactacttagatgtag

SEQ ID NO: 8112290 - DNA, 22 bp, Homo sapiens
aatggctgccagggcaggaggt

SEQ ID NO: 8112291 - DNA, 22 bp, Homo sapiens
aacctagggcatgaggatggtt

SEQ ID NO: 8112292 - DNA, 22 bp, Homo sapiens
aaccattcactgaacagttcaa

SEQ ID NO: 8112293 - DNA, 22 bp, Homo sapiens
aacgaatagggatttttctaac

SEQ ID NO: 8112294 - DNA, 22 bp, Homo sapiens
aagaaactgttgcgtgacagcg

SEQ ID NO: 8112295 - DNA, 22 bp, Homo sapiens
aattcacaatgtgtagtcatgc

SEQ ID NO: 8112296 - DNA, 21 bp, Homo sapiens
aagaaagataattaaggaccc

SEQ ID NO: 8112297 - DNA, 22 bp, Homo sapiens
aattctagcattgtgaaaatat

SEQ ID NO: 8112298 - DNA, 22 bp, Homo sapiens
aatttcactggaaaagataatt

SEQ ID NO: 8112299 - DNA, 22 bp, Homo sapiens
aagaacaactgctttaaaagca

SEQ ID NO: 8112300 - DNA, 22 bp, Homo sapiens
aagaacaactgctttaaaagca

SEQ ID NO: 8112301 - DNA, 22 bp, Homo sapiens
acaatgttttgaaacatctagg

SEQ ID NO: 8112302 - DNA, 19 bp, Homo sapiens
acaatgttgttggacactc

SEQ ID NO: 8112303 - DNA, 21 bp, Homo sapiens
aagagacatttctcatcagca

SEQ ID NO: 8112304 - DNA, 22 bp, Homo sapiens
aagagactggaaactagggtca

SEQ ID NO: 8112305 - DNA, 21 bp, Homo sapiens
aagagacatttctcatcagca

SEQ ID NO: 8112306 - DNA, 22 bp, Homo sapiens
aagagaatacaagcaggcagga

SEQ ID NO: 8112307 - DNA, 22 bp, Homo sapiens
aagagaaggtgaggaagccggt

SEQ ID NO: 8112308 - DNA, 22 bp, Homo sapiens
aagagaaggattctgagcctgg

SEQ ID NO: 8112309 - DNA, 22 bp, Homo sapiens
aagagaaggccctgacccaccc

SEQ ID NO: 8112310 - DNA, 22 bp, Homo sapiens
aagagaagaaagtgtctacaca

SEQ ID NO: 8112311 - DNA, 20 bp, Homo sapiens
aagagaagaagtctttgaaa

SEQ ID NO: 8112312 - DNA, 21 bp, Homo sapiens
aatttcagacccattttgcct

SEQ ID NO: 8112313 - DNA, 22 bp, Homo sapiens
aattttaagcatatgactggtt

SEQ ID NO: 8112314 - DNA, 22 bp, Homo sapiens
aattttaagcatatgactggtt

SEQ ID NO: 8112315 - DNA, 22 bp, Homo sapiens
aattttaatcagtggtgctgag

SEQ ID NO: 8112316 - DNA, 22 bp, Homo sapiens
aattttaatcagtggtgctgag

SEQ ID NO: 8112317 - DNA, 22 bp, Homo sapiens
acacatttctaaatttttaccg

SEQ ID NO: 8112318 - DNA, 22 bp, Homo sapiens
aagatgcagcaaactacttttt

SEQ ID NO: 8112319 - DNA, 22 bp, Homo sapiens
aagatgcacaatgtggcaatta

SEQ ID NO: 8112320 - DNA, 22 bp, Homo sapiens
aagatgcatgctgaagctggct

SEQ ID NO: 8112321 - DNA, 22 bp, Homo sapiens
aagatgcagctttacaataagg

SEQ ID NO: 8112322 - DNA, 22 bp, Homo sapiens
aagatggcaggaatcataagct

SEQ ID NO: 8112323 - DNA, 22 bp, Homo sapiens
aagatggcttagagtcctggtg

SEQ ID NO: 8112324 - DNA, 22 bp, Homo sapiens
aagatggcatctcctatagatg

SEQ ID NO: 8112325 - DNA, 23 bp, Homo sapiens
aagcaatgctgagccagttctga

SEQ ID NO: 8112326 - DNA, 22 bp, Homo sapiens
aagcacactcagatattgactc

SEQ ID NO: 8112327 - DNA, 22 bp, Homo sapiens
aagcacacagcaaaggggagct

SEQ ID NO: 8112328 - DNA, 22 bp, Homo sapiens
aagcacacctccctggcaggag

SEQ ID NO: 8112329 - DNA, 22 bp, Homo sapiens
aagcagaatttcccactagttg

SEQ ID NO: 8112330 - DNA, 18 bp, Homo sapiens
aagcagacagcagacagt

SEQ ID NO: 8112331 - DNA, 20 bp, Homo sapiens
aagcagaagctgctctcagc

SEQ ID NO: 8112332 - DNA, 22 bp, Homo sapiens
aagcagaaggggaataatattt

SEQ ID NO: 8112333 - DNA, 22 bp, Homo sapiens
aagcagaatttaatagaaaggt

SEQ ID NO: 8112334 - DNA, 22 bp, Homo sapiens
aagcagaatagaggcccttccc

SEQ ID NO: 8112335 - DNA, 22 bp, Homo sapiens
aagcagaggaccgacggaggga

SEQ ID NO: 8112336 - DNA, 22 bp, Homo sapiens
acagcaaaagacaagaacttaa

SEQ ID NO: 8112337 - DNA, 21 bp, Homo sapiens
acagcagagatcaagactaag

SEQ ID NO: 8112338 - DNA, 21 bp, Homo sapiens
acagcagagatcaagactaag

SEQ ID NO: 8112339 - DNA, 22 bp, Homo sapiens
acagcagagcaccagggccact

SEQ ID NO: 8112340 - DNA, 21 bp, Homo sapiens
aagcaggaacttcaaagggac

SEQ ID NO: 8112341 - DNA, 22 bp, Homo sapiens
aggcgcctgcgggatccttgcc

SEQ ID NO: 8112342 - DNA, 22 bp, Homo sapiens
aggctgagtgctcccctagatg

SEQ ID NO: 8112343 - DNA, 20 bp, Homo sapiens
aggctgagttctatgcactt

SEQ ID NO: 8112344 - DNA, 18 bp, Homo sapiens
aggctgcactgtcttaaa

SEQ ID NO: 8112345 - DNA, 22 bp, Homo sapiens
aggctgagtttctcattctcgc

SEQ ID NO: 8112346 - DNA, 22 bp, Homo sapiens
aggctgatgctggctgaggctg

SEQ ID NO: 8112347 - DNA, 22 bp, Homo sapiens
aggctgaggctggcagctccag

SEQ ID NO: 8112348 - DNA, 22 bp, Homo sapiens
aggctgaggatccctgtgttct

SEQ ID NO: 8112349 - DNA, 22 bp, Homo sapiens
aggctgagggctcctgagggca

SEQ ID NO: 8112350 - DNA, 22 bp, Homo sapiens
aggctgaggctttccttggaga

SEQ ID NO: 8112351 - DNA, 22 bp, Homo sapiens
acatttacagtgctagacaatc

SEQ ID NO: 8112352 - DNA, 22 bp, Homo sapiens
acatgcagtgagtagttctcca

SEQ ID NO: 8112353 - DNA, 22 bp, Homo sapiens
acatgcagaattcttagagagc

SEQ ID NO: 8112354 - DNA, 22 bp, Homo sapiens
acatggagaccagatggaagta

SEQ ID NO: 8112355 - DNA, 22 bp, Homo sapiens
acatggaaagtactccacaatt

SEQ ID NO: 8112356 - DNA, 22 bp, Homo sapiens
aggccctgttatgagccactgt

SEQ ID NO: 8112357 - DNA, 22 bp, Homo sapiens
aggcccttggactcatgctcga

SEQ ID NO: 8112358 - DNA, 22 bp, Homo sapiens
aggcccttcttggtggctcagg

SEQ ID NO: 8112359 - DNA, 22 bp, Homo sapiens
aggcccttggagtagaggctga

SEQ ID NO: 8112360 - DNA, 22 bp, Homo sapiens
acatgagaagctgcaacatgac

SEQ ID NO: 8112361 - DNA, 22 bp, Homo sapiens
acatgaggaactcaggagtcac

SEQ ID NO: 8112362 - DNA, 22 bp, Homo sapiens
acatgagaggctgtggagtaca

SEQ ID NO: 8112363 - DNA, 22 bp, Homo sapiens
acatgcaacaaagtacctgcaa

SEQ ID NO: 8112364 - DNA, 22 bp, Homo sapiens
acatgcaaagccacaggacccg

SEQ ID NO: 8112365 - DNA, 22 bp, Homo sapiens
acatgcaaatgtgcatgcatgt

SEQ ID NO: 8112366 - DNA, 22 bp, Homo sapiens
acatgatttttaaagagataat

SEQ ID NO: 8112367 - DNA, 23 bp, Homo sapiens
acatgcaaaaatcacagtctcct

SEQ ID NO: 8112368 - DNA, 19 bp, Homo sapiens
acatgcaaggcacctgcag

SEQ ID NO: 8112369 - DNA, 22 bp, Homo sapiens
acccaggagcaggctgggcagt

SEQ ID NO: 8112370 - DNA, 22 bp, Homo sapiens
agggcatgaaatgggcagaagc

SEQ ID NO: 8112371 - DNA, 23 bp, Homo sapiens
agggcatgaagcagaggacgtgg

SEQ ID NO: 8112372 - DNA, 22 bp, Homo sapiens
agggcatgaaatgggcagaagc

SEQ ID NO: 8112373 - DNA, 22 bp, Homo sapiens
agggcagtgggaaagcctgctc

SEQ ID NO: 8112374 - DNA, 20 bp, Homo sapiens
agggcagcttgaggagccgg

SEQ ID NO: 8112375 - DNA, 17 bp, Homo sapiens
acccaggctctatcttg

SEQ ID NO: 8112376 - DNA, 22 bp, Homo sapiens
acccaggctgcttctcagtggc

SEQ ID NO: 8112377 - DNA, 22 bp, Homo sapiens
acccaggctggagtgcagtagc

SEQ ID NO: 8112378 - DNA, 22 bp, Homo sapiens
acccaggctgcttctcagtggc

SEQ ID NO: 8112379 - DNA, 22 bp, Homo sapiens
acccaggctagggtgcagtggc

SEQ ID NO: 8112380 - DNA, 17 bp, Homo sapiens
acccaggctctatcttg

SEQ ID NO: 8112381 - DNA, 18 bp, Homo sapiens
acccaggctcatggtcct

SEQ ID NO: 8112382 - DNA, 18 bp, Homo sapiens
acccaggctcatggtcct

SEQ ID NO: 8112383 - DNA, 22 bp, Homo sapiens
acccaggctagagtgcagtggt

SEQ ID NO: 8112384 - DNA, 22 bp, Homo sapiens
acccaggcctgagagacaggag

SEQ ID NO: 8112385 - DNA, 22 bp, Homo sapiens
acccaggcgggagtgcagtgtc

SEQ ID NO: 8112386 - DNA, 22 bp, Homo sapiens
acccgggaggcaggagtcatag

SEQ ID NO: 8112387 - DNA, 22 bp, Homo sapiens
accctcaacaaattcactctat

SEQ ID NO: 8112388 - DNA, 22 bp, Homo sapiens
aggctggatctctgttgccttc

SEQ ID NO: 8112389 - DNA, 22 bp, Homo sapiens
aggctggcagccacctcagcag

SEQ ID NO: 8112390 - DNA, 22 bp, Homo sapiens
aggctggcagccacctcagcag

SEQ ID NO: 8112391 - DNA, 22 bp, Homo sapiens
agggaagaatcactgggatgtt

SEQ ID NO: 8112392 - DNA, 22 bp, Homo sapiens
agggaagaggaccagagtctct

SEQ ID NO: 8112393 - DNA, 22 bp, Homo sapiens
agggaatgtagcaagatgccaa

SEQ ID NO: 8112394 - DNA, 19 bp, Homo sapiens
accaggcctcagaggccct

SEQ ID NO: 8112395 - DNA, 22 bp, Homo sapiens
accaggccctccagctgcgtgg

SEQ ID NO: 8112396 - DNA, 22 bp, Homo sapiens
accaggcccgctgctatggtgg

SEQ ID NO: 8112397 - DNA, 22 bp, Homo sapiens
accaggagttgggggtgggacc

SEQ ID NO: 8112398 - DNA, 22 bp, Homo sapiens
accaggcccaccgcatgctcct

SEQ ID NO: 8112399 - DNA, 22 bp, Homo sapiens
aggcagcagtgataagatagga

SEQ ID NO: 8112400 - DNA, 22 bp, Homo sapiens
aggcagcatccagaggagaatg

SEQ ID NO: 8112401 - DNA, 22 bp, Homo sapiens
aggcagcagtgataagatagga

SEQ ID NO: 8112402 - DNA, 22 bp, Homo sapiens
aggcagcaattgaaatcattgt

SEQ ID NO: 8112403 - DNA, 22 bp, Homo sapiens
aggcagcatgctctgcttctac

SEQ ID NO: 8112404 - DNA, 22 bp, Homo sapiens
aggcagcatccagaggagaatg

SEQ ID NO: 8112405 - DNA, 22 bp, Homo sapiens
acagtttgttccttttcattgc

SEQ ID NO: 8112406 - DNA, 22 bp, Homo sapiens
acagttttttcaacattggaat

SEQ ID NO: 8112407 - DNA, 22 bp, Homo sapiens
acagttattctttatgcaacca

SEQ ID NO: 8112408 - DNA, 22 bp, Homo sapiens
acagttatctttgaaatagaga

SEQ ID NO: 8112409 - DNA, 22 bp, Homo sapiens
aggaggaactcagaaagaaggt

SEQ ID NO: 8112410 - DNA, 20 bp, Homo sapiens
aggaggaaaaaatgacgagc

SEQ ID NO: 8112411 - DNA, 20 bp, Homo sapiens
aggaggaaaaaatgacgagc

SEQ ID NO: 8112412 - DNA, 21 bp, Homo sapiens
aggaggaacccgtggctgggc

SEQ ID NO: 8112413 - DNA, 22 bp, Homo sapiens
aggagtgagtgtcctcagcaga

SEQ ID NO: 8112414 - DNA, 22 bp, Homo sapiens
aggagtgagctttggggtcaga

SEQ ID NO: 8112415 - DNA, 22 bp, Homo sapiens
aggagtctgttgaaatgtctat

SEQ ID NO: 8112416 - DNA, 22 bp, Homo sapiens
aggagtggaattactgggttct

SEQ ID NO: 8112417 - DNA, 22 bp, Homo sapiens
acaggtggcttattggctgatt

SEQ ID NO: 8112418 - DNA, 22 bp, Homo sapiens
acaggtggcttattggctgatt

SEQ ID NO: 8112419 - DNA, 22 bp, Homo sapiens
acaggtggtaaaatggactgtc

SEQ ID NO: 8112420 - DNA, 22 bp, Homo sapiens
acaggtggcactgctgttactc

SEQ ID NO: 8112421 - DNA, 22 bp, Homo sapiens
acagggtggggatggtgagctt

SEQ ID NO: 8112422 - DNA, 22 bp, Homo sapiens
acagggagtctgaggggatagt

SEQ ID NO: 8112423 - DNA, 19 bp, Homo sapiens
aggaatggaattaattctg

SEQ ID NO: 8112424 - DNA, 22 bp, Homo sapiens
aggaagggctgtttctccaaga

SEQ ID NO: 8112425 - DNA, 22 bp, Homo sapiens
aggaatgatagtaaaagagaat

SEQ ID NO: 8112426 - DNA, 18 bp, Homo sapiens
acaggctgtgggaatggt

SEQ ID NO: 8112427 - DNA, 22 bp, Homo sapiens
acaggctgttggggtccagggt

SEQ ID NO: 8112428 - DNA, 22 bp, Homo sapiens
acaggctgtacttctaatcatc

SEQ ID NO: 8112429 - DNA, 22 bp, Homo sapiens
acaggctggtttgtaaaagatg

SEQ ID NO: 8112430 - DNA, 22 bp, Homo sapiens
acaggctgccacttgcatccaa

SEQ ID NO: 8112431 - DNA, 22 bp, Homo sapiens
acaggctgcccgctccccacct

SEQ ID NO: 8112432 - DNA, 22 bp, Homo sapiens
acaggctgctgagccatttgct

SEQ ID NO: 8112433 - DNA, 22 bp, Homo sapiens
acaggctgcctaccaagtatca

SEQ ID NO: 8112434 - DNA, 22 bp, Homo sapiens
acaggctgcccgctccccacct

SEQ ID NO: 8112435 - DNA, 22 bp, Homo sapiens
acaggctgctgggctccgtgct

SEQ ID NO: 8112436 - DNA, 22 bp, Homo sapiens
acaggctgctgggctccgtgct

SEQ ID NO: 8112437 - DNA, 22 bp, Homo sapiens
acaggctggaggaggaccaaga

SEQ ID NO: 8112438 - DNA, 22 bp, Homo sapiens
acaggctggtggtcctggccat

SEQ ID NO: 8112439 - DNA, 22 bp, Homo sapiens
acaggctggtggtcctggccat

SEQ ID NO: 8112440 - DNA, 22 bp, Homo sapiens
acaggctgggcgcttcctgcgg

SEQ ID NO: 8112441 - DNA, 22 bp, Homo sapiens
acaggcctgacacacagagggc

SEQ ID NO: 8112442 - DNA, 22 bp, Homo sapiens
acaggcctgacacacagagggc

SEQ ID NO: 8112443 - DNA, 22 bp, Homo sapiens
acagctacatcaaactcagaag

SEQ ID NO: 8112444 - DNA, 22 bp, Homo sapiens
acagctcctactgaagccatgt

SEQ ID NO: 8112445 - DNA, 22 bp, Homo sapiens
acagctcttaggcagaaccaac

SEQ ID NO: 8112446 - DNA, 23 bp, Homo sapiens
acagctgcacctggccgcctggc

SEQ ID NO: 8112447 - DNA, 22 bp, Homo sapiens
agctgcccaatcctgcagggcg

SEQ ID NO: 8112448 - DNA, 21 bp, Homo sapiens
agctgcccagagtagggaagg

SEQ ID NO: 8112449 - DNA, 22 bp, Homo sapiens
agctgcccagctaggaagaagg

SEQ ID NO: 8112450 - DNA, 22 bp, Homo sapiens
agctgcccagataggaggaggc

SEQ ID NO: 8112451 - DNA, 21 bp, Homo sapiens
acagcagacaggcttaggacc

SEQ ID NO: 8112452 - DNA, 22 bp, Homo sapiens
agctgccccatgagaggcaggt

SEQ ID NO: 8112453 - DNA, 22 bp, Homo sapiens
agctgccccatgagaggcaggt

SEQ ID NO: 8112454 - DNA, 22 bp, Homo sapiens
agctgcccccagggctgtgctt

SEQ ID NO: 8112455 - DNA, 20 bp, Homo sapiens
acgtggccaccagtggctta

SEQ ID NO: 8112456 - DNA, 22 bp, Homo sapiens
acgtggcggccgccgtgagcgg

SEQ ID NO: 8112457 - DNA, 22 bp, Homo sapiens
actaaaacatagccagtcagtg

SEQ ID NO: 8112458 - DNA, 22 bp, Homo sapiens
actattcacctttcatgcagga

SEQ ID NO: 8112459 - DNA, 22 bp, Homo sapiens
actattgcaatacgtgtcagca

SEQ ID NO: 8112460 - DNA, 19 bp, Homo sapiens
actcagggaaaggagaatt

SEQ ID NO: 8112461 - DNA, 22 bp, Homo sapiens
actcacagcagactatgaggga

SEQ ID NO: 8112462 - DNA, 20 bp, Homo sapiens
actatgaagttagccctcca

SEQ ID NO: 8112463 - DNA, 22 bp, Homo sapiens
actaaatagcctctggtagttg

SEQ ID NO: 8112464 - DNA, 23 bp, Homo sapiens
acctggctgctcaacctgcaggg

SEQ ID NO: 8112465 - DNA, 23 bp, Homo sapiens
acctggctgctcaacctgcaggg

SEQ ID NO: 8112466 - DNA, 22 bp, Homo sapiens
acctggctggttgtgattccca

SEQ ID NO: 8112467 - DNA, 22 bp, Homo sapiens
aggtagaaggaccagaatttat

SEQ ID NO: 8112468 - DNA, 22 bp, Homo sapiens
aggtacagtagacagacagtta

SEQ ID NO: 8112469 - DNA, 22 bp, Homo sapiens
aggtacagtagacagacagtta

SEQ ID NO: 8112470 - DNA, 22 bp, Homo sapiens
acctgccttctcaaggacatga

SEQ ID NO: 8112471 - DNA, 22 bp, Homo sapiens
acctgctcaactggcttctcgc

SEQ ID NO: 8112472 - DNA, 22 bp, Homo sapiens
acctgctcaactggcttctcgc

SEQ ID NO: 8112473 - DNA, 23 bp, Homo sapiens
acctgctccatgtcaccttcact

SEQ ID NO: 8112474 - DNA, 22 bp, Homo sapiens
acctccctggccttctgattcc

SEQ ID NO: 8112475 - DNA, 18 bp, Homo sapiens
acctgcctgttcttctct

SEQ ID NO: 8112476 - DNA, 22 bp, Homo sapiens
acctccctcgccgtccactctg

SEQ ID NO: 8112477 - DNA, 22 bp, Homo sapiens
agggtgtcagccacggaatggg

SEQ ID NO: 8112478 - DNA, 22 bp, Homo sapiens
agggtgtgctgttgggtctttc

SEQ ID NO: 8112479 - DNA, 22 bp, Homo sapiens
actccagggctgaacgaggccc

SEQ ID NO: 8112480 - DNA, 22 bp, Homo sapiens
actccagggcttctatgatggt

SEQ ID NO: 8112481 - DNA, 22 bp, Homo sapiens
actccagggctccatcccttgt

SEQ ID NO: 8112482 - DNA, 22 bp, Homo sapiens
actccagggctccaccccagat

SEQ ID NO: 8112483 - DNA, 22 bp, Homo sapiens
actccacatttgaacacagttc

SEQ ID NO: 8112484 - DNA, 22 bp, Homo sapiens
actcatttgcatgatgtgctat

SEQ ID NO: 8112485 - DNA, 22 bp, Homo sapiens
actcatttttactgcaattgag

SEQ ID NO: 8112486 - DNA, 22 bp, Homo sapiens
actccaggatgtagaatcagag

SEQ ID NO: 8112487 - DNA, 22 bp, Homo sapiens
actccaggatgtagaatcagag

SEQ ID NO: 8112488 - DNA, 22 bp, Homo sapiens
actccaggaaacttaggggaaa

SEQ ID NO: 8112489 - DNA, 22 bp, Homo sapiens
actccaggaaacttaggggaaa

SEQ ID NO: 8112490 - DNA, 22 bp, Homo sapiens
actccagatgataagggacagt

SEQ ID NO: 8112491 - DNA, 22 bp, Homo sapiens
actccagagctcacatgtctaa

SEQ ID NO: 8112492 - DNA, 22 bp, Homo sapiens
actccagacacagacactatga

SEQ ID NO: 8112493 - DNA, 19 bp, Homo sapiens
actccagggatgacagaag

SEQ ID NO: 8112494 - DNA, 22 bp, Homo sapiens
actccagggaggtgagtgtgcg

SEQ ID NO: 8112495 - DNA, 19 bp, Homo sapiens
actccagggatgacagaag

SEQ ID NO: 8112496 - DNA, 22 bp, Homo sapiens
actccaggcatctgcttctgct

SEQ ID NO: 8112497 - DNA, 22 bp, Homo sapiens
agtctggatttagaggtgggcc

SEQ ID NO: 8112498 - DNA, 22 bp, Homo sapiens
agtctggattttctacccttct

SEQ ID NO: 8112499 - DNA, 22 bp, Homo sapiens
actgaaatgaaatctatcatct

SEQ ID NO: 8112500 - DNA, 22 bp, Homo sapiens
actgaagacctcctgtcagcgg

SEQ ID NO: 8112501 - DNA, 22 bp, Homo sapiens
actgcacagatgaagctgtaaa

SEQ ID NO: 8112502 - DNA, 22 bp, Homo sapiens
actgcacagaaccttagaatat

SEQ ID NO: 8112503 - DNA, 22 bp, Homo sapiens
actgcacagaattatggttggt

SEQ ID NO: 8112504 - DNA, 22 bp, Homo sapiens
actgcacagaagaaactatcaa

SEQ ID NO: 8112505 - DNA, 22 bp, Homo sapiens
actgcacacttagcatctggga

SEQ ID NO: 8112506 - DNA, 22 bp, Homo sapiens
actgcacacctccagggcacta

SEQ ID NO: 8112507 - DNA, 21 bp, Homo sapiens
actgcacactatgtgaattga

SEQ ID NO: 8112508 - DNA, 22 bp, Homo sapiens
actgcacaaggcctggacacac

SEQ ID NO: 8112509 - DNA, 21 bp, Homo sapiens
actgcacaagttgctttgctt

SEQ ID NO: 8112510 - DNA, 22 bp, Homo sapiens
actgcacacacagaatttaggg

SEQ ID NO: 8112511 - DNA, 22 bp, Homo sapiens
actgcacacatgtttaagtgga

SEQ ID NO: 8112512 - DNA, 22 bp, Homo sapiens
actgctcacgcattacttgagc

SEQ ID NO: 8112513 - DNA, 22 bp, Homo sapiens
actgctgactaaacagctccat

SEQ ID NO: 8112514 - DNA, 22 bp, Homo sapiens
actgctgagcacacaagagtgt

SEQ ID NO: 8112515 - DNA, 22 bp, Homo sapiens
actgctgacctcaggtcatcct

SEQ ID NO: 8112516 - DNA, 22 bp, Homo sapiens
actggcactatgttggagaaat

SEQ ID NO: 8112517 - DNA, 22 bp, Homo sapiens
actggcagaacgtgatgcgggt

SEQ ID NO: 8112518 - DNA, 22 bp, Homo sapiens
actggcagaactggtgattgtc

SEQ ID NO: 8112519 - DNA, 22 bp, Homo sapiens
actggcagcagcagcccttggg

SEQ ID NO: 8112520 - DNA, 22 bp, Homo sapiens
atcattgagattttttacaact

SEQ ID NO: 8112521 - DNA, 22 bp, Homo sapiens
atcatttatgccccaattagat

SEQ ID NO: 8112522 - DNA, 16 bp, Homo sapiens
atccagacagcacagg

SEQ ID NO: 8112523 - DNA, 22 bp, Homo sapiens
atccagacagtctggtgccaga

SEQ ID NO: 8112524 - DNA, 22 bp, Homo sapiens
atccactctaagatctgtggtg

SEQ ID NO: 8112525 - DNA, 22 bp, Homo sapiens
atccactctcccattcatgcat

SEQ ID NO: 8112526 - DNA, 22 bp, Homo sapiens
agaagaaatgtgaaggccactg

SEQ ID NO: 8112527 - DNA, 21 bp, Homo sapiens
atcaccagcagaagctgcaga

SEQ ID NO: 8112528 - DNA, 22 bp, Homo sapiens
atcaccaggcaaaatgtcagag

SEQ ID NO: 8112529 - DNA, 22 bp, Homo sapiens
atcactgttatctagaagcaca

SEQ ID NO: 8112530 - DNA, 22 bp, Homo sapiens
atcactgtggcccaaaacctca

SEQ ID NO: 8112531 - DNA, 20 bp, Homo sapiens
atcactggagaaggaaacct

SEQ ID NO: 8112532 - DNA, 22 bp, Homo sapiens
atcacaaaggctgcttcatgat

SEQ ID NO: 8112533 - DNA, 22 bp, Homo sapiens
agaaacatcttggcaactggaa

SEQ ID NO: 8112534 - DNA, 22 bp, Homo sapiens
actttgtaggtttcagtgaaac

SEQ ID NO: 8112535 - DNA, 22 bp, Homo sapiens
acttggttgatgtcataaggtt

SEQ ID NO: 8112536 - DNA, 22 bp, Homo sapiens
atatatttgagaatattcatga

SEQ ID NO: 8112537 - DNA, 22 bp, Homo sapiens
atatatttgagaatattcatga

SEQ ID NO: 8112538 - DNA, 22 bp, Homo sapiens
atatgaaaagaagtcaccattg

SEQ ID NO: 8112539 - DNA, 22 bp, Homo sapiens
atatgaaagtaagcatgtgtgt

SEQ ID NO: 8112540 - DNA, 22 bp, Homo sapiens
acttccagacctgtgcttgctc

SEQ ID NO: 8112541 - DNA, 22 bp, Homo sapiens
acttcatttcatttgcacagtg

SEQ ID NO: 8112542 - DNA, 22 bp, Homo sapiens
acttcagtgtggtataaaacgt

SEQ ID NO: 8112543 - DNA, 22 bp, Homo sapiens
acttgccccagaattgctgctg

SEQ ID NO: 8112544 - DNA, 22 bp, Homo sapiens
acttcaaattttcagaagaaat

SEQ ID NO: 8112545 - DNA, 22 bp, Homo sapiens
acttcacattagctaaaaggga

SEQ ID NO: 8112546 - DNA, 22 bp, Homo sapiens
agtttacatcttcaatctcatt

SEQ ID NO: 8112547 - DNA, 22 bp, Homo sapiens
actggtttttctcatgaaaatg

SEQ ID NO: 8112548 - DNA, 22 bp, Homo sapiens
actgtaaaactgctttggaaac

SEQ ID NO: 8112549 - DNA, 22 bp, Homo sapiens
agtttacactatgaaaagacta

SEQ ID NO: 8112550 - DNA, 22 bp, Homo sapiens
actggcagtttgagaatgcatt

SEQ ID NO: 8112551 - DNA, 22 bp, Homo sapiens
actggcagtgtcgtttacatga

SEQ ID NO: 8112552 - DNA, 22 bp, Homo sapiens
actggcagccacaactggcagg

SEQ ID NO: 8112553 - DNA, 20 bp, Homo sapiens
actggcagcctgcctgctgt

SEQ ID NO: 8112554 - DNA, 22 bp, Homo sapiens
actggcagctgtaggatgcatg

SEQ ID NO: 8112555 - DNA, 22 bp, Homo sapiens
actggcaggctgctggccggcg

SEQ ID NO: 8112556 - DNA, 22 bp, Homo sapiens
actggcagtggcagcagaaaga

SEQ ID NO: 8112557 - DNA, 22 bp, Homo sapiens
actggcagtagagggagcgcat

SEQ ID NO: 8112558 - DNA, 19 bp, Homo sapiens
actggcagggctgcggtgg

SEQ ID NO: 8112559 - DNA, 22 bp, Homo sapiens
actgtgaacggactgaagccca

SEQ ID NO: 8112560 - DNA, 22 bp, Homo sapiens
agtttccaaatattgttttagc

SEQ ID NO: 8112561 - DNA, 22 bp, Homo sapiens
agtttccttggattcaatttgg

SEQ ID NO: 8112562 - DNA, 22 bp, Homo sapiens
agtttccttgggcatttgttta

SEQ ID NO: 8112563 - DNA, 22 bp, Homo sapiens
actgtgctatctactgaattat

SEQ ID NO: 8112564 - DNA, 22 bp, Homo sapiens
agagggtggtgaggcctggttc

SEQ ID NO: 8112565 - DNA, 22 bp, Homo sapiens
agagggtgggcacgtgatggat

SEQ ID NO: 8112566 - DNA, 22 bp, Homo sapiens
atttaagactgacttcaccagt

SEQ ID NO: 8112567 - DNA, 22 bp, Homo sapiens
agagtggcttctttgacatgct

SEQ ID NO: 8112568 - DNA, 22 bp, Homo sapiens
atttaagggatttggagaccaa

SEQ ID NO: 8112569 - DNA, 22 bp, Homo sapiens
atttagcacctccatctcaaca

SEQ ID NO: 8112570 - DNA, 22 bp, Homo sapiens
atttagaagttggagggcaaga

SEQ ID NO: 8112571 - DNA, 22 bp, Homo sapiens
atttagcaagagtacaaaataa

SEQ ID NO: 8112572 - DNA, 22 bp, Homo sapiens
atttagcaaaaaatgatgaagc

SEQ ID NO: 8112573 - DNA, 22 bp, Homo sapiens
agatgaatccacacatggcaaa

SEQ ID NO: 8112574 - DNA, 21 bp, Homo sapiens
atttccaagggtacctaagat

SEQ ID NO: 8112575 - DNA, 22 bp, Homo sapiens
atttccaagaaagctttaggat

SEQ ID NO: 8112576 - DNA, 19 bp, Homo sapiens
atttccaagaattggagag

SEQ ID NO: 8112577 - DNA, 22 bp, Homo sapiens
atttccaaaaccacttattgcc

SEQ ID NO: 8112578 - DNA, 22 bp, Homo sapiens
atttccaatctctgcatatggg

SEQ ID NO: 8112579 - DNA, 22 bp, Homo sapiens
agatttcacatgctgctctatt

SEQ ID NO: 8112580 - DNA, 22 bp, Homo sapiens
agcaaacagtgtgctaagaaat

SEQ ID NO: 8112581 - DNA, 22 bp, Homo sapiens
agatgtggaaagaagttagaag

SEQ ID NO: 8112582 - DNA, 22 bp, Homo sapiens
atttgcttcttgcttccagcac

SEQ ID NO: 8112583 - DNA, 22 bp, Homo sapiens
atttgcttgactatggcttgca

SEQ ID NO: 8112584 - DNA, 19 bp, Homo sapiens
atttgcttgtctgctctgc

SEQ ID NO: 8112585 - DNA, 22 bp, Homo sapiens
atttgcttcatagatctgtgga

SEQ ID NO: 8112586 - DNA, 22 bp, Homo sapiens
atttgcttatctccacagttgt

SEQ ID NO: 8112587 - DNA, 22 bp, Homo sapiens
atttgcttcctaatactcatat

SEQ ID NO: 8112588 - DNA, 22 bp, Homo sapiens
attcaaagtaataaccagaact

SEQ ID NO: 8112589 - DNA, 22 bp, Homo sapiens
attcaaagcccagtaaacattg

SEQ ID NO: 8112590 - DNA, 22 bp, Homo sapiens
attctgtatttggatataaggg

SEQ ID NO: 8112591 - DNA, 22 bp, Homo sapiens
attctgtatttctaataagatc

SEQ ID NO: 8112592 - DNA, 21 bp, Homo sapiens
agagggagagtggcccttcca

SEQ ID NO: 8112593 - DNA, 22 bp, Homo sapiens
agagggatcaccctgtttctgg

SEQ ID NO: 8112594 - DNA, 22 bp, Homo sapiens
agagggatcaccctgtttctgg

SEQ ID NO: 8112595 - DNA, 22 bp, Homo sapiens
agagggagtgaaatggaataga

SEQ ID NO: 8112596 - DNA, 22 bp, Homo sapiens
agagggagcccagtcatagctg

SEQ ID NO: 8112597 - DNA, 23 bp, Homo sapiens
agagggagatgtttttctcaaga

SEQ ID NO: 8112598 - DNA, 22 bp, Homo sapiens
agagggagctttatttttctgt

SEQ ID NO: 8112599 - DNA, 23 bp, Homo sapiens
agagggtgcaacatggggatcta

SEQ ID NO: 8112600 - DNA, 22 bp, Homo sapiens
agagggtatgagtggggctaaa

SEQ ID NO: 8112601 - DNA, 22 bp, Homo sapiens
agagggtcaaccaggagcgtca

SEQ ID NO: 8112602 - DNA, 22 bp, Homo sapiens
agaggggctcaagcagtggtct

SEQ ID NO: 8112603 - DNA, 22 bp, Homo sapiens
atgttttaaatatgtgtgtaaa

SEQ ID NO: 8112604 - DNA, 22 bp, Homo sapiens
atgttttaaatatgtgtgtaaa

SEQ ID NO: 8112605 - DNA, 22 bp, Homo sapiens
atgttttaccctttgcacaaac

SEQ ID NO: 8112606 - DNA, 22 bp, Homo sapiens
attagccttggtaagtctttca

SEQ ID NO: 8112607 - DNA, 22 bp, Homo sapiens
attagccttaataatttagaag

SEQ ID NO: 8112608 - DNA, 22 bp, Homo sapiens
attagcctgttgcattttcact

SEQ ID NO: 8112609 - DNA, 22 bp, Homo sapiens
attagcctgctctttagtgaaa

SEQ ID NO: 8112610 - DNA, 22 bp, Homo sapiens
attagcctccttgtctcatgcg

SEQ ID NO: 8112611 - DNA, 22 bp, Homo sapiens
attagcaaattctaattcacta

SEQ ID NO: 8112612 - DNA, 22 bp, Homo sapiens
atgttacaattcaaaatgctgc

SEQ ID NO: 8112613 - DNA, 22 bp, Homo sapiens
atgttacacataggcataaatg

SEQ ID NO: 8112614 - DNA, 22 bp, Homo sapiens
atgttacaatccaacaaaatta

SEQ ID NO: 8112615 - DNA, 20 bp, Homo sapiens
atgttaaatagcatttagag

SEQ ID NO: 8112616 - DNA, 22 bp, Homo sapiens
agaatagttttacttttctatg

SEQ ID NO: 8112617 - DNA, 20 bp, Homo sapiens
agaaggcattcctcattctt

SEQ ID NO: 8112618 - DNA, 22 bp, Homo sapiens
agaatacaattgttcagtaata

SEQ ID NO: 8112619 - DNA, 22 bp, Homo sapiens
agaagagcctggggaccatggc

SEQ ID NO: 8112620 - DNA, 21 bp, Homo sapiens
agaagagaagcaggaccctct

SEQ ID NO: 8112621 - DNA, 22 bp, Homo sapiens
agaagagaactgccaaacactt

SEQ ID NO: 8112622 - DNA, 22 bp, Homo sapiens
agaagagaaatagtgccactgt

SEQ ID NO: 8112623 - DNA, 22 bp, Homo sapiens
agaagaaatgtgaaggccactg

SEQ ID NO: 8112624 - DNA, 22 bp, Homo sapiens
agaagaatacttgatgttcatg

SEQ ID NO: 8112625 - DNA, 17 bp, Homo sapiens
agaatgcaaagcaggct

SEQ ID NO: 8112626 - DNA, 22 bp, Homo sapiens
agaatgataatgccatgatgga

SEQ ID NO: 8112627 - DNA, 22 bp, Homo sapiens
agaatgaattaatcaactggaa

SEQ ID NO: 8112628 - DNA, 22 bp, Homo sapiens
agaatgtgttattagagaagga

SEQ ID NO: 8112629 - DNA, 22 bp, Homo sapiens
agaatgtgttttaacatgggaa

SEQ ID NO: 8112630 - DNA, 22 bp, Homo sapiens
agaatgtgggcacgtatgttct

SEQ ID NO: 8112631 - DNA, 22 bp, Homo sapiens
agaatgtgggggaaaagagtgt

SEQ ID NO: 8112632 - DNA, 22 bp, Homo sapiens
agaatgtgtgcaagcaagtgtg

SEQ ID NO: 8112633 - DNA, 22 bp, Homo sapiens
agaatgtgtgattgaagctctt

SEQ ID NO: 8112634 - DNA, 22 bp, Homo sapiens
agaatgcattttgtgtagctat

SEQ ID NO: 8112635 - DNA, 22 bp, Homo sapiens
agaatgtagtcttggagattta

SEQ ID NO: 8112636 - DNA, 22 bp, Homo sapiens
agaattacataaatacatgaat

SEQ ID NO: 8112637 - DNA, 22 bp, Homo sapiens
atgcaggctcatgaatctgttt

SEQ ID NO: 8112638 - DNA, 21 bp, Homo sapiens
atgcaggctgctcagaagcaa

SEQ ID NO: 8112639 - DNA, 21 bp, Homo sapiens
atgcaggctgctcagaagcaa

SEQ ID NO: 8112640 - DNA, 22 bp, Homo sapiens
atgcaggcagacactgtgggca

SEQ ID NO: 8112641 - DNA, 22 bp, Homo sapiens
agacacagcagtgcctgcctca

SEQ ID NO: 8112642 - DNA, 22 bp, Homo sapiens
atgtccagctcatgatactatc

SEQ ID NO: 8112643 - DNA, 23 bp, Homo sapiens
atgtccaaagggattcgtctgat

SEQ ID NO: 8112644 - DNA, 22 bp, Homo sapiens
atgtccaagtcacagattttca

SEQ ID NO: 8112645 - DNA, 22 bp, Homo sapiens
atgtccaatttctgaggctgct

SEQ ID NO: 8112646 - DNA, 22 bp, Homo sapiens
atgtccaatagaagggagaagc

SEQ ID NO: 8112647 - DNA, 22 bp, Homo sapiens
atgtccaatttcagagtctcat

SEQ ID NO: 8112648 - DNA, 22 bp, Homo sapiens
atgtccagagtaaagcacattc

SEQ ID NO: 8112649 - DNA, 22 bp, Homo sapiens
atgtacagccacttcacagtta

SEQ ID NO: 8112650 - DNA, 22 bp, Homo sapiens
atgtacagccacttcacagtta

SEQ ID NO: 8112651 - DNA, 22 bp, Homo sapiens
atgtacaggatggtgctcatct

SEQ ID NO: 8112652 - DNA, 22 bp, Homo sapiens
atgtacaggtcttggcaaaggg

SEQ ID NO: 8112653 - DNA, 22 bp, Homo sapiens
atgtacagtgataagagggcag

SEQ ID NO: 8112654 - DNA, 22 bp, Homo sapiens
atgtacataaaatgtataatga

SEQ ID NO: 8112655 - DNA, 22 bp, Homo sapiens
atgtacagtggaaactaacaaa

SEQ ID NO: 8112656 - DNA, 22 bp, Homo sapiens
atgtacagtttctagactcaaa

SEQ ID NO: 8112657 - DNA, 22 bp, Homo sapiens
atgtacagtttctagactcaaa

SEQ ID NO: 8112658 - DNA, 22 bp, Homo sapiens
atggttttgaagggaggtcaaa

SEQ ID NO: 8112659 - DNA, 22 bp, Homo sapiens
atggttttgtcctctttggttc

SEQ ID NO: 8112660 - DNA, 22 bp, Homo sapiens
atggtttttcaagtattcagaa

SEQ ID NO: 8112661 - DNA, 22 bp, Homo sapiens
atggttttagaatcaggaaaaa

SEQ ID NO: 8112662 - DNA, 22 bp, Homo sapiens
atggttttcctctgctgcttaa

SEQ ID NO: 8112663 - DNA, 22 bp, Homo sapiens
atggttttatttctctatagct

SEQ ID NO: 8112664 - DNA, 22 bp, Homo sapiens
atggagtgggccaattttagtg

SEQ ID NO: 8112665 - DNA, 22 bp, Homo sapiens
atggagtggggactgcagtgga

SEQ ID NO: 8112666 - DNA, 22 bp, Homo sapiens
atggacagtactgagtggacta

SEQ ID NO: 8112667 - DNA, 22 bp, Homo sapiens
atggcagcatagtggcaagtta

SEQ ID NO: 8112668 - DNA, 22 bp, Homo sapiens
atggcagcctgagcagaggaat

SEQ ID NO: 8112669 - DNA, 22 bp, Homo sapiens
agacgcggtggtgcatgcctgt

SEQ ID NO: 8112670 - DNA, 19 bp, Homo sapiens
atggaaaatgccagactga

SEQ ID NO: 8112671 - DNA, 22 bp, Homo sapiens
atgcagggaggtaagaggtgcc

SEQ ID NO: 8112672 - DNA, 22 bp, Homo sapiens
caatgaaaatgaggactcctgt

SEQ ID NO: 8112673 - DNA, 22 bp, Homo sapiens
agcagcagaagggagacccagg

SEQ ID NO: 8112674 - DNA, 22 bp, Homo sapiens
agcagagtgccccatcacaagg

SEQ ID NO: 8112675 - DNA, 22 bp, Homo sapiens
agcagacaccaggagtaaagaa

SEQ ID NO: 8112676 - DNA, 22 bp, Homo sapiens
caactgaactgatatcaactat

SEQ ID NO: 8112677 - DNA, 22 bp, Homo sapiens
attttctattctgctggtttag

SEQ ID NO: 8112678 - DNA, 22 bp, Homo sapiens
attttctatgttgtaattgtta

SEQ ID NO: 8112679 - DNA, 23 bp, Homo sapiens
agcacagactagaaaggtctttc

SEQ ID NO: 8112680 - DNA, 22 bp, Homo sapiens
agcacagagttgctcactgccg

SEQ ID NO: 8112681 - DNA, 22 bp, Homo sapiens
agcacagagttgcagagagcgt

SEQ ID NO: 8112682 - DNA, 22 bp, Homo sapiens
agcacagaggtggaagtgtata

SEQ ID NO: 8112683 - DNA, 22 bp, Homo sapiens
agcacagagaaactaagacatt

SEQ ID NO: 8112684 - DNA, 22 bp, Homo sapiens
caaatgtttttattctacaaca

SEQ ID NO: 8112685 - DNA, 22 bp, Homo sapiens
agcagaagtgccttagcaatca

SEQ ID NO: 8112686 - DNA, 17 bp, Homo sapiens
agcagaagtcagaggga

SEQ ID NO: 8112687 - DNA, 22 bp, Homo sapiens
agcagaagaaagccacatgact

SEQ ID NO: 8112688 - DNA, 22 bp, Homo sapiens
caaatgatccttgcaagctgtg

SEQ ID NO: 8112689 - DNA, 22 bp, Homo sapiens
caaatgatagagccgattatca

SEQ ID NO: 8112690 - DNA, 22 bp, Homo sapiens
caaatgatactgtttttagtct

SEQ ID NO: 8112691 - DNA, 22 bp, Homo sapiens
caaatgcatagaaagatgaaac

SEQ ID NO: 8112692 - DNA, 22 bp, Homo sapiens
caaatgatgcatggctagtgag

SEQ ID NO: 8112693 - DNA, 22 bp, Homo sapiens
caaatgcaggtcagcaggtgtc

SEQ ID NO: 8112694 - DNA, 22 bp, Homo sapiens
caaatgcaggtcataacctgag

SEQ ID NO: 8112695 - DNA, 22 bp, Homo sapiens
agcagctgtactttcatctgtt

SEQ ID NO: 8112696 - DNA, 22 bp, Homo sapiens
caatgacactctgcacagtgct

SEQ ID NO: 8112697 - DNA, 22 bp, Homo sapiens
cacaggagctgtggggcagtgt

SEQ ID NO: 8112698 - DNA, 18 bp, Homo sapiens
cacaggagccacactcac

SEQ ID NO: 8112699 - DNA, 22 bp, Homo sapiens
cacagtatcttttgagtaagca

SEQ ID NO: 8112700 - DNA, 22 bp, Homo sapiens
cacagtattcactgggcagatt

SEQ ID NO: 8112701 - DNA, 22 bp, Homo sapiens
cacaggagggagcgggcagcca

SEQ ID NO: 8112702 - DNA, 22 bp, Homo sapiens
cacaggagggagcgggcagcca

SEQ ID NO: 8112703 - DNA, 22 bp, Homo sapiens
caccagggctctgagctctgaa

SEQ ID NO: 8112704 - DNA, 22 bp, Homo sapiens
caccaggtgctggaggacatca

SEQ ID NO: 8112705 - DNA, 22 bp, Homo sapiens
caccaggtggaaatgtcacagc

SEQ ID NO: 8112706 - DNA, 22 bp, Homo sapiens
caccagggcagcagcctagtct

SEQ ID NO: 8112707 - DNA, 22 bp, Homo sapiens
caccagggacaatgctaggggt

SEQ ID NO: 8112708 - DNA, 22 bp, Homo sapiens
cagacagacctgcaagggcaca

SEQ ID NO: 8112709 - DNA, 22 bp, Homo sapiens
cagagagggcggccctggcttc

SEQ ID NO: 8112710 - DNA, 22 bp, Homo sapiens
cagagagggcggccctggcttc

SEQ ID NO: 8112711 - DNA, 22 bp, Homo sapiens
cagagaggatggattccatagc

SEQ ID NO: 8112712 - DNA, 22 bp, Homo sapiens
agccagtgatgaagactctgga

SEQ ID NO: 8112713 - DNA, 19 bp, Homo sapiens
agccagtgagcctctgggt

SEQ ID NO: 8112714 - DNA, 22 bp, Homo sapiens
agccccttgctgccctctagag

SEQ ID NO: 8112715 - DNA, 22 bp, Homo sapiens
agccccttccagttctcagatc

SEQ ID NO: 8112716 - DNA, 22 bp, Homo sapiens
cagagctggcggtgagaagaca

SEQ ID NO: 8112717 - DNA, 23 bp, Homo sapiens
cagagctggctcagagctgcctg

SEQ ID NO: 8112718 - DNA, 22 bp, Homo sapiens
cagaagcattccagcaaatagt

SEQ ID NO: 8112719 - DNA, 22 bp, Homo sapiens
cagaagcagtgagagatgtgca

SEQ ID NO: 8112720 - DNA, 22 bp, Homo sapiens
cagaactgttataacagctgtt

SEQ ID NO: 8112721 - DNA, 22 bp, Homo sapiens
agccaggcagggctctcgctct

SEQ ID NO: 8112722 - DNA, 22 bp, Homo sapiens
agccaggcagggctctcgctct

SEQ ID NO: 8112723 - DNA, 22 bp, Homo sapiens
cagacagaaggctccttgaggt

SEQ ID NO: 8112724 - DNA, 22 bp, Homo sapiens
cagacagacagccgtggccacc

SEQ ID NO: 8112725 - DNA, 21 bp, Homo sapiens
agccaggcaagcacccccact

SEQ ID NO: 8112726 - DNA, 22 bp, Homo sapiens
agccaggcagactctctttctt

SEQ ID NO: 8112727 - DNA, 22 bp, Homo sapiens
agccaggcagactctctttctt

SEQ ID NO: 8112728 - DNA, 22 bp, Homo sapiens
agccagctccctcccctgcagg

SEQ ID NO: 8112729 - DNA, 22 bp, Homo sapiens
cagaactgggcagggagcagag

SEQ ID NO: 8112730 - DNA, 22 bp, Homo sapiens
agccacagcaacaagtgcaatt

SEQ ID NO: 8112731 - DNA, 22 bp, Homo sapiens
agccacagcccacaggactctt

SEQ ID NO: 8112732 - DNA, 19 bp, Homo sapiens
agccacagaacttgcagga

SEQ ID NO: 8112733 - DNA, 22 bp, Homo sapiens
agccacacctgtcctgccagct

SEQ ID NO: 8112734 - DNA, 22 bp, Homo sapiens
agccacacagcttaatgacaga

SEQ ID NO: 8112735 - DNA, 22 bp, Homo sapiens
cactgaaaggaaaccagagcat

SEQ ID NO: 8112736 - DNA, 22 bp, Homo sapiens
agccttctaggatgtcatctgc

SEQ ID NO: 8112737 - DNA, 22 bp, Homo sapiens
cagcaggaccattgaggcatca

SEQ ID NO: 8112738 - DNA, 22 bp, Homo sapiens
agctcagaacctcctcatccca

SEQ ID NO: 8112739 - DNA, 22 bp, Homo sapiens
agctcagaactgcagacatgtg

SEQ ID NO: 8112740 - DNA, 22 bp, Homo sapiens
agctcagaagggaggaaatgag

SEQ ID NO: 8112741 - DNA, 22 bp, Homo sapiens
agctcaagttttcaaatattat

SEQ ID NO: 8112742 - DNA, 22 bp, Homo sapiens
cagcaggaggtgagatgtgacc

SEQ ID NO: 8112743 - DNA, 22 bp, Homo sapiens
cagccctgggtccctgccctgg

SEQ ID NO: 8112744 - DNA, 22 bp, Homo sapiens
cagccctggctagggcgagggc

SEQ ID NO: 8112745 - DNA, 22 bp, Homo sapiens
cagccctggcgcccccagatct

SEQ ID NO: 8112746 - DNA, 20 bp, Homo sapiens
agctcctctgcccattcttc

SEQ ID NO: 8112747 - DNA, 22 bp, Homo sapiens
cagccagagaggaaggaatgca

SEQ ID NO: 8112748 - DNA, 22 bp, Homo sapiens
cagaggctcaccagcctttcac

SEQ ID NO: 8112749 - DNA, 22 bp, Homo sapiens
cagaggctaagggtagcttggg

SEQ ID NO: 8112750 - DNA, 22 bp, Homo sapiens
agccctccaaaggttgggggag

SEQ ID NO: 8112751 - DNA, 22 bp, Homo sapiens
agccctcctcacatcagcgtcc

SEQ ID NO: 8112752 - DNA, 22 bp, Homo sapiens
cagcacagtacaaggcacggat

SEQ ID NO: 8112753 - DNA, 22 bp, Homo sapiens
cagcagagcttattaactaaaa

SEQ ID NO: 8112754 - DNA, 22 bp, Homo sapiens
agcctggtttaagcattttata

SEQ ID NO: 8112755 - DNA, 18 bp, Homo sapiens
aggaaagacgaagagggc

SEQ ID NO: 8112756 - DNA, 18 bp, Homo sapiens
aggaaagacgaagagggc

SEQ ID NO: 8112757 - DNA, 22 bp, Homo sapiens
aggaaagatggaaggaggataa

SEQ ID NO: 8112758 - DNA, 22 bp, Homo sapiens
aggaaagatggaaggaggataa

SEQ ID NO: 8112759 - DNA, 22 bp, Homo sapiens
cagggccagcgcccaggcccag

SEQ ID NO: 8112760 - DNA, 22 bp, Homo sapiens
cagggccagccgcagcatccac

SEQ ID NO: 8112761 - DNA, 22 bp, Homo sapiens
aggaaatgctgatgctcctgga

SEQ ID NO: 8112762 - DNA, 22 bp, Homo sapiens
aggaaataggaccagacaaagc

SEQ ID NO: 8112763 - DNA, 22 bp, Homo sapiens
aggaaccagaggttgagcaact

SEQ ID NO: 8112764 - DNA, 22 bp, Homo sapiens
aggaacagaagagcaatgcagg

SEQ ID NO: 8112765 - DNA, 22 bp, Homo sapiens
aggaagctccatgaaggcagag

SEQ ID NO: 8112766 - DNA, 22 bp, Homo sapiens
aggaagctcggagagggcaaat

SEQ ID NO: 8112767 - DNA, 22 bp, Homo sapiens
aggaagctcctggagagccagt

SEQ ID NO: 8112768 - DNA, 22 bp, Homo sapiens
aggaagctcctggagagccagt

SEQ ID NO: 8112769 - DNA, 23 bp, Homo sapiens
agctgggaattttctgaagcttt

SEQ ID NO: 8112770 - DNA, 22 bp, Homo sapiens
caggcctccactccacgcagac

SEQ ID NO: 8112771 - DNA, 22 bp, Homo sapiens
caggcctcaggggctcaggctg

SEQ ID NO: 8112772 - DNA, 22 bp, Homo sapiens
agcttgatagtggctatcaagc

SEQ ID NO: 8112773 - DNA, 22 bp, Homo sapiens
agctgcaggcccatgctcagtc

SEQ ID NO: 8112774 - DNA, 21 bp, Homo sapiens
agctgcaggcctcccagggat

SEQ ID NO: 8112775 - DNA, 21 bp, Homo sapiens
agctgcagcccaaaggcctgt

SEQ ID NO: 8112776 - DNA, 22 bp, Homo sapiens
agctgaggcatggacaggctgc

SEQ ID NO: 8112777 - DNA, 21 bp, Homo sapiens
agctgcagtcaagccagaggt

SEQ ID NO: 8112778 - DNA, 22 bp, Homo sapiens
agctgcagtatgaggctggtgg

SEQ ID NO: 8112779 - DNA, 22 bp, Homo sapiens
agctgcagtaaagctctccagg

SEQ ID NO: 8112780 - DNA, 22 bp, Homo sapiens
agctgcaggcgccggggccgat

SEQ ID NO: 8112781 - DNA, 22 bp, Homo sapiens
agctgcaggcctctcctgggga

SEQ ID NO: 8112782 - DNA, 22 bp, Homo sapiens
agctgcaggttcagcattccac

SEQ ID NO: 8112783 - DNA, 22 bp, Homo sapiens
agctgcagggcttgggtttccc

SEQ ID NO: 8112784 - DNA, 23 bp, Homo sapiens
agctctgctcgggcatgccctgc

SEQ ID NO: 8112785 - DNA, 18 bp, Homo sapiens
agctctcccccacatgcc

SEQ ID NO: 8112786 - DNA, 22 bp, Homo sapiens
agctctcccaccttcttcttac

SEQ ID NO: 8112787 - DNA, 22 bp, Homo sapiens
cagctctcacaccctcctccca

SEQ ID NO: 8112788 - DNA, 22 bp, Homo sapiens
cagctctccaccctcctggttc

SEQ ID NO: 8112789 - DNA, 22 bp, Homo sapiens
caggacagacagaatgcctaac

SEQ ID NO: 8112790 - DNA, 19 bp, Homo sapiens
caggacagacttcaaagcc

SEQ ID NO: 8112791 - DNA, 22 bp, Homo sapiens
caggacagaccaagatcgtgct

SEQ ID NO: 8112792 - DNA, 19 bp, Homo sapiens
caggacagacttcaaagcc

SEQ ID NO: 8112793 - DNA, 22 bp, Homo sapiens
caggacagacagaatgcctaac

SEQ ID NO: 8112794 - DNA, 22 bp, Homo sapiens
caggacagaaataaggaatata

SEQ ID NO: 8112795 - DNA, 22 bp, Homo sapiens
agctggcatactttgctaggaa

SEQ ID NO: 8112796 - DNA, 22 bp, Homo sapiens
caggagggtgtggaaaactggg

SEQ ID NO: 8112797 - DNA, 22 bp, Homo sapiens
caggagtccagagtgtcatttt

SEQ ID NO: 8112798 - DNA, 22 bp, Homo sapiens
agctggctgccttctccttagg

SEQ ID NO: 8112799 - DNA, 22 bp, Homo sapiens
aggaggtgctgtttgtcctgga

SEQ ID NO: 8112800 - DNA, 22 bp, Homo sapiens
aggaggtgctagagaagatgtt

SEQ ID NO: 8112801 - DNA, 22 bp, Homo sapiens
aggaggtggcctgagcgtgccc

SEQ ID NO: 8112802 - DNA, 22 bp, Homo sapiens
aggaggtggctgaacttgaggg

SEQ ID NO: 8112803 - DNA, 22 bp, Homo sapiens
aggaggtggctgaacttgaggg

SEQ ID NO: 8112804 - DNA, 22 bp, Homo sapiens
aggaggtgtagatttcctgtca

SEQ ID NO: 8112805 - DNA, 22 bp, Homo sapiens
catgaaatgttagaattagaca

SEQ ID NO: 8112806 - DNA, 18 bp, Homo sapiens
catgcagagggatctgtg

SEQ ID NO: 8112807 - DNA, 22 bp, Homo sapiens
catgcagaggtgccacgaggct

SEQ ID NO: 8112808 - DNA, 22 bp, Homo sapiens
catgccagttttgagatgcacc

SEQ ID NO: 8112809 - DNA, 22 bp, Homo sapiens
catgccagggcttgctgcctgg

SEQ ID NO: 8112810 - DNA, 22 bp, Homo sapiens
aggcacagcacacctggccccc

SEQ ID NO: 8112811 - DNA, 22 bp, Homo sapiens
catgcctgtatttctgatctat

SEQ ID NO: 8112812 - DNA, 22 bp, Homo sapiens
aggcacagcctcccttcacatg

SEQ ID NO: 8112813 - DNA, 21 bp, Homo sapiens
catttacatgacagattggtt

SEQ ID NO: 8112814 - DNA, 22 bp, Homo sapiens
catttacataacagtaacgctg

SEQ ID NO: 8112815 - DNA, 21 bp, Homo sapiens
aggcagcaggatccagggaca

SEQ ID NO: 8112816 - DNA, 22 bp, Homo sapiens
catttacagtgagagtttttac

SEQ ID NO: 8112817 - DNA, 22 bp, Homo sapiens
aggcagcagaaaacaaatggtt

SEQ ID NO: 8112818 - DNA, 22 bp, Homo sapiens
aggcagcagaaaacaaatggtt

SEQ ID NO: 8112819 - DNA, 22 bp, Homo sapiens
aggcagcagactgttaatcaga

SEQ ID NO: 8112820 - DNA, 22 bp, Homo sapiens
aggcagcagaggttgaggaaag

SEQ ID NO: 8112821 - DNA, 22 bp, Homo sapiens
aggcagcagccacaaggcctga

SEQ ID NO: 8112822 - DNA, 18 bp, Homo sapiens
aggcagcagcatcttctc

SEQ ID NO: 8112823 - DNA, 22 bp, Homo sapiens
aggcagccagttcaggtttctt

SEQ ID NO: 8112824 - DNA, 22 bp, Homo sapiens
aggcagcatttctgcttatcca

SEQ ID NO: 8112825 - DNA, 22 bp, Homo sapiens
aggcagccaatcagaggctgac

SEQ ID NO: 8112826 - DNA, 19 bp, Homo sapiens
aggcagcattctggggctt

SEQ ID NO: 8112827 - DNA, 19 bp, Homo sapiens
aggcagcattctggggctt

SEQ ID NO: 8112828 - DNA, 22 bp, Homo sapiens
catttacatttaaggttaatat

SEQ ID NO: 8112829 - DNA, 19 bp, Homo sapiens
aggcagaggcttggctagc

SEQ ID NO: 8112830 - DNA, 19 bp, Homo sapiens
aggcagcacccagtccttg

SEQ ID NO: 8112831 - DNA, 22 bp, Homo sapiens
cattccttaacgtggggagtct

SEQ ID NO: 8112832 - DNA, 22 bp, Homo sapiens
aggagaagccaagttgtgagca

SEQ ID NO: 8112833 - DNA, 22 bp, Homo sapiens
aggagaagccaagttgtgagca

SEQ ID NO: 8112834 - DNA, 19 bp, Homo sapiens
aggagaagactctctcccc

SEQ ID NO: 8112835 - DNA, 23 bp, Homo sapiens
aggagaagagatttccacatgca

SEQ ID NO: 8112836 - DNA, 19 bp, Homo sapiens
aggagaagactctctcccc

SEQ ID NO: 8112837 - DNA, 22 bp, Homo sapiens
aggagacactgagacttcacca

SEQ ID NO: 8112838 - DNA, 21 bp, Homo sapiens
aggacaggaactggctgaata

SEQ ID NO: 8112839 - DNA, 22 bp, Homo sapiens
aggacagcccttgagagcacat

SEQ ID NO: 8112840 - DNA, 22 bp, Homo sapiens
aggacagcattttcagcatctc

SEQ ID NO: 8112841 - DNA, 22 bp, Homo sapiens
aggacagcatatgggaaccagt

SEQ ID NO: 8112842 - DNA, 21 bp, Homo sapiens
aggacaggaactggctgaata

SEQ ID NO: 8112843 - DNA, 22 bp, Homo sapiens
aggaagctttatgaccagctaa

SEQ ID NO: 8112844 - DNA, 22 bp, Homo sapiens
aggaagctgggaaactgacatt

SEQ ID NO: 8112845 - DNA, 22 bp, Homo sapiens
aggaagctgctggagtagtgtg

SEQ ID NO: 8112846 - DNA, 21 bp, Homo sapiens
aggaagctgcccagatagtag

SEQ ID NO: 8112847 - DNA, 22 bp, Homo sapiens
aggaggaagggaagacaagtaa

SEQ ID NO: 8112848 - DNA, 22 bp, Homo sapiens
aggaggaggctggagtacaccc

SEQ ID NO: 8112849 - DNA, 22 bp, Homo sapiens
aggaggaggctggagtacaccc

SEQ ID NO: 8112850 - DNA, 22 bp, Homo sapiens
aggaggaattgacacagaagcc

SEQ ID NO: 8112851 - DNA, 22 bp, Homo sapiens
aggaggaatacaatccagcagc

SEQ ID NO: 8112852 - DNA, 22 bp, Homo sapiens
aggaggaggtgggacacagtga

SEQ ID NO: 8112853 - DNA, 20 bp, Homo sapiens
aggaggcaatgtagataagc

SEQ ID NO: 8112854 - DNA, 19 bp, Homo sapiens
aggagccttgagcagtgag

SEQ ID NO: 8112855 - DNA, 22 bp, Homo sapiens
aggagagaatgttccaggcttg

SEQ ID NO: 8112856 - DNA, 22 bp, Homo sapiens
aggagaggcatcaagaaaatcg

SEQ ID NO: 8112857 - DNA, 22 bp, Homo sapiens
aggagaggcatcaagaaaatcg

SEQ ID NO: 8112858 - DNA, 22 bp, Homo sapiens
agggaggagtcctcaaagtcat

SEQ ID NO: 8112859 - DNA, 22 bp, Homo sapiens
agggcagagggtgcctcacctg

SEQ ID NO: 8112860 - DNA, 22 bp, Homo sapiens
agggcagccatgagccttcagg

SEQ ID NO: 8112861 - DNA, 22 bp, Homo sapiens
agggcagcagctcctcctagct

SEQ ID NO: 8112862 - DNA, 22 bp, Homo sapiens
agggcagcctctcagcctaggt

SEQ ID NO: 8112863 - DNA, 22 bp, Homo sapiens
agggcagctagctgtagaaaga

SEQ ID NO: 8112864 - DNA, 22 bp, Homo sapiens
agggcagctgtgagccactgtg

SEQ ID NO: 8112865 - DNA, 22 bp, Homo sapiens
agggccagagtctgtgtagata

SEQ ID NO: 8112866 - DNA, 22 bp, Homo sapiens
agggccagccccaccctctctg

SEQ ID NO: 8112867 - DNA, 22 bp, Homo sapiens
ccctggcccctcactccgaggc

SEQ ID NO: 8112868 - DNA, 22 bp, Homo sapiens
ccctgggcagtctgcacttcag

SEQ ID NO: 8112869 - DNA, 22 bp, Homo sapiens
agggccagctgatgagaatgag

SEQ ID NO: 8112870 - DNA, 22 bp, Homo sapiens
agggccagctgatgagaatgag

SEQ ID NO: 8112871 - DNA, 22 bp, Homo sapiens
agggccaggaacacctgaaggg

SEQ ID NO: 8112872 - DNA, 22 bp, Homo sapiens
cctccaggaacttgagagacac

SEQ ID NO: 8112873 - DNA, 22 bp, Homo sapiens
cctccaggctgaatatctagaa

SEQ ID NO: 8112874 - DNA, 22 bp, Homo sapiens
cctcccatccctgcaagagagc

SEQ ID NO: 8112875 - DNA, 22 bp, Homo sapiens
cctccccacagcccaggagact

SEQ ID NO: 8112876 - DNA, 22 bp, Homo sapiens
cctctctccaagggaaatccta

SEQ ID NO: 8112877 - DNA, 22 bp, Homo sapiens
cctctccttgcacccgtcccgc

SEQ ID NO: 8112878 - DNA, 22 bp, Homo sapiens
cctctcctggctgtaggacctc

SEQ ID NO: 8112879 - DNA, 18 bp, Homo sapiens
cctcacagacttccatgt

SEQ ID NO: 8112880 - DNA, 22 bp, Homo sapiens
cctcagagaaatgtctattcaa

SEQ ID NO: 8112881 - DNA, 21 bp, Homo sapiens
cctcagagacagatacgggtg

SEQ ID NO: 8112882 - DNA, 22 bp, Homo sapiens
cctcagagcctccagaaggaat

SEQ ID NO: 8112883 - DNA, 19 bp, Homo sapiens
ccctgggggtttctggtac

SEQ ID NO: 8112884 - DNA, 22 bp, Homo sapiens
ccctgttgggaagagagatggc

SEQ ID NO: 8112885 - DNA, 22 bp, Homo sapiens
cctcaaaggcctggcaccagaa

SEQ ID NO: 8112886 - DNA, 22 bp, Homo sapiens
cccttcagctgagtgggacagc

SEQ ID NO: 8112887 - DNA, 22 bp, Homo sapiens
cccttcagggttaagtagaggg

SEQ ID NO: 8112888 - DNA, 22 bp, Homo sapiens
ccagtttttccagtgctttctg

SEQ ID NO: 8112889 - DNA, 22 bp, Homo sapiens
ccatctccaaataccatcacat

SEQ ID NO: 8112890 - DNA, 22 bp, Homo sapiens
ccatctccactgtccctgtcaa

SEQ ID NO: 8112891 - DNA, 22 bp, Homo sapiens
ccatctccactgtccctgtcaa

SEQ ID NO: 8112892 - DNA, 22 bp, Homo sapiens
ccatctccagtttattcttcct

SEQ ID NO: 8112893 - DNA, 22 bp, Homo sapiens
cccagcctctgtttgctcctct

SEQ ID NO: 8112894 - DNA, 22 bp, Homo sapiens
agggaaggaggttagaacccac

SEQ ID NO: 8112895 - DNA, 22 bp, Homo sapiens
agggaagcttgttactgagaag

SEQ ID NO: 8112896 - DNA, 22 bp, Homo sapiens
agggaagaagctggtagtaggt

SEQ ID NO: 8112897 - DNA, 22 bp, Homo sapiens
agggaagaagctggtagtaggt

SEQ ID NO: 8112898 - DNA, 23 bp, Homo sapiens
agggaagggggcttattccacag

SEQ ID NO: 8112899 - DNA, 22 bp, Homo sapiens
agggaagggcagggtctatgca

SEQ ID NO: 8112900 - DNA, 22 bp, Homo sapiens
agggaaggtagaggtcaccggc

SEQ ID NO: 8112901 - DNA, 22 bp, Homo sapiens
agggaagtgataggacgtctct

SEQ ID NO: 8112902 - DNA, 19 bp, Homo sapiens
agggaatccggctgaggga

SEQ ID NO: 8112903 - DNA, 22 bp, Homo sapiens
agggagaggctgaactatccta

SEQ ID NO: 8112904 - DNA, 22 bp, Homo sapiens
agggagaggttgaaacctcagt

SEQ ID NO: 8112905 - DNA, 22 bp, Homo sapiens
ccccattctggccagcccagct

SEQ ID NO: 8112906 - DNA, 22 bp, Homo sapiens
agggagccaggaacgcaggtcg

SEQ ID NO: 8112907 - DNA, 22 bp, Homo sapiens
agggagcatgggtgaagcaggc

SEQ ID NO: 8112908 - DNA, 22 bp, Homo sapiens
agggagagtagatatcaggtgt

SEQ ID NO: 8112909 - DNA, 22 bp, Homo sapiens
agggagagtttgatgtttcctc

SEQ ID NO: 8112910 - DNA, 22 bp, Homo sapiens
agggagcatgggtgaagcaggc

SEQ ID NO: 8112911 - DNA, 22 bp, Homo sapiens
aggctgagcggggtcccagagc

SEQ ID NO: 8112912 - DNA, 23 bp, Homo sapiens
aggctgagctctcccagcttcag

SEQ ID NO: 8112913 - DNA, 22 bp, Homo sapiens
aggctgagcggggtcccagagc

SEQ ID NO: 8112914 - DNA, 22 bp, Homo sapiens
aggctgagctgacctggtttgg

SEQ ID NO: 8112915 - DNA, 22 bp, Homo sapiens
ccagtgcacagccaggcaggtg

SEQ ID NO: 8112916 - DNA, 22 bp, Homo sapiens
aggctgaggcgggaggatcact

SEQ ID NO: 8112917 - DNA, 22 bp, Homo sapiens
aggctgaggcaggtggatcact

SEQ ID NO: 8112918 - DNA, 22 bp, Homo sapiens
aggctgaggcaggtggatcatt

SEQ ID NO: 8112919 - DNA, 22 bp, Homo sapiens
aggctgagagcaacgtgtcaga

SEQ ID NO: 8112920 - DNA, 22 bp, Homo sapiens
aggctgagcctgggcgtggtgg

SEQ ID NO: 8112921 - DNA, 22 bp, Homo sapiens
aggctgagccacggggctggct

SEQ ID NO: 8112922 - DNA, 22 bp, Homo sapiens
aggctgagataggtggatcatt

SEQ ID NO: 8112923 - DNA, 22 bp, Homo sapiens
aggctgagcaaagggccttacc

SEQ ID NO: 8112924 - DNA, 22 bp, Homo sapiens
aggctctgatcaggtggctgtg

SEQ ID NO: 8112925 - DNA, 22 bp, Homo sapiens
aggctccttgctcacaggctca

SEQ ID NO: 8112926 - DNA, 17 bp, Homo sapiens
aggcctccctccaggcc

SEQ ID NO: 8112927 - DNA, 22 bp, Homo sapiens
ccaggcctagcccctgagggta

SEQ ID NO: 8112928 - DNA, 22 bp, Homo sapiens
aggctccagtctcctctggcag

SEQ ID NO: 8112929 - DNA, 22 bp, Homo sapiens
ccaggcccttgcaagtcccacc

SEQ ID NO: 8112930 - DNA, 22 bp, Homo sapiens
ccaggccctgctcctcacacca

SEQ ID NO: 8112931 - DNA, 22 bp, Homo sapiens
ccaggcccgttcccttctccag

SEQ ID NO: 8112932 - DNA, 22 bp, Homo sapiens
ccaggctctgagaggaatgtga

SEQ ID NO: 8112933 - DNA, 22 bp, Homo sapiens
ccaggctctgagcctcactctt

SEQ ID NO: 8112934 - DNA, 22 bp, Homo sapiens
ccaggctctgcaaaatcaggct

SEQ ID NO: 8112935 - DNA, 22 bp, Homo sapiens
aggctccttgctcacaggctca

SEQ ID NO: 8112936 - DNA, 22 bp, Homo sapiens
ccaggctctatccctccttctt

SEQ ID NO: 8112937 - DNA, 21 bp, Homo sapiens
aggctcccagaaatgggcatc

SEQ ID NO: 8112938 - DNA, 22 bp, Homo sapiens
aggctcccatggtgtggcagga

SEQ ID NO: 8112939 - DNA, 22 bp, Homo sapiens
aggctccattcatgtgaaggca

SEQ ID NO: 8112940 - DNA, 22 bp, Homo sapiens
aggccacaaccaccctgtgccc

SEQ ID NO: 8112941 - DNA, 22 bp, Homo sapiens
aggcccagtgtggcttcctgga

SEQ ID NO: 8112942 - DNA, 22 bp, Homo sapiens
aggcagcctttagacagtctgc

SEQ ID NO: 8112943 - DNA, 22 bp, Homo sapiens
aggcagcctggtttgaatggaa

SEQ ID NO: 8112944 - DNA, 22 bp, Homo sapiens
aggcagcctatggggagctcag

SEQ ID NO: 8112945 - DNA, 22 bp, Homo sapiens
aggcagccatctgcaggaagga

SEQ ID NO: 8112946 - DNA, 22 bp, Homo sapiens
aggcagtggagctggaataggc

SEQ ID NO: 8112947 - DNA, 22 bp, Homo sapiens
ccactgctctgccaggagctgg

SEQ ID NO: 8112948 - DNA, 22 bp, Homo sapiens
ccactgctcctgaccaaggtca

SEQ ID NO: 8112949 - DNA, 23 bp, Homo sapiens
ccactgctttcattttgtcatgg

SEQ ID NO: 8112950 - DNA, 22 bp, Homo sapiens
ccactggcatccagctgccatc

SEQ ID NO: 8112951 - DNA, 19 bp, Homo sapiens
ccactggggctccacatta

SEQ ID NO: 8112952 - DNA, 22 bp, Homo sapiens
aggcattgaggcggatgtggct

SEQ ID NO: 8112953 - DNA, 22 bp, Homo sapiens
aggcagtggctgagaccagggg

SEQ ID NO: 8112954 - DNA, 22 bp, Homo sapiens
aggcagttctcgtgtgtgtccc

SEQ ID NO: 8112955 - DNA, 22 bp, Homo sapiens
aggcagttgtagagagggctct

SEQ ID NO: 8112956 - DNA, 22 bp, Homo sapiens
ctggagggatgtagggtgtatt

SEQ ID NO: 8112957 - DNA, 22 bp, Homo sapiens
ctggagggctgcagcgaggctg

SEQ ID NO: 8112958 - DNA, 22 bp, Homo sapiens
ctggagggctgcagcgaggctg

SEQ ID NO: 8112959 - DNA, 22 bp, Homo sapiens
ctggagggctgcagcgaggctg

SEQ ID NO: 8112960 - DNA, 22 bp, Homo sapiens
ctggagtgaagtctggcagctt

SEQ ID NO: 8112961 - DNA, 22 bp, Homo sapiens
ctggagtgaggtctgggagcct

SEQ ID NO: 8112962 - DNA, 22 bp, Homo sapiens
atacttatgataaataattgct

SEQ ID NO: 8112963 - DNA, 22 bp, Homo sapiens
ctggagtgcaatgaacaaggtc

SEQ ID NO: 8112964 - DNA, 22 bp, Homo sapiens
atacttcctgcttccctgatct

SEQ ID NO: 8112965 - DNA, 22 bp, Homo sapiens
ctggcagctctactcagagcct

SEQ ID NO: 8112966 - DNA, 22 bp, Homo sapiens
ctggcagctctgagtcccttct

SEQ ID NO: 8112967 - DNA, 22 bp, Homo sapiens
ctggcagcggtttgcagcctgg

SEQ ID NO: 8112968 - DNA, 19 bp, Homo sapiens
ctggcagcctgtctgtgtc

SEQ ID NO: 8112969 - DNA, 22 bp, Homo sapiens
ctggagggaggaggctgctatt

SEQ ID NO: 8112970 - DNA, 22 bp, Homo sapiens
ctggagggagttaggacccgga

SEQ ID NO: 8112971 - DNA, 22 bp, Homo sapiens
ctggagggagttaggacccgga

SEQ ID NO: 8112972 - DNA, 22 bp, Homo sapiens
ctggagggatgtagggtgtatt

SEQ ID NO: 8112973 - DNA, 22 bp, Homo sapiens
ctggagggagattcaaaggagg

SEQ ID NO: 8112974 - DNA, 22 bp, Homo sapiens
ctggagggaggaggctgctatt

SEQ ID NO: 8112975 - DNA, 20 bp, Homo sapiens
atacagatggttccagctgg

SEQ ID NO: 8112976 - DNA, 22 bp, Homo sapiens
atacagataatgattgtatgtg

SEQ ID NO: 8112977 - DNA, 22 bp, Homo sapiens
atacagatcccacagcatgtga

SEQ ID NO: 8112978 - DNA, 22 bp, Homo sapiens
atacagatgagatcaggcataa

SEQ ID NO: 8112979 - DNA, 22 bp, Homo sapiens
atacagatgctcatatgcccca

SEQ ID NO: 8112980 - DNA, 22 bp, Homo sapiens
ctggagccccagacagggagag

SEQ ID NO: 8112981 - DNA, 22 bp, Homo sapiens
atacagaattcactacagtttc

SEQ ID NO: 8112982 - DNA, 22 bp, Homo sapiens
ctggagcccaggcctggtgtct

SEQ ID NO: 8112983 - DNA, 22 bp, Homo sapiens
ctgcccacttggccaccttcta

SEQ ID NO: 8112984 - DNA, 22 bp, Homo sapiens
ctgcccagaagcttagagctta

SEQ ID NO: 8112985 - DNA, 22 bp, Homo sapiens
ctgcccagaatcactcactcga

SEQ ID NO: 8112986 - DNA, 22 bp, Homo sapiens
ctgcccagaatcactcactcga

SEQ ID NO: 8112987 - DNA, 22 bp, Homo sapiens
ctgcccagaatcactcactcga

SEQ ID NO: 8112988 - DNA, 22 bp, Homo sapiens
ctgcccacagttctctgccatg

SEQ ID NO: 8112989 - DNA, 22 bp, Homo sapiens
ctgcccacagttctctgccatg

SEQ ID NO: 8112990 - DNA, 22 bp, Homo sapiens
ctgcccaccacacctgctcctg

SEQ ID NO: 8112991 - DNA, 21 bp, Homo sapiens
ctgctctggggaccggctgtg

SEQ ID NO: 8112992 - DNA, 20 bp, Homo sapiens
ctgctctgctttgcaggtgg

SEQ ID NO: 8112993 - DNA, 20 bp, Homo sapiens
ctgctctgctttgcaggtgg

SEQ ID NO: 8112994 - DNA, 22 bp, Homo sapiens
ctgcttcttttgggtaattgat

SEQ ID NO: 8112995 - DNA, 22 bp, Homo sapiens
ctgaggtcagagtttagtctgg

SEQ ID NO: 8112996 - DNA, 22 bp, Homo sapiens
ctgaggggtatccaaggggtaa

SEQ ID NO: 8112997 - DNA, 22 bp, Homo sapiens
ctgccaggcacgtgcagcatca

SEQ ID NO: 8112998 - DNA, 22 bp, Homo sapiens
ctgccaggcctccgctgtcccc

SEQ ID NO: 8112999 - DNA, 22 bp, Homo sapiens
ctgccaggcagcagagggagaa

SEQ ID NO: 8113000 - DNA, 22 bp, Homo sapiens
ctgccaggcagggagatggctg

SEQ ID NO: 8113001 - DNA, 22 bp, Homo sapiens
ctgccaggcctcatcccagcca

SEQ ID NO: 8113002 - DNA, 22 bp, Homo sapiens
ataaatagtgtgtcataaagtc

SEQ ID NO: 8113003 - DNA, 22 bp, Homo sapiens
ataaatatcactgttgtccctc

SEQ ID NO: 8113004 - DNA, 20 bp, Homo sapiens
ataaaataactgccacaaga

SEQ ID NO: 8113005 - DNA, 22 bp, Homo sapiens
atataacatacatacagaaaag

SEQ ID NO: 8113006 - DNA, 22 bp, Homo sapiens
atatataatacttgctgtgggc

SEQ ID NO: 8113007 - DNA, 22 bp, Homo sapiens
atatatacaactagattaaaag

SEQ ID NO: 8113008 - DNA, 22 bp, Homo sapiens
ctgggaatgagcaggtggctcc

SEQ ID NO: 8113009 - DNA, 22 bp, Homo sapiens
ctggcagctggaggctagaggc

SEQ ID NO: 8113010 - DNA, 22 bp, Homo sapiens
atatgtctctgtacaacagtct

SEQ ID NO: 8113011 - DNA, 22 bp, Homo sapiens
atatgtacacttacgttacaaa

SEQ ID NO: 8113012 - DNA, 22 bp, Homo sapiens
atatgtatgtacgcacatattc

SEQ ID NO: 8113013 - DNA, 22 bp, Homo sapiens
atatttcttgagcacctggtat

SEQ ID NO: 8113014 - DNA, 22 bp, Homo sapiens
atatttctctcagacatggaag

SEQ ID NO: 8113015 - DNA, 22 bp, Homo sapiens
atatttagcaacatccttggcc

SEQ ID NO: 8113016 - DNA, 22 bp, Homo sapiens
atatgtttttggaaagaacaca

SEQ ID NO: 8113017 - DNA, 22 bp, Homo sapiens
ctgggcagtggtggcccttccc

SEQ ID NO: 8113018 - DNA, 22 bp, Homo sapiens
ctgggcagtggtggcatctttg

SEQ ID NO: 8113019 - DNA, 22 bp, Homo sapiens
ctgggcaggagggctctatgga

SEQ ID NO: 8113020 - DNA, 22 bp, Homo sapiens
atatgcaagcacatagaatact

SEQ ID NO: 8113021 - DNA, 22 bp, Homo sapiens
ctgggcagtatgaatattcaaa

SEQ ID NO: 8113022 - DNA, 22 bp, Homo sapiens
ctgggcagtatgaatattcaaa

SEQ ID NO: 8113023 - DNA, 22 bp, Homo sapiens
ctgggcaggtatacaaaaaatg

SEQ ID NO: 8113024 - DNA, 22 bp, Homo sapiens
atatatattgcccaggctggtt

SEQ ID NO: 8113025 - DNA, 19 bp, Homo sapiens
atatatgtatacaatgtgg

SEQ ID NO: 8113026 - DNA, 22 bp, Homo sapiens
ctgtctctgtcttaactcccag

SEQ ID NO: 8113027 - DNA, 22 bp, Homo sapiens
ctgtgcagctggcttcctggaa

SEQ ID NO: 8113028 - DNA, 19 bp, Homo sapiens
ctgtgcaggccgggctgag

SEQ ID NO: 8113029 - DNA, 18 bp, Homo sapiens
ctgtgcagcaaactgagc

SEQ ID NO: 8113030 - DNA, 22 bp, Homo sapiens
ctgtcctccggccacctacagt

SEQ ID NO: 8113031 - DNA, 22 bp, Homo sapiens
ctgtcctccggccacctacagt

SEQ ID NO: 8113032 - DNA, 22 bp, Homo sapiens
ctgtcctccggccacctacagt

SEQ ID NO: 8113033 - DNA, 22 bp, Homo sapiens
atcacaggctatgtgggttttg

SEQ ID NO: 8113034 - DNA, 22 bp, Homo sapiens
ctgtcctccagacgacagtccc

SEQ ID NO: 8113035 - DNA, 22 bp, Homo sapiens
ctgtcctcatctgccccaaggg

SEQ ID NO: 8113036 - DNA, 22 bp, Homo sapiens
atcacatatttaagaaacatgt

SEQ ID NO: 8113037 - DNA, 22 bp, Homo sapiens
atcacatatttaagaaacatgt

SEQ ID NO: 8113038 - DNA, 20 bp, Homo sapiens
atcctctcctgattaattca

SEQ ID NO: 8113039 - DNA, 23 bp, Homo sapiens
atcctctctccatcccactgtgc

SEQ ID NO: 8113040 - DNA, 23 bp, Homo sapiens
atcctctctccatcccactgtgc

SEQ ID NO: 8113041 - DNA, 22 bp, Homo sapiens
atcctctctcccataccagtct

SEQ ID NO: 8113042 - DNA, 22 bp, Homo sapiens
atcctctctgttttcgtgtatg

SEQ ID NO: 8113043 - DNA, 22 bp, Homo sapiens
atcctctctgtgacagggaacg

SEQ ID NO: 8113044 - DNA, 22 bp, Homo sapiens
atcctcagcatctagcatgaag

SEQ ID NO: 8113045 - DNA, 19 bp, Homo sapiens
atcctaaatccagtttcta

SEQ ID NO: 8113046 - DNA, 22 bp, Homo sapiens
atccccttcacaccctctgcat

SEQ ID NO: 8113047 - DNA, 22 bp, Homo sapiens
atccccttatcccaggctgagc

SEQ ID NO: 8113048 - DNA, 22 bp, Homo sapiens
atccctctctgcatgactgtgt

SEQ ID NO: 8113049 - DNA, 22 bp, Homo sapiens
atccacagagaggaagaatagt

SEQ ID NO: 8113050 - DNA, 22 bp, Homo sapiens
atccacagaaggaacttgaaag

SEQ ID NO: 8113051 - DNA, 22 bp, Homo sapiens
atccacagtcttagccatcaaa

SEQ ID NO: 8113052 - DNA, 22 bp, Homo sapiens
atccaagcttcaccctaggatg

SEQ ID NO: 8113053 - DNA, 22 bp, Homo sapiens
atccaagaatttgcactcctaa

SEQ ID NO: 8113054 - DNA, 22 bp, Homo sapiens
atccaagcagaatcacgtgaga

SEQ ID NO: 8113055 - DNA, 22 bp, Homo sapiens
ctgtggagtggggagtactggt

SEQ ID NO: 8113056 - DNA, 22 bp, Homo sapiens
ctcagggagtagcacatgtgga

SEQ ID NO: 8113057 - DNA, 22 bp, Homo sapiens
ctcagggagtagcacatgtgga

SEQ ID NO: 8113058 - DNA, 22 bp, Homo sapiens
ctcagtgtctggggccccaggg

SEQ ID NO: 8113059 - DNA, 20 bp, Homo sapiens
ctcagtgtattctgggtgct

SEQ ID NO: 8113060 - DNA, 22 bp, Homo sapiens
ctcagtgtgaatgctcagtaaa

SEQ ID NO: 8113061 - DNA, 22 bp, Homo sapiens
ctcagtgtgagtgagaagtgca

SEQ ID NO: 8113062 - DNA, 23 bp, Homo sapiens
ctcagtgtgtgacccatggcctc

SEQ ID NO: 8113063 - DNA, 20 bp, Homo sapiens
ctcagtgtggcctgagtgtt

SEQ ID NO: 8113064 - DNA, 22 bp, Homo sapiens
agtgacaaaacggaacatacag

SEQ ID NO: 8113065 - DNA, 22 bp, Homo sapiens
ctcagtgttaaagactttccag

SEQ ID NO: 8113066 - DNA, 20 bp, Homo sapiens
agtgacagagactgtgtggc

SEQ ID NO: 8113067 - DNA, 22 bp, Homo sapiens
ctccactctggggtgggtgaga

SEQ ID NO: 8113068 - DNA, 22 bp, Homo sapiens
ctccagaaattcaacagcaaat

SEQ ID NO: 8113069 - DNA, 21 bp, Homo sapiens
agtgacagaggaaggtgcata

SEQ ID NO: 8113070 - DNA, 22 bp, Homo sapiens
ctccactcaccagatgccagga

SEQ ID NO: 8113071 - DNA, 22 bp, Homo sapiens
ctccactcaggtgcttaagttg

SEQ ID NO: 8113072 - DNA, 22 bp, Homo sapiens
ctccactcaccgaggcagagca

SEQ ID NO: 8113073 - DNA, 22 bp, Homo sapiens
ctcagggaggcctctgctggtt

SEQ ID NO: 8113074 - DNA, 22 bp, Homo sapiens
ctcagggaggtcctgtgctgaa

SEQ ID NO: 8113075 - DNA, 22 bp, Homo sapiens
ctcagggaggccctgggaccct

SEQ ID NO: 8113076 - DNA, 22 bp, Homo sapiens
ctcagggaggccaatttatcaa

SEQ ID NO: 8113077 - DNA, 22 bp, Homo sapiens
ctcagggaggccaatttatcaa

SEQ ID NO: 8113078 - DNA, 22 bp, Homo sapiens
ctcagggagagccaagagttcc

SEQ ID NO: 8113079 - DNA, 22 bp, Homo sapiens
ctcagggaggagcttctgggcc

SEQ ID NO: 8113080 - DNA, 22 bp, Homo sapiens
ctcagggacagtatcatttagg

SEQ ID NO: 8113081 - DNA, 22 bp, Homo sapiens
ctcagggacgttagaggacagg

SEQ ID NO: 8113082 - DNA, 22 bp, Homo sapiens
ctcagggacggcatctcatttc

SEQ ID NO: 8113083 - DNA, 22 bp, Homo sapiens
ctcagggacttggatcctggcc

SEQ ID NO: 8113084 - DNA, 22 bp, Homo sapiens
ctcagggacagtatcatttagg

SEQ ID NO: 8113085 - DNA, 22 bp, Homo sapiens
ctcagggacaaggggagacccc

SEQ ID NO: 8113086 - DNA, 22 bp, Homo sapiens
ctcagggacggaggcttgcgga

SEQ ID NO: 8113087 - DNA, 22 bp, Homo sapiens
ctcagggaattgaatctccttg

SEQ ID NO: 8113088 - DNA, 22 bp, Homo sapiens
agtctccttggcctcaatgcct

SEQ ID NO: 8113089 - DNA, 22 bp, Homo sapiens
agtctccttaaatatttcccag

SEQ ID NO: 8113090 - DNA, 22 bp, Homo sapiens
agtctccttaaatatttcccag

SEQ ID NO: 8113091 - DNA, 22 bp, Homo sapiens
ctcagctccaggtgtgcatctt

SEQ ID NO: 8113092 - DNA, 22 bp, Homo sapiens
ctcagcctgtgaagagcagagg

SEQ ID NO: 8113093 - DNA, 22 bp, Homo sapiens
ctcagctccagccctcagcagc

SEQ ID NO: 8113094 - DNA, 22 bp, Homo sapiens
agtatcttaacagcttccagga

SEQ ID NO: 8113095 - DNA, 22 bp, Homo sapiens
agtatcatgttggaattaatca

SEQ ID NO: 8113096 - DNA, 22 bp, Homo sapiens
cgggtggagacagagggcataa

SEQ ID NO: 8113097 - DNA, 22 bp, Homo sapiens
cggggtgggaatagacctgtct

SEQ ID NO: 8113098 - DNA, 22 bp, Homo sapiens
cggggtggcactctaaatagaa

SEQ ID NO: 8113099 - DNA, 22 bp, Homo sapiens
ctcaccatatgactttactaac

SEQ ID NO: 8113100 - DNA, 22 bp, Homo sapiens
ctcagacatctgaaatgggtta

SEQ ID NO: 8113101 - DNA, 22 bp, Homo sapiens
ctcagaggtcaagagcagagct

SEQ ID NO: 8113102 - DNA, 22 bp, Homo sapiens
ctcagaggtcaagagcagagct

SEQ ID NO: 8113103 - DNA, 18 bp, Homo sapiens
ctcctttccctacacctc

SEQ ID NO: 8113104 - DNA, 22 bp, Homo sapiens
ctcgcatgccctgcctcatcca

SEQ ID NO: 8113105 - DNA, 22 bp, Homo sapiens
agtgctgactctgggcacagtg

SEQ ID NO: 8113106 - DNA, 22 bp, Homo sapiens
agtgctgactctgggcacagtg

SEQ ID NO: 8113107 - DNA, 22 bp, Homo sapiens
ctctccatctgtgtgacctccc

SEQ ID NO: 8113108 - DNA, 22 bp, Homo sapiens
ctctcctttcactaaatattct

SEQ ID NO: 8113109 - DNA, 20 bp, Homo sapiens
ctctcccagcacagcttcct

SEQ ID NO: 8113110 - DNA, 22 bp, Homo sapiens
ctctccccacaccctctgcatg

SEQ ID NO: 8113111 - DNA, 22 bp, Homo sapiens
ctctcccagtcaggctcaggat

SEQ ID NO: 8113112 - DNA, 22 bp, Homo sapiens
ctctcccagtcaggctcaggat

SEQ ID NO: 8113113 - DNA, 22 bp, Homo sapiens
ctctgtgagggtctgtacagaa

SEQ ID NO: 8113114 - DNA, 22 bp, Homo sapiens
ctctgtctatcccattctgtgc

SEQ ID NO: 8113115 - DNA, 22 bp, Homo sapiens
ctctgtcccagacccacctctc

SEQ ID NO: 8113116 - DNA, 22 bp, Homo sapiens
ctctgtcctccacctgctttca

SEQ ID NO: 8113117 - DNA, 22 bp, Homo sapiens
ctctgtcctatgcttgatagaa

SEQ ID NO: 8113118 - DNA, 22 bp, Homo sapiens
ctctgctgcccaggcctgctag

SEQ ID NO: 8113119 - DNA, 22 bp, Homo sapiens
ctctgctgcaggaaggcgtgca

SEQ ID NO: 8113120 - DNA, 20 bp, Homo sapiens
ctctctccatctcagtggcc

SEQ ID NO: 8113121 - DNA, 19 bp, Homo sapiens
ctctctccagtggctggct

SEQ ID NO: 8113122 - DNA, 17 bp, Homo sapiens
ctctggaattggtgaag

SEQ ID NO: 8113123 - DNA, 22 bp, Homo sapiens
ctctggagcaccgggctatcca

SEQ ID NO: 8113124 - DNA, 23 bp, Homo sapiens
ctctggagatcctctgcctgggt

SEQ ID NO: 8113125 - DNA, 22 bp, Homo sapiens
ctctggagatggttctcaattg

SEQ ID NO: 8113126 - DNA, 22 bp, Homo sapiens
ctctggagaacgctatggatct

SEQ ID NO: 8113127 - DNA, 19 bp, Homo sapiens
ctctggagaacaatagtgc

SEQ ID NO: 8113128 - DNA, 22 bp, Homo sapiens
ctctggagaactccttgtgtct

SEQ ID NO: 8113129 - DNA, 22 bp, Homo sapiens
ctctggagaggttcccatggga

SEQ ID NO: 8113130 - DNA, 22 bp, Homo sapiens
agtggcttccttcataagcttt

SEQ ID NO: 8113131 - DNA, 22 bp, Homo sapiens
agtggctttttagtggcagatg

SEQ ID NO: 8113132 - DNA, 22 bp, Homo sapiens
ctctggtttttcttccattaag

SEQ ID NO: 8113133 - DNA, 22 bp, Homo sapiens
agtgggagaatgaataagggcc

SEQ ID NO: 8113134 - DNA, 20 bp, Homo sapiens
cctgctgagccagtgtgagg

SEQ ID NO: 8113135 - DNA, 22 bp, Homo sapiens
cctgctgaggtcagccacccaa

SEQ ID NO: 8113136 - DNA, 19 bp, Homo sapiens
cctgctgaagtgatgcagc

SEQ ID NO: 8113137 - DNA, 22 bp, Homo sapiens
cctgctctggtttagtcagtct

SEQ ID NO: 8113138 - DNA, 22 bp, Homo sapiens
cctgctctgccaagtcctcttt

SEQ ID NO: 8113139 - DNA, 22 bp, Homo sapiens
cctgctctccatacactttcta

SEQ ID NO: 8113140 - DNA, 22 bp, Homo sapiens
cctggcagcccagagcgccgct

SEQ ID NO: 8113141 - DNA, 22 bp, Homo sapiens
cctggcagcctcagccaattct

SEQ ID NO: 8113142 - DNA, 22 bp, Homo sapiens
cctggcagcgccgaagctggcc

SEQ ID NO: 8113143 - DNA, 22 bp, Homo sapiens
cctggaaggtgatggtacagca

SEQ ID NO: 8113144 - DNA, 20 bp, Homo sapiens
cctggaagagctccccaggc

SEQ ID NO: 8113145 - DNA, 22 bp, Homo sapiens
cctggaagttggaggttgcagt

SEQ ID NO: 8113146 - DNA, 22 bp, Homo sapiens
cctggctgcttcctctgccatg

SEQ ID NO: 8113147 - DNA, 22 bp, Homo sapiens
cctggcagctcctccccggcgg

SEQ ID NO: 8113148 - DNA, 22 bp, Homo sapiens
cctggcagctaagtgctttgag

SEQ ID NO: 8113149 - DNA, 22 bp, Homo sapiens
cctggcagcgtgccgagctgcg

SEQ ID NO: 8113150 - DNA, 22 bp, Homo sapiens
cctggcagctcctccccggcgg

SEQ ID NO: 8113151 - DNA, 22 bp, Homo sapiens
cctggcagctccgtggccttcc

SEQ ID NO: 8113152 - DNA, 22 bp, Homo sapiens
cctggccacagggctctgcatt

SEQ ID NO: 8113153 - DNA, 22 bp, Homo sapiens
cctgcccaggagtctctctgtg

SEQ ID NO: 8113154 - DNA, 22 bp, Homo sapiens
cctgcccagcttcccgagtgca

SEQ ID NO: 8113155 - DNA, 21 bp, Homo sapiens
cctgccaggaaactgagtgtc

SEQ ID NO: 8113156 - DNA, 22 bp, Homo sapiens
cctctgccacctcccacgaggc

SEQ ID NO: 8113157 - DNA, 22 bp, Homo sapiens
cctgccctatgaccagcttcac

SEQ ID NO: 8113158 - DNA, 22 bp, Homo sapiens
cctgccctagagatgacacaat

SEQ ID NO: 8113159 - DNA, 22 bp, Homo sapiens
cctctctctgcatctggagggc

SEQ ID NO: 8113160 - DNA, 22 bp, Homo sapiens
cctctctctgcatctggagggc

SEQ ID NO: 8113161 - DNA, 22 bp, Homo sapiens
cctctctctcctgcacacacac

SEQ ID NO: 8113162 - DNA, 22 bp, Homo sapiens
cctctctctcctgcacacacac

SEQ ID NO: 8113163 - DNA, 22 bp, Homo sapiens
cctctctccttcctttgccaaa

SEQ ID NO: 8113164 - DNA, 22 bp, Homo sapiens
cctctctccaattttcacctca

SEQ ID NO: 8113165 - DNA, 22 bp, Homo sapiens
cctctctccaattttcacctca

SEQ ID NO: 8113166 - DNA, 22 bp, Homo sapiens
cctctgcagcagagagccagag

SEQ ID NO: 8113167 - DNA, 22 bp, Homo sapiens
cctctgcacttcaccttagctc

SEQ ID NO: 8113168 - DNA, 22 bp, Homo sapiens
agggtctgactgaatggaaaag

SEQ ID NO: 8113169 - DNA, 20 bp, Homo sapiens
agggtctggccctgttcctt

SEQ ID NO: 8113170 - DNA, 22 bp, Homo sapiens
agggtctctacgcactagaggg

SEQ ID NO: 8113171 - DNA, 22 bp, Homo sapiens
agggtctgtggatgcatctggg

SEQ ID NO: 8113172 - DNA, 22 bp, Homo sapiens
agggtctgtgcaagaacacgcc

SEQ ID NO: 8113173 - DNA, 22 bp, Homo sapiens
agggtcagagtcaggtgcagta

SEQ ID NO: 8113174 - DNA, 22 bp, Homo sapiens
agggtctcagagcctgagaacc

SEQ ID NO: 8113175 - DNA, 22 bp, Homo sapiens
agggtcaggttaagggagtcat

SEQ ID NO: 8113176 - DNA, 20 bp, Homo sapiens
agtaggggaatgcaagagca

SEQ ID NO: 8113177 - DNA, 22 bp, Homo sapiens
agtatatatgaggaaccacaaa

SEQ ID NO: 8113178 - DNA, 22 bp, Homo sapiens
cggaggggatacattttctgaa

SEQ ID NO: 8113179 - DNA, 22 bp, Homo sapiens
cggaggggtttgaacagaggag

SEQ ID NO: 8113180 - DNA, 22 bp, Homo sapiens
cggaggttgaggctgcagtgag

SEQ ID NO: 8113181 - DNA, 22 bp, Homo sapiens
cggagcctgcttgttgcagctg

SEQ ID NO: 8113182 - DNA, 22 bp, Homo sapiens
cggagcgctgggggactctgca

SEQ ID NO: 8113183 - DNA, 22 bp, Homo sapiens
cctttgttcattgccttcagtc

SEQ ID NO: 8113184 - DNA, 22 bp, Homo sapiens
cctttgttctgtgtatctttgt

SEQ ID NO: 8113185 - DNA, 22 bp, Homo sapiens
ccttggcatgtggcatgtggct

SEQ ID NO: 8113186 - DNA, 22 bp, Homo sapiens
ccttggcagtggagtgaggtgg

SEQ ID NO: 8113187 - DNA, 22 bp, Homo sapiens
ccttgctcaagctagtgacggg

SEQ ID NO: 8113188 - DNA, 22 bp, Homo sapiens
ccttctctctgaagaccccaaa

SEQ ID NO: 8113189 - DNA, 22 bp, Homo sapiens
aggtgctggagtagaagaaaaa

SEQ ID NO: 8113190 - DNA, 22 bp, Homo sapiens
aggtggcatgagactgtaccag

SEQ ID NO: 8113191 - DNA, 22 bp, Homo sapiens
aggtggctctgacagctctggt

SEQ ID NO: 8113192 - DNA, 22 bp, Homo sapiens
gtattttactgctcaaagctct

SEQ ID NO: 8113193 - DNA, 22 bp, Homo sapiens
gtattttaagtgactactaggt

SEQ ID NO: 8113194 - DNA, 22 bp, Homo sapiens
gtattttaagtgactactaggt

SEQ ID NO: 8113195 - DNA, 22 bp, Homo sapiens
gtattttactgctcaaagctct

SEQ ID NO: 8113196 - DNA, 22 bp, Homo sapiens
gtattttacttacgcatgactt

SEQ ID NO: 8113197 - DNA, 22 bp, Homo sapiens
cagccactgacaggaatggtcc

SEQ ID NO: 8113198 - DNA, 22 bp, Homo sapiens
cagccactgacaggaatggtcc

SEQ ID NO: 8113199 - DNA, 22 bp, Homo sapiens
cagccactggtgccaggctgtt

SEQ ID NO: 8113200 - DNA, 22 bp, Homo sapiens
cagccactgtggaatagccccc

SEQ ID NO: 8113201 - DNA, 22 bp, Homo sapiens
cagccacttgtgatgctgggga

SEQ ID NO: 8113202 - DNA, 22 bp, Homo sapiens
cagccagtggttgaagatgcag

SEQ ID NO: 8113203 - DNA, 22 bp, Homo sapiens
cagccactcggccataaaggct

SEQ ID NO: 8113204 - DNA, 22 bp, Homo sapiens
cagccaccatacagcagaagct

SEQ ID NO: 8113205 - DNA, 22 bp, Homo sapiens
cagccactgaactcctggctat

SEQ ID NO: 8113206 - DNA, 22 bp, Homo sapiens
cagccactctcagacagtccca

SEQ ID NO: 8113207 - DNA, 22 bp, Homo sapiens
cagcccagcagggtctggccct

SEQ ID NO: 8113208 - DNA, 22 bp, Homo sapiens
cagcccagagccagttcccgct

SEQ ID NO: 8113209 - DNA, 21 bp, Homo sapiens
cagcccagagcagtggggcca

SEQ ID NO: 8113210 - DNA, 22 bp, Homo sapiens
ggtggggtcacgacagagggaa

SEQ ID NO: 8113211 - DNA, 21 bp, Homo sapiens
ggtggggtacctaaggtagct

SEQ ID NO: 8113212 - DNA, 21 bp, Homo sapiens
gggtgggaggacacagcaggc

SEQ ID NO: 8113213 - DNA, 20 bp, Homo sapiens
gggtgggagagtctgagggt

SEQ ID NO: 8113214 - DNA, 23 bp, Homo sapiens
cagcaagtgaattccaagagaga

SEQ ID NO: 8113215 - DNA, 22 bp, Homo sapiens
ggtgtgcctggggcttagctgc

SEQ ID NO: 8113216 - DNA, 22 bp, Homo sapiens
ggtgtgccacttcactgagcag

SEQ ID NO: 8113217 - DNA, 22 bp, Homo sapiens
cagcacaattttcaggagtcca

SEQ ID NO: 8113218 - DNA, 22 bp, Homo sapiens
ggttgcaaactcctgggatcaa

SEQ ID NO: 8113219 - DNA, 22 bp, Homo sapiens
gtaaaattgcaattacttttgc

SEQ ID NO: 8113220 - DNA, 22 bp, Homo sapiens
gtatcggtttatttttgggata

SEQ ID NO: 8113221 - DNA, 22 bp, Homo sapiens
cagcagcaaatctagaagagga

SEQ ID NO: 8113222 - DNA, 22 bp, Homo sapiens
cagcagatcaatgtagaatatt

SEQ ID NO: 8113223 - DNA, 22 bp, Homo sapiens
cagcagcaacaacggaagcctt

SEQ ID NO: 8113224 - DNA, 22 bp, Homo sapiens
cagcaggatttgaaaggaagag

SEQ ID NO: 8113225 - DNA, 22 bp, Homo sapiens
gtatttctagtttcttccacag

SEQ ID NO: 8113226 - DNA, 22 bp, Homo sapiens
cagcaggcccaggtgctggtga

SEQ ID NO: 8113227 - DNA, 22 bp, Homo sapiens
gggtgcaggggaccctagggac

SEQ ID NO: 8113228 - DNA, 22 bp, Homo sapiens
cagaggctggatggacttgcct

SEQ ID NO: 8113229 - DNA, 22 bp, Homo sapiens
cagaggtttgatcgagtaggtc

SEQ ID NO: 8113230 - DNA, 21 bp, Homo sapiens
cagaggcctcatgctctgtgc

SEQ ID NO: 8113231 - DNA, 22 bp, Homo sapiens
cagagctggtgtgtcctggcat

SEQ ID NO: 8113232 - DNA, 22 bp, Homo sapiens
cagagctggtaagtggtagagg

SEQ ID NO: 8113233 - DNA, 20 bp, Homo sapiens
ggggaagaaaaggatgtgat

SEQ ID NO: 8113234 - DNA, 22 bp, Homo sapiens
cagagctggtgttacaagtcca

SEQ ID NO: 8113235 - DNA, 22 bp, Homo sapiens
cagaggcaggataagaactgcg

SEQ ID NO: 8113236 - DNA, 22 bp, Homo sapiens
cagagctgcagattgaaggcat

SEQ ID NO: 8113237 - DNA, 19 bp, Homo sapiens
cagagctgctggcctcgtc

SEQ ID NO: 8113238 - DNA, 20 bp, Homo sapiens
ggggaagaaaaggatgtgat

SEQ ID NO: 8113239 - DNA, 22 bp, Homo sapiens
cagagctgacccaaggattgaa

SEQ ID NO: 8113240 - DNA, 22 bp, Homo sapiens
gggcgccgtgggaaacagccgg

SEQ ID NO: 8113241 - DNA, 22 bp, Homo sapiens
cagagccctgcatgctccatct

SEQ ID NO: 8113242 - DNA, 22 bp, Homo sapiens
cagagcccctcagctctctccc

SEQ ID NO: 8113243 - DNA, 22 bp, Homo sapiens
cagagcccctcagctctctccc

SEQ ID NO: 8113244 - DNA, 22 bp, Homo sapiens
cagagcccctcgtctccaccac

SEQ ID NO: 8113245 - DNA, 22 bp, Homo sapiens
cagagcccagggcctacgtccc

SEQ ID NO: 8113246 - DNA, 22 bp, Homo sapiens
cagagcccatcctatactctcc

SEQ ID NO: 8113247 - DNA, 22 bp, Homo sapiens
gggcacagaagtctaagacatc

SEQ ID NO: 8113248 - DNA, 22 bp, Homo sapiens
gggcactgtgttcagagtgcag

SEQ ID NO: 8113249 - DNA, 22 bp, Homo sapiens
cagaagttcatttagcctctct

SEQ ID NO: 8113250 - DNA, 22 bp, Homo sapiens
cagaagttctagatttgagtcc

SEQ ID NO: 8113251 - DNA, 22 bp, Homo sapiens
cagaagttcctatttacctcct

SEQ ID NO: 8113252 - DNA, 22 bp, Homo sapiens
cagaagttagtgtctgccagta

SEQ ID NO: 8113253 - DNA, 22 bp, Homo sapiens
cagaagttatgtcaatggtcat

SEQ ID NO: 8113254 - DNA, 22 bp, Homo sapiens
cagaagttagtcttaattataa

SEQ ID NO: 8113255 - DNA, 22 bp, Homo sapiens
cagaagttagacttcaactaat

SEQ ID NO: 8113256 - DNA, 22 bp, Homo sapiens
cagaagttgccacatgaccctt

SEQ ID NO: 8113257 - DNA, 22 bp, Homo sapiens
cagaagttgatcctgcgtttcc

SEQ ID NO: 8113258 - DNA, 22 bp, Homo sapiens
cagaagttctttcatataggct

SEQ ID NO: 8113259 - DNA, 22 bp, Homo sapiens
cagaagtttgaatgagagcctg

SEQ ID NO: 8113260 - DNA, 22 bp, Homo sapiens
cagaagtttgacatgtttagct

SEQ ID NO: 8113261 - DNA, 22 bp, Homo sapiens
cagaagttggagctttccatca

SEQ ID NO: 8113262 - DNA, 22 bp, Homo sapiens
cagaagttttgctctcttgggt

SEQ ID NO: 8113263 - DNA, 22 bp, Homo sapiens
cagaagtttgaccttggtgggt

SEQ ID NO: 8113264 - DNA, 20 bp, Homo sapiens
cagaagtttgcattggtata

SEQ ID NO: 8113265 - DNA, 22 bp, Homo sapiens
cagaagtttgcaattgtttatt

SEQ ID NO: 8113266 - DNA, 22 bp, Homo sapiens
cagaagtggcctcagagggagt

SEQ ID NO: 8113267 - DNA, 22 bp, Homo sapiens
cagacaggagactggatcatgg

SEQ ID NO: 8113268 - DNA, 19 bp, Homo sapiens
gggagcaggaaagctgtgg

SEQ ID NO: 8113269 - DNA, 22 bp, Homo sapiens
gggaggggttgcatgtttgagt

SEQ ID NO: 8113270 - DNA, 22 bp, Homo sapiens
cagacaggctagccagactcac

SEQ ID NO: 8113271 - DNA, 22 bp, Homo sapiens
gggagggccaggctcacccagg

SEQ ID NO: 8113272 - DNA, 22 bp, Homo sapiens
gggagcaggagcctgcctgcca

SEQ ID NO: 8113273 - DNA, 22 bp, Homo sapiens
gggagggcttggacccagatgt

SEQ ID NO: 8113274 - DNA, 22 bp, Homo sapiens
gggagggccagtgctctctaga

SEQ ID NO: 8113275 - DNA, 22 bp, Homo sapiens
gggatgagagtagggtgtgaaa

SEQ ID NO: 8113276 - DNA, 22 bp, Homo sapiens
gggatgagagtagggtgtgaaa

SEQ ID NO: 8113277 - DNA, 22 bp, Homo sapiens
cagacagggccctgtgatggta

SEQ ID NO: 8113278 - DNA, 22 bp, Homo sapiens
cagacagggacctcgctccaga

SEQ ID NO: 8113279 - DNA, 22 bp, Homo sapiens
gggcacaccttgtctgagcaca

SEQ ID NO: 8113280 - DNA, 18 bp, Homo sapiens
gggcaagcggctgtcacc

SEQ ID NO: 8113281 - DNA, 22 bp, Homo sapiens
gggcaagcagtgaggacagcac

SEQ ID NO: 8113282 - DNA, 22 bp, Homo sapiens
gggcaaggcagaagagttggag

SEQ ID NO: 8113283 - DNA, 22 bp, Homo sapiens
gggaaagacttattttgacttc

SEQ ID NO: 8113284 - DNA, 22 bp, Homo sapiens
gggaaaaataatgcacagatat

SEQ ID NO: 8113285 - DNA, 22 bp, Homo sapiens
cagaaggtttgaaagatgtctt

SEQ ID NO: 8113286 - DNA, 22 bp, Homo sapiens
cagaaggctttgtggagtagac

SEQ ID NO: 8113287 - DNA, 22 bp, Homo sapiens
cagaaggcatagatgaaggcct

SEQ ID NO: 8113288 - DNA, 22 bp, Homo sapiens
gggactggagtagaggccggtg

SEQ ID NO: 8113289 - DNA, 22 bp, Homo sapiens
gggactggatagatgtgggtga

SEQ ID NO: 8113290 - DNA, 22 bp, Homo sapiens
gggactggcacagggctgggag

SEQ ID NO: 8113291 - DNA, 19 bp, Homo sapiens
gggactggaggatgtggag

SEQ ID NO: 8113292 - DNA, 22 bp, Homo sapiens
gggactctgagagcctgagggt

SEQ ID NO: 8113293 - DNA, 22 bp, Homo sapiens
gggacagaaggaagtgagcaca

SEQ ID NO: 8113294 - DNA, 22 bp, Homo sapiens
gggacagacccatgggccaggt

SEQ ID NO: 8113295 - DNA, 22 bp, Homo sapiens
gggacagaggcaaactagcaga

SEQ ID NO: 8113296 - DNA, 22 bp, Homo sapiens
gctgcagactgggaggcaggtg

SEQ ID NO: 8113297 - DNA, 22 bp, Homo sapiens
gctgcagagggaggggctcgca

SEQ ID NO: 8113298 - DNA, 22 bp, Homo sapiens
gctgcagagtgatgaagtgggg

SEQ ID NO: 8113299 - DNA, 22 bp, Homo sapiens
gctcctcttatttcatcagggc

SEQ ID NO: 8113300 - DNA, 22 bp, Homo sapiens
caacatataatatttgagttct

SEQ ID NO: 8113301 - DNA, 22 bp, Homo sapiens
caacatttcaaggtctttagga

SEQ ID NO: 8113302 - DNA, 22 bp, Homo sapiens
caacatttgtgatgagcaaact

SEQ ID NO: 8113303 - DNA, 19 bp, Homo sapiens
caacagtactggtttgtcc

SEQ ID NO: 8113304 - DNA, 22 bp, Homo sapiens
gctgccaccgtggagatgagtg

SEQ ID NO: 8113305 - DNA, 22 bp, Homo sapiens
gctgcaggtttgtctagtctgg

SEQ ID NO: 8113306 - DNA, 22 bp, Homo sapiens
gctgcagccctgcggatcactt

SEQ ID NO: 8113307 - DNA, 22 bp, Homo sapiens
gctgctggagagcgagactgtt

SEQ ID NO: 8113308 - DNA, 22 bp, Homo sapiens
caagagctctccactaggttgg

SEQ ID NO: 8113309 - DNA, 22 bp, Homo sapiens
gctgccttgaacttggcctggg

SEQ ID NO: 8113310 - DNA, 22 bp, Homo sapiens
caaccccactacacgttggaga

SEQ ID NO: 8113311 - DNA, 22 bp, Homo sapiens
caagatcaatcaatactcctta

SEQ ID NO: 8113312 - DNA, 22 bp, Homo sapiens
caagatcaaggtgtcagcaggt

SEQ ID NO: 8113313 - DNA, 22 bp, Homo sapiens
caagatcaaggtatcagcagat

SEQ ID NO: 8113314 - DNA, 22 bp, Homo sapiens
caagatatcaatgacatagtat

SEQ ID NO: 8113315 - DNA, 22 bp, Homo sapiens
caagatatgtcctgttactaag

SEQ ID NO: 8113316 - DNA, 22 bp, Homo sapiens
caagagggaacctaagatgtat

SEQ ID NO: 8113317 - DNA, 22 bp, Homo sapiens
caagctgctataggttgctggg

SEQ ID NO: 8113318 - DNA, 22 bp, Homo sapiens
caagctgcttattctctgctct

SEQ ID NO: 8113319 - DNA, 22 bp, Homo sapiens
caaggacactgagctttgtaaa

SEQ ID NO: 8113320 - DNA, 22 bp, Homo sapiens
caaggacactccctgctgggca

SEQ ID NO: 8113321 - DNA, 22 bp, Homo sapiens
caaggacaacttcatattgtgg

SEQ ID NO: 8113322 - DNA, 21 bp, Homo sapiens
caaggacaggttgcagggcaa

SEQ ID NO: 8113323 - DNA, 22 bp, Homo sapiens
caaggacactgatgttcatcct

SEQ ID NO: 8113324 - DNA, 22 bp, Homo sapiens
caaggacactgatgttcatcct

SEQ ID NO: 8113325 - DNA, 22 bp, Homo sapiens
caaggacagcgtcaggtgcaac

SEQ ID NO: 8113326 - DNA, 22 bp, Homo sapiens
cacaatttgttttatcagtatt

SEQ ID NO: 8113327 - DNA, 22 bp, Homo sapiens
cacacatcaacctagacattgt

SEQ ID NO: 8113328 - DNA, 22 bp, Homo sapiens
cacaatttccttgcttcacttt

SEQ ID NO: 8113329 - DNA, 22 bp, Homo sapiens
cacaatttggacttcactggtt

SEQ ID NO: 8113330 - DNA, 22 bp, Homo sapiens
cacaatttggtgctaaagaaag

SEQ ID NO: 8113331 - DNA, 22 bp, Homo sapiens
cacaatttccaagtcatgttat

SEQ ID NO: 8113332 - DNA, 18 bp, Homo sapiens
cacaatttacagatgaca

SEQ ID NO: 8113333 - DNA, 19 bp, Homo sapiens
cacacccatgcttgccaag

SEQ ID NO: 8113334 - DNA, 19 bp, Homo sapiens
cacacccatgcttgccaag

SEQ ID NO: 8113335 - DNA, 19 bp, Homo sapiens
cacacccatgcttgccaag

SEQ ID NO: 8113336 - DNA, 23 bp, Homo sapiens
cacacccatcactaagagctcct

SEQ ID NO: 8113337 - DNA, 22 bp, Homo sapiens
cacacccaaatttctctctcag

SEQ ID NO: 8113338 - DNA, 22 bp, Homo sapiens
ggaaaagacagaattctagaat

SEQ ID NO: 8113339 - DNA, 19 bp, Homo sapiens
cacaacttcgcttgattcc

SEQ ID NO: 8113340 - DNA, 22 bp, Homo sapiens
ggaaaagacagaattctagaat

SEQ ID NO: 8113341 - DNA, 22 bp, Homo sapiens
cacaagtcattttcagcaggct

SEQ ID NO: 8113342 - DNA, 22 bp, Homo sapiens
cacaatgtctggtaggccactt

SEQ ID NO: 8113343 - DNA, 22 bp, Homo sapiens
cacaatgtggtttgtcatcttt

SEQ ID NO: 8113344 - DNA, 19 bp, Homo sapiens
gctgtctgatgctgaggtc

SEQ ID NO: 8113345 - DNA, 22 bp, Homo sapiens
gctgtctgagaacatggtggaa

SEQ ID NO: 8113346 - DNA, 22 bp, Homo sapiens
caaggcagaattcagactcagg

SEQ ID NO: 8113347 - DNA, 22 bp, Homo sapiens
caaggcagctattgtctccata

SEQ ID NO: 8113348 - DNA, 22 bp, Homo sapiens
gcttccaggggctgtgggctga

SEQ ID NO: 8113349 - DNA, 22 bp, Homo sapiens
gcttctctggctggtctgccac

SEQ ID NO: 8113350 - DNA, 22 bp, Homo sapiens
ggcagccagagggcagctggat

SEQ ID NO: 8113351 - DNA, 20 bp, Homo sapiens
ggcagccaatcagcgtgccg

SEQ ID NO: 8113352 - DNA, 22 bp, Homo sapiens
ggcagagctgcatgagcactca

SEQ ID NO: 8113353 - DNA, 22 bp, Homo sapiens
ggcacaaggtttaaataacatc

SEQ ID NO: 8113354 - DNA, 22 bp, Homo sapiens
ggcacagggtgatgttgcagtt

SEQ ID NO: 8113355 - DNA, 22 bp, Homo sapiens
ggcacagggaggccctggtgtg

SEQ ID NO: 8113356 - DNA, 22 bp, Homo sapiens
ggaggcggaagttgcagtgagc

SEQ ID NO: 8113357 - DNA, 22 bp, Homo sapiens
ggaggcggagcttgcagtgagc

SEQ ID NO: 8113358 - DNA, 22 bp, Homo sapiens
cacactcattagtcatttctct

SEQ ID NO: 8113359 - DNA, 22 bp, Homo sapiens
ggatgtagtgcaaggagtgaat

SEQ ID NO: 8113360 - DNA, 22 bp, Homo sapiens
ggatgtagtgcaaggagtgaat

SEQ ID NO: 8113361 - DNA, 22 bp, Homo sapiens
ggatgtgaatctgggctgagac

SEQ ID NO: 8113362 - DNA, 22 bp, Homo sapiens
ggatgtgaatctgggctgagac

SEQ ID NO: 8113363 - DNA, 22 bp, Homo sapiens
ggagggagcatccccttgctga

SEQ ID NO: 8113364 - DNA, 22 bp, Homo sapiens
ggagggagggctagaccaaaga

SEQ ID NO: 8113365 - DNA, 22 bp, Homo sapiens
ggaggcggaggctgcagtgagc

SEQ ID NO: 8113366 - DNA, 22 bp, Homo sapiens
ggagggagcagagaacccaacc

SEQ ID NO: 8113367 - DNA, 22 bp, Homo sapiens
ggagggagtcagctgattagaa

SEQ ID NO: 8113368 - DNA, 22 bp, Homo sapiens
ggagggagtcagctgattagaa

SEQ ID NO: 8113369 - DNA, 22 bp, Homo sapiens
ggagggaggttagattcaagct

SEQ ID NO: 8113370 - DNA, 22 bp, Homo sapiens
ggagggagtcagctgattagaa

SEQ ID NO: 8113371 - DNA, 22 bp, Homo sapiens
ggatctcagggttctggtctgg

SEQ ID NO: 8113372 - DNA, 22 bp, Homo sapiens
ggatgggaacttggtagggcat

SEQ ID NO: 8113373 - DNA, 22 bp, Homo sapiens
ggatgggaacttggtagggcat

SEQ ID NO: 8113374 - DNA, 22 bp, Homo sapiens
ggcctctctagcatccagcctg

SEQ ID NO: 8113375 - DNA, 22 bp, Homo sapiens
cactgcagatcagaggctgaga

SEQ ID NO: 8113376 - DNA, 22 bp, Homo sapiens
cactgcagcaccatgcagggct

SEQ ID NO: 8113377 - DNA, 22 bp, Homo sapiens
cactgcagccacatagatgacg

SEQ ID NO: 8113378 - DNA, 22 bp, Homo sapiens
cactgcaggtctgagatggggg

SEQ ID NO: 8113379 - DNA, 23 bp, Homo sapiens
cactgcagcgtggtctggcagga

SEQ ID NO: 8113380 - DNA, 23 bp, Homo sapiens
ggcctcctggtctaggctagact

SEQ ID NO: 8113381 - DNA, 23 bp, Homo sapiens
ggcctcctggtctaggctagact

SEQ ID NO: 8113382 - DNA, 22 bp, Homo sapiens
cactgaggactcccacgtaggt

SEQ ID NO: 8113383 - DNA, 22 bp, Homo sapiens
cactgagaccagagtccctgac

SEQ ID NO: 8113384 - DNA, 22 bp, Homo sapiens
cactgactaagtttgtgaaggt

SEQ ID NO: 8113385 - DNA, 22 bp, Homo sapiens
cactgcagtaactctaggactg

SEQ ID NO: 8113386 - DNA, 22 bp, Homo sapiens
cactgcagtcttcatcaaccaa

SEQ ID NO: 8113387 - DNA, 22 bp, Homo sapiens
cactgcagttccccagtgcgca

SEQ ID NO: 8113388 - DNA, 22 bp, Homo sapiens
ggctagggatctagaccaggac

SEQ ID NO: 8113389 - DNA, 19 bp, Homo sapiens
ggctcaagcatccaggtag

SEQ ID NO: 8113390 - DNA, 22 bp, Homo sapiens
cactggaaccatccacatagtg

SEQ ID NO: 8113391 - DNA, 21 bp, Homo sapiens
cactggaattttctgtgacat

SEQ ID NO: 8113392 - DNA, 22 bp, Homo sapiens
cactggaatgttgaggagacaa

SEQ ID NO: 8113393 - DNA, 22 bp, Homo sapiens
cacccacattccatcactctgc

SEQ ID NO: 8113394 - DNA, 22 bp, Homo sapiens
cacccacatggaaattcacagt

SEQ ID NO: 8113395 - DNA, 22 bp, Homo sapiens
cacccacattccatcactctgc

SEQ ID NO: 8113396 - DNA, 20 bp, Homo sapiens
ggcagttaaggcacagtcat

SEQ ID NO: 8113397 - DNA, 22 bp, Homo sapiens
caccatcagcagcaggtgtcaa

SEQ ID NO: 8113398 - DNA, 22 bp, Homo sapiens
ggcagctgattagcatcaagga

SEQ ID NO: 8113399 - DNA, 22 bp, Homo sapiens
cacccctcgccactgcccttgt

SEQ ID NO: 8113400 - DNA, 22 bp, Homo sapiens
cacccctacctgagtcaggagt

SEQ ID NO: 8113401 - DNA, 20 bp, Homo sapiens
caccctcccagcacctatgc

SEQ ID NO: 8113402 - DNA, 22 bp, Homo sapiens
caccctgactggccctgcagga

SEQ ID NO: 8113403 - DNA, 22 bp, Homo sapiens
cacccaggttggagtgcagtgg

SEQ ID NO: 8113404 - DNA, 22 bp, Homo sapiens
caccccacatcaggcttctcca

SEQ ID NO: 8113405 - DNA, 22 bp, Homo sapiens
ggcatatttatgagaacttagt

SEQ ID NO: 8113406 - DNA, 22 bp, Homo sapiens
cacccaggctggaatgcaatgg

SEQ ID NO: 8113407 - DNA, 22 bp, Homo sapiens
cacccaggctagagtgcagtgg

SEQ ID NO: 8113408 - DNA, 22 bp, Homo sapiens
atggtactggggtcccggagtt

SEQ ID NO: 8113409 - DNA, 22 bp, Homo sapiens
atggtattaggaaatctgaatg

SEQ ID NO: 8113410 - DNA, 19 bp, Homo sapiens
atggtacagtgtacacttg

SEQ ID NO: 8113411 - DNA, 22 bp, Homo sapiens
atggctggatttgatccatggg

SEQ ID NO: 8113412 - DNA, 22 bp, Homo sapiens
atgtacatgtgaatttaggcaa

SEQ ID NO: 8113413 - DNA, 18 bp, Homo sapiens
atgtacatgtactcacac

SEQ ID NO: 8113414 - DNA, 22 bp, Homo sapiens
atgtacatttgtagtaatatca

SEQ ID NO: 8113415 - DNA, 22 bp, Homo sapiens
gaggggagcatgatctagattg

SEQ ID NO: 8113416 - DNA, 16 bp, Homo sapiens
gaggggagcagtaggc

SEQ ID NO: 8113417 - DNA, 22 bp, Homo sapiens
gaggggagacagggaaatcagt

SEQ ID NO: 8113418 - DNA, 22 bp, Homo sapiens
atgtgtgtacacacgtgactct

SEQ ID NO: 8113419 - DNA, 22 bp, Homo sapiens
atgtgtgtatgtgcctatatct

SEQ ID NO: 8113420 - DNA, 19 bp, Homo sapiens
atgtctgggtaacagctgc

SEQ ID NO: 8113421 - DNA, 22 bp, Homo sapiens
atgtctggaggtcatctggtta

SEQ ID NO: 8113422 - DNA, 22 bp, Homo sapiens
atgtctggctaaaatccctggt

SEQ ID NO: 8113423 - DNA, 22 bp, Homo sapiens
atgtctggtggtcgatgctaca

SEQ ID NO: 8113424 - DNA, 22 bp, Homo sapiens
atgtcttttatgattacgggat

SEQ ID NO: 8113425 - DNA, 22 bp, Homo sapiens
atgtctttgccatagttcatat

SEQ ID NO: 8113426 - DNA, 22 bp, Homo sapiens
gagaggaactcccagtgcctgg

SEQ ID NO: 8113427 - DNA, 22 bp, Homo sapiens
gagagctgtggtttgaccaggc

SEQ ID NO: 8113428 - DNA, 22 bp, Homo sapiens
gagaggaaagaaccaatgaccc

SEQ ID NO: 8113429 - DNA, 22 bp, Homo sapiens
atggcagagggattgaacagct

SEQ ID NO: 8113430 - DNA, 22 bp, Homo sapiens
gagcagtgactggagcatgaga

SEQ ID NO: 8113431 - DNA, 22 bp, Homo sapiens
gacagaggcaagaccagaagcc

SEQ ID NO: 8113432 - DNA, 22 bp, Homo sapiens
gacagagttgttgatgtatgct

SEQ ID NO: 8113433 - DNA, 22 bp, Homo sapiens
atggaaaaggctgatttcatta

SEQ ID NO: 8113434 - DNA, 22 bp, Homo sapiens
atgccactgcgctccagcctgg

SEQ ID NO: 8113435 - DNA, 22 bp, Homo sapiens
atgccactgtactcaacaatag

SEQ ID NO: 8113436 - DNA, 22 bp, Homo sapiens
atggaagagtccccatggatga

SEQ ID NO: 8113437 - DNA, 22 bp, Homo sapiens
atggaagactaacagaaacatg

SEQ ID NO: 8113438 - DNA, 22 bp, Homo sapiens
atggaagacagataaggcagaa

SEQ ID NO: 8113439 - DNA, 22 bp, Homo sapiens
atggaagacagataaggcagaa

SEQ ID NO: 8113440 - DNA, 22 bp, Homo sapiens
atggagccattcctgaagactt

SEQ ID NO: 8113441 - DNA, 20 bp, Homo sapiens
atggaggaagggcaagagaa

SEQ ID NO: 8113442 - DNA, 22 bp, Homo sapiens
atggagagagaaggcttgctgt

SEQ ID NO: 8113443 - DNA, 22 bp, Homo sapiens
atgcagatggtggatggagaaa

SEQ ID NO: 8113444 - DNA, 22 bp, Homo sapiens
atgcagagcttccagtggcctg

SEQ ID NO: 8113445 - DNA, 21 bp, Homo sapiens
atgcagagaactccagggaag

SEQ ID NO: 8113446 - DNA, 22 bp, Homo sapiens
atgcagaagaaaccatggcttc

SEQ ID NO: 8113447 - DNA, 22 bp, Homo sapiens
atgcacttcaagcatctctctg

SEQ ID NO: 8113448 - DNA, 22 bp, Homo sapiens
atgcacagtatgtagggtctat

SEQ ID NO: 8113449 - DNA, 22 bp, Homo sapiens
atgcaaagcacacacagaatcc

SEQ ID NO: 8113450 - DNA, 22 bp, Homo sapiens
atgcaaaagtaattgcaatttt

SEQ ID NO: 8113451 - DNA, 22 bp, Homo sapiens
atgcaaaataaggcagaaacat

SEQ ID NO: 8113452 - DNA, 22 bp, Homo sapiens
atgcaaagcaccacactaagat

SEQ ID NO: 8113453 - DNA, 23 bp, Homo sapiens
atgcaggacttataaggtaaggt

SEQ ID NO: 8113454 - DNA, 22 bp, Homo sapiens
atgcagcttcaggattatgatg

SEQ ID NO: 8113455 - DNA, 22 bp, Homo sapiens
atgcatatgccgtagaataagt

SEQ ID NO: 8113456 - DNA, 22 bp, Homo sapiens
gacactgaccccaagctgtcct

SEQ ID NO: 8113457 - DNA, 22 bp, Homo sapiens
atgcatggtctgaagtcaacct

SEQ ID NO: 8113458 - DNA, 22 bp, Homo sapiens
atgaggcaggtggaggctgcca

SEQ ID NO: 8113459 - DNA, 22 bp, Homo sapiens
atgaggcagctgctggagaacg

SEQ ID NO: 8113460 - DNA, 22 bp, Homo sapiens
atgaggaacagacttgctggat

SEQ ID NO: 8113461 - DNA, 22 bp, Homo sapiens
atgattttttctaacacagtcg

SEQ ID NO: 8113462 - DNA, 22 bp, Homo sapiens
atgatacaagcaaaactaatca

SEQ ID NO: 8113463 - DNA, 22 bp, Homo sapiens
gaaagcagtaaatgggtcccat

SEQ ID NO: 8113464 - DNA, 22 bp, Homo sapiens
atctttttgacatggtgatggt

SEQ ID NO: 8113465 - DNA, 22 bp, Homo sapiens
atctttttatctgtttggaaca

SEQ ID NO: 8113466 - DNA, 22 bp, Homo sapiens
atctttttactaacactgctta

SEQ ID NO: 8113467 - DNA, 22 bp, Homo sapiens
atctttttactaacactgctta

SEQ ID NO: 8113468 - DNA, 22 bp, Homo sapiens
atgaaatatcttgaagaaattc

SEQ ID NO: 8113469 - DNA, 22 bp, Homo sapiens
atgaaacagtgtgtatagcaaa

SEQ ID NO: 8113470 - DNA, 22 bp, Homo sapiens
atgaaacatgagaaatggagag

SEQ ID NO: 8113471 - DNA, 22 bp, Homo sapiens
atgaaaagggagtgatatttgt

SEQ ID NO: 8113472 - DNA, 22 bp, Homo sapiens
atgaaaagcataaacgctgaag

SEQ ID NO: 8113473 - DNA, 22 bp, Homo sapiens
atgaaatatcttgaagaaattc

SEQ ID NO: 8113474 - DNA, 22 bp, Homo sapiens
atgaaatgattgaaatctttac

SEQ ID NO: 8113475 - DNA, 22 bp, Homo sapiens
atgaaatattctttggtaagaa

SEQ ID NO: 8113476 - DNA, 22 bp, Homo sapiens
cttttattttgaattaagggct

SEQ ID NO: 8113477 - DNA, 20 bp, Homo sapiens
cttggtggctctgggaagtg

SEQ ID NO: 8113478 - DNA, 22 bp, Homo sapiens
cttggcagagggctgggctcag

SEQ ID NO: 8113479 - DNA, 22 bp, Homo sapiens
atctagattaggtataagagct

SEQ ID NO: 8113480 - DNA, 22 bp, Homo sapiens
atctattatgctgagaaactgt

SEQ ID NO: 8113481 - DNA, 22 bp, Homo sapiens
cttgcctttgtcttcaaaggct

SEQ ID NO: 8113482 - DNA, 22 bp, Homo sapiens
cttgccttcagtgtccctttgc

SEQ ID NO: 8113483 - DNA, 22 bp, Homo sapiens
cttgccttctgttcctatagaa

SEQ ID NO: 8113484 - DNA, 22 bp, Homo sapiens
cttgccttcagtgtccctttgc

SEQ ID NO: 8113485 - DNA, 22 bp, Homo sapiens
cttgccttcagtccatcagtca

SEQ ID NO: 8113486 - DNA, 22 bp, Homo sapiens
cttgccttcttttcctatagaa

SEQ ID NO: 8113487 - DNA, 22 bp, Homo sapiens
atttaaattttctgatggagag

SEQ ID NO: 8113488 - DNA, 22 bp, Homo sapiens
atttaattgttcttctggctat

SEQ ID NO: 8113489 - DNA, 22 bp, Homo sapiens
atttaattaatcatggtgaatt

SEQ ID NO: 8113490 - DNA, 22 bp, Homo sapiens
atttaatttacatttgacagag

SEQ ID NO: 8113491 - DNA, 22 bp, Homo sapiens
atttaatttacatttgacagag

SEQ ID NO: 8113492 - DNA, 22 bp, Homo sapiens
atttaatttatagatgtggata

SEQ ID NO: 8113493 - DNA, 22 bp, Homo sapiens
atttaatttggagagagaaacc

SEQ ID NO: 8113494 - DNA, 22 bp, Homo sapiens
atttaatttgtgtctttagctg

SEQ ID NO: 8113495 - DNA, 21 bp, Homo sapiens
atttacaaaacagtcccttcc

SEQ ID NO: 8113496 - DNA, 22 bp, Homo sapiens
atttaattttctcaacagtgct

SEQ ID NO: 8113497 - DNA, 22 bp, Homo sapiens
atttaattttctcaacagtgct

SEQ ID NO: 8113498 - DNA, 22 bp, Homo sapiens
attggaaataggccttgtacag

SEQ ID NO: 8113499 - DNA, 22 bp, Homo sapiens
attggaaatactgagagataaa

SEQ ID NO: 8113500 - DNA, 22 bp, Homo sapiens
attggaaataggccttgtacag

SEQ ID NO: 8113501 - DNA, 22 bp, Homo sapiens
attggaaatgctacaagttaga

SEQ ID NO: 8113502 - DNA, 22 bp, Homo sapiens
attggaaagttcttaagggata

SEQ ID NO: 8113503 - DNA, 22 bp, Homo sapiens
attggaaagtgtctagtgtggt

SEQ ID NO: 8113504 - DNA, 21 bp, Homo sapiens
attggaaaaggtagttggctt

SEQ ID NO: 8113505 - DNA, 22 bp, Homo sapiens
attggaaaatatggtttctgga

SEQ ID NO: 8113506 - DNA, 22 bp, Homo sapiens
attggaaatacagtagaaaaat

SEQ ID NO: 8113507 - DNA, 22 bp, Homo sapiens
atttacagaagcatgtaatagc

SEQ ID NO: 8113508 - DNA, 22 bp, Homo sapiens
atttacagaaacttaatcatag

SEQ ID NO: 8113509 - DNA, 22 bp, Homo sapiens
atttagaaccccttccaacctg

SEQ ID NO: 8113510 - DNA, 22 bp, Homo sapiens
atttagaaattccaaaagtatt

SEQ ID NO: 8113511 - DNA, 22 bp, Homo sapiens
atttagaagctaatttttcaga

SEQ ID NO: 8113512 - DNA, 22 bp, Homo sapiens
atttagaactttgtttgccaat

SEQ ID NO: 8113513 - DNA, 22 bp, Homo sapiens
atttctaaagagggtggtttgg

SEQ ID NO: 8113514 - DNA, 22 bp, Homo sapiens
atttcatatgtatcacctagcc

SEQ ID NO: 8113515 - DNA, 22 bp, Homo sapiens
gcgagggcacgcggttgaaggc

SEQ ID NO: 8113516 - DNA, 22 bp, Homo sapiens
gctcaggactggaggagcgggg

SEQ ID NO: 8113517 - DNA, 22 bp, Homo sapiens
gctcaggaaggctcaaccagga

SEQ ID NO: 8113518 - DNA, 22 bp, Homo sapiens
gctcaggcaggagtgcagtggc

SEQ ID NO: 8113519 - DNA, 22 bp, Homo sapiens
gctcaggatcagccacctcttt

SEQ ID NO: 8113520 - DNA, 22 bp, Homo sapiens
gcgagcctctggagtcctctgg

SEQ ID NO: 8113521 - DNA, 19 bp, Homo sapiens
gcgaggaagtcactgtggt

SEQ ID NO: 8113522 - DNA, 22 bp, Homo sapiens
gcgagcctctggagtcctctgg

SEQ ID NO: 8113523 - DNA, 19 bp, Homo sapiens
gcgaggaagtcactgtggc

SEQ ID NO: 8113524 - DNA, 22 bp, Homo sapiens
caaaacattctctgcagcaggg

SEQ ID NO: 8113525 - DNA, 22 bp, Homo sapiens
gcctgtctgcagggctgtcatt

SEQ ID NO: 8113526 - DNA, 22 bp, Homo sapiens
gcctgtctcttggaacttggta

SEQ ID NO: 8113527 - DNA, 22 bp, Homo sapiens
atttctcagtgtacattatgtt

SEQ ID NO: 8113528 - DNA, 21 bp, Homo sapiens
gcctctccaaatcctgccttc

SEQ ID NO: 8113529 - DNA, 21 bp, Homo sapiens
gcctctccaaatcctgccttc

SEQ ID NO: 8113530 - DNA, 22 bp, Homo sapiens
gcctctcctggagaaggcaggg

SEQ ID NO: 8113531 - DNA, 22 bp, Homo sapiens
gcctctccgagccactgcctct

SEQ ID NO: 8113532 - DNA, 22 bp, Homo sapiens
gcctctccgagccactgcctct

SEQ ID NO: 8113533 - DNA, 22 bp, Homo sapiens
gcctctcctcttaataccatta

SEQ ID NO: 8113534 - DNA, 22 bp, Homo sapiens
gcctcctgttatgccatgtgcc

SEQ ID NO: 8113535 - DNA, 22 bp, Homo sapiens
gcctctctctacccagtatgat

SEQ ID NO: 8113536 - DNA, 22 bp, Homo sapiens
gcctgctggctgtccattgcag

SEQ ID NO: 8113537 - DNA, 22 bp, Homo sapiens
gcctggctgaggcctctgctaa

SEQ ID NO: 8113538 - DNA, 22 bp, Homo sapiens
attagacatcatatgattcagc

SEQ ID NO: 8113539 - DNA, 22 bp, Homo sapiens
attagaagatagtgatttctgc

SEQ ID NO: 8113540 - DNA, 21 bp, Homo sapiens
attagaaggtatttagggcct

SEQ ID NO: 8113541 - DNA, 22 bp, Homo sapiens
attattaaagctacatcaagga

SEQ ID NO: 8113542 - DNA, 22 bp, Homo sapiens
attattaaagctacatcaagga

SEQ ID NO: 8113543 - DNA, 22 bp, Homo sapiens
gatgatgagataaggataactt

SEQ ID NO: 8113544 - DNA, 22 bp, Homo sapiens
gatgatgaggccatgaggcagg

SEQ ID NO: 8113545 - DNA, 22 bp, Homo sapiens
attacaataatacatgctcatt

SEQ ID NO: 8113546 - DNA, 18 bp, Homo sapiens
gatgaggctgtctgagaa

SEQ ID NO: 8113547 - DNA, 22 bp, Homo sapiens
attaaaagcttcccaagagtta

SEQ ID NO: 8113548 - DNA, 22 bp, Homo sapiens
atgttttctagagtttaaaatc

SEQ ID NO: 8113549 - DNA, 22 bp, Homo sapiens
atgttttatgcttcagatgagg

SEQ ID NO: 8113550 - DNA, 23 bp, Homo sapiens
atgttttatgtctctagctgcca

SEQ ID NO: 8113551 - DNA, 22 bp, Homo sapiens
atgttttatgttccactcaagg

SEQ ID NO: 8113552 - DNA, 22 bp, Homo sapiens
atgttttatattttgcagcagt

SEQ ID NO: 8113553 - DNA, 22 bp, Homo sapiens
atgttttatattttgcagcagt

SEQ ID NO: 8113554 - DNA, 22 bp, Homo sapiens
atgtgttttggtaatttctgct

SEQ ID NO: 8113555 - DNA, 22 bp, Homo sapiens
atgtgtttggttatatggtatt

SEQ ID NO: 8113556 - DNA, 22 bp, Homo sapiens
attcttaattccaaagactgag

SEQ ID NO: 8113557 - DNA, 22 bp, Homo sapiens
attctcagatcttagaggaata

SEQ ID NO: 8113558 - DNA, 22 bp, Homo sapiens
attctagatgctgtaagtagca

SEQ ID NO: 8113559 - DNA, 22 bp, Homo sapiens
attgcagaacatgaggtcttct

SEQ ID NO: 8113560 - DNA, 22 bp, Homo sapiens
attgcttacagctatttctgta

SEQ ID NO: 8113561 - DNA, 20 bp, Homo sapiens
attgaaatttttctgagatt

SEQ ID NO: 8113562 - DNA, 22 bp, Homo sapiens
attgaaattgatgaaattcttg

SEQ ID NO: 8113563 - DNA, 22 bp, Homo sapiens
attgaagatcagggaaagattc

SEQ ID NO: 8113564 - DNA, 22 bp, Homo sapiens
attgaagattctgacatcagaa

SEQ ID NO: 8113565 - DNA, 22 bp, Homo sapiens
attctagaaggcaaagcaaggg

SEQ ID NO: 8113566 - DNA, 22 bp, Homo sapiens
gcagcaggcttttcataccttg

SEQ ID NO: 8113567 - DNA, 22 bp, Homo sapiens
gcagcagggtgccagctttgca

SEQ ID NO: 8113568 - DNA, 22 bp, Homo sapiens
attcctcatttgttgagaacca

SEQ ID NO: 8113569 - DNA, 22 bp, Homo sapiens
attcctcattatttactgagga

SEQ ID NO: 8113570 - DNA, 22 bp, Homo sapiens
attcctcattatttactgagga

SEQ ID NO: 8113571 - DNA, 22 bp, Homo sapiens
attcctcagcaggccttttgtt

SEQ ID NO: 8113572 - DNA, 20 bp, Homo sapiens
attcctcagccccagcctca

SEQ ID NO: 8113573 - DNA, 19 bp, Homo sapiens
attcctcaaggacagaaat

SEQ ID NO: 8113574 - DNA, 22 bp, Homo sapiens
attcctcaaaggtagcccatta

SEQ ID NO: 8113575 - DNA, 22 bp, Homo sapiens
gcagcaggcatggccgccctgg

SEQ ID NO: 8113576 - DNA, 22 bp, Homo sapiens
gcagcaggcacttaccgttgct

SEQ ID NO: 8113577 - DNA, 22 bp, Homo sapiens
attcctcatttgttgagaacca

SEQ ID NO: 8113578 - DNA, 22 bp, Homo sapiens
attatttacagtgtgctcgaag

SEQ ID NO: 8113579 - DNA, 22 bp, Homo sapiens
catgcaaaggtcaagatcagga

SEQ ID NO: 8113580 - DNA, 22 bp, Homo sapiens
catggctgcgagaagagtgggt

SEQ ID NO: 8113581 - DNA, 19 bp, Homo sapiens
catggctgctgcttgggag

SEQ ID NO: 8113582 - DNA, 22 bp, Homo sapiens
catggctgaacactcagtgact

SEQ ID NO: 8113583 - DNA, 22 bp, Homo sapiens
catgcacaacatactcaagagg

SEQ ID NO: 8113584 - DNA, 22 bp, Homo sapiens
catgcacacacagttctaatta

SEQ ID NO: 8113585 - DNA, 22 bp, Homo sapiens
catgtcttccttgcacacacac

SEQ ID NO: 8113586 - DNA, 22 bp, Homo sapiens
catgtctttctcatcacatcta

SEQ ID NO: 8113587 - DNA, 22 bp, Homo sapiens
tccagcccagctcctctcagaa

SEQ ID NO: 8113588 - DNA, 22 bp, Homo sapiens
catgtacatgcctactatcaat

SEQ ID NO: 8113589 - DNA, 22 bp, Homo sapiens
tcagttcttattttcatgaata

SEQ ID NO: 8113590 - DNA, 22 bp, Homo sapiens
catccattcattaattctaaag

SEQ ID NO: 8113591 - DNA, 19 bp, Homo sapiens
tcatgtctctcatctgtga

SEQ ID NO: 8113592 - DNA, 22 bp, Homo sapiens
tcatttgttctcattctctact

SEQ ID NO: 8113593 - DNA, 22 bp, Homo sapiens
catgatggttcttacaaaggtg

SEQ ID NO: 8113594 - DNA, 22 bp, Homo sapiens
catgatggatgtgcacttcgct

SEQ ID NO: 8113595 - DNA, 22 bp, Homo sapiens
catgagaatgaagaagacttaa

SEQ ID NO: 8113596 - DNA, 22 bp, Homo sapiens
tcagggccatcttttgcctcaa

SEQ ID NO: 8113597 - DNA, 22 bp, Homo sapiens
catcacagatgttgtgtggagt

SEQ ID NO: 8113598 - DNA, 22 bp, Homo sapiens
catcacaggcattttgagtgtc

SEQ ID NO: 8113599 - DNA, 22 bp, Homo sapiens
catccagggcagccatggcctg

SEQ ID NO: 8113600 - DNA, 22 bp, Homo sapiens
catccactagaatgacagagtt

SEQ ID NO: 8113601 - DNA, 22 bp, Homo sapiens
catatcataggtcttggataat

SEQ ID NO: 8113602 - DNA, 22 bp, Homo sapiens
catatcttctgacatgatcagg

SEQ ID NO: 8113603 - DNA, 22 bp, Homo sapiens
catatcttatggttttctaagt

SEQ ID NO: 8113604 - DNA, 20 bp, Homo sapiens
catatatacctagaagtgga

SEQ ID NO: 8113605 - DNA, 22 bp, Homo sapiens
catatattctggttttcactgg

SEQ ID NO: 8113606 - DNA, 20 bp, Homo sapiens
catatatacctagaagtgga

SEQ ID NO: 8113607 - DNA, 22 bp, Homo sapiens
catagaatgtaataaagagtag

SEQ ID NO: 8113608 - DNA, 22 bp, Homo sapiens
tcaggaagtggtaaaggatgtt

SEQ ID NO: 8113609 - DNA, 22 bp, Homo sapiens
tcagaagtaggagacattcttg

SEQ ID NO: 8113610 - DNA, 22 bp, Homo sapiens
tcagaagtattatgctaaagga

SEQ ID NO: 8113611 - DNA, 22 bp, Homo sapiens
tcagaagtcccttgcatcttag

SEQ ID NO: 8113612 - DNA, 22 bp, Homo sapiens
tcagaagtcacttaggaaaggg

SEQ ID NO: 8113613 - DNA, 22 bp, Homo sapiens
tcagaagtcatgctcagtctgt

SEQ ID NO: 8113614 - DNA, 22 bp, Homo sapiens
tcagaagtccaattttcgcacc

SEQ ID NO: 8113615 - DNA, 22 bp, Homo sapiens
tcagaagtccaataccatggga

SEQ ID NO: 8113616 - DNA, 22 bp, Homo sapiens
tcagaagtcccagaattcacat

SEQ ID NO: 8113617 - DNA, 22 bp, Homo sapiens
tcagaagtccccagtcaaggag

SEQ ID NO: 8113618 - DNA, 22 bp, Homo sapiens
tcagaagtactgtgctacaata

SEQ ID NO: 8113619 - DNA, 22 bp, Homo sapiens
tcagaagtagctccccttcatt

SEQ ID NO: 8113620 - DNA, 22 bp, Homo sapiens
tcagaagtaaggttctcccaag

SEQ ID NO: 8113621 - DNA, 22 bp, Homo sapiens
tcagaagtctggactgcttctc

SEQ ID NO: 8113622 - DNA, 22 bp, Homo sapiens
cagtttctgtggtctcttttca

SEQ ID NO: 8113623 - DNA, 22 bp, Homo sapiens
cagtttgcaaatgacttacaga

SEQ ID NO: 8113624 - DNA, 22 bp, Homo sapiens
cagtttggtcatttgtcttgta

SEQ ID NO: 8113625 - DNA, 22 bp, Homo sapiens
cataatttttttaagtcagaac

SEQ ID NO: 8113626 - DNA, 22 bp, Homo sapiens
catagaaaagagtaggtaatgt

SEQ ID NO: 8113627 - DNA, 22 bp, Homo sapiens
tcagccctgggcttcctcatgg

SEQ ID NO: 8113628 - DNA, 22 bp, Homo sapiens
tcagctcttaaccctctggcct

SEQ ID NO: 8113629 - DNA, 22 bp, Homo sapiens
tcagaaatttaggctggacttg

SEQ ID NO: 8113630 - DNA, 22 bp, Homo sapiens
tcagaaatactatcagcttttg

SEQ ID NO: 8113631 - DNA, 22 bp, Homo sapiens
tcagaaatgatcgttattcatt

SEQ ID NO: 8113632 - DNA, 22 bp, Homo sapiens
tcacttccctcttcagctccca

SEQ ID NO: 8113633 - DNA, 22 bp, Homo sapiens
tcactccatctttgctactggt

SEQ ID NO: 8113634 - DNA, 22 bp, Homo sapiens
tcactcaggttcatgtctttgt

SEQ ID NO: 8113635 - DNA, 22 bp, Homo sapiens
tcactcatattatctctccaca

SEQ ID NO: 8113636 - DNA, 22 bp, Homo sapiens
tcactcaatatcccagtggggc

SEQ ID NO: 8113637 - DNA, 19 bp, Homo sapiens
cagtgcccgacgcaggtct

SEQ ID NO: 8113638 - DNA, 22 bp, Homo sapiens
cagtgcccaagatgtgccatgc

SEQ ID NO: 8113639 - DNA, 22 bp, Homo sapiens
tcaccaggctggagtgcagtgg

SEQ ID NO: 8113640 - DNA, 22 bp, Homo sapiens
tcaccaggctcctgttaagatg

SEQ ID NO: 8113641 - DNA, 22 bp, Homo sapiens
tcaccaggctggaatgcagtgg

SEQ ID NO: 8113642 - DNA, 22 bp, Homo sapiens
tcaccagggagcttgtcctctg

SEQ ID NO: 8113643 - DNA, 22 bp, Homo sapiens
tatttagaacagacaatagaaa

SEQ ID NO: 8113644 - DNA, 22 bp, Homo sapiens
tatttagaacagacaatagaaa

SEQ ID NO: 8113645 - DNA, 20 bp, Homo sapiens
tatttacaacttagagcctc

SEQ ID NO: 8113646 - DNA, 22 bp, Homo sapiens
cagtcctggggaccaggctgag

SEQ ID NO: 8113647 - DNA, 22 bp, Homo sapiens
cagtcctgggcaggtcaggcca

SEQ ID NO: 8113648 - DNA, 22 bp, Homo sapiens
cagtcctggggaccaggctgag

SEQ ID NO: 8113649 - DNA, 22 bp, Homo sapiens
cagtgcaattacaagctaattc

SEQ ID NO: 8113650 - DNA, 22 bp, Homo sapiens
cagtgcaagctgatactgaggt

SEQ ID NO: 8113651 - DNA, 22 bp, Homo sapiens
cagtgattttggtctgccttag

SEQ ID NO: 8113652 - DNA, 22 bp, Homo sapiens
cagtgatttcagaatggattat

SEQ ID NO: 8113653 - DNA, 22 bp, Homo sapiens
cagtgattaaaacatgacagcc

SEQ ID NO: 8113654 - DNA, 22 bp, Homo sapiens
cagtgattcacgcccttgggcc

SEQ ID NO: 8113655 - DNA, 22 bp, Homo sapiens
cagtgattattgattgcattca

SEQ ID NO: 8113656 - DNA, 19 bp, Homo sapiens
cagtgattaattcatctta

SEQ ID NO: 8113657 - DNA, 22 bp, Homo sapiens
cagtgattaagatacccaggct

SEQ ID NO: 8113658 - DNA, 22 bp, Homo sapiens
cagtctcctgggggctgttgtt

SEQ ID NO: 8113659 - DNA, 22 bp, Homo sapiens
tatgtttttcaagtgcacacta

SEQ ID NO: 8113660 - DNA, 22 bp, Homo sapiens
tatgtggaaaatgcacttaaaa

SEQ ID NO: 8113661 - DNA, 22 bp, Homo sapiens
tatggccatgatggccaattgg

SEQ ID NO: 8113662 - DNA, 22 bp, Homo sapiens
caggtctgtattaacagagggt

SEQ ID NO: 8113663 - DNA, 22 bp, Homo sapiens
tatacagtcttttgctatattc

SEQ ID NO: 8113664 - DNA, 22 bp, Homo sapiens
caggggccggctgtccgtgccc

SEQ ID NO: 8113665 - DNA, 22 bp, Homo sapiens
caggggcctggctgtctaggaa

SEQ ID NO: 8113666 - DNA, 22 bp, Homo sapiens
cagggtgcttccgtggagctgt

SEQ ID NO: 8113667 - DNA, 22 bp, Homo sapiens
tataatgttttccatggactga

SEQ ID NO: 8113668 - DNA, 18 bp, Homo sapiens
tcctggtggagaagtggt

SEQ ID NO: 8113669 - DNA, 22 bp, Homo sapiens
tcctggtgaggctagaagtgtc

SEQ ID NO: 8113670 - DNA, 22 bp, Homo sapiens
ccactctgctgtgctccatgat

SEQ ID NO: 8113671 - DNA, 21 bp, Homo sapiens
ccactctgagtgttgaacaga

SEQ ID NO: 8113672 - DNA, 22 bp, Homo sapiens
ccactctgattttggctccact

SEQ ID NO: 8113673 - DNA, 22 bp, Homo sapiens
ccactctgattttggctccact

SEQ ID NO: 8113674 - DNA, 22 bp, Homo sapiens
ccacagtcctggcttctgtctg

SEQ ID NO: 8113675 - DNA, 22 bp, Homo sapiens
ccactgccgatgttccatcttg

SEQ ID NO: 8113676 - DNA, 22 bp, Homo sapiens
ccactgccccctgaagaccagg

SEQ ID NO: 8113677 - DNA, 22 bp, Homo sapiens
ccactgcccaccccgacgtcta

SEQ ID NO: 8113678 - DNA, 22 bp, Homo sapiens
ccactgccccctgaagaccagg

SEQ ID NO: 8113679 - DNA, 22 bp, Homo sapiens
ccactgccagctttgtcctccc

SEQ ID NO: 8113680 - DNA, 22 bp, Homo sapiens
ccagaagtggctttctcaggga

SEQ ID NO: 8113681 - DNA, 22 bp, Homo sapiens
ccagaagtcaatgcagatgtga

SEQ ID NO: 8113682 - DNA, 22 bp, Homo sapiens
ccagaatcatcatctgaagcct

SEQ ID NO: 8113683 - DNA, 22 bp, Homo sapiens
ccagaggagttgaggctttggg

SEQ ID NO: 8113684 - DNA, 22 bp, Homo sapiens
ccagaggagggctctgatgagg

SEQ ID NO: 8113685 - DNA, 22 bp, Homo sapiens
ccagaggagcaggctggctcca

SEQ ID NO: 8113686 - DNA, 22 bp, Homo sapiens
ccagaggagatgcctcctctgt

SEQ ID NO: 8113687 - DNA, 22 bp, Homo sapiens
ccagaggacttgggggctgaat

SEQ ID NO: 8113688 - DNA, 22 bp, Homo sapiens
tctctacctgctccatagccat

SEQ ID NO: 8113689 - DNA, 22 bp, Homo sapiens
ccagatggaaatgatgttctca

SEQ ID NO: 8113690 - DNA, 18 bp, Homo sapiens
ccagatggccagtctgct

SEQ ID NO: 8113691 - DNA, 22 bp, Homo sapiens
ccagatgggctttagcaaatga

SEQ ID NO: 8113692 - DNA, 20 bp, Homo sapiens
ccagatggtccctgtgaaaa

SEQ ID NO: 8113693 - DNA, 22 bp, Homo sapiens
ccagatggtccagagtctagcc

SEQ ID NO: 8113694 - DNA, 20 bp, Homo sapiens
tctctctggttggaggagct

SEQ ID NO: 8113695 - DNA, 22 bp, Homo sapiens
ccagaattcagaaagggcataa

SEQ ID NO: 8113696 - DNA, 22 bp, Homo sapiens
ccagaatgttctagagccaccc

SEQ ID NO: 8113697 - DNA, 22 bp, Homo sapiens
ccagaatttgaactcaggcaat

SEQ ID NO: 8113698 - DNA, 22 bp, Homo sapiens
ccagaggaaaaatatctcccta

SEQ ID NO: 8113699 - DNA, 22 bp, Homo sapiens
tctccatctgtcattcttgtcc

SEQ ID NO: 8113700 - DNA, 22 bp, Homo sapiens
tctcccaagtgaccaggaaaga

SEQ ID NO: 8113701 - DNA, 22 bp, Homo sapiens
tctctaaatgctctcccatccc

SEQ ID NO: 8113702 - DNA, 22 bp, Homo sapiens
tctctaaatctggttcacttgc

SEQ ID NO: 8113703 - DNA, 22 bp, Homo sapiens
tctctaaatacagatgtcatgg

SEQ ID NO: 8113704 - DNA, 22 bp, Homo sapiens
tctctaaataacacttattgaa

SEQ ID NO: 8113705 - DNA, 22 bp, Homo sapiens
tctctaaagcactttaaccaca

SEQ ID NO: 8113706 - DNA, 22 bp, Homo sapiens
catttacagcagactgatgaaa

SEQ ID NO: 8113707 - DNA, 22 bp, Homo sapiens
catttatataaaatgtccagaa

SEQ ID NO: 8113708 - DNA, 22 bp, Homo sapiens
catttagagaagattacaagga

SEQ ID NO: 8113709 - DNA, 22 bp, Homo sapiens
tccctgctgcactcacacctac

SEQ ID NO: 8113710 - DNA, 22 bp, Homo sapiens
tccctgctaattggaatgtata

SEQ ID NO: 8113711 - DNA, 22 bp, Homo sapiens
tccctgctgggagatgacctta

SEQ ID NO: 8113712 - DNA, 19 bp, Homo sapiens
ccaaaagcaattccaagta

SEQ ID NO: 8113713 - DNA, 22 bp, Homo sapiens
ccaaagtctggagcagcagagc

SEQ ID NO: 8113714 - DNA, 22 bp, Homo sapiens
tccctgcctgacagcacccacc

SEQ ID NO: 8113715 - DNA, 22 bp, Homo sapiens
ccaagggccatcctatcacttg

SEQ ID NO: 8113716 - DNA, 23 bp, Homo sapiens
tcctcccaaatttcagcctcatt

SEQ ID NO: 8113717 - DNA, 22 bp, Homo sapiens
tcctccccaaagcccagcctgg

SEQ ID NO: 8113718 - DNA, 20 bp, Homo sapiens
tcctgcagttcctaggaggg

SEQ ID NO: 8113719 - DNA, 22 bp, Homo sapiens
ccacagctgaaagcagaggctc

SEQ ID NO: 8113720 - DNA, 22 bp, Homo sapiens
ccacagctctagctccctccca

SEQ ID NO: 8113721 - DNA, 22 bp, Homo sapiens
ccacagcaccgctgccagtccc

SEQ ID NO: 8113722 - DNA, 22 bp, Homo sapiens
ccagctagtaagcacctgcatc

SEQ ID NO: 8113723 - DNA, 22 bp, Homo sapiens
tctgatagataccatgaggcaa

SEQ ID NO: 8113724 - DNA, 22 bp, Homo sapiens
tctgcctcctgcttgtcccgac

SEQ ID NO: 8113725 - DNA, 22 bp, Homo sapiens
tctgcctcgctaacagcagcca

SEQ ID NO: 8113726 - DNA, 22 bp, Homo sapiens
tctgccagctctgtgggtctcg

SEQ ID NO: 8113727 - DNA, 22 bp, Homo sapiens
ccagctcctcttgtctctagca

SEQ ID NO: 8113728 - DNA, 22 bp, Homo sapiens
ccagctcctgggtcttagtcag

SEQ ID NO: 8113729 - DNA, 21 bp, Homo sapiens
ccagctccaggaccttggatc

SEQ ID NO: 8113730 - DNA, 22 bp, Homo sapiens
tctgaaatgaactcttgaactt

SEQ ID NO: 8113731 - DNA, 22 bp, Homo sapiens
tctgaaatctgtaagcactagc

SEQ ID NO: 8113732 - DNA, 22 bp, Homo sapiens
tctgaaatctaatgctctgtgg

SEQ ID NO: 8113733 - DNA, 22 bp, Homo sapiens
tctgaaatattggtaatacttt

SEQ ID NO: 8113734 - DNA, 22 bp, Homo sapiens
tctgaaatattggtaatacttt

SEQ ID NO: 8113735 - DNA, 22 bp, Homo sapiens
tctgaaatcctttatcttggct

SEQ ID NO: 8113736 - DNA, 22 bp, Homo sapiens
tctgaaataggcttcttttggt

SEQ ID NO: 8113737 - DNA, 22 bp, Homo sapiens
tctgaaatatattttgagtgtt

SEQ ID NO: 8113738 - DNA, 22 bp, Homo sapiens
tctgaaataggagccatgtaga

SEQ ID NO: 8113739 - DNA, 22 bp, Homo sapiens
tctgaaataggaaagcaaatgg

SEQ ID NO: 8113740 - DNA, 22 bp, Homo sapiens
tctctctgtgacagctttgctg

SEQ ID NO: 8113741 - DNA, 22 bp, Homo sapiens
ccagcccctatcctcgctccac

SEQ ID NO: 8113742 - DNA, 22 bp, Homo sapiens
ccagcccctatcctcgctccac

SEQ ID NO: 8113743 - DNA, 22 bp, Homo sapiens
ccagccccgggaacctggccgt

SEQ ID NO: 8113744 - DNA, 21 bp, Homo sapiens
ccagcccagctgtgtcccagc

SEQ ID NO: 8113745 - DNA, 21 bp, Homo sapiens
ccagcccagcctccttctctt

SEQ ID NO: 8113746 - DNA, 22 bp, Homo sapiens
ccagccataatacgaacccagc

SEQ ID NO: 8113747 - DNA, 23 bp, Homo sapiens
ccagctgtgcctggcccaggagc

SEQ ID NO: 8113748 - DNA, 22 bp, Homo sapiens
ccagctggtttatattccccac

SEQ ID NO: 8113749 - DNA, 22 bp, Homo sapiens
tctggctttattttcatcatct

SEQ ID NO: 8113750 - DNA, 22 bp, Homo sapiens
tctggcttgaacaattaggtaa

SEQ ID NO: 8113751 - DNA, 22 bp, Homo sapiens
tctggagctggagggcaaggca

SEQ ID NO: 8113752 - DNA, 19 bp, Homo sapiens
tctggagctgatgcaggtg

SEQ ID NO: 8113753 - DNA, 22 bp, Homo sapiens
tctggaggcaactaacctagtt

SEQ ID NO: 8113754 - DNA, 22 bp, Homo sapiens
tctggcttcaagtcccagctct

SEQ ID NO: 8113755 - DNA, 19 bp, Homo sapiens
tctgcctctggtcaggctc

SEQ ID NO: 8113756 - DNA, 22 bp, Homo sapiens
tctgcctctttcaggcctggca

SEQ ID NO: 8113757 - DNA, 22 bp, Homo sapiens
tctgcctctttcaggcctggca

SEQ ID NO: 8113758 - DNA, 22 bp, Homo sapiens
tctgcctttgctttggctgtca

SEQ ID NO: 8113759 - DNA, 22 bp, Homo sapiens
tctggagcgaggtccctgtctg

SEQ ID NO: 8113760 - DNA, 22 bp, Homo sapiens
ccaggaagctgtgagattccaa

SEQ ID NO: 8113761 - DNA, 22 bp, Homo sapiens
ccaggaagcggtgagggctgcc

SEQ ID NO: 8113762 - DNA, 22 bp, Homo sapiens
ccaggaggcagaagttgcagtg

SEQ ID NO: 8113763 - DNA, 22 bp, Homo sapiens
ccaggaggatggttgttaggtg

SEQ ID NO: 8113764 - DNA, 22 bp, Homo sapiens
ccagcttcatgggcatgcacca

SEQ ID NO: 8113765 - DNA, 23 bp, Homo sapiens
ccaggaagaggccatccacagtc

SEQ ID NO: 8113766 - DNA, 22 bp, Homo sapiens
tctgtcactattggccagaaca

SEQ ID NO: 8113767 - DNA, 22 bp, Homo sapiens
ccaggaggcagaggttgtagtg

SEQ ID NO: 8113768 - DNA, 22 bp, Homo sapiens
ccaggaggcagaagttgcagtg

SEQ ID NO: 8113769 - DNA, 22 bp, Homo sapiens
ccaggaggcggaaggtacagtg

SEQ ID NO: 8113770 - DNA, 18 bp, Homo sapiens
tctgtctgtgttgtcttt

SEQ ID NO: 8113771 - DNA, 22 bp, Homo sapiens
tctgtctgggtgcctcgagtac

SEQ ID NO: 8113772 - DNA, 22 bp, Homo sapiens
taaactcttctgtagaatcaga

SEQ ID NO: 8113773 - DNA, 22 bp, Homo sapiens
caggacagttggcatctgctgc

SEQ ID NO: 8113774 - DNA, 22 bp, Homo sapiens
caggacagtgcaggtccatcct

SEQ ID NO: 8113775 - DNA, 22 bp, Homo sapiens
caggacagttggcatctgctgc

SEQ ID NO: 8113776 - DNA, 19 bp, Homo sapiens
caggacagtttgccaagaa

SEQ ID NO: 8113777 - DNA, 22 bp, Homo sapiens
caggacatcttctgtgttttta

SEQ ID NO: 8113778 - DNA, 22 bp, Homo sapiens
caggacagtttgctttgccctg

SEQ ID NO: 8113779 - DNA, 22 bp, Homo sapiens
caggacatctacccagtgtttc

SEQ ID NO: 8113780 - DNA, 22 bp, Homo sapiens
caggagaagtctctagggggtg

SEQ ID NO: 8113781 - DNA, 22 bp, Homo sapiens
caggacccatcagccaggcact

SEQ ID NO: 8113782 - DNA, 22 bp, Homo sapiens
caggagaagtctctagggggtg

SEQ ID NO: 8113783 - DNA, 22 bp, Homo sapiens
gttttctaccagggaagagagt

SEQ ID NO: 8113784 - DNA, 22 bp, Homo sapiens
taaaatagcttatgtcttttga

SEQ ID NO: 8113785 - DNA, 22 bp, Homo sapiens
taaaaatcttatgaatggcaag

SEQ ID NO: 8113786 - DNA, 22 bp, Homo sapiens
taaaatgacttcctccaacatc

SEQ ID NO: 8113787 - DNA, 22 bp, Homo sapiens
caggacaccttagctaaaattc

SEQ ID NO: 8113788 - DNA, 22 bp, Homo sapiens
caggaatgtttgtgctccttta

SEQ ID NO: 8113789 - DNA, 22 bp, Homo sapiens
caggaatgtatgatacagtggt

SEQ ID NO: 8113790 - DNA, 18 bp, Homo sapiens
caggaatggatgggattt

SEQ ID NO: 8113791 - DNA, 22 bp, Homo sapiens
caggaatgcattctagaatggc

SEQ ID NO: 8113792 - DNA, 22 bp, Homo sapiens
caggaatgccaaccagtgcatg

SEQ ID NO: 8113793 - DNA, 22 bp, Homo sapiens
caggacagctcaacacctcctc

SEQ ID NO: 8113794 - DNA, 22 bp, Homo sapiens
caggacagctcaacacctcctc

SEQ ID NO: 8113795 - DNA, 22 bp, Homo sapiens
caggacaggagtggggtcaaag

SEQ ID NO: 8113796 - DNA, 22 bp, Homo sapiens
caggacagctgggccaccacca

SEQ ID NO: 8113797 - DNA, 22 bp, Homo sapiens
caggacagtataggctttagga

SEQ ID NO: 8113798 - DNA, 22 bp, Homo sapiens
caggacagtataggctttagga

SEQ ID NO: 8113799 - DNA, 22 bp, Homo sapiens
caggacaggtgttctagatcag

SEQ ID NO: 8113800 - DNA, 22 bp, Homo sapiens
caggacaggtgttctagatcag

SEQ ID NO: 8113801 - DNA, 22 bp, Homo sapiens
caggacaggccctgtggggtct

SEQ ID NO: 8113802 - DNA, 22 bp, Homo sapiens
gttttccatggaggtctgacct

SEQ ID NO: 8113803 - DNA, 22 bp, Homo sapiens
gttttccactggattgtttgga

SEQ ID NO: 8113804 - DNA, 22 bp, Homo sapiens
caggaaggaaagggtgtggaga

SEQ ID NO: 8113805 - DNA, 22 bp, Homo sapiens
caggaatgaaaggtcagggttg

SEQ ID NO: 8113806 - DNA, 22 bp, Homo sapiens
caggaagtggctgggctgggtt

SEQ ID NO: 8113807 - DNA, 22 bp, Homo sapiens
caggaagtggggtcatggagta

SEQ ID NO: 8113808 - DNA, 22 bp, Homo sapiens
caggaagtctttgcccaggcca

SEQ ID NO: 8113809 - DNA, 22 bp, Homo sapiens
caggaagtagagttggccagcc

SEQ ID NO: 8113810 - DNA, 23 bp, Homo sapiens
caggaagcagatggggtagaaga

SEQ ID NO: 8113811 - DNA, 22 bp, Homo sapiens
caggaagctcttagcagtcacc

SEQ ID NO: 8113812 - DNA, 22 bp, Homo sapiens
gtttggagccccgtgggaagga

SEQ ID NO: 8113813 - DNA, 22 bp, Homo sapiens
caggaggcccggccacagccca

SEQ ID NO: 8113814 - DNA, 23 bp, Homo sapiens
caggagggaatgaagttagacaa

SEQ ID NO: 8113815 - DNA, 22 bp, Homo sapiens
taaatgcttagattcatagaaa

SEQ ID NO: 8113816 - DNA, 22 bp, Homo sapiens
taaatgctttctatgaaagagg

SEQ ID NO: 8113817 - DNA, 22 bp, Homo sapiens
taaagtgcccagggaaagcggg

SEQ ID NO: 8113818 - DNA, 22 bp, Homo sapiens
taaagtgcaggctactcagaag

SEQ ID NO: 8113819 - DNA, 22 bp, Homo sapiens
taaagtgcatgcggggccagat

SEQ ID NO: 8113820 - DNA, 22 bp, Homo sapiens
taaagtgcagattgtgattcag

SEQ ID NO: 8113821 - DNA, 22 bp, Homo sapiens
taaagtgcagactcccggaaac

SEQ ID NO: 8113822 - DNA, 22 bp, Homo sapiens
caggagctcactgtctaatggg

SEQ ID NO: 8113823 - DNA, 22 bp, Homo sapiens
taaggcagatgtggaatcaatt

SEQ ID NO: 8113824 - DNA, 22 bp, Homo sapiens
taagacacagtccgcactctct

SEQ ID NO: 8113825 - DNA, 22 bp, Homo sapiens
caggcacatgggagctcatcat

SEQ ID NO: 8113826 - DNA, 22 bp, Homo sapiens
caggcacagtggggtcctctct

SEQ ID NO: 8113827 - DNA, 22 bp, Homo sapiens
caggcacagtggggtcctctct

SEQ ID NO: 8113828 - DNA, 22 bp, Homo sapiens
caggcacagctaagactggcca

SEQ ID NO: 8113829 - DNA, 22 bp, Homo sapiens
caggcacagagagaataccttt

SEQ ID NO: 8113830 - DNA, 22 bp, Homo sapiens
caggattaaggtgaggggagta

SEQ ID NO: 8113831 - DNA, 19 bp, Homo sapiens
taacttgtagatatgaagt

SEQ ID NO: 8113832 - DNA, 22 bp, Homo sapiens
caggatattacctaatatttga

SEQ ID NO: 8113833 - DNA, 22 bp, Homo sapiens
caggatgaggtagaggcagata

SEQ ID NO: 8113834 - DNA, 22 bp, Homo sapiens
caggatgagaggcccagggaag

SEQ ID NO: 8113835 - DNA, 22 bp, Homo sapiens
caggatgaggtagaggcagata

SEQ ID NO: 8113836 - DNA, 18 bp, Homo sapiens
caggatgagtgatgggga

SEQ ID NO: 8113837 - DNA, 22 bp, Homo sapiens
caggatgcttctggggccaggc

SEQ ID NO: 8113838 - DNA, 20 bp, Homo sapiens
caggatgattggacacgatg

SEQ ID NO: 8113839 - DNA, 22 bp, Homo sapiens
taacagaagaaaacatattgga

SEQ ID NO: 8113840 - DNA, 22 bp, Homo sapiens
taacagaaaggctcaggtgctc

SEQ ID NO: 8113841 - DNA, 22 bp, Homo sapiens
taacaagtcattttatcagcag

SEQ ID NO: 8113842 - DNA, 23 bp, Homo sapiens
caggcaggatgaggactacactc

SEQ ID NO: 8113843 - DNA, 22 bp, Homo sapiens
caggcagctgcgacaagagagc

SEQ ID NO: 8113844 - DNA, 22 bp, Homo sapiens
caggcagctgactgtcagatat

SEQ ID NO: 8113845 - DNA, 22 bp, Homo sapiens
caggcagctgggtcaccgtccc

SEQ ID NO: 8113846 - DNA, 22 bp, Homo sapiens
caggcagcaggagccctgctcg

SEQ ID NO: 8113847 - DNA, 22 bp, Homo sapiens
taatttacttgcaaataacaat

SEQ ID NO: 8113848 - DNA, 22 bp, Homo sapiens
caggcagcatcagtctgctgta

SEQ ID NO: 8113849 - DNA, 22 bp, Homo sapiens
caggcagcctgcggtctgcaca

SEQ ID NO: 8113850 - DNA, 22 bp, Homo sapiens
caggcagcctgagggatctggg

SEQ ID NO: 8113851 - DNA, 22 bp, Homo sapiens
caggcagaatgaccgacctcgc

SEQ ID NO: 8113852 - DNA, 22 bp, Homo sapiens
tacaggtagaaatgaagccaga

SEQ ID NO: 8113853 - DNA, 22 bp, Homo sapiens
tacaggtagaatgggtgtacag

SEQ ID NO: 8113854 - DNA, 22 bp, Homo sapiens
tacagggtataggtacagatga

SEQ ID NO: 8113855 - DNA, 20 bp, Homo sapiens
tacaatacacatgcatatga

SEQ ID NO: 8113856 - DNA, 22 bp, Homo sapiens
tacaagtaaattgtagatacca

SEQ ID NO: 8113857 - DNA, 22 bp, Homo sapiens
tacaagtatattctagtgatat

SEQ ID NO: 8113858 - DNA, 22 bp, Homo sapiens
tacaagtccgtaaagggcagat

SEQ ID NO: 8113859 - DNA, 22 bp, Homo sapiens
caggcagggagccactgtataa

SEQ ID NO: 8113860 - DNA, 22 bp, Homo sapiens
tacaaatgagttgtatgaacca

SEQ ID NO: 8113861 - DNA, 22 bp, Homo sapiens
tacaaatgagttgtatgaacca

SEQ ID NO: 8113862 - DNA, 20 bp, Homo sapiens
tacaaattttccatgtttcc

SEQ ID NO: 8113863 - DNA, 22 bp, Homo sapiens
caggccctgggcaggatcagcc

SEQ ID NO: 8113864 - DNA, 22 bp, Homo sapiens
caggccctgggcaggcacagag

SEQ ID NO: 8113865 - DNA, 18 bp, Homo sapiens
caggccctgtctggcctc

SEQ ID NO: 8113866 - DNA, 22 bp, Homo sapiens
tacaggtggatcactagtatag

SEQ ID NO: 8113867 - DNA, 20 bp, Homo sapiens
tacatattatatcagctgca

SEQ ID NO: 8113868 - DNA, 22 bp, Homo sapiens
tacatatttgtctttgtactgt

SEQ ID NO: 8113869 - DNA, 22 bp, Homo sapiens
tacatattgtccatagttgctt

SEQ ID NO: 8113870 - DNA, 22 bp, Homo sapiens
tacatattcaacgttcagtatt

SEQ ID NO: 8113871 - DNA, 22 bp, Homo sapiens
gtgtggaaacagagagggcaac

SEQ ID NO: 8113872 - DNA, 22 bp, Homo sapiens
gtgtgcgccgacacagccaggt

SEQ ID NO: 8113873 - DNA, 22 bp, Homo sapiens
cagctgtctggggagtgctcgc

SEQ ID NO: 8113874 - DNA, 22 bp, Homo sapiens
cagctgtctaagttgagcagga

SEQ ID NO: 8113875 - DNA, 22 bp, Homo sapiens
cagctggggcagccacgtgcgg

SEQ ID NO: 8113876 - DNA, 22 bp, Homo sapiens
gtgtctggaacgggtggtactc

SEQ ID NO: 8113877 - DNA, 22 bp, Homo sapiens
gtgtctggaacgggtggtactc

SEQ ID NO: 8113878 - DNA, 20 bp, Homo sapiens
gtgtctggagtactagagag

SEQ ID NO: 8113879 - DNA, 22 bp, Homo sapiens
gtgtctggcttatgggaactgg

SEQ ID NO: 8113880 - DNA, 22 bp, Homo sapiens
gtgtacatattgagtctgctga

SEQ ID NO: 8113881 - DNA, 22 bp, Homo sapiens
gtgtacatagaattgtgctttg

SEQ ID NO: 8113882 - DNA, 22 bp, Homo sapiens
gtgtacaggatgactgtactta

SEQ ID NO: 8113883 - DNA, 22 bp, Homo sapiens
gtgtacagtaagtgaatctagg

SEQ ID NO: 8113884 - DNA, 22 bp, Homo sapiens
gtgtacagtaagtgaatctagg

SEQ ID NO: 8113885 - DNA, 22 bp, Homo sapiens
gtgtacagtgatttgagttcac

SEQ ID NO: 8113886 - DNA, 22 bp, Homo sapiens
cagctgcctgtattgtcctcat

SEQ ID NO: 8113887 - DNA, 22 bp, Homo sapiens
cagctgctctggtggtctctcc

SEQ ID NO: 8113888 - DNA, 22 bp, Homo sapiens
cagctgctcttctggcctgtca

SEQ ID NO: 8113889 - DNA, 22 bp, Homo sapiens
cagctgctgatggcctgacaga

SEQ ID NO: 8113890 - DNA, 22 bp, Homo sapiens
cagctgctgcccttggctgcag

SEQ ID NO: 8113891 - DNA, 22 bp, Homo sapiens
cagctgctgttcagttttgttt

SEQ ID NO: 8113892 - DNA, 22 bp, Homo sapiens
cagctgctgttcagttttgttt

SEQ ID NO: 8113893 - DNA, 22 bp, Homo sapiens
cagctgcttactagctgtgtga

SEQ ID NO: 8113894 - DNA, 22 bp, Homo sapiens
cagctgctttagttttccatcc

SEQ ID NO: 8113895 - DNA, 22 bp, Homo sapiens
cagctggcatacctgggcccgg

SEQ ID NO: 8113896 - DNA, 22 bp, Homo sapiens
cagctgctgttcagttttgttt

SEQ ID NO: 8113897 - DNA, 22 bp, Homo sapiens
cagctggctgcatgatgccaaa

SEQ ID NO: 8113898 - DNA, 22 bp, Homo sapiens
cagctgccctgccttgccctta

SEQ ID NO: 8113899 - DNA, 22 bp, Homo sapiens
cagctgcctatgacctagcctc

SEQ ID NO: 8113900 - DNA, 20 bp, Homo sapiens
cagctgcctggctctgggat

SEQ ID NO: 8113901 - DNA, 22 bp, Homo sapiens
cagctgcctatgacctagcctc

SEQ ID NO: 8113902 - DNA, 22 bp, Homo sapiens
cagctgccaagaatcttttcta

SEQ ID NO: 8113903 - DNA, 22 bp, Homo sapiens
cagctgcaggctgtgcaggaag

SEQ ID NO: 8113904 - DNA, 18 bp, Homo sapiens
cagctgcaggctcaggac

SEQ ID NO: 8113905 - DNA, 22 bp, Homo sapiens
cagctgcaggaacaaaaatgtg

SEQ ID NO: 8113906 - DNA, 22 bp, Homo sapiens
gtggggcctgtggcttccgtgg

SEQ ID NO: 8113907 - DNA, 22 bp, Homo sapiens
gtggggcatgcacgctgctcct

SEQ ID NO: 8113908 - DNA, 22 bp, Homo sapiens
gtggggcagtggcctgggagca

SEQ ID NO: 8113909 - DNA, 22 bp, Homo sapiens
gtgggcagtggtttgcgcggtc

SEQ ID NO: 8113910 - DNA, 22 bp, Homo sapiens
gtggcgcagagggtggcagaga

SEQ ID NO: 8113911 - DNA, 23 bp, Homo sapiens
cagctgaagcagcctgggctgga

SEQ ID NO: 8113912 - DNA, 22 bp, Homo sapiens
cagctgaagagaggtgctgagt

SEQ ID NO: 8113913 - DNA, 22 bp, Homo sapiens
cagctcttattttctctcctaa

SEQ ID NO: 8113914 - DNA, 22 bp, Homo sapiens
cagctgaagaaagagtggttag

SEQ ID NO: 8113915 - DNA, 22 bp, Homo sapiens
cagctctggcgtcagggagcga

SEQ ID NO: 8113916 - DNA, 22 bp, Homo sapiens
gtggccatctttggccctgact

SEQ ID NO: 8113917 - DNA, 22 bp, Homo sapiens
gtggccagtgggaatgggctca

SEQ ID NO: 8113918 - DNA, 22 bp, Homo sapiens
gtggccaggtcagggacttgtg

SEQ ID NO: 8113919 - DNA, 22 bp, Homo sapiens
gtggccagtcccgatgcttgtt

SEQ ID NO: 8113920 - DNA, 22 bp, Homo sapiens
cagcccagccgagggcctggct

SEQ ID NO: 8113921 - DNA, 22 bp, Homo sapiens
gtggcaggtcccattggagcag

SEQ ID NO: 8113922 - DNA, 22 bp, Homo sapiens
gttaccatgagtgggtgggtga

SEQ ID NO: 8113923 - DNA, 22 bp, Homo sapiens
caggaaagagagctattcactt

SEQ ID NO: 8113924 - DNA, 22 bp, Homo sapiens
caggaaagaaatgagaacacca

SEQ ID NO: 8113925 - DNA, 21 bp, Homo sapiens
caggaaagaaaacgtacatat

SEQ ID NO: 8113926 - DNA, 22 bp, Homo sapiens
caggaaagagctgccaggcagg

SEQ ID NO: 8113927 - DNA, 22 bp, Homo sapiens
gttacaaatgtaaattctgggg

SEQ ID NO: 8113928 - DNA, 22 bp, Homo sapiens
gttacacacaatatatcctaaa

SEQ ID NO: 8113929 - DNA, 22 bp, Homo sapiens
gttacaatgtccttacatgaaa

SEQ ID NO: 8113930 - DNA, 22 bp, Homo sapiens
gtgtgtgctccccaggagagct

SEQ ID NO: 8113931 - DNA, 22 bp, Homo sapiens
gtgtttgttcatcctctcttct

SEQ ID NO: 8113932 - DNA, 22 bp, Homo sapiens
gtgtttggtcagacgtccgggg

SEQ ID NO: 8113933 - DNA, 22 bp, Homo sapiens
gtgtgtgtactctgtatataaa

SEQ ID NO: 8113934 - DNA, 22 bp, Homo sapiens
cagcttcccttggctgagcaga

SEQ ID NO: 8113935 - DNA, 22 bp, Homo sapiens
cagcttccatctccactgccct

SEQ ID NO: 8113936 - DNA, 22 bp, Homo sapiens
cagcttccacagacttggctcg

SEQ ID NO: 8113937 - DNA, 22 bp, Homo sapiens
cagcttccatctccactgccct

SEQ ID NO: 8113938 - DNA, 22 bp, Homo sapiens
gttcctcacgtggacagatgat

SEQ ID NO: 8113939 - DNA, 22 bp, Homo sapiens
gttcctcaaaaaggagagcccc

SEQ ID NO: 8113940 - DNA, 22 bp, Homo sapiens
gttcctcatgagtaccccttaa

SEQ ID NO: 8113941 - DNA, 22 bp, Homo sapiens
gttcctcatccagtcatgacta

SEQ ID NO: 8113942 - DNA, 22 bp, Homo sapiens
gttcctcagttgtaaaaaatgt

SEQ ID NO: 8113943 - DNA, 22 bp, Homo sapiens
gttcctcagcccttacttagcc

SEQ ID NO: 8113944 - DNA, 22 bp, Homo sapiens
gttcttaaccttctttggttgt

SEQ ID NO: 8113945 - DNA, 20 bp, Homo sapiens
gttggaaagttcactctgct

SEQ ID NO: 8113946 - DNA, 19 bp, Homo sapiens
gttggcactgaaaatggct

SEQ ID NO: 8113947 - DNA, 22 bp, Homo sapiens
gttggaaatgcagagtctcaga

SEQ ID NO: 8113948 - DNA, 22 bp, Homo sapiens
gttggaaatggtttctatccct

SEQ ID NO: 8113949 - DNA, 22 bp, Homo sapiens
caggaaaggtagtcacaatgta

SEQ ID NO: 8113950 - DNA, 22 bp, Homo sapiens
caggaaaggtgtgtcatgatgg

SEQ ID NO: 8113951 - DNA, 22 bp, Homo sapiens
caggaaaggtgtgtcatgatgg

SEQ ID NO: 8113952 - DNA, 22 bp, Homo sapiens
caggaaagtctgtaaaggaacc

SEQ ID NO: 8113953 - DNA, 22 bp, Homo sapiens
caggaaagccgagtgccatagg

SEQ ID NO: 8113954 - DNA, 22 bp, Homo sapiens
caggaaagggatgggctgccac

SEQ ID NO: 8113955 - DNA, 21 bp, Homo sapiens
gtttacaaggctttgctcctg

SEQ ID NO: 8113956 - DNA, 22 bp, Homo sapiens
gtttacaacatgccaactgggc

SEQ ID NO: 8113957 - DNA, 22 bp, Homo sapiens
gtttacaacatcttgtccttca

SEQ ID NO: 8113958 - DNA, 22 bp, Homo sapiens
gtttacagtactcacttgcatt

SEQ ID NO: 8113959 - DNA, 22 bp, Homo sapiens
caggaagattgtggaggtggtt

SEQ ID NO: 8113960 - DNA, 22 bp, Homo sapiens
caggaagaggacaggcttcccc

SEQ ID NO: 8113961 - DNA, 19 bp, Homo sapiens
caggaacatggagggaggg

SEQ ID NO: 8113962 - DNA, 22 bp, Homo sapiens
gtttcctctgctggttttcatt

SEQ ID NO: 8113963 - DNA, 22 bp, Homo sapiens
cctggctctagaggccactcct

SEQ ID NO: 8113964 - DNA, 22 bp, Homo sapiens
cctggctccctgcacagggctc

SEQ ID NO: 8113965 - DNA, 22 bp, Homo sapiens
cctggctcccggaacagggtct

SEQ ID NO: 8113966 - DNA, 22 bp, Homo sapiens
cctggccctggaatagggcagg

SEQ ID NO: 8113967 - DNA, 19 bp, Homo sapiens
cctggccctgctgcgcggg

SEQ ID NO: 8113968 - DNA, 22 bp, Homo sapiens
cctggctccagctgcctgtcct

SEQ ID NO: 8113969 - DNA, 22 bp, Homo sapiens
tgtctctggcccatgagcagag

SEQ ID NO: 8113970 - DNA, 22 bp, Homo sapiens
tgtcctctaattggcctcttgc

SEQ ID NO: 8113971 - DNA, 22 bp, Homo sapiens
tgtcctctccaacagcctctgt

SEQ ID NO: 8113972 - DNA, 22 bp, Homo sapiens
cctggcaggtggaggttgcagt

SEQ ID NO: 8113973 - DNA, 22 bp, Homo sapiens
cctggcaggctggggacagtgc

SEQ ID NO: 8113974 - DNA, 22 bp, Homo sapiens
cctggcaggtagcattgaggag

SEQ ID NO: 8113975 - DNA, 22 bp, Homo sapiens
cctggcagggctgcagtaatgg

SEQ ID NO: 8113976 - DNA, 22 bp, Homo sapiens
cctggcagtcaggggagtcctt

SEQ ID NO: 8113977 - DNA, 22 bp, Homo sapiens
cctggcaggttacaaccagtta

SEQ ID NO: 8113978 - DNA, 22 bp, Homo sapiens
cctggcaggtggcgccctcggc

SEQ ID NO: 8113979 - DNA, 22 bp, Homo sapiens
cctggcaggctggggacagtgc

SEQ ID NO: 8113980 - DNA, 20 bp, Homo sapiens
cctggcaggcgggttactta

SEQ ID NO: 8113981 - DNA, 22 bp, Homo sapiens
cctggcaggcccctcctggatt

SEQ ID NO: 8113982 - DNA, 22 bp, Homo sapiens
cctggcaggcaagaggaaggga

SEQ ID NO: 8113983 - DNA, 22 bp, Homo sapiens
cctggcagctgtttggcttggc

SEQ ID NO: 8113984 - DNA, 22 bp, Homo sapiens
cctggcaggactgttgtaagaa

SEQ ID NO: 8113985 - DNA, 23 bp, Homo sapiens
cctggcagcaaacgaggaggtta

SEQ ID NO: 8113986 - DNA, 23 bp, Homo sapiens
cctggcagcaaacgaggaggtta

SEQ ID NO: 8113987 - DNA, 22 bp, Homo sapiens
cctggcagcagcacatgccttc

SEQ ID NO: 8113988 - DNA, 22 bp, Homo sapiens
cctggcagcattggtagagatt

SEQ ID NO: 8113989 - DNA, 18 bp, Homo sapiens
cctggcagccatgcgcgc

SEQ ID NO: 8113990 - DNA, 22 bp, Homo sapiens
cctggcagcaggtgggcccgtg

SEQ ID NO: 8113991 - DNA, 22 bp, Homo sapiens
cctggcagactgtgagggcagg

SEQ ID NO: 8113992 - DNA, 22 bp, Homo sapiens
cctggcagactgtgagggcagg

SEQ ID NO: 8113993 - DNA, 22 bp, Homo sapiens
cctggccaggcatggagtcaca

SEQ ID NO: 8113994 - DNA, 22 bp, Homo sapiens
cctggccatagggcccaggaaa

SEQ ID NO: 8113995 - DNA, 22 bp, Homo sapiens
cctggccagcgccggctgctcg

SEQ ID NO: 8113996 - DNA, 22 bp, Homo sapiens
cctggcagttttgcccaggatt

SEQ ID NO: 8113997 - DNA, 22 bp, Homo sapiens
cctggcagttcatcaaatggca

SEQ ID NO: 8113998 - DNA, 22 bp, Homo sapiens
cctggcagttttgcccaggatt

SEQ ID NO: 8113999 - DNA, 22 bp, Homo sapiens
cctggcagtggtgaagaagagg

SEQ ID NO: 8114000 - DNA, 22 bp, Homo sapiens
cctggcagtcaggggagtcctt

SEQ ID NO: 8114001 - DNA, 23 bp, Homo sapiens
tgtcccagagggagggataggct

SEQ ID NO: 8114002 - DNA, 22 bp, Homo sapiens
tgtcccagatactggacataga

SEQ ID NO: 8114003 - DNA, 22 bp, Homo sapiens
tgtcccagatcacaggagggga

SEQ ID NO: 8114004 - DNA, 22 bp, Homo sapiens
tgtagtcacaaaaactgtaagc

SEQ ID NO: 8114005 - DNA, 19 bp, Homo sapiens
cctggaggtgaaggttctc

SEQ ID NO: 8114006 - DNA, 22 bp, Homo sapiens
tgtagggagaagagaggcacct

SEQ ID NO: 8114007 - DNA, 22 bp, Homo sapiens
cctggcagaaagagttacacct

SEQ ID NO: 8114008 - DNA, 21 bp, Homo sapiens
cctggcagaagcctgatatgc

SEQ ID NO: 8114009 - DNA, 22 bp, Homo sapiens
cctggcagaatattaaagtgca

SEQ ID NO: 8114010 - DNA, 22 bp, Homo sapiens
cctggcagacagcactgaagct

SEQ ID NO: 8114011 - DNA, 22 bp, Homo sapiens
cctggcagacagcactgaagct

SEQ ID NO: 8114012 - DNA, 22 bp, Homo sapiens
tgtatgtgcaatgtttatatgt

SEQ ID NO: 8114013 - DNA, 22 bp, Homo sapiens
tgtatgtgtcctaattcaagca

SEQ ID NO: 8114014 - DNA, 17 bp, Homo sapiens
cctgcccagagacagat

SEQ ID NO: 8114015 - DNA, 22 bp, Homo sapiens
cctgcccagagcccctttcact

SEQ ID NO: 8114016 - DNA, 22 bp, Homo sapiens
cctggagacctgatggcagcgg

SEQ ID NO: 8114017 - DNA, 22 bp, Homo sapiens
tggtggccgaagccctctctca

SEQ ID NO: 8114018 - DNA, 22 bp, Homo sapiens
tgtgaaggcagagccagtgaaa

SEQ ID NO: 8114019 - DNA, 22 bp, Homo sapiens
tgtgaaggagcatgcagagggg

SEQ ID NO: 8114020 - DNA, 22 bp, Homo sapiens
tgtgaaggagatgaagggagtg

SEQ ID NO: 8114021 - DNA, 22 bp, Homo sapiens
tgtgaaggtaaggaggggcaag

SEQ ID NO: 8114022 - DNA, 23 bp, Homo sapiens
tgtgaaggtgggtccaagggctg

SEQ ID NO: 8114023 - DNA, 22 bp, Homo sapiens
tgtgaaggtaaggaggggcaag

SEQ ID NO: 8114024 - DNA, 22 bp, Homo sapiens
tgtgagggttttaagggaatga

SEQ ID NO: 8114025 - DNA, 19 bp, Homo sapiens
cctggctctgagcccagcc

SEQ ID NO: 8114026 - DNA, 22 bp, Homo sapiens
tgtctggtgggttgacaggcag

SEQ ID NO: 8114027 - DNA, 22 bp, Homo sapiens
cctggctgccgagtgtgcagcg

SEQ ID NO: 8114028 - DNA, 20 bp, Homo sapiens
cctggctgcattcaggacgg

SEQ ID NO: 8114029 - DNA, 22 bp, Homo sapiens
cctggctgcattttgctggatg

SEQ ID NO: 8114030 - DNA, 22 bp, Homo sapiens
cctggctgtggcggtgctctca

SEQ ID NO: 8114031 - DNA, 20 bp, Homo sapiens
cctggctttgcagcatgaga

SEQ ID NO: 8114032 - DNA, 22 bp, Homo sapiens
cctggcttccttcatgacctgg

SEQ ID NO: 8114033 - DNA, 22 bp, Homo sapiens
tgtgcttcaggttgtcgccacg

SEQ ID NO: 8114034 - DNA, 22 bp, Homo sapiens
tgtgctgtggaagtttagagaa

SEQ ID NO: 8114035 - DNA, 22 bp, Homo sapiens
tgtgcttctctttctcacttaa

SEQ ID NO: 8114036 - DNA, 22 bp, Homo sapiens
cctgggagagccatctgtggcc

SEQ ID NO: 8114037 - DNA, 22 bp, Homo sapiens
cctgggagagtctgtggtctcc

SEQ ID NO: 8114038 - DNA, 22 bp, Homo sapiens
cctgggagccaagcctctgtgt

SEQ ID NO: 8114039 - DNA, 22 bp, Homo sapiens
cctgggagccgactgactgtgc

SEQ ID NO: 8114040 - DNA, 22 bp, Homo sapiens
cctgggctttgctggcaaggcc

SEQ ID NO: 8114041 - DNA, 22 bp, Homo sapiens
cctgggtgacccgtgagcgtcc

SEQ ID NO: 8114042 - DNA, 22 bp, Homo sapiens
cctgggtgacagagtgagacct

SEQ ID NO: 8114043 - DNA, 20 bp, Homo sapiens
tgtggcaggatgagggcgga

SEQ ID NO: 8114044 - DNA, 22 bp, Homo sapiens
tgtggcaggcaagatgtacaga

SEQ ID NO: 8114045 - DNA, 17 bp, Homo sapiens
cctgggaggagttatga

SEQ ID NO: 8114046 - DNA, 22 bp, Homo sapiens
cctgggcataaatcactccaag

SEQ ID NO: 8114047 - DNA, 22 bp, Homo sapiens
cctgggcattctttgagttctc

SEQ ID NO: 8114048 - DNA, 22 bp, Homo sapiens
tgtgtgggcgaagacagccttt

SEQ ID NO: 8114049 - DNA, 22 bp, Homo sapiens
ccctcagctccaccctcagcag

SEQ ID NO: 8114050 - DNA, 21 bp, Homo sapiens
ccctcaggaaacagaatgcac

SEQ ID NO: 8114051 - DNA, 22 bp, Homo sapiens
ccctcagggaccactgacttca

SEQ ID NO: 8114052 - DNA, 22 bp, Homo sapiens
cccctcctggccacactgtcag

SEQ ID NO: 8114053 - DNA, 22 bp, Homo sapiens
cccctcctggccacactgtcag

SEQ ID NO: 8114054 - DNA, 22 bp, Homo sapiens
cccctcctgcagcacctttctt

SEQ ID NO: 8114055 - DNA, 22 bp, Homo sapiens
cccccaccgtgttcctgctcgg

SEQ ID NO: 8114056 - DNA, 22 bp, Homo sapiens
cccccacctgaggacagtctta

SEQ ID NO: 8114057 - DNA, 22 bp, Homo sapiens
cccctcaggtacccgtgcagca

SEQ ID NO: 8114058 - DNA, 22 bp, Homo sapiens
tgctggagaggaaggtggggtc

SEQ ID NO: 8114059 - DNA, 22 bp, Homo sapiens
tgctggagatcattaatgttca

SEQ ID NO: 8114060 - DNA, 22 bp, Homo sapiens
ccccaggcagggcctaacagag

SEQ ID NO: 8114061 - DNA, 22 bp, Homo sapiens
tgctggagcatctgagagcatc

SEQ ID NO: 8114062 - DNA, 22 bp, Homo sapiens
tgctggagatgaaagggccctg

SEQ ID NO: 8114063 - DNA, 22 bp, Homo sapiens
tgctggagacatagcaggcagc

SEQ ID NO: 8114064 - DNA, 23 bp, Homo sapiens
tgctggagacaagtgtgagaagg

SEQ ID NO: 8114065 - DNA, 22 bp, Homo sapiens
ccccactctcggccagataggc

SEQ ID NO: 8114066 - DNA, 22 bp, Homo sapiens
ccccagcagcacctggggcagt

SEQ ID NO: 8114067 - DNA, 22 bp, Homo sapiens
tgctgactcctggctgtgacac

SEQ ID NO: 8114068 - DNA, 19 bp, Homo sapiens
tgctgactgggcctcaccg

SEQ ID NO: 8114069 - DNA, 19 bp, Homo sapiens
tgctgactgagctgcaaaa

SEQ ID NO: 8114070 - DNA, 22 bp, Homo sapiens
tgctgacgtcaatgagaacata

SEQ ID NO: 8114071 - DNA, 17 bp, Homo sapiens
cccagggaccactgctt

SEQ ID NO: 8114072 - DNA, 22 bp, Homo sapiens
cccagggatgtggcagatgtta

SEQ ID NO: 8114073 - DNA, 22 bp, Homo sapiens
cccagggaggtagcaggagaaa

SEQ ID NO: 8114074 - DNA, 22 bp, Homo sapiens
tgctgaagttactagagactat

SEQ ID NO: 8114075 - DNA, 22 bp, Homo sapiens
tgctgaagtccatctgtttgac

SEQ ID NO: 8114076 - DNA, 22 bp, Homo sapiens
cccaggctcttatgtgacttgc

SEQ ID NO: 8114077 - DNA, 21 bp, Homo sapiens
cccaggctgaattaaaaatat

SEQ ID NO: 8114078 - DNA, 22 bp, Homo sapiens
cccaggctcctgctgtgttgac

SEQ ID NO: 8114079 - DNA, 22 bp, Homo sapiens
cccaggctcctagaggcccaga

SEQ ID NO: 8114080 - DNA, 22 bp, Homo sapiens
cccaggctcctgactcattcta

SEQ ID NO: 8114081 - DNA, 22 bp, Homo sapiens
tgcctgggccttcccacctctg

SEQ ID NO: 8114082 - DNA, 22 bp, Homo sapiens
cccaggctcctactgtattctg

SEQ ID NO: 8114083 - DNA, 22 bp, Homo sapiens
cccaggctcctagaggcccaga

SEQ ID NO: 8114084 - DNA, 22 bp, Homo sapiens
tgcctgggcctctgaggaaggc

SEQ ID NO: 8114085 - DNA, 22 bp, Homo sapiens
tgcctgggagtgaccaagactc

SEQ ID NO: 8114086 - DNA, 22 bp, Homo sapiens
tgcctgggatctgtgccctttg

SEQ ID NO: 8114087 - DNA, 22 bp, Homo sapiens
tgcctgggaaccaatcctggct

SEQ ID NO: 8114088 - DNA, 20 bp, Homo sapiens
tgcctgggaaggcgtggagg

SEQ ID NO: 8114089 - DNA, 22 bp, Homo sapiens
tgcctgggacatgctgtggact

SEQ ID NO: 8114090 - DNA, 22 bp, Homo sapiens
tgcctgggactctgttatcttg

SEQ ID NO: 8114091 - DNA, 22 bp, Homo sapiens
tgcctgggactgtactaaattt

SEQ ID NO: 8114092 - DNA, 22 bp, Homo sapiens
tgccaattagagacatccatct

SEQ ID NO: 8114093 - DNA, 22 bp, Homo sapiens
tgccaattgtgtgaatccttaa

SEQ ID NO: 8114094 - DNA, 22 bp, Homo sapiens
cccaggaggtggagttcacagt

SEQ ID NO: 8114095 - DNA, 22 bp, Homo sapiens
cccaggaggtgtgcccaactcg

SEQ ID NO: 8114096 - DNA, 22 bp, Homo sapiens
tgccaggcctcaggagtctcca

SEQ ID NO: 8114097 - DNA, 22 bp, Homo sapiens
tgccaggcctcaggagtctcca

SEQ ID NO: 8114098 - DNA, 22 bp, Homo sapiens
cccaggcagggacgtgctctgg

SEQ ID NO: 8114099 - DNA, 20 bp, Homo sapiens
cccaggcagagctagcggca

SEQ ID NO: 8114100 - DNA, 22 bp, Homo sapiens
cccaggcagcggggtctccttg

SEQ ID NO: 8114101 - DNA, 22 bp, Homo sapiens
tgccaggcgtggtggtgcgcac

SEQ ID NO: 8114102 - DNA, 22 bp, Homo sapiens
tgccaggctaagtggaggactt

SEQ ID NO: 8114103 - DNA, 21 bp, Homo sapiens
tgccaggcctgagctggggtc

SEQ ID NO: 8114104 - DNA, 22 bp, Homo sapiens
tgccaggcgattgctatcagca

SEQ ID NO: 8114105 - DNA, 22 bp, Homo sapiens
tgccaggcgtggtggtgcgcac

SEQ ID NO: 8114106 - DNA, 22 bp, Homo sapiens
tgcagggagctctggggtgcag

SEQ ID NO: 8114107 - DNA, 22 bp, Homo sapiens
tgcagggaatgcttgcagcatg

SEQ ID NO: 8114108 - DNA, 22 bp, Homo sapiens
tgcagggacacgaagacaaata

SEQ ID NO: 8114109 - DNA, 22 bp, Homo sapiens
tgcagggaatgcttgcagcatg

SEQ ID NO: 8114110 - DNA, 23 bp, Homo sapiens
cccagctggaagttagaggacca

SEQ ID NO: 8114111 - DNA, 23 bp, Homo sapiens
cccagctgagacttcctgaactc

SEQ ID NO: 8114112 - DNA, 22 bp, Homo sapiens
cccagctgaacttgcattccaa

SEQ ID NO: 8114113 - DNA, 22 bp, Homo sapiens
cccagctcttttagcggcatct

SEQ ID NO: 8114114 - DNA, 22 bp, Homo sapiens
cctccagagggtttcccatgaa

SEQ ID NO: 8114115 - DNA, 22 bp, Homo sapiens
cctccagagggaagtactttct

SEQ ID NO: 8114116 - DNA, 20 bp, Homo sapiens
cctccactgtcactgacctg

SEQ ID NO: 8114117 - DNA, 22 bp, Homo sapiens
cctccactgcttcccagctttg

SEQ ID NO: 8114118 - DNA, 22 bp, Homo sapiens
cctccaagtttgactcaggaca

SEQ ID NO: 8114119 - DNA, 22 bp, Homo sapiens
cctccactctggcctctcaggt

SEQ ID NO: 8114120 - DNA, 22 bp, Homo sapiens
tggctgagggggcagttcagga

SEQ ID NO: 8114121 - DNA, 22 bp, Homo sapiens
tggctgagagcaattgactctg

SEQ ID NO: 8114122 - DNA, 23 bp, Homo sapiens
tggctgaggtccaggtagtttca

SEQ ID NO: 8114123 - DNA, 22 bp, Homo sapiens
tggctgaggtctggggcttctg

SEQ ID NO: 8114124 - DNA, 22 bp, Homo sapiens
tggctgaggtaactatgaataa

SEQ ID NO: 8114125 - DNA, 22 bp, Homo sapiens
tggctgagggggctctgctcag

SEQ ID NO: 8114126 - DNA, 22 bp, Homo sapiens
cctcgtccacaatccttgcaca

SEQ ID NO: 8114127 - DNA, 22 bp, Homo sapiens
cctcctccttatggtggcccag

SEQ ID NO: 8114128 - DNA, 22 bp, Homo sapiens
cctcctggtccagcatctcttt

SEQ ID NO: 8114129 - DNA, 22 bp, Homo sapiens
cctcctctgggaagattcagag

SEQ ID NO: 8114130 - DNA, 22 bp, Homo sapiens
tggcccctgaggagcatcagcc

SEQ ID NO: 8114131 - DNA, 22 bp, Homo sapiens
cctctgggggtcctcagagtct

SEQ ID NO: 8114132 - DNA, 22 bp, Homo sapiens
cctctgtagtaagagaacatat

SEQ ID NO: 8114133 - DNA, 22 bp, Homo sapiens
cctctgaggtgagcccagctgg

SEQ ID NO: 8114134 - DNA, 22 bp, Homo sapiens
cctctgagaacacctggcgtcc

SEQ ID NO: 8114135 - DNA, 22 bp, Homo sapiens
cctctcagcgattcctcttgga

SEQ ID NO: 8114136 - DNA, 22 bp, Homo sapiens
cctctcatagtctgtatccttt

SEQ ID NO: 8114137 - DNA, 23 bp, Homo sapiens
cctctccagacactgggccttgt

SEQ ID NO: 8114138 - DNA, 22 bp, Homo sapiens
cctctcatcattatcgctttgt

SEQ ID NO: 8114139 - DNA, 18 bp, Homo sapiens
cctctacctacccctaga

SEQ ID NO: 8114140 - DNA, 22 bp, Homo sapiens
cctctacagggcatagcccaaa

SEQ ID NO: 8114141 - DNA, 22 bp, Homo sapiens
cctctacttaccactcagccag

SEQ ID NO: 8114142 - DNA, 22 bp, Homo sapiens
cctctatagatgtgtgcatcta

SEQ ID NO: 8114143 - DNA, 22 bp, Homo sapiens
cctctatgtacacatttccagc

SEQ ID NO: 8114144 - DNA, 21 bp, Homo sapiens
tggctgcctggctctgtggtt

SEQ ID NO: 8114145 - DNA, 22 bp, Homo sapiens
tggctgcctagtccctcagcct

SEQ ID NO: 8114146 - DNA, 22 bp, Homo sapiens
cctctctgtaagggtccctccc

SEQ ID NO: 8114147 - DNA, 22 bp, Homo sapiens
cctctctgtgtggcctctccat

SEQ ID NO: 8114148 - DNA, 22 bp, Homo sapiens
cctctctgtcacaccagtggcc

SEQ ID NO: 8114149 - DNA, 22 bp, Homo sapiens
cctctctgtagcagcccccagt

SEQ ID NO: 8114150 - DNA, 22 bp, Homo sapiens
cctctctcttgtagtccctgcc

SEQ ID NO: 8114151 - DNA, 22 bp, Homo sapiens
tggctgcctttcacctcatctc

SEQ ID NO: 8114152 - DNA, 20 bp, Homo sapiens
cctctctgcatgctccctga

SEQ ID NO: 8114153 - DNA, 22 bp, Homo sapiens
ccctgctgcagagagctttcca

SEQ ID NO: 8114154 - DNA, 23 bp, Homo sapiens
tggagctgacagtcagagggagg

SEQ ID NO: 8114155 - DNA, 22 bp, Homo sapiens
ccctggagatcgggagaggaag

SEQ ID NO: 8114156 - DNA, 22 bp, Homo sapiens
ccctggctgccagtcaccagac

SEQ ID NO: 8114157 - DNA, 22 bp, Homo sapiens
ccctggctcttcaccacctgcc

SEQ ID NO: 8114158 - DNA, 22 bp, Homo sapiens
ccctggcaaaatccctggtaca

SEQ ID NO: 8114159 - DNA, 22 bp, Homo sapiens
tggatgagaaactctggtgact

SEQ ID NO: 8114160 - DNA, 22 bp, Homo sapiens
tggatgaggctgggttaggcag

SEQ ID NO: 8114161 - DNA, 22 bp, Homo sapiens
tggatgagattaaagtgaggtt

SEQ ID NO: 8114162 - DNA, 22 bp, Homo sapiens
tggcaaggaaattagttctcct

SEQ ID NO: 8114163 - DNA, 22 bp, Homo sapiens
tggcaaggaagagcctggtgca

SEQ ID NO: 8114164 - DNA, 22 bp, Homo sapiens
tggcaagagcaaaatgtacagt

SEQ ID NO: 8114165 - DNA, 22 bp, Homo sapiens
tggatgagtctgagattgggca

SEQ ID NO: 8114166 - DNA, 22 bp, Homo sapiens
tggatgagggctgagcactggg

SEQ ID NO: 8114167 - DNA, 22 bp, Homo sapiens
tggatgagttcaatgaggcaga

SEQ ID NO: 8114168 - DNA, 22 bp, Homo sapiens
tggcaagaaccgcaattacttt

SEQ ID NO: 8114169 - DNA, 23 bp, Homo sapiens
tggcaactccttagcacctgtgg

SEQ ID NO: 8114170 - DNA, 21 bp, Homo sapiens
tggcagcacccacaccctctg

SEQ ID NO: 8114171 - DNA, 22 bp, Homo sapiens
tggcaaggctgtgggggcagag

SEQ ID NO: 8114172 - DNA, 22 bp, Homo sapiens
tggcacaggaatttagatgcag

SEQ ID NO: 8114173 - DNA, 23 bp, Homo sapiens
tggcaagtcatttctagtaacct

SEQ ID NO: 8114174 - DNA, 22 bp, Homo sapiens
tggcaagtggcttgtatacgcc

SEQ ID NO: 8114175 - DNA, 22 bp, Homo sapiens
tggccaggaggctgcttctgac

SEQ ID NO: 8114176 - DNA, 22 bp, Homo sapiens
tggcagcttgaatgcagtcttt

SEQ ID NO: 8114177 - DNA, 22 bp, Homo sapiens
tggcagctggtacagtgggtct

SEQ ID NO: 8114178 - DNA, 22 bp, Homo sapiens
cctaggtattttgtaaaggtaa

SEQ ID NO: 8114179 - DNA, 22 bp, Homo sapiens
cctagggagcctgagagcagtg

SEQ ID NO: 8114180 - DNA, 19 bp, Homo sapiens
ctgcttccttccctcactg

SEQ ID NO: 8114181 - DNA, 22 bp, Homo sapiens
ctgcctggatgaatggcgcctt

SEQ ID NO: 8114182 - DNA, 22 bp, Homo sapiens
ctgcctgctcaccagggctctg

SEQ ID NO: 8114183 - DNA, 19 bp, Homo sapiens
ctggaatgtggctggtgca

SEQ ID NO: 8114184 - DNA, 22 bp, Homo sapiens
ctggacaaccactcagcctcag

SEQ ID NO: 8114185 - DNA, 22 bp, Homo sapiens
ctggacagaaagggctgctgtg

SEQ ID NO: 8114186 - DNA, 22 bp, Homo sapiens
ctggacaggctggggactgcaa

SEQ ID NO: 8114187 - DNA, 22 bp, Homo sapiens
ctggaaaatgaagaagcagagg

SEQ ID NO: 8114188 - DNA, 22 bp, Homo sapiens
ctggaggggctggcatggtagc

SEQ ID NO: 8114189 - DNA, 22 bp, Homo sapiens
ctggaggggccatccacagtct

SEQ ID NO: 8114190 - DNA, 22 bp, Homo sapiens
ctggagggcttctgcaggttac

SEQ ID NO: 8114191 - DNA, 22 bp, Homo sapiens
ctggaggggccatccacagtct

SEQ ID NO: 8114192 - DNA, 22 bp, Homo sapiens
ctggagggctggactaaggaaa

SEQ ID NO: 8114193 - DNA, 22 bp, Homo sapiens
ctggagggcttctgcaggttac

SEQ ID NO: 8114194 - DNA, 22 bp, Homo sapiens
ctggagggactttctcacggat

SEQ ID NO: 8114195 - DNA, 22 bp, Homo sapiens
ctggagggactttctcacggat

SEQ ID NO: 8114196 - DNA, 22 bp, Homo sapiens
ctggagggacaaggtatgcatt

SEQ ID NO: 8114197 - DNA, 22 bp, Homo sapiens
ctggagggtgagcctcatctct

SEQ ID NO: 8114198 - DNA, 22 bp, Homo sapiens
ctggagggtggagagaagtctc

SEQ ID NO: 8114199 - DNA, 22 bp, Homo sapiens
ctggagggtggagagaagtctc

SEQ ID NO: 8114200 - DNA, 22 bp, Homo sapiens
ctggagggggaaatgttcattg

SEQ ID NO: 8114201 - DNA, 21 bp, Homo sapiens
ctggagggtagagttgggctg

SEQ ID NO: 8114202 - DNA, 22 bp, Homo sapiens
ctggagggtgagcctcatctct

SEQ ID NO: 8114203 - DNA, 22 bp, Homo sapiens
ctggagtgtaaagagcatagaa

SEQ ID NO: 8114204 - DNA, 20 bp, Homo sapiens
ctggagtgtagcagtggctg

SEQ ID NO: 8114205 - DNA, 22 bp, Homo sapiens
ctggacagtgctgcttgagatg

SEQ ID NO: 8114206 - DNA, 23 bp, Homo sapiens
ctggactcaggggatgtgaagga

SEQ ID NO: 8114207 - DNA, 22 bp, Homo sapiens
ctggaggaatcacagaaggctt

SEQ ID NO: 8114208 - DNA, 22 bp, Homo sapiens
ctggagggacaaggtatgcatt

SEQ ID NO: 8114209 - DNA, 21 bp, Homo sapiens
ctggaggcaggtggtgccagg

SEQ ID NO: 8114210 - DNA, 22 bp, Homo sapiens
ctggcagagtctgctgtctgca

SEQ ID NO: 8114211 - DNA, 22 bp, Homo sapiens
ctggcagcagcttctggatcga

SEQ ID NO: 8114212 - DNA, 22 bp, Homo sapiens
ctggcagattggggtcagcagt

SEQ ID NO: 8114213 - DNA, 22 bp, Homo sapiens
ctggcagatatttgcagacatg

SEQ ID NO: 8114214 - DNA, 22 bp, Homo sapiens
ctggcacctccagctcatggcc

SEQ ID NO: 8114215 - DNA, 22 bp, Homo sapiens
ctggcactggatcgtgcatatc

SEQ ID NO: 8114216 - DNA, 22 bp, Homo sapiens
ctggatcccgtctgagcctcct

SEQ ID NO: 8114217 - DNA, 22 bp, Homo sapiens
ctggcatggaggactactgagc

SEQ ID NO: 8114218 - DNA, 22 bp, Homo sapiens
ctggccaggcggcccctgcatg

SEQ ID NO: 8114219 - DNA, 22 bp, Homo sapiens
ctggcagggtgggctttgcttt

SEQ ID NO: 8114220 - DNA, 22 bp, Homo sapiens
ctggcagcatggagcctgtgct

SEQ ID NO: 8114221 - DNA, 22 bp, Homo sapiens
ctggcagcatggagcctgtgct

SEQ ID NO: 8114222 - DNA, 22 bp, Homo sapiens
ctggcagtctggtggaaggcct

SEQ ID NO: 8114223 - DNA, 22 bp, Homo sapiens
ctggctcctgaggcttggcccc

SEQ ID NO: 8114224 - DNA, 22 bp, Homo sapiens
ctggctcctctacacacccaaa

SEQ ID NO: 8114225 - DNA, 22 bp, Homo sapiens
ctggctccctctccctgagtca

SEQ ID NO: 8114226 - DNA, 22 bp, Homo sapiens
ctgaggcagaaaaagcaagggt

SEQ ID NO: 8114227 - DNA, 22 bp, Homo sapiens
ctgatttcatgctatcaatgtt

SEQ ID NO: 8114228 - DNA, 22 bp, Homo sapiens
ctgattttcaaaatgtgttaaa

SEQ ID NO: 8114229 - DNA, 22 bp, Homo sapiens
ctgattctttcttcttgccagg

SEQ ID NO: 8114230 - DNA, 22 bp, Homo sapiens
ctgattctctgactcttggctt

SEQ ID NO: 8114231 - DNA, 22 bp, Homo sapiens
ctgattctgtaatttttcctaa

SEQ ID NO: 8114232 - DNA, 22 bp, Homo sapiens
ctgcagacctctgaggtccatg

SEQ ID NO: 8114233 - DNA, 22 bp, Homo sapiens
ctgcagagcatgaggaggtctg

SEQ ID NO: 8114234 - DNA, 22 bp, Homo sapiens
ctgcagacctctgaggtccatg

SEQ ID NO: 8114235 - DNA, 22 bp, Homo sapiens
ctgaggaggggcctgagtgaga

SEQ ID NO: 8114236 - DNA, 22 bp, Homo sapiens
ctgagagaatcatgctgcaggt

SEQ ID NO: 8114237 - DNA, 22 bp, Homo sapiens
ctgagagaaacatgactcagga

SEQ ID NO: 8114238 - DNA, 22 bp, Homo sapiens
ctgagacattatgacaagtgga

SEQ ID NO: 8114239 - DNA, 22 bp, Homo sapiens
ctgagaattactctgatgagta

SEQ ID NO: 8114240 - DNA, 22 bp, Homo sapiens
ctgccaggactgacgtcttcag

SEQ ID NO: 8114241 - DNA, 22 bp, Homo sapiens
ctgccaggggcctcacaggcca

SEQ ID NO: 8114242 - DNA, 22 bp, Homo sapiens
ctgccagggaggctgggaagtt

SEQ ID NO: 8114243 - DNA, 22 bp, Homo sapiens
ctgcagatttggtgtctggtga

SEQ ID NO: 8114244 - DNA, 22 bp, Homo sapiens
ctgcagatggtattgttctggt

SEQ ID NO: 8114245 - DNA, 22 bp, Homo sapiens
ctgcagagtggagcctcggctg

SEQ ID NO: 8114246 - DNA, 22 bp, Homo sapiens
ctgcagatcttgtgtacttgtc

SEQ ID NO: 8114247 - DNA, 22 bp, Homo sapiens
ctgccctgggttttatgggagt

SEQ ID NO: 8114248 - DNA, 22 bp, Homo sapiens
ctgccctggggggcctccttgc

SEQ ID NO: 8114249 - DNA, 18 bp, Homo sapiens
ctgccagtgtgctctccg

SEQ ID NO: 8114250 - DNA, 22 bp, Homo sapiens
ctgccagtctatgctgctcggc

SEQ ID NO: 8114251 - DNA, 17 bp, Homo sapiens
ctgccagtggggaggca

SEQ ID NO: 8114252 - DNA, 22 bp, Homo sapiens
ctgccagtgaaattgtgtcagt

SEQ ID NO: 8114253 - DNA, 22 bp, Homo sapiens
ctgccaggttggcgctcgctct

SEQ ID NO: 8114254 - DNA, 22 bp, Homo sapiens
ctgcctataaactgcctcaaat

SEQ ID NO: 8114255 - DNA, 22 bp, Homo sapiens
ctgcctcagcgttgtggcccta

SEQ ID NO: 8114256 - DNA, 22 bp, Homo sapiens
ctgcctccaggctcaccttgac

SEQ ID NO: 8114257 - DNA, 22 bp, Homo sapiens
ctgcctcctcacgtccacagtg

SEQ ID NO: 8114258 - DNA, 22 bp, Homo sapiens
ctgcctcctcacgtccacagtg

SEQ ID NO: 8114259 - DNA, 22 bp, Homo sapiens
ctgagaatggacagcagggcag

SEQ ID NO: 8114260 - DNA, 22 bp, Homo sapiens
ctgagaataaagccagcaggag

SEQ ID NO: 8114261 - DNA, 22 bp, Homo sapiens
ctgacttcagggataaaaagta

SEQ ID NO: 8114262 - DNA, 22 bp, Homo sapiens
ctgactgtttgctgaaaggtct

SEQ ID NO: 8114263 - DNA, 22 bp, Homo sapiens
ctgactgttgctgttgatgagg

SEQ ID NO: 8114264 - DNA, 22 bp, Homo sapiens
ctgactgtgagagcaggaatgg

SEQ ID NO: 8114265 - DNA, 17 bp, Homo sapiens
ctgaagataatggcaac

SEQ ID NO: 8114266 - DNA, 20 bp, Homo sapiens
ctgaagagtggcctgatctg

SEQ ID NO: 8114267 - DNA, 22 bp, Homo sapiens
ctgaagaggacgcagcagcaag

SEQ ID NO: 8114268 - DNA, 22 bp, Homo sapiens
ctgaaaggaataaggctctttg

SEQ ID NO: 8114269 - DNA, 19 bp, Homo sapiens
tttttaatgggctggagca

SEQ ID NO: 8114270 - DNA, 22 bp, Homo sapiens
ctgaagagaaagggagctcttc

SEQ ID NO: 8114271 - DNA, 22 bp, Homo sapiens
ctctggttgagtgagaaccaag

SEQ ID NO: 8114272 - DNA, 22 bp, Homo sapiens
ctctggttcagggctccctggc

SEQ ID NO: 8114273 - DNA, 22 bp, Homo sapiens
tttttaatgcagtctgagacat

SEQ ID NO: 8114274 - DNA, 22 bp, Homo sapiens
ctctttttcacctctgtcagcg

SEQ ID NO: 8114275 - DNA, 22 bp, Homo sapiens
tttgtgaacaaacatgaagatg

SEQ ID NO: 8114276 - DNA, 19 bp, Homo sapiens
tttgtgaagaaaatgatgc

SEQ ID NO: 8114277 - DNA, 22 bp, Homo sapiens
ctctcctgggctgaccgtccga

SEQ ID NO: 8114278 - DNA, 22 bp, Homo sapiens
ctctcctgggctgaccgtccga

SEQ ID NO: 8114279 - DNA, 23 bp, Homo sapiens
ctctcctgaaggacaagctgccg

SEQ ID NO: 8114280 - DNA, 22 bp, Homo sapiens
ctctcctcccatgtaggagatg

SEQ ID NO: 8114281 - DNA, 22 bp, Homo sapiens
ctctggctggctgggcctcagt

SEQ ID NO: 8114282 - DNA, 22 bp, Homo sapiens
ctctgggatgaggcctaggcac

SEQ ID NO: 8114283 - DNA, 22 bp, Homo sapiens
ctctgggctccttcagcccttt

SEQ ID NO: 8114284 - DNA, 22 bp, Homo sapiens
ttttagtttggatttctaaagc

SEQ ID NO: 8114285 - DNA, 22 bp, Homo sapiens
ctacaaaagtaattgtggtttt

SEQ ID NO: 8114286 - DNA, 22 bp, Homo sapiens
ctaattgtaagctccttgaggg

SEQ ID NO: 8114287 - DNA, 22 bp, Homo sapiens
ctacaaagaaagtatactggac

SEQ ID NO: 8114288 - DNA, 22 bp, Homo sapiens
ctacaaatataaaacacagata

SEQ ID NO: 8114289 - DNA, 22 bp, Homo sapiens
ttccttctaatattctgcctgt

SEQ ID NO: 8114290 - DNA, 22 bp, Homo sapiens
ttccttccctcagtggctgaag

SEQ ID NO: 8114291 - DNA, 22 bp, Homo sapiens
ttccctggttaaccattttctg

SEQ ID NO: 8114292 - DNA, 22 bp, Homo sapiens
ttccgagtctccaaggggttgt

SEQ ID NO: 8114293 - DNA, 22 bp, Homo sapiens
ttccctttgttaaattggaaga

SEQ ID NO: 8114294 - DNA, 21 bp, Homo sapiens
ttcccttctggttttgagaga

SEQ ID NO: 8114295 - DNA, 22 bp, Homo sapiens
ttcccttctagttttgagagac

SEQ ID NO: 8114296 - DNA, 22 bp, Homo sapiens
ttccaaagctgctttatttagt

SEQ ID NO: 8114297 - DNA, 22 bp, Homo sapiens
ttccaaagcacttgatgtaaag

SEQ ID NO: 8114298 - DNA, 22 bp, Homo sapiens
ttccaaagtcatgttgctgata

SEQ ID NO: 8114299 - DNA, 22 bp, Homo sapiens
ttccaaagttagttattagaaa

SEQ ID NO: 8114300 - DNA, 22 bp, Homo sapiens
ttcagaaacagagtgagtgagt

SEQ ID NO: 8114301 - DNA, 22 bp, Homo sapiens
ttcagaaacatcagtggatgga

SEQ ID NO: 8114302 - DNA, 22 bp, Homo sapiens
ttcacttatttcttgagtagca

SEQ ID NO: 8114303 - DNA, 22 bp, Homo sapiens
cggctgagacggccatagacac

SEQ ID NO: 8114304 - DNA, 22 bp, Homo sapiens
cggctgaggatctccaggcctg

SEQ ID NO: 8114305 - DNA, 22 bp, Homo sapiens
cggctgagcagtgctgatggaa

SEQ ID NO: 8114306 - DNA, 22 bp, Homo sapiens
ttcattcttgtctttgtatagt

SEQ ID NO: 8114307 - DNA, 19 bp, Homo sapiens
ttcattctcttattgttgt

SEQ ID NO: 8114308 - DNA, 22 bp, Homo sapiens
cggacaggctcctggagctcct

SEQ ID NO: 8114309 - DNA, 22 bp, Homo sapiens
ttcacataaatagatcacatca

SEQ ID NO: 8114310 - DNA, 22 bp, Homo sapiens
ttcacatataatgtctttaaaa

SEQ ID NO: 8114311 - DNA, 22 bp, Homo sapiens
ttcacatctcagcactgcctct

SEQ ID NO: 8114312 - DNA, 22 bp, Homo sapiens
ttgacttcccagacttgtgttt

SEQ ID NO: 8114313 - DNA, 22 bp, Homo sapiens
ttgactgttaagacttggctct

SEQ ID NO: 8114314 - DNA, 22 bp, Homo sapiens
ttgacttcagcctgtacttgta

SEQ ID NO: 8114315 - DNA, 22 bp, Homo sapiens
ttgactctggaggtcactgaag

SEQ ID NO: 8114316 - DNA, 22 bp, Homo sapiens
ttgacctatgtttcttcatctg

SEQ ID NO: 8114317 - DNA, 22 bp, Homo sapiens
ttgacccagttgtaaaagagct

SEQ ID NO: 8114318 - DNA, 21 bp, Homo sapiens
ttgaggagtgagagtgggttt

SEQ ID NO: 8114319 - DNA, 23 bp, Homo sapiens
ttgaggagtgctttttctatcca

SEQ ID NO: 8114320 - DNA, 22 bp, Homo sapiens
ttgaggaaagagtgcaaagagg

SEQ ID NO: 8114321 - DNA, 22 bp, Homo sapiens
ttgaggagcaggatgggaggct

SEQ ID NO: 8114322 - DNA, 22 bp, Homo sapiens
ttgaggagaagactttgcttcc

SEQ ID NO: 8114323 - DNA, 22 bp, Homo sapiens
ttgaggaggaactgtgaggcaa

SEQ ID NO: 8114324 - DNA, 22 bp, Homo sapiens
ttgaggaggaaaagggggtacc

SEQ ID NO: 8114325 - DNA, 23 bp, Homo sapiens
ctcagaggcctgtccagggtggt

SEQ ID NO: 8114326 - DNA, 22 bp, Homo sapiens
ctattttgcctgcctagaaatc

SEQ ID NO: 8114327 - DNA, 22 bp, Homo sapiens
ttctttaaaatagtgagaaaga

SEQ ID NO: 8114328 - DNA, 22 bp, Homo sapiens
ctattttaagaggccattaggt

SEQ ID NO: 8114329 - DNA, 23 bp, Homo sapiens
ctagggcagtatttcacagacac

SEQ ID NO: 8114330 - DNA, 22 bp, Homo sapiens
ctattttaacttgattacctct

SEQ ID NO: 8114331 - DNA, 22 bp, Homo sapiens
ttctgtccactgctggggcctc

SEQ ID NO: 8114332 - DNA, 22 bp, Homo sapiens
ctagcccactgcaaatgttggc

SEQ ID NO: 8114333 - DNA, 22 bp, Homo sapiens
ctagcccactgcaaatgttggc

SEQ ID NO: 8114334 - DNA, 22 bp, Homo sapiens
ctagcccagttcttctcattag

SEQ ID NO: 8114335 - DNA, 22 bp, Homo sapiens
ttccttctaattttacacctga

SEQ ID NO: 8114336 - DNA, 22 bp, Homo sapiens
ttccttctaatattctgcctgt

SEQ ID NO: 8114337 - DNA, 22 bp, Homo sapiens
ttcctttctctggactgcagcc

SEQ ID NO: 8114338 - DNA, 22 bp, Homo sapiens
ctagggaacaagatgcccaggg

SEQ ID NO: 8114339 - DNA, 22 bp, Homo sapiens
ctagggaagtctgtattttgtg

SEQ ID NO: 8114340 - DNA, 22 bp, Homo sapiens
ctaggctgttcatgctcagacc

SEQ ID NO: 8114341 - DNA, 22 bp, Homo sapiens
ctagggagactcgcaggactca

SEQ ID NO: 8114342 - DNA, 22 bp, Homo sapiens
ctaggcagggtgctgtgccatg

SEQ ID NO: 8114343 - DNA, 22 bp, Homo sapiens
ttgttaaaaatagatttccagg

SEQ ID NO: 8114344 - DNA, 22 bp, Homo sapiens
tttaaaaaactagtctgagtct

SEQ ID NO: 8114345 - DNA, 22 bp, Homo sapiens
ctccagtgcgcaggacagcccc

SEQ ID NO: 8114346 - DNA, 22 bp, Homo sapiens
ctccaggtattactgttttccc

SEQ ID NO: 8114347 - DNA, 22 bp, Homo sapiens
ttgtatttctccactttctgtt

SEQ ID NO: 8114348 - DNA, 22 bp, Homo sapiens
ctccaggcgccgcttttgcagt

SEQ ID NO: 8114349 - DNA, 20 bp, Homo sapiens
ctcatctctgagcctcctgg

SEQ ID NO: 8114350 - DNA, 22 bp, Homo sapiens
ttggccaagtcactggttaatg

SEQ ID NO: 8114351 - DNA, 22 bp, Homo sapiens
ttggccaaggaagtagcaacgg

SEQ ID NO: 8114352 - DNA, 22 bp, Homo sapiens
ttgatatgttaggaagactgat

SEQ ID NO: 8114353 - DNA, 22 bp, Homo sapiens
ttgcttttgggaaaacatgcct

SEQ ID NO: 8114354 - DNA, 22 bp, Homo sapiens
tttaaatttgtgtttagagggt

SEQ ID NO: 8114355 - DNA, 22 bp, Homo sapiens
tttaaaagttatcatctgtcca

SEQ ID NO: 8114356 - DNA, 22 bp, Homo sapiens
tttacatgtcaagactggcagt

SEQ ID NO: 8114357 - DNA, 22 bp, Homo sapiens
tttacatgtccttcaagagcag

SEQ ID NO: 8114358 - DNA, 17 bp, Homo sapiens
tttagaatacaatgttt

SEQ ID NO: 8114359 - DNA, 17 bp, Homo sapiens
ctcctctctgggttact

SEQ ID NO: 8114360 - DNA, 17 bp, Homo sapiens
ctcctctctgggttact

SEQ ID NO: 8114361 - DNA, 16 bp, Homo sapiens
ctcctctccttcagga

SEQ ID NO: 8114362 - DNA, 22 bp, Homo sapiens
ctcctctctggagttatgcaga

SEQ ID NO: 8114363 - DNA, 22 bp, Homo sapiens
ctcctctctggagttatgcaga

SEQ ID NO: 8114364 - DNA, 22 bp, Homo sapiens
ctcctctccatcagcgccaccc

SEQ ID NO: 8114365 - DNA, 22 bp, Homo sapiens
ctcctctccatcagcgccaccc

SEQ ID NO: 8114366 - DNA, 22 bp, Homo sapiens
ctcctgacttgtgagcccctcc

SEQ ID NO: 8114367 - DNA, 22 bp, Homo sapiens
ctcctctttagccccagctgga

SEQ ID NO: 8114368 - DNA, 22 bp, Homo sapiens
ctcctgagaattttcagttgga

SEQ ID NO: 8114369 - DNA, 19 bp, Homo sapiens
ctctcactcgccacatcct

SEQ ID NO: 8114370 - DNA, 22 bp, Homo sapiens
ctctccactcagcgtcatgtcc

SEQ ID NO: 8114371 - DNA, 22 bp, Homo sapiens
ctctccagaattattactatta

SEQ ID NO: 8114372 - DNA, 18 bp, Homo sapiens
ctcctgggctgcagatgc

SEQ ID NO: 8114373 - DNA, 22 bp, Homo sapiens
ctctccagccaggggcttcctg

SEQ ID NO: 8114374 - DNA, 22 bp, Homo sapiens
ctctccagatctgctgagccag

SEQ ID NO: 8114375 - DNA, 22 bp, Homo sapiens
ctcctgggagcagggatggatg

SEQ ID NO: 8114376 - DNA, 22 bp, Homo sapiens
ctcctgggagctgtggcagagc

SEQ ID NO: 8114377 - DNA, 22 bp, Homo sapiens
ctctcccccacagcagccttct

SEQ ID NO: 8114378 - DNA, 22 bp, Homo sapiens
ctctccctatgcctcccaggag

SEQ ID NO: 8114379 - DNA, 22 bp, Homo sapiens
ctctccctatgcctcccaggag

SEQ ID NO: 8114380 - DNA, 22 bp, Homo sapiens
ctctcctccaggaactcacagt

SEQ ID NO: 8114381 - DNA, 22 bp, Homo sapiens
ctctcctccaggaactcacagt

SEQ ID NO: 8114382 - DNA, 22 bp, Homo sapiens
ctctcctcagaacaggccctct

SEQ ID NO: 8114383 - DNA, 22 bp, Homo sapiens
ctctcctcagaacaggccctct

SEQ ID NO: 8114384 - DNA, 22 bp, Homo sapiens
ctctcctacatttcattcacaa

SEQ ID NO: 8114385 - DNA, 22 bp, Homo sapiens
ctctccctggccagctgtgcag

SEQ ID NO: 8114386 - DNA, 22 bp, Homo sapiens
ctctccaggactttggcccaat

SEQ ID NO: 8114387 - DNA, 19 bp, Homo sapiens
ctctccagctccagtagct

SEQ ID NO: 8114388 - DNA, 23 bp, Homo sapiens
gccatggctgccccacaggcctc

SEQ ID NO: 8114389 - DNA, 23 bp, Homo sapiens
gccatggctgccccacaggcctc

SEQ ID NO: 8114390 - DNA, 22 bp, Homo sapiens
gccaggctgtttttattactgt

SEQ ID NO: 8114391 - DNA, 22 bp, Homo sapiens
gccaggctgtggggaacttgaa

SEQ ID NO: 8114392 - DNA, 22 bp, Homo sapiens
gccagtgggacccgctgtgggc

SEQ ID NO: 8114393 - DNA, 22 bp, Homo sapiens
gccaggctgtttttattactgt

SEQ ID NO: 8114394 - DNA, 22 bp, Homo sapiens
gccagtggtagaggggaggccg

SEQ ID NO: 8114395 - DNA, 22 bp, Homo sapiens
gccagtgggtagttggagctgg

SEQ ID NO: 8114396 - DNA, 22 bp, Homo sapiens
gccagtggtcagtgggagggtg

SEQ ID NO: 8114397 - DNA, 22 bp, Homo sapiens
gccagtggtcactgaggaagaa

SEQ ID NO: 8114398 - DNA, 22 bp, Homo sapiens
gccagtggtcactgaggaagaa

SEQ ID NO: 8114399 - DNA, 22 bp, Homo sapiens
gccaggctgctccagggaggcc

SEQ ID NO: 8114400 - DNA, 22 bp, Homo sapiens
gccaggctgccttatctctagc

SEQ ID NO: 8114401 - DNA, 22 bp, Homo sapiens
gccaggctggttatttaatgag

SEQ ID NO: 8114402 - DNA, 22 bp, Homo sapiens
gccaggctggtgtcacaactct

SEQ ID NO: 8114403 - DNA, 22 bp, Homo sapiens
gccaggctgaggctctggaaga

SEQ ID NO: 8114404 - DNA, 22 bp, Homo sapiens
gccaggctgactcccccggcct

SEQ ID NO: 8114405 - DNA, 22 bp, Homo sapiens
gccaggctcttggttatgtttt

SEQ ID NO: 8114406 - DNA, 22 bp, Homo sapiens
gccaggctgactcccccggcct

SEQ ID NO: 8114407 - DNA, 22 bp, Homo sapiens
gccaggctctcagtgactgccc

SEQ ID NO: 8114408 - DNA, 19 bp, Homo sapiens
gccaggctcttattctgtg

SEQ ID NO: 8114409 - DNA, 22 bp, Homo sapiens
gccaggctcttccatttgggtc

SEQ ID NO: 8114410 - DNA, 16 bp, Homo sapiens
gccctttccttggctg

SEQ ID NO: 8114411 - DNA, 22 bp, Homo sapiens
gccctttcttcttctggactgg

SEQ ID NO: 8114412 - DNA, 22 bp, Homo sapiens
gcccttggaagcggcaggtagc

SEQ ID NO: 8114413 - DNA, 22 bp, Homo sapiens
gccctctgctcagctcctcagc

SEQ ID NO: 8114414 - DNA, 20 bp, Homo sapiens
gccctctgcctccctcagcg

SEQ ID NO: 8114415 - DNA, 22 bp, Homo sapiens
gccctctcttctgcagcctcca

SEQ ID NO: 8114416 - DNA, 22 bp, Homo sapiens
gccctctggcacagagatgcag

SEQ ID NO: 8114417 - DNA, 22 bp, Homo sapiens
gccctgttttgaaacttgcata

SEQ ID NO: 8114418 - DNA, 22 bp, Homo sapiens
gcccttacagggtggtcagcca

SEQ ID NO: 8114419 - DNA, 22 bp, Homo sapiens
gccctcctttgcttctcctagt

SEQ ID NO: 8114420 - DNA, 22 bp, Homo sapiens
gccctcctttgcttctcctagt

SEQ ID NO: 8114421 - DNA, 22 bp, Homo sapiens
gccctctcggcatagcaggggc

SEQ ID NO: 8114422 - DNA, 21 bp, Homo sapiens
gccctcaggggaggatggcct

SEQ ID NO: 8114423 - DNA, 22 bp, Homo sapiens
gccctcagagttccccacagtg

SEQ ID NO: 8114424 - DNA, 22 bp, Homo sapiens
gcccaggctggagtgcagtggc

SEQ ID NO: 8114425 - DNA, 22 bp, Homo sapiens
gccctcagctcctggacacatg

SEQ ID NO: 8114426 - DNA, 22 bp, Homo sapiens
gccctcagctcctggacacatg

SEQ ID NO: 8114427 - DNA, 22 bp, Homo sapiens
gcctctgccctcctgggactgc

SEQ ID NO: 8114428 - DNA, 19 bp, Homo sapiens
gcctctgctggggacaggc

SEQ ID NO: 8114429 - DNA, 22 bp, Homo sapiens
gcctctgctctcaggtagcctc

SEQ ID NO: 8114430 - DNA, 22 bp, Homo sapiens
gcctctgcatcatcactccagc

SEQ ID NO: 8114431 - DNA, 22 bp, Homo sapiens
gcctctgcatgctcagcaccca

SEQ ID NO: 8114432 - DNA, 22 bp, Homo sapiens
gcctcctgttatgccatgtgcc

SEQ ID NO: 8114433 - DNA, 22 bp, Homo sapiens
gcctcctgtcccaggctgagga

SEQ ID NO: 8114434 - DNA, 22 bp, Homo sapiens
gccgtgggtgtcatggcccata

SEQ ID NO: 8114435 - DNA, 22 bp, Homo sapiens
gccgggaccaaggccacggagc

SEQ ID NO: 8114436 - DNA, 22 bp, Homo sapiens
gcctgcctcaaaatcccagttc

SEQ ID NO: 8114437 - DNA, 20 bp, Homo sapiens
gcctgcctcagctagctgag

SEQ ID NO: 8114438 - DNA, 22 bp, Homo sapiens
gcctgcctgaaggctgtaccag

SEQ ID NO: 8114439 - DNA, 23 bp, Homo sapiens
gcctgcctgacctgtgcaaagtc

SEQ ID NO: 8114440 - DNA, 21 bp, Homo sapiens
gcctgcctgcgtgaccctctt

SEQ ID NO: 8114441 - DNA, 22 bp, Homo sapiens
gcctgcctgctgtcatctgcct

SEQ ID NO: 8114442 - DNA, 22 bp, Homo sapiens
gcctgcctgctgtgtgcaagtt

SEQ ID NO: 8114443 - DNA, 19 bp, Homo sapiens
gcctgcctgggtttctgag

SEQ ID NO: 8114444 - DNA, 22 bp, Homo sapiens
gcctgcctgttggctgaggtgc

SEQ ID NO: 8114445 - DNA, 22 bp, Homo sapiens
gcctgcctttgtatgaccctga

SEQ ID NO: 8114446 - DNA, 22 bp, Homo sapiens
gcctgccttcggtgcgcagcgg

SEQ ID NO: 8114447 - DNA, 21 bp, Homo sapiens
gcctgctgttcaccctgccac

SEQ ID NO: 8114448 - DNA, 22 bp, Homo sapiens
gcctgctgtcctgattcccatg

SEQ ID NO: 8114449 - DNA, 22 bp, Homo sapiens
gcctgcctttgtgaggaagcgg

SEQ ID NO: 8114450 - DNA, 22 bp, Homo sapiens
gcctggcattacagcactcctg

SEQ ID NO: 8114451 - DNA, 22 bp, Homo sapiens
gcctggcagttgacagtttgct

SEQ ID NO: 8114452 - DNA, 22 bp, Homo sapiens
gcctggcatatagtagttgtgc

SEQ ID NO: 8114453 - DNA, 22 bp, Homo sapiens
gcctggcagtggggccctggga

SEQ ID NO: 8114454 - DNA, 19 bp, Homo sapiens
gcctggcagtgtacaaggc

SEQ ID NO: 8114455 - DNA, 22 bp, Homo sapiens
gcctggcagggcccggacggca

SEQ ID NO: 8114456 - DNA, 21 bp, Homo sapiens
gcctggcaggtggaagggctc

SEQ ID NO: 8114457 - DNA, 22 bp, Homo sapiens
gcctggcaggggcctgggagtg

SEQ ID NO: 8114458 - DNA, 22 bp, Homo sapiens
gcctggcaggcctgggccagca

SEQ ID NO: 8114459 - DNA, 22 bp, Homo sapiens
gcctggcaggcctgttggggct

SEQ ID NO: 8114460 - DNA, 22 bp, Homo sapiens
gcctggcaggcctcatgagggg

SEQ ID NO: 8114461 - DNA, 22 bp, Homo sapiens
gcctggcattggagccggggca

SEQ ID NO: 8114462 - DNA, 22 bp, Homo sapiens
gcctggccgctccgagctccgc

SEQ ID NO: 8114463 - DNA, 22 bp, Homo sapiens
gcctgggaactctgatctcctg

SEQ ID NO: 8114464 - DNA, 22 bp, Homo sapiens
gcctgtgtggatgcgccggtgc

SEQ ID NO: 8114465 - DNA, 22 bp, Homo sapiens
gctcctggctccaggcagccaa

SEQ ID NO: 8114466 - DNA, 22 bp, Homo sapiens
gctcctggcaggcagtgtgtgt

SEQ ID NO: 8114467 - DNA, 22 bp, Homo sapiens
gctcctctgtcaaatgagagtg

SEQ ID NO: 8114468 - DNA, 22 bp, Homo sapiens
gctcctctcctcggagtcgggg

SEQ ID NO: 8114469 - DNA, 22 bp, Homo sapiens
gctcctctcccagagctgcagg

SEQ ID NO: 8114470 - DNA, 22 bp, Homo sapiens
gctccaggaggatgaccttcct

SEQ ID NO: 8114471 - DNA, 22 bp, Homo sapiens
gctccaggagctcacagctcgc

SEQ ID NO: 8114472 - DNA, 22 bp, Homo sapiens
gctccaggagagggaagcagat

SEQ ID NO: 8114473 - DNA, 20 bp, Homo sapiens
gctccaagcccctttagagg

SEQ ID NO: 8114474 - DNA, 22 bp, Homo sapiens
gctccactaggaatctgctctt

SEQ ID NO: 8114475 - DNA, 21 bp, Homo sapiens
gctccagaactctatgctaac

SEQ ID NO: 8114476 - DNA, 22 bp, Homo sapiens
gctccacttgcagctaggcttg

SEQ ID NO: 8114477 - DNA, 22 bp, Homo sapiens
gctccactgtttattggcagaa

SEQ ID NO: 8114478 - DNA, 22 bp, Homo sapiens
gctccactgcccctgggcaccg

SEQ ID NO: 8114479 - DNA, 22 bp, Homo sapiens
gctccactgtcccatgggactt

SEQ ID NO: 8114480 - DNA, 22 bp, Homo sapiens
gctccacttgattgttacagca

SEQ ID NO: 8114481 - DNA, 22 bp, Homo sapiens
gctccacttccttctgccctca

SEQ ID NO: 8114482 - DNA, 22 bp, Homo sapiens
gctcagaccccaccctggcaga

SEQ ID NO: 8114483 - DNA, 22 bp, Homo sapiens
gctcagagatgttcagtagctt

SEQ ID NO: 8114484 - DNA, 19 bp, Homo sapiens
gctcagagccatgggggct

SEQ ID NO: 8114485 - DNA, 22 bp, Homo sapiens
gctcagagcatcccagtgaatg

SEQ ID NO: 8114486 - DNA, 19 bp, Homo sapiens
gctcctgggcctcactcat

SEQ ID NO: 8114487 - DNA, 19 bp, Homo sapiens
gctcctgggcctcactcat

SEQ ID NO: 8114488 - DNA, 22 bp, Homo sapiens
gctcctggcttcactgacatca

SEQ ID NO: 8114489 - DNA, 22 bp, Homo sapiens
gctcctggcttcactgacatca

SEQ ID NO: 8114490 - DNA, 18 bp, Homo sapiens
gctgagcaaattcctccc

SEQ ID NO: 8114491 - DNA, 22 bp, Homo sapiens
gctgagagtgtgagatcagatt

SEQ ID NO: 8114492 - DNA, 22 bp, Homo sapiens
gctgaagacaatggaattgact

SEQ ID NO: 8114493 - DNA, 22 bp, Homo sapiens
gctcttctaaagaatgtacagg

SEQ ID NO: 8114494 - DNA, 17 bp, Homo sapiens
gctctgccaggaaagag

SEQ ID NO: 8114495 - DNA, 22 bp, Homo sapiens
gctggagaggatcccaaagcca

SEQ ID NO: 8114496 - DNA, 22 bp, Homo sapiens
gctgctgcaagagccagctctt

SEQ ID NO: 8114497 - DNA, 22 bp, Homo sapiens
gctgctctgggtctgcccagct

SEQ ID NO: 8114498 - DNA, 22 bp, Homo sapiens
gctgctctgttaattgctgtaa

SEQ ID NO: 8114499 - DNA, 21 bp, Homo sapiens
gctgctcgagatccagtgctt

SEQ ID NO: 8114500 - DNA, 22 bp, Homo sapiens
gctgctctcagagctcatgctg

SEQ ID NO: 8114501 - DNA, 22 bp, Homo sapiens
gctgaggatatagcaggaacaa

SEQ ID NO: 8114502 - DNA, 22 bp, Homo sapiens
gctgggatgcgtcttcccaggc

SEQ ID NO: 8114503 - DNA, 22 bp, Homo sapiens
gctggccttgtgtctgaggaag

SEQ ID NO: 8114504 - DNA, 22 bp, Homo sapiens
gctggcccagtgacccacagtg

SEQ ID NO: 8114505 - DNA, 22 bp, Homo sapiens
gctggagatagtaggatccata

SEQ ID NO: 8114506 - DNA, 22 bp, Homo sapiens
gcagggtgaaggtcacatagaa

SEQ ID NO: 8114507 - DNA, 22 bp, Homo sapiens
gcagggcaaatgtggaaaggag

SEQ ID NO: 8114508 - DNA, 22 bp, Homo sapiens
gcaggctgccctcttgtgttga

SEQ ID NO: 8114509 - DNA, 22 bp, Homo sapiens
gcaggctggaggctgttctggg

SEQ ID NO: 8114510 - DNA, 22 bp, Homo sapiens
gcaggctggaggctgttctggg

SEQ ID NO: 8114511 - DNA, 22 bp, Homo sapiens
gcaggctgccctcttgtgttga

SEQ ID NO: 8114512 - DNA, 22 bp, Homo sapiens
gcaggctgctgagatccttagg

SEQ ID NO: 8114513 - DNA, 22 bp, Homo sapiens
gcaggctgctgagatccttagg

SEQ ID NO: 8114514 - DNA, 22 bp, Homo sapiens
gcaggcagaggtggaggagaca

SEQ ID NO: 8114515 - DNA, 22 bp, Homo sapiens
gcaggctggggtagccccactt

SEQ ID NO: 8114516 - DNA, 22 bp, Homo sapiens
gcaggctggggtagccccactt

SEQ ID NO: 8114517 - DNA, 22 bp, Homo sapiens
gcaggctggggtagccccactt

SEQ ID NO: 8114518 - DNA, 22 bp, Homo sapiens
gcaggctggggtagccccactt

SEQ ID NO: 8114519 - DNA, 21 bp, Homo sapiens
gcaggctggtcaaacctcagt

SEQ ID NO: 8114520 - DNA, 21 bp, Homo sapiens
gcaggctggtcaaacctcagt

SEQ ID NO: 8114521 - DNA, 21 bp, Homo sapiens
gcaggctggtcaaacctcagt

SEQ ID NO: 8114522 - DNA, 21 bp, Homo sapiens
gcaggctggtcaaacctcagt

SEQ ID NO: 8114523 - DNA, 22 bp, Homo sapiens
gcaggctggtctgaccatccct

SEQ ID NO: 8114524 - DNA, 22 bp, Homo sapiens
gcaggctggtctgaccatccct

SEQ ID NO: 8114525 - DNA, 22 bp, Homo sapiens
gcaggctggtctgaccatccct

SEQ ID NO: 8114526 - DNA, 22 bp, Homo sapiens
gcagctattgtctcctgggccc

SEQ ID NO: 8114527 - DNA, 22 bp, Homo sapiens
gcagctcctttaggctgcaaag

SEQ ID NO: 8114528 - DNA, 18 bp, Homo sapiens
gcagctgacactggagtt

SEQ ID NO: 8114529 - DNA, 22 bp, Homo sapiens
gcagctctctggcctgccctgg

SEQ ID NO: 8114530 - DNA, 22 bp, Homo sapiens
gcaggagaaatgaagattgggt

SEQ ID NO: 8114531 - DNA, 22 bp, Homo sapiens
gcagctgagagaagaacagggc

SEQ ID NO: 8114532 - DNA, 22 bp, Homo sapiens
gcagtgggcctgaggaagggtg

SEQ ID NO: 8114533 - DNA, 22 bp, Homo sapiens
gcaggtggtggggctatgatct

SEQ ID NO: 8114534 - DNA, 22 bp, Homo sapiens
gcaggtgggagccgctgcctga

SEQ ID NO: 8114535 - DNA, 22 bp, Homo sapiens
gccacagcggggccgctagagc

SEQ ID NO: 8114536 - DNA, 22 bp, Homo sapiens
gccacagcttagatcacagcct

SEQ ID NO: 8114537 - DNA, 20 bp, Homo sapiens
gccagaggccggcaggggct

SEQ ID NO: 8114538 - DNA, 22 bp, Homo sapiens
gccagcagccacagaagtcact

SEQ ID NO: 8114539 - DNA, 22 bp, Homo sapiens
gatttctttgaattagagaggt

SEQ ID NO: 8114540 - DNA, 22 bp, Homo sapiens
gatttctttgcaagctgtgttc

SEQ ID NO: 8114541 - DNA, 22 bp, Homo sapiens
gatttctttgtacccacaatcc

SEQ ID NO: 8114542 - DNA, 22 bp, Homo sapiens
gatttctttaggtgtaatagtg

SEQ ID NO: 8114543 - DNA, 22 bp, Homo sapiens
gatttctttatgaagtacagaa

SEQ ID NO: 8114544 - DNA, 22 bp, Homo sapiens
gatttctttagctcatcagatc

SEQ ID NO: 8114545 - DNA, 22 bp, Homo sapiens
gatttcttggcccactctcaga

SEQ ID NO: 8114546 - DNA, 22 bp, Homo sapiens
gatttcttgataattcaaatcc

SEQ ID NO: 8114547 - DNA, 22 bp, Homo sapiens
gatttcttcaggagcagaggag

SEQ ID NO: 8114548 - DNA, 22 bp, Homo sapiens
gatttcttcatttgtggtgaat

SEQ ID NO: 8114549 - DNA, 22 bp, Homo sapiens
gatttcttcattcattagatgg

SEQ ID NO: 8114550 - DNA, 22 bp, Homo sapiens
gatttcttctctcccaagagga

SEQ ID NO: 8114551 - DNA, 22 bp, Homo sapiens
gatttcttgagcaagttgctta

SEQ ID NO: 8114552 - DNA, 22 bp, Homo sapiens
gatttcttgataagtagtgtga

SEQ ID NO: 8114553 - DNA, 22 bp, Homo sapiens
gatttcttgacccctgtctcag

SEQ ID NO: 8114554 - DNA, 21 bp, Homo sapiens
gattttaaagagactgccaca

SEQ ID NO: 8114555 - DNA, 22 bp, Homo sapiens
gattttaattataggaggtcct

SEQ ID NO: 8114556 - DNA, 22 bp, Homo sapiens
gattttaattataggaggtcct

SEQ ID NO: 8114557 - DNA, 21 bp, Homo sapiens
gattttaaagagactgccaca

SEQ ID NO: 8114558 - DNA, 22 bp, Homo sapiens
gattttatagtcaggaaaaaga

SEQ ID NO: 8114559 - DNA, 22 bp, Homo sapiens
gattttatatggcatactgtgg

SEQ ID NO: 8114560 - DNA, 22 bp, Homo sapiens
gattttcattatagctagtttc

SEQ ID NO: 8114561 - DNA, 22 bp, Homo sapiens
gattttcatgataaacttgtga

SEQ ID NO: 8114562 - DNA, 22 bp, Homo sapiens
gattttgaatattaaagaagag

SEQ ID NO: 8114563 - DNA, 22 bp, Homo sapiens
gatttttatataaagtgagaaa

SEQ ID NO: 8114564 - DNA, 22 bp, Homo sapiens
gcaaacatgttgtgagatacca

SEQ ID NO: 8114565 - DNA, 22 bp, Homo sapiens
gcacaaggagaattcattagtg

SEQ ID NO: 8114566 - DNA, 22 bp, Homo sapiens
gcacaagggtggtctctggagc

SEQ ID NO: 8114567 - DNA, 22 bp, Homo sapiens
gcacaagcagcccactgacatt

SEQ ID NO: 8114568 - DNA, 22 bp, Homo sapiens
gcacaagcacgagcagcgtgcg

SEQ ID NO: 8114569 - DNA, 22 bp, Homo sapiens
gcacctggacagtgaccctagc

SEQ ID NO: 8114570 - DNA, 22 bp, Homo sapiens
gcacccctgcgtgccttccctt

SEQ ID NO: 8114571 - DNA, 20 bp, Homo sapiens
gcacccagcttcttgttcta

SEQ ID NO: 8114572 - DNA, 22 bp, Homo sapiens
gcacccagtttgtctcagggtt

SEQ ID NO: 8114573 - DNA, 22 bp, Homo sapiens
gcacccaggcttgggcagcaac

SEQ ID NO: 8114574 - DNA, 22 bp, Homo sapiens
gcacccaggccggcgactgcag

SEQ ID NO: 8114575 - DNA, 22 bp, Homo sapiens
gcagaacatttcacagtatctt

SEQ ID NO: 8114576 - DNA, 22 bp, Homo sapiens
gcagaagaccatggtggaaaga

SEQ ID NO: 8114577 - DNA, 22 bp, Homo sapiens
gcagaagctgggagaagggatt

SEQ ID NO: 8114578 - DNA, 22 bp, Homo sapiens
gcagaagcagggcaggggcaaa

SEQ ID NO: 8114579 - DNA, 22 bp, Homo sapiens
gcagaagcagcagatgggcgca

SEQ ID NO: 8114580 - DNA, 22 bp, Homo sapiens
gcagaaggatccgcaggtgcaa

SEQ ID NO: 8114581 - DNA, 22 bp, Homo sapiens
gcagaagctgggcagcgaggtg

SEQ ID NO: 8114582 - DNA, 22 bp, Homo sapiens
gcagagcagtgcttgcccagcg

SEQ ID NO: 8114583 - DNA, 22 bp, Homo sapiens
gatttataaaggttgcactgga

SEQ ID NO: 8114584 - DNA, 22 bp, Homo sapiens
gatttatagtatgtgctttcag

SEQ ID NO: 8114585 - DNA, 21 bp, Homo sapiens
gatttataagccttaagccta

SEQ ID NO: 8114586 - DNA, 22 bp, Homo sapiens
gatttacaggttaggtcctgta

SEQ ID NO: 8114587 - DNA, 22 bp, Homo sapiens
gatttacagctatacccaatgg

SEQ ID NO: 8114588 - DNA, 22 bp, Homo sapiens
gatttacagatctaagggtcac

SEQ ID NO: 8114589 - DNA, 22 bp, Homo sapiens
gatttacaaagctctctagtgt

SEQ ID NO: 8114590 - DNA, 22 bp, Homo sapiens
gattaagagaagtttcttatcg

SEQ ID NO: 8114591 - DNA, 22 bp, Homo sapiens
gattaagattacatatttaagt

SEQ ID NO: 8114592 - DNA, 22 bp, Homo sapiens
gatgttctctgattggtggtag

SEQ ID NO: 8114593 - DNA, 22 bp, Homo sapiens
gatgttcttcgatgatctgttt

SEQ ID NO: 8114594 - DNA, 22 bp, Homo sapiens
gatggggatgagaagtgagcag

SEQ ID NO: 8114595 - DNA, 22 bp, Homo sapiens
gatgtacaaagagaggatttca

SEQ ID NO: 8114596 - DNA, 22 bp, Homo sapiens
gatgtacaatgtcactatgacc

SEQ ID NO: 8114597 - DNA, 22 bp, Homo sapiens
gatgtacaagtaaaatatgtgt

SEQ ID NO: 8114598 - DNA, 22 bp, Homo sapiens
gatgtacaagattgtaggaatg

SEQ ID NO: 8114599 - DNA, 22 bp, Homo sapiens
gatgtacatggattcctttcct

SEQ ID NO: 8114600 - DNA, 22 bp, Homo sapiens
gatgtacatgcaagcacttaga

SEQ ID NO: 8114601 - DNA, 21 bp, Homo sapiens
gatgtacatcaagcactttgc

SEQ ID NO: 8114602 - DNA, 22 bp, Homo sapiens
gatgtacaggagtttttcaagg

SEQ ID NO: 8114603 - DNA, 22 bp, Homo sapiens
gatggaagaaaaatgcatgtct

SEQ ID NO: 8114604 - DNA, 18 bp, Homo sapiens
gatgggagcaagagaaga

SEQ ID NO: 8114605 - DNA, 22 bp, Homo sapiens
gatggaggaaaagttggaatgc

SEQ ID NO: 8114606 - DNA, 22 bp, Homo sapiens
gatggacacctcctgaggttct

SEQ ID NO: 8114607 - DNA, 22 bp, Homo sapiens
gacttcagatattttttaagtt

SEQ ID NO: 8114608 - DNA, 22 bp, Homo sapiens
gacccagggtggtcacctgaaa

SEQ ID NO: 8114609 - DNA, 22 bp, Homo sapiens
gactggggtaaggtgaggaggt

SEQ ID NO: 8114610 - DNA, 22 bp, Homo sapiens
gacaggaggcagagctcaggtg

SEQ ID NO: 8114611 - DNA, 22 bp, Homo sapiens
gacccacctcaccaagcatgtg

SEQ ID NO: 8114612 - DNA, 18 bp, Homo sapiens
gacccaggaaagagtcct

SEQ ID NO: 8114613 - DNA, 22 bp, Homo sapiens
gacccaggaagctacttctggt

SEQ ID NO: 8114614 - DNA, 22 bp, Homo sapiens
gacccaggcaatgaacttactt

SEQ ID NO: 8114615 - DNA, 22 bp, Homo sapiens
gacccaggcccaaggctgccag

SEQ ID NO: 8114616 - DNA, 22 bp, Homo sapiens
gacccaggagagagggttgcat

SEQ ID NO: 8114617 - DNA, 22 bp, Homo sapiens
gacccaggagtgcagagagtgg

SEQ ID NO: 8114618 - DNA, 22 bp, Homo sapiens
gacccaggggtccatttctcct

SEQ ID NO: 8114619 - DNA, 22 bp, Homo sapiens
gacccaggggcagggagaaagt

SEQ ID NO: 8114620 - DNA, 22 bp, Homo sapiens
gacccaggctcgtgggacggct

SEQ ID NO: 8114621 - DNA, 22 bp, Homo sapiens
gacccagggtatccagagctgc

SEQ ID NO: 8114622 - DNA, 22 bp, Homo sapiens
gagacacaggcacagaagaggc

SEQ ID NO: 8114623 - DNA, 22 bp, Homo sapiens
gagacagagaggtactcaacat

SEQ ID NO: 8114624 - DNA, 22 bp, Homo sapiens
gagacacagttatcaggcatac

SEQ ID NO: 8114625 - DNA, 22 bp, Homo sapiens
gagacactcaacaaagatatga

SEQ ID NO: 8114626 - DNA, 22 bp, Homo sapiens
gagacacaagaagacatgcaca

SEQ ID NO: 8114627 - DNA, 22 bp, Homo sapiens
gagacacacacaggaggtggca

SEQ ID NO: 8114628 - DNA, 22 bp, Homo sapiens
gagacacacattctggagagaa

SEQ ID NO: 8114629 - DNA, 22 bp, Homo sapiens
gagagctgggctttgggtgaag

SEQ ID NO: 8114630 - DNA, 22 bp, Homo sapiens
gagagtccttagtttgcaggta

SEQ ID NO: 8114631 - DNA, 22 bp, Homo sapiens
gagagtccttagtttgcaggta

SEQ ID NO: 8114632 - DNA, 22 bp, Homo sapiens
gagaggtaatttgaagtgcaaa

SEQ ID NO: 8114633 - DNA, 22 bp, Homo sapiens
gagacagagatcttgctgagtc

SEQ ID NO: 8114634 - DNA, 22 bp, Homo sapiens
gagacagagtttcactcttgtt

SEQ ID NO: 8114635 - DNA, 22 bp, Homo sapiens
gaagtggaattactgggtcata

SEQ ID NO: 8114636 - DNA, 22 bp, Homo sapiens
gaagtacaaaggacatggaaac

SEQ ID NO: 8114637 - DNA, 22 bp, Homo sapiens
gaagggaaattcagatcttcag

SEQ ID NO: 8114638 - DNA, 22 bp, Homo sapiens
gaagtggaagccatcggcagtc

SEQ ID NO: 8114639 - DNA, 19 bp, Homo sapiens
gaaggctgaaatgaagcac

SEQ ID NO: 8114640 - DNA, 22 bp, Homo sapiens
gaaggctaaaggggcagaggtt

SEQ ID NO: 8114641 - DNA, 22 bp, Homo sapiens
gaaggctgagtgggtacggagg

SEQ ID NO: 8114642 - DNA, 22 bp, Homo sapiens
gaaggctgagcagacaggccaa

SEQ ID NO: 8114643 - DNA, 22 bp, Homo sapiens
gaaggctgcgaggggagtgccg

SEQ ID NO: 8114644 - DNA, 22 bp, Homo sapiens
gaaggaagtcattagtgcagac

SEQ ID NO: 8114645 - DNA, 22 bp, Homo sapiens
gaaggaagtcattagtgcagac

SEQ ID NO: 8114646 - DNA, 20 bp, Homo sapiens
gaaggaagggggcaaggtga

SEQ ID NO: 8114647 - DNA, 22 bp, Homo sapiens
gaaggaagtcattagtgcagac

SEQ ID NO: 8114648 - DNA, 21 bp, Homo sapiens
gaaggagaaagcaagtgctgc

SEQ ID NO: 8114649 - DNA, 22 bp, Homo sapiens
gaaggcctaggaaggaagcctt

SEQ ID NO: 8114650 - DNA, 22 bp, Homo sapiens
gaaggagagggtcaaggataat

SEQ ID NO: 8114651 - DNA, 22 bp, Homo sapiens
gaaggagaggattgtgaggctg

SEQ ID NO: 8114652 - DNA, 22 bp, Homo sapiens
gaattacatgaccctgagtaga

SEQ ID NO: 8114653 - DNA, 22 bp, Homo sapiens
gacacagcttgatgagggcttt

SEQ ID NO: 8114654 - DNA, 22 bp, Homo sapiens
gacacagcactgtacaaggaat

SEQ ID NO: 8114655 - DNA, 22 bp, Homo sapiens
gacagctgtgcaggagaagggg

SEQ ID NO: 8114656 - DNA, 19 bp, Homo sapiens
gacaggaaggctaccagta

SEQ ID NO: 8114657 - DNA, 19 bp, Homo sapiens
gacaggacgaagggaagtt

SEQ ID NO: 8114658 - DNA, 22 bp, Homo sapiens
gaaagggagtgaagatggtata

SEQ ID NO: 8114659 - DNA, 22 bp, Homo sapiens
gaaagtgcttttgagtgtgtgc

SEQ ID NO: 8114660 - DNA, 22 bp, Homo sapiens
gaaagtgctctctctatacaca

SEQ ID NO: 8114661 - DNA, 22 bp, Homo sapiens
gaaagtgcttagagtgtggtat

SEQ ID NO: 8114662 - DNA, 22 bp, Homo sapiens
gaaagtgctaggaagtgttaga

SEQ ID NO: 8114663 - DNA, 18 bp, Homo sapiens
gaaagtgcggggcagggg

SEQ ID NO: 8114664 - DNA, 22 bp, Homo sapiens
gaaaggggcatgtagggatcac

SEQ ID NO: 8114665 - DNA, 22 bp, Homo sapiens
gaaagggagtggacaacaggca

SEQ ID NO: 8114666 - DNA, 22 bp, Homo sapiens
gaaagtgccagaataggaggcc

SEQ ID NO: 8114667 - DNA, 22 bp, Homo sapiens
gaaagtgcctcagtcctcttat

SEQ ID NO: 8114668 - DNA, 22 bp, Homo sapiens
gaaaggttgggtgaatggtgga

SEQ ID NO: 8114669 - DNA, 22 bp, Homo sapiens
gaaagtgcatgtgcccaccatt

SEQ ID NO: 8114670 - DNA, 17 bp, Homo sapiens
cttttaatttacttccc

SEQ ID NO: 8114671 - DNA, 22 bp, Homo sapiens
cttttaatgggagcagtatttg

SEQ ID NO: 8114672 - DNA, 22 bp, Homo sapiens
cttttaatgagcattgctgtct

SEQ ID NO: 8114673 - DNA, 22 bp, Homo sapiens
gaaaagggcaagagagagggca

SEQ ID NO: 8114674 - DNA, 22 bp, Homo sapiens
gaactggtcagtttagcccact

SEQ ID NO: 8114675 - DNA, 22 bp, Homo sapiens
gaacacatgtcctccttggatt

SEQ ID NO: 8114676 - DNA, 22 bp, Homo sapiens
gaacacattagtctgagttggc

SEQ ID NO: 8114677 - DNA, 22 bp, Homo sapiens
gaacacatttctctgactgtag

SEQ ID NO: 8114678 - DNA, 22 bp, Homo sapiens
gaacactgagaaagtcagcttt

SEQ ID NO: 8114679 - DNA, 22 bp, Homo sapiens
gaacacatgattataaatgcta

SEQ ID NO: 8114680 - DNA, 22 bp, Homo sapiens
gaacacatcacattttacagtg

SEQ ID NO: 8114681 - DNA, 22 bp, Homo sapiens
gaacacaagcgtatgtctttgt

SEQ ID NO: 8114682 - DNA, 22 bp, Homo sapiens
gaaataacctcatgcaccatga

SEQ ID NO: 8114683 - DNA, 22 bp, Homo sapiens
gaaataacagctctggaagagt

SEQ ID NO: 8114684 - DNA, 22 bp, Homo sapiens
gaaagttttcatatataccaaa

SEQ ID NO: 8114685 - DNA, 22 bp, Homo sapiens
ctttgtagctgcttctgattta

SEQ ID NO: 8114686 - DNA, 18 bp, Homo sapiens
ctttagctgtcatctttg

SEQ ID NO: 8114687 - DNA, 22 bp, Homo sapiens
ctttagatgtgcaaaggagaaa

SEQ ID NO: 8114688 - DNA, 22 bp, Homo sapiens
ctttagaatttgatataatcaa

SEQ ID NO: 8114689 - DNA, 22 bp, Homo sapiens
ctttagaatttcatgtttggtc

SEQ ID NO: 8114690 - DNA, 22 bp, Homo sapiens
ctttagatcctggtgtctctct

SEQ ID NO: 8114691 - DNA, 22 bp, Homo sapiens
ctttacaattcaagggaactct

SEQ ID NO: 8114692 - DNA, 22 bp, Homo sapiens
ctttagaagggtaacggaatta

SEQ ID NO: 8114693 - DNA, 20 bp, Homo sapiens
ctttagaagaacccaagcat

SEQ ID NO: 8114694 - DNA, 22 bp, Homo sapiens
cttgggaggagaacaaagctcc

SEQ ID NO: 8114695 - DNA, 22 bp, Homo sapiens
ctttacaacctaagttgaagct

SEQ ID NO: 8114696 - DNA, 22 bp, Homo sapiens
cttggcttttgctcccagatca

SEQ ID NO: 8114697 - DNA, 22 bp, Homo sapiens
cttctcttgggtgtggtgtctt

SEQ ID NO: 8114698 - DNA, 22 bp, Homo sapiens
cttcttgagcatgggtagtact

SEQ ID NO: 8114699 - DNA, 22 bp, Homo sapiens
cttctctctgcataggcatggg

SEQ ID NO: 8114700 - DNA, 17 bp, Homo sapiens
cttctctggcagaagat

SEQ ID NO: 8114701 - DNA, 22 bp, Homo sapiens
ctggctggagtgcaggtgagtg

SEQ ID NO: 8114702 - DNA, 22 bp, Homo sapiens
ctggctggtcctcggggacagc

SEQ ID NO: 8114703 - DNA, 22 bp, Homo sapiens
cttctcagttgcaagtgtcaga

SEQ ID NO: 8114704 - DNA, 22 bp, Homo sapiens
cttctctccctggcactcagac

SEQ ID NO: 8114705 - DNA, 22 bp, Homo sapiens
cttctctcggtgcatccctcac

SEQ ID NO: 8114706 - DNA, 22 bp, Homo sapiens
gagtgagggcagcaggggctgc

SEQ ID NO: 8114707 - DNA, 22 bp, Homo sapiens
gagtgagtgctgggctgaggct

SEQ ID NO: 8114708 - DNA, 22 bp, Homo sapiens
gagtgagtggccaggaggcaga

SEQ ID NO: 8114709 - DNA, 22 bp, Homo sapiens
gagtccttctggctggcaggat

SEQ ID NO: 8114710 - DNA, 22 bp, Homo sapiens
gagtgcagttggggtgagggga

SEQ ID NO: 8114711 - DNA, 23 bp, Homo sapiens
gagtgcagaatagacatgcagtg

SEQ ID NO: 8114712 - DNA, 22 bp, Homo sapiens
gagtgggcaccgtgggcacact

SEQ ID NO: 8114713 - DNA, 21 bp, Homo sapiens
gagtgggacatgggagtggtt

SEQ ID NO: 8114714 - DNA, 22 bp, Homo sapiens
gagtggagatcgtgccactgca

SEQ ID NO: 8114715 - DNA, 21 bp, Homo sapiens
gagtggaacgctcttcacacc

SEQ ID NO: 8114716 - DNA, 22 bp, Homo sapiens
gagtggagcaaaagaggtagat

SEQ ID NO: 8114717 - DNA, 22 bp, Homo sapiens
gagtggagcaaaagaggtagat

SEQ ID NO: 8114718 - DNA, 22 bp, Homo sapiens
gataaacacaaggtgatttcat

SEQ ID NO: 8114719 - DNA, 22 bp, Homo sapiens
gataaacactgatgatatgggg

SEQ ID NO: 8114720 - DNA, 22 bp, Homo sapiens
gagttctgaactgtgaaatgca

SEQ ID NO: 8114721 - DNA, 22 bp, Homo sapiens
gagtgtgttattaaagatggaa

SEQ ID NO: 8114722 - DNA, 22 bp, Homo sapiens
gagtgtgttctttatgctgtga

SEQ ID NO: 8114723 - DNA, 22 bp, Homo sapiens
gagtgtggtgaacaggagcacc

SEQ ID NO: 8114724 - DNA, 22 bp, Homo sapiens
gagtggggtctgggcatcagtc

SEQ ID NO: 8114725 - DNA, 22 bp, Homo sapiens
gagtggggggtccgtctcagtg

SEQ ID NO: 8114726 - DNA, 22 bp, Homo sapiens
gatcacatgaatggaatagaag

SEQ ID NO: 8114727 - DNA, 21 bp, Homo sapiens
gatatttatgactcattcctt

SEQ ID NO: 8114728 - DNA, 22 bp, Homo sapiens
gatatttattaagtggttggta

SEQ ID NO: 8114729 - DNA, 22 bp, Homo sapiens
gatagtcacctcccttaacttt

SEQ ID NO: 8114730 - DNA, 19 bp, Homo sapiens
gatagctgatgaccatcat

SEQ ID NO: 8114731 - DNA, 22 bp, Homo sapiens
gatagaaaggtgttgaaatcca

SEQ ID NO: 8114732 - DNA, 22 bp, Homo sapiens
gatagaaagaatatagattcca

SEQ ID NO: 8114733 - DNA, 22 bp, Homo sapiens
gatacagtatttaaagagcaac

SEQ ID NO: 8114734 - DNA, 22 bp, Homo sapiens
gatacatttcaaggaggactgg

SEQ ID NO: 8114735 - DNA, 22 bp, Homo sapiens
gatgcaaagataaaacagacgc

SEQ ID NO: 8114736 - DNA, 22 bp, Homo sapiens
gatgcaaactgtgacatagagt

SEQ ID NO: 8114737 - DNA, 22 bp, Homo sapiens
gatgacagttctagcatctgaa

SEQ ID NO: 8114738 - DNA, 22 bp, Homo sapiens
gatgatgggttgatgtgaaggg

SEQ ID NO: 8114739 - DNA, 20 bp, Homo sapiens
gatgagacccatgcatgaga

SEQ ID NO: 8114740 - DNA, 22 bp, Homo sapiens
gatccctgccctcagcctggac

SEQ ID NO: 8114741 - DNA, 22 bp, Homo sapiens
gatgaaaaattgctgtgtcata

SEQ ID NO: 8114742 - DNA, 16 bp, Homo sapiens
gagggcagaggcggaa

SEQ ID NO: 8114743 - DNA, 16 bp, Homo sapiens
gagggcagaggcggaa

SEQ ID NO: 8114744 - DNA, 22 bp, Homo sapiens
gagggatgcagaaacagaggcc

SEQ ID NO: 8114745 - DNA, 22 bp, Homo sapiens
gaggctgcccacacctgcgccg

SEQ ID NO: 8114746 - DNA, 22 bp, Homo sapiens
gagggcagagtctaatgatgca

SEQ ID NO: 8114747 - DNA, 22 bp, Homo sapiens
gaggggaaagtgtgaggctgcg

SEQ ID NO: 8114748 - DNA, 22 bp, Homo sapiens
gaggggaagacttctggacagt

SEQ ID NO: 8114749 - DNA, 22 bp, Homo sapiens
gaggggaaagtgtgaggctgcg

SEQ ID NO: 8114750 - DNA, 22 bp, Homo sapiens
gagggccaaagagcaagagcct

SEQ ID NO: 8114751 - DNA, 22 bp, Homo sapiens
gaggggcaatgagggaaagagt

SEQ ID NO: 8114752 - DNA, 22 bp, Homo sapiens
gaggggcacagtaaagggtccc

SEQ ID NO: 8114753 - DNA, 22 bp, Homo sapiens
gaggggcagaggtagagaacaa

SEQ ID NO: 8114754 - DNA, 22 bp, Homo sapiens
gaggggcagaggtagagaacaa

SEQ ID NO: 8114755 - DNA, 22 bp, Homo sapiens
gagtcaggctagggtgacaggc

SEQ ID NO: 8114756 - DNA, 22 bp, Homo sapiens
gagtcaggcatgaaggtaatta

SEQ ID NO: 8114757 - DNA, 22 bp, Homo sapiens
gaggggccggcatgtgcctctc

SEQ ID NO: 8114758 - DNA, 22 bp, Homo sapiens
gaggggcctggcgaggacatgt

SEQ ID NO: 8114759 - DNA, 22 bp, Homo sapiens
gaggtcattacactttgtttgt

SEQ ID NO: 8114760 - DNA, 22 bp, Homo sapiens
gaggccctgaagacagctgggg

SEQ ID NO: 8114761 - DNA, 22 bp, Homo sapiens
gaggccctggtaggtcagagtg

SEQ ID NO: 8114762 - DNA, 22 bp, Homo sapiens
gaggccctccagctgtcagctg

SEQ ID NO: 8114763 - DNA, 22 bp, Homo sapiens
gaggcagcaggctgaggaggat

SEQ ID NO: 8114764 - DNA, 22 bp, Homo sapiens
gaggcagctgaagcttcaaaga

SEQ ID NO: 8114765 - DNA, 22 bp, Homo sapiens
gaggagggttggccttaggtag

SEQ ID NO: 8114766 - DNA, 22 bp, Homo sapiens
gaggcagaggttgcagtgagct

SEQ ID NO: 8114767 - DNA, 22 bp, Homo sapiens
gaggcagagtcacaaagagtct

SEQ ID NO: 8114768 - DNA, 22 bp, Homo sapiens
gaggcagcagaacatggaagag

SEQ ID NO: 8114769 - DNA, 23 bp, Homo sapiens
gaggagggtctgacaagtgtagc

SEQ ID NO: 8114770 - DNA, 23 bp, Homo sapiens
gaggagggtctgacaagtgtagc

SEQ ID NO: 8114771 - DNA, 22 bp, Homo sapiens
gaggagggagaattaggcttaa

SEQ ID NO: 8114772 - DNA, 22 bp, Homo sapiens
gaggagggagctggaagctctt

SEQ ID NO: 8114773 - DNA, 22 bp, Homo sapiens
gaggaatgttattaaaggagct

SEQ ID NO: 8114774 - DNA, 21 bp, Homo sapiens
gaggaatggtttgcaaagcac

SEQ ID NO: 8114775 - DNA, 22 bp, Homo sapiens
gaggaatgggtgtctcgtgatt

SEQ ID NO: 8114776 - DNA, 22 bp, Homo sapiens
gaggacagagccgcctggcaag

SEQ ID NO: 8114777 - DNA, 22 bp, Homo sapiens
gaggacagagccgcctggcaag

SEQ ID NO: 8114778 - DNA, 22 bp, Homo sapiens
gaggacagctctaactaaagtc

SEQ ID NO: 8114779 - DNA, 22 bp, Homo sapiens
gaggacagcttagggcttcctg

SEQ ID NO: 8114780 - DNA, 22 bp, Homo sapiens
gaggacagcttagggcttcctg

SEQ ID NO: 8114781 - DNA, 22 bp, Homo sapiens
gaggaagatggttgagtggtcc

SEQ ID NO: 8114782 - DNA, 22 bp, Homo sapiens
gaggaagggctgcctgccgggc

SEQ ID NO: 8114783 - DNA, 22 bp, Homo sapiens
gagctggccgcagagagggcag

SEQ ID NO: 8114784 - DNA, 22 bp, Homo sapiens
gagctggccgcagagagggcag

SEQ ID NO: 8114785 - DNA, 22 bp, Homo sapiens
gagagttccagtaagtggattc

SEQ ID NO: 8114786 - DNA, 22 bp, Homo sapiens
gagagtggaaagcaagctgagt

SEQ ID NO: 8114787 - DNA, 22 bp, Homo sapiens
gagagtctagtgcacctagttt

SEQ ID NO: 8114788 - DNA, 22 bp, Homo sapiens
gagagtgagatcctcctgggga

SEQ ID NO: 8114789 - DNA, 22 bp, Homo sapiens
gagagtgaggcatcaggggcag

SEQ ID NO: 8114790 - DNA, 22 bp, Homo sapiens
gagagtgaggcctgggaatcta

SEQ ID NO: 8114791 - DNA, 22 bp, Homo sapiens
gggctgagacgatggggtcttc

SEQ ID NO: 8114792 - DNA, 22 bp, Homo sapiens
gggctgagaattcagctttcct

SEQ ID NO: 8114793 - DNA, 22 bp, Homo sapiens
gggctgagaagttgatcccaag

SEQ ID NO: 8114794 - DNA, 22 bp, Homo sapiens
gggctggacatctaaggtagct

SEQ ID NO: 8114795 - DNA, 22 bp, Homo sapiens
gggctctgggtcgtgtctccat

SEQ ID NO: 8114796 - DNA, 23 bp, Homo sapiens
ggggaagtggcagtgagtgaggc

SEQ ID NO: 8114797 - DNA, 23 bp, Homo sapiens
ggggacagttcccactggggtct

SEQ ID NO: 8114798 - DNA, 22 bp, Homo sapiens
ggggacagttaaagaccaagac

SEQ ID NO: 8114799 - DNA, 22 bp, Homo sapiens
gggggtggttctaagtcctata

SEQ ID NO: 8114800 - DNA, 16 bp, Homo sapiens
gggggtgagagagagt

SEQ ID NO: 8114801 - DNA, 22 bp, Homo sapiens
gggggtgaggacaggagcactg

SEQ ID NO: 8114802 - DNA, 22 bp, Homo sapiens
gggtccaggcgtggcccagatg

SEQ ID NO: 8114803 - DNA, 22 bp, Homo sapiens
ggggaccctcaggactgcgtct

SEQ ID NO: 8114804 - DNA, 22 bp, Homo sapiens
gggggctcctcccagctgccag

SEQ ID NO: 8114805 - DNA, 22 bp, Homo sapiens
gggggctggaatatccatcaac

SEQ ID NO: 8114806 - DNA, 22 bp, Homo sapiens
gggtgaagctcctgcaggggcc

SEQ ID NO: 8114807 - DNA, 20 bp, Homo sapiens
gggtgagatgtaggagaggg

SEQ ID NO: 8114808 - DNA, 22 bp, Homo sapiens
gggatgaggatcaatcagggag

SEQ ID NO: 8114809 - DNA, 22 bp, Homo sapiens
gggatgaggatcaatcagggag

SEQ ID NO: 8114810 - DNA, 20 bp, Homo sapiens
gggatgagagtcctagctct

SEQ ID NO: 8114811 - DNA, 22 bp, Homo sapiens
gggagggaaggtacctgtgtga

SEQ ID NO: 8114812 - DNA, 22 bp, Homo sapiens
gggagggaaggaggcgccgtgt

SEQ ID NO: 8114813 - DNA, 22 bp, Homo sapiens
gggagggaaggaccttatgaat

SEQ ID NO: 8114814 - DNA, 22 bp, Homo sapiens
gggagggaaagcttgatctgtc

SEQ ID NO: 8114815 - DNA, 22 bp, Homo sapiens
gggatggagggtagagcaagtg

SEQ ID NO: 8114816 - DNA, 22 bp, Homo sapiens
gggatggatcttggctgaggct

SEQ ID NO: 8114817 - DNA, 22 bp, Homo sapiens
gggatggggagctggaaagggg

SEQ ID NO: 8114818 - DNA, 22 bp, Homo sapiens
gggaggaggaatgttttgtgta

SEQ ID NO: 8114819 - DNA, 20 bp, Homo sapiens
gggagaagggctgatgagag

SEQ ID NO: 8114820 - DNA, 22 bp, Homo sapiens
gggaggagcttggagattcact

SEQ ID NO: 8114821 - DNA, 22 bp, Homo sapiens
gggagaaggaggactgtgctgt

SEQ ID NO: 8114822 - DNA, 22 bp, Homo sapiens
gggagaaggagctagttcttga

SEQ ID NO: 8114823 - DNA, 22 bp, Homo sapiens
gggagaaggagctagttcttga

SEQ ID NO: 8114824 - DNA, 20 bp, Homo sapiens
gggagaagggctgatgagag

SEQ ID NO: 8114825 - DNA, 22 bp, Homo sapiens
gggacgagatcttggcagtgtg

SEQ ID NO: 8114826 - DNA, 22 bp, Homo sapiens
gggagaaggagctagttcttga

SEQ ID NO: 8114827 - DNA, 22 bp, Homo sapiens
gggagaagaatgtgtcaattgt

SEQ ID NO: 8114828 - DNA, 22 bp, Homo sapiens
gggagaagaatgtgtcaattgt

SEQ ID NO: 8114829 - DNA, 22 bp, Homo sapiens
gggcagcaaatctgagtctggt

SEQ ID NO: 8114830 - DNA, 22 bp, Homo sapiens
gggcagatgtctggacacctca

SEQ ID NO: 8114831 - DNA, 20 bp, Homo sapiens
gggcagcctcgggagtgggt

SEQ ID NO: 8114832 - DNA, 22 bp, Homo sapiens
gggccatgagaggttcatcaac

SEQ ID NO: 8114833 - DNA, 22 bp, Homo sapiens
gggccatgagaggttcatcaac

SEQ ID NO: 8114834 - DNA, 22 bp, Homo sapiens
gggaaatctcgtcctctattta

SEQ ID NO: 8114835 - DNA, 22 bp, Homo sapiens
gggaaaggatcagtgggaggct

SEQ ID NO: 8114836 - DNA, 22 bp, Homo sapiens
ggcttcctccttcctgctgtca

SEQ ID NO: 8114837 - DNA, 22 bp, Homo sapiens
gggaacagggcctgagctgggg

SEQ ID NO: 8114838 - DNA, 22 bp, Homo sapiens
ggcttcccagcagagggcgcac

SEQ ID NO: 8114839 - DNA, 22 bp, Homo sapiens
ggctgcaggatgcccagccgtg

SEQ ID NO: 8114840 - DNA, 22 bp, Homo sapiens
ggctgcaggaacgacggagggg

SEQ ID NO: 8114841 - DNA, 22 bp, Homo sapiens
ggctgcaggaacgacggagggg

SEQ ID NO: 8114842 - DNA, 22 bp, Homo sapiens
ggctgcaggatgcccagccgtg

SEQ ID NO: 8114843 - DNA, 22 bp, Homo sapiens
ggctgcaggcagggtatccact

SEQ ID NO: 8114844 - DNA, 22 bp, Homo sapiens
ggctgctgaacaagggaaccct

SEQ ID NO: 8114845 - DNA, 22 bp, Homo sapiens
ggctctagagactctagagaaa

SEQ ID NO: 8114846 - DNA, 22 bp, Homo sapiens
ggctccttcaagcctgtcactg

SEQ ID NO: 8114847 - DNA, 19 bp, Homo sapiens
ggctgcagagccccggcgc

SEQ ID NO: 8114848 - DNA, 22 bp, Homo sapiens
ggctgcagagctgggtgggcct

SEQ ID NO: 8114849 - DNA, 22 bp, Homo sapiens
ggctgcagaagtacttccggat

SEQ ID NO: 8114850 - DNA, 22 bp, Homo sapiens
ggctgcagcggattggggattg

SEQ ID NO: 8114851 - DNA, 22 bp, Homo sapiens
ggctgcagaggcccccagtggg

SEQ ID NO: 8114852 - DNA, 22 bp, Homo sapiens
ggctgcagaggcgatctgaggt

SEQ ID NO: 8114853 - DNA, 22 bp, Homo sapiens
ggctgcagagctggtgccctgg

SEQ ID NO: 8114854 - DNA, 22 bp, Homo sapiens
ggcccctgcggactgcctagag

SEQ ID NO: 8114855 - DNA, 17 bp, Homo sapiens
ggccagaggcggggctg

SEQ ID NO: 8114856 - DNA, 22 bp, Homo sapiens
ggccagaggccatcctcctgct

SEQ ID NO: 8114857 - DNA, 18 bp, Homo sapiens
ggccagagggagggtccc

SEQ ID NO: 8114858 - DNA, 22 bp, Homo sapiens
ggccacctgggatctcatcctg

SEQ ID NO: 8114859 - DNA, 22 bp, Homo sapiens
ggccacctgggttcgactgggc

SEQ ID NO: 8114860 - DNA, 22 bp, Homo sapiens
ggccttgggaggagggtcagaa

SEQ ID NO: 8114861 - DNA, 22 bp, Homo sapiens
ggctccaagtctcagagtgaag

SEQ ID NO: 8114862 - DNA, 22 bp, Homo sapiens
ggctcaggtttaaagtgcttta

SEQ ID NO: 8114863 - DNA, 22 bp, Homo sapiens
ggcctgggcctttgtgttttga

SEQ ID NO: 8114864 - DNA, 22 bp, Homo sapiens
ggcctgggcccactgtcaagag

SEQ ID NO: 8114865 - DNA, 22 bp, Homo sapiens
ggcccctggcaccaggctgatt

SEQ ID NO: 8114866 - DNA, 22 bp, Homo sapiens
ggccttccttcccagcctactg

SEQ ID NO: 8114867 - DNA, 22 bp, Homo sapiens
ggccttgccaaggagcccttaa

SEQ ID NO: 8114868 - DNA, 22 bp, Homo sapiens
ggccttggaaagatacccagct

SEQ ID NO: 8114869 - DNA, 22 bp, Homo sapiens
ggaggcggaggttgcagtgagc

SEQ ID NO: 8114870 - DNA, 22 bp, Homo sapiens
ggaggcggaggttgcagtgagt

SEQ ID NO: 8114871 - DNA, 20 bp, Homo sapiens
ggagggcagctgagagttgg

SEQ ID NO: 8114872 - DNA, 22 bp, Homo sapiens
ggagggaatgtctagcattctt

SEQ ID NO: 8114873 - DNA, 22 bp, Homo sapiens
ggagggacccactctagaggtg

SEQ ID NO: 8114874 - DNA, 22 bp, Homo sapiens
ggagggacccactgcggtgacc

SEQ ID NO: 8114875 - DNA, 22 bp, Homo sapiens
ggagggagagtgaccctaccaa

SEQ ID NO: 8114876 - DNA, 22 bp, Homo sapiens
ggaggtggtggcagtgacaatt

SEQ ID NO: 8114877 - DNA, 22 bp, Homo sapiens
ggaggtgggagcctccagtggt

SEQ ID NO: 8114878 - DNA, 22 bp, Homo sapiens
ggaggtggcagggaacataatt

SEQ ID NO: 8114879 - DNA, 22 bp, Homo sapiens
ggaggtgggagacataggcggc

SEQ ID NO: 8114880 - DNA, 22 bp, Homo sapiens
ggagggtgggtcattcttacat

SEQ ID NO: 8114881 - DNA, 20 bp, Homo sapiens
ggagggtggaagaaagcaag

SEQ ID NO: 8114882 - DNA, 20 bp, Homo sapiens
ggagggtggaagaaagcaag

SEQ ID NO: 8114883 - DNA, 22 bp, Homo sapiens
ggaggtggaggttgcagtgagc

SEQ ID NO: 8114884 - DNA, 22 bp, Homo sapiens
ggaggtggcagagggacattct

SEQ ID NO: 8114885 - DNA, 22 bp, Homo sapiens
ggagggggaagaagctaaagac

SEQ ID NO: 8114886 - DNA, 22 bp, Homo sapiens
ggagggggaaactttggctgcc

SEQ ID NO: 8114887 - DNA, 22 bp, Homo sapiens
ggaggggctcctgttcgccccc

SEQ ID NO: 8114888 - DNA, 22 bp, Homo sapiens
ggaggggctgagcaactttcag

SEQ ID NO: 8114889 - DNA, 22 bp, Homo sapiens
ggaggggaggattaatgacaaa

SEQ ID NO: 8114890 - DNA, 22 bp, Homo sapiens
ggaggggtggtcacctggcagg

SEQ ID NO: 8114891 - DNA, 22 bp, Homo sapiens
ggaggggtggtcgcgaagagca

SEQ ID NO: 8114892 - DNA, 22 bp, Homo sapiens
ggaggggtggtcgcgaagagca

SEQ ID NO: 8114893 - DNA, 22 bp, Homo sapiens
ggagggggactgacactgattt

SEQ ID NO: 8114894 - DNA, 22 bp, Homo sapiens
ggaggggtctctagcgaggaga

SEQ ID NO: 8114895 - DNA, 22 bp, Homo sapiens
ggaggggtgctcagctgtcacg

SEQ ID NO: 8114896 - DNA, 22 bp, Homo sapiens
ggaggggtgctcagctgtcacg

SEQ ID NO: 8114897 - DNA, 22 bp, Homo sapiens
ggaggggtctctagcgaggaga

SEQ ID NO: 8114898 - DNA, 22 bp, Homo sapiens
ggaggggtgagaatggctgcct

SEQ ID NO: 8114899 - DNA, 23 bp, Homo sapiens
ggcagctctcatctgatgactga

SEQ ID NO: 8114900 - DNA, 20 bp, Homo sapiens
ggcagctctagtcgaggccc

SEQ ID NO: 8114901 - DNA, 22 bp, Homo sapiens
ggcagctctgctccttggctcc

SEQ ID NO: 8114902 - DNA, 22 bp, Homo sapiens
ggcagctctgctccacatgagt

SEQ ID NO: 8114903 - DNA, 22 bp, Homo sapiens
ggcacacagcggaatttgctct

SEQ ID NO: 8114904 - DNA, 22 bp, Homo sapiens
ggcacacagatggagcactagc

SEQ ID NO: 8114905 - DNA, 22 bp, Homo sapiens
ggagtggtgtcactgagaggaa

SEQ ID NO: 8114906 - DNA, 22 bp, Homo sapiens
ggagtgggcagcactgccctgt

SEQ ID NO: 8114907 - DNA, 22 bp, Homo sapiens
ggagtggcagcgaggatcagat

SEQ ID NO: 8114908 - DNA, 22 bp, Homo sapiens
ggcagacctctccagccccaca

SEQ ID NO: 8114909 - DNA, 22 bp, Homo sapiens
ggcagacaatctgtctgttagg

SEQ ID NO: 8114910 - DNA, 23 bp, Homo sapiens
ggcacagatgctgagcatgtgca

SEQ ID NO: 8114911 - DNA, 22 bp, Homo sapiens
ggcacagaggttgcctccagat

SEQ ID NO: 8114912 - DNA, 22 bp, Homo sapiens
ggcacagagctttgtcccagtt

SEQ ID NO: 8114913 - DNA, 22 bp, Homo sapiens
ggcacagagcaggccactaatc

SEQ ID NO: 8114914 - DNA, 22 bp, Homo sapiens
ggcacagagcccagcttcctag

SEQ ID NO: 8114915 - DNA, 22 bp, Homo sapiens
ggcacagagctccagccttggc

SEQ ID NO: 8114916 - DNA, 22 bp, Homo sapiens
gcttctgagttcttgcttaata

SEQ ID NO: 8114917 - DNA, 22 bp, Homo sapiens
gcttctgctgttgaagccacca

SEQ ID NO: 8114918 - DNA, 22 bp, Homo sapiens
gcttctagggaaggcagtcaca

SEQ ID NO: 8114919 - DNA, 22 bp, Homo sapiens
gcttctgaggaaggctcagcct

SEQ ID NO: 8114920 - DNA, 22 bp, Homo sapiens
gctgggctgcgtcggggaagcc

SEQ ID NO: 8114921 - DNA, 22 bp, Homo sapiens
gctgggctccaggccagggtga

SEQ ID NO: 8114922 - DNA, 22 bp, Homo sapiens
ggaactcctgctccaagcagct

SEQ ID NO: 8114923 - DNA, 19 bp, Homo sapiens
ggaactcacttagagaaac

SEQ ID NO: 8114924 - DNA, 22 bp, Homo sapiens
ggaactcagtatcagactccag

SEQ ID NO: 8114925 - DNA, 22 bp, Homo sapiens
ggaactcagacgatcctatgtt

SEQ ID NO: 8114926 - DNA, 22 bp, Homo sapiens
ggaaagccaggtgctctggtgt

SEQ ID NO: 8114927 - DNA, 22 bp, Homo sapiens
ggaaagaggatagtgggtaggt

SEQ ID NO: 8114928 - DNA, 22 bp, Homo sapiens
ggaaagagctaaaagggtgaga

SEQ ID NO: 8114929 - DNA, 23 bp, Homo sapiens
ggaaagagaggagttgtgcatag

SEQ ID NO: 8114930 - DNA, 22 bp, Homo sapiens
ggaaagagcccagcagtgcttg

SEQ ID NO: 8114931 - DNA, 22 bp, Homo sapiens
ggaagaaaagcttccagcgcct

SEQ ID NO: 8114932 - DNA, 22 bp, Homo sapiens
ggaactgaggaacgaactggga

SEQ ID NO: 8114933 - DNA, 18 bp, Homo sapiens
ggaagaaaaggaactcag

SEQ ID NO: 8114934 - DNA, 17 bp, Homo sapiens
ggaagaaaaggatcatc

SEQ ID NO: 8114935 - DNA, 22 bp, Homo sapiens
ggaagaaaatgggcaacaggtg

SEQ ID NO: 8114936 - DNA, 22 bp, Homo sapiens
ggaagaaagacatttattttga

SEQ ID NO: 8114937 - DNA, 22 bp, Homo sapiens
ggaagaaagcacacaaacttga

SEQ ID NO: 8114938 - DNA, 22 bp, Homo sapiens
ggaagaaagcacacaaacttga

SEQ ID NO: 8114939 - DNA, 22 bp, Homo sapiens
ggaagaaaggtggacaacaggt

SEQ ID NO: 8114940 - DNA, 22 bp, Homo sapiens
ggaagaaagtagaaaaccgtgg

SEQ ID NO: 8114941 - DNA, 22 bp, Homo sapiens
ggaagaaatctggttaagagat

SEQ ID NO: 8114942 - DNA, 22 bp, Homo sapiens
ggaagaaaggtggacaacaggt

SEQ ID NO: 8114943 - DNA, 22 bp, Homo sapiens
ggaaggggtgggtgagcctcag

SEQ ID NO: 8114944 - DNA, 21 bp, Homo sapiens
ggaaggggtcctcccaacagt

SEQ ID NO: 8114945 - DNA, 22 bp, Homo sapiens
ggaagggcaataaaatctcagg

SEQ ID NO: 8114946 - DNA, 22 bp, Homo sapiens
ggaagggcaaaagagatgaact

SEQ ID NO: 8114947 - DNA, 22 bp, Homo sapiens
ggaaggggtcacctcctgatga

SEQ ID NO: 8114948 - DNA, 22 bp, Homo sapiens
ggaagaaatgctcttctatgcg

SEQ ID NO: 8114949 - DNA, 22 bp, Homo sapiens
ggaaggggtgtcgcccatggat

SEQ ID NO: 8114950 - DNA, 22 bp, Homo sapiens
ggaaggggttaggggtccctga

SEQ ID NO: 8114951 - DNA, 22 bp, Homo sapiens
ggaggccatgaggctctaggtg

SEQ ID NO: 8114952 - DNA, 22 bp, Homo sapiens
ggaggaggcaagtaccagatgc

SEQ ID NO: 8114953 - DNA, 22 bp, Homo sapiens
ggaggccaccatggagtcactt

SEQ ID NO: 8114954 - DNA, 22 bp, Homo sapiens
ggaggaagaggttgttctctca

SEQ ID NO: 8114955 - DNA, 22 bp, Homo sapiens
ggaggaagtgcagttctactac

SEQ ID NO: 8114956 - DNA, 22 bp, Homo sapiens
ggaggacaggggctgcagcaca

SEQ ID NO: 8114957 - DNA, 22 bp, Homo sapiens
ggaggagcatgagagggtagtg

SEQ ID NO: 8114958 - DNA, 22 bp, Homo sapiens
ggagctgcaagtgttgagagct

SEQ ID NO: 8114959 - DNA, 22 bp, Homo sapiens
ggagaaggaatattggagtagg

SEQ ID NO: 8114960 - DNA, 21 bp, Homo sapiens
ggagaaggacaatgttgagta

SEQ ID NO: 8114961 - DNA, 22 bp, Homo sapiens
ggagaaggaatattggagtagg

SEQ ID NO: 8114962 - DNA, 22 bp, Homo sapiens
ggagaatgattctttgctcact

SEQ ID NO: 8114963 - DNA, 22 bp, Homo sapiens
ggagaatgatatatagctcagt

SEQ ID NO: 8114964 - DNA, 22 bp, Homo sapiens
ggagaaggtggctcagcaaagg

SEQ ID NO: 8114965 - DNA, 22 bp, Homo sapiens
ggagacagcaggaagaaatatc

SEQ ID NO: 8114966 - DNA, 17 bp, Homo sapiens
ggagacagggtctttaa

SEQ ID NO: 8114967 - DNA, 22 bp, Homo sapiens
ggaaggtgctccctggacagag

SEQ ID NO: 8114968 - DNA, 18 bp, Homo sapiens
ggaagtaggaagaggaag

SEQ ID NO: 8114969 - DNA, 22 bp, Homo sapiens
ggagaagcaggtgctttgggtc

SEQ ID NO: 8114970 - DNA, 22 bp, Homo sapiens
ggaatagtttatgtagctgaat

SEQ ID NO: 8114971 - DNA, 19 bp, Homo sapiens
ggagaagcatctagaaata

SEQ ID NO: 8114972 - DNA, 22 bp, Homo sapiens
ggagaagccacacattgggtgt

SEQ ID NO: 8114973 - DNA, 22 bp, Homo sapiens
ggagaagccaggtgataagcaa

SEQ ID NO: 8114974 - DNA, 19 bp, Homo sapiens
ggagaagcccaggaatcct

SEQ ID NO: 8114975 - DNA, 22 bp, Homo sapiens
ggaataaaaattgtttactgta

SEQ ID NO: 8114976 - DNA, 22 bp, Homo sapiens
ggaatagtagttggggaatggc

SEQ ID NO: 8114977 - DNA, 22 bp, Homo sapiens
ggagatgctttccagtggggat

SEQ ID NO: 8114978 - DNA, 20 bp, Homo sapiens
ggagatgcagcccaggtgcc

SEQ ID NO: 8114979 - DNA, 22 bp, Homo sapiens
ggagatgccagaattgcaaatt

SEQ ID NO: 8114980 - DNA, 22 bp, Homo sapiens
ggagatgctatgtagtttggtt

SEQ ID NO: 8114981 - DNA, 23 bp, Homo sapiens
ggagaggggtgtgggcatcttta

SEQ ID NO: 8114982 - DNA, 23 bp, Homo sapiens
ggagaggggtgtgggcatcttta

SEQ ID NO: 8114983 - DNA, 22 bp, Homo sapiens
ggagaggggaacttgttgcttg

SEQ ID NO: 8114984 - DNA, 22 bp, Homo sapiens
ggagagggtgtggaaagttatc

SEQ ID NO: 8114985 - DNA, 22 bp, Homo sapiens
ggagagggtaggggtcctgccc

SEQ ID NO: 8114986 - DNA, 22 bp, Homo sapiens
taaatcactgttcattccacac

SEQ ID NO: 8114987 - DNA, 22 bp, Homo sapiens
taaatagaatctaaactgctca

SEQ ID NO: 8114988 - DNA, 22 bp, Homo sapiens
taaatcagtagatatggtatag

SEQ ID NO: 8114989 - DNA, 22 bp, Homo sapiens
taaatgacattcttaagtcttg

SEQ ID NO: 8114990 - DNA, 22 bp, Homo sapiens
taaatgacccatgctgacctca

SEQ ID NO: 8114991 - DNA, 22 bp, Homo sapiens
taacactggcttttgctgaggc

SEQ ID NO: 8114992 - DNA, 22 bp, Homo sapiens
taacactggttatccctgtgca

SEQ ID NO: 8114993 - DNA, 21 bp, Homo sapiens
taacagcagggaaatacgtgc

SEQ ID NO: 8114994 - DNA, 22 bp, Homo sapiens
gtttaattcccacacctgccct

SEQ ID NO: 8114995 - DNA, 22 bp, Homo sapiens
taaaacactcagcacctagcaa

SEQ ID NO: 8114996 - DNA, 22 bp, Homo sapiens
gtggggtgggctgagttaggcc

SEQ ID NO: 8114997 - DNA, 18 bp, Homo sapiens
gtggggtgttgtgaggat

SEQ ID NO: 8114998 - DNA, 22 bp, Homo sapiens
gtggggtgtccagcagcgagct

SEQ ID NO: 8114999 - DNA, 18 bp, Homo sapiens
gtggggtgttgtgaggat

SEQ ID NO: 8115000 - DNA, 21 bp, Homo sapiens
gtggttctagagaaacagaat

SEQ ID NO: 8115001 - DNA, 22 bp, Homo sapiens
gtggtgtgtgcttagggctagg

SEQ ID NO: 8115002 - DNA, 22 bp, Homo sapiens
gtggtgaagccccatctctgct

SEQ ID NO: 8115003 - DNA, 22 bp, Homo sapiens
gtgtacagatatctcacgttct

SEQ ID NO: 8115004 - DNA, 22 bp, Homo sapiens
gtgtacagatatctcacgttct

SEQ ID NO: 8115005 - DNA, 22 bp, Homo sapiens
gtgtcaatgaggtttatttttg

SEQ ID NO: 8115006 - DNA, 22 bp, Homo sapiens
gtggttttgccattacaagtaa

SEQ ID NO: 8115007 - DNA, 22 bp, Homo sapiens
gtggtttttagatttctacagt

SEQ ID NO: 8115008 - DNA, 22 bp, Homo sapiens
gtggttttggaggccactgttt

SEQ ID NO: 8115009 - DNA, 22 bp, Homo sapiens
gtggttttgctttatgagtgaa

SEQ ID NO: 8115010 - DNA, 19 bp, Homo sapiens
gtggttttctgaggagtct

SEQ ID NO: 8115011 - DNA, 22 bp, Homo sapiens
gtggttttctccaacccagaac

SEQ ID NO: 8115012 - DNA, 22 bp, Homo sapiens
gtggttttattcgttcctctgt

SEQ ID NO: 8115013 - DNA, 22 bp, Homo sapiens
gtggttttaatattcagtctag

SEQ ID NO: 8115014 - DNA, 22 bp, Homo sapiens
gtggttttacaaagagaaagat

SEQ ID NO: 8115015 - DNA, 22 bp, Homo sapiens
gtgggccacatcccagggctct

SEQ ID NO: 8115016 - DNA, 22 bp, Homo sapiens
gtgggcagacagtgctttgcag

SEQ ID NO: 8115017 - DNA, 22 bp, Homo sapiens
gtggggaaaggagtggggctca

SEQ ID NO: 8115018 - DNA, 22 bp, Homo sapiens
gtggggaaaggagtggggctca

SEQ ID NO: 8115019 - DNA, 22 bp, Homo sapiens
gtgggctggagcaatgatttca

SEQ ID NO: 8115020 - DNA, 22 bp, Homo sapiens
gtgggctgcccttgaggtcagc

SEQ ID NO: 8115021 - DNA, 22 bp, Homo sapiens
gttcaaggaagggaggaaagcc

SEQ ID NO: 8115022 - DNA, 18 bp, Homo sapiens
gttcaaggtcaagagaga

SEQ ID NO: 8115023 - DNA, 22 bp, Homo sapiens
gttcaaggttttacagagtgta

SEQ ID NO: 8115024 - DNA, 22 bp, Homo sapiens
gttattttcattggctcagact

SEQ ID NO: 8115025 - DNA, 22 bp, Homo sapiens
gttattttatctctgagaggtt

SEQ ID NO: 8115026 - DNA, 21 bp, Homo sapiens
gttattttaagtgagctttgc

SEQ ID NO: 8115027 - DNA, 22 bp, Homo sapiens
gttattttaacttctcagtaat

SEQ ID NO: 8115028 - DNA, 22 bp, Homo sapiens
gttctcagtggggagcagggtt

SEQ ID NO: 8115029 - DNA, 22 bp, Homo sapiens
gttgttcttctcatccagcttg

SEQ ID NO: 8115030 - DNA, 22 bp, Homo sapiens
gtgtggtcgaagttctcccgga

SEQ ID NO: 8115031 - DNA, 22 bp, Homo sapiens
gtgtggggagctgcagccacat

SEQ ID NO: 8115032 - DNA, 22 bp, Homo sapiens
gtgtgggctgcagaggcacagc

SEQ ID NO: 8115033 - DNA, 22 bp, Homo sapiens
gtgtgcagtctgctaggcaggg

SEQ ID NO: 8115034 - DNA, 22 bp, Homo sapiens
gtgtgcagggctgcctgtgccg

SEQ ID NO: 8115035 - DNA, 22 bp, Homo sapiens
gtgtgcagggatgagtgcaggt

SEQ ID NO: 8115036 - DNA, 22 bp, Homo sapiens
gtgtgcaggccacaggccaggg

SEQ ID NO: 8115037 - DNA, 22 bp, Homo sapiens
gtgtgcaggtgtcagtgcagct

SEQ ID NO: 8115038 - DNA, 22 bp, Homo sapiens
gtgtgcagggggccagcgcagc

SEQ ID NO: 8115039 - DNA, 22 bp, Homo sapiens
gtgtgcagcagagacaggactc

SEQ ID NO: 8115040 - DNA, 22 bp, Homo sapiens
gtgtgcacagagctccagtgtt

SEQ ID NO: 8115041 - DNA, 22 bp, Homo sapiens
gtgtcctgcaggccaggaatgg

SEQ ID NO: 8115042 - DNA, 22 bp, Homo sapiens
gtaaatataaatgctagctgcc

SEQ ID NO: 8115043 - DNA, 22 bp, Homo sapiens
gtaaataactggtaattggggt

SEQ ID NO: 8115044 - DNA, 22 bp, Homo sapiens
gtaaatattaaaggctgctaga

SEQ ID NO: 8115045 - DNA, 22 bp, Homo sapiens
gtacacaaagtgagacttgata

SEQ ID NO: 8115046 - DNA, 22 bp, Homo sapiens
gtacacaaataataaagttaca

SEQ ID NO: 8115047 - DNA, 22 bp, Homo sapiens
gtacagattaataatatactga

SEQ ID NO: 8115048 - DNA, 22 bp, Homo sapiens
gtaaagatggtattttggagtt

SEQ ID NO: 8115049 - DNA, 23 bp, Homo sapiens
gtaaaatacgcagtgcagtgtga

SEQ ID NO: 8115050 - DNA, 22 bp, Homo sapiens
ggtgtcctcatgattttctaga

SEQ ID NO: 8115051 - DNA, 20 bp, Homo sapiens
gtatataaccatagtgacta

SEQ ID NO: 8115052 - DNA, 22 bp, Homo sapiens
gtacatgcagattatagctaat

SEQ ID NO: 8115053 - DNA, 22 bp, Homo sapiens
gtacaggttggctctatcgctg

SEQ ID NO: 8115054 - DNA, 22 bp, Homo sapiens
gtacaggtcttatctcctagga

SEQ ID NO: 8115055 - DNA, 22 bp, Homo sapiens
ggtgaggggagagtgaaagaaa

SEQ ID NO: 8115056 - DNA, 22 bp, Homo sapiens
ggtgagggtaaactaaaacatc

SEQ ID NO: 8115057 - DNA, 22 bp, Homo sapiens
ggtggcagaggtgcatcagccc

SEQ ID NO: 8115058 - DNA, 22 bp, Homo sapiens
ggtgcaggagcggggtgctcgg

SEQ ID NO: 8115059 - DNA, 22 bp, Homo sapiens
ggtggccataggaccagcctgg

SEQ ID NO: 8115060 - DNA, 22 bp, Homo sapiens
ggtggccaggccagctctggcc

SEQ ID NO: 8115061 - DNA, 22 bp, Homo sapiens
ggtgtagctctgtgtcccactg

SEQ ID NO: 8115062 - DNA, 22 bp, Homo sapiens
gtcccagggccaccatatatag

SEQ ID NO: 8115063 - DNA, 21 bp, Homo sapiens
gtcagctgtgtgtgaggaccc

SEQ ID NO: 8115064 - DNA, 22 bp, Homo sapiens
gtcagctgcagtgggcacagcc

SEQ ID NO: 8115065 - DNA, 22 bp, Homo sapiens
gtcagctgcagtgggcacagcc

SEQ ID NO: 8115066 - DNA, 22 bp, Homo sapiens
gtcaggagagatcaggacagca

SEQ ID NO: 8115067 - DNA, 20 bp, Homo sapiens
gtctggcttcgtgattctgg

SEQ ID NO: 8115068 - DNA, 22 bp, Homo sapiens
gtctggagtggtggatttaaag

SEQ ID NO: 8115069 - DNA, 22 bp, Homo sapiens
gtctgggggtccgggtgcctgc

SEQ ID NO: 8115070 - DNA, 22 bp, Homo sapiens
gtctctgagctctgagctggct

SEQ ID NO: 8115071 - DNA, 22 bp, Homo sapiens
gtggccaggagaccttgggcat

SEQ ID NO: 8115072 - DNA, 22 bp, Homo sapiens
gtggccaatttccatctgtaag

SEQ ID NO: 8115073 - DNA, 22 bp, Homo sapiens
gtggccaagaggggactggata

SEQ ID NO: 8115074 - DNA, 22 bp, Homo sapiens
gtggccaagagataaaattgtg

SEQ ID NO: 8115075 - DNA, 22 bp, Homo sapiens
gtggcagctgtgggacactggt

SEQ ID NO: 8115076 - DNA, 22 bp, Homo sapiens
gtggcagctctcttgatttccc

SEQ ID NO: 8115077 - DNA, 22 bp, Homo sapiens
gtggcagctggtatgcagacag

SEQ ID NO: 8115078 - DNA, 21 bp, Homo sapiens
gtggctctgccaggactgaaa

SEQ ID NO: 8115079 - DNA, 22 bp, Homo sapiens
gtggctctctggtcccctgcca

SEQ ID NO: 8115080 - DNA, 22 bp, Homo sapiens
gtggcctctgttggctcctagg

SEQ ID NO: 8115081 - DNA, 22 bp, Homo sapiens
gtggcctctgtgctcctgccta

SEQ ID NO: 8115082 - DNA, 23 bp, Homo sapiens
gtggcctccccggaatgcctcgc

SEQ ID NO: 8115083 - DNA, 22 bp, Homo sapiens
gtggctgcagagggcacagcat

SEQ ID NO: 8115084 - DNA, 22 bp, Homo sapiens
gtgacaatattagctcaggggc

SEQ ID NO: 8115085 - DNA, 22 bp, Homo sapiens
gtgacagtcaaagacatgactt

SEQ ID NO: 8115086 - DNA, 22 bp, Homo sapiens
gtgcgcaccctcccggcatccc

SEQ ID NO: 8115087 - DNA, 22 bp, Homo sapiens
gtggaaggaattaacagactag

SEQ ID NO: 8115088 - DNA, 22 bp, Homo sapiens
gtggaaggtgctagaacaagga

SEQ ID NO: 8115089 - DNA, 22 bp, Homo sapiens
gtggaaggtgaaggagcagcga

SEQ ID NO: 8115090 - DNA, 22 bp, Homo sapiens
gtggatggattgaggcagtggg

SEQ ID NO: 8115091 - DNA, 22 bp, Homo sapiens
gtggcacagtgggagagcccca

SEQ ID NO: 8115092 - DNA, 22 bp, Homo sapiens
gtggcacataggatcctgtggc

SEQ ID NO: 8115093 - DNA, 18 bp, Homo sapiens
gtggcagcctttggcttt

SEQ ID NO: 8115094 - DNA, 22 bp, Homo sapiens
gtggcagccgcaggccctgtgt

SEQ ID NO: 8115095 - DNA, 22 bp, Homo sapiens
gtggcagcggcccaggccgtct

SEQ ID NO: 8115096 - DNA, 22 bp, Homo sapiens
gtggcagcaaatgcctggacta

SEQ ID NO: 8115097 - DNA, 19 bp, Homo sapiens
gtggcagcagatttggtgt

SEQ ID NO: 8115098 - DNA, 22 bp, Homo sapiens
gtggcagcagaggggtggtatg

SEQ ID NO: 8115099 - DNA, 22 bp, Homo sapiens
gtggcagcaggtactcacgcac

SEQ ID NO: 8115100 - DNA, 22 bp, Homo sapiens
gtggagggaatgaatcttctct

SEQ ID NO: 8115101 - DNA, 22 bp, Homo sapiens
gtggagggtgagctcatgtttg

SEQ ID NO: 8115102 - DNA, 22 bp, Homo sapiens
gtggagggaatgaatcttctct

SEQ ID NO: 8115103 - DNA, 22 bp, Homo sapiens
gtggaggacaaaagaagccttt

SEQ ID NO: 8115104 - DNA, 22 bp, Homo sapiens
gtggagggtgagctcatgtttg

SEQ ID NO: 8115105 - DNA, 22 bp, Homo sapiens
gtggagggtgattgccggctgt

SEQ ID NO: 8115106 - DNA, 18 bp, Homo sapiens
gtggagggttctcagaat

SEQ ID NO: 8115107 - DNA, 22 bp, Homo sapiens
gtggagggtttgcaatgtgcag

SEQ ID NO: 8115108 - DNA, 18 bp, Homo sapiens
gtggagggttctcagaat

SEQ ID NO: 8115109 - DNA, 22 bp, Homo sapiens
gtggagggtttgcaatgtgcag

SEQ ID NO: 8115110 - DNA, 22 bp, Homo sapiens
gtggagggtttgcaatgtgcag

SEQ ID NO: 8115111 - DNA, 22 bp, Homo sapiens
gtggaggtcccgggcaggagca

SEQ ID NO: 8115112 - DNA, 20 bp, Homo sapiens
gtggatgatcagtgtagtgg

SEQ ID NO: 8115113 - DNA, 22 bp, Homo sapiens
gtggagtggtgatggataggtt

SEQ ID NO: 8115114 - DNA, 22 bp, Homo sapiens
gtggaggaagggattcagacca

SEQ ID NO: 8115115 - DNA, 22 bp, Homo sapiens
gtggaggacaaaagaagccttt

SEQ ID NO: 8115116 - DNA, 22 bp, Homo sapiens
gtggaggaaaagaagttgggtg

SEQ ID NO: 8115117 - DNA, 22 bp, Homo sapiens
tctggggcagttactggggcct

SEQ ID NO: 8115118 - DNA, 22 bp, Homo sapiens
tctgtcacccaggctggagtgc

SEQ ID NO: 8115119 - DNA, 22 bp, Homo sapiens
tctgtaatcccagctactcagg

SEQ ID NO: 8115120 - DNA, 22 bp, Homo sapiens
tctgtacagtaccagatagtaa

SEQ ID NO: 8115121 - DNA, 22 bp, Homo sapiens
tctgtcctgtttcctcctgaca

SEQ ID NO: 8115122 - DNA, 18 bp, Homo sapiens
tctgtccttccattcttc

SEQ ID NO: 8115123 - DNA, 22 bp, Homo sapiens
tctgtcctctccctgaccacaa

SEQ ID NO: 8115124 - DNA, 22 bp, Homo sapiens
tctgtctcctcagatgactcca

SEQ ID NO: 8115125 - DNA, 23 bp, Homo sapiens
tctgtctgaataatttactcttt

SEQ ID NO: 8115126 - DNA, 22 bp, Homo sapiens
tctgtcctccggagctcccagt

SEQ ID NO: 8115127 - DNA, 22 bp, Homo sapiens
tctgttgcaatgtgcatggtga

SEQ ID NO: 8115128 - DNA, 22 bp, Homo sapiens
tctgttggagcctaggatgaca

SEQ ID NO: 8115129 - DNA, 22 bp, Homo sapiens
tcttaagcagagaagaagttga

SEQ ID NO: 8115130 - DNA, 22 bp, Homo sapiens
tcttaaatgactgataagagga

SEQ ID NO: 8115131 - DNA, 22 bp, Homo sapiens
tcttaacagtgctacagagcag

SEQ ID NO: 8115132 - DNA, 22 bp, Homo sapiens
tcttatatgcacatacattggg

SEQ ID NO: 8115133 - DNA, 22 bp, Homo sapiens
tctgtgtctcaatcccatgctg

SEQ ID NO: 8115134 - DNA, 22 bp, Homo sapiens
tctgtggtctggctttagtcta

SEQ ID NO: 8115135 - DNA, 22 bp, Homo sapiens
tctgtgctttccctgccttctt

SEQ ID NO: 8115136 - DNA, 22 bp, Homo sapiens
tctgtgctgccatcctgtggcc

SEQ ID NO: 8115137 - DNA, 19 bp, Homo sapiens
tctgtgctgggaggcagca

SEQ ID NO: 8115138 - DNA, 22 bp, Homo sapiens
tctgtctgagggagtgacattt

SEQ ID NO: 8115139 - DNA, 22 bp, Homo sapiens
tctgtctgcacctaagcacagt

SEQ ID NO: 8115140 - DNA, 22 bp, Homo sapiens
tctgtctgccccagcaagtcac

SEQ ID NO: 8115141 - DNA, 22 bp, Homo sapiens
tctgtctgcctgtgtccccacc

SEQ ID NO: 8115142 - DNA, 22 bp, Homo sapiens
tctgtgaacatcacattgacag

SEQ ID NO: 8115143 - DNA, 22 bp, Homo sapiens
tctgtgatcttgcatttatatg

SEQ ID NO: 8115144 - DNA, 22 bp, Homo sapiens
tctgtgatagtttttcagctat

SEQ ID NO: 8115145 - DNA, 22 bp, Homo sapiens
tcttattttgttagatgctgta

SEQ ID NO: 8115146 - DNA, 22 bp, Homo sapiens
tcttcaaaaatacaggttttca

SEQ ID NO: 8115147 - DNA, 22 bp, Homo sapiens
tcttcaaatacagtcatattga

SEQ ID NO: 8115148 - DNA, 21 bp, Homo sapiens
tcttcagcagtggtgaggtgg

SEQ ID NO: 8115149 - DNA, 22 bp, Homo sapiens
tcttccaaggttgcacactatc

SEQ ID NO: 8115150 - DNA, 22 bp, Homo sapiens
tcttctcctttgccatgtgttt

SEQ ID NO: 8115151 - DNA, 20 bp, Homo sapiens
tcttctggatttcctttagg

SEQ ID NO: 8115152 - DNA, 22 bp, Homo sapiens
tcttctctacaccagcagcccc

SEQ ID NO: 8115153 - DNA, 22 bp, Homo sapiens
tcttctgtcctaagtcaaagca

SEQ ID NO: 8115154 - DNA, 22 bp, Homo sapiens
tcttctccagttcatcctacca

SEQ ID NO: 8115155 - DNA, 22 bp, Homo sapiens
tcttctcccatctccaggcagg

SEQ ID NO: 8115156 - DNA, 22 bp, Homo sapiens
tcttccttttgtaccttctgaa

SEQ ID NO: 8115157 - DNA, 22 bp, Homo sapiens
tcttcctggatgggggttgatg

SEQ ID NO: 8115158 - DNA, 22 bp, Homo sapiens
tcttcctgctttggtgaggctt

SEQ ID NO: 8115159 - DNA, 22 bp, Homo sapiens
tcttcctctctaattgatcaga

SEQ ID NO: 8115160 - DNA, 22 bp, Homo sapiens
tcttcctccctacagagctcag

SEQ ID NO: 8115161 - DNA, 22 bp, Homo sapiens
tcttcctgaaaccctgttccag

SEQ ID NO: 8115162 - DNA, 22 bp, Homo sapiens
tcttcctgaaaccctgttccag

SEQ ID NO: 8115163 - DNA, 23 bp, Homo sapiens
tcttcctgaactatcaggcacat

SEQ ID NO: 8115164 - DNA, 21 bp, Homo sapiens
tcttcctgctccacactcccc

SEQ ID NO: 8115165 - DNA, 22 bp, Homo sapiens
tcttccagcttctagaggatgc

SEQ ID NO: 8115166 - DNA, 22 bp, Homo sapiens
tctttctctctaatcaagcaca

SEQ ID NO: 8115167 - DNA, 22 bp, Homo sapiens
tctttcctaggtgatatgcaat

SEQ ID NO: 8115168 - DNA, 22 bp, Homo sapiens
tctttcctaggtgatatgcaat

SEQ ID NO: 8115169 - DNA, 22 bp, Homo sapiens
tctttctacatcatttgcttct

SEQ ID NO: 8115170 - DNA, 22 bp, Homo sapiens
tctttccatggccacacagtct

SEQ ID NO: 8115171 - DNA, 22 bp, Homo sapiens
tctttccacagcatgtccatgc

SEQ ID NO: 8115172 - DNA, 21 bp, Homo sapiens
tctttccaatattcatgtctc

SEQ ID NO: 8115173 - DNA, 22 bp, Homo sapiens
tctttcaatgtgaaaccatgta

SEQ ID NO: 8115174 - DNA, 22 bp, Homo sapiens
tctttataaaagtcattatgtc

SEQ ID NO: 8115175 - DNA, 19 bp, Homo sapiens
tcttgaggaaagtaaggca

SEQ ID NO: 8115176 - DNA, 22 bp, Homo sapiens
tcttggattttaatggatcaaa

SEQ ID NO: 8115177 - DNA, 22 bp, Homo sapiens
tcttggattttaatggatcaaa

SEQ ID NO: 8115178 - DNA, 22 bp, Homo sapiens
tctttacatcacaattgtatgg

SEQ ID NO: 8115179 - DNA, 22 bp, Homo sapiens
tcttgggaccatttacacatac

SEQ ID NO: 8115180 - DNA, 22 bp, Homo sapiens
tcttgggaaataaacagattga

SEQ ID NO: 8115181 - DNA, 22 bp, Homo sapiens
tctgcaggaaaaaagtgcctgg

SEQ ID NO: 8115182 - DNA, 22 bp, Homo sapiens
tctgcaggaagctggcggctga

SEQ ID NO: 8115183 - DNA, 22 bp, Homo sapiens
tctgcaggactgaggcctgttt

SEQ ID NO: 8115184 - DNA, 18 bp, Homo sapiens
tctgcaggacctcagggc

SEQ ID NO: 8115185 - DNA, 22 bp, Homo sapiens
tctgcaggagagtgccctagag

SEQ ID NO: 8115186 - DNA, 22 bp, Homo sapiens
tctgcaggagcagggcgtggag

SEQ ID NO: 8115187 - DNA, 22 bp, Homo sapiens
tctgcaggaggctggctgcagg

SEQ ID NO: 8115188 - DNA, 22 bp, Homo sapiens
tctgcaggatggatgctcagaa

SEQ ID NO: 8115189 - DNA, 22 bp, Homo sapiens
tctgcaggatcagagccagagg

SEQ ID NO: 8115190 - DNA, 22 bp, Homo sapiens
tctgcaggatgcaaagtgtaca

SEQ ID NO: 8115191 - DNA, 22 bp, Homo sapiens
tctgcaggcatttttggttgtc

SEQ ID NO: 8115192 - DNA, 22 bp, Homo sapiens
tctgcaggcctcgacaaggcca

SEQ ID NO: 8115193 - DNA, 22 bp, Homo sapiens
tctgcagaaactgtgactatgt

SEQ ID NO: 8115194 - DNA, 22 bp, Homo sapiens
tctgcagaaagtggctcagtgg

SEQ ID NO: 8115195 - DNA, 22 bp, Homo sapiens
tctgcagaagaattaaggacag

SEQ ID NO: 8115196 - DNA, 22 bp, Homo sapiens
tctgcagatttatcagcagctg

SEQ ID NO: 8115197 - DNA, 22 bp, Homo sapiens
tctgcacaaaactgtcgcagaa

SEQ ID NO: 8115198 - DNA, 22 bp, Homo sapiens
tctgcacacaatttatctttct

SEQ ID NO: 8115199 - DNA, 22 bp, Homo sapiens
tctgcacaagtaagggtttaat

SEQ ID NO: 8115200 - DNA, 22 bp, Homo sapiens
tctgcacaattgatcatggcaa

SEQ ID NO: 8115201 - DNA, 22 bp, Homo sapiens
tctgcacaccgccaggctgact

SEQ ID NO: 8115202 - DNA, 22 bp, Homo sapiens
tctgcacagattctctgagaat

SEQ ID NO: 8115203 - DNA, 22 bp, Homo sapiens
tctgcacagagacccttgccag

SEQ ID NO: 8115204 - DNA, 22 bp, Homo sapiens
tctgcacacttttattgacctc

SEQ ID NO: 8115205 - DNA, 22 bp, Homo sapiens
tctgcacattttaccaatactc

SEQ ID NO: 8115206 - DNA, 22 bp, Homo sapiens
tctgcacatggcgctggtcctg

SEQ ID NO: 8115207 - DNA, 22 bp, Homo sapiens
tctgcacatcccccaaagtatt

SEQ ID NO: 8115208 - DNA, 22 bp, Homo sapiens
tctgcacatgtagtaaatatta

SEQ ID NO: 8115209 - DNA, 22 bp, Homo sapiens
tctgcacaggcgtaggttgact

SEQ ID NO: 8115210 - DNA, 22 bp, Homo sapiens
tctgcacataggtaggctggaa

SEQ ID NO: 8115211 - DNA, 22 bp, Homo sapiens
tctgcacaggagggccgtggtg

SEQ ID NO: 8115212 - DNA, 22 bp, Homo sapiens
tctgcacagctcacctccctgg

SEQ ID NO: 8115213 - DNA, 21 bp, Homo sapiens
tctgcacagccccgcaggagg

SEQ ID NO: 8115214 - DNA, 22 bp, Homo sapiens
tctgcagggatgtgaggggtga

SEQ ID NO: 8115215 - DNA, 22 bp, Homo sapiens
tctgcagggcccttggctcctg

SEQ ID NO: 8115216 - DNA, 17 bp, Homo sapiens
tctgcagggggccgtgt

SEQ ID NO: 8115217 - DNA, 22 bp, Homo sapiens
tctgcagggtcccagcctcagc

SEQ ID NO: 8115218 - DNA, 22 bp, Homo sapiens
tctgcaggtaagcgttcttgga

SEQ ID NO: 8115219 - DNA, 22 bp, Homo sapiens
tctgcaggctgtacaggaagca

SEQ ID NO: 8115220 - DNA, 22 bp, Homo sapiens
tctgcaggctctagatgaggtt

SEQ ID NO: 8115221 - DNA, 22 bp, Homo sapiens
tctgcaggcttataggatgggt

SEQ ID NO: 8115222 - DNA, 22 bp, Homo sapiens
tctgcaggcttggagtggcagc

SEQ ID NO: 8115223 - DNA, 22 bp, Homo sapiens
tctgcatctcaggattcccttc

SEQ ID NO: 8115224 - DNA, 22 bp, Homo sapiens
tctgcatccgaacccgccaccg

SEQ ID NO: 8115225 - DNA, 22 bp, Homo sapiens
tctgcaggtgttggaagggtca

SEQ ID NO: 8115226 - DNA, 22 bp, Homo sapiens
tctgcaggtgggcccctagaat

SEQ ID NO: 8115227 - DNA, 22 bp, Homo sapiens
tctgcaggtcacgctccagcct

SEQ ID NO: 8115228 - DNA, 22 bp, Homo sapiens
tctgcaggtagagctcaggaat

SEQ ID NO: 8115229 - DNA, 22 bp, Homo sapiens
tctgccaggcattgtgctgctc

SEQ ID NO: 8115230 - DNA, 21 bp, Homo sapiens
tctgcccacactggccactgc

SEQ ID NO: 8115231 - DNA, 22 bp, Homo sapiens
tctgcctggatgatggcagggc

SEQ ID NO: 8115232 - DNA, 22 bp, Homo sapiens
tctgcctgttgctagaatgtca

SEQ ID NO: 8115233 - DNA, 20 bp, Homo sapiens
tctgccttatgaccttcgcc

SEQ ID NO: 8115234 - DNA, 22 bp, Homo sapiens
tctgcctgagggagctgaggaa

SEQ ID NO: 8115235 - DNA, 22 bp, Homo sapiens
tctgcctgcagtgtggcagggc

SEQ ID NO: 8115236 - DNA, 22 bp, Homo sapiens
tctgccctggggtcagcctcca

SEQ ID NO: 8115237 - DNA, 22 bp, Homo sapiens
tctgccgtgcgaggtcccacca

SEQ ID NO: 8115238 - DNA, 22 bp, Homo sapiens
tctgccgtgcgaggtcccacca

SEQ ID NO: 8115239 - DNA, 22 bp, Homo sapiens
tctgcctgagcagagggaggcc

SEQ ID NO: 8115240 - DNA, 21 bp, Homo sapiens
tctgccctccaggagctcata

SEQ ID NO: 8115241 - DNA, 22 bp, Homo sapiens
tctgccctcattgctgcctgga

SEQ ID NO: 8115242 - DNA, 22 bp, Homo sapiens
tctgcccacagcctcctgtcca

SEQ ID NO: 8115243 - DNA, 22 bp, Homo sapiens
tctgcccaggacacctgccact

SEQ ID NO: 8115244 - DNA, 22 bp, Homo sapiens
tctgcccagggacaggacacag

SEQ ID NO: 8115245 - DNA, 21 bp, Homo sapiens
tctgatggtagatgagatgtg

SEQ ID NO: 8115246 - DNA, 22 bp, Homo sapiens
tctgatgtaagttcttccagag

SEQ ID NO: 8115247 - DNA, 22 bp, Homo sapiens
tctgattagagcattcttgagt

SEQ ID NO: 8115248 - DNA, 22 bp, Homo sapiens
tctgagggtgggagaaggagct

SEQ ID NO: 8115249 - DNA, 22 bp, Homo sapiens
tctgagaatggtggatgtggtg

SEQ ID NO: 8115250 - DNA, 20 bp, Homo sapiens
tctgagaagcaaacaatgtt

SEQ ID NO: 8115251 - DNA, 22 bp, Homo sapiens
tctgagaaatcagtggtgaata

SEQ ID NO: 8115252 - DNA, 22 bp, Homo sapiens
tctgagaaggtgcatcagctgc

SEQ ID NO: 8115253 - DNA, 22 bp, Homo sapiens
tctggcagtgaagtcatgaggt

SEQ ID NO: 8115254 - DNA, 22 bp, Homo sapiens
tctggcagtgagcaacttgaca

SEQ ID NO: 8115255 - DNA, 20 bp, Homo sapiens
tctggcaggtgaacgagctg

SEQ ID NO: 8115256 - DNA, 20 bp, Homo sapiens
tctggcaggtgaacgagctg

SEQ ID NO: 8115257 - DNA, 22 bp, Homo sapiens
tctggcaggtcaatcattcttt

SEQ ID NO: 8115258 - DNA, 22 bp, Homo sapiens
tctggcagatcttcccacgttt

SEQ ID NO: 8115259 - DNA, 22 bp, Homo sapiens
tctggcagagtcagtgcacaca

SEQ ID NO: 8115260 - DNA, 22 bp, Homo sapiens
tctggcagggtcagggcccagg

SEQ ID NO: 8115261 - DNA, 22 bp, Homo sapiens
tctggcagaagtgctgtcagta

SEQ ID NO: 8115262 - DNA, 22 bp, Homo sapiens
tctggcagagatatccatccca

SEQ ID NO: 8115263 - DNA, 22 bp, Homo sapiens
tctggcagaggaaggaggcctg

SEQ ID NO: 8115264 - DNA, 22 bp, Homo sapiens
tctggcagttgccgcttcagtc

SEQ ID NO: 8115265 - DNA, 22 bp, Homo sapiens
tctggcagtttgagaaaggcta

SEQ ID NO: 8115266 - DNA, 22 bp, Homo sapiens
tctggcagtgatttctgtgatc

SEQ ID NO: 8115267 - DNA, 22 bp, Homo sapiens
tctggcagtggatgagggcagc

SEQ ID NO: 8115268 - DNA, 22 bp, Homo sapiens
tctggcagttccttgttgatat

SEQ ID NO: 8115269 - DNA, 22 bp, Homo sapiens
tctggaggggtttagagggaca

SEQ ID NO: 8115270 - DNA, 22 bp, Homo sapiens
tctggaggccatagggaaggat

SEQ ID NO: 8115271 - DNA, 18 bp, Homo sapiens
tctggagggaagctttga

SEQ ID NO: 8115272 - DNA, 22 bp, Homo sapiens
tctggaggctctgagggtgagt

SEQ ID NO: 8115273 - DNA, 22 bp, Homo sapiens
tctggagggcccacatccacaa

SEQ ID NO: 8115274 - DNA, 23 bp, Homo sapiens
tctggaggggacactgcagatgc

SEQ ID NO: 8115275 - DNA, 22 bp, Homo sapiens
tctggagggggatgcctcatcc

SEQ ID NO: 8115276 - DNA, 22 bp, Homo sapiens
tctggatcccaccgccacacac

SEQ ID NO: 8115277 - DNA, 22 bp, Homo sapiens
tctggatctccctcatcctggg

SEQ ID NO: 8115278 - DNA, 22 bp, Homo sapiens
tctggaatgatttccttcccct

SEQ ID NO: 8115279 - DNA, 22 bp, Homo sapiens
tctggaatgtagtgagttcctg

SEQ ID NO: 8115280 - DNA, 22 bp, Homo sapiens
tctggaaggcttcaaggtctaa

SEQ ID NO: 8115281 - DNA, 22 bp, Homo sapiens
tctggaataggtcctgagtatt

SEQ ID NO: 8115282 - DNA, 22 bp, Homo sapiens
tctggaatcagacctaatccca

SEQ ID NO: 8115283 - DNA, 22 bp, Homo sapiens
tctggagaggaggatgtggaca

SEQ ID NO: 8115284 - DNA, 22 bp, Homo sapiens
tctggagagatcttccacaaca

SEQ ID NO: 8115285 - DNA, 22 bp, Homo sapiens
tctggagaagcccagggagctg

SEQ ID NO: 8115286 - DNA, 22 bp, Homo sapiens
tctggagaagaaacttgctctg

SEQ ID NO: 8115287 - DNA, 22 bp, Homo sapiens
tctgctgctacagactctctag

SEQ ID NO: 8115288 - DNA, 22 bp, Homo sapiens
tctgctgcctcggtgtgggtac

SEQ ID NO: 8115289 - DNA, 22 bp, Homo sapiens
tctgctgccaccttgtggtgag

SEQ ID NO: 8115290 - DNA, 22 bp, Homo sapiens
tctgctgagtcagacctctggg

SEQ ID NO: 8115291 - DNA, 22 bp, Homo sapiens
tctgctgaggtggttttagaga

SEQ ID NO: 8115292 - DNA, 22 bp, Homo sapiens
tctgctgaggccttcccactcc

SEQ ID NO: 8115293 - DNA, 22 bp, Homo sapiens
tctgctgagatgcccatggtta

SEQ ID NO: 8115294 - DNA, 22 bp, Homo sapiens
tctgctgaacttgctgcccaga

SEQ ID NO: 8115295 - DNA, 22 bp, Homo sapiens
tctgctgaatcagatagctaag

SEQ ID NO: 8115296 - DNA, 22 bp, Homo sapiens
tctgctgacctttctctgacac

SEQ ID NO: 8115297 - DNA, 22 bp, Homo sapiens
tctgctgaatggagccaacctc

SEQ ID NO: 8115298 - DNA, 22 bp, Homo sapiens
tctgctgacatttatgaataga

SEQ ID NO: 8115299 - DNA, 22 bp, Homo sapiens
tctgctctccatacttccgcac

SEQ ID NO: 8115300 - DNA, 23 bp, Homo sapiens
tctgctctgaagttcggctgagc

SEQ ID NO: 8115301 - DNA, 22 bp, Homo sapiens
tctgctctgagagggccatcag

SEQ ID NO: 8115302 - DNA, 22 bp, Homo sapiens
tctgctctagttgcttcctgcc

SEQ ID NO: 8115303 - DNA, 22 bp, Homo sapiens
tctgctctgtggcttcagctaa

SEQ ID NO: 8115304 - DNA, 22 bp, Homo sapiens
tctgctctgggccagctattaa

SEQ ID NO: 8115305 - DNA, 22 bp, Homo sapiens
tctgctctgtactgcactggcc

SEQ ID NO: 8115306 - DNA, 17 bp, Homo sapiens
tctgctctgccaatcca

SEQ ID NO: 8115307 - DNA, 22 bp, Homo sapiens
tctgctgttctcatgctgattt

SEQ ID NO: 8115308 - DNA, 22 bp, Homo sapiens
tctgctgctgaccaacactgtg

SEQ ID NO: 8115309 - DNA, 22 bp, Homo sapiens
tctgctgctgcagctacactat

SEQ ID NO: 8115310 - DNA, 22 bp, Homo sapiens
tctgctggccttagcaggtcta

SEQ ID NO: 8115311 - DNA, 22 bp, Homo sapiens
tctgggaagctgcgtgcctgtt

SEQ ID NO: 8115312 - DNA, 22 bp, Homo sapiens
tctgggaaggctctgcagatat

SEQ ID NO: 8115313 - DNA, 22 bp, Homo sapiens
tctgggaagacggatggaccct

SEQ ID NO: 8115314 - DNA, 22 bp, Homo sapiens
tctggccccggtcttcacagct

SEQ ID NO: 8115315 - DNA, 22 bp, Homo sapiens
tctgggagtttctgtgggagct

SEQ ID NO: 8115316 - DNA, 22 bp, Homo sapiens
tctgggaggtaaccatgctgat

SEQ ID NO: 8115317 - DNA, 22 bp, Homo sapiens
tctgggaggtactgggaggtgt

SEQ ID NO: 8115318 - DNA, 22 bp, Homo sapiens
tctgggagggagcctcagaatc

SEQ ID NO: 8115319 - DNA, 22 bp, Homo sapiens
tctgggaggggctgccattgct

SEQ ID NO: 8115320 - DNA, 22 bp, Homo sapiens
tctgggaggtggcagggtgcat

SEQ ID NO: 8115321 - DNA, 22 bp, Homo sapiens
tctgggaggtgttttgagaact

SEQ ID NO: 8115322 - DNA, 22 bp, Homo sapiens
tctgggagtgaagcaacagatg

SEQ ID NO: 8115323 - DNA, 22 bp, Homo sapiens
tctgggagtgggtccaaggaat

SEQ ID NO: 8115324 - DNA, 22 bp, Homo sapiens
tctgggagtgtgtctggccatc

SEQ ID NO: 8115325 - DNA, 22 bp, Homo sapiens
tctgggagagcacgtggctgac

SEQ ID NO: 8115326 - DNA, 22 bp, Homo sapiens
tctgggagagctgctgtcagag

SEQ ID NO: 8115327 - DNA, 22 bp, Homo sapiens
tctgggagaagctgatgtgaag

SEQ ID NO: 8115328 - DNA, 22 bp, Homo sapiens
tctgggagagagttgataaagg

SEQ ID NO: 8115329 - DNA, 22 bp, Homo sapiens
tctgggagagcacgtggctgac

SEQ ID NO: 8115330 - DNA, 22 bp, Homo sapiens
tctgggaatttattggcacttt

SEQ ID NO: 8115331 - DNA, 23 bp, Homo sapiens
tctccctcatgcctaggcctggg

SEQ ID NO: 8115332 - DNA, 22 bp, Homo sapiens
tctcccagtgtctggcagtcag

SEQ ID NO: 8115333 - DNA, 22 bp, Homo sapiens
tctcccagtgtctggcagtcag

SEQ ID NO: 8115334 - DNA, 22 bp, Homo sapiens
tctcccattacttatggcccac

SEQ ID NO: 8115335 - DNA, 22 bp, Homo sapiens
tctccccagctgagctgccctt

SEQ ID NO: 8115336 - DNA, 22 bp, Homo sapiens
tctccccaaccatggcactcac

SEQ ID NO: 8115337 - DNA, 22 bp, Homo sapiens
tctcccaggtcatacacagaga

SEQ ID NO: 8115338 - DNA, 22 bp, Homo sapiens
tctcccaggctggagtgcagtg

SEQ ID NO: 8115339 - DNA, 22 bp, Homo sapiens
tctcccaggtgggtgcctggag

SEQ ID NO: 8115340 - DNA, 22 bp, Homo sapiens
tctcccaggtgggtgcctggag

SEQ ID NO: 8115341 - DNA, 22 bp, Homo sapiens
tctcccagtcctctgtgcttac

SEQ ID NO: 8115342 - DNA, 22 bp, Homo sapiens
tctcccaggcaggagtgcagtg

SEQ ID NO: 8115343 - DNA, 22 bp, Homo sapiens
tctcccaggctgccctgtggac

SEQ ID NO: 8115344 - DNA, 19 bp, Homo sapiens
tctccaggtgccccaaaca

SEQ ID NO: 8115345 - DNA, 22 bp, Homo sapiens
tctccaggtgagggtggttaga

SEQ ID NO: 8115346 - DNA, 22 bp, Homo sapiens
tctccaggtgaaacttgcaggg

SEQ ID NO: 8115347 - DNA, 22 bp, Homo sapiens
tctccaggtagatatgtcagga

SEQ ID NO: 8115348 - DNA, 22 bp, Homo sapiens
tctccagggcagagaatagcaa

SEQ ID NO: 8115349 - DNA, 22 bp, Homo sapiens
tctccagggaggtagcccagtg

SEQ ID NO: 8115350 - DNA, 22 bp, Homo sapiens
tctccagggactgaggctggag

SEQ ID NO: 8115351 - DNA, 23 bp, Homo sapiens
tctccaggccttactccaggcct

SEQ ID NO: 8115352 - DNA, 22 bp, Homo sapiens
tctccaggcttaatctcagctt

SEQ ID NO: 8115353 - DNA, 22 bp, Homo sapiens
tctctaaagatatttatggcaa

SEQ ID NO: 8115354 - DNA, 21 bp, Homo sapiens
tctctaaaaagattctatttg

SEQ ID NO: 8115355 - DNA, 21 bp, Homo sapiens
tctctaaaaagattctatttg

SEQ ID NO: 8115356 - DNA, 22 bp, Homo sapiens
tctcctgggcttggttgaagtt

SEQ ID NO: 8115357 - DNA, 22 bp, Homo sapiens
tctcctgggtaaaagggttgat

SEQ ID NO: 8115358 - DNA, 22 bp, Homo sapiens
tctcctgggtgctttatcagaa

SEQ ID NO: 8115359 - DNA, 22 bp, Homo sapiens
tctcctcaccaccagcagcaga

SEQ ID NO: 8115360 - DNA, 22 bp, Homo sapiens
tctcctctatttctgtatgtat

SEQ ID NO: 8115361 - DNA, 22 bp, Homo sapiens
tctcctctactgggtctgcaga

SEQ ID NO: 8115362 - DNA, 22 bp, Homo sapiens
tctcctctactgggtctgcaga

SEQ ID NO: 8115363 - DNA, 22 bp, Homo sapiens
tctcctctcctttcatgttgtt

SEQ ID NO: 8115364 - DNA, 22 bp, Homo sapiens
tctcctctgtgccacagcttgg

SEQ ID NO: 8115365 - DNA, 22 bp, Homo sapiens
tctcctctgcgcggcagtgccc

SEQ ID NO: 8115366 - DNA, 22 bp, Homo sapiens
tctcctgctcagaacagcctca

SEQ ID NO: 8115367 - DNA, 22 bp, Homo sapiens
tctcctgccactgcttcccatt

SEQ ID NO: 8115368 - DNA, 22 bp, Homo sapiens
tctcctgcagtcagcagtctca

SEQ ID NO: 8115369 - DNA, 22 bp, Homo sapiens
tctcctggcatttggttgagta

SEQ ID NO: 8115370 - DNA, 22 bp, Homo sapiens
tctcattcataccctacatgct

SEQ ID NO: 8115371 - DNA, 19 bp, Homo sapiens
tctccaaaaccaatcacta

SEQ ID NO: 8115372 - DNA, 22 bp, Homo sapiens
tctccaggactgagctccagcc

SEQ ID NO: 8115373 - DNA, 17 bp, Homo sapiens
tctccaggacgagctca

SEQ ID NO: 8115374 - DNA, 22 bp, Homo sapiens
tctccaagaaaagatctcagct

SEQ ID NO: 8115375 - DNA, 22 bp, Homo sapiens
tctccaggagaaatatgaagga

SEQ ID NO: 8115376 - DNA, 22 bp, Homo sapiens
tctccaggcccactgatttata

SEQ ID NO: 8115377 - DNA, 22 bp, Homo sapiens
tctcatctccattatagcatca

SEQ ID NO: 8115378 - DNA, 22 bp, Homo sapiens
tctcatctagactctgcccttg

SEQ ID NO: 8115379 - DNA, 22 bp, Homo sapiens
tctcatcttcatatctgaaaga

SEQ ID NO: 8115380 - DNA, 22 bp, Homo sapiens
tctcatctgcgagctctgccag

SEQ ID NO: 8115381 - DNA, 22 bp, Homo sapiens
tctcatgaaaggtctctcctgg

SEQ ID NO: 8115382 - DNA, 22 bp, Homo sapiens
tctcagggcgcagtgaggcagt

SEQ ID NO: 8115383 - DNA, 22 bp, Homo sapiens
tctcagggcctccctctgtttc

SEQ ID NO: 8115384 - DNA, 22 bp, Homo sapiens
tctcagggctcagagctcaggc

SEQ ID NO: 8115385 - DNA, 22 bp, Homo sapiens
tctcagggcttttcttttgaat

SEQ ID NO: 8115386 - DNA, 22 bp, Homo sapiens
tctcaggggattcactggcacc

SEQ ID NO: 8115387 - DNA, 22 bp, Homo sapiens
tctcaggggcagtgatcctaag

SEQ ID NO: 8115388 - DNA, 22 bp, Homo sapiens
tctcaggggcctggagtcctgg

SEQ ID NO: 8115389 - DNA, 17 bp, Homo sapiens
tctcaggggctagccct

SEQ ID NO: 8115390 - DNA, 20 bp, Homo sapiens
tctcagggtcttagatggaa

SEQ ID NO: 8115391 - DNA, 22 bp, Homo sapiens
tctcagggggacttaatttact

SEQ ID NO: 8115392 - DNA, 23 bp, Homo sapiens
tctcagggtggctgggcccatcc

SEQ ID NO: 8115393 - DNA, 22 bp, Homo sapiens
tctcagggggacttaatttact

SEQ ID NO: 8115394 - DNA, 20 bp, Homo sapiens
tctcagggtcttagatggaa

SEQ ID NO: 8115395 - DNA, 22 bp, Homo sapiens
tctcagggtttcctgggggctg

SEQ ID NO: 8115396 - DNA, 22 bp, Homo sapiens
tctcagggttctgtgttataat

SEQ ID NO: 8115397 - DNA, 22 bp, Homo sapiens
tctcagggttctgtgttataat

SEQ ID NO: 8115398 - DNA, 20 bp, Homo sapiens
tctcagggttcagcaaagta

SEQ ID NO: 8115399 - DNA, 22 bp, Homo sapiens
tctcagggtgaggaaagaattt

SEQ ID NO: 8115400 - DNA, 22 bp, Homo sapiens
tctcagggtttgtacaagtgta

SEQ ID NO: 8115401 - DNA, 22 bp, Homo sapiens
tctcagggtttgtacaagtgta

SEQ ID NO: 8115402 - DNA, 22 bp, Homo sapiens
tctcagagtttagagctgagcc

SEQ ID NO: 8115403 - DNA, 22 bp, Homo sapiens
tctcagagtttgaatctggagt

SEQ ID NO: 8115404 - DNA, 22 bp, Homo sapiens
tctcagaggtgccctggcatct

SEQ ID NO: 8115405 - DNA, 22 bp, Homo sapiens
tctcagagggaggattactgcc

SEQ ID NO: 8115406 - DNA, 22 bp, Homo sapiens
tctcagctgcctgccctgctcc

SEQ ID NO: 8115407 - DNA, 22 bp, Homo sapiens
tctcagggagggcgagtcagcg

SEQ ID NO: 8115408 - DNA, 22 bp, Homo sapiens
tctcagggagagctgctggcat

SEQ ID NO: 8115409 - DNA, 22 bp, Homo sapiens
tctcagggagcccagtacttac

SEQ ID NO: 8115410 - DNA, 22 bp, Homo sapiens
tctcagggaccatgatgatgac

SEQ ID NO: 8115411 - DNA, 22 bp, Homo sapiens
tctcagggatgggaggccccag

SEQ ID NO: 8115412 - DNA, 22 bp, Homo sapiens
tctcagggagttgaggctgcct

SEQ ID NO: 8115413 - DNA, 22 bp, Homo sapiens
tctcagggaggttccccgttct

SEQ ID NO: 8115414 - DNA, 22 bp, Homo sapiens
tctcagggcagcaaggaagcat

SEQ ID NO: 8115415 - DNA, 22 bp, Homo sapiens
tctcagggcaattctcagcgac

SEQ ID NO: 8115416 - DNA, 18 bp, Homo sapiens
tctcagggcatacccaga

SEQ ID NO: 8115417 - DNA, 22 bp, Homo sapiens
tctcagggccccaaaggctagt

SEQ ID NO: 8115418 - DNA, 22 bp, Homo sapiens
tctcagagagctgtgttttcct

SEQ ID NO: 8115419 - DNA, 22 bp, Homo sapiens
tctcagagaggggccgggcctt

SEQ ID NO: 8115420 - DNA, 19 bp, Homo sapiens
tctcagagccctagaggcc

SEQ ID NO: 8115421 - DNA, 22 bp, Homo sapiens
tctcagagcatcattttcttag

SEQ ID NO: 8115422 - DNA, 22 bp, Homo sapiens
tctcagagatgttagggaagag

SEQ ID NO: 8115423 - DNA, 22 bp, Homo sapiens
tctcacagggctaggccctgcc

SEQ ID NO: 8115424 - DNA, 22 bp, Homo sapiens
tctcacagttgtccactgaaaa

SEQ ID NO: 8115425 - DNA, 22 bp, Homo sapiens
tctgaaagggctaaataatttg

SEQ ID NO: 8115426 - DNA, 22 bp, Homo sapiens
tctgaaagtctgaaacagtgtc

SEQ ID NO: 8115427 - DNA, 22 bp, Homo sapiens
tctgaaataaatgcactgttag

SEQ ID NO: 8115428 - DNA, 22 bp, Homo sapiens
tctgaaagcattacagtttatt

SEQ ID NO: 8115429 - DNA, 22 bp, Homo sapiens
tctgaaagagagtacatacagt

SEQ ID NO: 8115430 - DNA, 22 bp, Homo sapiens
tctgaaataactgatgccagat

SEQ ID NO: 8115431 - DNA, 22 bp, Homo sapiens
tctgaaataagggagaagggaa

SEQ ID NO: 8115432 - DNA, 22 bp, Homo sapiens
tctgaaatagaagtgtctttct

SEQ ID NO: 8115433 - DNA, 22 bp, Homo sapiens
tctgaaatactgcaggttctct

SEQ ID NO: 8115434 - DNA, 22 bp, Homo sapiens
tctgaaagaagggcagtctttt

SEQ ID NO: 8115435 - DNA, 17 bp, Homo sapiens
tctctttccctttctgc

SEQ ID NO: 8115436 - DNA, 22 bp, Homo sapiens
tctgaaatgcaggcaatttgct

SEQ ID NO: 8115437 - DNA, 22 bp, Homo sapiens
tctgaaatgcaaatttgactga

SEQ ID NO: 8115438 - DNA, 22 bp, Homo sapiens
tctgaaataggaaagcaaatgg

SEQ ID NO: 8115439 - DNA, 22 bp, Homo sapiens
tctgaaatgcaggcaatttgct

SEQ ID NO: 8115440 - DNA, 22 bp, Homo sapiens
tctgaaatggcagcgggaatga

SEQ ID NO: 8115441 - DNA, 22 bp, Homo sapiens
tctgaaatggcgatggccgttg

SEQ ID NO: 8115442 - DNA, 22 bp, Homo sapiens
tctgaaatggggctgaagcact

SEQ ID NO: 8115443 - DNA, 22 bp, Homo sapiens
tctgaaattccttccagacttt

SEQ ID NO: 8115444 - DNA, 22 bp, Homo sapiens
tctgaaattccttccagacttt

SEQ ID NO: 8115445 - DNA, 22 bp, Homo sapiens
tctgaaattgttagtaaaaatg

SEQ ID NO: 8115446 - DNA, 22 bp, Homo sapiens
tctgaaattttagttatagaaa

SEQ ID NO: 8115447 - DNA, 22 bp, Homo sapiens
tctgaaattcacagttgagtca

SEQ ID NO: 8115448 - DNA, 22 bp, Homo sapiens
tctgaaatgttctcttgttttg

SEQ ID NO: 8115449 - DNA, 22 bp, Homo sapiens
tctgaaattttagttatagaaa

SEQ ID NO: 8115450 - DNA, 18 bp, Homo sapiens
tctgaaggaatgattcca

SEQ ID NO: 8115451 - DNA, 22 bp, Homo sapiens
tctgaaggtgctagagaaagct

SEQ ID NO: 8115452 - DNA, 22 bp, Homo sapiens
tctgaagggctgagtggaggag

SEQ ID NO: 8115453 - DNA, 22 bp, Homo sapiens
tctgaaggtctgagaaccagga

SEQ ID NO: 8115454 - DNA, 22 bp, Homo sapiens
tctctgtgcttgactttcccat

SEQ ID NO: 8115455 - DNA, 22 bp, Homo sapiens
tctctgtgtctcatgttcctat

SEQ ID NO: 8115456 - DNA, 22 bp, Homo sapiens
tctctgtccctaggagccttgc

SEQ ID NO: 8115457 - DNA, 22 bp, Homo sapiens
tctctgtgactgcagctttgca

SEQ ID NO: 8115458 - DNA, 22 bp, Homo sapiens
tctcttattttgcctttgacaa

SEQ ID NO: 8115459 - DNA, 22 bp, Homo sapiens
tctcttccatgtttcagcccca

SEQ ID NO: 8115460 - DNA, 22 bp, Homo sapiens
tctcttccatgtttcagcccca

SEQ ID NO: 8115461 - DNA, 22 bp, Homo sapiens
tctcttccttgacctattgtaa

SEQ ID NO: 8115462 - DNA, 22 bp, Homo sapiens
tctcttctatttgagactattt

SEQ ID NO: 8115463 - DNA, 22 bp, Homo sapiens
tctcttctaattttcccgagta

SEQ ID NO: 8115464 - DNA, 22 bp, Homo sapiens
tctcttctaattagggtccatg

SEQ ID NO: 8115465 - DNA, 22 bp, Homo sapiens
tctcttctgaaacctgtcttta

SEQ ID NO: 8115466 - DNA, 22 bp, Homo sapiens
tctcttctgacctagccttgga

SEQ ID NO: 8115467 - DNA, 18 bp, Homo sapiens
tctcttcttggcagtcaa

SEQ ID NO: 8115468 - DNA, 18 bp, Homo sapiens
tctcttcttggcagtcaa

SEQ ID NO: 8115469 - DNA, 22 bp, Homo sapiens
tctctcactggtgcctctgttg

SEQ ID NO: 8115470 - DNA, 22 bp, Homo sapiens
tctctcagaggaagaggcagtg

SEQ ID NO: 8115471 - DNA, 22 bp, Homo sapiens
tctctatttgcctaggcttgtg

SEQ ID NO: 8115472 - DNA, 22 bp, Homo sapiens
tctctcataagatgagtactta

SEQ ID NO: 8115473 - DNA, 22 bp, Homo sapiens
tctctccaacatggtggtgctg

SEQ ID NO: 8115474 - DNA, 18 bp, Homo sapiens
tctctcagggaaacagaa

SEQ ID NO: 8115475 - DNA, 22 bp, Homo sapiens
tctctcaggaggcaggttccta

SEQ ID NO: 8115476 - DNA, 22 bp, Homo sapiens
tctctctcagccattacagaac

SEQ ID NO: 8115477 - DNA, 22 bp, Homo sapiens
tctctcctgtgttctgatgttt

SEQ ID NO: 8115478 - DNA, 22 bp, Homo sapiens
tctctctgagttgagcaggagt

SEQ ID NO: 8115479 - DNA, 22 bp, Homo sapiens
tctctcccaaatctgcagatag

SEQ ID NO: 8115480 - DNA, 22 bp, Homo sapiens
tctctcccctggccgctacgcg

SEQ ID NO: 8115481 - DNA, 18 bp, Homo sapiens
tctctccatctatttgtt

SEQ ID NO: 8115482 - DNA, 22 bp, Homo sapiens
tctctccctttccttatcagtt

SEQ ID NO: 8115483 - DNA, 21 bp, Homo sapiens
tctctcctcaagctcgacccc

SEQ ID NO: 8115484 - DNA, 22 bp, Homo sapiens
tctctcctaatttcaggtgctt

SEQ ID NO: 8115485 - DNA, 22 bp, Homo sapiens
tctctcctgcactgaattatgt

SEQ ID NO: 8115486 - DNA, 22 bp, Homo sapiens
tctctgagaagttcctttgtga

SEQ ID NO: 8115487 - DNA, 22 bp, Homo sapiens
tctctgaattgtttaagttatt

SEQ ID NO: 8115488 - DNA, 23 bp, Homo sapiens
tctctctggcaaatttcacatat

SEQ ID NO: 8115489 - DNA, 22 bp, Homo sapiens
tctctctgccaactcacagcca

SEQ ID NO: 8115490 - DNA, 20 bp, Homo sapiens
tctctgagcttctcttgggg

SEQ ID NO: 8115491 - DNA, 22 bp, Homo sapiens
tctctgagctgcttcttgcata

SEQ ID NO: 8115492 - DNA, 22 bp, Homo sapiens
tctctgagttctcctccagccc

SEQ ID NO: 8115493 - DNA, 22 bp, Homo sapiens
tctctgaggttgtttccagcac

SEQ ID NO: 8115494 - DNA, 22 bp, Homo sapiens
tctctgagcgcattcctccggc

SEQ ID NO: 8115495 - DNA, 22 bp, Homo sapiens
tctctgagcccagtgtccccct

SEQ ID NO: 8115496 - DNA, 22 bp, Homo sapiens
tctctgagcccaatgtagcaat

SEQ ID NO: 8115497 - DNA, 22 bp, Homo sapiens
tctctgagcatgccatattgct

SEQ ID NO: 8115498 - DNA, 22 bp, Homo sapiens
tctctgagacagtagcctctgc

SEQ ID NO: 8115499 - DNA, 21 bp, Homo sapiens
tctctggagttagcagagaga

SEQ ID NO: 8115500 - DNA, 22 bp, Homo sapiens
tctctggcagacacctccctga

SEQ ID NO: 8115501 - DNA, 22 bp, Homo sapiens
tctctggcagaggccctatccc

SEQ ID NO: 8115502 - DNA, 22 bp, Homo sapiens
tctctggacttccacctctatt

SEQ ID NO: 8115503 - DNA, 22 bp, Homo sapiens
tctctggagtataaccagggat

SEQ ID NO: 8115504 - DNA, 22 bp, Homo sapiens
tctctggagggctccaggcggg

SEQ ID NO: 8115505 - DNA, 22 bp, Homo sapiens
tctctggagctgcagatccagg

SEQ ID NO: 8115506 - DNA, 23 bp, Homo sapiens
tctctggaactggagagtacggt

SEQ ID NO: 8115507 - DNA, 22 bp, Homo sapiens
tctctggaattggctgaggcaa

SEQ ID NO: 8115508 - DNA, 22 bp, Homo sapiens
tctctggggatggacctgggag

SEQ ID NO: 8115509 - DNA, 22 bp, Homo sapiens
tctctggctggcaccccaggga

SEQ ID NO: 8115510 - DNA, 23 bp, Homo sapiens
tctagcctgtcatcagcctctcc

SEQ ID NO: 8115511 - DNA, 22 bp, Homo sapiens
tctagctgagggtaggagacct

SEQ ID NO: 8115512 - DNA, 22 bp, Homo sapiens
tctagagactataatgtgtcct

SEQ ID NO: 8115513 - DNA, 22 bp, Homo sapiens
tctagacctggcactgccctgt

SEQ ID NO: 8115514 - DNA, 22 bp, Homo sapiens
tctagagctttttcctcttgta

SEQ ID NO: 8115515 - DNA, 22 bp, Homo sapiens
tctagaaaaccaatattacatg

SEQ ID NO: 8115516 - DNA, 22 bp, Homo sapiens
tctagaaaaccaatattacatg

SEQ ID NO: 8115517 - DNA, 22 bp, Homo sapiens
tctacttttccctatacagttt

SEQ ID NO: 8115518 - DNA, 22 bp, Homo sapiens
tctacccagagctatgacctga

SEQ ID NO: 8115519 - DNA, 22 bp, Homo sapiens
tctaaagtgagtcatttcgact

SEQ ID NO: 8115520 - DNA, 22 bp, Homo sapiens
tctacaaataaattactatgta

SEQ ID NO: 8115521 - DNA, 22 bp, Homo sapiens
tctagttctagatccctgagga

SEQ ID NO: 8115522 - DNA, 20 bp, Homo sapiens
tctagggatggcatatgtct

SEQ ID NO: 8115523 - DNA, 22 bp, Homo sapiens
tctagggagctctagcagtggt

SEQ ID NO: 8115524 - DNA, 22 bp, Homo sapiens
tctagggagagttgttatgggt

SEQ ID NO: 8115525 - DNA, 22 bp, Homo sapiens
tctagggtgttacatacctgct

SEQ ID NO: 8115526 - DNA, 22 bp, Homo sapiens
tctattaatgattcaatagtgt

SEQ ID NO: 8115527 - DNA, 22 bp, Homo sapiens
tctatggggcctcacaggcact

SEQ ID NO: 8115528 - DNA, 22 bp, Homo sapiens
tctatgcttgagacagatgggg

SEQ ID NO: 8115529 - DNA, 22 bp, Homo sapiens
tctattttgtttccagctctac

SEQ ID NO: 8115530 - DNA, 22 bp, Homo sapiens
tctcaaactaacaatgattata

SEQ ID NO: 8115531 - DNA, 22 bp, Homo sapiens
tctcaaagtagctcccacagat

SEQ ID NO: 8115532 - DNA, 23 bp, Homo sapiens
tctcaaatatgatctgggtcatc

SEQ ID NO: 8115533 - DNA, 23 bp, Homo sapiens
tctcacagcgatctaggaagagg

SEQ ID NO: 8115534 - DNA, 22 bp, Homo sapiens
tctcacagccatttctccctct

SEQ ID NO: 8115535 - DNA, 22 bp, Homo sapiens
tctcacagcattatccagggca

SEQ ID NO: 8115536 - DNA, 22 bp, Homo sapiens
tctcacagcaggggccaggtct

SEQ ID NO: 8115537 - DNA, 22 bp, Homo sapiens
tctcacagatcagcagggggct

SEQ ID NO: 8115538 - DNA, 20 bp, Homo sapiens
tctcacagacatcgtctcat

SEQ ID NO: 8115539 - DNA, 22 bp, Homo sapiens
tctcacactaatgctctatcag

SEQ ID NO: 8115540 - DNA, 22 bp, Homo sapiens
tctcacactatttattctgctt

SEQ ID NO: 8115541 - DNA, 22 bp, Homo sapiens
tctcaaatgtaaagcatgattt

SEQ ID NO: 8115542 - DNA, 22 bp, Homo sapiens
tctcaagcttgttggtatgttt

SEQ ID NO: 8115543 - DNA, 19 bp, Homo sapiens
tctcaattcagactgagag

SEQ ID NO: 8115544 - DNA, 22 bp, Homo sapiens
tctcaagttttctcataatctc

SEQ ID NO: 8115545 - DNA, 22 bp, Homo sapiens
tccttctctggtttttactgta

SEQ ID NO: 8115546 - DNA, 22 bp, Homo sapiens
tccttctctacaaatccaggca

SEQ ID NO: 8115547 - DNA, 22 bp, Homo sapiens
tccttctctacaaatccaggca

SEQ ID NO: 8115548 - DNA, 21 bp, Homo sapiens
tccttctctatgattgtctga

SEQ ID NO: 8115549 - DNA, 22 bp, Homo sapiens
tccttctcctccttgagtgaca

SEQ ID NO: 8115550 - DNA, 19 bp, Homo sapiens
tccttctccggccaccccg

SEQ ID NO: 8115551 - DNA, 19 bp, Homo sapiens
tccttctccggccaccccg

SEQ ID NO: 8115552 - DNA, 22 bp, Homo sapiens
tccttcctggggtctctgctgc

SEQ ID NO: 8115553 - DNA, 22 bp, Homo sapiens
tccttcctggggtctctgctgc

SEQ ID NO: 8115554 - DNA, 23 bp, Homo sapiens
tccttcctttgagaggctccatc

SEQ ID NO: 8115555 - DNA, 22 bp, Homo sapiens
tccttcctggggtctctgctgc

SEQ ID NO: 8115556 - DNA, 22 bp, Homo sapiens
tccttctttgacaagtggcaga

SEQ ID NO: 8115557 - DNA, 22 bp, Homo sapiens
tccttctttcacctcatagtca

SEQ ID NO: 8115558 - DNA, 22 bp, Homo sapiens
tccttgcacattatctgggaaa

SEQ ID NO: 8115559 - DNA, 22 bp, Homo sapiens
tccttgggaaatcactagcact

SEQ ID NO: 8115560 - DNA, 22 bp, Homo sapiens
tcctttctatcttgggtatcta

SEQ ID NO: 8115561 - DNA, 22 bp, Homo sapiens
tcctttctccttccgacttcat

SEQ ID NO: 8115562 - DNA, 18 bp, Homo sapiens
tcctttctccctcatctt

SEQ ID NO: 8115563 - DNA, 18 bp, Homo sapiens
tcctttctccctcatctt

SEQ ID NO: 8115564 - DNA, 22 bp, Homo sapiens
tcctttcttgtgtatcaaatgg

SEQ ID NO: 8115565 - DNA, 22 bp, Homo sapiens
tcctttcttcttctgcccatgg

SEQ ID NO: 8115566 - DNA, 19 bp, Homo sapiens
tcctttctgttcctgagat

SEQ ID NO: 8115567 - DNA, 22 bp, Homo sapiens
tcctttgcttctgtcattctcc

SEQ ID NO: 8115568 - DNA, 22 bp, Homo sapiens
tctaaagatttggattcatttg

SEQ ID NO: 8115569 - DNA, 22 bp, Homo sapiens
tctaaagtatgctaatatgtga

SEQ ID NO: 8115570 - DNA, 22 bp, Homo sapiens
tctaaactagggttaaaggaaa

SEQ ID NO: 8115571 - DNA, 22 bp, Homo sapiens
tctaaacattatgatagtagag

SEQ ID NO: 8115572 - DNA, 22 bp, Homo sapiens
tctaaacttcactttaagtgct

SEQ ID NO: 8115573 - DNA, 22 bp, Homo sapiens
tctaaagacactttttacaggg

SEQ ID NO: 8115574 - DNA, 22 bp, Homo sapiens
tcgccagggatgctgtaaggaa

SEQ ID NO: 8115575 - DNA, 22 bp, Homo sapiens
tcgtcctgtgcacctgcctgca

SEQ ID NO: 8115576 - DNA, 22 bp, Homo sapiens
tcgttaaatgctaaaactgaca

SEQ ID NO: 8115577 - DNA, 22 bp, Homo sapiens
taagaatattgggaatggatgg

SEQ ID NO: 8115578 - DNA, 22 bp, Homo sapiens
taagaatagtgtttgcctttgg

SEQ ID NO: 8115579 - DNA, 22 bp, Homo sapiens
tcctgctgtttacctacaatgg

SEQ ID NO: 8115580 - DNA, 19 bp, Homo sapiens
tcctgctgtgtgaagggga

SEQ ID NO: 8115581 - DNA, 22 bp, Homo sapiens
taagaatagtccctagatgtgt

SEQ ID NO: 8115582 - DNA, 22 bp, Homo sapiens
taagaatacctctcagctcttt

SEQ ID NO: 8115583 - DNA, 22 bp, Homo sapiens
tcctggactggctcagcaccct

SEQ ID NO: 8115584 - DNA, 22 bp, Homo sapiens
tcctggacagatccccatcatc

SEQ ID NO: 8115585 - DNA, 22 bp, Homo sapiens
tcctggacaagcccttcaccct

SEQ ID NO: 8115586 - DNA, 19 bp, Homo sapiens
tcctggcatttgtaggaaa

SEQ ID NO: 8115587 - DNA, 22 bp, Homo sapiens
tcctggcattgtgcagggtgtg

SEQ ID NO: 8115588 - DNA, 22 bp, Homo sapiens
tcctggcatttacaaacccacc

SEQ ID NO: 8115589 - DNA, 22 bp, Homo sapiens
tcctggcatccgtgggtctgtg

SEQ ID NO: 8115590 - DNA, 19 bp, Homo sapiens
tcctggcatcttcctccct

SEQ ID NO: 8115591 - DNA, 17 bp, Homo sapiens
tcctggcagtcccctgg

SEQ ID NO: 8115592 - DNA, 22 bp, Homo sapiens
tcctggcagtgcttgttttgga

SEQ ID NO: 8115593 - DNA, 17 bp, Homo sapiens
tcctggcagtcccctgg

SEQ ID NO: 8115594 - DNA, 18 bp, Homo sapiens
tcctggcagtcagagagg

SEQ ID NO: 8115595 - DNA, 22 bp, Homo sapiens
tcctggcacattgcaggggctc

SEQ ID NO: 8115596 - DNA, 22 bp, Homo sapiens
tcctggcacaaccctttaccag

SEQ ID NO: 8115597 - DNA, 22 bp, Homo sapiens
tcctggcaatggcaggttcagg

SEQ ID NO: 8115598 - DNA, 20 bp, Homo sapiens
tcctggcaagccgtacctcc

SEQ ID NO: 8115599 - DNA, 19 bp, Homo sapiens
tcctggcacagtggaacca

SEQ ID NO: 8115600 - DNA, 22 bp, Homo sapiens
tcctggcaaagcaagttatgaa

SEQ ID NO: 8115601 - DNA, 22 bp, Homo sapiens
tcctgtcctctgggtgccccat

SEQ ID NO: 8115602 - DNA, 22 bp, Homo sapiens
tcctgtccacagccctgacctc

SEQ ID NO: 8115603 - DNA, 22 bp, Homo sapiens
tcctggtgtaatggtaagcatg

SEQ ID NO: 8115604 - DNA, 22 bp, Homo sapiens
tcctggtggtgccagctgcagg

SEQ ID NO: 8115605 - DNA, 22 bp, Homo sapiens
tcctgtggagaggactggaggt

SEQ ID NO: 8115606 - DNA, 19 bp, Homo sapiens
tcctggggatgtggtcacc

SEQ ID NO: 8115607 - DNA, 22 bp, Homo sapiens
tcctgggagtaattgagtcatg

SEQ ID NO: 8115608 - DNA, 22 bp, Homo sapiens
tcctgggatgacttttgaaatg

SEQ ID NO: 8115609 - DNA, 22 bp, Homo sapiens
tcctgggcagcgggacgctcag

SEQ ID NO: 8115610 - DNA, 22 bp, Homo sapiens
tcctgggcccaggctgccaggg

SEQ ID NO: 8115611 - DNA, 22 bp, Homo sapiens
tcctgggcggttatgtgatctg

SEQ ID NO: 8115612 - DNA, 22 bp, Homo sapiens
tcctgggacaagccgtggaagt

SEQ ID NO: 8115613 - DNA, 22 bp, Homo sapiens
tcctggctgagttcccaagtcg

SEQ ID NO: 8115614 - DNA, 22 bp, Homo sapiens
tgcaggaaaaccaacacgcctt

SEQ ID NO: 8115615 - DNA, 20 bp, Homo sapiens
tgcagctggtttcacaggga

SEQ ID NO: 8115616 - DNA, 22 bp, Homo sapiens
tgcaggagagctggtctggccc

SEQ ID NO: 8115617 - DNA, 22 bp, Homo sapiens
tgcaggaacagaactcactccc

SEQ ID NO: 8115618 - DNA, 22 bp, Homo sapiens
tgcaggctcacctgccagggcc

SEQ ID NO: 8115619 - DNA, 22 bp, Homo sapiens
tgcaggctcaccctggagctga

SEQ ID NO: 8115620 - DNA, 22 bp, Homo sapiens
tgcaggctatatcttatttgac

SEQ ID NO: 8115621 - DNA, 22 bp, Homo sapiens
tgcaggctatcctttgctgcaa

SEQ ID NO: 8115622 - DNA, 22 bp, Homo sapiens
tgcaggctcatctcaagagtag

SEQ ID NO: 8115623 - DNA, 22 bp, Homo sapiens
tgcaggctccacgttgttgtcc

SEQ ID NO: 8115624 - DNA, 22 bp, Homo sapiens
tgcaggctccaggtgcacatat

SEQ ID NO: 8115625 - DNA, 23 bp, Homo sapiens
tgcaggctaggaagagagccttc

SEQ ID NO: 8115626 - DNA, 21 bp, Homo sapiens
tgcaggctacttctgactcta

SEQ ID NO: 8115627 - DNA, 22 bp, Homo sapiens
tgcaggagttaagtgctctcct

SEQ ID NO: 8115628 - DNA, 19 bp, Homo sapiens
tgcaggaggactgagcaga

SEQ ID NO: 8115629 - DNA, 22 bp, Homo sapiens
tgcagctagcgtgcctagtgaa

SEQ ID NO: 8115630 - DNA, 22 bp, Homo sapiens
tgcagccttgcctcctcccagc

SEQ ID NO: 8115631 - DNA, 22 bp, Homo sapiens
tgcagctcctctggctgcctga

SEQ ID NO: 8115632 - DNA, 22 bp, Homo sapiens
tgcagctcctctggctgcctga

SEQ ID NO: 8115633 - DNA, 22 bp, Homo sapiens
tgcagctgacccactccagtcc

SEQ ID NO: 8115634 - DNA, 22 bp, Homo sapiens
tgcagctgagtcacccagccat

SEQ ID NO: 8115635 - DNA, 22 bp, Homo sapiens
tgcagctgatgatacccccatg

SEQ ID NO: 8115636 - DNA, 17 bp, Homo sapiens
tgcagctgctcccaggc

SEQ ID NO: 8115637 - DNA, 22 bp, Homo sapiens
tgcagctggtatcccatggatt

SEQ ID NO: 8115638 - DNA, 22 bp, Homo sapiens
tgcagctggtatcccatggatt

SEQ ID NO: 8115639 - DNA, 22 bp, Homo sapiens
tgcagctggtatcccatggatt

SEQ ID NO: 8115640 - DNA, 22 bp, Homo sapiens
tgcagcagggcccaggcacaga

SEQ ID NO: 8115641 - DNA, 22 bp, Homo sapiens
tgcagcccagccccagaacctt

SEQ ID NO: 8115642 - DNA, 22 bp, Homo sapiens
tgcagccatcgcagagtctgta

SEQ ID NO: 8115643 - DNA, 22 bp, Homo sapiens
tgcagcctagacattctggtca

SEQ ID NO: 8115644 - DNA, 22 bp, Homo sapiens
tgcagcagcagggaggaggctc

SEQ ID NO: 8115645 - DNA, 22 bp, Homo sapiens
tgcagagattgaacaagaagga

SEQ ID NO: 8115646 - DNA, 22 bp, Homo sapiens
tgcagaccacagctaggctgga

SEQ ID NO: 8115647 - DNA, 22 bp, Homo sapiens
tgcagagatcctggactgagcg

SEQ ID NO: 8115648 - DNA, 21 bp, Homo sapiens
tgcagagatatctgaagcaga

SEQ ID NO: 8115649 - DNA, 22 bp, Homo sapiens
tgcagacaagtcgtgggatctt

SEQ ID NO: 8115650 - DNA, 22 bp, Homo sapiens
tgcagaggcgccgtgggtgggg

SEQ ID NO: 8115651 - DNA, 22 bp, Homo sapiens
tgcagaggctggctcgccgggt

SEQ ID NO: 8115652 - DNA, 22 bp, Homo sapiens
tgcagaggcatttattgatgta

SEQ ID NO: 8115653 - DNA, 21 bp, Homo sapiens
tgcagaggcacaaacaagccc

SEQ ID NO: 8115654 - DNA, 22 bp, Homo sapiens
tgcagaggagtcagcctgggca

SEQ ID NO: 8115655 - DNA, 22 bp, Homo sapiens
tgcagaggagctggaaggctgg

SEQ ID NO: 8115656 - DNA, 22 bp, Homo sapiens
tgcagagggaaaaggtgctcct

SEQ ID NO: 8115657 - DNA, 22 bp, Homo sapiens
tgcagagggacagccacagctc

SEQ ID NO: 8115658 - DNA, 23 bp, Homo sapiens
tgcagagggactgaagccagctt

SEQ ID NO: 8115659 - DNA, 19 bp, Homo sapiens
tgcagagggtaggaaggcc

SEQ ID NO: 8115660 - DNA, 22 bp, Homo sapiens
tgcagagtaacgatcacatata

SEQ ID NO: 8115661 - DNA, 22 bp, Homo sapiens
tgcagatggggatcagtggctc

SEQ ID NO: 8115662 - DNA, 22 bp, Homo sapiens
tgcagcacatgtctggggctgg

SEQ ID NO: 8115663 - DNA, 22 bp, Homo sapiens
tgcagaaaccaattcaagtaag

SEQ ID NO: 8115664 - DNA, 22 bp, Homo sapiens
tgcagaaagcattgactcttcc

SEQ ID NO: 8115665 - DNA, 21 bp, Homo sapiens
tgcagaaagcggcttgaagca

SEQ ID NO: 8115666 - DNA, 21 bp, Homo sapiens
tgcacctgtgccccatccttc

SEQ ID NO: 8115667 - DNA, 22 bp, Homo sapiens
tgcacagtaaacatgactggag

SEQ ID NO: 8115668 - DNA, 22 bp, Homo sapiens
tgcacattgaaatgaccagctg

SEQ ID NO: 8115669 - DNA, 20 bp, Homo sapiens
tgcacagggtgggaagcaac

SEQ ID NO: 8115670 - DNA, 22 bp, Homo sapiens
tgcaaatattgggacagtctag

SEQ ID NO: 8115671 - DNA, 22 bp, Homo sapiens
tgcaaagaagcctttgccttct

SEQ ID NO: 8115672 - DNA, 19 bp, Homo sapiens
tgcaaattctaaaaactga

SEQ ID NO: 8115673 - DNA, 20 bp, Homo sapiens
tgcaaacacagagtgtatga

SEQ ID NO: 8115674 - DNA, 22 bp, Homo sapiens
tgcaaacaatttcctataaagt

SEQ ID NO: 8115675 - DNA, 22 bp, Homo sapiens
tgcaaaagaatatagatattgt

SEQ ID NO: 8115676 - DNA, 21 bp, Homo sapiens
tgatttatgcccaagtccctg

SEQ ID NO: 8115677 - DNA, 22 bp, Homo sapiens
tgatttacaattgtaaaagttt

SEQ ID NO: 8115678 - DNA, 22 bp, Homo sapiens
tgatttaggaaacagctacagg

SEQ ID NO: 8115679 - DNA, 22 bp, Homo sapiens
tgatttacttctggataaatcc

SEQ ID NO: 8115680 - DNA, 22 bp, Homo sapiens
tgcaaggaagggacagctgaga

SEQ ID NO: 8115681 - DNA, 22 bp, Homo sapiens
tgcaatttatgtgcaagtggtt

SEQ ID NO: 8115682 - DNA, 22 bp, Homo sapiens
tgcacacagatggtacatgcat

SEQ ID NO: 8115683 - DNA, 19 bp, Homo sapiens
tgcacacagataagtatct

SEQ ID NO: 8115684 - DNA, 22 bp, Homo sapiens
tgattctgagggagcattctgc

SEQ ID NO: 8115685 - DNA, 22 bp, Homo sapiens
tgattctgatcatcatcatggt

SEQ ID NO: 8115686 - DNA, 22 bp, Homo sapiens
tgattctgccctttcttctgac

SEQ ID NO: 8115687 - DNA, 23 bp, Homo sapiens
tgattctgctttgagaatcatgg

SEQ ID NO: 8115688 - DNA, 22 bp, Homo sapiens
tgattctgctttgatccttgtg

SEQ ID NO: 8115689 - DNA, 22 bp, Homo sapiens
tgattctgaggaccctgtgacg

SEQ ID NO: 8115690 - DNA, 22 bp, Homo sapiens
tgattctgtaagtcatattgtt

SEQ ID NO: 8115691 - DNA, 22 bp, Homo sapiens
tgattctgttctccttgagaat

SEQ ID NO: 8115692 - DNA, 21 bp, Homo sapiens
tgattctgttttatcatcagc

SEQ ID NO: 8115693 - DNA, 23 bp, Homo sapiens
tgattacaagggccaaagaaagg

SEQ ID NO: 8115694 - DNA, 22 bp, Homo sapiens
tgattacaaaagattgtttgaa

SEQ ID NO: 8115695 - DNA, 22 bp, Homo sapiens
tgatgttatggtactattcatt

SEQ ID NO: 8115696 - DNA, 22 bp, Homo sapiens
tgatgttcagtgaagaggaccg

SEQ ID NO: 8115697 - DNA, 22 bp, Homo sapiens
tgatgttctgtatatcatatag

SEQ ID NO: 8115698 - DNA, 22 bp, Homo sapiens
tgatgaggtggattcaaagcag

SEQ ID NO: 8115699 - DNA, 22 bp, Homo sapiens
tgatatttgctgactgcattgt

SEQ ID NO: 8115700 - DNA, 22 bp, Homo sapiens
tgatatgttggatctgttggtt

SEQ ID NO: 8115701 - DNA, 22 bp, Homo sapiens
tgatcacaagtctgaagaatga

SEQ ID NO: 8115702 - DNA, 23 bp, Homo sapiens
tgagtgtgttccctgtgagattt

SEQ ID NO: 8115703 - DNA, 22 bp, Homo sapiens
tgagtgtgtattatgtatcagg

SEQ ID NO: 8115704 - DNA, 23 bp, Homo sapiens
tgagtgtggggacagtggtttgc

SEQ ID NO: 8115705 - DNA, 22 bp, Homo sapiens
tgagtgtggggaatgtcatgag

SEQ ID NO: 8115706 - DNA, 22 bp, Homo sapiens
tgagtgtgctaggtgtctcggt

SEQ ID NO: 8115707 - DNA, 22 bp, Homo sapiens
tgagtggacacctgcttcttta

SEQ ID NO: 8115708 - DNA, 22 bp, Homo sapiens
tgagtggacacctgcttcttta

SEQ ID NO: 8115709 - DNA, 22 bp, Homo sapiens
tgccaggccacgtagcttcaag

SEQ ID NO: 8115710 - DNA, 22 bp, Homo sapiens
tgccaggcccagcagggcggcc

SEQ ID NO: 8115711 - DNA, 22 bp, Homo sapiens
tgccaggccacgtagcttcaag

SEQ ID NO: 8115712 - DNA, 22 bp, Homo sapiens
tgccaggcccagctccagagct

SEQ ID NO: 8115713 - DNA, 22 bp, Homo sapiens
tgccaggccaattctatttgac

SEQ ID NO: 8115714 - DNA, 22 bp, Homo sapiens
tgccaggccaattctatttgac

SEQ ID NO: 8115715 - DNA, 22 bp, Homo sapiens
tgccaggcatttgacagacact

SEQ ID NO: 8115716 - DNA, 22 bp, Homo sapiens
tgccaggcatttgacagacact

SEQ ID NO: 8115717 - DNA, 22 bp, Homo sapiens
tgccaggccaatgaaggcaggg

SEQ ID NO: 8115718 - DNA, 22 bp, Homo sapiens
tgccaggcccagctccagagct

SEQ ID NO: 8115719 - DNA, 22 bp, Homo sapiens
tgccaggccctcccacagatta

SEQ ID NO: 8115720 - DNA, 22 bp, Homo sapiens
tgccaggccctgtgctggatgc

SEQ ID NO: 8115721 - DNA, 22 bp, Homo sapiens
tgccaggccctgcggggtccca

SEQ ID NO: 8115722 - DNA, 22 bp, Homo sapiens
tgccaggccctcccacagatta

SEQ ID NO: 8115723 - DNA, 22 bp, Homo sapiens
tgccaggctcaggatgtccctg

SEQ ID NO: 8115724 - DNA, 22 bp, Homo sapiens
tgccaggctcagcccctatctt

SEQ ID NO: 8115725 - DNA, 20 bp, Homo sapiens
tgccaggcacggagtgcatg

SEQ ID NO: 8115726 - DNA, 22 bp, Homo sapiens
tgccaggcaactgcccagccat

SEQ ID NO: 8115727 - DNA, 22 bp, Homo sapiens
tgccaggcagtgtcagattgag

SEQ ID NO: 8115728 - DNA, 22 bp, Homo sapiens
tgccaggcatatggcctctttg

SEQ ID NO: 8115729 - DNA, 22 bp, Homo sapiens
tgccaggcatgtagtagacttg

SEQ ID NO: 8115730 - DNA, 22 bp, Homo sapiens
tgccaggcaggaccctagaacc

SEQ ID NO: 8115731 - DNA, 22 bp, Homo sapiens
tgccaggcacgtgagagtggcc

SEQ ID NO: 8115732 - DNA, 22 bp, Homo sapiens
tgccatggaagtggccagacct

SEQ ID NO: 8115733 - DNA, 22 bp, Homo sapiens
tgccaggctccggaacgacagt

SEQ ID NO: 8115734 - DNA, 20 bp, Homo sapiens
tgccaggctgcacgcctgcc

SEQ ID NO: 8115735 - DNA, 22 bp, Homo sapiens
tgccaggctgaacagggtctta

SEQ ID NO: 8115736 - DNA, 22 bp, Homo sapiens
tgccaggctgtcaattcaccca

SEQ ID NO: 8115737 - DNA, 22 bp, Homo sapiens
tgccaggctgccctccagtctg

SEQ ID NO: 8115738 - DNA, 22 bp, Homo sapiens
tgccaggctgtcctgggcctgg

SEQ ID NO: 8115739 - DNA, 22 bp, Homo sapiens
tgccaggctttggtcaaaggct

SEQ ID NO: 8115740 - DNA, 22 bp, Homo sapiens
tgccaggcttagagcaggggct

SEQ ID NO: 8115741 - DNA, 22 bp, Homo sapiens
tgcccagcacccagcatgatgc

SEQ ID NO: 8115742 - DNA, 20 bp, Homo sapiens
tgcccagcaagagtgcagtt

SEQ ID NO: 8115743 - DNA, 22 bp, Homo sapiens
tgcccagcaataaaccagaaga

SEQ ID NO: 8115744 - DNA, 22 bp, Homo sapiens
tgcccaggatctggcgatgctc

SEQ ID NO: 8115745 - DNA, 20 bp, Homo sapiens
tgcccagcaagagtgcagtt

SEQ ID NO: 8115746 - DNA, 22 bp, Homo sapiens
tgccattgggcagtcattgaag

SEQ ID NO: 8115747 - DNA, 22 bp, Homo sapiens
tgcccatgtttctctgtatccc

SEQ ID NO: 8115748 - DNA, 22 bp, Homo sapiens
tgcccaggtttgagtgcccaag

SEQ ID NO: 8115749 - DNA, 22 bp, Homo sapiens
tgcccagggtggagtgcagcgg

SEQ ID NO: 8115750 - DNA, 22 bp, Homo sapiens
tgccccctggtggccagagccg

SEQ ID NO: 8115751 - DNA, 19 bp, Homo sapiens
tgcccaggccaggttgggc

SEQ ID NO: 8115752 - DNA, 22 bp, Homo sapiens
tgcccaggctggagtacagtgg

SEQ ID NO: 8115753 - DNA, 22 bp, Homo sapiens
tgcccaggcttcaccctcagag

SEQ ID NO: 8115754 - DNA, 22 bp, Homo sapiens
tgccctcaagcaacagagagga

SEQ ID NO: 8115755 - DNA, 22 bp, Homo sapiens
tgccctggaaccatctacagtc

SEQ ID NO: 8115756 - DNA, 22 bp, Homo sapiens
tgccctggcacacacacagctg

SEQ ID NO: 8115757 - DNA, 22 bp, Homo sapiens
tgccctgtgtgtgcaagcactg

SEQ ID NO: 8115758 - DNA, 22 bp, Homo sapiens
tgccgcagtgcggggagggccc

SEQ ID NO: 8115759 - DNA, 22 bp, Homo sapiens
tgcctcagagacctgacagtac

SEQ ID NO: 8115760 - DNA, 22 bp, Homo sapiens
tgcctatttacttcacagttga

SEQ ID NO: 8115761 - DNA, 22 bp, Homo sapiens
tgccgtggggctgaggctggag

SEQ ID NO: 8115762 - DNA, 22 bp, Homo sapiens
tgcctaagtctgcagtcacttg

SEQ ID NO: 8115763 - DNA, 22 bp, Homo sapiens
tgccgctgtcgccaccatggct

SEQ ID NO: 8115764 - DNA, 22 bp, Homo sapiens
tgccgcagtgcggggagggccc

SEQ ID NO: 8115765 - DNA, 22 bp, Homo sapiens
tgcctggcactcctggagctca

SEQ ID NO: 8115766 - DNA, 22 bp, Homo sapiens
tgcctggatctgaggacccatt

SEQ ID NO: 8115767 - DNA, 22 bp, Homo sapiens
tgcctcagagtgggcttgctat

SEQ ID NO: 8115768 - DNA, 22 bp, Homo sapiens
tgcctcctctttgccaaggtca

SEQ ID NO: 8115769 - DNA, 22 bp, Homo sapiens
tgcctctgctgctgtggcatca

SEQ ID NO: 8115770 - DNA, 22 bp, Homo sapiens
tgcctctgcctccattgttagt

SEQ ID NO: 8115771 - DNA, 22 bp, Homo sapiens
tgcctctgtggaaatggtggtc

SEQ ID NO: 8115772 - DNA, 22 bp, Homo sapiens
tgcctctggttatctggtacct

SEQ ID NO: 8115773 - DNA, 22 bp, Homo sapiens
tgcctctgctgctgtggcatca

SEQ ID NO: 8115774 - DNA, 22 bp, Homo sapiens
tgcctctgtgggcagagctgcc

SEQ ID NO: 8115775 - DNA, 22 bp, Homo sapiens
tgcctctgtgtgcaggtgagca

SEQ ID NO: 8115776 - DNA, 22 bp, Homo sapiens
tgcctctgttgagccttggctg

SEQ ID NO: 8115777 - DNA, 21 bp, Homo sapiens
tgcagtcctttgacatgattc

SEQ ID NO: 8115778 - DNA, 22 bp, Homo sapiens
tgcagtggtggtaaagatgctc

SEQ ID NO: 8115779 - DNA, 22 bp, Homo sapiens
tgcagtggtggtaaagatgctc

SEQ ID NO: 8115780 - DNA, 22 bp, Homo sapiens
tgcagtgggccggaggccaggg

SEQ ID NO: 8115781 - DNA, 22 bp, Homo sapiens
tgcagtgggccggaggccaggg

SEQ ID NO: 8115782 - DNA, 22 bp, Homo sapiens
tgcagtggttgagagcccagac

SEQ ID NO: 8115783 - DNA, 22 bp, Homo sapiens
tgcagtgtgacctgtagcgagc

SEQ ID NO: 8115784 - DNA, 22 bp, Homo sapiens
tgcagggtggtttgaagggtct

SEQ ID NO: 8115785 - DNA, 22 bp, Homo sapiens
tgcagggatcctagctgaagag

SEQ ID NO: 8115786 - DNA, 22 bp, Homo sapiens
tgcagggatgctagaggtaaga

SEQ ID NO: 8115787 - DNA, 22 bp, Homo sapiens
tgcagggattatgtaggggttg

SEQ ID NO: 8115788 - DNA, 22 bp, Homo sapiens
tgcaggctgtaatctgaggcta

SEQ ID NO: 8115789 - DNA, 21 bp, Homo sapiens
tgcaggctgtgcgctcctgcc

SEQ ID NO: 8115790 - DNA, 21 bp, Homo sapiens
tgcaggctgtttaagaggcaa

SEQ ID NO: 8115791 - DNA, 18 bp, Homo sapiens
tgcaggctgttgaaactg

SEQ ID NO: 8115792 - DNA, 22 bp, Homo sapiens
tgcaggctgtgtcatttagtga

SEQ ID NO: 8115793 - DNA, 17 bp, Homo sapiens
tgcaggctgttatagcc

SEQ ID NO: 8115794 - DNA, 22 bp, Homo sapiens
tgcaggcttggatcacatctcc

SEQ ID NO: 8115795 - DNA, 22 bp, Homo sapiens
tgcaggctgtttggtggatctc

SEQ ID NO: 8115796 - DNA, 20 bp, Homo sapiens
tgcaggcttcgctctaggag

SEQ ID NO: 8115797 - DNA, 22 bp, Homo sapiens
tgcaggctttagccccatggct

SEQ ID NO: 8115798 - DNA, 22 bp, Homo sapiens
tgcagggaaaacccaggatgct

SEQ ID NO: 8115799 - DNA, 22 bp, Homo sapiens
tgcagggaagtcccagctcctg

SEQ ID NO: 8115800 - DNA, 22 bp, Homo sapiens
tgcagggaagcaagggtggctc

SEQ ID NO: 8115801 - DNA, 22 bp, Homo sapiens
tgcagggaacttggacagctag

SEQ ID NO: 8115802 - DNA, 22 bp, Homo sapiens
tgcaggctgctcaagacttagt

SEQ ID NO: 8115803 - DNA, 22 bp, Homo sapiens
tgcaggctgccttcacagagcc

SEQ ID NO: 8115804 - DNA, 22 bp, Homo sapiens
tgcaggctgctggcagtagctt

SEQ ID NO: 8115805 - DNA, 22 bp, Homo sapiens
tgcaggctggcagatatctcat

SEQ ID NO: 8115806 - DNA, 22 bp, Homo sapiens
tgcaggctggatttgcttttgt

SEQ ID NO: 8115807 - DNA, 22 bp, Homo sapiens
tgcaggctggaggagggactaa

SEQ ID NO: 8115808 - DNA, 18 bp, Homo sapiens
tgcaggctggggttcctc

SEQ ID NO: 8115809 - DNA, 22 bp, Homo sapiens
tgcaggctggggaggcagactt

SEQ ID NO: 8115810 - DNA, 22 bp, Homo sapiens
tgcaggctggcagtgctgaaat

SEQ ID NO: 8115811 - DNA, 22 bp, Homo sapiens
tgcaggctgggaagagggacaa

SEQ ID NO: 8115812 - DNA, 22 bp, Homo sapiens
tgcaggctctctgctgccagat

SEQ ID NO: 8115813 - DNA, 22 bp, Homo sapiens
tgcaggctccatgaggacaggc

SEQ ID NO: 8115814 - DNA, 17 bp, Homo sapiens
tgcaggctcctgtccct

SEQ ID NO: 8115815 - DNA, 22 bp, Homo sapiens
tgcaggctgcagtctcaggtgg

SEQ ID NO: 8115816 - DNA, 22 bp, Homo sapiens
tgcaggctgcacccctgccctg

SEQ ID NO: 8115817 - DNA, 22 bp, Homo sapiens
tgcaggctctggtttatagtgc

SEQ ID NO: 8115818 - DNA, 22 bp, Homo sapiens
tgcaggctgaggctggctcaac

SEQ ID NO: 8115819 - DNA, 22 bp, Homo sapiens
tgcaggctctgtgtgtgcctgg

SEQ ID NO: 8115820 - DNA, 22 bp, Homo sapiens
tgcaggctcttggtgacgtggg

SEQ ID NO: 8115821 - DNA, 22 bp, Homo sapiens
tgccactggggctaggactgtt

SEQ ID NO: 8115822 - DNA, 22 bp, Homo sapiens
tgcattggtcttaatcttcagg

SEQ ID NO: 8115823 - DNA, 17 bp, Homo sapiens
tgcattgttggaaattt

SEQ ID NO: 8115824 - DNA, 19 bp, Homo sapiens
tgccaaatccatgcccagg

SEQ ID NO: 8115825 - DNA, 22 bp, Homo sapiens
tgcatgtttataacagatgagg

SEQ ID NO: 8115826 - DNA, 22 bp, Homo sapiens
tgcatcctcctttgtcctcttg

SEQ ID NO: 8115827 - DNA, 23 bp, Homo sapiens
tgcatcctcatttttcacacgag

SEQ ID NO: 8115828 - DNA, 22 bp, Homo sapiens
tgcatcctcctttgtcctcttg

SEQ ID NO: 8115829 - DNA, 22 bp, Homo sapiens
tgagcctggcggaagcagcgtg

SEQ ID NO: 8115830 - DNA, 20 bp, Homo sapiens
tgagcctgctgtaggaggcc

SEQ ID NO: 8115831 - DNA, 22 bp, Homo sapiens
tgagcccttgacatcgcccact

SEQ ID NO: 8115832 - DNA, 22 bp, Homo sapiens
tgagcttcctccctgcatccat

SEQ ID NO: 8115833 - DNA, 22 bp, Homo sapiens
tgaggaaacttacaaggcagaa

SEQ ID NO: 8115834 - DNA, 22 bp, Homo sapiens
tgagctgccccctggcctgctc

SEQ ID NO: 8115835 - DNA, 22 bp, Homo sapiens
tgagctggagtctgtggctcct

SEQ ID NO: 8115836 - DNA, 19 bp, Homo sapiens
tgagctgctgctgcccatc

SEQ ID NO: 8115837 - DNA, 19 bp, Homo sapiens
tgagcatgcgagctgagaa

SEQ ID NO: 8115838 - DNA, 22 bp, Homo sapiens
tgagcatggtgggtgcagagca

SEQ ID NO: 8115839 - DNA, 22 bp, Homo sapiens
tgagcagcttctgtctgaaggc

SEQ ID NO: 8115840 - DNA, 22 bp, Homo sapiens
tgagcaggcgcagcaggaggtc

SEQ ID NO: 8115841 - DNA, 22 bp, Homo sapiens
tgagcagaggagtgacgtaggt

SEQ ID NO: 8115842 - DNA, 22 bp, Homo sapiens
tgagcagagcagtaacaggagc

SEQ ID NO: 8115843 - DNA, 22 bp, Homo sapiens
tgagcagagcaataggactctc

SEQ ID NO: 8115844 - DNA, 22 bp, Homo sapiens
tgagacagggtcttgctctgtt

SEQ ID NO: 8115845 - DNA, 17 bp, Homo sapiens
tgagacagggcaggccc

SEQ ID NO: 8115846 - DNA, 22 bp, Homo sapiens
tgagacagtaattgtatagttt

SEQ ID NO: 8115847 - DNA, 22 bp, Homo sapiens
tgagacagtatcgccccaaggc

SEQ ID NO: 8115848 - DNA, 22 bp, Homo sapiens
tgagacagtcccatgatctgca

SEQ ID NO: 8115849 - DNA, 22 bp, Homo sapiens
tgagacagtcaccaggcaggcc

SEQ ID NO: 8115850 - DNA, 18 bp, Homo sapiens
tgagacagctaccacttg

SEQ ID NO: 8115851 - DNA, 22 bp, Homo sapiens
tgagacaggagaggcccctcct

SEQ ID NO: 8115852 - DNA, 19 bp, Homo sapiens
tgagacagggattcaggtg

SEQ ID NO: 8115853 - DNA, 22 bp, Homo sapiens
tgagacaggcttccttcttggg

SEQ ID NO: 8115854 - DNA, 22 bp, Homo sapiens
tgagacagcagtcagggaaata

SEQ ID NO: 8115855 - DNA, 22 bp, Homo sapiens
tgagacagcctctgcactcatg

SEQ ID NO: 8115856 - DNA, 22 bp, Homo sapiens
tgagacagcccttctgcacagg

SEQ ID NO: 8115857 - DNA, 22 bp, Homo sapiens
tgagaagctgcttgtgctgtat

SEQ ID NO: 8115858 - DNA, 20 bp, Homo sapiens
tgagaagctcctgtctcctc

SEQ ID NO: 8115859 - DNA, 22 bp, Homo sapiens
tgagaagctgctgacttagcct

SEQ ID NO: 8115860 - DNA, 19 bp, Homo sapiens
tgagacagaagatgagcct

SEQ ID NO: 8115861 - DNA, 22 bp, Homo sapiens
tgagacagcagattagcaatga

SEQ ID NO: 8115862 - DNA, 19 bp, Homo sapiens
tgagacagagaccagttct

SEQ ID NO: 8115863 - DNA, 23 bp, Homo sapiens
tgagaaattttgattcagtagga

SEQ ID NO: 8115864 - DNA, 22 bp, Homo sapiens
tgagaaattacttcagtgatgg

SEQ ID NO: 8115865 - DNA, 22 bp, Homo sapiens
tgagaaatattgcacagtgagg

SEQ ID NO: 8115866 - DNA, 22 bp, Homo sapiens
tgagaaatccagatgtgcagtt

SEQ ID NO: 8115867 - DNA, 22 bp, Homo sapiens
tgagaactggtagcacttgtga

SEQ ID NO: 8115868 - DNA, 22 bp, Homo sapiens
tgagaagagcaaggaactggtt

SEQ ID NO: 8115869 - DNA, 22 bp, Homo sapiens
tgagaagcagcttacaggtgtc

SEQ ID NO: 8115870 - DNA, 22 bp, Homo sapiens
tgagaagcagtttcagtaagaa

SEQ ID NO: 8115871 - DNA, 22 bp, Homo sapiens
tgagaagagcaaggaactggtt

SEQ ID NO: 8115872 - DNA, 23 bp, Homo sapiens
tgagaagccaggggagcgtgagg

SEQ ID NO: 8115873 - DNA, 23 bp, Homo sapiens
tgagaagccaggggagcgtgagg

SEQ ID NO: 8115874 - DNA, 23 bp, Homo sapiens
tgagaagccattagagcaggtgg

SEQ ID NO: 8115875 - DNA, 22 bp, Homo sapiens
tgagataattaaatcaaaacct

SEQ ID NO: 8115876 - DNA, 22 bp, Homo sapiens
tgagagggcccagagcacacca

SEQ ID NO: 8115877 - DNA, 22 bp, Homo sapiens
tgagaggaacaggcagtaggtt

SEQ ID NO: 8115878 - DNA, 22 bp, Homo sapiens
tgagaggaacaggcagtaggtt

SEQ ID NO: 8115879 - DNA, 22 bp, Homo sapiens
tgagaggagtgattgtaaaatt

SEQ ID NO: 8115880 - DNA, 22 bp, Homo sapiens
tgaggcaggagttcaggctgcg

SEQ ID NO: 8115881 - DNA, 22 bp, Homo sapiens
tgaggccaggacccccagcagg

SEQ ID NO: 8115882 - DNA, 22 bp, Homo sapiens
tgaggagcgggcagggatgcag

SEQ ID NO: 8115883 - DNA, 22 bp, Homo sapiens
tgaggatgacgatggcaatggc

SEQ ID NO: 8115884 - DNA, 22 bp, Homo sapiens
tgaggatgagatgagataacac

SEQ ID NO: 8115885 - DNA, 22 bp, Homo sapiens
tgaggagtcgagaaggggtaat

SEQ ID NO: 8115886 - DNA, 22 bp, Homo sapiens
tgaggagtttagatatagggaa

SEQ ID NO: 8115887 - DNA, 22 bp, Homo sapiens
tgaggatggtcccgaggacact

SEQ ID NO: 8115888 - DNA, 22 bp, Homo sapiens
tgaggatggggagatggtgtct

SEQ ID NO: 8115889 - DNA, 22 bp, Homo sapiens
tgaggatggcagtgtgctcagc

SEQ ID NO: 8115890 - DNA, 22 bp, Homo sapiens
tgaggatggaatgctgtgcaag

SEQ ID NO: 8115891 - DNA, 22 bp, Homo sapiens
tgaggaaggaattgaggtttta

SEQ ID NO: 8115892 - DNA, 22 bp, Homo sapiens
tgaggaagtggttgtatggttt

SEQ ID NO: 8115893 - DNA, 22 bp, Homo sapiens
tgaggagaaatgctcagagcca

SEQ ID NO: 8115894 - DNA, 22 bp, Homo sapiens
tgaggaagggtgtgacggcacc

SEQ ID NO: 8115895 - DNA, 22 bp, Homo sapiens
tgaggaagggtgtgacggcacc

SEQ ID NO: 8115896 - DNA, 20 bp, Homo sapiens
tgaggcaggagaatggcatg

SEQ ID NO: 8115897 - DNA, 22 bp, Homo sapiens
tgaggcaggactgagcgggatg

SEQ ID NO: 8115898 - DNA, 21 bp, Homo sapiens
tgaggatgtgcagcagcagga

SEQ ID NO: 8115899 - DNA, 19 bp, Homo sapiens
tgaggcacagtggtgaaat

SEQ ID NO: 8115900 - DNA, 22 bp, Homo sapiens
tgaggctcttcctcccctgctc

SEQ ID NO: 8115901 - DNA, 22 bp, Homo sapiens
tgaggctcattctgcatgccaa

SEQ ID NO: 8115902 - DNA, 22 bp, Homo sapiens
tgaggctccagccaggccagca

SEQ ID NO: 8115903 - DNA, 22 bp, Homo sapiens
tgaggctcacgaacagaagact

SEQ ID NO: 8115904 - DNA, 22 bp, Homo sapiens
tgaggctcagagaacagtgact

SEQ ID NO: 8115905 - DNA, 22 bp, Homo sapiens
tgaggctcagaagtgccaagtg

SEQ ID NO: 8115906 - DNA, 22 bp, Homo sapiens
tgagggaatattgatagatccg

SEQ ID NO: 8115907 - DNA, 22 bp, Homo sapiens
tgagggagagggcgaaaatgaa

SEQ ID NO: 8115908 - DNA, 22 bp, Homo sapiens
tgagggagagggcgaaaatgaa

SEQ ID NO: 8115909 - DNA, 22 bp, Homo sapiens
tgagggaggccctttgagcaga

SEQ ID NO: 8115910 - DNA, 20 bp, Homo sapiens
tgagggagtattgatttccc

SEQ ID NO: 8115911 - DNA, 22 bp, Homo sapiens
tgagggaggcctccatctgcca

SEQ ID NO: 8115912 - DNA, 22 bp, Homo sapiens
tgagggagctgacctttctgtg

SEQ ID NO: 8115913 - DNA, 22 bp, Homo sapiens
tgagggagcacacactgaagtg

SEQ ID NO: 8115914 - DNA, 22 bp, Homo sapiens
tgagggagcacacactgaagtg

SEQ ID NO: 8115915 - DNA, 19 bp, Homo sapiens
tgaggggaggagaggcctg

SEQ ID NO: 8115916 - DNA, 22 bp, Homo sapiens
tgaggggaggttggggcacatc

SEQ ID NO: 8115917 - DNA, 22 bp, Homo sapiens
tgaggggagacagagtggactc

SEQ ID NO: 8115918 - DNA, 22 bp, Homo sapiens
tgagggagttgggtgtatagga

SEQ ID NO: 8115919 - DNA, 22 bp, Homo sapiens
tgagggagtcatgattaaggaa

SEQ ID NO: 8115920 - DNA, 22 bp, Homo sapiens
tgagggagtgtggatacagtag

SEQ ID NO: 8115921 - DNA, 22 bp, Homo sapiens
tgagggagtgtggatacagtag

SEQ ID NO: 8115922 - DNA, 22 bp, Homo sapiens
tgaggttatttattatgcatga

SEQ ID NO: 8115923 - DNA, 22 bp, Homo sapiens
tgagtatttctaatattccagt

SEQ ID NO: 8115924 - DNA, 22 bp, Homo sapiens
tgagtaggtggttaagcatgga

SEQ ID NO: 8115925 - DNA, 22 bp, Homo sapiens
tgaggggcgctggcaggttcct

SEQ ID NO: 8115926 - DNA, 22 bp, Homo sapiens
tgaggggcggcctgcagaggcc

SEQ ID NO: 8115927 - DNA, 22 bp, Homo sapiens
tgaggggccagaccccacctag

SEQ ID NO: 8115928 - DNA, 22 bp, Homo sapiens
tgaggggccgcccaagcacttc

SEQ ID NO: 8115929 - DNA, 22 bp, Homo sapiens
tgaggggcatgtgtttacacat

SEQ ID NO: 8115930 - DNA, 22 bp, Homo sapiens
tgaggggcagagaggtgtccag

SEQ ID NO: 8115931 - DNA, 22 bp, Homo sapiens
tgaggggggtaatcactgggtt

SEQ ID NO: 8115932 - DNA, 19 bp, Homo sapiens
tgaggggctcacagtctca

SEQ ID NO: 8115933 - DNA, 22 bp, Homo sapiens
tgagggggttaattaggagagt

SEQ ID NO: 8115934 - DNA, 22 bp, Homo sapiens
tgaggggtaagtaaaggaattg

SEQ ID NO: 8115935 - DNA, 22 bp, Homo sapiens
tgaggggtaagtaaaggaattg

SEQ ID NO: 8115936 - DNA, 22 bp, Homo sapiens
tgaggggttgtgagaaatgtag

SEQ ID NO: 8115937 - DNA, 21 bp, Homo sapiens
tgaggggttataacagggtgg

SEQ ID NO: 8115938 - DNA, 21 bp, Homo sapiens
tgaggggttataacagggtgg

SEQ ID NO: 8115939 - DNA, 22 bp, Homo sapiens
tgaggggttgtgagaaatgtag

SEQ ID NO: 8115940 - DNA, 22 bp, Homo sapiens
tgaagccatcaggaagccagca

SEQ ID NO: 8115941 - DNA, 22 bp, Homo sapiens
tgaagccatccctcagatggcc

SEQ ID NO: 8115942 - DNA, 22 bp, Homo sapiens
tgaagccattactgtgttaggg

SEQ ID NO: 8115943 - DNA, 22 bp, Homo sapiens
tgaagccaccgaaccagaagag

SEQ ID NO: 8115944 - DNA, 22 bp, Homo sapiens
tgaagccactttccagaatcac

SEQ ID NO: 8115945 - DNA, 22 bp, Homo sapiens
tgaagccataggacagaggata

SEQ ID NO: 8115946 - DNA, 22 bp, Homo sapiens
tgaagccagtcaatgttaagtt

SEQ ID NO: 8115947 - DNA, 22 bp, Homo sapiens
tgaagccacactagcttgtcct

SEQ ID NO: 8115948 - DNA, 22 bp, Homo sapiens
tgaagccacagagcatctgcct

SEQ ID NO: 8115949 - DNA, 22 bp, Homo sapiens
tgaagccaatctgccaggcaga

SEQ ID NO: 8115950 - DNA, 22 bp, Homo sapiens
tgaaggagatttttagggaggc

SEQ ID NO: 8115951 - DNA, 22 bp, Homo sapiens
tgaaggagctgatgtaaggggt

SEQ ID NO: 8115952 - DNA, 22 bp, Homo sapiens
tgaaggcacttgcctaggggca

SEQ ID NO: 8115953 - DNA, 22 bp, Homo sapiens
tgaaggagggaagaaggctctg

SEQ ID NO: 8115954 - DNA, 22 bp, Homo sapiens
tgaaggtgaatgtctatgggga

SEQ ID NO: 8115955 - DNA, 22 bp, Homo sapiens
tgaataatcttgggtattaata

SEQ ID NO: 8115956 - DNA, 21 bp, Homo sapiens
tgaaggggtggcagtgtgctt

SEQ ID NO: 8115957 - DNA, 22 bp, Homo sapiens
tgaaggggttcagcatgggggt

SEQ ID NO: 8115958 - DNA, 21 bp, Homo sapiens
tgaaggggccatcacaaaggc

SEQ ID NO: 8115959 - DNA, 22 bp, Homo sapiens
tgaagggggagatatatgtgtg

SEQ ID NO: 8115960 - DNA, 22 bp, Homo sapiens
tgaagggcaaccccaggcccag

SEQ ID NO: 8115961 - DNA, 22 bp, Homo sapiens
tgaaggcattgatgaaggaatc

SEQ ID NO: 8115962 - DNA, 22 bp, Homo sapiens
tgaatacactaaaaatcacttt

SEQ ID NO: 8115963 - DNA, 22 bp, Homo sapiens
tgaatacaggaaaatatactga

SEQ ID NO: 8115964 - DNA, 22 bp, Homo sapiens
tgaatcctaattctatcactta

SEQ ID NO: 8115965 - DNA, 22 bp, Homo sapiens
tgaatatgctttgcaatcctaa

SEQ ID NO: 8115966 - DNA, 22 bp, Homo sapiens
tgaatgtgatgctaaacatatg

SEQ ID NO: 8115967 - DNA, 22 bp, Homo sapiens
tgaatgtgatgctaaacatatg

SEQ ID NO: 8115968 - DNA, 22 bp, Homo sapiens
tgaatgtaccttgaaggtgtaa

SEQ ID NO: 8115969 - DNA, 22 bp, Homo sapiens
tgacaaaactgcaattactttt

SEQ ID NO: 8115970 - DNA, 23 bp, Homo sapiens
tgacaaagtggtcgttcaaggtg

SEQ ID NO: 8115971 - DNA, 22 bp, Homo sapiens
tgacttgtctctttgggagaca

SEQ ID NO: 8115972 - DNA, 22 bp, Homo sapiens
tgacttccagcaacttcctcca

SEQ ID NO: 8115973 - DNA, 22 bp, Homo sapiens
tgactggattgtcattacgacg

SEQ ID NO: 8115974 - DNA, 21 bp, Homo sapiens
tgactgaggcttcttcacaca

SEQ ID NO: 8115975 - DNA, 22 bp, Homo sapiens
tgactattttttatagattcca

SEQ ID NO: 8115976 - DNA, 23 bp, Homo sapiens
tgacacaggtcaaaaataagatg

SEQ ID NO: 8115977 - DNA, 22 bp, Homo sapiens
tgacacagattagagacatacc

SEQ ID NO: 8115978 - DNA, 22 bp, Homo sapiens
tgacacagtagaaagatgatga

SEQ ID NO: 8115979 - DNA, 22 bp, Homo sapiens
tgacacagtatcaaacatgatt

SEQ ID NO: 8115980 - DNA, 22 bp, Homo sapiens
tgacactgccgaaactgtagag

SEQ ID NO: 8115981 - DNA, 22 bp, Homo sapiens
tgacagaaagaatatgtcaatc

SEQ ID NO: 8115982 - DNA, 18 bp, Homo sapiens
tgacagaacctggagcct

SEQ ID NO: 8115983 - DNA, 22 bp, Homo sapiens
tgacagaactcattctcaccaa

SEQ ID NO: 8115984 - DNA, 22 bp, Homo sapiens
tgacagaactttttcacatctc

SEQ ID NO: 8115985 - DNA, 22 bp, Homo sapiens
tgacagggaaaggtcctctttt

SEQ ID NO: 8115986 - DNA, 22 bp, Homo sapiens
tgacagggacagtggagatgga

SEQ ID NO: 8115987 - DNA, 22 bp, Homo sapiens
tgacaggatgatgagcaggggg

SEQ ID NO: 8115988 - DNA, 21 bp, Homo sapiens
tgacaggcaccctggctgtga

SEQ ID NO: 8115989 - DNA, 22 bp, Homo sapiens
tgacagggccatgctgcactgc

SEQ ID NO: 8115990 - DNA, 22 bp, Homo sapiens
tgacagggcaggcttactggtt

SEQ ID NO: 8115991 - DNA, 22 bp, Homo sapiens
tgacagggaggtggaataagta

SEQ ID NO: 8115992 - DNA, 22 bp, Homo sapiens
tgacagggacagtggagatgga

SEQ ID NO: 8115993 - DNA, 22 bp, Homo sapiens
tgacagggctgttctgttttag

SEQ ID NO: 8115994 - DNA, 22 bp, Homo sapiens
tgacagggctagaggcaatgca

SEQ ID NO: 8115995 - DNA, 22 bp, Homo sapiens
tgacagggcttccctttaatca

SEQ ID NO: 8115996 - DNA, 22 bp, Homo sapiens
tgacaggggctggtggataaat

SEQ ID NO: 8115997 - DNA, 22 bp, Homo sapiens
tgacagggtcagagctgagctg

SEQ ID NO: 8115998 - DNA, 22 bp, Homo sapiens
tgacagggtgattatgagagct

SEQ ID NO: 8115999 - DNA, 22 bp, Homo sapiens
tgacagggggcagaggtggctg

SEQ ID NO: 8116000 - DNA, 22 bp, Homo sapiens
tgacagggtgtttgtgagacta

SEQ ID NO: 8116001 - DNA, 22 bp, Homo sapiens
tgaaacaggcaaaactgcagat

SEQ ID NO: 8116002 - DNA, 23 bp, Homo sapiens
tgaaacatttagggtagaatttc

SEQ ID NO: 8116003 - DNA, 21 bp, Homo sapiens
tcttttctctgcaggattcct

SEQ ID NO: 8116004 - DNA, 22 bp, Homo sapiens
tcttttattaggctgaaatggg

SEQ ID NO: 8116005 - DNA, 22 bp, Homo sapiens
tcttttcattgagaacacactg

SEQ ID NO: 8116006 - DNA, 22 bp, Homo sapiens
tcttttatctgttgtgtaacaa

SEQ ID NO: 8116007 - DNA, 22 bp, Homo sapiens
tctttgtttgcctttatcaaga

SEQ ID NO: 8116008 - DNA, 22 bp, Homo sapiens
tctttgttggagtccaaggata

SEQ ID NO: 8116009 - DNA, 22 bp, Homo sapiens
tcttttatagtgaattttcttg

SEQ ID NO: 8116010 - DNA, 22 bp, Homo sapiens
tcttttagagcatttctgattc

SEQ ID NO: 8116011 - DNA, 22 bp, Homo sapiens
tctttgcatgagttccctctgt

SEQ ID NO: 8116012 - DNA, 22 bp, Homo sapiens
tctttgctccacactctagaga

SEQ ID NO: 8116013 - DNA, 22 bp, Homo sapiens
tctttgctccacactctagaga

SEQ ID NO: 8116014 - DNA, 22 bp, Homo sapiens
tctttggactttccaatttgtt

SEQ ID NO: 8116015 - DNA, 22 bp, Homo sapiens
tgaaatggatgagagcagaggt

SEQ ID NO: 8116016 - DNA, 22 bp, Homo sapiens
tgaaatggcaaggcagagcttt

SEQ ID NO: 8116017 - DNA, 22 bp, Homo sapiens
tgaaatggattgaagtggctta

SEQ ID NO: 8116018 - DNA, 22 bp, Homo sapiens
tgaaatgctgtagagactgtat

SEQ ID NO: 8116019 - DNA, 22 bp, Homo sapiens
tgaaagagtgcaagtcaaggag

SEQ ID NO: 8116020 - DNA, 23 bp, Homo sapiens
tgaaagcaatgggtctatagtat

SEQ ID NO: 8116021 - DNA, 22 bp, Homo sapiens
tgaaataggaaacagatgtttc

SEQ ID NO: 8116022 - DNA, 22 bp, Homo sapiens
tgaacctggggctgttgctggt

SEQ ID NO: 8116023 - DNA, 22 bp, Homo sapiens
tgaacgcaggtccacatggctc

SEQ ID NO: 8116024 - DNA, 22 bp, Homo sapiens
tgaagaagccaattggtaggct

SEQ ID NO: 8116025 - DNA, 22 bp, Homo sapiens
tgaagaaaggtgtgggatactc

SEQ ID NO: 8116026 - DNA, 22 bp, Homo sapiens
tgaagaaacgcagagaggtagg

SEQ ID NO: 8116027 - DNA, 22 bp, Homo sapiens
tgaagaaacgcagagaggtagg

SEQ ID NO: 8116028 - DNA, 22 bp, Homo sapiens
tgaagaaacagaccaagaggat

SEQ ID NO: 8116029 - DNA, 22 bp, Homo sapiens
tgaagaaaatatgattacccca

SEQ ID NO: 8116030 - DNA, 22 bp, Homo sapiens
tgaagaatgttgcagtgagcat

SEQ ID NO: 8116031 - DNA, 22 bp, Homo sapiens
tgaagcaggaaccagcagcatt

SEQ ID NO: 8116032 - DNA, 22 bp, Homo sapiens
tgaagcacaggcatacacaacc

SEQ ID NO: 8116033 - DNA, 22 bp, Homo sapiens
tgaagcaatagagacaagacca

SEQ ID NO: 8116034 - DNA, 22 bp, Homo sapiens
tggctgaggctggagtgcagtg

SEQ ID NO: 8116035 - DNA, 22 bp, Homo sapiens
tggctgagggcactatgaagcc

SEQ ID NO: 8116036 - DNA, 22 bp, Homo sapiens
tggctgaggcttttcttaaaga

SEQ ID NO: 8116037 - DNA, 22 bp, Homo sapiens
tggctgagtgaacatgtccatt

SEQ ID NO: 8116038 - DNA, 22 bp, Homo sapiens
tggctgagtaagttgtgatatg

SEQ ID NO: 8116039 - DNA, 22 bp, Homo sapiens
tggctgaggttatgctggttgt

SEQ ID NO: 8116040 - DNA, 22 bp, Homo sapiens
tggctgagctgcagcgtggctt

SEQ ID NO: 8116041 - DNA, 22 bp, Homo sapiens
tggctgagctccctgtgtgttg

SEQ ID NO: 8116042 - DNA, 19 bp, Homo sapiens
tggctgagctggactgagg

SEQ ID NO: 8116043 - DNA, 22 bp, Homo sapiens
tggctgaggagagggcggaagt

SEQ ID NO: 8116044 - DNA, 22 bp, Homo sapiens
tggctgaggcacagctgccgcc

SEQ ID NO: 8116045 - DNA, 22 bp, Homo sapiens
tggctgaggagggtcttctggt

SEQ ID NO: 8116046 - DNA, 22 bp, Homo sapiens
tggctgagaaaaaagagctata

SEQ ID NO: 8116047 - DNA, 22 bp, Homo sapiens
tggctgagaaaatggttttagg

SEQ ID NO: 8116048 - DNA, 22 bp, Homo sapiens
tggctgagaagttctggtggga

SEQ ID NO: 8116049 - DNA, 21 bp, Homo sapiens
tggctgagccaggtgtgtgga

SEQ ID NO: 8116050 - DNA, 23 bp, Homo sapiens
tggctgagcccactatcttggcc

SEQ ID NO: 8116051 - DNA, 22 bp, Homo sapiens
tggctgagcctttggggctttc

SEQ ID NO: 8116052 - DNA, 22 bp, Homo sapiens
tggctgagagtcatcctgtgtg

SEQ ID NO: 8116053 - DNA, 23 bp, Homo sapiens
tggctgagatcctactgtttgct

SEQ ID NO: 8116054 - DNA, 22 bp, Homo sapiens
tggctgagccacttgttcagat

SEQ ID NO: 8116055 - DNA, 22 bp, Homo sapiens
tggctgccagctcctcgccttg

SEQ ID NO: 8116056 - DNA, 22 bp, Homo sapiens
tggctgcagttcacaggagcaa

SEQ ID NO: 8116057 - DNA, 21 bp, Homo sapiens
tggctgagtggatgcatgaat

SEQ ID NO: 8116058 - DNA, 22 bp, Homo sapiens
tggctgagtgatatttgcaaag

SEQ ID NO: 8116059 - DNA, 22 bp, Homo sapiens
tggctgagtgttccaaggagca

SEQ ID NO: 8116060 - DNA, 22 bp, Homo sapiens
tggctgagttctccaggagtag

SEQ ID NO: 8116061 - DNA, 22 bp, Homo sapiens
tggctgagttacgaacagagca

SEQ ID NO: 8116062 - DNA, 22 bp, Homo sapiens
tggctgagttcctggcacacgg

SEQ ID NO: 8116063 - DNA, 22 bp, Homo sapiens
tggctgagtttcatgcatcatg

SEQ ID NO: 8116064 - DNA, 22 bp, Homo sapiens
tggctgcagatcaagggcaggc

SEQ ID NO: 8116065 - DNA, 22 bp, Homo sapiens
tggctgcagacacctatggcag

SEQ ID NO: 8116066 - DNA, 22 bp, Homo sapiens
tggctctgggcaccgtgtccac

SEQ ID NO: 8116067 - DNA, 17 bp, Homo sapiens
tggctctgaggctgaat

SEQ ID NO: 8116068 - DNA, 22 bp, Homo sapiens
tggctccttccgcagcatgcct

SEQ ID NO: 8116069 - DNA, 22 bp, Homo sapiens
tggctccttcattctcctgcca

SEQ ID NO: 8116070 - DNA, 22 bp, Homo sapiens
tggctcctcatcacagttggtg

SEQ ID NO: 8116071 - DNA, 22 bp, Homo sapiens
tggctcctgcatttgtgctaac

SEQ ID NO: 8116072 - DNA, 22 bp, Homo sapiens
tggctccaccgccgcggagctc

SEQ ID NO: 8116073 - DNA, 22 bp, Homo sapiens
tggctcaggatctaagcagaat

SEQ ID NO: 8116074 - DNA, 22 bp, Homo sapiens
tggctcagcaagacattgacct

SEQ ID NO: 8116075 - DNA, 22 bp, Homo sapiens
tggctcaggtgtgagctgaaga

SEQ ID NO: 8116076 - DNA, 22 bp, Homo sapiens
tggctcagtgaagagataactt

SEQ ID NO: 8116077 - DNA, 19 bp, Homo sapiens
tggctataattccagagct

SEQ ID NO: 8116078 - DNA, 22 bp, Homo sapiens
tggctcagagagggagtgtgga

SEQ ID NO: 8116079 - DNA, 22 bp, Homo sapiens
tggctcagaagaaaaggtaaac

SEQ ID NO: 8116080 - DNA, 22 bp, Homo sapiens
tggcctggtgtctgcgaggcct

SEQ ID NO: 8116081 - DNA, 22 bp, Homo sapiens
tggcctggttgttgctgccgtt

SEQ ID NO: 8116082 - DNA, 22 bp, Homo sapiens
tggcctggtccttgtcaaggca

SEQ ID NO: 8116083 - DNA, 22 bp, Homo sapiens
tggcctgggtgctgctgacatc

SEQ ID NO: 8116084 - DNA, 22 bp, Homo sapiens
tggcctttgttgatagctatgc

SEQ ID NO: 8116085 - DNA, 22 bp, Homo sapiens
tggccttggcagtgagaagagt

SEQ ID NO: 8116086 - DNA, 22 bp, Homo sapiens
tggccttcctggtgactcatga

SEQ ID NO: 8116087 - DNA, 22 bp, Homo sapiens
tgggaacacctgctgcccagtg

SEQ ID NO: 8116088 - DNA, 22 bp, Homo sapiens
tgggaacaacatgcactgccac

SEQ ID NO: 8116089 - DNA, 22 bp, Homo sapiens
tgggaaagtgtagcctgcaggc

SEQ ID NO: 8116090 - DNA, 22 bp, Homo sapiens
tgggaagaagcagagaactgga

SEQ ID NO: 8116091 - DNA, 22 bp, Homo sapiens
tgggaagaagcagagaactgga

SEQ ID NO: 8116092 - DNA, 21 bp, Homo sapiens
tggctttgccctgcttgcccc

SEQ ID NO: 8116093 - DNA, 23 bp, Homo sapiens
tggcttctgccccattctctcca

SEQ ID NO: 8116094 - DNA, 22 bp, Homo sapiens
tggcttctgggatgtgttgaca

SEQ ID NO: 8116095 - DNA, 22 bp, Homo sapiens
tggcttctggtttatccttata

SEQ ID NO: 8116096 - DNA, 22 bp, Homo sapiens
tggcttctgtccctgctacatt

SEQ ID NO: 8116097 - DNA, 22 bp, Homo sapiens
tggcttctgagtctcctgacat

SEQ ID NO: 8116098 - DNA, 22 bp, Homo sapiens
tggcttctgagcattgaaacgt

SEQ ID NO: 8116099 - DNA, 20 bp, Homo sapiens
tggcttctcttcactcctgt

SEQ ID NO: 8116100 - DNA, 22 bp, Homo sapiens
tggcttctccctctgcctgatt

SEQ ID NO: 8116101 - DNA, 22 bp, Homo sapiens
tggcttctcgcctgtcatcccg

SEQ ID NO: 8116102 - DNA, 22 bp, Homo sapiens
tggcttctctggcatccccatc

SEQ ID NO: 8116103 - DNA, 22 bp, Homo sapiens
tggcttctccctccccatctag

SEQ ID NO: 8116104 - DNA, 22 bp, Homo sapiens
tggcttctagagcccatccttc

SEQ ID NO: 8116105 - DNA, 22 bp, Homo sapiens
tggcttcagagacagaatctat

SEQ ID NO: 8116106 - DNA, 22 bp, Homo sapiens
tggcttatcacattgtccatgg

SEQ ID NO: 8116107 - DNA, 22 bp, Homo sapiens
tggctgggagctggaactgggc

SEQ ID NO: 8116108 - DNA, 22 bp, Homo sapiens
tgggaaggtgattttccaaaag

SEQ ID NO: 8116109 - DNA, 22 bp, Homo sapiens
tgggaaggggagctggaaagga

SEQ ID NO: 8116110 - DNA, 22 bp, Homo sapiens
tgggaagggagagtgtcctgga

SEQ ID NO: 8116111 - DNA, 22 bp, Homo sapiens
tgggaagatggagtgacaggca

SEQ ID NO: 8116112 - DNA, 22 bp, Homo sapiens
tgggaagcacgctcagcagaaa

SEQ ID NO: 8116113 - DNA, 22 bp, Homo sapiens
tgggaagagttagagacagctg

SEQ ID NO: 8116114 - DNA, 21 bp, Homo sapiens
tgggacagtgatggctcctcc

SEQ ID NO: 8116115 - DNA, 22 bp, Homo sapiens
tgggacacacaaggtcagctct

SEQ ID NO: 8116116 - DNA, 22 bp, Homo sapiens
tgggacacattagtcaccttac

SEQ ID NO: 8116117 - DNA, 22 bp, Homo sapiens
tgggaatgctgatttcaggaac

SEQ ID NO: 8116118 - DNA, 22 bp, Homo sapiens
tgggaatgggcctagaaggctg

SEQ ID NO: 8116119 - DNA, 22 bp, Homo sapiens
tgggaatacaattctgagagaa

SEQ ID NO: 8116120 - DNA, 23 bp, Homo sapiens
tgggaatgacatctagagcagag

SEQ ID NO: 8116121 - DNA, 22 bp, Homo sapiens
tgggagcaccttgagggcagaa

SEQ ID NO: 8116122 - DNA, 22 bp, Homo sapiens
tgggagcaccttgagggcagaa

SEQ ID NO: 8116123 - DNA, 22 bp, Homo sapiens
tgggagcaccctgaggagcttc

SEQ ID NO: 8116124 - DNA, 22 bp, Homo sapiens
tgggagaacccagggtcaggct

SEQ ID NO: 8116125 - DNA, 22 bp, Homo sapiens
tgggacttgtgtggcagtattt

SEQ ID NO: 8116126 - DNA, 21 bp, Homo sapiens
tgggagagcgttgctgtcctc

SEQ ID NO: 8116127 - DNA, 22 bp, Homo sapiens
tgggagaagcagtgggacagta

SEQ ID NO: 8116128 - DNA, 22 bp, Homo sapiens
tgggagaagcatggggtgcaga

SEQ ID NO: 8116129 - DNA, 22 bp, Homo sapiens
tgggagagtctaaaaccgaggt

SEQ ID NO: 8116130 - DNA, 22 bp, Homo sapiens
tgggagagtgctcaatgtgcaa

SEQ ID NO: 8116131 - DNA, 22 bp, Homo sapiens
tgggagagtttgtttagagtga

SEQ ID NO: 8116132 - DNA, 23 bp, Homo sapiens
tgggagataagcagaagcctggt

SEQ ID NO: 8116133 - DNA, 19 bp, Homo sapiens
tgggagaggcaacagagta

SEQ ID NO: 8116134 - DNA, 22 bp, Homo sapiens
tgggagagcttcatgccttcag

SEQ ID NO: 8116135 - DNA, 22 bp, Homo sapiens
tgggagagcttcatgccttcag

SEQ ID NO: 8116136 - DNA, 22 bp, Homo sapiens
tgggagaggctgccatcttgca

SEQ ID NO: 8116137 - DNA, 21 bp, Homo sapiens
tgggagagggctcagctaccc

SEQ ID NO: 8116138 - DNA, 22 bp, Homo sapiens
tgggagagtaaccaattccttc

SEQ ID NO: 8116139 - DNA, 22 bp, Homo sapiens
tggccactggcttccactgagt

SEQ ID NO: 8116140 - DNA, 20 bp, Homo sapiens
tggccactggccactggagc

SEQ ID NO: 8116141 - DNA, 22 bp, Homo sapiens
tggccaccaccaatacttgcct

SEQ ID NO: 8116142 - DNA, 22 bp, Homo sapiens
tggccaccaccaatacttgcct

SEQ ID NO: 8116143 - DNA, 22 bp, Homo sapiens
tggccacccctttctctgcact

SEQ ID NO: 8116144 - DNA, 22 bp, Homo sapiens
tggccacccctttctctgcact

SEQ ID NO: 8116145 - DNA, 22 bp, Homo sapiens
tggccacagtgtccagcagcag

SEQ ID NO: 8116146 - DNA, 22 bp, Homo sapiens
tggccacagtgtccagcagcag

SEQ ID NO: 8116147 - DNA, 22 bp, Homo sapiens
tggccacacccacctagaggag

SEQ ID NO: 8116148 - DNA, 22 bp, Homo sapiens
tggccagcccttcagccatgcc

SEQ ID NO: 8116149 - DNA, 19 bp, Homo sapiens
tggccaggtactgtctgct

SEQ ID NO: 8116150 - DNA, 22 bp, Homo sapiens
tggcagtccctctggtagcacc

SEQ ID NO: 8116151 - DNA, 22 bp, Homo sapiens
tggcagtcattatcgctgagtc

SEQ ID NO: 8116152 - DNA, 21 bp, Homo sapiens
tggcaggttcaaaggcctatc

SEQ ID NO: 8116153 - DNA, 22 bp, Homo sapiens
tggcagtcttgtaggcatctcc

SEQ ID NO: 8116154 - DNA, 22 bp, Homo sapiens
tggcagtgatgcggcaggacat

SEQ ID NO: 8116155 - DNA, 22 bp, Homo sapiens
tggcatatgattcttggcatcc

SEQ ID NO: 8116156 - DNA, 22 bp, Homo sapiens
tggcatcacctccacgatcatc

SEQ ID NO: 8116157 - DNA, 21 bp, Homo sapiens
tggccatttatccttatgaga

SEQ ID NO: 8116158 - DNA, 22 bp, Homo sapiens
tggccctgtctgcacacaggat

SEQ ID NO: 8116159 - DNA, 22 bp, Homo sapiens
tggccctgtgtgcaggctgcac

SEQ ID NO: 8116160 - DNA, 22 bp, Homo sapiens
tggcctggaaaaatgcagatgg

SEQ ID NO: 8116161 - DNA, 22 bp, Homo sapiens
tggcctggaacctggcagggac

SEQ ID NO: 8116162 - DNA, 22 bp, Homo sapiens
tggcagagaacacggctgatct

SEQ ID NO: 8116163 - DNA, 22 bp, Homo sapiens
tggcagagccttgccaaactcc

SEQ ID NO: 8116164 - DNA, 22 bp, Homo sapiens
tggcagagagagtgcagtcgac

SEQ ID NO: 8116165 - DNA, 22 bp, Homo sapiens
tggcagagatgaagagttgttt

SEQ ID NO: 8116166 - DNA, 22 bp, Homo sapiens
tggcacatggtaagtgcttaac

SEQ ID NO: 8116167 - DNA, 22 bp, Homo sapiens
tggcactcactctcagagtctg

SEQ ID NO: 8116168 - DNA, 22 bp, Homo sapiens
tggatgtgagaaggatcaggct

SEQ ID NO: 8116169 - DNA, 22 bp, Homo sapiens
tggattgataagagacaagtga

SEQ ID NO: 8116170 - DNA, 22 bp, Homo sapiens
tggattgataaaatgggatgtt

SEQ ID NO: 8116171 - DNA, 20 bp, Homo sapiens
tggattctggagctgccctc

SEQ ID NO: 8116172 - DNA, 22 bp, Homo sapiens
tggcaatataatcatctgctct

SEQ ID NO: 8116173 - DNA, 22 bp, Homo sapiens
tggcaatatgctttcagtggcc

SEQ ID NO: 8116174 - DNA, 22 bp, Homo sapiens
tggcaataaatacatctgggca

SEQ ID NO: 8116175 - DNA, 22 bp, Homo sapiens
tggcaatacataatcttaatgg

SEQ ID NO: 8116176 - DNA, 22 bp, Homo sapiens
tggcaactcctgactctactca

SEQ ID NO: 8116177 - DNA, 22 bp, Homo sapiens
tggcaaagtatctgtcccagct

SEQ ID NO: 8116178 - DNA, 22 bp, Homo sapiens
tggcaaaggaaatgatttaaga

SEQ ID NO: 8116179 - DNA, 22 bp, Homo sapiens
tggcaaaggcgctcacatgcct

SEQ ID NO: 8116180 - DNA, 22 bp, Homo sapiens
tggcacagacatttaatagcct

SEQ ID NO: 8116181 - DNA, 22 bp, Homo sapiens
tggcacagacagcacagcaatg

SEQ ID NO: 8116182 - DNA, 22 bp, Homo sapiens
tggcacaaaagtaattgcagtt

SEQ ID NO: 8116183 - DNA, 22 bp, Homo sapiens
tggcaattttaggtggtttagt

SEQ ID NO: 8116184 - DNA, 22 bp, Homo sapiens
tggcaatttcacatggcttaac

SEQ ID NO: 8116185 - DNA, 22 bp, Homo sapiens
tggcaattcctgagctctgaga

SEQ ID NO: 8116186 - DNA, 22 bp, Homo sapiens
tggcaattggcaatttcgtatg

SEQ ID NO: 8116187 - DNA, 22 bp, Homo sapiens
tggcaattgtccactgtctgcc

SEQ ID NO: 8116188 - DNA, 23 bp, Homo sapiens
tggcaattcctgagctctgagaa

SEQ ID NO: 8116189 - DNA, 22 bp, Homo sapiens
tggcaattctctacctttctca

SEQ ID NO: 8116190 - DNA, 22 bp, Homo sapiens
tggcaatattaacagtacttat

SEQ ID NO: 8116191 - DNA, 22 bp, Homo sapiens
tggcaggcagagagcggccttt

SEQ ID NO: 8116192 - DNA, 22 bp, Homo sapiens
tggcaggcagctggcatcctaa

SEQ ID NO: 8116193 - DNA, 22 bp, Homo sapiens
tggcaggagacacatggcatag

SEQ ID NO: 8116194 - DNA, 22 bp, Homo sapiens
tggcaggaggatgaggcggcta

SEQ ID NO: 8116195 - DNA, 18 bp, Homo sapiens
tggcaggaaatgcacttt

SEQ ID NO: 8116196 - DNA, 22 bp, Homo sapiens
tggcagctgaatggctggatgg

SEQ ID NO: 8116197 - DNA, 22 bp, Homo sapiens
tggcaggaaaaagggccagagg

SEQ ID NO: 8116198 - DNA, 22 bp, Homo sapiens
tggcaggaaagtaacagagcac

SEQ ID NO: 8116199 - DNA, 22 bp, Homo sapiens
tggcagctgattagatggtgcc

SEQ ID NO: 8116200 - DNA, 22 bp, Homo sapiens
tggcagagtctgggcttgggca

SEQ ID NO: 8116201 - DNA, 22 bp, Homo sapiens
tggcagagtaggatggccctgt

SEQ ID NO: 8116202 - DNA, 22 bp, Homo sapiens
tggcagagttcgctgtgccttt

SEQ ID NO: 8116203 - DNA, 22 bp, Homo sapiens
tggcagagttggaggtggaaga

SEQ ID NO: 8116204 - DNA, 20 bp, Homo sapiens
tggcagagttgtcccaccca

SEQ ID NO: 8116205 - DNA, 18 bp, Homo sapiens
tggcagcaggaagccatt

SEQ ID NO: 8116206 - DNA, 22 bp, Homo sapiens
tggcagcagtagccaccccagc

SEQ ID NO: 8116207 - DNA, 22 bp, Homo sapiens
tggcagcagtagccaccccagc

SEQ ID NO: 8116208 - DNA, 22 bp, Homo sapiens
tggcagcagtggaggtagaaag

SEQ ID NO: 8116209 - DNA, 22 bp, Homo sapiens
tggcagccacatctcgtggatt

SEQ ID NO: 8116210 - DNA, 22 bp, Homo sapiens
tggcagcctcccagctgcattc

SEQ ID NO: 8116211 - DNA, 22 bp, Homo sapiens
tggcagccttctctgagaaggt

SEQ ID NO: 8116212 - DNA, 22 bp, Homo sapiens
tggcagcctggaatctctcagc

SEQ ID NO: 8116213 - DNA, 22 bp, Homo sapiens
tgcttattaacatgtatatctc

SEQ ID NO: 8116214 - DNA, 22 bp, Homo sapiens
tgcttattaaacatgcatattc

SEQ ID NO: 8116215 - DNA, 22 bp, Homo sapiens
tgcttctgaaatgcaggtcttc

SEQ ID NO: 8116216 - DNA, 22 bp, Homo sapiens
tgcttctgcaacttgaatgtac

SEQ ID NO: 8116217 - DNA, 22 bp, Homo sapiens
tgcttctgattcatggttattg

SEQ ID NO: 8116218 - DNA, 22 bp, Homo sapiens
tgcttctgcaacttgaatgtac

SEQ ID NO: 8116219 - DNA, 22 bp, Homo sapiens
tgcttctgcattcaatgttgga

SEQ ID NO: 8116220 - DNA, 22 bp, Homo sapiens
tgcttctgagttgcaggacttg

SEQ ID NO: 8116221 - DNA, 22 bp, Homo sapiens
tgcttctgactgggtcagttga

SEQ ID NO: 8116222 - DNA, 22 bp, Homo sapiens
tgcttctgactaagctgcatga

SEQ ID NO: 8116223 - DNA, 22 bp, Homo sapiens
tgcttctgaactcagcatgtgg

SEQ ID NO: 8116224 - DNA, 22 bp, Homo sapiens
tgctgtgaggttgagaaggaag

SEQ ID NO: 8116225 - DNA, 22 bp, Homo sapiens
tgctgtgcaaaggtgatgtgag

SEQ ID NO: 8116226 - DNA, 20 bp, Homo sapiens
tgctgtaagattagagagct

SEQ ID NO: 8116227 - DNA, 22 bp, Homo sapiens
tgctggtgaggtccttgctgga

SEQ ID NO: 8116228 - DNA, 22 bp, Homo sapiens
tgctgggtgttccgcacttgac

SEQ ID NO: 8116229 - DNA, 22 bp, Homo sapiens
tgctgctgatgcatagtctgct

SEQ ID NO: 8116230 - DNA, 22 bp, Homo sapiens
tgctgcctccttcctgccagga

SEQ ID NO: 8116231 - DNA, 22 bp, Homo sapiens
tgctgcatagcagctcctgaaa

SEQ ID NO: 8116232 - DNA, 22 bp, Homo sapiens
tgctgcttttagttggatagaa

SEQ ID NO: 8116233 - DNA, 22 bp, Homo sapiens
tgctgctgatggatgcctggac

SEQ ID NO: 8116234 - DNA, 23 bp, Homo sapiens
tgctggaatttgtaccctggcag

SEQ ID NO: 8116235 - DNA, 20 bp, Homo sapiens
tgctggaaattgttctagga

SEQ ID NO: 8116236 - DNA, 23 bp, Homo sapiens
tgctggagaagcaaagttctgag

SEQ ID NO: 8116237 - DNA, 22 bp, Homo sapiens
tgctggctgtgtaccatctcaa

SEQ ID NO: 8116238 - DNA, 19 bp, Homo sapiens
tgctggagggtagtgagtc

SEQ ID NO: 8116239 - DNA, 22 bp, Homo sapiens
tgctggagtgagattatgagtt

SEQ ID NO: 8116240 - DNA, 22 bp, Homo sapiens
tgctggaggcagtggaggtgcc

SEQ ID NO: 8116241 - DNA, 22 bp, Homo sapiens
tgctggaggccgagaagcagca

SEQ ID NO: 8116242 - DNA, 23 bp, Homo sapiens
tgctggagtttactcaggccagc

SEQ ID NO: 8116243 - DNA, 17 bp, Homo sapiens
tgcctgtgataagcaca

SEQ ID NO: 8116244 - DNA, 22 bp, Homo sapiens
tgcctgtgatcagctgagttca

SEQ ID NO: 8116245 - DNA, 22 bp, Homo sapiens
tgcctgtgacccaaggatgcga

SEQ ID NO: 8116246 - DNA, 22 bp, Homo sapiens
tgcctgggttcccaccccaaag

SEQ ID NO: 8116247 - DNA, 22 bp, Homo sapiens
tgcctgggtgtaaagggccaac

SEQ ID NO: 8116248 - DNA, 22 bp, Homo sapiens
tgcctgggttgactcttagctg

SEQ ID NO: 8116249 - DNA, 22 bp, Homo sapiens
tgcctgggtgccctctgctcct

SEQ ID NO: 8116250 - DNA, 22 bp, Homo sapiens
tgcctgggtccaggccaagcct

SEQ ID NO: 8116251 - DNA, 22 bp, Homo sapiens
tgcctgggtgctggctggtcac

SEQ ID NO: 8116252 - DNA, 22 bp, Homo sapiens
tgcctgggctcaccgcctcttt

SEQ ID NO: 8116253 - DNA, 22 bp, Homo sapiens
tgcctgggctcggtagccatcg

SEQ ID NO: 8116254 - DNA, 22 bp, Homo sapiens
tgcctggggttggcaaactgct

SEQ ID NO: 8116255 - DNA, 22 bp, Homo sapiens
tgcctgggggactaaggccaaa

SEQ ID NO: 8116256 - DNA, 22 bp, Homo sapiens
tgcctggggattgctctgggcc

SEQ ID NO: 8116257 - DNA, 22 bp, Homo sapiens
tgccttggattgcagggaacct

SEQ ID NO: 8116258 - DNA, 22 bp, Homo sapiens
tgcctgtgcccttcttggcatt

SEQ ID NO: 8116259 - DNA, 22 bp, Homo sapiens
tgcctgtgcccttcttggcatt

SEQ ID NO: 8116260 - DNA, 22 bp, Homo sapiens
tgcctgtgccctttgctgggag

SEQ ID NO: 8116261 - DNA, 19 bp, Homo sapiens
tgcctgtggcgagcatctt

SEQ ID NO: 8116262 - DNA, 19 bp, Homo sapiens
tgcctgtggcgagcatctt

SEQ ID NO: 8116263 - DNA, 22 bp, Homo sapiens
tgcctgtgtatgtgcatgcaca

SEQ ID NO: 8116264 - DNA, 22 bp, Homo sapiens
tgcctgtgggtgatgatttgat

SEQ ID NO: 8116265 - DNA, 22 bp, Homo sapiens
tgcctgtgtatttccggcctgc

SEQ ID NO: 8116266 - DNA, 22 bp, Homo sapiens
tgcctgtgtcacagtgatgttt

SEQ ID NO: 8116267 - DNA, 22 bp, Homo sapiens
tgcctgtgtccccttcttggca

SEQ ID NO: 8116268 - DNA, 22 bp, Homo sapiens
tgccttcttctccctggctcag

SEQ ID NO: 8116269 - DNA, 22 bp, Homo sapiens
tgcgcctctaatctcgggcgtc

SEQ ID NO: 8116270 - DNA, 22 bp, Homo sapiens
tgcgcaggagctctgccaggag

SEQ ID NO: 8116271 - DNA, 22 bp, Homo sapiens
tgctatttttatcttgatcaaa

SEQ ID NO: 8116272 - DNA, 22 bp, Homo sapiens
tgctagtgtgtgagatgttcaa

SEQ ID NO: 8116273 - DNA, 22 bp, Homo sapiens
tgctcagagctccagctctcct

SEQ ID NO: 8116274 - DNA, 19 bp, Homo sapiens
tgctcactctcagtccctc

SEQ ID NO: 8116275 - DNA, 22 bp, Homo sapiens
tgctcattgctgatttacatgt

SEQ ID NO: 8116276 - DNA, 22 bp, Homo sapiens
tgctcagtcctaccttggctcc

SEQ ID NO: 8116277 - DNA, 22 bp, Homo sapiens
tgctcatgctggggacagatgt

SEQ ID NO: 8116278 - DNA, 22 bp, Homo sapiens
tgctcagttaagcagaggaaat

SEQ ID NO: 8116279 - DNA, 22 bp, Homo sapiens
tgctgagtacactaaagaacat

SEQ ID NO: 8116280 - DNA, 22 bp, Homo sapiens
tgctgagggagcatcaaagaaa

SEQ ID NO: 8116281 - DNA, 22 bp, Homo sapiens
tgctgaggcatttggacagagt

SEQ ID NO: 8116282 - DNA, 22 bp, Homo sapiens
tgctgaggcccaggagcacttt

SEQ ID NO: 8116283 - DNA, 23 bp, Homo sapiens
tgctcttctcagacctgtcagcc

SEQ ID NO: 8116284 - DNA, 22 bp, Homo sapiens
tgctctgtcaagaaaagatgcc

SEQ ID NO: 8116285 - DNA, 22 bp, Homo sapiens
tgctctgtccagtgcaccatca

SEQ ID NO: 8116286 - DNA, 21 bp, Homo sapiens
tgctctggtagaaactctttc

SEQ ID NO: 8116287 - DNA, 18 bp, Homo sapiens
tgctctggtctcacttgg

SEQ ID NO: 8116288 - DNA, 20 bp, Homo sapiens
tgctctgggggtggagagac

SEQ ID NO: 8116289 - DNA, 22 bp, Homo sapiens
tgctgaaggcaggggaggtggc

SEQ ID NO: 8116290 - DNA, 19 bp, Homo sapiens
tgctgaggatgcaagatcc

SEQ ID NO: 8116291 - DNA, 22 bp, Homo sapiens
tgctctcctgctcctcagccca

SEQ ID NO: 8116292 - DNA, 22 bp, Homo sapiens
tgctctccggcttccgtggcct

SEQ ID NO: 8116293 - DNA, 22 bp, Homo sapiens
tgctcgccccacatgccctcat

SEQ ID NO: 8116294 - DNA, 22 bp, Homo sapiens
tgctctaagaactctaggaatt

SEQ ID NO: 8116295 - DNA, 22 bp, Homo sapiens
tgctccagcctatgctctccgg

SEQ ID NO: 8116296 - DNA, 20 bp, Homo sapiens
tgctccaggaacactggccg

SEQ ID NO: 8116297 - DNA, 18 bp, Homo sapiens
tgctccaggcccatgggc

SEQ ID NO: 8116298 - DNA, 22 bp, Homo sapiens
tgctcccagggactctggctgg

SEQ ID NO: 8116299 - DNA, 22 bp, Homo sapiens
tgctcccaggcattctctgttg

SEQ ID NO: 8116300 - DNA, 22 bp, Homo sapiens
tgctcctgaacacagccctatg

SEQ ID NO: 8116301 - DNA, 22 bp, Homo sapiens
tgctcctgaattacactactac

SEQ ID NO: 8116302 - DNA, 22 bp, Homo sapiens
tggagtgaagtaaagaggacaa

SEQ ID NO: 8116303 - DNA, 16 bp, Homo sapiens
tggaggtgtttctagt

SEQ ID NO: 8116304 - DNA, 22 bp, Homo sapiens
tggaggtgtccaactcgtgggt

SEQ ID NO: 8116305 - DNA, 23 bp, Homo sapiens
tggatatttcagagatacttcag

SEQ ID NO: 8116306 - DNA, 22 bp, Homo sapiens
tggatggattgacgaaggcagc

SEQ ID NO: 8116307 - DNA, 22 bp, Homo sapiens
tggagtggacttcatgaggcca

SEQ ID NO: 8116308 - DNA, 22 bp, Homo sapiens
tggaggtggggctcaggaatct

SEQ ID NO: 8116309 - DNA, 20 bp, Homo sapiens
tggaggtggtctgctgtcct

SEQ ID NO: 8116310 - DNA, 22 bp, Homo sapiens
tggaggtggggctcaggaatct

SEQ ID NO: 8116311 - DNA, 22 bp, Homo sapiens
tggaggtgtataaggtagcttc

SEQ ID NO: 8116312 - DNA, 22 bp, Homo sapiens
tggaggtggcacaagggaggtc

SEQ ID NO: 8116313 - DNA, 22 bp, Homo sapiens
tggaggtgggagggactgtcct

SEQ ID NO: 8116314 - DNA, 22 bp, Homo sapiens
tggaggtggagttggaaactga

SEQ ID NO: 8116315 - DNA, 22 bp, Homo sapiens
tggagggaacaaaggagtccca

SEQ ID NO: 8116316 - DNA, 22 bp, Homo sapiens
tggagggaacaaaggagtccca

SEQ ID NO: 8116317 - DNA, 22 bp, Homo sapiens
tggagggaacccaggctgctct

SEQ ID NO: 8116318 - DNA, 22 bp, Homo sapiens
tggagggatacaaagatgaaaa

SEQ ID NO: 8116319 - DNA, 22 bp, Homo sapiens
tggagggatacaaagatgaaaa

SEQ ID NO: 8116320 - DNA, 20 bp, Homo sapiens
tggagggattgttggcaaat

SEQ ID NO: 8116321 - DNA, 22 bp, Homo sapiens
tggaggcaactgaagatgtagt

SEQ ID NO: 8116322 - DNA, 20 bp, Homo sapiens
tggaggcagagccagaggga

SEQ ID NO: 8116323 - DNA, 22 bp, Homo sapiens
tggaggcaggtggaggagtgaa

SEQ ID NO: 8116324 - DNA, 22 bp, Homo sapiens
tggaggagaccattccactcag

SEQ ID NO: 8116325 - DNA, 22 bp, Homo sapiens
tggaggagaactccctggctac

SEQ ID NO: 8116326 - DNA, 22 bp, Homo sapiens
tggaggagggctggtgtctgta

SEQ ID NO: 8116327 - DNA, 22 bp, Homo sapiens
tggaggaggaacttcttatctc

SEQ ID NO: 8116328 - DNA, 22 bp, Homo sapiens
tggaggagggctggtgtctgta

SEQ ID NO: 8116329 - DNA, 22 bp, Homo sapiens
tggaggagtagattttcagagg

SEQ ID NO: 8116330 - DNA, 22 bp, Homo sapiens
tggaggagtgtgattgtctgcc

SEQ ID NO: 8116331 - DNA, 22 bp, Homo sapiens
tggaggaaaaaaccaggcagag

SEQ ID NO: 8116332 - DNA, 22 bp, Homo sapiens
tggaggaaaaaaccaggcagag

SEQ ID NO: 8116333 - DNA, 22 bp, Homo sapiens
tggagagaaaaaagacagttct

SEQ ID NO: 8116334 - DNA, 22 bp, Homo sapiens
tggagagaaaaaagacagttct

SEQ ID NO: 8116335 - DNA, 22 bp, Homo sapiens
tggagagaaagttgaatggagg

SEQ ID NO: 8116336 - DNA, 22 bp, Homo sapiens
tggagagaaagttgaatggagg

SEQ ID NO: 8116337 - DNA, 22 bp, Homo sapiens
tggagaagtcaaagtgaacagg

SEQ ID NO: 8116338 - DNA, 22 bp, Homo sapiens
tggagagaacagtgtctgaaag

SEQ ID NO: 8116339 - DNA, 22 bp, Homo sapiens
tggagagaagaggcagtgtgct

SEQ ID NO: 8116340 - DNA, 22 bp, Homo sapiens
tggagagaagaggcagtgtgct

SEQ ID NO: 8116341 - DNA, 22 bp, Homo sapiens
tggagaaggacagcctgagaaa

SEQ ID NO: 8116342 - DNA, 22 bp, Homo sapiens
tggagaagctgtaggtggactc

SEQ ID NO: 8116343 - DNA, 22 bp, Homo sapiens
tggagaaggggcagggtctcca

SEQ ID NO: 8116344 - DNA, 22 bp, Homo sapiens
tggagaaggccggccaggagtg

SEQ ID NO: 8116345 - DNA, 22 bp, Homo sapiens
tggagaagctgtaggtggactc

SEQ ID NO: 8116346 - DNA, 22 bp, Homo sapiens
tggagaagattggtcaccattc

SEQ ID NO: 8116347 - DNA, 22 bp, Homo sapiens
tggagcagcacaagaaagggga

SEQ ID NO: 8116348 - DNA, 22 bp, Homo sapiens
tggagcagccttttctaagcaa

SEQ ID NO: 8116349 - DNA, 21 bp, Homo sapiens
tggagagtgatttcagtgtgg

SEQ ID NO: 8116350 - DNA, 22 bp, Homo sapiens
tggagaggttgaataacttgtc

SEQ ID NO: 8116351 - DNA, 22 bp, Homo sapiens
tggagcccagggtgagaaggag

SEQ ID NO: 8116352 - DNA, 22 bp, Homo sapiens
tggagcccaggagaggataaac

SEQ ID NO: 8116353 - DNA, 22 bp, Homo sapiens
tggagcccagacactggcattg

SEQ ID NO: 8116354 - DNA, 22 bp, Homo sapiens
tggagcccctcacccacacctg

SEQ ID NO: 8116355 - DNA, 22 bp, Homo sapiens
tggagcccatgagccataccag

SEQ ID NO: 8116356 - DNA, 22 bp, Homo sapiens
tggagcgagctcaaaggcagga

SEQ ID NO: 8116357 - DNA, 18 bp, Homo sapiens
tggagcaggaagcctggc

SEQ ID NO: 8116358 - DNA, 22 bp, Homo sapiens
tggagcaggaagtctatggctg

SEQ ID NO: 8116359 - DNA, 22 bp, Homo sapiens
tggagcaggacggggagtggta

SEQ ID NO: 8116360 - DNA, 22 bp, Homo sapiens
tggagcaggaagtctatggctg

SEQ ID NO: 8116361 - DNA, 22 bp, Homo sapiens
tggagcagtggtcctggagatg

SEQ ID NO: 8116362 - DNA, 22 bp, Homo sapiens
tggagcaggtgctcagggtaat

SEQ ID NO: 8116363 - DNA, 22 bp, Homo sapiens
tgcttctgtctcttatgccttg

SEQ ID NO: 8116364 - DNA, 22 bp, Homo sapiens
tgcttctgtctcttatgccttg

SEQ ID NO: 8116365 - DNA, 22 bp, Homo sapiens
tgcttctgttctttcacctacg

SEQ ID NO: 8116366 - DNA, 22 bp, Homo sapiens
tgcttctgttctttcacctacg

SEQ ID NO: 8116367 - DNA, 22 bp, Homo sapiens
tgcttctgggtcccagcctggc

SEQ ID NO: 8116368 - DNA, 17 bp, Homo sapiens
tgcttctgtattgctgg

SEQ ID NO: 8116369 - DNA, 17 bp, Homo sapiens
tgcttctgtattgctgg

SEQ ID NO: 8116370 - DNA, 22 bp, Homo sapiens
tgcttctgtattgaaattgtta

SEQ ID NO: 8116371 - DNA, 22 bp, Homo sapiens
tgcttctgtttgtttctgtcat

SEQ ID NO: 8116372 - DNA, 22 bp, Homo sapiens
tgcttctgtttcattgatctta

SEQ ID NO: 8116373 - DNA, 22 bp, Homo sapiens
tgcttctgtttcattgatctta

SEQ ID NO: 8116374 - DNA, 22 bp, Homo sapiens
tgcttctgtttcattgatctta

SEQ ID NO: 8116375 - DNA, 22 bp, Homo sapiens
tgcttctgtttgtttctgtcat

SEQ ID NO: 8116376 - DNA, 19 bp, Homo sapiens
tgcttctggaatgcaaggc

SEQ ID NO: 8116377 - DNA, 22 bp, Homo sapiens
tgcttctggcttatctcgtgcc

SEQ ID NO: 8116378 - DNA, 22 bp, Homo sapiens
tgcttctggcagattgagtgag

SEQ ID NO: 8116379 - DNA, 22 bp, Homo sapiens
tgcttctgctgatattttgtga

SEQ ID NO: 8116380 - DNA, 22 bp, Homo sapiens
tgcttctggggacaggctgcct

SEQ ID NO: 8116381 - DNA, 19 bp, Homo sapiens
tgcttctggggcttctcca

SEQ ID NO: 8116382 - DNA, 22 bp, Homo sapiens
tgcttctgggtaggcctcagga

SEQ ID NO: 8116383 - DNA, 22 bp, Homo sapiens
tgcttctgggcaaatgtgtgtg

SEQ ID NO: 8116384 - DNA, 22 bp, Homo sapiens
tgcttctggcttatctcgtgcc

SEQ ID NO: 8116385 - DNA, 22 bp, Homo sapiens
tgcttgatgagtgtgccaagca

SEQ ID NO: 8116386 - DNA, 22 bp, Homo sapiens
tgcttgatggctcttctttcta

SEQ ID NO: 8116387 - DNA, 22 bp, Homo sapiens
tgcttgattaagccttgtttgc

SEQ ID NO: 8116388 - DNA, 22 bp, Homo sapiens
tgcttgattagggaagtcacat

SEQ ID NO: 8116389 - DNA, 22 bp, Homo sapiens
tgcttgaagcctacattcgtca

SEQ ID NO: 8116390 - DNA, 17 bp, Homo sapiens
tgcttgactctcttgtt

SEQ ID NO: 8116391 - DNA, 22 bp, Homo sapiens
tgcttgacttagtttctcattt

SEQ ID NO: 8116392 - DNA, 22 bp, Homo sapiens
tggaaagagaaactcttgctaa

SEQ ID NO: 8116393 - DNA, 22 bp, Homo sapiens
tggaaagaggtagaggatctgg

SEQ ID NO: 8116394 - DNA, 22 bp, Homo sapiens
tggaaaggacagttgctgatag

SEQ ID NO: 8116395 - DNA, 21 bp, Homo sapiens
tggaaatggaatactttggat

SEQ ID NO: 8116396 - DNA, 21 bp, Homo sapiens
tggaaatgagcgttcagcttt

SEQ ID NO: 8116397 - DNA, 22 bp, Homo sapiens
tggaaatacttgccataaaact

SEQ ID NO: 8116398 - DNA, 22 bp, Homo sapiens
tggaaatatacaatgtgtctct

SEQ ID NO: 8116399 - DNA, 23 bp, Homo sapiens
tggacaggacccccttcggaccc

SEQ ID NO: 8116400 - DNA, 22 bp, Homo sapiens
tggacaggatctgagactgaga

SEQ ID NO: 8116401 - DNA, 22 bp, Homo sapiens
tggacaggcaagcaagacatac

SEQ ID NO: 8116402 - DNA, 22 bp, Homo sapiens
tggacaggatagtgcagtacgc

SEQ ID NO: 8116403 - DNA, 19 bp, Homo sapiens
tggaatgttccaaggaggc

SEQ ID NO: 8116404 - DNA, 22 bp, Homo sapiens
tggaatgaatatgttttaagga

SEQ ID NO: 8116405 - DNA, 22 bp, Homo sapiens
tggaatgaagacatgttgtttg

SEQ ID NO: 8116406 - DNA, 22 bp, Homo sapiens
tggaatgaatttggcttcctcc

SEQ ID NO: 8116407 - DNA, 22 bp, Homo sapiens
tggaatgacaagttgttcagag

SEQ ID NO: 8116408 - DNA, 22 bp, Homo sapiens
tggaatgacagagagtctgaat

SEQ ID NO: 8116409 - DNA, 22 bp, Homo sapiens
tggaatgacagagagtctgaat

SEQ ID NO: 8116410 - DNA, 22 bp, Homo sapiens
tggaatgaaaagtacttcagaa

SEQ ID NO: 8116411 - DNA, 22 bp, Homo sapiens
tggaatgaaaatggagatcttg

SEQ ID NO: 8116412 - DNA, 22 bp, Homo sapiens
tggaatgaaaatggagatcttg

SEQ ID NO: 8116413 - DNA, 22 bp, Homo sapiens
tggaatgaaggagatggccttt

SEQ ID NO: 8116414 - DNA, 22 bp, Homo sapiens
tggaatggaaacaaactgagga

SEQ ID NO: 8116415 - DNA, 22 bp, Homo sapiens
tggaatgatgactaggaattgt

SEQ ID NO: 8116416 - DNA, 22 bp, Homo sapiens
tggaatgatctgatgtatttta

SEQ ID NO: 8116417 - DNA, 22 bp, Homo sapiens
tggaatgagctggctaataacc

SEQ ID NO: 8116418 - DNA, 23 bp, Homo sapiens
tggaatgagctgggaagctgagc

SEQ ID NO: 8116419 - DNA, 21 bp, Homo sapiens
tggaatgaggctgagcagtgc

SEQ ID NO: 8116420 - DNA, 22 bp, Homo sapiens
tggaatgagtggctaagattca

SEQ ID NO: 8116421 - DNA, 22 bp, Homo sapiens
tggactctgaactggcactgac

SEQ ID NO: 8116422 - DNA, 22 bp, Homo sapiens
tggactctatgatgcgccagca

SEQ ID NO: 8116423 - DNA, 22 bp, Homo sapiens
tggacaggtgagtgactcaggg

SEQ ID NO: 8116424 - DNA, 18 bp, Homo sapiens
tggacagggtggagaaaa

SEQ ID NO: 8116425 - DNA, 23 bp, Homo sapiens
tggacagggtaactggtggtttt

SEQ ID NO: 8116426 - DNA, 22 bp, Homo sapiens
tggacaggggctgctgttgtca

SEQ ID NO: 8116427 - DNA, 22 bp, Homo sapiens
tggacaggctcctaggggttcc

SEQ ID NO: 8116428 - DNA, 20 bp, Homo sapiens
tggacaggggcataggttgc

SEQ ID NO: 8116429 - DNA, 22 bp, Homo sapiens
tggacagggcagagaccgagtc

SEQ ID NO: 8116430 - DNA, 22 bp, Homo sapiens
tggaaggggagttgttccacgt

SEQ ID NO: 8116431 - DNA, 22 bp, Homo sapiens
tggaaggggagctggaaagggg

SEQ ID NO: 8116432 - DNA, 22 bp, Homo sapiens
tggaaggggccaggcgcggagt

SEQ ID NO: 8116433 - DNA, 22 bp, Homo sapiens
tggaaggggttacgcagcagga

SEQ ID NO: 8116434 - DNA, 22 bp, Homo sapiens
tggaaggggttacgcagcagga

SEQ ID NO: 8116435 - DNA, 22 bp, Homo sapiens
tggaagggggaagacagctctg

SEQ ID NO: 8116436 - DNA, 16 bp, Homo sapiens
tggaaggggtctccgg

SEQ ID NO: 8116437 - DNA, 22 bp, Homo sapiens
tggaagggagtgacagtcagag

SEQ ID NO: 8116438 - DNA, 22 bp, Homo sapiens
tggaaggagctaaggacctggg

SEQ ID NO: 8116439 - DNA, 22 bp, Homo sapiens
tggaaggaagccaaggaaggtt

SEQ ID NO: 8116440 - DNA, 22 bp, Homo sapiens
tggaaggaagccaaggaaggtt

SEQ ID NO: 8116441 - DNA, 22 bp, Homo sapiens
tggaagtgctcttctgaccaac

SEQ ID NO: 8116442 - DNA, 22 bp, Homo sapiens
tggaatctgtgctgttttagtg

SEQ ID NO: 8116443 - DNA, 19 bp, Homo sapiens
tggaagaggaagggaaata

SEQ ID NO: 8116444 - DNA, 22 bp, Homo sapiens
tggaagatgaataaagattcta

SEQ ID NO: 8116445 - DNA, 22 bp, Homo sapiens
tggaagaggtggaagtggcttc

SEQ ID NO: 8116446 - DNA, 22 bp, Homo sapiens
tggaagcagagagctatcacca

SEQ ID NO: 8116447 - DNA, 18 bp, Homo sapiens
tggaagctggcagatttt

SEQ ID NO: 8116448 - DNA, 22 bp, Homo sapiens
tggaagcttttgagattgttgc

SEQ ID NO: 8116449 - DNA, 17 bp, Homo sapiens
tggaagcttcatgttgg

SEQ ID NO: 8116450 - DNA, 22 bp, Homo sapiens
tggaaggaaaggtagcagagaa

SEQ ID NO: 8116451 - DNA, 21 bp, Homo sapiens
tggtggaccagtgctgggaga

SEQ ID NO: 8116452 - DNA, 22 bp, Homo sapiens
tggtggagctgtggccacgacc

SEQ ID NO: 8116453 - DNA, 19 bp, Homo sapiens
tggtggaggccccatgttc

SEQ ID NO: 8116454 - DNA, 22 bp, Homo sapiens
tggtggagggaactatttccag

SEQ ID NO: 8116455 - DNA, 22 bp, Homo sapiens
tggtggagcctaggctaagtct

SEQ ID NO: 8116456 - DNA, 22 bp, Homo sapiens
tggtggagagacagtgtattgg

SEQ ID NO: 8116457 - DNA, 20 bp, Homo sapiens
tggtggagagaagctatttg

SEQ ID NO: 8116458 - DNA, 22 bp, Homo sapiens
tggtggagacctcgctaacccc

SEQ ID NO: 8116459 - DNA, 22 bp, Homo sapiens
tggtggagtttctctttcaaac

SEQ ID NO: 8116460 - DNA, 19 bp, Homo sapiens
tggtggaggtgcacctgac

SEQ ID NO: 8116461 - DNA, 22 bp, Homo sapiens
tggtggaggtgcatttcggagc

SEQ ID NO: 8116462 - DNA, 21 bp, Homo sapiens
tggtggagtgtgctgagcatg

SEQ ID NO: 8116463 - DNA, 22 bp, Homo sapiens
tggtcctgcagtaatagacatc

SEQ ID NO: 8116464 - DNA, 22 bp, Homo sapiens
tggtcctggagatcaatatgca

SEQ ID NO: 8116465 - DNA, 22 bp, Homo sapiens
tggtcctcaccctacccagctg

SEQ ID NO: 8116466 - DNA, 22 bp, Homo sapiens
tggtcaggattctcagcccttc

SEQ ID NO: 8116467 - DNA, 22 bp, Homo sapiens
tggtcgaccagttggaaagtaa

SEQ ID NO: 8116468 - DNA, 18 bp, Homo sapiens
tggtgaagggtggaggag

SEQ ID NO: 8116469 - DNA, 18 bp, Homo sapiens
tggtgaagggtggaggag

SEQ ID NO: 8116470 - DNA, 22 bp, Homo sapiens
tggtctctgctgcagcttctca

SEQ ID NO: 8116471 - DNA, 22 bp, Homo sapiens
tgtacagataaagactgtaaat

SEQ ID NO: 8116472 - DNA, 22 bp, Homo sapiens
tgtaccaggccctgtggacatg

SEQ ID NO: 8116473 - DNA, 22 bp, Homo sapiens
tgtacagaaattcctactacat

SEQ ID NO: 8116474 - DNA, 22 bp, Homo sapiens
tgtacagaaggcactaaggtca

SEQ ID NO: 8116475 - DNA, 22 bp, Homo sapiens
tgtacagaggtgtacatatgat

SEQ ID NO: 8116476 - DNA, 22 bp, Homo sapiens
tgtacacaattcttaacataca

SEQ ID NO: 8116477 - DNA, 22 bp, Homo sapiens
tgtaactaagcacattatctaa

SEQ ID NO: 8116478 - DNA, 22 bp, Homo sapiens
tgtaacagtagttactattctt

SEQ ID NO: 8116479 - DNA, 23 bp, Homo sapiens
tgtaacaatttcatatacatgca

SEQ ID NO: 8116480 - DNA, 22 bp, Homo sapiens
tggttgtggtcctccacatcgc

SEQ ID NO: 8116481 - DNA, 22 bp, Homo sapiens
tggtttctcagactctttgcag

SEQ ID NO: 8116482 - DNA, 22 bp, Homo sapiens
tggtgtcatataaggggctctg

SEQ ID NO: 8116483 - DNA, 22 bp, Homo sapiens
tggtgtcactcaagcccggccg

SEQ ID NO: 8116484 - DNA, 22 bp, Homo sapiens
tggtgttttagcattaaagacc

SEQ ID NO: 8116485 - DNA, 22 bp, Homo sapiens
tggtgttttctaagaaagtgtg

SEQ ID NO: 8116486 - DNA, 22 bp, Homo sapiens
tggtgttttctttagactttat

SEQ ID NO: 8116487 - DNA, 22 bp, Homo sapiens
tgtaaataatgcatgtaaatca

SEQ ID NO: 8116488 - DNA, 22 bp, Homo sapiens
tggttttagagtatattcaggg

SEQ ID NO: 8116489 - DNA, 22 bp, Homo sapiens
tggttttatttatgttgagtca

SEQ ID NO: 8116490 - DNA, 22 bp, Homo sapiens
tggttttgccctctttatgatt

SEQ ID NO: 8116491 - DNA, 23 bp, Homo sapiens
tgtatctgtactattcctgcctc

SEQ ID NO: 8116492 - DNA, 22 bp, Homo sapiens
tgtacttgaacttgactgtaga

SEQ ID NO: 8116493 - DNA, 18 bp, Homo sapiens
tgtagagccaggtttgcc

SEQ ID NO: 8116494 - DNA, 22 bp, Homo sapiens
tgtattttctgaagataatcaa

SEQ ID NO: 8116495 - DNA, 22 bp, Homo sapiens
tgtatttcgctaggtactccct

SEQ ID NO: 8116496 - DNA, 22 bp, Homo sapiens
tgtatttctgctttctctagta

SEQ ID NO: 8116497 - DNA, 20 bp, Homo sapiens
tgtatttcatgcattcctgg

SEQ ID NO: 8116498 - DNA, 17 bp, Homo sapiens
tgtatttatcatgtcag

SEQ ID NO: 8116499 - DNA, 20 bp, Homo sapiens
tgtattgttattgggacaga

SEQ ID NO: 8116500 - DNA, 22 bp, Homo sapiens
tgtattgttataatttgtatgt

SEQ ID NO: 8116501 - DNA, 22 bp, Homo sapiens
tgtatttaagctttacctaaaa

SEQ ID NO: 8116502 - DNA, 22 bp, Homo sapiens
tgtcacagagcaactatttctt

SEQ ID NO: 8116503 - DNA, 21 bp, Homo sapiens
tgtcacagattctcagcttgc

SEQ ID NO: 8116504 - DNA, 22 bp, Homo sapiens
tgtcacagtctcgtgagcatct

SEQ ID NO: 8116505 - DNA, 22 bp, Homo sapiens
tgtcctatttctctgtgcatga

SEQ ID NO: 8116506 - DNA, 22 bp, Homo sapiens
tgtcccagttgggtattgaatt

SEQ ID NO: 8116507 - DNA, 22 bp, Homo sapiens
tgtcccagtttatctgggactg

SEQ ID NO: 8116508 - DNA, 22 bp, Homo sapiens
tgtcccagttcccagggttgct

SEQ ID NO: 8116509 - DNA, 22 bp, Homo sapiens
tgtccctggtggaggctggcag

SEQ ID NO: 8116510 - DNA, 22 bp, Homo sapiens
tgtccctgcctgcccactctgt

SEQ ID NO: 8116511 - DNA, 22 bp, Homo sapiens
tgtccctctgaggcttccctgg

SEQ ID NO: 8116512 - DNA, 18 bp, Homo sapiens
tgtccctgcaaataacat

SEQ ID NO: 8116513 - DNA, 20 bp, Homo sapiens
tgtcccctagatcccagctc

SEQ ID NO: 8116514 - DNA, 22 bp, Homo sapiens
tgtcactttttataggtgttga

SEQ ID NO: 8116515 - DNA, 22 bp, Homo sapiens
tgtcagtgatttgtagggaatt

SEQ ID NO: 8116516 - DNA, 22 bp, Homo sapiens
tgtcagtgctatagtgggaata

SEQ ID NO: 8116517 - DNA, 22 bp, Homo sapiens
tgtcatcttgtccagccaggca

SEQ ID NO: 8116518 - DNA, 22 bp, Homo sapiens
tggggtctgagtatctgcattt

SEQ ID NO: 8116519 - DNA, 22 bp, Homo sapiens
tggggtggggttactcattctg

SEQ ID NO: 8116520 - DNA, 22 bp, Homo sapiens
tggggtggtaatacaccgttct

SEQ ID NO: 8116521 - DNA, 22 bp, Homo sapiens
tggggtggtgggaaccaagtag

SEQ ID NO: 8116522 - DNA, 22 bp, Homo sapiens
tggggtgggcatgcgctgtcct

SEQ ID NO: 8116523 - DNA, 22 bp, Homo sapiens
tggggtggatagaaagtgatgt

SEQ ID NO: 8116524 - DNA, 22 bp, Homo sapiens
tggggtggaacccttctgctgg

SEQ ID NO: 8116525 - DNA, 22 bp, Homo sapiens
tgggtaggccaggaagcagtgt

SEQ ID NO: 8116526 - DNA, 22 bp, Homo sapiens
tgggtagggcctgcgcctgtgc

SEQ ID NO: 8116527 - DNA, 22 bp, Homo sapiens
tggtaaccacaaccctccttgt

SEQ ID NO: 8116528 - DNA, 22 bp, Homo sapiens
tggtatttccaggcttatggta

SEQ ID NO: 8116529 - DNA, 22 bp, Homo sapiens
tggtattacttctagacacaag

SEQ ID NO: 8116530 - DNA, 22 bp, Homo sapiens
tggtatttaagacttcactcct

SEQ ID NO: 8116531 - DNA, 16 bp, Homo sapiens
tggtagtcacttagag

SEQ ID NO: 8116532 - DNA, 22 bp, Homo sapiens
tgggtgtgcccagatggtgtcc

SEQ ID NO: 8116533 - DNA, 21 bp, Homo sapiens
tgggtggaagcgggaggccgc

SEQ ID NO: 8116534 - DNA, 22 bp, Homo sapiens
tgggtgagtggagggcattcta

SEQ ID NO: 8116535 - DNA, 22 bp, Homo sapiens
tggggcctgaggtggagctgca

SEQ ID NO: 8116536 - DNA, 22 bp, Homo sapiens
tggggctcctcctggcaggagg

SEQ ID NO: 8116537 - DNA, 22 bp, Homo sapiens
tggggccacactgatctcccag

SEQ ID NO: 8116538 - DNA, 22 bp, Homo sapiens
tgggggcatggaccagcctggc

SEQ ID NO: 8116539 - DNA, 22 bp, Homo sapiens
tgggggagatagagtctgatgg

SEQ ID NO: 8116540 - DNA, 22 bp, Homo sapiens
tgggggagagtttagatgattt

SEQ ID NO: 8116541 - DNA, 22 bp, Homo sapiens
tgggggagagaggcattctttc

SEQ ID NO: 8116542 - DNA, 22 bp, Homo sapiens
tggggaaggcggagcttgcagc

SEQ ID NO: 8116543 - DNA, 22 bp, Homo sapiens
tggggaggaagtcagatttcag

SEQ ID NO: 8116544 - DNA, 22 bp, Homo sapiens
tggggaggacgggcgccttcct

SEQ ID NO: 8116545 - DNA, 22 bp, Homo sapiens
tggggaggatatgtgagttatt

SEQ ID NO: 8116546 - DNA, 23 bp, Homo sapiens
tggggagggaagtcatttctgta

SEQ ID NO: 8116547 - DNA, 21 bp, Homo sapiens
tggggaggggacctgattatg

SEQ ID NO: 8116548 - DNA, 22 bp, Homo sapiens
tggggaggtaacaatttcaggc

SEQ ID NO: 8116549 - DNA, 22 bp, Homo sapiens
tggggaggttcgggaatcttgt

SEQ ID NO: 8116550 - DNA, 22 bp, Homo sapiens
tgggctctcgtccctgcagaag

SEQ ID NO: 8116551 - DNA, 22 bp, Homo sapiens
tgggctctcctggaggacaaca

SEQ ID NO: 8116552 - DNA, 22 bp, Homo sapiens
tgggctctgaagtcagtctgct

SEQ ID NO: 8116553 - DNA, 22 bp, Homo sapiens
tgggctcttcctatagtttata

SEQ ID NO: 8116554 - DNA, 22 bp, Homo sapiens
tgggctgaaatgctgtggacta

SEQ ID NO: 8116555 - DNA, 22 bp, Homo sapiens
tgggctctggtttcctggctgg

SEQ ID NO: 8116556 - DNA, 22 bp, Homo sapiens
tgggctgagcactgaggaagga

SEQ ID NO: 8116557 - DNA, 20 bp, Homo sapiens
tgggctgaggatcaggtgcc

SEQ ID NO: 8116558 - DNA, 22 bp, Homo sapiens
tgggctgagtgtggaactagtt

SEQ ID NO: 8116559 - DNA, 22 bp, Homo sapiens
tgggctgagtggcagccagagt

SEQ ID NO: 8116560 - DNA, 20 bp, Homo sapiens
tgggcctgtggcagaagtct

SEQ ID NO: 8116561 - DNA, 22 bp, Homo sapiens
tgggcctgggttcctcctgggc

SEQ ID NO: 8116562 - DNA, 22 bp, Homo sapiens
tgggcctccgcatggcccagcg

SEQ ID NO: 8116563 - DNA, 22 bp, Homo sapiens
tgggcctcctgccctggcctag

SEQ ID NO: 8116564 - DNA, 22 bp, Homo sapiens
tgggcctcatgcccagccaccc

SEQ ID NO: 8116565 - DNA, 20 bp, Homo sapiens
tgggcctctggtgcctctgg

SEQ ID NO: 8116566 - DNA, 22 bp, Homo sapiens
tgggcctctgtttcctcatctg

SEQ ID NO: 8116567 - DNA, 22 bp, Homo sapiens
tgggcctgagctcaccaggggc

SEQ ID NO: 8116568 - DNA, 21 bp, Homo sapiens
tgggcctgattcccagggtca

SEQ ID NO: 8116569 - DNA, 19 bp, Homo sapiens
tgggcaggttcagtaatgg

SEQ ID NO: 8116570 - DNA, 22 bp, Homo sapiens
tgggccacacacagaagaatca

SEQ ID NO: 8116571 - DNA, 22 bp, Homo sapiens
tgggccacgggggtggagagct

SEQ ID NO: 8116572 - DNA, 22 bp, Homo sapiens
tgggcaggagagaagctaaaga

SEQ ID NO: 8116573 - DNA, 23 bp, Homo sapiens
tgggcagcttctgcatgcccacc

SEQ ID NO: 8116574 - DNA, 22 bp, Homo sapiens
tgggcagccatcccagcctctc

SEQ ID NO: 8116575 - DNA, 19 bp, Homo sapiens
tgggcagctccctctgtcc

SEQ ID NO: 8116576 - DNA, 22 bp, Homo sapiens
tgggcagcagcaaagccagact

SEQ ID NO: 8116577 - DNA, 22 bp, Homo sapiens
tgggcagcatcctccacagtca

SEQ ID NO: 8116578 - DNA, 19 bp, Homo sapiens
tgggatgatgcagaaggta

SEQ ID NO: 8116579 - DNA, 22 bp, Homo sapiens
tgggatgataggtaagtaatta

SEQ ID NO: 8116580 - DNA, 22 bp, Homo sapiens
tgggatattttgagctttcctc

SEQ ID NO: 8116581 - DNA, 22 bp, Homo sapiens
tgggatatacctatcctagaag

SEQ ID NO: 8116582 - DNA, 22 bp, Homo sapiens
tgggatatagtaaaacatgaat

SEQ ID NO: 8116583 - DNA, 22 bp, Homo sapiens
tgggatgagctatatagaaagt

SEQ ID NO: 8116584 - DNA, 22 bp, Homo sapiens
tgggatataatggtattacatc

SEQ ID NO: 8116585 - DNA, 22 bp, Homo sapiens
tgggaggtctcttgcggcctag

SEQ ID NO: 8116586 - DNA, 22 bp, Homo sapiens
tgggagtgaggcagagtctatc

SEQ ID NO: 8116587 - DNA, 22 bp, Homo sapiens
tgggcacagtgagttgccttta

SEQ ID NO: 8116588 - DNA, 22 bp, Homo sapiens
tgggcaatttatttggtcatca

SEQ ID NO: 8116589 - DNA, 22 bp, Homo sapiens
ttattccatagaagtcaaggaa

SEQ ID NO: 8116590 - DNA, 22 bp, Homo sapiens
ttattccagctaagagtcctgg

SEQ ID NO: 8116591 - DNA, 22 bp, Homo sapiens
ttattcttggatctgagtctct

SEQ ID NO: 8116592 - DNA, 20 bp, Homo sapiens
ttatctgtcaatctgtctca

SEQ ID NO: 8116593 - DNA, 22 bp, Homo sapiens
ttatcttggtgttttagtaatt

SEQ ID NO: 8116594 - DNA, 22 bp, Homo sapiens
ttatcttggcaattctaaggta

SEQ ID NO: 8116595 - DNA, 22 bp, Homo sapiens
ttagaaatgtcacagatctgat

SEQ ID NO: 8116596 - DNA, 22 bp, Homo sapiens
ttagaaatcacctctgaagatc

SEQ ID NO: 8116597 - DNA, 22 bp, Homo sapiens
ttagaaaggggtgaatcaatgg

SEQ ID NO: 8116598 - DNA, 22 bp, Homo sapiens
ttagataatgttattgtaattt

SEQ ID NO: 8116599 - DNA, 22 bp, Homo sapiens
ttagaacactgagaaagtgatg

SEQ ID NO: 8116600 - DNA, 22 bp, Homo sapiens
ttagaacatagcaacagaatta

SEQ ID NO: 8116601 - DNA, 22 bp, Homo sapiens
ttagcatttcagtacacatgtt

SEQ ID NO: 8116602 - DNA, 19 bp, Homo sapiens
ttaggggtatgaagtggta

SEQ ID NO: 8116603 - DNA, 22 bp, Homo sapiens
ttagggaaggacagtgaagaaa

SEQ ID NO: 8116604 - DNA, 22 bp, Homo sapiens
ttagggttacaccagcctcctg

SEQ ID NO: 8116605 - DNA, 22 bp, Homo sapiens
ttaggtgtgacattttgttcct

SEQ ID NO: 8116606 - DNA, 22 bp, Homo sapiens
ttagatgactgaaaagagcaca

SEQ ID NO: 8116607 - DNA, 22 bp, Homo sapiens
ttagattctgttgttgctagtg

SEQ ID NO: 8116608 - DNA, 17 bp, Homo sapiens
ttagcaaaatagcactt

SEQ ID NO: 8116609 - DNA, 17 bp, Homo sapiens
ttagcaaaatagcactt

SEQ ID NO: 8116610 - DNA, 22 bp, Homo sapiens
ttagcaaacctggactacagat

SEQ ID NO: 8116611 - DNA, 22 bp, Homo sapiens
ttagcaaacccttgctggtgag

SEQ ID NO: 8116612 - DNA, 22 bp, Homo sapiens
ttagcaaacaaatgaaatggtt

SEQ ID NO: 8116613 - DNA, 22 bp, Homo sapiens
ttacagatgtttcaggaatact

SEQ ID NO: 8116614 - DNA, 19 bp, Homo sapiens
ttacagatgtggaaattga

SEQ ID NO: 8116615 - DNA, 22 bp, Homo sapiens
ttacagatggggttgcaataaa

SEQ ID NO: 8116616 - DNA, 22 bp, Homo sapiens
ttacagatgtaggaactgaagt

SEQ ID NO: 8116617 - DNA, 22 bp, Homo sapiens
ttacagatcatcaaggtataat

SEQ ID NO: 8116618 - DNA, 22 bp, Homo sapiens
ttacagatggatctagcaaaat

SEQ ID NO: 8116619 - DNA, 22 bp, Homo sapiens
ttacatgatgatttcataaaca

SEQ ID NO: 8116620 - DNA, 22 bp, Homo sapiens
ttacatgcaggtcagactgcat

SEQ ID NO: 8116621 - DNA, 22 bp, Homo sapiens
ttacatgctctgtgtgtctccg

SEQ ID NO: 8116622 - DNA, 22 bp, Homo sapiens
ttacatgcttagagatgcatgc

SEQ ID NO: 8116623 - DNA, 22 bp, Homo sapiens
ttacatgggcttgtgagtcctt

SEQ ID NO: 8116624 - DNA, 22 bp, Homo sapiens
ttacatgggccatttagacatg

SEQ ID NO: 8116625 - DNA, 21 bp, Homo sapiens
ttacatggtttatcatatgga

SEQ ID NO: 8116626 - DNA, 22 bp, Homo sapiens
ttacaagacagtgtggtaaata

SEQ ID NO: 8116627 - DNA, 22 bp, Homo sapiens
ttacaaggaggatagcatttcc

SEQ ID NO: 8116628 - DNA, 22 bp, Homo sapiens
ttacaatgatgggattcagcca

SEQ ID NO: 8116629 - DNA, 22 bp, Homo sapiens
ttacaatgcactcacctttaga

SEQ ID NO: 8116630 - DNA, 22 bp, Homo sapiens
ttacaatgggtatacttccatt

SEQ ID NO: 8116631 - DNA, 22 bp, Homo sapiens
ttacaatgggtatacttccatt

SEQ ID NO: 8116632 - DNA, 22 bp, Homo sapiens
ttacagatactttgtaggcaag

SEQ ID NO: 8116633 - DNA, 22 bp, Homo sapiens
ttacacaaaaataagatatggc

SEQ ID NO: 8116634 - DNA, 22 bp, Homo sapiens
ttacagaatctactcgtggtga

SEQ ID NO: 8116635 - DNA, 22 bp, Homo sapiens
ttacagaatgttcttccaacag

SEQ ID NO: 8116636 - DNA, 22 bp, Homo sapiens
ttaatacagtctccagaagtaa

SEQ ID NO: 8116637 - DNA, 22 bp, Homo sapiens
ttaatacagaagcaagacactg

SEQ ID NO: 8116638 - DNA, 22 bp, Homo sapiens
ttaaagcaagtagaagcctgag

SEQ ID NO: 8116639 - DNA, 22 bp, Homo sapiens
ttaaagattctgaggctgatta

SEQ ID NO: 8116640 - DNA, 17 bp, Homo sapiens
ttacaacgtcatctctg

SEQ ID NO: 8116641 - DNA, 17 bp, Homo sapiens
ttacaacaattcatgag

SEQ ID NO: 8116642 - DNA, 20 bp, Homo sapiens
ttacaaagaggcatcgcttt

SEQ ID NO: 8116643 - DNA, 22 bp, Homo sapiens
ttaattaattagttaagcatgt

SEQ ID NO: 8116644 - DNA, 22 bp, Homo sapiens
ttaattaaattcatgagcattg

SEQ ID NO: 8116645 - DNA, 22 bp, Homo sapiens
ttaatgttttaagttatagaga

SEQ ID NO: 8116646 - DNA, 22 bp, Homo sapiens
ttaattaactagccaaccacta

SEQ ID NO: 8116647 - DNA, 22 bp, Homo sapiens
ttacaaagtgttatgataaaca

SEQ ID NO: 8116648 - DNA, 22 bp, Homo sapiens
ttacaaagtgttatgataaaca

SEQ ID NO: 8116649 - DNA, 22 bp, Homo sapiens
ttacaaagttctgagttcaaac

SEQ ID NO: 8116650 - DNA, 22 bp, Homo sapiens
ttccagctaactcacatccctt

SEQ ID NO: 8116651 - DNA, 22 bp, Homo sapiens
ttccagctaactcacatccctt

SEQ ID NO: 8116652 - DNA, 22 bp, Homo sapiens
ttccagaggcctgggcacactc

SEQ ID NO: 8116653 - DNA, 19 bp, Homo sapiens
ttcattctttctacttacc

SEQ ID NO: 8116654 - DNA, 21 bp, Homo sapiens
ttcaggacaggaaaaacaggg

SEQ ID NO: 8116655 - DNA, 22 bp, Homo sapiens
ttcatgtttgtaggactgaggc

SEQ ID NO: 8116656 - DNA, 22 bp, Homo sapiens
ttcacattgttttaatgtgaat

SEQ ID NO: 8116657 - DNA, 22 bp, Homo sapiens
ttcacatttactggtttgtccg

SEQ ID NO: 8116658 - DNA, 22 bp, Homo sapiens
ttcacattggtgatatgtttct

SEQ ID NO: 8116659 - DNA, 18 bp, Homo sapiens
ttcaccagtgtgatgggt

SEQ ID NO: 8116660 - DNA, 22 bp, Homo sapiens
ttcacatttctctgctgtttga

SEQ ID NO: 8116661 - DNA, 22 bp, Homo sapiens
ttatttgacttcttgctatgct

SEQ ID NO: 8116662 - DNA, 22 bp, Homo sapiens
ttcactgctgggtgattgggtt

SEQ ID NO: 8116663 - DNA, 22 bp, Homo sapiens
ttcactgcagcccatgaaggga

SEQ ID NO: 8116664 - DNA, 18 bp, Homo sapiens
tgtgcctctgcaggacgt

SEQ ID NO: 8116665 - DNA, 22 bp, Homo sapiens
tgtgcctgactaggtgaatcaa

SEQ ID NO: 8116666 - DNA, 22 bp, Homo sapiens
tgtgcctctgcctcatgccctg

SEQ ID NO: 8116667 - DNA, 22 bp, Homo sapiens
tgtgcagctctagagccaagcc

SEQ ID NO: 8116668 - DNA, 22 bp, Homo sapiens
tgtgcagcagcagctgtggaga

SEQ ID NO: 8116669 - DNA, 22 bp, Homo sapiens
tgtgcacattctaggactagta

SEQ ID NO: 8116670 - DNA, 23 bp, Homo sapiens
tgtgcacatctgacgggtgaagg

SEQ ID NO: 8116671 - DNA, 22 bp, Homo sapiens
tgtgcacaatgtgcaggtttgt

SEQ ID NO: 8116672 - DNA, 22 bp, Homo sapiens
tgtgctcatggtccagcatggt

SEQ ID NO: 8116673 - DNA, 22 bp, Homo sapiens
tgtgctattacacatttattta

SEQ ID NO: 8116674 - DNA, 22 bp, Homo sapiens
tgtgctcttgtctgtgactaac

SEQ ID NO: 8116675 - DNA, 22 bp, Homo sapiens
tgtgcctgatggtcacgtggcc

SEQ ID NO: 8116676 - DNA, 22 bp, Homo sapiens
tgtgcctggatctctgtgacaa

SEQ ID NO: 8116677 - DNA, 22 bp, Homo sapiens
tgtgcctgttggtgtagacata

SEQ ID NO: 8116678 - DNA, 22 bp, Homo sapiens
tgtgactggcagaggtgtctgg

SEQ ID NO: 8116679 - DNA, 22 bp, Homo sapiens
tgtgactggttgtcccgctttc

SEQ ID NO: 8116680 - DNA, 22 bp, Homo sapiens
tgtgacctcatcttaactggaa

SEQ ID NO: 8116681 - DNA, 22 bp, Homo sapiens
tgtgactaggcctgagctcttg

SEQ ID NO: 8116682 - DNA, 22 bp, Homo sapiens
tgtgactgtgctgtggagggag

SEQ ID NO: 8116683 - DNA, 22 bp, Homo sapiens
tgtgagagagtgcatttgcata

SEQ ID NO: 8116684 - DNA, 22 bp, Homo sapiens
tgtgagattgttttactataat

SEQ ID NO: 8116685 - DNA, 22 bp, Homo sapiens
tgtgagatacctgttcaaatta

SEQ ID NO: 8116686 - DNA, 22 bp, Homo sapiens
tgtgagaggagaaatgcattaa

SEQ ID NO: 8116687 - DNA, 22 bp, Homo sapiens
tgtgagtgaatgggtctgaagt

SEQ ID NO: 8116688 - DNA, 22 bp, Homo sapiens
tgtgatttattgaaaagagctt

SEQ ID NO: 8116689 - DNA, 22 bp, Homo sapiens
tgtgatttcactggtgacatgt

SEQ ID NO: 8116690 - DNA, 22 bp, Homo sapiens
tgtgacagcacggttcaactgc

SEQ ID NO: 8116691 - DNA, 22 bp, Homo sapiens
tgtctctttggcctcccatatg

SEQ ID NO: 8116692 - DNA, 21 bp, Homo sapiens
tgtctgcctgcttcttcactc

SEQ ID NO: 8116693 - DNA, 22 bp, Homo sapiens
tgtctgcctgtctctgtgcaaa

SEQ ID NO: 8116694 - DNA, 22 bp, Homo sapiens
tgtctgaatcgcttcctagagg

SEQ ID NO: 8116695 - DNA, 21 bp, Homo sapiens
tgtctagacctcatcctacag

SEQ ID NO: 8116696 - DNA, 22 bp, Homo sapiens
tgtctaggtctaggttggcaat

SEQ ID NO: 8116697 - DNA, 22 bp, Homo sapiens
tgtctagggcgagaatgtgtag

SEQ ID NO: 8116698 - DNA, 22 bp, Homo sapiens
tgtctcctaatgtctgtttcct

SEQ ID NO: 8116699 - DNA, 22 bp, Homo sapiens
tgtctcccaggtgtgcccagtg

SEQ ID NO: 8116700 - DNA, 22 bp, Homo sapiens
tgtctcctcaactcatgctcga

SEQ ID NO: 8116701 - DNA, 22 bp, Homo sapiens
tgtctcctgggccctggccctg

SEQ ID NO: 8116702 - DNA, 22 bp, Homo sapiens
tgtctcctgggtcccttccacc

SEQ ID NO: 8116703 - DNA, 22 bp, Homo sapiens
tgtctggacagagattctcaat

SEQ ID NO: 8116704 - DNA, 22 bp, Homo sapiens
tgtctggaatttctattttgtc

SEQ ID NO: 8116705 - DNA, 22 bp, Homo sapiens
tgtctggaagggctatgtgacc

SEQ ID NO: 8116706 - DNA, 19 bp, Homo sapiens
tgtctggaagagctgcagg

SEQ ID NO: 8116707 - DNA, 22 bp, Homo sapiens
tgtctggaagtaccagggaagc

SEQ ID NO: 8116708 - DNA, 23 bp, Homo sapiens
tgtctggagcctgagcaggtgct

SEQ ID NO: 8116709 - DNA, 22 bp, Homo sapiens
tgtctggagggctggctccctg

SEQ ID NO: 8116710 - DNA, 22 bp, Homo sapiens
tgtctggaggggatgttatggt

SEQ ID NO: 8116711 - DNA, 23 bp, Homo sapiens
tgtctggagagggcttgctctcc

SEQ ID NO: 8116712 - DNA, 22 bp, Homo sapiens
tgtctggactgctcacagtacc

SEQ ID NO: 8116713 - DNA, 22 bp, Homo sapiens
tgtctggacattgacaatcatg

SEQ ID NO: 8116714 - DNA, 22 bp, Homo sapiens
tgtctggatggtggagattgag

SEQ ID NO: 8116715 - DNA, 22 bp, Homo sapiens
tgtctggatcagtgggtgcttg

SEQ ID NO: 8116716 - DNA, 22 bp, Homo sapiens
tgtctggatagagcctaggccc

SEQ ID NO: 8116717 - DNA, 22 bp, Homo sapiens
tgtctggaggtcaggtcctggg

SEQ ID NO: 8116718 - DNA, 23 bp, Homo sapiens
tgtctggagttttgcactgttgc

SEQ ID NO: 8116719 - DNA, 22 bp, Homo sapiens
tgtctggatgtctggagcatcg

SEQ ID NO: 8116720 - DNA, 20 bp, Homo sapiens
tgtctggatgtttaagcaga

SEQ ID NO: 8116721 - DNA, 22 bp, Homo sapiens
tgtctggattgctgagccccag

SEQ ID NO: 8116722 - DNA, 23 bp, Homo sapiens
tgtctggattcgactgtggttgg

SEQ ID NO: 8116723 - DNA, 22 bp, Homo sapiens
tgtcttcagtaaaatacactat

SEQ ID NO: 8116724 - DNA, 22 bp, Homo sapiens
tgtcttttagtttgtgagatct

SEQ ID NO: 8116725 - DNA, 22 bp, Homo sapiens
tgtctttgttattgtggacagg

SEQ ID NO: 8116726 - DNA, 22 bp, Homo sapiens
tgtcttttggagcatctttctt

SEQ ID NO: 8116727 - DNA, 22 bp, Homo sapiens
tgttagcctgcctgaagagact

SEQ ID NO: 8116728 - DNA, 22 bp, Homo sapiens
tgttaggactccccagaagctg

SEQ ID NO: 8116729 - DNA, 22 bp, Homo sapiens
tgttcttatggctatttctccc

SEQ ID NO: 8116730 - DNA, 22 bp, Homo sapiens
tgttcttagcaggagcatctat

SEQ ID NO: 8116731 - DNA, 22 bp, Homo sapiens
tgttgagtatatacctacaagt

SEQ ID NO: 8116732 - DNA, 20 bp, Homo sapiens
tgtttgtgtggggccttggc

SEQ ID NO: 8116733 - DNA, 22 bp, Homo sapiens
tgtttgctctgactatcttgcg

SEQ ID NO: 8116734 - DNA, 22 bp, Homo sapiens
tgttttatcaagatggcatgtc

SEQ ID NO: 8116735 - DNA, 22 bp, Homo sapiens
tgttttatgagccatataacct

SEQ ID NO: 8116736 - DNA, 22 bp, Homo sapiens
tgttttaatctcccattgctct

SEQ ID NO: 8116737 - DNA, 22 bp, Homo sapiens
tgttttaatctcccattgctct

SEQ ID NO: 8116738 - DNA, 23 bp, Homo sapiens
tgtttgtttctatgagagatagc

SEQ ID NO: 8116739 - DNA, 22 bp, Homo sapiens
tgttttaagagcgcactttata

SEQ ID NO: 8116740 - DNA, 22 bp, Homo sapiens
tgtggacaccactgggaggtct

SEQ ID NO: 8116741 - DNA, 22 bp, Homo sapiens
tgtggaagtgccaatgacaaat

SEQ ID NO: 8116742 - DNA, 22 bp, Homo sapiens
tgtgggaggaattagaatggga

SEQ ID NO: 8116743 - DNA, 22 bp, Homo sapiens
tgtgggaggaacacagccagaa

SEQ ID NO: 8116744 - DNA, 22 bp, Homo sapiens
tgtgtacatgtatcaactatcg

SEQ ID NO: 8116745 - DNA, 23 bp, Homo sapiens
tgtgtacatacatatgtacacac

SEQ ID NO: 8116746 - DNA, 23 bp, Homo sapiens
tgtgtacatacatatgtacacac

SEQ ID NO: 8116747 - DNA, 22 bp, Homo sapiens
tgtgggcactaatgacatgcag

SEQ ID NO: 8116748 - DNA, 22 bp, Homo sapiens
tgtgggcaggagcacaagtcag

SEQ ID NO: 8116749 - DNA, 22 bp, Homo sapiens
tgtgtgtgttcctcctcagcta

SEQ ID NO: 8116750 - DNA, 22 bp, Homo sapiens
tgtgtgtgtttacagtttctca

SEQ ID NO: 8116751 - DNA, 22 bp, Homo sapiens
tgtgtgtgtttataaatctaaa

SEQ ID NO: 8116752 - DNA, 22 bp, Homo sapiens
tgtgtgttctcaattattgatg

SEQ ID NO: 8116753 - DNA, 22 bp, Homo sapiens
tgtgtgtgcaggagagcaggtg

SEQ ID NO: 8116754 - DNA, 22 bp, Homo sapiens
tgtgtgtgcacatgcatataca

SEQ ID NO: 8116755 - DNA, 22 bp, Homo sapiens
tgtgtgtgcacgtgcgcgcgag

SEQ ID NO: 8116756 - DNA, 22 bp, Homo sapiens
tgtgtgtggggaggcagcagat

SEQ ID NO: 8116757 - DNA, 21 bp, Homo sapiens
tgtgtgtgcaggcacacacac

SEQ ID NO: 8116758 - DNA, 22 bp, Homo sapiens
tgtgtgtgggcggaacggcccc

SEQ ID NO: 8116759 - DNA, 22 bp, Homo sapiens
tgtgtgtgtcctcatttgcaga

SEQ ID NO: 8116760 - DNA, 22 bp, Homo sapiens
tgtgtgtgtgcgcgcacgcata

SEQ ID NO: 8116761 - DNA, 22 bp, Homo sapiens
tgtgtgtgtaaaagcatttata

SEQ ID NO: 8116762 - DNA, 23 bp, Homo sapiens
tgtgtgtgtattctacgcaaggt

SEQ ID NO: 8116763 - DNA, 20 bp, Homo sapiens
tgtgtgtgtacttctaaata

SEQ ID NO: 8116764 - DNA, 22 bp, Homo sapiens
tgtgtcagaaatcagtgcctcg

SEQ ID NO: 8116765 - DNA, 22 bp, Homo sapiens
tgtgtagaggtaagtaacactt

SEQ ID NO: 8116766 - DNA, 22 bp, Homo sapiens
tgtgtagaaagatctccaagat

SEQ ID NO: 8116767 - DNA, 22 bp, Homo sapiens
tgtgtgccagcctacgaggagc

SEQ ID NO: 8116768 - DNA, 22 bp, Homo sapiens
tgtgtggattcatctcaaagag

SEQ ID NO: 8116769 - DNA, 22 bp, Homo sapiens
tgtgtggatgcagcgtgggtct

SEQ ID NO: 8116770 - DNA, 22 bp, Homo sapiens
tgtgtgtgacaacctagttcag

SEQ ID NO: 8116771 - DNA, 22 bp, Homo sapiens
tgtgtgtgaaccattgagggct

SEQ ID NO: 8116772 - DNA, 22 bp, Homo sapiens
tgtgtgtgagtcctggctttcc

SEQ ID NO: 8116773 - DNA, 22 bp, Homo sapiens
tgtgtgtgactcatactagaac

SEQ ID NO: 8116774 - DNA, 22 bp, Homo sapiens
aagatatagataaaactatgca

SEQ ID NO: 8116775 - DNA, 22 bp, Homo sapiens
aagatacattttcttcagagaa

SEQ ID NO: 8116776 - DNA, 22 bp, Homo sapiens
aagatactttgcatgcatgaag

SEQ ID NO: 8116777 - DNA, 22 bp, Homo sapiens
aagcaaaacgtgctctaggagg

SEQ ID NO: 8116778 - DNA, 22 bp, Homo sapiens
aagattttctcaactgtatttg

SEQ ID NO: 8116779 - DNA, 22 bp, Homo sapiens
aagcacatctcctgtgcagaac

SEQ ID NO: 8116780 - DNA, 22 bp, Homo sapiens
aagcacatctcaaacttcatct

SEQ ID NO: 8116781 - DNA, 22 bp, Homo sapiens
acagatgaaacccagctagttg

SEQ ID NO: 8116782 - DNA, 22 bp, Homo sapiens
acagatgagaagctgcattcaa

SEQ ID NO: 8116783 - DNA, 22 bp, Homo sapiens
acagaggaaggctgagctgccc

SEQ ID NO: 8116784 - DNA, 22 bp, Homo sapiens
acagaggaagcatatagcacaa

SEQ ID NO: 8116785 - DNA, 22 bp, Homo sapiens
aagacattttagagatagggaa

SEQ ID NO: 8116786 - DNA, 19 bp, Homo sapiens
aagagggaaagtgctatgc

SEQ ID NO: 8116787 - DNA, 22 bp, Homo sapiens
acacacagcgcctaccatgtgc

SEQ ID NO: 8116788 - DNA, 22 bp, Homo sapiens
acacacagagtttatacaggca

SEQ ID NO: 8116789 - DNA, 22 bp, Homo sapiens
acactaaatgagtctacagtac

SEQ ID NO: 8116790 - DNA, 22 bp, Homo sapiens
acacggcactttaggaaggggc

SEQ ID NO: 8116791 - DNA, 22 bp, Homo sapiens
acacccaggctggcgtgcagtg

SEQ ID NO: 8116792 - DNA, 22 bp, Homo sapiens
aagagtttatgatataacatgt

SEQ ID NO: 8116793 - DNA, 22 bp, Homo sapiens
aagagttctcagaaacgtgggt

SEQ ID NO: 8116794 - DNA, 22 bp, Homo sapiens
aagagtttaccagtgctgcttc

SEQ ID NO: 8116795 - DNA, 22 bp, Homo sapiens
aagagttaagcaacagatacca

SEQ ID NO: 8116796 - DNA, 22 bp, Homo sapiens
aagagtcctgttacacatgagt

SEQ ID NO: 8116797 - DNA, 22 bp, Homo sapiens
aactctatttaccctactaaac

SEQ ID NO: 8116798 - DNA, 22 bp, Homo sapiens
aactttcaggcaatgaatattt

SEQ ID NO: 8116799 - DNA, 22 bp, Homo sapiens
aatgttacgatcaacaacacat

SEQ ID NO: 8116800 - DNA, 22 bp, Homo sapiens
aagacaattttgagtatgcaca

SEQ ID NO: 8116801 - DNA, 22 bp, Homo sapiens
acaactgtcagtaaagaatatt

SEQ ID NO: 8116802 - DNA, 22 bp, Homo sapiens
acaacaaaatgaggaagtggtc

SEQ ID NO: 8116803 - DNA, 22 bp, Homo sapiens
acaagaaaggtaggattcaggt

SEQ ID NO: 8116804 - DNA, 22 bp, Homo sapiens
acaagaataaggataagagatt

SEQ ID NO: 8116805 - DNA, 22 bp, Homo sapiens
acaagaatgtagattagttaag

SEQ ID NO: 8116806 - DNA, 22 bp, Homo sapiens
aagacattcatgaagaagggat

SEQ ID NO: 8116807 - DNA, 22 bp, Homo sapiens
aagacattccaaagtggctaat

SEQ ID NO: 8116808 - DNA, 22 bp, Homo sapiens
aagacattgtggagatgttgct

SEQ ID NO: 8116809 - DNA, 22 bp, Homo sapiens
aagacattggcattgactgtaa

SEQ ID NO: 8116810 - DNA, 23 bp, Homo sapiens
aattcaaattcagtgtgactagg

SEQ ID NO: 8116811 - DNA, 22 bp, Homo sapiens
aagaattattgcaatactagat

SEQ ID NO: 8116812 - DNA, 22 bp, Homo sapiens
aagaatttaaactaaccatatg

SEQ ID NO: 8116813 - DNA, 22 bp, Homo sapiens
aaggacagggatggttgattgt

SEQ ID NO: 8116814 - DNA, 22 bp, Homo sapiens
aaggacaggttggggcttcagg

SEQ ID NO: 8116815 - DNA, 22 bp, Homo sapiens
aaattagtgttttcttactggt

SEQ ID NO: 8116816 - DNA, 22 bp, Homo sapiens
aaattataggtgccaccttgga

SEQ ID NO: 8116817 - DNA, 22 bp, Homo sapiens
aaattagtcatgttgtattact

SEQ ID NO: 8116818 - DNA, 22 bp, Homo sapiens
aaggagaaatggtagatgtgca

SEQ ID NO: 8116819 - DNA, 22 bp, Homo sapiens
aagctggggactcagaccccat

SEQ ID NO: 8116820 - DNA, 22 bp, Homo sapiens
aagctgggacttagcgcagata

SEQ ID NO: 8116821 - DNA, 22 bp, Homo sapiens
aagcccaatgtacaaataactc

SEQ ID NO: 8116822 - DNA, 22 bp, Homo sapiens
aagccatttcctgatacaccta

SEQ ID NO: 8116823 - DNA, 21 bp, Homo sapiens
aagccagcccacagtggtttg

SEQ ID NO: 8116824 - DNA, 22 bp, Homo sapiens
aagccagtgtccagaatgggca

SEQ ID NO: 8116825 - DNA, 22 bp, Homo sapiens
aagccagtcctctactgggcac

SEQ ID NO: 8116826 - DNA, 22 bp, Homo sapiens
aagccagtgtttttgagagttg

SEQ ID NO: 8116827 - DNA, 22 bp, Homo sapiens
aacaaatgtgtggcagtgtggg

SEQ ID NO: 8116828 - DNA, 22 bp, Homo sapiens
aacaagttgttgaaaataatta

SEQ ID NO: 8116829 - DNA, 22 bp, Homo sapiens
aagggagacagttgtgtgagga

SEQ ID NO: 8116830 - DNA, 22 bp, Homo sapiens
aagtacacctttggagtccacg

SEQ ID NO: 8116831 - DNA, 22 bp, Homo sapiens
aacaatcaagtttctaaatgac

SEQ ID NO: 8116832 - DNA, 22 bp, Homo sapiens
aagggagcggggagaccctatg

SEQ ID NO: 8116833 - DNA, 22 bp, Homo sapiens
aaggggaagtagcaccagaggt

SEQ ID NO: 8116834 - DNA, 22 bp, Homo sapiens
aagggctggagactgggtcttc

SEQ ID NO: 8116835 - DNA, 22 bp, Homo sapiens
aagggaggaggatttattgtac

SEQ ID NO: 8116836 - DNA, 22 bp, Homo sapiens
aaggggaatagagtgggttgtg

SEQ ID NO: 8116837 - DNA, 22 bp, Homo sapiens
aagttacattttggtctaattg

SEQ ID NO: 8116838 - DNA, 22 bp, Homo sapiens
aagttcttggaggatgaagagt

SEQ ID NO: 8116839 - DNA, 22 bp, Homo sapiens
aagttgaatcagtaacacagtt

SEQ ID NO: 8116840 - DNA, 22 bp, Homo sapiens
aagtattcataaggacatatgt

SEQ ID NO: 8116841 - DNA, 22 bp, Homo sapiens
aacactgagtatcagagttggg

SEQ ID NO: 8116842 - DNA, 22 bp, Homo sapiens
aacactgctgctgggttctgtg

SEQ ID NO: 8116843 - DNA, 18 bp, Homo sapiens
aacagtttccagattctc

SEQ ID NO: 8116844 - DNA, 22 bp, Homo sapiens
aacagtttgagctttgaatttc

SEQ ID NO: 8116845 - DNA, 22 bp, Homo sapiens
aacagtttgctttaagaggcac

SEQ ID NO: 8116846 - DNA, 22 bp, Homo sapiens
aagtttctgtatgctcttctgt

SEQ ID NO: 8116847 - DNA, 22 bp, Homo sapiens
aagtttctgttcatatctctga

SEQ ID NO: 8116848 - DNA, 20 bp, Homo sapiens
aagttgcagagagttgtctt

SEQ ID NO: 8116849 - DNA, 22 bp, Homo sapiens
aaccagctgagaatgcttctgc

SEQ ID NO: 8116850 - DNA, 22 bp, Homo sapiens
aactccagctcacacagtgacc

SEQ ID NO: 8116851 - DNA, 22 bp, Homo sapiens
aactccagcaggaaggtgagaa

SEQ ID NO: 8116852 - DNA, 22 bp, Homo sapiens
aactccagggtcaccattcaca

SEQ ID NO: 8116853 - DNA, 21 bp, Homo sapiens
aactcccagtgccttcccagc

SEQ ID NO: 8116854 - DNA, 22 bp, Homo sapiens
aactcccactcagcttcttaat

SEQ ID NO: 8116855 - DNA, 22 bp, Homo sapiens
aactcagtgtgtttcttagtat

SEQ ID NO: 8116856 - DNA, 20 bp, Homo sapiens
aacattgaaagtctagaaga

SEQ ID NO: 8116857 - DNA, 22 bp, Homo sapiens
aacagtttgggtaggtatgtag

SEQ ID NO: 8116858 - DNA, 22 bp, Homo sapiens
aagaaagtgggtaatatgattt

SEQ ID NO: 8116859 - DNA, 22 bp, Homo sapiens
aagaatgtcgttggtattttaa

SEQ ID NO: 8116860 - DNA, 22 bp, Homo sapiens
aagaatgtgggtggatatgatg

SEQ ID NO: 8116861 - DNA, 22 bp, Homo sapiens
aagaatgtgggtggatatgatg

SEQ ID NO: 8116862 - DNA, 22 bp, Homo sapiens
aagaatgagctcaaagatctta

SEQ ID NO: 8116863 - DNA, 22 bp, Homo sapiens
aagagccagctagtgaagaggc

SEQ ID NO: 8116864 - DNA, 22 bp, Homo sapiens
aagagccagtgggaaagtcttg

SEQ ID NO: 8116865 - DNA, 22 bp, Homo sapiens
aagaggaagtctccatggagag

SEQ ID NO: 8116866 - DNA, 22 bp, Homo sapiens
aagaatgttcaacgcttttttg

SEQ ID NO: 8116867 - DNA, 22 bp, Homo sapiens
aagaatgttagtttctgataca

SEQ ID NO: 8116868 - DNA, 21 bp, Homo sapiens
aagaatgttccaggtcttgcc

SEQ ID NO: 8116869 - DNA, 22 bp, Homo sapiens
aagacagaagtgatttgatgtg

SEQ ID NO: 8116870 - DNA, 22 bp, Homo sapiens
aagccactatggtgattctcaa

SEQ ID NO: 8116871 - DNA, 22 bp, Homo sapiens
aagccacaatctgcatcagcat

SEQ ID NO: 8116872 - DNA, 22 bp, Homo sapiens
aagccactgagatttcactgca

SEQ ID NO: 8116873 - DNA, 22 bp, Homo sapiens
aagccactcacaataactgtcc

SEQ ID NO: 8116874 - DNA, 22 bp, Homo sapiens
aagccactgagatttcactgca

SEQ ID NO: 8116875 - DNA, 22 bp, Homo sapiens
aagccactttcagctgtctcag

SEQ ID NO: 8116876 - DNA, 22 bp, Homo sapiens
aagccagagtttttgagaactt

SEQ ID NO: 8116877 - DNA, 22 bp, Homo sapiens
aagcagaaagaacaactgagtg

SEQ ID NO: 8116878 - DNA, 22 bp, Homo sapiens
aagcagaaaaactgagctccaa

SEQ ID NO: 8116879 - DNA, 22 bp, Homo sapiens
aagcactttagtgagaataagg

SEQ ID NO: 8116880 - DNA, 22 bp, Homo sapiens
aagcactttatgtcaatgtcct

SEQ ID NO: 8116881 - DNA, 22 bp, Homo sapiens
aagcactgggtatagcaatgat

SEQ ID NO: 8116882 - DNA, 22 bp, Homo sapiens
aagcactgggtatagcaatgat

SEQ ID NO: 8116883 - DNA, 22 bp, Homo sapiens
aagcactggggccacagacacg

SEQ ID NO: 8116884 - DNA, 22 bp, Homo sapiens
aagcactgagcacagtggctga

SEQ ID NO: 8116885 - DNA, 22 bp, Homo sapiens
aaatatgaatgataagagttat

SEQ ID NO: 8116886 - DNA, 22 bp, Homo sapiens
aagcaaatgtgggtgcagaatt

SEQ ID NO: 8116887 - DNA, 22 bp, Homo sapiens
aagcaaatgtgggtgcagaatt

SEQ ID NO: 8116888 - DNA, 22 bp, Homo sapiens
aagcaaagtgaattttgccaag

SEQ ID NO: 8116889 - DNA, 22 bp, Homo sapiens
aagcacagctggaacagcagga

SEQ ID NO: 8116890 - DNA, 22 bp, Homo sapiens
aaatatcattctggtgcacaga

SEQ ID NO: 8116891 - DNA, 22 bp, Homo sapiens
aaatatcattctggtgcacaga

SEQ ID NO: 8116892 - DNA, 19 bp, Homo sapiens
aaatatcagagagatgata

SEQ ID NO: 8116893 - DNA, 23 bp, Homo sapiens
aacacaaagctgattccagtggc

SEQ ID NO: 8116894 - DNA, 21 bp, Homo sapiens
aacacatccagagtatttgac

SEQ ID NO: 8116895 - DNA, 22 bp, Homo sapiens
aacacatatttatatatgcaca

SEQ ID NO: 8116896 - DNA, 22 bp, Homo sapiens
aaagcaatgggtctaaggtaaa

SEQ ID NO: 8116897 - DNA, 23 bp, Homo sapiens
aaatggcttgccctctcgtttgg

SEQ ID NO: 8116898 - DNA, 22 bp, Homo sapiens
aaatggctgcatttgtgtaaat

SEQ ID NO: 8116899 - DNA, 22 bp, Homo sapiens
aaatggctccagttgacttttt

SEQ ID NO: 8116900 - DNA, 18 bp, Homo sapiens
aaatggctacctttgtca

SEQ ID NO: 8116901 - DNA, 22 bp, Homo sapiens
aaagcacagggtgctagagagt

SEQ ID NO: 8116902 - DNA, 22 bp, Homo sapiens
aacaacttgcgttcagagatgt

SEQ ID NO: 8116903 - DNA, 22 bp, Homo sapiens
aactatgttaataagtttcatt

SEQ ID NO: 8116904 - DNA, 22 bp, Homo sapiens
aacatttgtgaagtacttagat

SEQ ID NO: 8116905 - DNA, 22 bp, Homo sapiens
aacatttgcatgctttattaga

SEQ ID NO: 8116906 - DNA, 22 bp, Homo sapiens
aacatttgagaaaaatactctt

SEQ ID NO: 8116907 - DNA, 22 bp, Homo sapiens
aactgagcccctgcacttgtga

SEQ ID NO: 8116908 - DNA, 22 bp, Homo sapiens
aacatttcataacttgactttt

SEQ ID NO: 8116909 - DNA, 22 bp, Homo sapiens
aacatgcaatgtctgaaaatcc

SEQ ID NO: 8116910 - DNA, 22 bp, Homo sapiens
aacatgcacaattttaggcctg

SEQ ID NO: 8116911 - DNA, 22 bp, Homo sapiens
aacatgcacatcatagctcgtg

SEQ ID NO: 8116912 - DNA, 22 bp, Homo sapiens
aacattcaaaacccagttcagt

SEQ ID NO: 8116913 - DNA, 22 bp, Homo sapiens
aacattcaagttctggtttatg

SEQ ID NO: 8116914 - DNA, 22 bp, Homo sapiens
aaacaagagcttacatggctgc

SEQ ID NO: 8116915 - DNA, 22 bp, Homo sapiens
aaacacacagaaatgaatgagg

SEQ ID NO: 8116916 - DNA, 22 bp, Homo sapiens
aaacacaatgtttctttgttct

SEQ ID NO: 8116917 - DNA, 22 bp, Homo sapiens
aaacaaagcatcttgctatgca

SEQ ID NO: 8116918 - DNA, 22 bp, Homo sapiens
aaaagtattttggatctcagat

SEQ ID NO: 8116919 - DNA, 22 bp, Homo sapiens
aaaaggctcttcaaaatggaag

SEQ ID NO: 8116920 - DNA, 22 bp, Homo sapiens
aaaaatgaattcttcagtggca

SEQ ID NO: 8116921 - DNA, 21 bp, Homo sapiens
aaaaatgaagttgttcaggaa

SEQ ID NO: 8116922 - DNA, 22 bp, Homo sapiens
aaaaagatgtcctgaagtttag

SEQ ID NO: 8116923 - DNA, 22 bp, Homo sapiens
aaaccacctccccagctgctgt

SEQ ID NO: 8116924 - DNA, 22 bp, Homo sapiens
aaagatgaccgtatgtcagagc

SEQ ID NO: 8116925 - DNA, 22 bp, Homo sapiens
aaagatgcctaactcagaagat

SEQ ID NO: 8116926 - DNA, 18 bp, Homo sapiens
aaagaaggattggagagc

SEQ ID NO: 8116927 - DNA, 22 bp, Homo sapiens
aaagaagacagacatttctttc

SEQ ID NO: 8116928 - DNA, 22 bp, Homo sapiens
aaacttgagccaagggcttggg

SEQ ID NO: 8116929 - DNA, 22 bp, Homo sapiens
aaacttgagccaagggcttggg

SEQ ID NO: 8116930 - DNA, 22 bp, Homo sapiens
aaagcaatggatgagaatctgt

SEQ ID NO: 8116931 - DNA, 22 bp, Homo sapiens
aaagcaatcagattcagatgtc

SEQ ID NO: 8116932 - DNA, 22 bp, Homo sapiens
aaacatcaccattttacctaat

SEQ ID NO: 8116933 - DNA, 22 bp, Homo sapiens
aaacagttttctcatttagtgt

SEQ ID NO: 8116934 - DNA, 22 bp, Homo sapiens
aaagtgctgggattataggcat

SEQ ID NO: 8116935 - DNA, 22 bp, Homo sapiens
aaagtgctgcgacatttgagcg

SEQ ID NO: 8116936 - DNA, 22 bp, Homo sapiens
aaagtgctcggcgctggtccca

SEQ ID NO: 8116937 - DNA, 22 bp, Homo sapiens
aaagtgcatcaaatgacttccc

SEQ ID NO: 8116938 - DNA, 22 bp, Homo sapiens
aaagtgcatagagtagtgccta

SEQ ID NO: 8116939 - DNA, 22 bp, Homo sapiens
aaagtgcctgactcatagttag

SEQ ID NO: 8116940 - DNA, 22 bp, Homo sapiens
aaagtccaattttgttcaggct

SEQ ID NO: 8116941 - DNA, 22 bp, Homo sapiens
aaagtgcagtccatgaaattaa

SEQ ID NO: 8116942 - DNA, 23 bp, Homo sapiens
aaagtgcagttgaggaatcatag

SEQ ID NO: 8116943 - DNA, 22 bp, Homo sapiens
aaacactggtatgatgtatagt

SEQ ID NO: 8116944 - DNA, 19 bp, Homo sapiens
aaactaaggggaaatgttt

SEQ ID NO: 8116945 - DNA, 22 bp, Homo sapiens
aaatgctctccaaaatgaaagt

SEQ ID NO: 8116946 - DNA, 22 bp, Homo sapiens
aaatgctctctaatgtaataca

SEQ ID NO: 8116947 - DNA, 19 bp, Homo sapiens
agagaaagaattgagtcta

SEQ ID NO: 8116948 - DNA, 22 bp, Homo sapiens
agactggggttctggcaaggag

SEQ ID NO: 8116949 - DNA, 22 bp, Homo sapiens
agactgggccatttccccagct

SEQ ID NO: 8116950 - DNA, 17 bp, Homo sapiens
agacactgagccaagta

SEQ ID NO: 8116951 - DNA, 22 bp, Homo sapiens
agacactgatgttcagctcaat

SEQ ID NO: 8116952 - DNA, 21 bp, Homo sapiens
agacctcttcccttcatgcac

SEQ ID NO: 8116953 - DNA, 20 bp, Homo sapiens
agagagcacaggcaggaaag

SEQ ID NO: 8116954 - DNA, 22 bp, Homo sapiens
agagagcaggacttcactgagc

SEQ ID NO: 8116955 - DNA, 20 bp, Homo sapiens
agagagttgtcagtagcttc

SEQ ID NO: 8116956 - DNA, 22 bp, Homo sapiens
agagatattatttaccaagtta

SEQ ID NO: 8116957 - DNA, 22 bp, Homo sapiens
agagatatggatgtcagaaact

SEQ ID NO: 8116958 - DNA, 22 bp, Homo sapiens
agagatatggatgtcagaaact

SEQ ID NO: 8116959 - DNA, 22 bp, Homo sapiens
agagatatgctgcctaaattta

SEQ ID NO: 8116960 - DNA, 22 bp, Homo sapiens
agagatataagtataaataggg

SEQ ID NO: 8116961 - DNA, 22 bp, Homo sapiens
agagagagggaaactgctaaac

SEQ ID NO: 8116962 - DNA, 22 bp, Homo sapiens
agagagaggggcgagcaaacac

SEQ ID NO: 8116963 - DNA, 20 bp, Homo sapiens
agagagaggtaaattgagca

SEQ ID NO: 8116964 - DNA, 22 bp, Homo sapiens
agagagagaaatgaaatgtgct

SEQ ID NO: 8116965 - DNA, 22 bp, Homo sapiens
agagacagggttttgccatgtt

SEQ ID NO: 8116966 - DNA, 22 bp, Homo sapiens
agaataaaatagtctgaagatg

SEQ ID NO: 8116967 - DNA, 18 bp, Homo sapiens
aatggaaggggtgctgtt

SEQ ID NO: 8116968 - DNA, 22 bp, Homo sapiens
agaattgtaagcaatttgatta

SEQ ID NO: 8116969 - DNA, 19 bp, Homo sapiens
agaattgttttatgtcttc

SEQ ID NO: 8116970 - DNA, 22 bp, Homo sapiens
aatgtacactgaaagcctatca

SEQ ID NO: 8116971 - DNA, 22 bp, Homo sapiens
agaatttcctatgagagattcc

SEQ ID NO: 8116972 - DNA, 22 bp, Homo sapiens
aatgtacatctcagtgtagtac

SEQ ID NO: 8116973 - DNA, 22 bp, Homo sapiens
aatgtacaggctggctatgggg

SEQ ID NO: 8116974 - DNA, 22 bp, Homo sapiens
aatgtacagctgtctttcctcc

SEQ ID NO: 8116975 - DNA, 22 bp, Homo sapiens
aattcactgaacttctctgaga

SEQ ID NO: 8116976 - DNA, 22 bp, Homo sapiens
aattcactgttccttctgcttt

SEQ ID NO: 8116977 - DNA, 22 bp, Homo sapiens
aattcacatatacattattcct

SEQ ID NO: 8116978 - DNA, 22 bp, Homo sapiens
agagcagctcgctacctctcta

SEQ ID NO: 8116979 - DNA, 22 bp, Homo sapiens
agagcagctggggcagagacca

SEQ ID NO: 8116980 - DNA, 22 bp, Homo sapiens
agagcagctggggcagagacca

SEQ ID NO: 8116981 - DNA, 22 bp, Homo sapiens
agaggccaaagaatctacaaga

SEQ ID NO: 8116982 - DNA, 22 bp, Homo sapiens
agaggccaagccagactgtgca

SEQ ID NO: 8116983 - DNA, 22 bp, Homo sapiens
agagggctaactgggaagcagg

SEQ ID NO: 8116984 - DNA, 22 bp, Homo sapiens
agagggcccatgttgggctgct

SEQ ID NO: 8116985 - DNA, 21 bp, Homo sapiens
agagggcgaaggcggggtccg

SEQ ID NO: 8116986 - DNA, 22 bp, Homo sapiens
agagggctggacgcaggttgga

SEQ ID NO: 8116987 - DNA, 21 bp, Homo sapiens
aattttgaaggaagattaagg

SEQ ID NO: 8116988 - DNA, 21 bp, Homo sapiens
aattttgaaggaagattaagg

SEQ ID NO: 8116989 - DNA, 22 bp, Homo sapiens
agatcccaggatactggcctat

SEQ ID NO: 8116990 - DNA, 22 bp, Homo sapiens
agatatgtgcgtcttagattga

SEQ ID NO: 8116991 - DNA, 22 bp, Homo sapiens
agatattaatcgtacataaggt

SEQ ID NO: 8116992 - DNA, 22 bp, Homo sapiens
agatatctgtattgtttccaat

SEQ ID NO: 8116993 - DNA, 22 bp, Homo sapiens
agatatgatgcatgtaaacatt

SEQ ID NO: 8116994 - DNA, 22 bp, Homo sapiens
agattacagcatgggaatggga

SEQ ID NO: 8116995 - DNA, 21 bp, Homo sapiens
agattaaaatctgtgagaagg

SEQ ID NO: 8116996 - DNA, 22 bp, Homo sapiens
agaggggttaagtgctagtccg

SEQ ID NO: 8116997 - DNA, 22 bp, Homo sapiens
aattttgtttaagtgatctgct

SEQ ID NO: 8116998 - DNA, 22 bp, Homo sapiens
agagtctggaagcgcttctaaa

SEQ ID NO: 8116999 - DNA, 21 bp, Homo sapiens
agagtctgcatttctgacaag

SEQ ID NO: 8117000 - DNA, 22 bp, Homo sapiens
agagtgaaaagctagagcagta

SEQ ID NO: 8117001 - DNA, 22 bp, Homo sapiens
agcagccaggaatctgcagagc

SEQ ID NO: 8117002 - DNA, 22 bp, Homo sapiens
agcagccagagtctgaacatta

SEQ ID NO: 8117003 - DNA, 22 bp, Homo sapiens
agcacttctcatgggatcaggt

SEQ ID NO: 8117004 - DNA, 21 bp, Homo sapiens
acacactctgagtcttctatt

SEQ ID NO: 8117005 - DNA, 22 bp, Homo sapiens
acacactcaattgcataagcac

SEQ ID NO: 8117006 - DNA, 22 bp, Homo sapiens
agcaggagctgtgggaagatgg

SEQ ID NO: 8117007 - DNA, 22 bp, Homo sapiens
agcaggagctgtgggaagatgg

SEQ ID NO: 8117008 - DNA, 22 bp, Homo sapiens
agcagctgagccccagctgtga

SEQ ID NO: 8117009 - DNA, 22 bp, Homo sapiens
agcaggaacgagttcatgggga

SEQ ID NO: 8117010 - DNA, 22 bp, Homo sapiens
agcagccatagatagcatgcaa

SEQ ID NO: 8117011 - DNA, 22 bp, Homo sapiens
agcaggtgagcacagccaggct

SEQ ID NO: 8117012 - DNA, 22 bp, Homo sapiens
agcatccaacaggagggaaggg

SEQ ID NO: 8117013 - DNA, 19 bp, Homo sapiens
agcatccagtcatgggatc

SEQ ID NO: 8117014 - DNA, 22 bp, Homo sapiens
agcctgtgtgctttggacaggg

SEQ ID NO: 8117015 - DNA, 22 bp, Homo sapiens
agcctggctgtaacctcatggt

SEQ ID NO: 8117016 - DNA, 22 bp, Homo sapiens
agctcattgaagtcatgacctg

SEQ ID NO: 8117017 - DNA, 22 bp, Homo sapiens
agccctgcaggaggtgggagag

SEQ ID NO: 8117018 - DNA, 22 bp, Homo sapiens
agccctgcaggatgagggaggt

SEQ ID NO: 8117019 - DNA, 22 bp, Homo sapiens
agccaggcggggcaggtttcct

SEQ ID NO: 8117020 - DNA, 22 bp, Homo sapiens
agccaggcgcagtggcttatgc

SEQ ID NO: 8117021 - DNA, 22 bp, Homo sapiens
agcatttaatcctacatagatc

SEQ ID NO: 8117022 - DNA, 22 bp, Homo sapiens
agccaggctaaatgagccatga

SEQ ID NO: 8117023 - DNA, 22 bp, Homo sapiens
agccaggctactccttgctgac

SEQ ID NO: 8117024 - DNA, 22 bp, Homo sapiens
agccaggctaaatgagccatga

SEQ ID NO: 8117025 - DNA, 22 bp, Homo sapiens
agccaggcgggtctttgctcct

SEQ ID NO: 8117026 - DNA, 22 bp, Homo sapiens
agccaggcgggtctttgctcct

SEQ ID NO: 8117027 - DNA, 22 bp, Homo sapiens
agccaggctactccttgctgac

SEQ ID NO: 8117028 - DNA, 20 bp, Homo sapiens
agccaggctcaagctccccc

SEQ ID NO: 8117029 - DNA, 22 bp, Homo sapiens
agccaggctcaaggcctgctcc

SEQ ID NO: 8117030 - DNA, 22 bp, Homo sapiens
agcatccatccaggaaaattga

SEQ ID NO: 8117031 - DNA, 22 bp, Homo sapiens
agcccaggtctggcccagcctg

SEQ ID NO: 8117032 - DNA, 22 bp, Homo sapiens
acagacagtatggtggggctga

SEQ ID NO: 8117033 - DNA, 21 bp, Homo sapiens
acagacagggccagtgtcccc

SEQ ID NO: 8117034 - DNA, 22 bp, Homo sapiens
acagacagggcacctgcctcct

SEQ ID NO: 8117035 - DNA, 22 bp, Homo sapiens
acagaactgtgatctcataaat

SEQ ID NO: 8117036 - DNA, 22 bp, Homo sapiens
acagaactgcagacagtgccaa

SEQ ID NO: 8117037 - DNA, 22 bp, Homo sapiens
acagaactgcaggaggaaaagc

SEQ ID NO: 8117038 - DNA, 20 bp, Homo sapiens
acagaactgagaacagtctc

SEQ ID NO: 8117039 - DNA, 22 bp, Homo sapiens
aagccctgagcactgcagagaa

SEQ ID NO: 8117040 - DNA, 22 bp, Homo sapiens
acaggctctggggcaggatggc

SEQ ID NO: 8117041 - DNA, 22 bp, Homo sapiens
aagccctggcgggtggagggcc

SEQ ID NO: 8117042 - DNA, 22 bp, Homo sapiens
aagccctggcaatgtcagatga

SEQ ID NO: 8117043 - DNA, 22 bp, Homo sapiens
aagccctggattaaagatgcca

SEQ ID NO: 8117044 - DNA, 22 bp, Homo sapiens
acaggaaccaggcaggtcgatt

SEQ ID NO: 8117045 - DNA, 22 bp, Homo sapiens
acagcaaaagacaagaacttaa

SEQ ID NO: 8117046 - DNA, 22 bp, Homo sapiens
acagtgcattattgctgaatgc

SEQ ID NO: 8117047 - DNA, 22 bp, Homo sapiens
acaggtgaagtattacactaag

SEQ ID NO: 8117048 - DNA, 23 bp, Homo sapiens
acaggctcttaatcagtgctcct

SEQ ID NO: 8117049 - DNA, 22 bp, Homo sapiens
acaggctgaaagttaagttctg

SEQ ID NO: 8117050 - DNA, 22 bp, Homo sapiens
acaggctgaggatgattgcatc

SEQ ID NO: 8117051 - DNA, 22 bp, Homo sapiens
acaggctgacttcctgccatgt

SEQ ID NO: 8117052 - DNA, 22 bp, Homo sapiens
acaggctgagcgtccatcttca

SEQ ID NO: 8117053 - DNA, 22 bp, Homo sapiens
acaggctgttggggtccagggt

SEQ ID NO: 8117054 - DNA, 22 bp, Homo sapiens
acaggctgatagaccataaata

SEQ ID NO: 8117055 - DNA, 22 bp, Homo sapiens
aaggtgtcactgggacaggaaa

SEQ ID NO: 8117056 - DNA, 22 bp, Homo sapiens
aagggcagcctgactcacggtc

SEQ ID NO: 8117057 - DNA, 22 bp, Homo sapiens
aagggcagctgacagatgctta

SEQ ID NO: 8117058 - DNA, 22 bp, Homo sapiens
accaccccagaatttttcaagg

SEQ ID NO: 8117059 - DNA, 22 bp, Homo sapiens
aaggccagctggagggatgagg

SEQ ID NO: 8117060 - DNA, 22 bp, Homo sapiens
aaggccagcttgtagggctggt

SEQ ID NO: 8117061 - DNA, 22 bp, Homo sapiens
acatggtgtgctgagaatgaca

SEQ ID NO: 8117062 - DNA, 22 bp, Homo sapiens
aaggccagccttggaaccctga

SEQ ID NO: 8117063 - DNA, 22 bp, Homo sapiens
aaggccaggcctagcacggagg

SEQ ID NO: 8117064 - DNA, 22 bp, Homo sapiens
acataatggacaataatgcatc

SEQ ID NO: 8117065 - DNA, 22 bp, Homo sapiens
aatcttctttcttaacagtaca

SEQ ID NO: 8117066 - DNA, 22 bp, Homo sapiens
aatcttctttcttaacagtaca

SEQ ID NO: 8117067 - DNA, 22 bp, Homo sapiens
aatcttaaagaatattctacca

SEQ ID NO: 8117068 - DNA, 22 bp, Homo sapiens
aatatgatgccaaattgctaca

SEQ ID NO: 8117069 - DNA, 22 bp, Homo sapiens
aatatgtgaggtatgttcagtg

SEQ ID NO: 8117070 - DNA, 22 bp, Homo sapiens
aatatgttccacttaaagctgg

SEQ ID NO: 8117071 - DNA, 20 bp, Homo sapiens
agaaaatgttttcagctgga

SEQ ID NO: 8117072 - DNA, 20 bp, Homo sapiens
agaaaatgttttcagctgga

SEQ ID NO: 8117073 - DNA, 22 bp, Homo sapiens
aatatcttctaaggatagaact

SEQ ID NO: 8117074 - DNA, 22 bp, Homo sapiens
acttcccactgcagtgactgag

SEQ ID NO: 8117075 - DNA, 22 bp, Homo sapiens
acttccagtgtctgctgctagc

SEQ ID NO: 8117076 - DNA, 22 bp, Homo sapiens
acttccagctgccctgtgtgct

SEQ ID NO: 8117077 - DNA, 22 bp, Homo sapiens
actgtctgctggcccctggtta

SEQ ID NO: 8117078 - DNA, 19 bp, Homo sapiens
actgtgctcgggaaccact

SEQ ID NO: 8117079 - DNA, 21 bp, Homo sapiens
aataaccactaatatagtggc

SEQ ID NO: 8117080 - DNA, 22 bp, Homo sapiens
actgtggctcagggaatgcatg

SEQ ID NO: 8117081 - DNA, 22 bp, Homo sapiens
actgtggcgtcaggaagaaatt

SEQ ID NO: 8117082 - DNA, 22 bp, Homo sapiens
actgtggcaaagaagcaggctc

SEQ ID NO: 8117083 - DNA, 22 bp, Homo sapiens
actgtgctggagccctctggag

SEQ ID NO: 8117084 - DNA, 22 bp, Homo sapiens
aagtggctttgagcttctgcca

SEQ ID NO: 8117085 - DNA, 22 bp, Homo sapiens
aagtggctcatgtggcttctgc

SEQ ID NO: 8117086 - DNA, 22 bp, Homo sapiens
aagttttaacaagtacttacta

SEQ ID NO: 8117087 - DNA, 23 bp, Homo sapiens
actcatccttgatttgcagatgt

SEQ ID NO: 8117088 - DNA, 19 bp, Homo sapiens
actcatctgccacctctgt

SEQ ID NO: 8117089 - DNA, 23 bp, Homo sapiens
actcagagaccccgggaagtgac

SEQ ID NO: 8117090 - DNA, 22 bp, Homo sapiens
actcagtacatctggagttggc

SEQ ID NO: 8117091 - DNA, 22 bp, Homo sapiens
actcatgtaagcggaatgtagt

SEQ ID NO: 8117092 - DNA, 22 bp, Homo sapiens
actcatctgccattcctgtacc

SEQ ID NO: 8117093 - DNA, 21 bp, Homo sapiens
actcatctttttggagaccag

SEQ ID NO: 8117094 - DNA, 22 bp, Homo sapiens
aagtggaggccgagttcacgca

SEQ ID NO: 8117095 - DNA, 22 bp, Homo sapiens
aagtggagtccctacaaccagc

SEQ ID NO: 8117096 - DNA, 22 bp, Homo sapiens
actgagaaatagcaagtgtctc

SEQ ID NO: 8117097 - DNA, 22 bp, Homo sapiens
aagttttattggctatagcact

SEQ ID NO: 8117098 - DNA, 22 bp, Homo sapiens
actgactgtcagtggaaggcta

SEQ ID NO: 8117099 - DNA, 22 bp, Homo sapiens
actgactgtggatggcagcagc

SEQ ID NO: 8117100 - DNA, 22 bp, Homo sapiens
actgactcttgttaacttcagc

SEQ ID NO: 8117101 - DNA, 22 bp, Homo sapiens
actgagaaagaccacatggaga

SEQ ID NO: 8117102 - DNA, 22 bp, Homo sapiens
aagtgaaattgccattcttata

SEQ ID NO: 8117103 - DNA, 22 bp, Homo sapiens
aagtgaataccatcaagagctt

SEQ ID NO: 8117104 - DNA, 22 bp, Homo sapiens
aagtgacataccttacatatgt

SEQ ID NO: 8117105 - DNA, 22 bp, Homo sapiens
aagtgatttagtcttataaagg

SEQ ID NO: 8117106 - DNA, 21 bp, Homo sapiens
aagtaaatcagagaaataacc

SEQ ID NO: 8117107 - DNA, 22 bp, Homo sapiens
aagtaacacatgttacttctgc

SEQ ID NO: 8117108 - DNA, 18 bp, Homo sapiens
aagtaacagaagagcaca

SEQ ID NO: 8117109 - DNA, 22 bp, Homo sapiens
acctggcttctaatcatggctc

SEQ ID NO: 8117110 - DNA, 22 bp, Homo sapiens
acctgcctctaagcagcaggtg

SEQ ID NO: 8117111 - DNA, 22 bp, Homo sapiens
accttgcagtggaggtttagtg

SEQ ID NO: 8117112 - DNA, 17 bp, Homo sapiens
accttgcagtgtgccgg

SEQ ID NO: 8117113 - DNA, 22 bp, Homo sapiens
acctggcttgtttctacctcct

SEQ ID NO: 8117114 - DNA, 23 bp, Homo sapiens
agctagcataatgtctggctcct

SEQ ID NO: 8117115 - DNA, 22 bp, Homo sapiens
agcctgggaatttagagttcgg

SEQ ID NO: 8117116 - DNA, 17 bp, Homo sapiens
agcctgggaaggagtga

SEQ ID NO: 8117117 - DNA, 22 bp, Homo sapiens
agcctgggagacactaagttgt

SEQ ID NO: 8117118 - DNA, 22 bp, Homo sapiens
agcctgggcaacaacacagcga

SEQ ID NO: 8117119 - DNA, 22 bp, Homo sapiens
agcctgggcaacagagcaaaac

SEQ ID NO: 8117120 - DNA, 22 bp, Homo sapiens
agcctgggcaactccattcact

SEQ ID NO: 8117121 - DNA, 21 bp, Homo sapiens
agcctgggaggcggaggttgc

SEQ ID NO: 8117122 - DNA, 22 bp, Homo sapiens
agcctggcttagctctctcact

SEQ ID NO: 8117123 - DNA, 19 bp, Homo sapiens
agcctggctttgctctgct

SEQ ID NO: 8117124 - DNA, 22 bp, Homo sapiens
cagcaacatatatgaaactgtg

SEQ ID NO: 8117125 - DNA, 22 bp, Homo sapiens
cagcaactggtcattgctctcc

SEQ ID NO: 8117126 - DNA, 21 bp, Homo sapiens
agcctgggtatcctttgagga

SEQ ID NO: 8117127 - DNA, 22 bp, Homo sapiens
agcctgggttagggttcttccc

SEQ ID NO: 8117128 - DNA, 22 bp, Homo sapiens
agcctgggtgggggttcggaga

SEQ ID NO: 8117129 - DNA, 22 bp, Homo sapiens
agcctgggtttttattaaggag

SEQ ID NO: 8117130 - DNA, 22 bp, Homo sapiens
agctaagacttagtgacttagt

SEQ ID NO: 8117131 - DNA, 22 bp, Homo sapiens
agcctggggcacttctccaaac

SEQ ID NO: 8117132 - DNA, 18 bp, Homo sapiens
agcctgggctctgcctgg

SEQ ID NO: 8117133 - DNA, 20 bp, Homo sapiens
agcctggggaattccacccc

SEQ ID NO: 8117134 - DNA, 22 bp, Homo sapiens
agcctgggggcgcagaaaccgg

SEQ ID NO: 8117135 - DNA, 22 bp, Homo sapiens
agcctggggtttcagtttgcac

SEQ ID NO: 8117136 - DNA, 23 bp, Homo sapiens
agcctgggtagcctaaataacag

SEQ ID NO: 8117137 - DNA, 22 bp, Homo sapiens
agcctgggcctggcttcccgcc

SEQ ID NO: 8117138 - DNA, 22 bp, Homo sapiens
agcctgggccctgcctcttctc

SEQ ID NO: 8117139 - DNA, 22 bp, Homo sapiens
agcctgggcatgggacgggagg

SEQ ID NO: 8117140 - DNA, 22 bp, Homo sapiens
agccagagttgaatgtgagtct

SEQ ID NO: 8117141 - DNA, 22 bp, Homo sapiens
cactttctcatgaatttggccc

SEQ ID NO: 8117142 - DNA, 22 bp, Homo sapiens
agccagcaggtgagtgcagcct

SEQ ID NO: 8117143 - DNA, 22 bp, Homo sapiens
agccaggccagactcacaccct

SEQ ID NO: 8117144 - DNA, 17 bp, Homo sapiens
agccaggcatatgaagt

SEQ ID NO: 8117145 - DNA, 22 bp, Homo sapiens
cagagacattaagtgccatgat

SEQ ID NO: 8117146 - DNA, 22 bp, Homo sapiens
cagagacatgtggcctgcacgt

SEQ ID NO: 8117147 - DNA, 22 bp, Homo sapiens
agccaggccttttctcaaggtt

SEQ ID NO: 8117148 - DNA, 22 bp, Homo sapiens
cagagcccagggcctacgtccc

SEQ ID NO: 8117149 - DNA, 22 bp, Homo sapiens
agccaggccagctgtcttgagt

SEQ ID NO: 8117150 - DNA, 20 bp, Homo sapiens
agccaggcctcaagttaagt

SEQ ID NO: 8117151 - DNA, 22 bp, Homo sapiens
agccaggccttagggagaggca

SEQ ID NO: 8117152 - DNA, 22 bp, Homo sapiens
agccagtgggattagagcctct

SEQ ID NO: 8117153 - DNA, 22 bp, Homo sapiens
agccagtgttaagtgactggtt

SEQ ID NO: 8117154 - DNA, 22 bp, Homo sapiens
agcccagggacagggcggatgt

SEQ ID NO: 8117155 - DNA, 22 bp, Homo sapiens
agccagtttccagatattaact

SEQ ID NO: 8117156 - DNA, 20 bp, Homo sapiens
agcccatctcccacagctac

SEQ ID NO: 8117157 - DNA, 22 bp, Homo sapiens
agccccacactctctctgagaa

SEQ ID NO: 8117158 - DNA, 20 bp, Homo sapiens
agccccacccttgtcctggc

SEQ ID NO: 8117159 - DNA, 22 bp, Homo sapiens
agccccacgttgtctagcacct

SEQ ID NO: 8117160 - DNA, 22 bp, Homo sapiens
agccctgcgtgccaggggactg

SEQ ID NO: 8117161 - DNA, 22 bp, Homo sapiens
agcaggaaggctttgggggttc

SEQ ID NO: 8117162 - DNA, 22 bp, Homo sapiens
agcaggaactgacaccaagcca

SEQ ID NO: 8117163 - DNA, 22 bp, Homo sapiens
agcaggaactcagggagttctc

SEQ ID NO: 8117164 - DNA, 22 bp, Homo sapiens
agcaggaaggggatgatgggca

SEQ ID NO: 8117165 - DNA, 22 bp, Homo sapiens
agcaggaaggtctgtgtgagtc

SEQ ID NO: 8117166 - DNA, 22 bp, Homo sapiens
agcaggaaggggcctagcctgg

SEQ ID NO: 8117167 - DNA, 22 bp, Homo sapiens
agcaggaaggtctgtgtgagtc

SEQ ID NO: 8117168 - DNA, 20 bp, Homo sapiens
agcaggaatgatgctttcat

SEQ ID NO: 8117169 - DNA, 22 bp, Homo sapiens
agcaggaatctgttctgtataa

SEQ ID NO: 8117170 - DNA, 22 bp, Homo sapiens
agcaggaagtcctctcaggaga

SEQ ID NO: 8117171 - DNA, 22 bp, Homo sapiens
agcaggaagtagtctgtaagca

SEQ ID NO: 8117172 - DNA, 22 bp, Homo sapiens
cacagcaagagctaaatgacca

SEQ ID NO: 8117173 - DNA, 20 bp, Homo sapiens
caccagcagcagctgccacc

SEQ ID NO: 8117174 - DNA, 22 bp, Homo sapiens
agcagggcagctgatgcgcacg

SEQ ID NO: 8117175 - DNA, 22 bp, Homo sapiens
agcagggcactggaaggcactg

SEQ ID NO: 8117176 - DNA, 22 bp, Homo sapiens
cactgttttattccaacatagg

SEQ ID NO: 8117177 - DNA, 22 bp, Homo sapiens
cactgttgagcaatgtacagtg

SEQ ID NO: 8117178 - DNA, 22 bp, Homo sapiens
cactggtgacttctgagctgga

SEQ ID NO: 8117179 - DNA, 22 bp, Homo sapiens
agcatgaaagcataggacagtc

SEQ ID NO: 8117180 - DNA, 22 bp, Homo sapiens
agcatggggcaatgcatgtgct

SEQ ID NO: 8117181 - DNA, 18 bp, Homo sapiens
agcaggttctcacagcca

SEQ ID NO: 8117182 - DNA, 22 bp, Homo sapiens
agcagggctggggcacgagcca

SEQ ID NO: 8117183 - DNA, 22 bp, Homo sapiens
agcagtgagtgggaggaccatg

SEQ ID NO: 8117184 - DNA, 22 bp, Homo sapiens
agcatgaaagcataggacagtc

SEQ ID NO: 8117185 - DNA, 22 bp, Homo sapiens
agcatattgtatgtctatatgt

SEQ ID NO: 8117186 - DNA, 22 bp, Homo sapiens
agcatgaagacttcagagctag

SEQ ID NO: 8117187 - DNA, 22 bp, Homo sapiens
agcatgaaaggcgtgccaactt

SEQ ID NO: 8117188 - DNA, 21 bp, Homo sapiens
agcagaggcagaatgtatgca

SEQ ID NO: 8117189 - DNA, 22 bp, Homo sapiens
agcactgtgatttataacattt

SEQ ID NO: 8117190 - DNA, 22 bp, Homo sapiens
agcagaggtttgttggaaacct

SEQ ID NO: 8117191 - DNA, 22 bp, Homo sapiens
agcagaggtgtttattatggga

SEQ ID NO: 8117192 - DNA, 22 bp, Homo sapiens
caataatatcctgtgctgtttg

SEQ ID NO: 8117193 - DNA, 22 bp, Homo sapiens
agcactcctgtctttccccttt

SEQ ID NO: 8117194 - DNA, 22 bp, Homo sapiens
agcactgctttagagcctctgc

SEQ ID NO: 8117195 - DNA, 22 bp, Homo sapiens
agcacctgtgttcatgcctcat

SEQ ID NO: 8117196 - DNA, 22 bp, Homo sapiens
caaagggcggctgtcggagggt

SEQ ID NO: 8117197 - DNA, 22 bp, Homo sapiens
caaagggcattttagtgaactg

SEQ ID NO: 8117198 - DNA, 20 bp, Homo sapiens
agcaccagtgggggcagccc

SEQ ID NO: 8117199 - DNA, 22 bp, Homo sapiens
agcacctgtcacaagcagaagg

SEQ ID NO: 8117200 - DNA, 22 bp, Homo sapiens
caaagggcatggcctgagcact

SEQ ID NO: 8117201 - DNA, 22 bp, Homo sapiens
caaagggaaacgcagtgtcaag

SEQ ID NO: 8117202 - DNA, 22 bp, Homo sapiens
caaagggaaaagccatgtgggc

SEQ ID NO: 8117203 - DNA, 22 bp, Homo sapiens
cacagagagctacgtgcagcgt

SEQ ID NO: 8117204 - DNA, 22 bp, Homo sapiens
agaatatagttaccaaattctg

SEQ ID NO: 8117205 - DNA, 22 bp, Homo sapiens
agaatatagttaccaaattctg

SEQ ID NO: 8117206 - DNA, 22 bp, Homo sapiens
agaatatgatggttggagaatt

SEQ ID NO: 8117207 - DNA, 22 bp, Homo sapiens
agaatatgattcagaccattag

SEQ ID NO: 8117208 - DNA, 22 bp, Homo sapiens
agaatattcatctgtattctta

SEQ ID NO: 8117209 - DNA, 22 bp, Homo sapiens
agaatatcgtagcatattatct

SEQ ID NO: 8117210 - DNA, 22 bp, Homo sapiens
agaatatgaggaaactgtgaat

SEQ ID NO: 8117211 - DNA, 22 bp, Homo sapiens
agaatatgatcggaatacagat

SEQ ID NO: 8117212 - DNA, 22 bp, Homo sapiens
atgaagctggttttggcttggg

SEQ ID NO: 8117213 - DNA, 22 bp, Homo sapiens
atgaagctgaccttgtcttgct

SEQ ID NO: 8117214 - DNA, 22 bp, Homo sapiens
atgaagtctctttttcatgaga

SEQ ID NO: 8117215 - DNA, 22 bp, Homo sapiens
atgaagtctagcaagcattgaa

SEQ ID NO: 8117216 - DNA, 22 bp, Homo sapiens
atgaagctaaaccctgcagcca

SEQ ID NO: 8117217 - DNA, 22 bp, Homo sapiens
atgaacaatgactacatattga

SEQ ID NO: 8117218 - DNA, 20 bp, Homo sapiens
atctgctgagaatgaaaggc

SEQ ID NO: 8117219 - DNA, 18 bp, Homo sapiens
atctgctggcaggtctgg

SEQ ID NO: 8117220 - DNA, 22 bp, Homo sapiens
atctgctgttcttcacagcttg

SEQ ID NO: 8117221 - DNA, 22 bp, Homo sapiens
agacaagactaggcagttgttg

SEQ ID NO: 8117222 - DNA, 23 bp, Homo sapiens
agacactgtaaagaattgcagtt

SEQ ID NO: 8117223 - DNA, 22 bp, Homo sapiens
agacactgttctcacatgcttg

SEQ ID NO: 8117224 - DNA, 22 bp, Homo sapiens
agacagaaataggagaaaccag

SEQ ID NO: 8117225 - DNA, 22 bp, Homo sapiens
atgagggaggcaaggagatgct

SEQ ID NO: 8117226 - DNA, 22 bp, Homo sapiens
agaatattgaaagttcttgaca

SEQ ID NO: 8117227 - DNA, 22 bp, Homo sapiens
atgcctgtctcagggtctgttt

SEQ ID NO: 8117228 - DNA, 20 bp, Homo sapiens
atgccaagctatctagaatc

SEQ ID NO: 8117229 - DNA, 22 bp, Homo sapiens
atgcaggttggatcctatgccc

SEQ ID NO: 8117230 - DNA, 22 bp, Homo sapiens
atgcatatgtacccatgttctg

SEQ ID NO: 8117231 - DNA, 22 bp, Homo sapiens
atgatatacttcctagaacagt

SEQ ID NO: 8117232 - DNA, 22 bp, Homo sapiens
atgcatattttctactatatcg

SEQ ID NO: 8117233 - DNA, 21 bp, Homo sapiens
atgcatattttaagttgtgtc

SEQ ID NO: 8117234 - DNA, 22 bp, Homo sapiens
atgcatattgtcatttagtcct

SEQ ID NO: 8117235 - DNA, 22 bp, Homo sapiens
atgcatatgtacccatgttctg

SEQ ID NO: 8117236 - DNA, 22 bp, Homo sapiens
atgcatttttgagtatgaatga

SEQ ID NO: 8117237 - DNA, 22 bp, Homo sapiens
agagagaagcaatcagtggcca

SEQ ID NO: 8117238 - DNA, 22 bp, Homo sapiens
agagacagacacatcgggctgc

SEQ ID NO: 8117239 - DNA, 22 bp, Homo sapiens
agagacaatgccaatgcacacg

SEQ ID NO: 8117240 - DNA, 22 bp, Homo sapiens
agagaattctggtgctaacaag

SEQ ID NO: 8117241 - DNA, 22 bp, Homo sapiens
agagaattaacattccatggct

SEQ ID NO: 8117242 - DNA, 22 bp, Homo sapiens
agagagggcatagaaaaaggga

SEQ ID NO: 8117243 - DNA, 22 bp, Homo sapiens
agagagggcatagaaaaaggga

SEQ ID NO: 8117244 - DNA, 21 bp, Homo sapiens
agagagggagatgaaacatcc

SEQ ID NO: 8117245 - DNA, 19 bp, Homo sapiens
agagaggctgtgtgaggga

SEQ ID NO: 8117246 - DNA, 22 bp, Homo sapiens
agagagggaatatttggggtat

SEQ ID NO: 8117247 - DNA, 22 bp, Homo sapiens
agacttgatgttaaaagaaact

SEQ ID NO: 8117248 - DNA, 18 bp, Homo sapiens
agactttgagttagaggg

SEQ ID NO: 8117249 - DNA, 22 bp, Homo sapiens
agacttcaaagcctttgttcat

SEQ ID NO: 8117250 - DNA, 22 bp, Homo sapiens
agacttcactcccagagattct

SEQ ID NO: 8117251 - DNA, 22 bp, Homo sapiens
agacttatgcttcaaatagtaa

SEQ ID NO: 8117252 - DNA, 19 bp, Homo sapiens
agagaaggatcctatggtt

SEQ ID NO: 8117253 - DNA, 22 bp, Homo sapiens
agagaaggaaagctgacatggg

SEQ ID NO: 8117254 - DNA, 22 bp, Homo sapiens
agagaaggggtaaagagtcctg

SEQ ID NO: 8117255 - DNA, 22 bp, Homo sapiens
agagaatgcagggcttcggaca

SEQ ID NO: 8117256 - DNA, 22 bp, Homo sapiens
agagaaggtcactaaggaccca

SEQ ID NO: 8117257 - DNA, 22 bp, Homo sapiens
agagctggcagcagcttctcct

SEQ ID NO: 8117258 - DNA, 22 bp, Homo sapiens
agagctggaatcagacctcagg

SEQ ID NO: 8117259 - DNA, 22 bp, Homo sapiens
agagccctggagggcagtcccg

SEQ ID NO: 8117260 - DNA, 22 bp, Homo sapiens
agagagttctttctagttgaag

SEQ ID NO: 8117261 - DNA, 22 bp, Homo sapiens
agagcagatggagctggaagag

SEQ ID NO: 8117262 - DNA, 22 bp, Homo sapiens
agagcagatggagctggaagag

SEQ ID NO: 8117263 - DNA, 22 bp, Homo sapiens
agagcagatttcaaatattggc

SEQ ID NO: 8117264 - DNA, 22 bp, Homo sapiens
agagcccagtgacatcagcaca

SEQ ID NO: 8117265 - DNA, 20 bp, Homo sapiens
agcaacaataaaatgtcctg

SEQ ID NO: 8117266 - DNA, 22 bp, Homo sapiens
agcaaatcagctgctcaggaaa

SEQ ID NO: 8117267 - DNA, 22 bp, Homo sapiens
attttatctgcttactttcagg

SEQ ID NO: 8117268 - DNA, 22 bp, Homo sapiens
attttatctgcttactttcagg

SEQ ID NO: 8117269 - DNA, 22 bp, Homo sapiens
attttcaccctgaatatattga

SEQ ID NO: 8117270 - DNA, 23 bp, Homo sapiens
caaagatgattggaacatggctt

SEQ ID NO: 8117271 - DNA, 20 bp, Homo sapiens
agcaagagtaaggacagcga

SEQ ID NO: 8117272 - DNA, 20 bp, Homo sapiens
agcaagagtaaggacagcga

SEQ ID NO: 8117273 - DNA, 20 bp, Homo sapiens
agcaagagtaaggacagcga

SEQ ID NO: 8117274 - DNA, 19 bp, Homo sapiens
agatggcaaaatgcaaaga

SEQ ID NO: 8117275 - DNA, 22 bp, Homo sapiens
agatggctgatataaagataag

SEQ ID NO: 8117276 - DNA, 22 bp, Homo sapiens
agatcacagtggcaactccctt

SEQ ID NO: 8117277 - DNA, 22 bp, Homo sapiens
agatcactggttacttaatgaa

SEQ ID NO: 8117278 - DNA, 23 bp, Homo sapiens
agatcacatagttatcagatgac

SEQ ID NO: 8117279 - DNA, 22 bp, Homo sapiens
agatattttgtgtgatgtttca

SEQ ID NO: 8117280 - DNA, 22 bp, Homo sapiens
attggccatttgcatgtattat

SEQ ID NO: 8117281 - DNA, 22 bp, Homo sapiens
agagtggcagcaaaaagtgtgc

SEQ ID NO: 8117282 - DNA, 21 bp, Homo sapiens
agagtggcaaagtgtccaaga

SEQ ID NO: 8117283 - DNA, 22 bp, Homo sapiens
agagtggagagaaacaactctg

SEQ ID NO: 8117284 - DNA, 22 bp, Homo sapiens
attggggagagctaatatttta

SEQ ID NO: 8117285 - DNA, 18 bp, Homo sapiens
agaggggaggtaagtctg

SEQ ID NO: 8117286 - DNA, 22 bp, Homo sapiens
agaggggagtcctaatctgatt

SEQ ID NO: 8117287 - DNA, 22 bp, Homo sapiens
agaggggcaagtaaagagtctt

SEQ ID NO: 8117288 - DNA, 22 bp, Homo sapiens
agaggggcgggaactcaacctc

SEQ ID NO: 8117289 - DNA, 22 bp, Homo sapiens
agaggggcccggttctccgtct

SEQ ID NO: 8117290 - DNA, 22 bp, Homo sapiens
agaggggcagggtctccggatt

SEQ ID NO: 8117291 - DNA, 22 bp, Homo sapiens
agaggggaggcgaaccagagtc

SEQ ID NO: 8117292 - DNA, 22 bp, Homo sapiens
agaggggaggcgaaccagagtc

SEQ ID NO: 8117293 - DNA, 22 bp, Homo sapiens
agaggggagagctaagcaattc

SEQ ID NO: 8117294 - DNA, 22 bp, Homo sapiens
agaggggacagccacctgcccg

SEQ ID NO: 8117295 - DNA, 22 bp, Homo sapiens
agaggggaagtaatgaatgata

SEQ ID NO: 8117296 - DNA, 22 bp, Homo sapiens
agagggcttccctaggagtgag

SEQ ID NO: 8117297 - DNA, 19 bp, Homo sapiens
agagtattgaatttgccct

SEQ ID NO: 8117298 - DNA, 19 bp, Homo sapiens
agagtattgaatttgccct

SEQ ID NO: 8117299 - DNA, 22 bp, Homo sapiens
agagtccagaaaacagtgtgct

SEQ ID NO: 8117300 - DNA, 22 bp, Homo sapiens
agagtcagcttatgacacagtc

SEQ ID NO: 8117301 - DNA, 22 bp, Homo sapiens
agagtcagaaagcagacagggg

SEQ ID NO: 8117302 - DNA, 22 bp, Homo sapiens
agagtctgaggcagctgcagcc

SEQ ID NO: 8117303 - DNA, 22 bp, Homo sapiens
agagtccaggtgggctggaggc

SEQ ID NO: 8117304 - DNA, 22 bp, Homo sapiens
agagtgcccaagcctggcaggg

SEQ ID NO: 8117305 - DNA, 22 bp, Homo sapiens
agagtgcaaccgaaacaagcag

SEQ ID NO: 8117306 - DNA, 20 bp, Homo sapiens
agagtgagactccatctcag

SEQ ID NO: 8117307 - DNA, 22 bp, Homo sapiens
agaggcacccgcgcgcggccat

SEQ ID NO: 8117308 - DNA, 22 bp, Homo sapiens
agaggcacggaggctgcatgga

SEQ ID NO: 8117309 - DNA, 22 bp, Homo sapiens
agaggcactaagggaagagcag

SEQ ID NO: 8117310 - DNA, 22 bp, Homo sapiens
attacagaatgcagttccttat

SEQ ID NO: 8117311 - DNA, 22 bp, Homo sapiens
attacagagtcttgggaggtca

SEQ ID NO: 8117312 - DNA, 22 bp, Homo sapiens
attacagagggtcggtcgtttt

SEQ ID NO: 8117313 - DNA, 22 bp, Homo sapiens
attacagaaagcaatattgagt

SEQ ID NO: 8117314 - DNA, 22 bp, Homo sapiens
agagctggctgtgggtgacttt

SEQ ID NO: 8117315 - DNA, 22 bp, Homo sapiens
agaggcacaacagtcccattgt

SEQ ID NO: 8117316 - DNA, 22 bp, Homo sapiens
agaggcacagaggcagtcccct

SEQ ID NO: 8117317 - DNA, 22 bp, Homo sapiens
agaggccaccttctcttgagaa

SEQ ID NO: 8117318 - DNA, 23 bp, Homo sapiens
agaggccagcctttggagacacc

SEQ ID NO: 8117319 - DNA, 23 bp, Homo sapiens
agaggccagcctttggagacacc

SEQ ID NO: 8117320 - DNA, 22 bp, Homo sapiens
agaggctggattgagcatagac

SEQ ID NO: 8117321 - DNA, 18 bp, Homo sapiens
agaggctggacaggggat

SEQ ID NO: 8117322 - DNA, 17 bp, Homo sapiens
aggagggaaatagcttg

SEQ ID NO: 8117323 - DNA, 22 bp, Homo sapiens
aggagggaataagaaagagtca

SEQ ID NO: 8117324 - DNA, 20 bp, Homo sapiens
aggagggacctggattggcg

SEQ ID NO: 8117325 - DNA, 22 bp, Homo sapiens
aggagggacaccaatatatgtt

SEQ ID NO: 8117326 - DNA, 22 bp, Homo sapiens
aggagggacctaggaatattgc

SEQ ID NO: 8117327 - DNA, 22 bp, Homo sapiens
aggaggggcatagaaatgtaat

SEQ ID NO: 8117328 - DNA, 22 bp, Homo sapiens
aggagggagatgcccatcctgg

SEQ ID NO: 8117329 - DNA, 21 bp, Homo sapiens
aggaggggtctttcccactga

SEQ ID NO: 8117330 - DNA, 22 bp, Homo sapiens
aggaggggttctcgggtgctga

SEQ ID NO: 8117331 - DNA, 18 bp, Homo sapiens
aggcacagagcatacata

SEQ ID NO: 8117332 - DNA, 22 bp, Homo sapiens
aggcacagagaatgccctccat

SEQ ID NO: 8117333 - DNA, 22 bp, Homo sapiens
acaggggtgcatggtgcatggt

SEQ ID NO: 8117334 - DNA, 22 bp, Homo sapiens
acagggtgactttgtgacagat

SEQ ID NO: 8117335 - DNA, 20 bp, Homo sapiens
aggagccattgactgcagca

SEQ ID NO: 8117336 - DNA, 22 bp, Homo sapiens
aggactttaacatattaactgt

SEQ ID NO: 8117337 - DNA, 23 bp, Homo sapiens
aggagacagggaagtgcctggct

SEQ ID NO: 8117338 - DNA, 17 bp, Homo sapiens
aggaagggcaagtttct

SEQ ID NO: 8117339 - DNA, 22 bp, Homo sapiens
aggaagggatacataggatagt

SEQ ID NO: 8117340 - DNA, 22 bp, Homo sapiens
aggaagggatacataggatagt

SEQ ID NO: 8117341 - DNA, 17 bp, Homo sapiens
aggaagggcaagtttct

SEQ ID NO: 8117342 - DNA, 22 bp, Homo sapiens
aggagacatggaatagtgaggc

SEQ ID NO: 8117343 - DNA, 22 bp, Homo sapiens
aggagacatactataggaatat

SEQ ID NO: 8117344 - DNA, 22 bp, Homo sapiens
aggagacataactatgatgaga

SEQ ID NO: 8117345 - DNA, 22 bp, Homo sapiens
aggaagcccaagtctcatcttc

SEQ ID NO: 8117346 - DNA, 22 bp, Homo sapiens
aggaagcctggcattaaaaagc

SEQ ID NO: 8117347 - DNA, 22 bp, Homo sapiens
aggaagggagcagtttgttgtt

SEQ ID NO: 8117348 - DNA, 22 bp, Homo sapiens
aggaagccatggtggacgtcta

SEQ ID NO: 8117349 - DNA, 22 bp, Homo sapiens
aggaagagcattcacatggtag

SEQ ID NO: 8117350 - DNA, 18 bp, Homo sapiens
aggaaagaaaggcaggtg

SEQ ID NO: 8117351 - DNA, 19 bp, Homo sapiens
agcttttactaacagcaga

SEQ ID NO: 8117352 - DNA, 22 bp, Homo sapiens
aggaaaaaagtctgtgattata

SEQ ID NO: 8117353 - DNA, 22 bp, Homo sapiens
agctgggatgaggagcatcctt

SEQ ID NO: 8117354 - DNA, 22 bp, Homo sapiens
agctgggatgaggagcatcctt

SEQ ID NO: 8117355 - DNA, 22 bp, Homo sapiens
agctgggaggctcctctgtgac

SEQ ID NO: 8117356 - DNA, 19 bp, Homo sapiens
agctggctcttctttgtct

SEQ ID NO: 8117357 - DNA, 22 bp, Homo sapiens
agctgggactcaactgtctggg

SEQ ID NO: 8117358 - DNA, 21 bp, Homo sapiens
agctggctctctctggagaga

SEQ ID NO: 8117359 - DNA, 22 bp, Homo sapiens
agctgtggtgttttcaagccct

SEQ ID NO: 8117360 - DNA, 22 bp, Homo sapiens
agctgcagctacagtgttggtt

SEQ ID NO: 8117361 - DNA, 22 bp, Homo sapiens
agctgcaggagtcgcctaggat

SEQ ID NO: 8117362 - DNA, 22 bp, Homo sapiens
agctgcaggattatggaatgga

SEQ ID NO: 8117363 - DNA, 23 bp, Homo sapiens
acagccagttcacctctccttgg

SEQ ID NO: 8117364 - DNA, 22 bp, Homo sapiens
agctgcagccctcctgcatggc

SEQ ID NO: 8117365 - DNA, 22 bp, Homo sapiens
acagcccaagtcacctgcagga

SEQ ID NO: 8117366 - DNA, 22 bp, Homo sapiens
agctgcagcctcatgattcggt

SEQ ID NO: 8117367 - DNA, 22 bp, Homo sapiens
agctgcagccgcagctgtggcc

SEQ ID NO: 8117368 - DNA, 22 bp, Homo sapiens
agctcccagaagccagagtcgg

SEQ ID NO: 8117369 - DNA, 22 bp, Homo sapiens
acagcccagctctttctctgca

SEQ ID NO: 8117370 - DNA, 22 bp, Homo sapiens
acagcctgagagtggagctggc

SEQ ID NO: 8117371 - DNA, 22 bp, Homo sapiens
agctggctatgccctgtgaacc

SEQ ID NO: 8117372 - DNA, 22 bp, Homo sapiens
agctggccttcggtgtcactgg

SEQ ID NO: 8117373 - DNA, 22 bp, Homo sapiens
agctggccttagtgagcacctg

SEQ ID NO: 8117374 - DNA, 22 bp, Homo sapiens
accctggcctggttcatgtgat

SEQ ID NO: 8117375 - DNA, 22 bp, Homo sapiens
accctggcccattgctgtgcct

SEQ ID NO: 8117376 - DNA, 18 bp, Homo sapiens
accctctggcttctgagc

SEQ ID NO: 8117377 - DNA, 22 bp, Homo sapiens
accctctgccttgagcagtgcc

SEQ ID NO: 8117378 - DNA, 22 bp, Homo sapiens
acccattcctctcctgagggat

SEQ ID NO: 8117379 - DNA, 22 bp, Homo sapiens
acccattcctttacttcatctg

SEQ ID NO: 8117380 - DNA, 22 bp, Homo sapiens
accccacagcatacaaaggcac

SEQ ID NO: 8117381 - DNA, 22 bp, Homo sapiens
acccaggctggcgtgcagtggc

SEQ ID NO: 8117382 - DNA, 22 bp, Homo sapiens
acccaccctactagcagtgtcc

SEQ ID NO: 8117383 - DNA, 22 bp, Homo sapiens
accagtgcttcctgctggagct

SEQ ID NO: 8117384 - DNA, 20 bp, Homo sapiens
accaggtggctgatgacacc

SEQ ID NO: 8117385 - DNA, 22 bp, Homo sapiens
agggcctcgggctcagtgggtc

SEQ ID NO: 8117386 - DNA, 22 bp, Homo sapiens
accagggcttacagcagtagct

SEQ ID NO: 8117387 - DNA, 22 bp, Homo sapiens
accagggcccgggagagctctc

SEQ ID NO: 8117388 - DNA, 22 bp, Homo sapiens
accaggctgtgaagtgagacta

SEQ ID NO: 8117389 - DNA, 22 bp, Homo sapiens
accagctctttcttttcactat

SEQ ID NO: 8117390 - DNA, 20 bp, Homo sapiens
accaggagatggaggcaggg

SEQ ID NO: 8117391 - DNA, 22 bp, Homo sapiens
accaggagccacaggaggagcc

SEQ ID NO: 8117392 - DNA, 22 bp, Homo sapiens
accaggagccacaggaggagcc

SEQ ID NO: 8117393 - DNA, 22 bp, Homo sapiens
accaggaggcctggagcacaaa

SEQ ID NO: 8117394 - DNA, 22 bp, Homo sapiens
accaggaggcctggagcacaaa

SEQ ID NO: 8117395 - DNA, 22 bp, Homo sapiens
accaggagccatagagtcaggc

SEQ ID NO: 8117396 - DNA, 22 bp, Homo sapiens
acattcattccaggtcagtcag

SEQ ID NO: 8117397 - DNA, 22 bp, Homo sapiens
acattgaaagcatattatctcc

SEQ ID NO: 8117398 - DNA, 22 bp, Homo sapiens
aggctgtgcaattagggtaaga

SEQ ID NO: 8117399 - DNA, 22 bp, Homo sapiens
aggcttcccagctgagctcagc

SEQ ID NO: 8117400 - DNA, 22 bp, Homo sapiens
acattgaacagtacaaatgatc

SEQ ID NO: 8117401 - DNA, 22 bp, Homo sapiens
acattgaagggaatgcaaagat

SEQ ID NO: 8117402 - DNA, 19 bp, Homo sapiens
acattgaattttcttcttt

SEQ ID NO: 8117403 - DNA, 22 bp, Homo sapiens
aggctccagcagccagaggaag

SEQ ID NO: 8117404 - DNA, 22 bp, Homo sapiens
aggcccagggctgctctctgaa

SEQ ID NO: 8117405 - DNA, 22 bp, Homo sapiens
aggccagcattctctctccagg

SEQ ID NO: 8117406 - DNA, 22 bp, Homo sapiens
aggccacaggcaccctgtgttc

SEQ ID NO: 8117407 - DNA, 22 bp, Homo sapiens
aggccacagcctgggaggtgac

SEQ ID NO: 8117408 - DNA, 20 bp, Homo sapiens
aggcagttagaaggagatga

SEQ ID NO: 8117409 - DNA, 21 bp, Homo sapiens
actttacaatttacatagtga

SEQ ID NO: 8117410 - DNA, 22 bp, Homo sapiens
acttctctgctacctgcaaaga

SEQ ID NO: 8117411 - DNA, 22 bp, Homo sapiens
acttctctccacccaagtccct

SEQ ID NO: 8117412 - DNA, 22 bp, Homo sapiens
actttgttcctttcacaaagaa

SEQ ID NO: 8117413 - DNA, 22 bp, Homo sapiens
actttggatctgatgtaatcag

SEQ ID NO: 8117414 - DNA, 22 bp, Homo sapiens
atacatcatgctccatatattt

SEQ ID NO: 8117415 - DNA, 19 bp, Homo sapiens
ataaataaaaagtgggaga

SEQ ID NO: 8117416 - DNA, 22 bp, Homo sapiens
acttccagcaacttggtgctat

SEQ ID NO: 8117417 - DNA, 22 bp, Homo sapiens
acttccagctaggttctgctaa

SEQ ID NO: 8117418 - DNA, 18 bp, Homo sapiens
agtttttaggaagaaatg

SEQ ID NO: 8117419 - DNA, 22 bp, Homo sapiens
agttttataaaggcacctcagt

SEQ ID NO: 8117420 - DNA, 22 bp, Homo sapiens
agtttctagcaaggattgttga

SEQ ID NO: 8117421 - DNA, 22 bp, Homo sapiens
agttttaaatgatggtggtggt

SEQ ID NO: 8117422 - DNA, 22 bp, Homo sapiens
agaaagcatctccattgtaggt

SEQ ID NO: 8117423 - DNA, 22 bp, Homo sapiens
atattttgtaacttggaatagg

SEQ ID NO: 8117424 - DNA, 22 bp, Homo sapiens
atattttggggtgatgtgcatc

SEQ ID NO: 8117425 - DNA, 21 bp, Homo sapiens
agaaaaaccagcatgttttca

SEQ ID NO: 8117426 - DNA, 22 bp, Homo sapiens
actttttacagggtgtatacca

SEQ ID NO: 8117427 - DNA, 22 bp, Homo sapiens
atctcaggaggttcctctgtcc

SEQ ID NO: 8117428 - DNA, 22 bp, Homo sapiens
atctctgctagccttcttcagg

SEQ ID NO: 8117429 - DNA, 22 bp, Homo sapiens
atcccaggggttgtatcttccc

SEQ ID NO: 8117430 - DNA, 21 bp, Homo sapiens
atcccagcacccaggagtgca

SEQ ID NO: 8117431 - DNA, 22 bp, Homo sapiens
atcccagatagtgaccctcagg

SEQ ID NO: 8117432 - DNA, 22 bp, Homo sapiens
atccagctttgtctggtcttcg

SEQ ID NO: 8117433 - DNA, 22 bp, Homo sapiens
agaaatctattatttcagagtt

SEQ ID NO: 8117434 - DNA, 20 bp, Homo sapiens
agaagccaagtgacatgttt

SEQ ID NO: 8117435 - DNA, 22 bp, Homo sapiens
agaagccaatcagctctctgct

SEQ ID NO: 8117436 - DNA, 22 bp, Homo sapiens
agaagccacaggcctcgtctgg

SEQ ID NO: 8117437 - DNA, 22 bp, Homo sapiens
agaagccaatccttgtctctct

SEQ ID NO: 8117438 - DNA, 22 bp, Homo sapiens
agaagccaattctgtgtgagtc

SEQ ID NO: 8117439 - DNA, 22 bp, Homo sapiens
agaaggagtgtacaggtcatgc

SEQ ID NO: 8117440 - DNA, 22 bp, Homo sapiens
agaaggcactcacactggcacg

SEQ ID NO: 8117441 - DNA, 22 bp, Homo sapiens
agaaggcagatgggacggagca

SEQ ID NO: 8117442 - DNA, 22 bp, Homo sapiens
actgagcagaacaatgggagcc

SEQ ID NO: 8117443 - DNA, 22 bp, Homo sapiens
actgcacagtcccagaggatgc

SEQ ID NO: 8117444 - DNA, 22 bp, Homo sapiens
actgcacagattaagttagatt

SEQ ID NO: 8117445 - DNA, 22 bp, Homo sapiens
actgcacatagtgggctggcct

SEQ ID NO: 8117446 - DNA, 22 bp, Homo sapiens
agtgctcctttcattgctgccc

SEQ ID NO: 8117447 - DNA, 22 bp, Homo sapiens
actggcttcagggggaaagtcc

SEQ ID NO: 8117448 - DNA, 22 bp, Homo sapiens
actgccctgtaactgccaggta

SEQ ID NO: 8117449 - DNA, 22 bp, Homo sapiens
actgcctcttggtgctgagaga

SEQ ID NO: 8117450 - DNA, 22 bp, Homo sapiens
actgcctcttggtgctgagaga

SEQ ID NO: 8117451 - DNA, 22 bp, Homo sapiens
actgcccttgtcctggcacacc

SEQ ID NO: 8117452 - DNA, 22 bp, Homo sapiens
actgcccatgtgcatcaagtag

SEQ ID NO: 8117453 - DNA, 22 bp, Homo sapiens
actgccaggtgctccatctgaa

SEQ ID NO: 8117454 - DNA, 22 bp, Homo sapiens
actgcccacatctctttccgct

SEQ ID NO: 8117455 - DNA, 22 bp, Homo sapiens
actggctgcggggtggaagaag

SEQ ID NO: 8117456 - DNA, 22 bp, Homo sapiens
agtataattagatatcaaaagt

SEQ ID NO: 8117457 - DNA, 21 bp, Homo sapiens
agtagtttagcacagggtttg

SEQ ID NO: 8117458 - DNA, 22 bp, Homo sapiens
actccaggggttgctatttaca

SEQ ID NO: 8117459 - DNA, 22 bp, Homo sapiens
agtagtgaagaatttgttctac

SEQ ID NO: 8117460 - DNA, 22 bp, Homo sapiens
agtacatgcagaactaacagat

SEQ ID NO: 8117461 - DNA, 22 bp, Homo sapiens
actccctccaaatctgcacagt

SEQ ID NO: 8117462 - DNA, 22 bp, Homo sapiens
actccctccaaatctgcacagt

SEQ ID NO: 8117463 - DNA, 22 bp, Homo sapiens
actccctctctagtccttgcaa

SEQ ID NO: 8117464 - DNA, 22 bp, Homo sapiens
actccagggtgactctgtctga

SEQ ID NO: 8117465 - DNA, 22 bp, Homo sapiens
actccagggttttgcacctgga

SEQ ID NO: 8117466 - DNA, 22 bp, Homo sapiens
actcctgctgtcactgcagttc

SEQ ID NO: 8117467 - DNA, 22 bp, Homo sapiens
actcctgcttcttccctgagga

SEQ ID NO: 8117468 - DNA, 22 bp, Homo sapiens
actcctcagccagcatcaggga

SEQ ID NO: 8117469 - DNA, 22 bp, Homo sapiens
actcctggggctgccatcacag

SEQ ID NO: 8117470 - DNA, 22 bp, Homo sapiens
actcctggaaaagaacgcaggg

SEQ ID NO: 8117471 - DNA, 22 bp, Homo sapiens
actcctgggtgctgaccagcgt

SEQ ID NO: 8117472 - DNA, 22 bp, Homo sapiens
agtcaccatctgtggcagcctg

SEQ ID NO: 8117473 - DNA, 22 bp, Homo sapiens
agtcacttccagctgtgtttca

SEQ ID NO: 8117474 - DNA, 22 bp, Homo sapiens
actctccttttgatcttcagaa

SEQ ID NO: 8117475 - DNA, 22 bp, Homo sapiens
actctcccttggagcctcaggc

SEQ ID NO: 8117476 - DNA, 22 bp, Homo sapiens
actctctgggcatgccccacca

SEQ ID NO: 8117477 - DNA, 22 bp, Homo sapiens
actctctggtgtagaaagacct

SEQ ID NO: 8117478 - DNA, 22 bp, Homo sapiens
actctctgtctaaatgcagttt

SEQ ID NO: 8117479 - DNA, 22 bp, Homo sapiens
actctctgtctaaatgcagttt

SEQ ID NO: 8117480 - DNA, 22 bp, Homo sapiens
accttcctctaagacatttagc

SEQ ID NO: 8117481 - DNA, 22 bp, Homo sapiens
aggtcaagagtaaatttgggta

SEQ ID NO: 8117482 - DNA, 22 bp, Homo sapiens
acccttctgtgacctgcctgtc

SEQ ID NO: 8117483 - DNA, 22 bp, Homo sapiens
actagaaagtttccagagttat

SEQ ID NO: 8117484 - DNA, 22 bp, Homo sapiens
actagaaaattcctagaaacta

SEQ ID NO: 8117485 - DNA, 20 bp, Homo sapiens
aggtcttccaatcagctcct

SEQ ID NO: 8117486 - DNA, 22 bp, Homo sapiens
ctgagctgctcccgctgcagcg

SEQ ID NO: 8117487 - DNA, 22 bp, Homo sapiens
agttcccaggtgatgctgatgt

SEQ ID NO: 8117488 - DNA, 22 bp, Homo sapiens
agttcatggaagattcaatgga

SEQ ID NO: 8117489 - DNA, 22 bp, Homo sapiens
ctgagccagcgggctcactttt

SEQ ID NO: 8117490 - DNA, 22 bp, Homo sapiens
agtgtggagccactgagtggct

SEQ ID NO: 8117491 - DNA, 19 bp, Homo sapiens
agtggtagatgagcaggag

SEQ ID NO: 8117492 - DNA, 22 bp, Homo sapiens
agtggtagagtcaaggttgtaa

SEQ ID NO: 8117493 - DNA, 20 bp, Homo sapiens
agtgggtgatgaaggaatag

SEQ ID NO: 8117494 - DNA, 22 bp, Homo sapiens
agtgggtgcaaccatggctagg

SEQ ID NO: 8117495 - DNA, 20 bp, Homo sapiens
ctctggagttggggaacatt

SEQ ID NO: 8117496 - DNA, 22 bp, Homo sapiens
ctctggagttcttcaagctact

SEQ ID NO: 8117497 - DNA, 22 bp, Homo sapiens
ctctggagttctcatgaggaac

SEQ ID NO: 8117498 - DNA, 22 bp, Homo sapiens
ctctggagtgtctggccagggt

SEQ ID NO: 8117499 - DNA, 22 bp, Homo sapiens
ctctggagttcccttgatctga

SEQ ID NO: 8117500 - DNA, 22 bp, Homo sapiens
ctctggagttagtgatctgggc

SEQ ID NO: 8117501 - DNA, 22 bp, Homo sapiens
ctctggagtgggtggccgggag

SEQ ID NO: 8117502 - DNA, 20 bp, Homo sapiens
agtggggagtcaggagtgcc

SEQ ID NO: 8117503 - DNA, 22 bp, Homo sapiens
agtggctcttgggtcactgggc

SEQ ID NO: 8117504 - DNA, 22 bp, Homo sapiens
agtgggtgataagaccaaggag

SEQ ID NO: 8117505 - DNA, 22 bp, Homo sapiens
agtgggtgagcttggtctagat

SEQ ID NO: 8117506 - DNA, 22 bp, Homo sapiens
agtggccagtgctgctctgggg

SEQ ID NO: 8117507 - DNA, 22 bp, Homo sapiens
agtggccatccctcaggtaggc

SEQ ID NO: 8117508 - DNA, 22 bp, Homo sapiens
agtggccaggaaaggtccagcc

SEQ ID NO: 8117509 - DNA, 21 bp, Homo sapiens
ctctggagtttgaaggctggg

SEQ ID NO: 8117510 - DNA, 22 bp, Homo sapiens
agtgtacaaaatgatagataaa

SEQ ID NO: 8117511 - DNA, 22 bp, Homo sapiens
agtgtacaaaatgatagataaa

SEQ ID NO: 8117512 - DNA, 22 bp, Homo sapiens
agtgtcatcgtgaaaacatagc

SEQ ID NO: 8117513 - DNA, 22 bp, Homo sapiens
agtgtcatttccacgacattca

SEQ ID NO: 8117514 - DNA, 22 bp, Homo sapiens
agtgtgagtaattcagggaggg

SEQ ID NO: 8117515 - DNA, 22 bp, Homo sapiens
agtgtgagtaattcagggaggg

SEQ ID NO: 8117516 - DNA, 22 bp, Homo sapiens
agtgtgagctaatagcagagcc

SEQ ID NO: 8117517 - DNA, 22 bp, Homo sapiens
agtgtgagcctacaggccaaag

SEQ ID NO: 8117518 - DNA, 22 bp, Homo sapiens
agtgtcctcctctgggagccag

SEQ ID NO: 8117519 - DNA, 22 bp, Homo sapiens
agtgtcccctacagaggcattc

SEQ ID NO: 8117520 - DNA, 21 bp, Homo sapiens
agtgtcatttgatcattgtta

SEQ ID NO: 8117521 - DNA, 22 bp, Homo sapiens
agtggaggcactaattggattt

SEQ ID NO: 8117522 - DNA, 22 bp, Homo sapiens
agtggagaagaggatggtctcc

SEQ ID NO: 8117523 - DNA, 22 bp, Homo sapiens
agtggagaatatgcagaaagcc

SEQ ID NO: 8117524 - DNA, 22 bp, Homo sapiens
agtggagaagaggatggtctcc

SEQ ID NO: 8117525 - DNA, 22 bp, Homo sapiens
agtggagacaggacagtcgata

SEQ ID NO: 8117526 - DNA, 22 bp, Homo sapiens
agtggagacaggacagtcgata

SEQ ID NO: 8117527 - DNA, 22 bp, Homo sapiens
agtggccagcagcctagcctag

SEQ ID NO: 8117528 - DNA, 20 bp, Homo sapiens
agtggccactgcagagatgc

SEQ ID NO: 8117529 - DNA, 22 bp, Homo sapiens
agtggccactagaagctcagct

SEQ ID NO: 8117530 - DNA, 22 bp, Homo sapiens
agtggccaatatgtcatgctct

SEQ ID NO: 8117531 - DNA, 22 bp, Homo sapiens
agtggccaccatgccagctctc

SEQ ID NO: 8117532 - DNA, 22 bp, Homo sapiens
agtggcagtggggcagggccct

SEQ ID NO: 8117533 - DNA, 22 bp, Homo sapiens
agtggcagggctggctgctgca

SEQ ID NO: 8117534 - DNA, 22 bp, Homo sapiens
agtggcagaagccaagtctgca

SEQ ID NO: 8117535 - DNA, 22 bp, Homo sapiens
agtggaggttattgagttaagg

SEQ ID NO: 8117536 - DNA, 22 bp, Homo sapiens
agtgccagctccacacagcagc

SEQ ID NO: 8117537 - DNA, 22 bp, Homo sapiens
agtgcattctgtcatcttggtt

SEQ ID NO: 8117538 - DNA, 22 bp, Homo sapiens
agtgccctgtggcttcagcaat

SEQ ID NO: 8117539 - DNA, 22 bp, Homo sapiens
agtgccttgtgtgtgggcagcc

SEQ ID NO: 8117540 - DNA, 22 bp, Homo sapiens
ctcaccacagagcctgtccagc

SEQ ID NO: 8117541 - DNA, 22 bp, Homo sapiens
ctcacattccacttgtgccaac

SEQ ID NO: 8117542 - DNA, 22 bp, Homo sapiens
ctcacattcacaggacagaagg

SEQ ID NO: 8117543 - DNA, 22 bp, Homo sapiens
agtgacttctcctaatgtcata

SEQ ID NO: 8117544 - DNA, 22 bp, Homo sapiens
agtgaaatagcatttatgaagc

SEQ ID NO: 8117545 - DNA, 22 bp, Homo sapiens
agtgaaatcaggttttgactgc

SEQ ID NO: 8117546 - DNA, 22 bp, Homo sapiens
agtgaggggcagctgagtgggc

SEQ ID NO: 8117547 - DNA, 22 bp, Homo sapiens
agtgaggggattcaggcaaggt

SEQ ID NO: 8117548 - DNA, 22 bp, Homo sapiens
agtgaggggattcaggcaaggt

SEQ ID NO: 8117549 - DNA, 22 bp, Homo sapiens
agtgatatatgttgccagagag

SEQ ID NO: 8117550 - DNA, 22 bp, Homo sapiens
agtgatattagcaaatggttat

SEQ ID NO: 8117551 - DNA, 22 bp, Homo sapiens
agtcacatagtgttttggaatc

SEQ ID NO: 8117552 - DNA, 22 bp, Homo sapiens
agtcacagaaacccaggtgtgg

SEQ ID NO: 8117553 - DNA, 22 bp, Homo sapiens
ctaggaaagacacagagagttt

SEQ ID NO: 8117554 - DNA, 22 bp, Homo sapiens
ctatatttcttggctttaaaca

SEQ ID NO: 8117555 - DNA, 22 bp, Homo sapiens
agtcagctgctgcacacagcag

SEQ ID NO: 8117556 - DNA, 22 bp, Homo sapiens
agtcagcagtgaaagcacagcc

SEQ ID NO: 8117557 - DNA, 22 bp, Homo sapiens
agtcagcagcctggccaggaga

SEQ ID NO: 8117558 - DNA, 22 bp, Homo sapiens
agtcagcttggctcctcccatg

SEQ ID NO: 8117559 - DNA, 22 bp, Homo sapiens
agtcaggatatgccttgtgggc

SEQ ID NO: 8117560 - DNA, 22 bp, Homo sapiens
agtcaggagctgctgcattgta

SEQ ID NO: 8117561 - DNA, 22 bp, Homo sapiens
ctatctctccacaatgccagtg

SEQ ID NO: 8117562 - DNA, 22 bp, Homo sapiens
ctattgcccaaatctcaaccgc

SEQ ID NO: 8117563 - DNA, 22 bp, Homo sapiens
agtacatacttcaaatgtactt

SEQ ID NO: 8117564 - DNA, 22 bp, Homo sapiens
agtagattccagtgatagttaa

SEQ ID NO: 8117565 - DNA, 22 bp, Homo sapiens
agtagcagtgacagctgaggta

SEQ ID NO: 8117566 - DNA, 19 bp, Homo sapiens
agtagcagaaagtgcagtg

SEQ ID NO: 8117567 - DNA, 22 bp, Homo sapiens
agtaggaggcgggagcatgaag

SEQ ID NO: 8117568 - DNA, 22 bp, Homo sapiens
agtaggaggcgggagcatgaag

SEQ ID NO: 8117569 - DNA, 22 bp, Homo sapiens
agtaaatgtttatcacacagat

SEQ ID NO: 8117570 - DNA, 22 bp, Homo sapiens
agtaaataacagagaaaatggg

SEQ ID NO: 8117571 - DNA, 22 bp, Homo sapiens
ccttccagggctctccagaacc

SEQ ID NO: 8117572 - DNA, 22 bp, Homo sapiens
ccttctcctgccttgggttcat

SEQ ID NO: 8117573 - DNA, 22 bp, Homo sapiens
cctgggagggcaagtgctgatg

SEQ ID NO: 8117574 - DNA, 22 bp, Homo sapiens
aggtcagctgctgataggcagc

SEQ ID NO: 8117575 - DNA, 22 bp, Homo sapiens
aggtcagctgctgataggcagc

SEQ ID NO: 8117576 - DNA, 22 bp, Homo sapiens
aggtcagcatgctcctctctgt

SEQ ID NO: 8117577 - DNA, 23 bp, Homo sapiens
agggtggcttgctttgcttcctt

SEQ ID NO: 8117578 - DNA, 22 bp, Homo sapiens
agggttctgccagtgtcttgag

SEQ ID NO: 8117579 - DNA, 22 bp, Homo sapiens
aggtaaggctgtaagctaagcc

SEQ ID NO: 8117580 - DNA, 22 bp, Homo sapiens
aggtggcaaggggcgcctctct

SEQ ID NO: 8117581 - DNA, 22 bp, Homo sapiens
aggtgcaggagctgtgcaggga

SEQ ID NO: 8117582 - DNA, 22 bp, Homo sapiens
aggtgcagctggtggagtctgg

SEQ ID NO: 8117583 - DNA, 21 bp, Homo sapiens
aggtgcagaggcctcactcac

SEQ ID NO: 8117584 - DNA, 17 bp, Homo sapiens
aggtgcagaggcagagc

SEQ ID NO: 8117585 - DNA, 17 bp, Homo sapiens
aggtgcagaggcagagc

SEQ ID NO: 8117586 - DNA, 22 bp, Homo sapiens
cctggggctttctttgtatcat

SEQ ID NO: 8117587 - DNA, 22 bp, Homo sapiens
agttctagaagacttttccatt

SEQ ID NO: 8117588 - DNA, 22 bp, Homo sapiens
ctgcagggaactgaggcccaga

SEQ ID NO: 8117589 - DNA, 22 bp, Homo sapiens
ctgcagggaactgaggcccaga

SEQ ID NO: 8117590 - DNA, 22 bp, Homo sapiens
ataaagatttctttttctctac

SEQ ID NO: 8117591 - DNA, 22 bp, Homo sapiens
ataaagatttttaggcatttct

SEQ ID NO: 8117592 - DNA, 22 bp, Homo sapiens
atacacatctatttaagagaca

SEQ ID NO: 8117593 - DNA, 22 bp, Homo sapiens
ctgctgcccagtgtgcattggg

SEQ ID NO: 8117594 - DNA, 22 bp, Homo sapiens
ctgctcaagtgcgcacccaggg

SEQ ID NO: 8117595 - DNA, 22 bp, Homo sapiens
ctgctcacgccaccgttcatca

SEQ ID NO: 8117596 - DNA, 22 bp, Homo sapiens
ctgctcagaggaaggaatgtct

SEQ ID NO: 8117597 - DNA, 19 bp, Homo sapiens
ctgctcagagcagctccag

SEQ ID NO: 8117598 - DNA, 22 bp, Homo sapiens
ctgctcagcggaaggaagagcg

SEQ ID NO: 8117599 - DNA, 22 bp, Homo sapiens
ctgctacaccggaatagtgaca

SEQ ID NO: 8117600 - DNA, 22 bp, Homo sapiens
ctggcctaaaaatacagaacaa

SEQ ID NO: 8117601 - DNA, 22 bp, Homo sapiens
ctggcctcacagaggctaagcc

SEQ ID NO: 8117602 - DNA, 20 bp, Homo sapiens
ctggccagaacgcctacaca

SEQ ID NO: 8117603 - DNA, 20 bp, Homo sapiens
ctggccagaacgcctacaca

SEQ ID NO: 8117604 - DNA, 22 bp, Homo sapiens
ctggcaggtggaggttgcagtg

SEQ ID NO: 8117605 - DNA, 19 bp, Homo sapiens
atacatgcatttacatgct

SEQ ID NO: 8117606 - DNA, 22 bp, Homo sapiens
ctggcaagtactgggccagctc

SEQ ID NO: 8117607 - DNA, 22 bp, Homo sapiens
ctggcaatgggagtagtagggt

SEQ ID NO: 8117608 - DNA, 20 bp, Homo sapiens
atacacattcatagaaaaat

SEQ ID NO: 8117609 - DNA, 22 bp, Homo sapiens
atacacatgtgtatgtgcatgc

SEQ ID NO: 8117610 - DNA, 22 bp, Homo sapiens
atatacagggagaaacagctta

SEQ ID NO: 8117611 - DNA, 22 bp, Homo sapiens
atatacactgtttcagttgaag

SEQ ID NO: 8117612 - DNA, 22 bp, Homo sapiens
atatacactccactgatacagg

SEQ ID NO: 8117613 - DNA, 20 bp, Homo sapiens
atataccatcccacaacagg

SEQ ID NO: 8117614 - DNA, 22 bp, Homo sapiens
atatactgatagctgcacttct

SEQ ID NO: 8117615 - DNA, 22 bp, Homo sapiens
atatactgaggagactttatat

SEQ ID NO: 8117616 - DNA, 22 bp, Homo sapiens
atagtgcagtggactgagttaa

SEQ ID NO: 8117617 - DNA, 22 bp, Homo sapiens
ctggcctcggcagcaggaacag

SEQ ID NO: 8117618 - DNA, 22 bp, Homo sapiens
ctggctctttcctagctaggct

SEQ ID NO: 8117619 - DNA, 22 bp, Homo sapiens
ctgtctcagcaggaagtcatca

SEQ ID NO: 8117620 - DNA, 22 bp, Homo sapiens
ctgtcgcctggtcctctctgga

SEQ ID NO: 8117621 - DNA, 22 bp, Homo sapiens
atcagcagatgctcaatgaaca

SEQ ID NO: 8117622 - DNA, 22 bp, Homo sapiens
ctgtaatcccagctacctggga

SEQ ID NO: 8117623 - DNA, 22 bp, Homo sapiens
ctgtaaataatgacagttgact

SEQ ID NO: 8117624 - DNA, 20 bp, Homo sapiens
ctgggaggtcttccaaatca

SEQ ID NO: 8117625 - DNA, 22 bp, Homo sapiens
ctggtccccagactgggcttag

SEQ ID NO: 8117626 - DNA, 22 bp, Homo sapiens
ctggtccctggacctccctgga

SEQ ID NO: 8117627 - DNA, 22 bp, Homo sapiens
ctggtcagggtagtgttgcaga

SEQ ID NO: 8117628 - DNA, 22 bp, Homo sapiens
ctggtcaggaaggtggggacag

SEQ ID NO: 8117629 - DNA, 18 bp, Homo sapiens
atattcaagaagacagag

SEQ ID NO: 8117630 - DNA, 22 bp, Homo sapiens
cttcaagagaatgcagggatgt

SEQ ID NO: 8117631 - DNA, 22 bp, Homo sapiens
cttcaagatatttctagaatca

SEQ ID NO: 8117632 - DNA, 22 bp, Homo sapiens
cttcctctcttgcccataagag

SEQ ID NO: 8117633 - DNA, 22 bp, Homo sapiens
atccattgtggtcttgtacatt

SEQ ID NO: 8117634 - DNA, 22 bp, Homo sapiens
cttagatgaagtcacagaaccc

SEQ ID NO: 8117635 - DNA, 22 bp, Homo sapiens
cttctgtgttaaatgagtcttt

SEQ ID NO: 8117636 - DNA, 22 bp, Homo sapiens
cttctgattagcaagtttgtat

SEQ ID NO: 8117637 - DNA, 22 bp, Homo sapiens
cttctgcaataagttttggtcc

SEQ ID NO: 8117638 - DNA, 22 bp, Homo sapiens
cttctgcactgaccttttgtcc

SEQ ID NO: 8117639 - DNA, 22 bp, Homo sapiens
cttctgcagaattaattcacta

SEQ ID NO: 8117640 - DNA, 22 bp, Homo sapiens
cttctgagttaacagtagattt

SEQ ID NO: 8117641 - DNA, 20 bp, Homo sapiens
atctcctgctaccacccatt

SEQ ID NO: 8117642 - DNA, 22 bp, Homo sapiens
cttccttgctgtctgctccagg

SEQ ID NO: 8117643 - DNA, 22 bp, Homo sapiens
cttccttgtggtccttctcatt

SEQ ID NO: 8117644 - DNA, 22 bp, Homo sapiens
atctctgatttacagcatctct

SEQ ID NO: 8117645 - DNA, 22 bp, Homo sapiens
atctgtaacatcagtagcagaa

SEQ ID NO: 8117646 - DNA, 22 bp, Homo sapiens
atctggttttggctgtgtccct

SEQ ID NO: 8117647 - DNA, 22 bp, Homo sapiens
cttcttaatgacagattaaaat

SEQ ID NO: 8117648 - DNA, 22 bp, Homo sapiens
atctggttcttcttaggcatca

SEQ ID NO: 8117649 - DNA, 22 bp, Homo sapiens
cttcttaaattggattgctatt

SEQ ID NO: 8117650 - DNA, 22 bp, Homo sapiens
cttcttaaatatttggctgact

SEQ ID NO: 8117651 - DNA, 22 bp, Homo sapiens
atcttcaaagaatttcttgtcc

SEQ ID NO: 8117652 - DNA, 22 bp, Homo sapiens
atctgtggccaaaagactgttg

SEQ ID NO: 8117653 - DNA, 22 bp, Homo sapiens
atctgtggcagtgatgagtctt

SEQ ID NO: 8117654 - DNA, 22 bp, Homo sapiens
atctgtggctggtgagaggcag

SEQ ID NO: 8117655 - DNA, 22 bp, Homo sapiens
atctgtcttccaccacacatcc

SEQ ID NO: 8117656 - DNA, 22 bp, Homo sapiens
atctgtcttgccttgcatattt

SEQ ID NO: 8117657 - DNA, 22 bp, Homo sapiens
atctgtctatgatatagtctgt

SEQ ID NO: 8117658 - DNA, 22 bp, Homo sapiens
aggcagaggagaatgatcttcc

SEQ ID NO: 8117659 - DNA, 22 bp, Homo sapiens
aggcagaggaagggtggatttg

SEQ ID NO: 8117660 - DNA, 22 bp, Homo sapiens
aggcagagctgggttttgaaat

SEQ ID NO: 8117661 - DNA, 22 bp, Homo sapiens
aggcagagctgatgttctgtga

SEQ ID NO: 8117662 - DNA, 22 bp, Homo sapiens
aggcagagctaggaagaattgt

SEQ ID NO: 8117663 - DNA, 20 bp, Homo sapiens
aggcagagcgcacttttaga

SEQ ID NO: 8117664 - DNA, 23 bp, Homo sapiens
aggcagagccaaggtcaaaaccc

SEQ ID NO: 8117665 - DNA, 19 bp, Homo sapiens
aggcagaggcttggctagc

SEQ ID NO: 8117666 - DNA, 23 bp, Homo sapiens
ccaaaagcgagtctgttgttccc

SEQ ID NO: 8117667 - DNA, 22 bp, Homo sapiens
aggcagcttaagccctggccca

SEQ ID NO: 8117668 - DNA, 22 bp, Homo sapiens
aggcaggctcaggcccatgctt

SEQ ID NO: 8117669 - DNA, 16 bp, Homo sapiens
aggcagagatttaccc

SEQ ID NO: 8117670 - DNA, 22 bp, Homo sapiens
aggcagagagcagtggccgtct

SEQ ID NO: 8117671 - DNA, 22 bp, Homo sapiens
aggcacagtttcatccccgggc

SEQ ID NO: 8117672 - DNA, 22 bp, Homo sapiens
aggagtttcaaagcttccatgt

SEQ ID NO: 8117673 - DNA, 22 bp, Homo sapiens
aggagtttcctttagtttctgg

SEQ ID NO: 8117674 - DNA, 23 bp, Homo sapiens
aggagttgagggttgggttggca

SEQ ID NO: 8117675 - DNA, 22 bp, Homo sapiens
aggagtgttcagcgtggggatg

SEQ ID NO: 8117676 - DNA, 22 bp, Homo sapiens
aggatcagtgaatactcagggt

SEQ ID NO: 8117677 - DNA, 22 bp, Homo sapiens
aggatcaggccctctagggtag

SEQ ID NO: 8117678 - DNA, 22 bp, Homo sapiens
aggatgagaagattggaatctt

SEQ ID NO: 8117679 - DNA, 22 bp, Homo sapiens
aggcacaggtggacttcacagt

SEQ ID NO: 8117680 - DNA, 22 bp, Homo sapiens
catcactgtcctcagcattcca

SEQ ID NO: 8117681 - DNA, 22 bp, Homo sapiens
catcactggcatcatgggaggg

SEQ ID NO: 8117682 - DNA, 22 bp, Homo sapiens
catcactgcttctaaaatggtg

SEQ ID NO: 8117683 - DNA, 22 bp, Homo sapiens
cagttattctagttccacatct

SEQ ID NO: 8117684 - DNA, 22 bp, Homo sapiens
catcactgaaccccaactttct

SEQ ID NO: 8117685 - DNA, 22 bp, Homo sapiens
aggagtggtgcaggacctgcca

SEQ ID NO: 8117686 - DNA, 22 bp, Homo sapiens
aggagtgggggcgagaagttaa

SEQ ID NO: 8117687 - DNA, 22 bp, Homo sapiens
aggagtgggggcgagaagttaa

SEQ ID NO: 8117688 - DNA, 22 bp, Homo sapiens
aggagtggaattactgggttct

SEQ ID NO: 8117689 - DNA, 22 bp, Homo sapiens
aggaggtgttgatagaaggttt

SEQ ID NO: 8117690 - DNA, 22 bp, Homo sapiens
aggaggtgttgatagaaggttt

SEQ ID NO: 8117691 - DNA, 22 bp, Homo sapiens
aggaggtgagcggtcatgtggt

SEQ ID NO: 8117692 - DNA, 22 bp, Homo sapiens
aggaggtgacagcctgcatctg

SEQ ID NO: 8117693 - DNA, 22 bp, Homo sapiens
aggagggtggcctcatgtgagt

SEQ ID NO: 8117694 - DNA, 22 bp, Homo sapiens
aggaggggcatagaaatgtaat

SEQ ID NO: 8117695 - DNA, 22 bp, Homo sapiens
aggaggggcaatgatagtctgg

SEQ ID NO: 8117696 - DNA, 22 bp, Homo sapiens
aggaatttggaatttttcctgt

SEQ ID NO: 8117697 - DNA, 22 bp, Homo sapiens
cagtgcaggctgggggccctgc

SEQ ID NO: 8117698 - DNA, 23 bp, Homo sapiens
cagtgcagggcaactcagactcc

SEQ ID NO: 8117699 - DNA, 22 bp, Homo sapiens
cagtgaggctctgctgagcggt

SEQ ID NO: 8117700 - DNA, 22 bp, Homo sapiens
cagtgcagccaaggacaggcac

SEQ ID NO: 8117701 - DNA, 22 bp, Homo sapiens
aggagcagaccgtagtcctgca

SEQ ID NO: 8117702 - DNA, 22 bp, Homo sapiens
aggagcagattggtaagatcat

SEQ ID NO: 8117703 - DNA, 22 bp, Homo sapiens
aggagccaaattactagctctg

SEQ ID NO: 8117704 - DNA, 22 bp, Homo sapiens
aggagcagcttctgaaccatgt

SEQ ID NO: 8117705 - DNA, 22 bp, Homo sapiens
aggagcagcccactcctgtcct

SEQ ID NO: 8117706 - DNA, 22 bp, Homo sapiens
cagtggaaatcagagtgagagt

SEQ ID NO: 8117707 - DNA, 22 bp, Homo sapiens
cagtggaaactatgctgctgga

SEQ ID NO: 8117708 - DNA, 22 bp, Homo sapiens
cagtggaagctggctgtgaaga

SEQ ID NO: 8117709 - DNA, 22 bp, Homo sapiens
cagtggaatatataggggattt

SEQ ID NO: 8117710 - DNA, 22 bp, Homo sapiens
cagtggaagactcagctctccc

SEQ ID NO: 8117711 - DNA, 22 bp, Homo sapiens
cagtggagagacttttactctt

SEQ ID NO: 8117712 - DNA, 23 bp, Homo sapiens
cagtggagactcatgcttcctta

SEQ ID NO: 8117713 - DNA, 22 bp, Homo sapiens
aggagctggcctagaaaggaga

SEQ ID NO: 8117714 - DNA, 22 bp, Homo sapiens
agctgaagaaatgggaagcatt

SEQ ID NO: 8117715 - DNA, 22 bp, Homo sapiens
agctgccgatgcccagctgcat

SEQ ID NO: 8117716 - DNA, 22 bp, Homo sapiens
agctgccctgtggggagggttg

SEQ ID NO: 8117717 - DNA, 22 bp, Homo sapiens
agctgcccttaataggcattca

SEQ ID NO: 8117718 - DNA, 22 bp, Homo sapiens
agctgccctttatgatgctgaa

SEQ ID NO: 8117719 - DNA, 20 bp, Homo sapiens
agctgcccttttcacatgtt

SEQ ID NO: 8117720 - DNA, 22 bp, Homo sapiens
agctgcccctcattttcaccac

SEQ ID NO: 8117721 - DNA, 20 bp, Homo sapiens
agctgcccctgggcactgcc

SEQ ID NO: 8117722 - DNA, 22 bp, Homo sapiens
agctgccctgggctggagatgg

SEQ ID NO: 8117723 - DNA, 18 bp, Homo sapiens
agctgccctgggctggag

SEQ ID NO: 8117724 - DNA, 22 bp, Homo sapiens
agctggaaagaaggtggcagcc

SEQ ID NO: 8117725 - DNA, 22 bp, Homo sapiens
agctggaacccgggtgggcagc

SEQ ID NO: 8117726 - DNA, 22 bp, Homo sapiens
agctggaagctgatgagcacag

SEQ ID NO: 8117727 - DNA, 22 bp, Homo sapiens
agctggaagctgatgagcacag

SEQ ID NO: 8117728 - DNA, 17 bp, Homo sapiens
agctgcctctcccacca

SEQ ID NO: 8117729 - DNA, 22 bp, Homo sapiens
aggaagatgggagagctctgga

SEQ ID NO: 8117730 - DNA, 22 bp, Homo sapiens
aggaagggttctttgtgaaaga

SEQ ID NO: 8117731 - DNA, 22 bp, Homo sapiens
caggtcccctcccctaccaggc

SEQ ID NO: 8117732 - DNA, 22 bp, Homo sapiens
aggaagggtggatagtaacgtg

SEQ ID NO: 8117733 - DNA, 22 bp, Homo sapiens
aggaagggtgtcatgagccctt

SEQ ID NO: 8117734 - DNA, 22 bp, Homo sapiens
aggaagggttctttctgtttat

SEQ ID NO: 8117735 - DNA, 22 bp, Homo sapiens
aggaagggttctttgtgaaaga

SEQ ID NO: 8117736 - DNA, 22 bp, Homo sapiens
aggaagggtggatagtaacgtg

SEQ ID NO: 8117737 - DNA, 22 bp, Homo sapiens
aggaaggggagaagttaaagct

SEQ ID NO: 8117738 - DNA, 22 bp, Homo sapiens
aggaagggctgtttctccaaga

SEQ ID NO: 8117739 - DNA, 22 bp, Homo sapiens
caggtcctggcatcaggcaggt

SEQ ID NO: 8117740 - DNA, 22 bp, Homo sapiens
aggaatgaactcgagtgatctg

SEQ ID NO: 8117741 - DNA, 22 bp, Homo sapiens
aggaatgtttagaatgtcagaa

SEQ ID NO: 8117742 - DNA, 22 bp, Homo sapiens
aggaaacagagtgaagcttggg

SEQ ID NO: 8117743 - DNA, 22 bp, Homo sapiens
aggaaaagtgtgaagtatggag

SEQ ID NO: 8117744 - DNA, 20 bp, Homo sapiens
aggaaaagggtggtggtaga

SEQ ID NO: 8117745 - DNA, 22 bp, Homo sapiens
cagggacattggtggccaggtt

SEQ ID NO: 8117746 - DNA, 22 bp, Homo sapiens
cagggacatttccaagagaatt

SEQ ID NO: 8117747 - DNA, 22 bp, Homo sapiens
cagggacaggggagaaaagatg

SEQ ID NO: 8117748 - DNA, 20 bp, Homo sapiens
agcttctgctgcctttcggc

SEQ ID NO: 8117749 - DNA, 22 bp, Homo sapiens
agcttctgttcatcttccaggc

SEQ ID NO: 8117750 - DNA, 22 bp, Homo sapiens
agcttctgaaagtctgttttcc

SEQ ID NO: 8117751 - DNA, 22 bp, Homo sapiens
agcttctgcccgtgtttgctct

SEQ ID NO: 8117752 - DNA, 17 bp, Homo sapiens
agcttctgccctttctt

SEQ ID NO: 8117753 - DNA, 22 bp, Homo sapiens
agcttctgcatcttttcttccc

SEQ ID NO: 8117754 - DNA, 22 bp, Homo sapiens
caggcttcatgaattatgcacc

SEQ ID NO: 8117755 - DNA, 22 bp, Homo sapiens
aggctggagtgcagttgcatga

SEQ ID NO: 8117756 - DNA, 22 bp, Homo sapiens
ccaggtctggcactggccagtc

SEQ ID NO: 8117757 - DNA, 19 bp, Homo sapiens
ccaggtctggggccagatt

SEQ ID NO: 8117758 - DNA, 22 bp, Homo sapiens
aggctggcggtgactgctctga

SEQ ID NO: 8117759 - DNA, 17 bp, Homo sapiens
aggctggccttcacagt

SEQ ID NO: 8117760 - DNA, 22 bp, Homo sapiens
aggctggggaattgaatttgct

SEQ ID NO: 8117761 - DNA, 22 bp, Homo sapiens
aggctgaggcaagaggatcact

SEQ ID NO: 8117762 - DNA, 22 bp, Homo sapiens
aggctgaggcaggtggatcacc

SEQ ID NO: 8117763 - DNA, 22 bp, Homo sapiens
ccaggtctgcgggcggcaggca

SEQ ID NO: 8117764 - DNA, 22 bp, Homo sapiens
ccagggctggtggctgcagagg

SEQ ID NO: 8117765 - DNA, 22 bp, Homo sapiens
aggctgaggatcgtactttcca

SEQ ID NO: 8117766 - DNA, 22 bp, Homo sapiens
ccaggctggtctgaatttctag

SEQ ID NO: 8117767 - DNA, 22 bp, Homo sapiens
ccagggctccattgctcatcct

SEQ ID NO: 8117768 - DNA, 22 bp, Homo sapiens
ccagggctcaggctcccagtgg

SEQ ID NO: 8117769 - DNA, 22 bp, Homo sapiens
ccaggctgctgttggtgtccgc

SEQ ID NO: 8117770 - DNA, 22 bp, Homo sapiens
ccaggctctgcgctggacatgg

SEQ ID NO: 8117771 - DNA, 22 bp, Homo sapiens
ccaggctgcttagccttatctt

SEQ ID NO: 8117772 - DNA, 22 bp, Homo sapiens
ccaggctgctttattactctgt

SEQ ID NO: 8117773 - DNA, 22 bp, Homo sapiens
ccaggctggaatcaatattctg

SEQ ID NO: 8117774 - DNA, 22 bp, Homo sapiens
ccaggctggagtatagtggcgc

SEQ ID NO: 8117775 - DNA, 22 bp, Homo sapiens
ccaggctgggctacaagttgag

SEQ ID NO: 8117776 - DNA, 15 bp, Homo sapiens
ccaggctgggtgagc

SEQ ID NO: 8117777 - DNA, 22 bp, Homo sapiens
ccaggctgggcggggaacctgg

SEQ ID NO: 8117778 - DNA, 21 bp, Homo sapiens
ccaggctgggagggcagttcc

SEQ ID NO: 8117779 - DNA, 22 bp, Homo sapiens
ccagagctaaacacacaggctg

SEQ ID NO: 8117780 - DNA, 22 bp, Homo sapiens
ccagagcctggcatctgcataa

SEQ ID NO: 8117781 - DNA, 22 bp, Homo sapiens
ccagagcctggcatctgcataa

SEQ ID NO: 8117782 - DNA, 22 bp, Homo sapiens
aggccatgtggccccagagtct

SEQ ID NO: 8117783 - DNA, 22 bp, Homo sapiens
ccactgggggctgcaggcactc

SEQ ID NO: 8117784 - DNA, 22 bp, Homo sapiens
ccagaccctttcttggcatgtg

SEQ ID NO: 8117785 - DNA, 22 bp, Homo sapiens
ccagaccctttcttggcatgtg

SEQ ID NO: 8117786 - DNA, 22 bp, Homo sapiens
aggcctggcatgagacctgaga

SEQ ID NO: 8117787 - DNA, 18 bp, Homo sapiens
aggcctgggaagctgagg

SEQ ID NO: 8117788 - DNA, 22 bp, Homo sapiens
ccaggaagtatgacccaacaga

SEQ ID NO: 8117789 - DNA, 22 bp, Homo sapiens
aggcggtgctgtggacagtgac

SEQ ID NO: 8117790 - DNA, 22 bp, Homo sapiens
aggcggtggccaaggagcggga

SEQ ID NO: 8117791 - DNA, 22 bp, Homo sapiens
aggcgtgggaggatctgaggcc

SEQ ID NO: 8117792 - DNA, 22 bp, Homo sapiens
ccagctctggcttcttgctggg

SEQ ID NO: 8117793 - DNA, 22 bp, Homo sapiens
ccagctggaacggcagcccagc

SEQ ID NO: 8117794 - DNA, 22 bp, Homo sapiens
agggctggcaagggattgaaat

SEQ ID NO: 8117795 - DNA, 22 bp, Homo sapiens
agggctgctttgctaaatatgg

SEQ ID NO: 8117796 - DNA, 22 bp, Homo sapiens
cctcaggccctgtccctgcgcc

SEQ ID NO: 8117797 - DNA, 22 bp, Homo sapiens
ccctggaaatgaggcatgtgcg

SEQ ID NO: 8117798 - DNA, 22 bp, Homo sapiens
agggtagggcccggagacagac

SEQ ID NO: 8117799 - DNA, 22 bp, Homo sapiens
aggggtgaaggcccgataggag

SEQ ID NO: 8117800 - DNA, 22 bp, Homo sapiens
agggtagggccgtagggccatg

SEQ ID NO: 8117801 - DNA, 22 bp, Homo sapiens
cctgaaacatcttctgtaaata

SEQ ID NO: 8117802 - DNA, 22 bp, Homo sapiens
agggctggctaggtgcgttccc

SEQ ID NO: 8117803 - DNA, 22 bp, Homo sapiens
agggctggcatctctaatgctg

SEQ ID NO: 8117804 - DNA, 22 bp, Homo sapiens
aggggaggcagcgataaacctg

SEQ ID NO: 8117805 - DNA, 22 bp, Homo sapiens
aggggaggagcttttcttgcct

SEQ ID NO: 8117806 - DNA, 22 bp, Homo sapiens
aggggaggtgtccccaaatctc

SEQ ID NO: 8117807 - DNA, 22 bp, Homo sapiens
cctcttccactgggccccatcc

SEQ ID NO: 8117808 - DNA, 22 bp, Homo sapiens
aggggatggagctggaaggcag

SEQ ID NO: 8117809 - DNA, 21 bp, Homo sapiens
aggctgtcctttgccagccct

SEQ ID NO: 8117810 - DNA, 22 bp, Homo sapiens
aggctgtcctctcttgctcagt

SEQ ID NO: 8117811 - DNA, 20 bp, Homo sapiens
cccaggagctgtgccccatc

SEQ ID NO: 8117812 - DNA, 23 bp, Homo sapiens
cccaggagcctgagtcctctctg

SEQ ID NO: 8117813 - DNA, 22 bp, Homo sapiens
cccaggagggtggcctctgccc

SEQ ID NO: 8117814 - DNA, 22 bp, Homo sapiens
cccaggagcttctctctgcctc

SEQ ID NO: 8117815 - DNA, 22 bp, Homo sapiens
cccaggagatgcactccattgg

SEQ ID NO: 8117816 - DNA, 22 bp, Homo sapiens
cccatccctgattttcactcgt

SEQ ID NO: 8117817 - DNA, 22 bp, Homo sapiens
cccaggcttttaagttagacag

SEQ ID NO: 8117818 - DNA, 22 bp, Homo sapiens
cccaggcttttctcttgcccca

SEQ ID NO: 8117819 - DNA, 22 bp, Homo sapiens
cccaggctgtctgtcctttgct

SEQ ID NO: 8117820 - DNA, 22 bp, Homo sapiens
cccaggctgcgtatccacaata

SEQ ID NO: 8117821 - DNA, 22 bp, Homo sapiens
cccaggctggtcctgaactcct

SEQ ID NO: 8117822 - DNA, 22 bp, Homo sapiens
cccaggctgtgcaaacttcaaa

SEQ ID NO: 8117823 - DNA, 22 bp, Homo sapiens
cccaggcttcccaatcagaagg

SEQ ID NO: 8117824 - DNA, 18 bp, Homo sapiens
cccaggctttgtgggtct

SEQ ID NO: 8117825 - DNA, 22 bp, Homo sapiens
cccaggctgagttagaggtgtc

SEQ ID NO: 8117826 - DNA, 22 bp, Homo sapiens
cccaggaggtcgaagctgcagt

SEQ ID NO: 8117827 - DNA, 22 bp, Homo sapiens
cccaggctgatgttcagcgggt

SEQ ID NO: 8117828 - DNA, 22 bp, Homo sapiens
cccaggctgcatgagtccatgg

SEQ ID NO: 8117829 - DNA, 22 bp, Homo sapiens
cccaggctgccacgattactgc

SEQ ID NO: 8117830 - DNA, 22 bp, Homo sapiens
cccaggctgatgggatgggcca

SEQ ID NO: 8117831 - DNA, 22 bp, Homo sapiens
ccctgccctggagacacttaaa

SEQ ID NO: 8117832 - DNA, 22 bp, Homo sapiens
ccctgcccaccacatgctggga

SEQ ID NO: 8117833 - DNA, 22 bp, Homo sapiens
cccatgcaccctctaagaagga

SEQ ID NO: 8117834 - DNA, 22 bp, Homo sapiens
cccatgggttttcctccctgcc

SEQ ID NO: 8117835 - DNA, 22 bp, Homo sapiens
ccccagaagtttgcacaagaga

SEQ ID NO: 8117836 - DNA, 22 bp, Homo sapiens
ccctatcagaagctgagagaag

SEQ ID NO: 8117837 - DNA, 22 bp, Homo sapiens
ccccagcactctgactcttacc

SEQ ID NO: 8117838 - DNA, 22 bp, Homo sapiens
ccccagcactaccagaagccag

SEQ ID NO: 8117839 - DNA, 22 bp, Homo sapiens
ccccttccacagtgcttcctaa

SEQ ID NO: 8117840 - DNA, 22 bp, Homo sapiens
ccctaggctgaggccagggtgc

SEQ ID NO: 8117841 - DNA, 22 bp, Homo sapiens
gctcaggggaatgggctgccgt

SEQ ID NO: 8117842 - DNA, 22 bp, Homo sapiens
gctcagggtcccttggtgctgg

SEQ ID NO: 8117843 - DNA, 22 bp, Homo sapiens
gctcagggctaaggctgagggg

SEQ ID NO: 8117844 - DNA, 22 bp, Homo sapiens
gctccaggcagcatagtggatg

SEQ ID NO: 8117845 - DNA, 17 bp, Homo sapiens
gctccaggcgtgagtga

SEQ ID NO: 8117846 - DNA, 22 bp, Homo sapiens
gctccaggcgagctggaccaga

SEQ ID NO: 8117847 - DNA, 22 bp, Homo sapiens
gctccaggccccagcgttccgc

SEQ ID NO: 8117848 - DNA, 22 bp, Homo sapiens
gctctatgagtttctcagttta

SEQ ID NO: 8117849 - DNA, 22 bp, Homo sapiens
gctctaactattaagaggtcat

SEQ ID NO: 8117850 - DNA, 22 bp, Homo sapiens
gcctggctcgggcactcgccag

SEQ ID NO: 8117851 - DNA, 22 bp, Homo sapiens
gcgtgtttgcccagtgagtggc

SEQ ID NO: 8117852 - DNA, 22 bp, Homo sapiens
gctaattcttgataacataaca

SEQ ID NO: 8117853 - DNA, 22 bp, Homo sapiens
gctattgtgacagcttttcgcc

SEQ ID NO: 8117854 - DNA, 22 bp, Homo sapiens
gctcaaagaccagacagaggag

SEQ ID NO: 8117855 - DNA, 22 bp, Homo sapiens
gctcaaagaatattcagaatga

SEQ ID NO: 8117856 - DNA, 20 bp, Homo sapiens
caaatccctgctctgtgctg

SEQ ID NO: 8117857 - DNA, 22 bp, Homo sapiens
caaatagactctagaatttatt

SEQ ID NO: 8117858 - DNA, 17 bp, Homo sapiens
atttacattgtcaccga

SEQ ID NO: 8117859 - DNA, 22 bp, Homo sapiens
atttacataatagactttaggt

SEQ ID NO: 8117860 - DNA, 22 bp, Homo sapiens
atttacagtgtgcctactatat

SEQ ID NO: 8117861 - DNA, 22 bp, Homo sapiens
atttacagaccctcccactaag

SEQ ID NO: 8117862 - DNA, 18 bp, Homo sapiens
gccagagggcccaaggtc

SEQ ID NO: 8117863 - DNA, 22 bp, Homo sapiens
gccagagggattcctggtgtgt

SEQ ID NO: 8117864 - DNA, 22 bp, Homo sapiens
gccagaggggctcgaaggcgcg

SEQ ID NO: 8117865 - DNA, 20 bp, Homo sapiens
gcccactctaatccactgtc

SEQ ID NO: 8117866 - DNA, 22 bp, Homo sapiens
gcccactccagcttctcccaca

SEQ ID NO: 8117867 - DNA, 22 bp, Homo sapiens
gcccactccagcttctcccaca

SEQ ID NO: 8117868 - DNA, 19 bp, Homo sapiens
gcccacggccctgctctgc

SEQ ID NO: 8117869 - DNA, 22 bp, Homo sapiens
gccctgcagtgcggaggtggca

SEQ ID NO: 8117870 - DNA, 19 bp, Homo sapiens
gccctgcaggaggtggggc

SEQ ID NO: 8117871 - DNA, 19 bp, Homo sapiens
gccctcctcactgagctct

SEQ ID NO: 8117872 - DNA, 22 bp, Homo sapiens
gcccccttgacctaatcacctt

SEQ ID NO: 8117873 - DNA, 21 bp, Homo sapiens
gccccctggactcctcatcca

SEQ ID NO: 8117874 - DNA, 22 bp, Homo sapiens
atttgccttactgaagaaggag

SEQ ID NO: 8117875 - DNA, 22 bp, Homo sapiens
atttgccttactgaagaaggag

SEQ ID NO: 8117876 - DNA, 20 bp, Homo sapiens
atttgcatctgaataactta

SEQ ID NO: 8117877 - DNA, 23 bp, Homo sapiens
attttaaccttgactaacatgca

SEQ ID NO: 8117878 - DNA, 22 bp, Homo sapiens
attttaataagattcccaagta

SEQ ID NO: 8117879 - DNA, 22 bp, Homo sapiens
attttaataagatccatttggt

SEQ ID NO: 8117880 - DNA, 22 bp, Homo sapiens
attttaataagatccatttggt

SEQ ID NO: 8117881 - DNA, 22 bp, Homo sapiens
atttgatttgtagatagtgtag

SEQ ID NO: 8117882 - DNA, 22 bp, Homo sapiens
atttgattagctgtgtaatttt

SEQ ID NO: 8117883 - DNA, 22 bp, Homo sapiens
atttgagatggtaaataacttt

SEQ ID NO: 8117884 - DNA, 22 bp, Homo sapiens
gcctgcctagaattgcagcttt

SEQ ID NO: 8117885 - DNA, 22 bp, Homo sapiens
attttcttctctccctggctgc

SEQ ID NO: 8117886 - DNA, 22 bp, Homo sapiens
attttgaaaagcatttgagtaa

SEQ ID NO: 8117887 - DNA, 22 bp, Homo sapiens
attttgaaaccaagttatttcc

SEQ ID NO: 8117888 - DNA, 18 bp, Homo sapiens
attttgaactgggaatat

SEQ ID NO: 8117889 - DNA, 22 bp, Homo sapiens
attttgaaatacttgaaggaaa

SEQ ID NO: 8117890 - DNA, 22 bp, Homo sapiens
gcctggctcacagagcagcctt

SEQ ID NO: 8117891 - DNA, 22 bp, Homo sapiens
attttgaagggaattgaagttc

SEQ ID NO: 8117892 - DNA, 22 bp, Homo sapiens
gcctggctccctctgcagctcc

SEQ ID NO: 8117893 - DNA, 22 bp, Homo sapiens
gcagccaggtttgaggaccact

SEQ ID NO: 8117894 - DNA, 22 bp, Homo sapiens
gcagccagggagagaaccaggg

SEQ ID NO: 8117895 - DNA, 16 bp, Homo sapiens
gcagaggaaaggggag

SEQ ID NO: 8117896 - DNA, 22 bp, Homo sapiens
gcagaagtggtgctgtgccact

SEQ ID NO: 8117897 - DNA, 22 bp, Homo sapiens
gcactgtgacccagagcaggtg

SEQ ID NO: 8117898 - DNA, 22 bp, Homo sapiens
gcagaagggaataaggagcttt

SEQ ID NO: 8117899 - DNA, 22 bp, Homo sapiens
gcagaagggaataaggagcttt

SEQ ID NO: 8117900 - DNA, 22 bp, Homo sapiens
gcagaaggtctggcacttcagg

SEQ ID NO: 8117901 - DNA, 22 bp, Homo sapiens
gcagaagtacctcgttctagtt

SEQ ID NO: 8117902 - DNA, 22 bp, Homo sapiens
gcagaagtggattctacaattt

SEQ ID NO: 8117903 - DNA, 21 bp, Homo sapiens
gcagaagtggctacatctcca

SEQ ID NO: 8117904 - DNA, 22 bp, Homo sapiens
gcaaaagtacagccggatttct

SEQ ID NO: 8117905 - DNA, 22 bp, Homo sapiens
gcaaatggagtgaagagctgga

SEQ ID NO: 8117906 - DNA, 23 bp, Homo sapiens
gcactgggctctcagcaaggtgt

SEQ ID NO: 8117907 - DNA, 22 bp, Homo sapiens
gcactcagtaccaggtcactgc

SEQ ID NO: 8117908 - DNA, 22 bp, Homo sapiens
gcactgtagtgggggagaaatg

SEQ ID NO: 8117909 - DNA, 22 bp, Homo sapiens
gcactgggggcagcagtgaggg

SEQ ID NO: 8117910 - DNA, 22 bp, Homo sapiens
gcacagggagacagccgtggcc

SEQ ID NO: 8117911 - DNA, 22 bp, Homo sapiens
gcacagagctggccctccaggc

SEQ ID NO: 8117912 - DNA, 23 bp, Homo sapiens
gcacagagcagttaggggaagat

SEQ ID NO: 8117913 - DNA, 22 bp, Homo sapiens
attgtaaaagtattctaagatt

SEQ ID NO: 8117914 - DNA, 22 bp, Homo sapiens
gcagggtctgaggccacagagg

SEQ ID NO: 8117915 - DNA, 22 bp, Homo sapiens
gcagggtcttgagaggcagcca

SEQ ID NO: 8117916 - DNA, 22 bp, Homo sapiens
gcagggtcgctctaggagatca

SEQ ID NO: 8117917 - DNA, 22 bp, Homo sapiens
gcagggtccatggaggcagccc

SEQ ID NO: 8117918 - DNA, 22 bp, Homo sapiens
gcaggggttttctgacttgagt

SEQ ID NO: 8117919 - DNA, 22 bp, Homo sapiens
gcaggattgggcagagggtgaa

SEQ ID NO: 8117920 - DNA, 22 bp, Homo sapiens
gcaggatgggtgtagcccagca

SEQ ID NO: 8117921 - DNA, 22 bp, Homo sapiens
gcaggctgtagacaccaaacta

SEQ ID NO: 8117922 - DNA, 22 bp, Homo sapiens
gcaggctgtctaaagttagagt

SEQ ID NO: 8117923 - DNA, 22 bp, Homo sapiens
gcaggctgtagacaccaaacta

SEQ ID NO: 8117924 - DNA, 22 bp, Homo sapiens
gcaggctgtctaaagttagagt

SEQ ID NO: 8117925 - DNA, 22 bp, Homo sapiens
gcaggctgtctaaagttagagt

SEQ ID NO: 8117926 - DNA, 22 bp, Homo sapiens
gcaggctgtgaggctcagatgg

SEQ ID NO: 8117927 - DNA, 22 bp, Homo sapiens
gcaggctgtgaggctcagatgg

SEQ ID NO: 8117928 - DNA, 22 bp, Homo sapiens
gcaggctgtggtatgttgggca

SEQ ID NO: 8117929 - DNA, 22 bp, Homo sapiens
gcaggctgtggtatgttgggca

SEQ ID NO: 8117930 - DNA, 18 bp, Homo sapiens
gcagtgccagcctctcct

SEQ ID NO: 8117931 - DNA, 22 bp, Homo sapiens
attgttatgaaaataagatgtt

SEQ ID NO: 8117932 - DNA, 21 bp, Homo sapiens
attgttctggaggaaaggatt

SEQ ID NO: 8117933 - DNA, 22 bp, Homo sapiens
atttaaatgcttaagagggttt

SEQ ID NO: 8117934 - DNA, 22 bp, Homo sapiens
gccactgcactccagcccaggc

SEQ ID NO: 8117935 - DNA, 22 bp, Homo sapiens
gccactcatgggaggtgtgcaa

SEQ ID NO: 8117936 - DNA, 23 bp, Homo sapiens
atgaatgaataaggcaggaaagc

SEQ ID NO: 8117937 - DNA, 22 bp, Homo sapiens
cttgagggcaggattctgtttt

SEQ ID NO: 8117938 - DNA, 22 bp, Homo sapiens
atcttcaatatttttgtgtaga

SEQ ID NO: 8117939 - DNA, 22 bp, Homo sapiens
cttgagaatgtgagccacagat

SEQ ID NO: 8117940 - DNA, 22 bp, Homo sapiens
cttgagaaggaggaagggcttt

SEQ ID NO: 8117941 - DNA, 22 bp, Homo sapiens
atgaatggatggggtcaagata

SEQ ID NO: 8117942 - DNA, 19 bp, Homo sapiens
atgaatgagctgtgaggtt

SEQ ID NO: 8117943 - DNA, 22 bp, Homo sapiens
gaaaatgagcctcagctacatt

SEQ ID NO: 8117944 - DNA, 22 bp, Homo sapiens
atgaggcatgtgaggagaaggg

SEQ ID NO: 8117945 - DNA, 22 bp, Homo sapiens
gaaatgattttagtttatcatg

SEQ ID NO: 8117946 - DNA, 22 bp, Homo sapiens
gaaatgatgtctgtgctgccac

SEQ ID NO: 8117947 - DNA, 22 bp, Homo sapiens
gaacatgatggctgttattttg

SEQ ID NO: 8117948 - DNA, 20 bp, Homo sapiens
gaacatggcaggtggagggg

SEQ ID NO: 8117949 - DNA, 22 bp, Homo sapiens
gaactttgcaaatgtcagaagc

SEQ ID NO: 8117950 - DNA, 17 bp, Homo sapiens
gaacttttattaaattc

SEQ ID NO: 8117951 - DNA, 22 bp, Homo sapiens
gaactttaccatttaggtaact

SEQ ID NO: 8117952 - DNA, 22 bp, Homo sapiens
atgcatatcagtgattgtttgc

SEQ ID NO: 8117953 - DNA, 20 bp, Homo sapiens
atgcatatatgtggtgtctg

SEQ ID NO: 8117954 - DNA, 22 bp, Homo sapiens
atgcatatctcctatctcctca

SEQ ID NO: 8117955 - DNA, 22 bp, Homo sapiens
atgcatatgcatctgtgtacat

SEQ ID NO: 8117956 - DNA, 22 bp, Homo sapiens
atgccctgagcaggccttcaag

SEQ ID NO: 8117957 - DNA, 22 bp, Homo sapiens
atgccctgtgactctcctggac

SEQ ID NO: 8117958 - DNA, 22 bp, Homo sapiens
gacagggacgaggcttcaggca

SEQ ID NO: 8117959 - DNA, 22 bp, Homo sapiens
gaagcagagcctaaggcagaca

SEQ ID NO: 8117960 - DNA, 22 bp, Homo sapiens
gaagcacatggctatagctatt

SEQ ID NO: 8117961 - DNA, 22 bp, Homo sapiens
atgcatatagaacatttgacat

SEQ ID NO: 8117962 - DNA, 22 bp, Homo sapiens
atgcatataaggcacatgtatt

SEQ ID NO: 8117963 - DNA, 22 bp, Homo sapiens
atgcatataatggccagaacaa

SEQ ID NO: 8117964 - DNA, 22 bp, Homo sapiens
gaatgtgaggttgtatgtgaaa

SEQ ID NO: 8117965 - DNA, 19 bp, Homo sapiens
gaatgtctcctacttctga

SEQ ID NO: 8117966 - DNA, 22 bp, Homo sapiens
gaatgtgggctgtgaagaggag

SEQ ID NO: 8117967 - DNA, 21 bp, Homo sapiens
gactttcttaccagatttttg

SEQ ID NO: 8117968 - DNA, 22 bp, Homo sapiens
gaccctctagatggaagcactg

SEQ ID NO: 8117969 - DNA, 18 bp, Homo sapiens
gaccccgggatctgtcga

SEQ ID NO: 8117970 - DNA, 22 bp, Homo sapiens
gacagggaggaaagagactgct

SEQ ID NO: 8117971 - DNA, 22 bp, Homo sapiens
gacagggccgcagatggagact

SEQ ID NO: 8117972 - DNA, 20 bp, Homo sapiens
atgtttaatgttgtccaccc

SEQ ID NO: 8117973 - DNA, 22 bp, Homo sapiens
gatctggaatctgaaggctgag

SEQ ID NO: 8117974 - DNA, 22 bp, Homo sapiens
gatctggaagaaagggagggca

SEQ ID NO: 8117975 - DNA, 22 bp, Homo sapiens
gatatttacattaagcacattg

SEQ ID NO: 8117976 - DNA, 22 bp, Homo sapiens
gatatttacaaatttgccaata

SEQ ID NO: 8117977 - DNA, 22 bp, Homo sapiens
gatcgggtgggttctgccatca

SEQ ID NO: 8117978 - DNA, 22 bp, Homo sapiens
gagggggtctatgaggtagagc

SEQ ID NO: 8117979 - DNA, 18 bp, Homo sapiens
gaggtagataagattttc

SEQ ID NO: 8117980 - DNA, 22 bp, Homo sapiens
gagggggcgaacagaagcaagg

SEQ ID NO: 8117981 - DNA, 22 bp, Homo sapiens
gaggggggcgccctgcagtgca

SEQ ID NO: 8117982 - DNA, 22 bp, Homo sapiens
gagggggctagcgcagtgccca

SEQ ID NO: 8117983 - DNA, 22 bp, Homo sapiens
gagggatggtagttgacactga

SEQ ID NO: 8117984 - DNA, 22 bp, Homo sapiens
gagggaagaaagaattgatgcg

SEQ ID NO: 8117985 - DNA, 22 bp, Homo sapiens
gagggatgtgcctgaaggcagg

SEQ ID NO: 8117986 - DNA, 22 bp, Homo sapiens
gagggatggtgtgagaggctca

SEQ ID NO: 8117987 - DNA, 22 bp, Homo sapiens
gagggatggtgtgagaggctca

SEQ ID NO: 8117988 - DNA, 23 bp, Homo sapiens
gaggccacattcccctgcttgag

SEQ ID NO: 8117989 - DNA, 22 bp, Homo sapiens
atgtaaagttacttgagttttg

SEQ ID NO: 8117990 - DNA, 23 bp, Homo sapiens
atgtaagagttccagttactttg

SEQ ID NO: 8117991 - DNA, 22 bp, Homo sapiens
atgtcacagcaggagtattctt

SEQ ID NO: 8117992 - DNA, 22 bp, Homo sapiens
atgtcacaggcaacaagattgc

SEQ ID NO: 8117993 - DNA, 22 bp, Homo sapiens
atgtacaatctagggtttgcat

SEQ ID NO: 8117994 - DNA, 22 bp, Homo sapiens
gaggaagatggttgagtggtcc

SEQ ID NO: 8117995 - DNA, 22 bp, Homo sapiens
gaggaagctgcgtggcatttca

SEQ ID NO: 8117996 - DNA, 22 bp, Homo sapiens
gagctctgcagattgttttagg

SEQ ID NO: 8117997 - DNA, 22 bp, Homo sapiens
gagcctggggaccctcctgagt

SEQ ID NO: 8117998 - DNA, 22 bp, Homo sapiens
gagcagtgaagacagaagtaca

SEQ ID NO: 8117999 - DNA, 22 bp, Homo sapiens
gagcagtgactggagcatgaga

SEQ ID NO: 8118000 - DNA, 22 bp, Homo sapiens
gagcaggtctttcatggtgcat

SEQ ID NO: 8118001 - DNA, 22 bp, Homo sapiens
gagcacagggaatagacagata

SEQ ID NO: 8118002 - DNA, 21 bp, Homo sapiens
atggaaaaacaggtagagcat

SEQ ID NO: 8118003 - DNA, 22 bp, Homo sapiens
cagagacagtttcacagggtct

SEQ ID NO: 8118004 - DNA, 23 bp, Homo sapiens
cagaagcacctgttgactgctgc

SEQ ID NO: 8118005 - DNA, 22 bp, Homo sapiens
cagaagcaaatgccttgctgag

SEQ ID NO: 8118006 - DNA, 16 bp, Homo sapiens
cagagaggacagaggc

SEQ ID NO: 8118007 - DNA, 22 bp, Homo sapiens
cagagagcacataggatacttt

SEQ ID NO: 8118008 - DNA, 22 bp, Homo sapiens
cagaggaccagaaaggggccca

SEQ ID NO: 8118009 - DNA, 22 bp, Homo sapiens
cagaggaagctgggtgtggagt

SEQ ID NO: 8118010 - DNA, 22 bp, Homo sapiens
cagaggaagggtgctgcgaaag

SEQ ID NO: 8118011 - DNA, 22 bp, Homo sapiens
cagaggaaggctctgggaatgt

SEQ ID NO: 8118012 - DNA, 22 bp, Homo sapiens
cagaggaagttccttgatgaga

SEQ ID NO: 8118013 - DNA, 22 bp, Homo sapiens
cagaggacaactggggcaagga

SEQ ID NO: 8118014 - DNA, 22 bp, Homo sapiens
cagaggcagaggtcatctctgg

SEQ ID NO: 8118015 - DNA, 22 bp, Homo sapiens
gggggaggtgaatgcaataagg

SEQ ID NO: 8118016 - DNA, 20 bp, Homo sapiens
gggctctgcatccatcagcc

SEQ ID NO: 8118017 - DNA, 22 bp, Homo sapiens
cagaggaacgtttggattgatt

SEQ ID NO: 8118018 - DNA, 22 bp, Homo sapiens
cagaggaagagatacaagccct

SEQ ID NO: 8118019 - DNA, 22 bp, Homo sapiens
cagaggaaatgggaaggagata

SEQ ID NO: 8118020 - DNA, 22 bp, Homo sapiens
cagaggaaagtatttctggaag

SEQ ID NO: 8118021 - DNA, 22 bp, Homo sapiens
gggctcagtcggcaagcccctt

SEQ ID NO: 8118022 - DNA, 22 bp, Homo sapiens
gggctcaggcctggcctctcac

SEQ ID NO: 8118023 - DNA, 22 bp, Homo sapiens
cagaggctgaccctgctgttgt

SEQ ID NO: 8118024 - DNA, 22 bp, Homo sapiens
cagaggctgagcagtcagtttg

SEQ ID NO: 8118025 - DNA, 22 bp, Homo sapiens
cagaggctgccagccatgtgca

SEQ ID NO: 8118026 - DNA, 22 bp, Homo sapiens
ggggtcggggcatagccactta

SEQ ID NO: 8118027 - DNA, 22 bp, Homo sapiens
ggggtgagatcaaggaagccct

SEQ ID NO: 8118028 - DNA, 22 bp, Homo sapiens
cagagtgaaaactgagctcaaa

SEQ ID NO: 8118029 - DNA, 22 bp, Homo sapiens
cagagtgtatctgtgtaagcat

SEQ ID NO: 8118030 - DNA, 22 bp, Homo sapiens
cagatgcttcgtgggtgagcac

SEQ ID NO: 8118031 - DNA, 22 bp, Homo sapiens
gtaacattattcatgagataca

SEQ ID NO: 8118032 - DNA, 19 bp, Homo sapiens
ggtgtgccaaatgggaatg

SEQ ID NO: 8118033 - DNA, 22 bp, Homo sapiens
gtaacatttacagttcctagag

SEQ ID NO: 8118034 - DNA, 22 bp, Homo sapiens
ggtgtctgttgcctcctggtta

SEQ ID NO: 8118035 - DNA, 19 bp, Homo sapiens
ggtgtgaagtgaggagtta

SEQ ID NO: 8118036 - DNA, 22 bp, Homo sapiens
cagcagactggagtaggcagtg

SEQ ID NO: 8118037 - DNA, 22 bp, Homo sapiens
cagcagacttactagaatgtaa

SEQ ID NO: 8118038 - DNA, 22 bp, Homo sapiens
cagatggaacacagaaaggaga

SEQ ID NO: 8118039 - DNA, 22 bp, Homo sapiens
cagatggagtcccgtggagttc

SEQ ID NO: 8118040 - DNA, 22 bp, Homo sapiens
cagcactgctgctgtacacaca

SEQ ID NO: 8118041 - DNA, 22 bp, Homo sapiens
cagctcctctggccagccctgc

SEQ ID NO: 8118042 - DNA, 22 bp, Homo sapiens
cagctctgagactgaggctatg

SEQ ID NO: 8118043 - DNA, 22 bp, Homo sapiens
gtgcaggagctcccgcagtggt

SEQ ID NO: 8118044 - DNA, 22 bp, Homo sapiens
gtgcatccagccatgagaacca

SEQ ID NO: 8118045 - DNA, 22 bp, Homo sapiens
gtgcatgaagactcagaaagtc

SEQ ID NO: 8118046 - DNA, 22 bp, Homo sapiens
cagcccttccttctgtttatac

SEQ ID NO: 8118047 - DNA, 22 bp, Homo sapiens
cagcccttggcccagggcacag

SEQ ID NO: 8118048 - DNA, 20 bp, Homo sapiens
cagccctttatcctcctatg

SEQ ID NO: 8118049 - DNA, 22 bp, Homo sapiens
gtgcctgggcatgagcttgttg

SEQ ID NO: 8118050 - DNA, 22 bp, Homo sapiens
gtgctgagctgcagatgcgctc

SEQ ID NO: 8118051 - DNA, 22 bp, Homo sapiens
cagctcagcttcctgggtgtgt

SEQ ID NO: 8118052 - DNA, 21 bp, Homo sapiens
cagctccactaaagcagctgt

SEQ ID NO: 8118053 - DNA, 22 bp, Homo sapiens
cagctccagcccaggcagctcc

SEQ ID NO: 8118054 - DNA, 22 bp, Homo sapiens
cagctcccagtggcagctcctt

SEQ ID NO: 8118055 - DNA, 23 bp, Homo sapiens
cagctccagtgcactcaggtagc

SEQ ID NO: 8118056 - DNA, 22 bp, Homo sapiens
gtgcagcctgtcgccagtggat

SEQ ID NO: 8118057 - DNA, 22 bp, Homo sapiens
gtgaatggggcaggaaggatgg

SEQ ID NO: 8118058 - DNA, 18 bp, Homo sapiens
gtctcaggagtggcacgt

SEQ ID NO: 8118059 - DNA, 22 bp, Homo sapiens
cagcagggttaagtgactcacc

SEQ ID NO: 8118060 - DNA, 22 bp, Homo sapiens
cagcaggtctcagcagctcctt

SEQ ID NO: 8118061 - DNA, 22 bp, Homo sapiens
cagcagtggctgcaggcagctg

SEQ ID NO: 8118062 - DNA, 22 bp, Homo sapiens
cagcaggtggacacactcacct

SEQ ID NO: 8118063 - DNA, 22 bp, Homo sapiens
cagcaggtgctgcctgtcaccc

SEQ ID NO: 8118064 - DNA, 23 bp, Homo sapiens
cacatgcaggcagtggccttcaa

SEQ ID NO: 8118065 - DNA, 22 bp, Homo sapiens
cacatgcagtttacgtcactga

SEQ ID NO: 8118066 - DNA, 22 bp, Homo sapiens
cacatgcatctgtcatgtttgg

SEQ ID NO: 8118067 - DNA, 21 bp, Homo sapiens
cacatgcatgcacaggttgta

SEQ ID NO: 8118068 - DNA, 22 bp, Homo sapiens
cacatgcatgccaggctcacag

SEQ ID NO: 8118069 - DNA, 22 bp, Homo sapiens
cacatgcattggcaaaagtgta

SEQ ID NO: 8118070 - DNA, 22 bp, Homo sapiens
cacatgcataaggataattact

SEQ ID NO: 8118071 - DNA, 22 bp, Homo sapiens
cacatgcagttttccagcagtc

SEQ ID NO: 8118072 - DNA, 22 bp, Homo sapiens
cacatgcatacctatgtgtata

SEQ ID NO: 8118073 - DNA, 22 bp, Homo sapiens
cacatgcatcacgacttccttt

SEQ ID NO: 8118074 - DNA, 22 bp, Homo sapiens
ggagtgactcacagctgggaca

SEQ ID NO: 8118075 - DNA, 22 bp, Homo sapiens
ggagtgaaaggtaagttgagct

SEQ ID NO: 8118076 - DNA, 22 bp, Homo sapiens
ggagtgaagtggcgcgatctcg

SEQ ID NO: 8118077 - DNA, 22 bp, Homo sapiens
ggagtgagcaaatagagatttg

SEQ ID NO: 8118078 - DNA, 22 bp, Homo sapiens
ggagtgagcaaatagagatttg

SEQ ID NO: 8118079 - DNA, 22 bp, Homo sapiens
ggatatctgccccatgagtcac

SEQ ID NO: 8118080 - DNA, 22 bp, Homo sapiens
ggatcagaggatcagggacagt

SEQ ID NO: 8118081 - DNA, 22 bp, Homo sapiens
ggatcaggcgccatgggaagtg

SEQ ID NO: 8118082 - DNA, 22 bp, Homo sapiens
ggcaggaagtagcagtctgagc

SEQ ID NO: 8118083 - DNA, 18 bp, Homo sapiens
ggccagccccaggccagc

SEQ ID NO: 8118084 - DNA, 22 bp, Homo sapiens
ggccagctcagtctccatcagg

SEQ ID NO: 8118085 - DNA, 22 bp, Homo sapiens
cacccaggcaggtggctgagaa

SEQ ID NO: 8118086 - DNA, 22 bp, Homo sapiens
cacccaggacaaaatatggaat

SEQ ID NO: 8118087 - DNA, 22 bp, Homo sapiens
cacccaggacaggccagatgtg

SEQ ID NO: 8118088 - DNA, 22 bp, Homo sapiens
cacccaggacaggccagatgtg

SEQ ID NO: 8118089 - DNA, 22 bp, Homo sapiens
cacccaggaggttgggaagggc

SEQ ID NO: 8118090 - DNA, 22 bp, Homo sapiens
cacccaggcaaggattctgcaa

SEQ ID NO: 8118091 - DNA, 22 bp, Homo sapiens
cagaacagacttaacagggctg

SEQ ID NO: 8118092 - DNA, 22 bp, Homo sapiens
cagaacagtacctagcacatag

SEQ ID NO: 8118093 - DNA, 19 bp, Homo sapiens
cagaacaggaccaggggcc

SEQ ID NO: 8118094 - DNA, 22 bp, Homo sapiens
cagaagaggactgggtagctca

SEQ ID NO: 8118095 - DNA, 22 bp, Homo sapiens
cagaagagtagctgaacaagtt

SEQ ID NO: 8118096 - DNA, 20 bp, Homo sapiens
cagaacagtctgagaggcca

SEQ ID NO: 8118097 - DNA, 19 bp, Homo sapiens
cagaaatagcgaagtgtaa

SEQ ID NO: 8118098 - DNA, 22 bp, Homo sapiens
cactgtctgtgtgtccttgggg

SEQ ID NO: 8118099 - DNA, 22 bp, Homo sapiens
ggctgcagccctcgcctagcca

SEQ ID NO: 8118100 - DNA, 22 bp, Homo sapiens
ggctgcagattgtagtctgtta

SEQ ID NO: 8118101 - DNA, 22 bp, Homo sapiens
ggctgcagatagccagccacca

SEQ ID NO: 8118102 - DNA, 22 bp, Homo sapiens
ggctcctgggggtgctcctgcc

SEQ ID NO: 8118103 - DNA, 22 bp, Homo sapiens
cactgcccagcgtcttaggcac

SEQ ID NO: 8118104 - DNA, 22 bp, Homo sapiens
cactgcccaggacctgccaccc

SEQ ID NO: 8118105 - DNA, 22 bp, Homo sapiens
cactgcccaggacctgccaccc

SEQ ID NO: 8118106 - DNA, 20 bp, Homo sapiens
cactgccctccagcctgagc

SEQ ID NO: 8118107 - DNA, 22 bp, Homo sapiens
ggcgctcagtgttgccccagag

SEQ ID NO: 8118108 - DNA, 22 bp, Homo sapiens
cactgattaagtctgctagagg

SEQ ID NO: 8118109 - DNA, 22 bp, Homo sapiens
caagttgctctgcctctgtagg

SEQ ID NO: 8118110 - DNA, 21 bp, Homo sapiens
caagtgtggatgtggaaggta

SEQ ID NO: 8118111 - DNA, 22 bp, Homo sapiens
caagttacagcgctgacagcag

SEQ ID NO: 8118112 - DNA, 22 bp, Homo sapiens
caatcccatcaccatctgctct

SEQ ID NO: 8118113 - DNA, 22 bp, Homo sapiens
caatggctctagagggttgtgt

SEQ ID NO: 8118114 - DNA, 20 bp, Homo sapiens
caaattctgttgaatacacc

SEQ ID NO: 8118115 - DNA, 22 bp, Homo sapiens
gctggaggctggagtgcagtgg

SEQ ID NO: 8118116 - DNA, 22 bp, Homo sapiens
gctggcagagagctggtgagga

SEQ ID NO: 8118117 - DNA, 19 bp, Homo sapiens
gctggcagatgtggccgtg

SEQ ID NO: 8118118 - DNA, 19 bp, Homo sapiens
gctggcagatgtggccgtg

SEQ ID NO: 8118119 - DNA, 22 bp, Homo sapiens
gctggcagagctctgggctggg

SEQ ID NO: 8118120 - DNA, 20 bp, Homo sapiens
gctggcagatgtcttgagat

SEQ ID NO: 8118121 - DNA, 22 bp, Homo sapiens
gctggcagcattagaccctggg

SEQ ID NO: 8118122 - DNA, 22 bp, Homo sapiens
gctgggagccccgagccagcgc

SEQ ID NO: 8118123 - DNA, 19 bp, Homo sapiens
gctgggagcagaccctccc

SEQ ID NO: 8118124 - DNA, 22 bp, Homo sapiens
ggaaggggccttgagcaaactg

SEQ ID NO: 8118125 - DNA, 22 bp, Homo sapiens
ggacaaagggtggagcctctga

SEQ ID NO: 8118126 - DNA, 22 bp, Homo sapiens
ggacaaaggtctggggaacctg

SEQ ID NO: 8118127 - DNA, 22 bp, Homo sapiens
ggacagagggttgacagagtat

SEQ ID NO: 8118128 - DNA, 22 bp, Homo sapiens
ggacacagataatcacacagat

SEQ ID NO: 8118129 - DNA, 19 bp, Homo sapiens
ggacacagaaagctgcatt

SEQ ID NO: 8118130 - DNA, 19 bp, Homo sapiens
ggaagagaggaaaggtgga

SEQ ID NO: 8118131 - DNA, 22 bp, Homo sapiens
ggaagagagatcccatagatgt

SEQ ID NO: 8118132 - DNA, 22 bp, Homo sapiens
ggaagagaatgatggctatggg

SEQ ID NO: 8118133 - DNA, 22 bp, Homo sapiens
ggaacaggaaaggagggatgct

SEQ ID NO: 8118134 - DNA, 22 bp, Homo sapiens
ggaacaggaaaggagggatgct

SEQ ID NO: 8118135 - DNA, 22 bp, Homo sapiens
ggaagagaaatgagtcaagact

SEQ ID NO: 8118136 - DNA, 22 bp, Homo sapiens
ggacagcatatcagcagggcag

SEQ ID NO: 8118137 - DNA, 22 bp, Homo sapiens
ggacagcattcctagttccaaa

SEQ ID NO: 8118138 - DNA, 22 bp, Homo sapiens
ggacagcatatcagcagggcag

SEQ ID NO: 8118139 - DNA, 22 bp, Homo sapiens
ggagagtctgccgagccagccc

SEQ ID NO: 8118140 - DNA, 22 bp, Homo sapiens
ggagagtggattccagctgtat

SEQ ID NO: 8118141 - DNA, 17 bp, Homo sapiens
ggagagtgggaatggcc

SEQ ID NO: 8118142 - DNA, 22 bp, Homo sapiens
cacagagaatactgctcttgct

SEQ ID NO: 8118143 - DNA, 22 bp, Homo sapiens
ggagatagtccaggtgaaggga

SEQ ID NO: 8118144 - DNA, 22 bp, Homo sapiens
ggagatatttgcaggtcttatg

SEQ ID NO: 8118145 - DNA, 22 bp, Homo sapiens
ggagggagtttcattcctgccc

SEQ ID NO: 8118146 - DNA, 22 bp, Homo sapiens
ggaggggagtctcccaaagccg

SEQ ID NO: 8118147 - DNA, 22 bp, Homo sapiens
ggaggggccggctgcctgccac

SEQ ID NO: 8118148 - DNA, 22 bp, Homo sapiens
ggaggggcatagttcaccatca

SEQ ID NO: 8118149 - DNA, 22 bp, Homo sapiens
ggaggggcagccatggaactcc

SEQ ID NO: 8118150 - DNA, 22 bp, Homo sapiens
ggaggggcaggtcccaagttgt

SEQ ID NO: 8118151 - DNA, 22 bp, Homo sapiens
ggaggagcatgagagggtagtg

SEQ ID NO: 8118152 - DNA, 22 bp, Homo sapiens
ggaggagcacttctgagctcag

SEQ ID NO: 8118153 - DNA, 22 bp, Homo sapiens
ggaggagaccctgtgtcagttt

SEQ ID NO: 8118154 - DNA, 22 bp, Homo sapiens
ggaggagacggagtgattagtg

SEQ ID NO: 8118155 - DNA, 22 bp, Homo sapiens
ggaggagacggagtgattagtg

SEQ ID NO: 8118156 - DNA, 22 bp, Homo sapiens
cacagcagggatgaatggagtg

SEQ ID NO: 8118157 - DNA, 22 bp, Homo sapiens
cacagcagggatgaatggagtg

SEQ ID NO: 8118158 - DNA, 22 bp, Homo sapiens
cacagcccccttgacactctgg

SEQ ID NO: 8118159 - DNA, 22 bp, Homo sapiens
cacagcccccttgacactctgg

SEQ ID NO: 8118160 - DNA, 22 bp, Homo sapiens
cacagcattcacagaaagacat

SEQ ID NO: 8118161 - DNA, 22 bp, Homo sapiens
ggagcagccacgtctcagggca

SEQ ID NO: 8118162 - DNA, 22 bp, Homo sapiens
ggagcagccgcgtctcagggca

SEQ ID NO: 8118163 - DNA, 22 bp, Homo sapiens
cagtacatttcatatgattcta

SEQ ID NO: 8118164 - DNA, 22 bp, Homo sapiens
tatgtacatgatttcatttgct

SEQ ID NO: 8118165 - DNA, 22 bp, Homo sapiens
tatgtacatcttgagcaatgaa

SEQ ID NO: 8118166 - DNA, 22 bp, Homo sapiens
tatgtacatgttaaagggcaaa

SEQ ID NO: 8118167 - DNA, 22 bp, Homo sapiens
tatgtacatggagagcaattga

SEQ ID NO: 8118168 - DNA, 22 bp, Homo sapiens
tatgtacatcgttgaattcaaa

SEQ ID NO: 8118169 - DNA, 22 bp, Homo sapiens
tatgatatgcactttatcagaa

SEQ ID NO: 8118170 - DNA, 22 bp, Homo sapiens
tatattcattttaaagccatct

SEQ ID NO: 8118171 - DNA, 21 bp, Homo sapiens
cagggccaatcctgacctcta

SEQ ID NO: 8118172 - DNA, 22 bp, Homo sapiens
tagtaataagttgtgctttgat

SEQ ID NO: 8118173 - DNA, 22 bp, Homo sapiens
tagtacactaccatcaggtttt

SEQ ID NO: 8118174 - DNA, 19 bp, Homo sapiens
tagtacacactctaattcc

SEQ ID NO: 8118175 - DNA, 22 bp, Homo sapiens
tagtacactctgtaagtttaaa

SEQ ID NO: 8118176 - DNA, 22 bp, Homo sapiens
cagggctggatttcatttctag

SEQ ID NO: 8118177 - DNA, 22 bp, Homo sapiens
tagttttagtcccattttacag

SEQ ID NO: 8118178 - DNA, 22 bp, Homo sapiens
tagttttagtcccattttacag

SEQ ID NO: 8118179 - DNA, 22 bp, Homo sapiens
tatataatttgtaaaagcacct

SEQ ID NO: 8118180 - DNA, 22 bp, Homo sapiens
tatattcaatgattagtatcag

SEQ ID NO: 8118181 - DNA, 18 bp, Homo sapiens
tatatagagaaacccatt

SEQ ID NO: 8118182 - DNA, 22 bp, Homo sapiens
tagtttgtaatgaggagaagta

SEQ ID NO: 8118183 - DNA, 22 bp, Homo sapiens
tagtttctgaggattgaaagat

SEQ ID NO: 8118184 - DNA, 22 bp, Homo sapiens
cagtgcaggtttagggctgggg

SEQ ID NO: 8118185 - DNA, 22 bp, Homo sapiens
cagtgcagtcaaggaagaacca

SEQ ID NO: 8118186 - DNA, 22 bp, Homo sapiens
cagtgcagttggtggcaggggt

SEQ ID NO: 8118187 - DNA, 22 bp, Homo sapiens
cagtgcagtttcccagatgctg

SEQ ID NO: 8118188 - DNA, 22 bp, Homo sapiens
cagtggaggctcaagtgtgctt

SEQ ID NO: 8118189 - DNA, 22 bp, Homo sapiens
cagtggaggccttgggaccttt

SEQ ID NO: 8118190 - DNA, 22 bp, Homo sapiens
cagtggagtgggactggtctga

SEQ ID NO: 8118191 - DNA, 22 bp, Homo sapiens
cagtggcaatgggacagagcac

SEQ ID NO: 8118192 - DNA, 22 bp, Homo sapiens
cagtggattagccagagctgga

SEQ ID NO: 8118193 - DNA, 22 bp, Homo sapiens
cagtggcaagtccggtattgaa

SEQ ID NO: 8118194 - DNA, 22 bp, Homo sapiens
tcacactctgcgggtgaccttt

SEQ ID NO: 8118195 - DNA, 19 bp, Homo sapiens
cagtggagattggaggagg

SEQ ID NO: 8118196 - DNA, 22 bp, Homo sapiens
tcacactgtgaagagacaagca

SEQ ID NO: 8118197 - DNA, 22 bp, Homo sapiens
tcactctctaagcatgacagac

SEQ ID NO: 8118198 - DNA, 19 bp, Homo sapiens
tcactctccctgtctgtcc

SEQ ID NO: 8118199 - DNA, 22 bp, Homo sapiens
cagtggcacccacgggctgggc

SEQ ID NO: 8118200 - DNA, 21 bp, Homo sapiens
tcactgcaatgctaggagaaa

SEQ ID NO: 8118201 - DNA, 22 bp, Homo sapiens
cagtggcagagaacagagacct

SEQ ID NO: 8118202 - DNA, 22 bp, Homo sapiens
cagtagaagcttgtttttcaga

SEQ ID NO: 8118203 - DNA, 22 bp, Homo sapiens
tattccaatgtcagttatatca

SEQ ID NO: 8118204 - DNA, 22 bp, Homo sapiens
tcaaaggagacacaaggagaaa

SEQ ID NO: 8118205 - DNA, 22 bp, Homo sapiens
tcaaaggaatttgattttgatg

SEQ ID NO: 8118206 - DNA, 22 bp, Homo sapiens
tcaaaggaaacacaagcttctg

SEQ ID NO: 8118207 - DNA, 22 bp, Homo sapiens
tcaaagcttagataatttcttt

SEQ ID NO: 8118208 - DNA, 22 bp, Homo sapiens
cagtccctagtggagctcacag

SEQ ID NO: 8118209 - DNA, 22 bp, Homo sapiens
cagtcccagtttgagactctgg

SEQ ID NO: 8118210 - DNA, 22 bp, Homo sapiens
cagtcccagctgctcagaaggc

SEQ ID NO: 8118211 - DNA, 22 bp, Homo sapiens
caggctgcagcagcagtggccc

SEQ ID NO: 8118212 - DNA, 22 bp, Homo sapiens
caggctgcagcagcagtggccc

SEQ ID NO: 8118213 - DNA, 22 bp, Homo sapiens
tacccagggcttttctgatgca

SEQ ID NO: 8118214 - DNA, 22 bp, Homo sapiens
tacccaggggctgagcagaggt

SEQ ID NO: 8118215 - DNA, 22 bp, Homo sapiens
tacccaggaggaaactgaggct

SEQ ID NO: 8118216 - DNA, 22 bp, Homo sapiens
tacccaggagaaacagcagggc

SEQ ID NO: 8118217 - DNA, 22 bp, Homo sapiens
caggctgcagcagcagtggccc

SEQ ID NO: 8118218 - DNA, 23 bp, Homo sapiens
tagacataagctctgtcaccttc

SEQ ID NO: 8118219 - DNA, 22 bp, Homo sapiens
cagggagaggcatcatagggaa

SEQ ID NO: 8118220 - DNA, 22 bp, Homo sapiens
cagggagaggctggtggagtaa

SEQ ID NO: 8118221 - DNA, 22 bp, Homo sapiens
cagggagaggcctctgttgccc

SEQ ID NO: 8118222 - DNA, 22 bp, Homo sapiens
tagaaatgtgataatagcttaa

SEQ ID NO: 8118223 - DNA, 22 bp, Homo sapiens
tagaaatgtcgtctccacattt

SEQ ID NO: 8118224 - DNA, 22 bp, Homo sapiens
cagggacagccttggggtggcg

SEQ ID NO: 8118225 - DNA, 22 bp, Homo sapiens
cagggagaaatctccaggaggt

SEQ ID NO: 8118226 - DNA, 22 bp, Homo sapiens
cagggcagtgaagaacacacgt

SEQ ID NO: 8118227 - DNA, 22 bp, Homo sapiens
cagggccaagcccctttggctg

SEQ ID NO: 8118228 - DNA, 22 bp, Homo sapiens
cagggatgctgcttaggcagtt

SEQ ID NO: 8118229 - DNA, 22 bp, Homo sapiens
cagggatgagagatggcacaga

SEQ ID NO: 8118230 - DNA, 22 bp, Homo sapiens
cagggatgaccagagggatgtg

SEQ ID NO: 8118231 - DNA, 22 bp, Homo sapiens
cagggaggctgtcttatgcctg

SEQ ID NO: 8118232 - DNA, 22 bp, Homo sapiens
cagggagggacaattgtcacct

SEQ ID NO: 8118233 - DNA, 22 bp, Homo sapiens
cagggagggaggaaaatttgct

SEQ ID NO: 8118234 - DNA, 23 bp, Homo sapiens
cagggaggagatactgtgtatct

SEQ ID NO: 8118235 - DNA, 22 bp, Homo sapiens
cagggaggatgggctgttttgc

SEQ ID NO: 8118236 - DNA, 22 bp, Homo sapiens
cagggagcctgaatgttccagg

SEQ ID NO: 8118237 - DNA, 22 bp, Homo sapiens
tacagagactttatggcacaaa

SEQ ID NO: 8118238 - DNA, 22 bp, Homo sapiens
tacagagagaggggttaccagg

SEQ ID NO: 8118239 - DNA, 22 bp, Homo sapiens
tacagagaggtgacccttgggc

SEQ ID NO: 8118240 - DNA, 22 bp, Homo sapiens
tacagagagctccggacattca

SEQ ID NO: 8118241 - DNA, 20 bp, Homo sapiens
tacagagagctagctctctg

SEQ ID NO: 8118242 - DNA, 22 bp, Homo sapiens
tacagagagataagtgtaaaag

SEQ ID NO: 8118243 - DNA, 17 bp, Homo sapiens
caggccttgagccttta

SEQ ID NO: 8118244 - DNA, 22 bp, Homo sapiens
tacagctgagtttaggtacagg

SEQ ID NO: 8118245 - DNA, 23 bp, Homo sapiens
tacagctgcagaatcaggctaag

SEQ ID NO: 8118246 - DNA, 22 bp, Homo sapiens
tacagtttagaaccatagatgg

SEQ ID NO: 8118247 - DNA, 22 bp, Homo sapiens
caggctccactgtaggcagctc

SEQ ID NO: 8118248 - DNA, 22 bp, Homo sapiens
caggctccagcttcctgctcag

SEQ ID NO: 8118249 - DNA, 20 bp, Homo sapiens
caggctccgcaggactaggg

SEQ ID NO: 8118250 - DNA, 20 bp, Homo sapiens
caggctccgcaggactaggg

SEQ ID NO: 8118251 - DNA, 22 bp, Homo sapiens
caggctcctcactcatgctccc

SEQ ID NO: 8118252 - DNA, 22 bp, Homo sapiens
caggctccttcccagggatggt

SEQ ID NO: 8118253 - DNA, 22 bp, Homo sapiens
caggctccttcccagggatggt

SEQ ID NO: 8118254 - DNA, 22 bp, Homo sapiens
caggctccctgggcagtggcag

SEQ ID NO: 8118255 - DNA, 22 bp, Homo sapiens
caggctccctgcaggccagtga

SEQ ID NO: 8118256 - DNA, 23 bp, Homo sapiens
caggctcccggaccaggatccgc

SEQ ID NO: 8118257 - DNA, 22 bp, Homo sapiens
caggccctgccttgagggacct

SEQ ID NO: 8118258 - DNA, 22 bp, Homo sapiens
caggcccaggggtctggcccac

SEQ ID NO: 8118259 - DNA, 22 bp, Homo sapiens
caggccctgcacagtggtcctg

SEQ ID NO: 8118260 - DNA, 22 bp, Homo sapiens
caggccctgcacagtggtcctg

SEQ ID NO: 8118261 - DNA, 22 bp, Homo sapiens
gtggagcacggaggaggcccct

SEQ ID NO: 8118262 - DNA, 22 bp, Homo sapiens
gtggagcaatcagagggtcagt

SEQ ID NO: 8118263 - DNA, 20 bp, Homo sapiens
gtggagaggctggcgggact

SEQ ID NO: 8118264 - DNA, 22 bp, Homo sapiens
cattacaaagttataaacagtt

SEQ ID NO: 8118265 - DNA, 22 bp, Homo sapiens
cattacaaccccaaattacaaa

SEQ ID NO: 8118266 - DNA, 22 bp, Homo sapiens
cattacaaccccaaattacaaa

SEQ ID NO: 8118267 - DNA, 22 bp, Homo sapiens
tccagggcatgctcagactcag

SEQ ID NO: 8118268 - DNA, 22 bp, Homo sapiens
tccaggctttttcatgctgtct

SEQ ID NO: 8118269 - DNA, 22 bp, Homo sapiens
tccaggcttgagaccaggctct

SEQ ID NO: 8118270 - DNA, 22 bp, Homo sapiens
tccaggcttgagaccaggctct

SEQ ID NO: 8118271 - DNA, 22 bp, Homo sapiens
tccaggctttggggcaggagcg

SEQ ID NO: 8118272 - DNA, 22 bp, Homo sapiens
catgtacagccagggttgagaa

SEQ ID NO: 8118273 - DNA, 22 bp, Homo sapiens
catgtacactcatgtaactata

SEQ ID NO: 8118274 - DNA, 22 bp, Homo sapiens
catgtacaaggatgctcagagt

SEQ ID NO: 8118275 - DNA, 22 bp, Homo sapiens
tccaggctgtgcgcaccgtgtg

SEQ ID NO: 8118276 - DNA, 22 bp, Homo sapiens
tccaggctgtgcatgagtttag

SEQ ID NO: 8118277 - DNA, 22 bp, Homo sapiens
tccaggcttcacgtctgccctc

SEQ ID NO: 8118278 - DNA, 22 bp, Homo sapiens
tccaggctgggctgaagggtgc

SEQ ID NO: 8118279 - DNA, 22 bp, Homo sapiens
tccaggctcctgactttttggg

SEQ ID NO: 8118280 - DNA, 22 bp, Homo sapiens
catgtacatgcatgggcactgt

SEQ ID NO: 8118281 - DNA, 20 bp, Homo sapiens
tccaggctcctccacttagt

SEQ ID NO: 8118282 - DNA, 22 bp, Homo sapiens
catgtacagtttttctgtcctg

SEQ ID NO: 8118283 - DNA, 22 bp, Homo sapiens
tccaagatctacagcagtttag

SEQ ID NO: 8118284 - DNA, 22 bp, Homo sapiens
tccaagacaagcacattcctgc

SEQ ID NO: 8118285 - DNA, 22 bp, Homo sapiens
catgctcacaaaagatggcaaa

SEQ ID NO: 8118286 - DNA, 22 bp, Homo sapiens
catgctgagcacattctgtatt

SEQ ID NO: 8118287 - DNA, 22 bp, Homo sapiens
catgtacaaaaggcaaatgcct

SEQ ID NO: 8118288 - DNA, 23 bp, Homo sapiens
catggaaaactgaaagctgacct

SEQ ID NO: 8118289 - DNA, 22 bp, Homo sapiens
catggtgaggggtgaagggcag

SEQ ID NO: 8118290 - DNA, 22 bp, Homo sapiens
catcaaagttgatatccaatta

SEQ ID NO: 8118291 - DNA, 22 bp, Homo sapiens
tcaggctgcccgttcagggctc

SEQ ID NO: 8118292 - DNA, 22 bp, Homo sapiens
tcaggctgcatctgtaagggtg

SEQ ID NO: 8118293 - DNA, 18 bp, Homo sapiens
tcaggctgccctgtgtct

SEQ ID NO: 8118294 - DNA, 22 bp, Homo sapiens
tcaggctgcagctgtcagcagc

SEQ ID NO: 8118295 - DNA, 22 bp, Homo sapiens
tcaggctgcagtggcaaaagac

SEQ ID NO: 8118296 - DNA, 22 bp, Homo sapiens
tcaggctgatttcttttgaggg

SEQ ID NO: 8118297 - DNA, 22 bp, Homo sapiens
tcaggaggctcaagacctggca

SEQ ID NO: 8118298 - DNA, 22 bp, Homo sapiens
tcaggaggcggtgctgcctttg

SEQ ID NO: 8118299 - DNA, 21 bp, Homo sapiens
tcaggaggctcagactcctgc

SEQ ID NO: 8118300 - DNA, 22 bp, Homo sapiens
tcaggaggcctgagtagctcta

SEQ ID NO: 8118301 - DNA, 22 bp, Homo sapiens
tcaggaatccagacagggcaca

SEQ ID NO: 8118302 - DNA, 22 bp, Homo sapiens
tcacttaggtgcaaagggaact

SEQ ID NO: 8118303 - DNA, 22 bp, Homo sapiens
cagtgtcctcagccagcagcta

SEQ ID NO: 8118304 - DNA, 20 bp, Homo sapiens
catcagtgcctgacaggtcc

SEQ ID NO: 8118305 - DNA, 22 bp, Homo sapiens
catccttcaaaggctacaatta

SEQ ID NO: 8118306 - DNA, 23 bp, Homo sapiens
catctagcatccagtgagtagtg

SEQ ID NO: 8118307 - DNA, 22 bp, Homo sapiens
tcataattgtatacatttatgg

SEQ ID NO: 8118308 - DNA, 21 bp, Homo sapiens
tcctgccttagtccagagcag

SEQ ID NO: 8118309 - DNA, 22 bp, Homo sapiens
ccacaggctgctgcaggtcccg

SEQ ID NO: 8118310 - DNA, 22 bp, Homo sapiens
ccacaggctgctgcaggtcccg

SEQ ID NO: 8118311 - DNA, 22 bp, Homo sapiens
catttcatagttgtcacaataa

SEQ ID NO: 8118312 - DNA, 19 bp, Homo sapiens
cattttaagcatccccagt

SEQ ID NO: 8118313 - DNA, 19 bp, Homo sapiens
cattttaagcatccccagt

SEQ ID NO: 8118314 - DNA, 22 bp, Homo sapiens
cattttaagatgacctggtttc

SEQ ID NO: 8118315 - DNA, 22 bp, Homo sapiens
cattttaagatgacctggtttc

SEQ ID NO: 8118316 - DNA, 22 bp, Homo sapiens
cattttcagcacccatctgaaa

SEQ ID NO: 8118317 - DNA, 22 bp, Homo sapiens
cattttatgtttatggagtgct

SEQ ID NO: 8118318 - DNA, 22 bp, Homo sapiens
cattttatcctctgggaagcta

SEQ ID NO: 8118319 - DNA, 22 bp, Homo sapiens
cattttcatgagtttctgttca

SEQ ID NO: 8118320 - DNA, 22 bp, Homo sapiens
tctataaatgcagatatgtgtg

SEQ ID NO: 8118321 - DNA, 22 bp, Homo sapiens
tctcagctgcctgccctgctcc

SEQ ID NO: 8118322 - DNA, 22 bp, Homo sapiens
tctcaggaatagagtggcagca

SEQ ID NO: 8118323 - DNA, 23 bp, Homo sapiens
tctcaggcaaaccaggacaagtt

SEQ ID NO: 8118324 - DNA, 22 bp, Homo sapiens
tctcaggagccacagcgggagt

SEQ ID NO: 8118325 - DNA, 22 bp, Homo sapiens
tctcaggactcctctggccata

SEQ ID NO: 8118326 - DNA, 22 bp, Homo sapiens
tctcaggcattcccacatagaa

SEQ ID NO: 8118327 - DNA, 22 bp, Homo sapiens
tcctgtggtctggaaggaatgg

SEQ ID NO: 8118328 - DNA, 18 bp, Homo sapiens
ccacccatctctgccttt

SEQ ID NO: 8118329 - DNA, 18 bp, Homo sapiens
ccacccatctctgccttt

SEQ ID NO: 8118330 - DNA, 22 bp, Homo sapiens
ccaccccaaatgaagacctctc

SEQ ID NO: 8118331 - DNA, 19 bp, Homo sapiens
ccacccctttgctgggccc

SEQ ID NO: 8118332 - DNA, 22 bp, Homo sapiens
ccacccctgggtgcagggagcg

SEQ ID NO: 8118333 - DNA, 22 bp, Homo sapiens
ccagagcagggcagcagggctc

SEQ ID NO: 8118334 - DNA, 22 bp, Homo sapiens
ccagagcccctgagcttccctg

SEQ ID NO: 8118335 - DNA, 22 bp, Homo sapiens
ccagagcccagggtcatgcagg

SEQ ID NO: 8118336 - DNA, 22 bp, Homo sapiens
ccagagcccctgagcttccctg

SEQ ID NO: 8118337 - DNA, 19 bp, Homo sapiens
ccagagcccgccagatggg

SEQ ID NO: 8118338 - DNA, 22 bp, Homo sapiens
ccagagccggctccctcagctt

SEQ ID NO: 8118339 - DNA, 22 bp, Homo sapiens
ccagagcctcaacacaggtcct

SEQ ID NO: 8118340 - DNA, 22 bp, Homo sapiens
ccagagcctcgcccggagcctc

SEQ ID NO: 8118341 - DNA, 22 bp, Homo sapiens
ccagaggatcagtactggctgg

SEQ ID NO: 8118342 - DNA, 22 bp, Homo sapiens
ccagaggctggcaagggctcct

SEQ ID NO: 8118343 - DNA, 22 bp, Homo sapiens
ccagagggagccaccagggtgt

SEQ ID NO: 8118344 - DNA, 22 bp, Homo sapiens
ccagagggaactgggcctcatt

SEQ ID NO: 8118345 - DNA, 18 bp, Homo sapiens
ccagagggtgcgtcagct

SEQ ID NO: 8118346 - DNA, 22 bp, Homo sapiens
ccagaggtctctctatactggg

SEQ ID NO: 8118347 - DNA, 22 bp, Homo sapiens
ccagaggggtgggcctggttta

SEQ ID NO: 8118348 - DNA, 20 bp, Homo sapiens
ccagagggtagggccgcccc

SEQ ID NO: 8118349 - DNA, 22 bp, Homo sapiens
ccagaggggctgagcaggtcac

SEQ ID NO: 8118350 - DNA, 22 bp, Homo sapiens
ccagatgtccctctcaggtttg

SEQ ID NO: 8118351 - DNA, 22 bp, Homo sapiens
tgctcagggacaatggagaggg

SEQ ID NO: 8118352 - DNA, 22 bp, Homo sapiens
tgctacagagccaggaagagtg

SEQ ID NO: 8118353 - DNA, 22 bp, Homo sapiens
tgccttctcccttggaccctga

SEQ ID NO: 8118354 - DNA, 22 bp, Homo sapiens
tgctgccttctaggcgtgccct

SEQ ID NO: 8118355 - DNA, 18 bp, Homo sapiens
cccagtgctcactgcctc

SEQ ID NO: 8118356 - DNA, 22 bp, Homo sapiens
cccagtggaaggagtagaagac

SEQ ID NO: 8118357 - DNA, 22 bp, Homo sapiens
cccagtggagataggagtgtgg

SEQ ID NO: 8118358 - DNA, 22 bp, Homo sapiens
cccaggtctccctgcagccctg

SEQ ID NO: 8118359 - DNA, 22 bp, Homo sapiens
cccaggtctgccagcctgtggg

SEQ ID NO: 8118360 - DNA, 22 bp, Homo sapiens
cccagtccaaaagtaggttcta

SEQ ID NO: 8118361 - DNA, 22 bp, Homo sapiens
cccagtgccaggcacaggcagc

SEQ ID NO: 8118362 - DNA, 22 bp, Homo sapiens
cccagttgttgccggctctgga

SEQ ID NO: 8118363 - DNA, 22 bp, Homo sapiens
tgctgcctttgtggggtcactg

SEQ ID NO: 8118364 - DNA, 22 bp, Homo sapiens
tgcttcctatccacacaatgcc

SEQ ID NO: 8118365 - DNA, 19 bp, Homo sapiens
tgcttcctcaccatctccc

SEQ ID NO: 8118366 - DNA, 19 bp, Homo sapiens
tgcttcctcaccatctccc

SEQ ID NO: 8118367 - DNA, 22 bp, Homo sapiens
tgcttccttgagctctccaatc

SEQ ID NO: 8118368 - DNA, 22 bp, Homo sapiens
tgcttcctgctaaggctgcctg

SEQ ID NO: 8118369 - DNA, 22 bp, Homo sapiens
ccccaggagatttgggagcaca

SEQ ID NO: 8118370 - DNA, 22 bp, Homo sapiens
cccttgctgccacagctgccca

SEQ ID NO: 8118371 - DNA, 22 bp, Homo sapiens
cccttgcatcccatgtgtggcc

SEQ ID NO: 8118372 - DNA, 22 bp, Homo sapiens
ccctgggacccgctgcagaggc

SEQ ID NO: 8118373 - DNA, 22 bp, Homo sapiens
tggcaggctctgagtagcacct

SEQ ID NO: 8118374 - DNA, 22 bp, Homo sapiens
tggcaggctgagttggcctggt

SEQ ID NO: 8118375 - DNA, 22 bp, Homo sapiens
tggcaggcggaggttgcagtga

SEQ ID NO: 8118376 - DNA, 22 bp, Homo sapiens
tggaggaagtggctggccagaa

SEQ ID NO: 8118377 - DNA, 22 bp, Homo sapiens
tggaggaagttgctggaagtca

SEQ ID NO: 8118378 - DNA, 23 bp, Homo sapiens
tggaggaaacacatcagaagacc

SEQ ID NO: 8118379 - DNA, 23 bp, Homo sapiens
tggaggaaacacatcagaagacc

SEQ ID NO: 8118380 - DNA, 21 bp, Homo sapiens
tggaggaataaagcacagaag

SEQ ID NO: 8118381 - DNA, 18 bp, Homo sapiens
tggaggaatcacaatggc

SEQ ID NO: 8118382 - DNA, 22 bp, Homo sapiens
tggaggacaggactggacagcc

SEQ ID NO: 8118383 - DNA, 22 bp, Homo sapiens
tggagatgcacgagcaggtgga

SEQ ID NO: 8118384 - DNA, 22 bp, Homo sapiens
tggagatgggttaatggagaga

SEQ ID NO: 8118385 - DNA, 22 bp, Homo sapiens
tggaggaaaattactggggtct

SEQ ID NO: 8118386 - DNA, 22 bp, Homo sapiens
tggagacctctacccatctcct

SEQ ID NO: 8118387 - DNA, 22 bp, Homo sapiens
tggagactctgcatctgtgaca

SEQ ID NO: 8118388 - DNA, 22 bp, Homo sapiens
tggagactgactgcctgtattt

SEQ ID NO: 8118389 - DNA, 22 bp, Homo sapiens
tggagatgaacatggtgatgtt

SEQ ID NO: 8118390 - DNA, 22 bp, Homo sapiens
tggagacagagatagccaattg

SEQ ID NO: 8118391 - DNA, 22 bp, Homo sapiens
tggagaattctatgttgagggg

SEQ ID NO: 8118392 - DNA, 22 bp, Homo sapiens
ccctccctttgcagcagtgcat

SEQ ID NO: 8118393 - DNA, 22 bp, Homo sapiens
ccctcctcaactctggcttcca

SEQ ID NO: 8118394 - DNA, 22 bp, Homo sapiens
ccctcctcaactctggcttcca

SEQ ID NO: 8118395 - DNA, 22 bp, Homo sapiens
tggaaagaaaaacaggccatga

SEQ ID NO: 8118396 - DNA, 22 bp, Homo sapiens
tggaaactataaaagcaccttc

SEQ ID NO: 8118397 - DNA, 17 bp, Homo sapiens
cctgcagtgcctgtcgg

SEQ ID NO: 8118398 - DNA, 22 bp, Homo sapiens
cctgcatccgaaagtgatcata

SEQ ID NO: 8118399 - DNA, 22 bp, Homo sapiens
cctgcaggttgcagaggcggaa

SEQ ID NO: 8118400 - DNA, 22 bp, Homo sapiens
cctgcaggtttcccccggacgg

SEQ ID NO: 8118401 - DNA, 22 bp, Homo sapiens
cctgcaggtccccggatgcgca

SEQ ID NO: 8118402 - DNA, 19 bp, Homo sapiens
cctgcagggatgagaggtt

SEQ ID NO: 8118403 - DNA, 22 bp, Homo sapiens
cctgcaggggagagacttctag

SEQ ID NO: 8118404 - DNA, 22 bp, Homo sapiens
cctgcagggtgctgccacagat

SEQ ID NO: 8118405 - DNA, 22 bp, Homo sapiens
cctgcaggtaaggctaactgcc

SEQ ID NO: 8118406 - DNA, 23 bp, Homo sapiens
tggtaatagggagcagaaggtag

SEQ ID NO: 8118407 - DNA, 22 bp, Homo sapiens
tgggtggaataaatcagttctg

SEQ ID NO: 8118408 - DNA, 22 bp, Homo sapiens
tgggtggattaggatagggtat

SEQ ID NO: 8118409 - DNA, 22 bp, Homo sapiens
tgggtggagctccacaacctgt

SEQ ID NO: 8118410 - DNA, 22 bp, Homo sapiens
tgggtggagaagtggacctgct

SEQ ID NO: 8118411 - DNA, 22 bp, Homo sapiens
tggtgggacatctgaggagagg

SEQ ID NO: 8118412 - DNA, 22 bp, Homo sapiens
cctgcctcccagaggtcctcta

SEQ ID NO: 8118413 - DNA, 23 bp, Homo sapiens
cctgcctccccatcagttataca

SEQ ID NO: 8118414 - DNA, 22 bp, Homo sapiens
cctgcctcatcaacttgtcgtg

SEQ ID NO: 8118415 - DNA, 22 bp, Homo sapiens
tggtacacatgtccaaggtcag

SEQ ID NO: 8118416 - DNA, 22 bp, Homo sapiens
cctgcccttctttccccagcat

SEQ ID NO: 8118417 - DNA, 22 bp, Homo sapiens
cctgcctcaggactctgcatat

SEQ ID NO: 8118418 - DNA, 22 bp, Homo sapiens
tgggctccagcacctgtgctct

SEQ ID NO: 8118419 - DNA, 22 bp, Homo sapiens
cctgcagggaatcgaggcagaa

SEQ ID NO: 8118420 - DNA, 22 bp, Homo sapiens
cctgcaggctgcaggccagttc

SEQ ID NO: 8118421 - DNA, 22 bp, Homo sapiens
tggggagagttacaaggaatct

SEQ ID NO: 8118422 - DNA, 22 bp, Homo sapiens
tggggagaggtatcattgagat

SEQ ID NO: 8118423 - DNA, 22 bp, Homo sapiens
tggggagagattgaggagtttt

SEQ ID NO: 8118424 - DNA, 22 bp, Homo sapiens
tggggagagattgaggagtttt

SEQ ID NO: 8118425 - DNA, 22 bp, Homo sapiens
tggggagagaccggaatgtttc

SEQ ID NO: 8118426 - DNA, 22 bp, Homo sapiens
tggggagagaccggaatgtttc

SEQ ID NO: 8118427 - DNA, 22 bp, Homo sapiens
tggcagtggtaccggctctcag

SEQ ID NO: 8118428 - DNA, 22 bp, Homo sapiens
tggcagtgggaagctggaagtc

SEQ ID NO: 8118429 - DNA, 22 bp, Homo sapiens
tggcagtgggaagctggaagtc

SEQ ID NO: 8118430 - DNA, 22 bp, Homo sapiens
tggcagtgggaagctggaagtc

SEQ ID NO: 8118431 - DNA, 22 bp, Homo sapiens
tggcagtgtcttatcaggagtg

SEQ ID NO: 8118432 - DNA, 19 bp, Homo sapiens
tggcatttggaggcaacct

SEQ ID NO: 8118433 - DNA, 22 bp, Homo sapiens
cctccagcgcgatccactccgg

SEQ ID NO: 8118434 - DNA, 22 bp, Homo sapiens
cctccaggctggttatcagctg

SEQ ID NO: 8118435 - DNA, 22 bp, Homo sapiens
tggccaatcactgacaaaatgc

SEQ ID NO: 8118436 - DNA, 21 bp, Homo sapiens
cctccaggtgattccgtgctc

SEQ ID NO: 8118437 - DNA, 22 bp, Homo sapiens
cctccagggcccctctcactgg

SEQ ID NO: 8118438 - DNA, 22 bp, Homo sapiens
tggcattttgttcagtatatgg

SEQ ID NO: 8118439 - DNA, 22 bp, Homo sapiens
cctccaggtgttacatatgact

SEQ ID NO: 8118440 - DNA, 22 bp, Homo sapiens
cctccagtactccagtccagcg

SEQ ID NO: 8118441 - DNA, 22 bp, Homo sapiens
cctccatctccagcttctgcct

SEQ ID NO: 8118442 - DNA, 22 bp, Homo sapiens
cctcctgggccttgctctgtga

SEQ ID NO: 8118443 - DNA, 22 bp, Homo sapiens
cctcctgggactcattagcacc

SEQ ID NO: 8118444 - DNA, 22 bp, Homo sapiens
cctcctggcttttcccattgaa

SEQ ID NO: 8118445 - DNA, 22 bp, Homo sapiens
cctcctctggtgctgccaaccc

SEQ ID NO: 8118446 - DNA, 19 bp, Homo sapiens
tgggacacgatctgcctgt

SEQ ID NO: 8118447 - DNA, 22 bp, Homo sapiens
cctctcccgggtgccgctgggc

SEQ ID NO: 8118448 - DNA, 19 bp, Homo sapiens
cctctcccatgcttacctc

SEQ ID NO: 8118449 - DNA, 22 bp, Homo sapiens
cctctcccctcccaaggcggga

SEQ ID NO: 8118450 - DNA, 22 bp, Homo sapiens
cctctcccagggagagcctgag

SEQ ID NO: 8118451 - DNA, 19 bp, Homo sapiens
cctctcccatgcttacctc

SEQ ID NO: 8118452 - DNA, 22 bp, Homo sapiens
cctctccagttttaacgtgacc

SEQ ID NO: 8118453 - DNA, 22 bp, Homo sapiens
cctctcccaggcgcggcggcag

SEQ ID NO: 8118454 - DNA, 22 bp, Homo sapiens
cctctcccacgtggcagaggct

SEQ ID NO: 8118455 - DNA, 22 bp, Homo sapiens
cctctccagcggcctcagggcc

SEQ ID NO: 8118456 - DNA, 22 bp, Homo sapiens
cctctccagcggcctcagggcc

SEQ ID NO: 8118457 - DNA, 22 bp, Homo sapiens
tggcttcccctaccttccaatt

SEQ ID NO: 8118458 - DNA, 22 bp, Homo sapiens
tggcttctttccactgtcctgt

SEQ ID NO: 8118459 - DNA, 22 bp, Homo sapiens
cctcctggtaattagcgaaagg

SEQ ID NO: 8118460 - DNA, 22 bp, Homo sapiens
tgggagagcactgcagccccgg

SEQ ID NO: 8118461 - DNA, 22 bp, Homo sapiens
tgggagagcagagaaccctctt

SEQ ID NO: 8118462 - DNA, 22 bp, Homo sapiens
tgggacaggaggcctctggaga

SEQ ID NO: 8118463 - DNA, 22 bp, Homo sapiens
tgggacaggaggcctctggaga

SEQ ID NO: 8118464 - DNA, 22 bp, Homo sapiens
tgggagagaataatcaataggt

SEQ ID NO: 8118465 - DNA, 22 bp, Homo sapiens
tgggagagataggcttctggac

SEQ ID NO: 8118466 - DNA, 22 bp, Homo sapiens
tgggagagagaattcccagtgg

SEQ ID NO: 8118467 - DNA, 22 bp, Homo sapiens
tgggagagaattctggtgactg

SEQ ID NO: 8118468 - DNA, 22 bp, Homo sapiens
tctggggagcagccctggtgag

SEQ ID NO: 8118469 - DNA, 22 bp, Homo sapiens
tctggggagtgcctaagtggaa

SEQ ID NO: 8118470 - DNA, 22 bp, Homo sapiens
tctgggagggagcctcagaatc

SEQ ID NO: 8118471 - DNA, 22 bp, Homo sapiens
ccagcactcctgtctcaagtct

SEQ ID NO: 8118472 - DNA, 20 bp, Homo sapiens
tctgggagggacaagtctcc

SEQ ID NO: 8118473 - DNA, 22 bp, Homo sapiens
ccaggaggcggaggttgcagcg

SEQ ID NO: 8118474 - DNA, 22 bp, Homo sapiens
tctgttccatgttttgttccat

SEQ ID NO: 8118475 - DNA, 17 bp, Homo sapiens
tctgttcatgcatacct

SEQ ID NO: 8118476 - DNA, 22 bp, Homo sapiens
ccaggaggcggaggttgcagtg

SEQ ID NO: 8118477 - DNA, 22 bp, Homo sapiens
ccaggaggcggaggttgcagtg

SEQ ID NO: 8118478 - DNA, 22 bp, Homo sapiens
ccaggaggcggaggttgcagcg

SEQ ID NO: 8118479 - DNA, 22 bp, Homo sapiens
tcttctggatcgatcacattgt

SEQ ID NO: 8118480 - DNA, 22 bp, Homo sapiens
tcttctgagacttctctttggt

SEQ ID NO: 8118481 - DNA, 19 bp, Homo sapiens
tcttctgacttgagaaaga

SEQ ID NO: 8118482 - DNA, 19 bp, Homo sapiens
tcttctgacttcaagaaac

SEQ ID NO: 8118483 - DNA, 22 bp, Homo sapiens
tcttctgaaggtaggaagcatt

SEQ ID NO: 8118484 - DNA, 22 bp, Homo sapiens
tcttctctgtggcctggtggtg

SEQ ID NO: 8118485 - DNA, 17 bp, Homo sapiens
tcttctcttccagtctt

SEQ ID NO: 8118486 - DNA, 22 bp, Homo sapiens
tcttctgaaactagtgggaaag

SEQ ID NO: 8118487 - DNA, 17 bp, Homo sapiens
tcttctcttccagtctt

SEQ ID NO: 8118488 - DNA, 17 bp, Homo sapiens
tcttctcttccagtctt

SEQ ID NO: 8118489 - DNA, 22 bp, Homo sapiens
tcttctctcatgtaggagggaa

SEQ ID NO: 8118490 - DNA, 22 bp, Homo sapiens
tcttctctcctgcttggcagaa

SEQ ID NO: 8118491 - DNA, 22 bp, Homo sapiens
tcttctctcatgtaggagggaa

SEQ ID NO: 8118492 - DNA, 22 bp, Homo sapiens
tcttctctcctgcttggcagaa

SEQ ID NO: 8118493 - DNA, 22 bp, Homo sapiens
ccaggcaggcgatggtgcagtg

SEQ ID NO: 8118494 - DNA, 22 bp, Homo sapiens
ccaggcctcccttttccagcca

SEQ ID NO: 8118495 - DNA, 22 bp, Homo sapiens
ccaggcctcctgtgagtggacc

SEQ ID NO: 8118496 - DNA, 23 bp, Homo sapiens
tgaagtgaaatttcacaagggac

SEQ ID NO: 8118497 - DNA, 22 bp, Homo sapiens
tgaagtgcattctctggcactc

SEQ ID NO: 8118498 - DNA, 22 bp, Homo sapiens
tgaagtgacctggggcagtgta

SEQ ID NO: 8118499 - DNA, 22 bp, Homo sapiens
tgaaggtgtatgctgtgggtca

SEQ ID NO: 8118500 - DNA, 21 bp, Homo sapiens
tgaaggtgttcatgatgcggt

SEQ ID NO: 8118501 - DNA, 22 bp, Homo sapiens
ccagggctctatgagggtggag

SEQ ID NO: 8118502 - DNA, 22 bp, Homo sapiens
ccagggagggtcctgtggcttc

SEQ ID NO: 8118503 - DNA, 22 bp, Homo sapiens
tgaaatgagcatttattcttta

SEQ ID NO: 8118504 - DNA, 22 bp, Homo sapiens
tgaaacagagtggatacagtga

SEQ ID NO: 8118505 - DNA, 22 bp, Homo sapiens
ccaggctgttttcaaacttggg

SEQ ID NO: 8118506 - DNA, 22 bp, Homo sapiens
ccaggctgtggtttagatagag

SEQ ID NO: 8118507 - DNA, 22 bp, Homo sapiens
ccaggctgtaagagtgatgttg

SEQ ID NO: 8118508 - DNA, 22 bp, Homo sapiens
ccaggctgtgcttttcataaat

SEQ ID NO: 8118509 - DNA, 22 bp, Homo sapiens
tcttttctggactctgcatgga

SEQ ID NO: 8118510 - DNA, 22 bp, Homo sapiens
tcttttcttgcattattgcact

SEQ ID NO: 8118511 - DNA, 22 bp, Homo sapiens
tgcagagacttgtgtgcatttg

SEQ ID NO: 8118512 - DNA, 22 bp, Homo sapiens
tgcagagaaagtgtagacaggc

SEQ ID NO: 8118513 - DNA, 18 bp, Homo sapiens
tgcactgtgctgagtggc

SEQ ID NO: 8118514 - DNA, 22 bp, Homo sapiens
tgcactccaggctgggtgacag

SEQ ID NO: 8118515 - DNA, 19 bp, Homo sapiens
tgcaagtgtcttggacaag

SEQ ID NO: 8118516 - DNA, 22 bp, Homo sapiens
tgcaaatattccatgctgttca

SEQ ID NO: 8118517 - DNA, 22 bp, Homo sapiens
tgcaatatgttgcattgtatgg

SEQ ID NO: 8118518 - DNA, 22 bp, Homo sapiens
cccaagggagtgcctggtcaac

SEQ ID NO: 8118519 - DNA, 22 bp, Homo sapiens
cccaaggggagattttcttgag

SEQ ID NO: 8118520 - DNA, 22 bp, Homo sapiens
cccaagccagaccctgaccctg

SEQ ID NO: 8118521 - DNA, 22 bp, Homo sapiens
cccaagccagaccctgaccctg

SEQ ID NO: 8118522 - DNA, 23 bp, Homo sapiens
cccaagcctgtgccctctgactc

SEQ ID NO: 8118523 - DNA, 22 bp, Homo sapiens
tgcagctgcctagggctggctt

SEQ ID NO: 8118524 - DNA, 22 bp, Homo sapiens
tgcaggaatagctacagagctg

SEQ ID NO: 8118525 - DNA, 22 bp, Homo sapiens
tgcagctgctcattctctcagt

SEQ ID NO: 8118526 - DNA, 22 bp, Homo sapiens
cccagagggctgaggatatgaa

SEQ ID NO: 8118527 - DNA, 22 bp, Homo sapiens
cccagagggaagggaatgaggt

SEQ ID NO: 8118528 - DNA, 22 bp, Homo sapiens
cccagaggaggcaaagctctgt

SEQ ID NO: 8118529 - DNA, 22 bp, Homo sapiens
cccagaggaggatctcggcccg

SEQ ID NO: 8118530 - DNA, 19 bp, Homo sapiens
tgcagccacgtgagagact

SEQ ID NO: 8118531 - DNA, 22 bp, Homo sapiens
tgcaggcattggtgagagaagc

SEQ ID NO: 8118532 - DNA, 22 bp, Homo sapiens
cccagcaggaggaggttgcagt

SEQ ID NO: 8118533 - DNA, 22 bp, Homo sapiens
cccagcagggtctctgtgtcta

SEQ ID NO: 8118534 - DNA, 22 bp, Homo sapiens
ccatcctgaatggtctcagcca

SEQ ID NO: 8118535 - DNA, 22 bp, Homo sapiens
tgagtcctgtctttgtcactta

SEQ ID NO: 8118536 - DNA, 22 bp, Homo sapiens
tgagtctgatttttctagcatt

SEQ ID NO: 8118537 - DNA, 22 bp, Homo sapiens
ccagtggccatgcacgagcagc

SEQ ID NO: 8118538 - DNA, 22 bp, Homo sapiens
ccagtggagtttttatacccag

SEQ ID NO: 8118539 - DNA, 22 bp, Homo sapiens
ccagtggacaatttctgaggaa

SEQ ID NO: 8118540 - DNA, 22 bp, Homo sapiens
ccagtggaattaaaaataagtg

SEQ ID NO: 8118541 - DNA, 22 bp, Homo sapiens
ccagtggaaatgtggtcaggat

SEQ ID NO: 8118542 - DNA, 22 bp, Homo sapiens
ccagtggacttctccctgtggt

SEQ ID NO: 8118543 - DNA, 22 bp, Homo sapiens
ccagtgcctgtgggcatggtgc

SEQ ID NO: 8118544 - DNA, 22 bp, Homo sapiens
ccagtgcccagtctccctggtc

SEQ ID NO: 8118545 - DNA, 22 bp, Homo sapiens
ccagtgcccagctgcccaggca

SEQ ID NO: 8118546 - DNA, 22 bp, Homo sapiens
ccagtgcataatcaatacagcc

SEQ ID NO: 8118547 - DNA, 22 bp, Homo sapiens
ccagtcccagctctgccatgct

SEQ ID NO: 8118548 - DNA, 22 bp, Homo sapiens
ccagtgcaggtgagcaccaggt

SEQ ID NO: 8118549 - DNA, 22 bp, Homo sapiens
ccaggtgggaggaaagcagaga

SEQ ID NO: 8118550 - DNA, 17 bp, Homo sapiens
ccaggtgggaggtgggg

SEQ ID NO: 8118551 - DNA, 22 bp, Homo sapiens
tgagcagagacgggggcctcca

SEQ ID NO: 8118552 - DNA, 22 bp, Homo sapiens
ccagggctgctgtgggactcca

SEQ ID NO: 8118553 - DNA, 22 bp, Homo sapiens
tgagcagtaacagctcacaggg

SEQ ID NO: 8118554 - DNA, 23 bp, Homo sapiens
cttctggctctatatcagaattc

SEQ ID NO: 8118555 - DNA, 22 bp, Homo sapiens
cttctggagctcaccaacttcc

SEQ ID NO: 8118556 - DNA, 22 bp, Homo sapiens
cttctggaggacactggcccca

SEQ ID NO: 8118557 - DNA, 22 bp, Homo sapiens
cttctgacccctggtctacagc

SEQ ID NO: 8118558 - DNA, 22 bp, Homo sapiens
cttctgaagtgtttgatgattg

SEQ ID NO: 8118559 - DNA, 22 bp, Homo sapiens
cttgttttggaacagagtgaat

SEQ ID NO: 8118560 - DNA, 22 bp, Homo sapiens
ctttctttgtccaccaacaatg

SEQ ID NO: 8118561 - DNA, 22 bp, Homo sapiens
ctttacaaattagctctcggga

SEQ ID NO: 8118562 - DNA, 22 bp, Homo sapiens
ctttacaaatagggagggagtg

SEQ ID NO: 8118563 - DNA, 22 bp, Homo sapiens
ctttacaaagcaattttgtctc

SEQ ID NO: 8118564 - DNA, 22 bp, Homo sapiens
ctttacaaactataaagtgcgg

SEQ ID NO: 8118565 - DNA, 22 bp, Homo sapiens
ctttaattgtagctcccataat

SEQ ID NO: 8118566 - DNA, 22 bp, Homo sapiens
ctttaattaggaagtataatga

SEQ ID NO: 8118567 - DNA, 22 bp, Homo sapiens
ctttaattcagatttgaaggga

SEQ ID NO: 8118568 - DNA, 22 bp, Homo sapiens
ctttaattaggaagtataatga

SEQ ID NO: 8118569 - DNA, 22 bp, Homo sapiens
ctttaattctcaggtgcacata

SEQ ID NO: 8118570 - DNA, 22 bp, Homo sapiens
cttttcttctcacggctgtcag

SEQ ID NO: 8118571 - DNA, 22 bp, Homo sapiens
ctttgattccaggcacatgttt

SEQ ID NO: 8118572 - DNA, 22 bp, Homo sapiens
gaaacacatgcagctccataga

SEQ ID NO: 8118573 - DNA, 22 bp, Homo sapiens
gaaacacatatgaacagttgat

SEQ ID NO: 8118574 - DNA, 22 bp, Homo sapiens
gaaagccatctggctgctggga

SEQ ID NO: 8118575 - DNA, 22 bp, Homo sapiens
gaaagccatagcccagctttac

SEQ ID NO: 8118576 - DNA, 22 bp, Homo sapiens
gaaagagaggggctgagatgca

SEQ ID NO: 8118577 - DNA, 22 bp, Homo sapiens
gaaagagaggggctgagatgca

SEQ ID NO: 8118578 - DNA, 22 bp, Homo sapiens
gaaacaatcatcatgtgatttg

SEQ ID NO: 8118579 - DNA, 22 bp, Homo sapiens
cttccaagtggggcacgtgcca

SEQ ID NO: 8118580 - DNA, 22 bp, Homo sapiens
cttctagaaccctctattcttt

SEQ ID NO: 8118581 - DNA, 23 bp, Homo sapiens
cttctagagtcagctccaagttt

SEQ ID NO: 8118582 - DNA, 19 bp, Homo sapiens
cttctagaccttataccac

SEQ ID NO: 8118583 - DNA, 22 bp, Homo sapiens
cttctagagtttctgatgcaac

SEQ ID NO: 8118584 - DNA, 22 bp, Homo sapiens
cttctcagatctcagctttgag

SEQ ID NO: 8118585 - DNA, 23 bp, Homo sapiens
cttctcagaagtctgtgccagga

SEQ ID NO: 8118586 - DNA, 22 bp, Homo sapiens
cttctcagaggccagaagctat

SEQ ID NO: 8118587 - DNA, 22 bp, Homo sapiens
cttagcttctctgcatctgtgt

SEQ ID NO: 8118588 - DNA, 22 bp, Homo sapiens
cttagccctgagagttctgagc

SEQ ID NO: 8118589 - DNA, 22 bp, Homo sapiens
cttcatttcaggctgaagaata

SEQ ID NO: 8118590 - DNA, 18 bp, Homo sapiens
cttcatttgtagagttcc

SEQ ID NO: 8118591 - DNA, 22 bp, Homo sapiens
cttccaaaatttatatgttgaa

SEQ ID NO: 8118592 - DNA, 22 bp, Homo sapiens
cttagaaattgttactcattca

SEQ ID NO: 8118593 - DNA, 22 bp, Homo sapiens
cttaaatccatcatttctaatc

SEQ ID NO: 8118594 - DNA, 22 bp, Homo sapiens
ctgttttcaaagagagagaatg

SEQ ID NO: 8118595 - DNA, 22 bp, Homo sapiens
ctgtttgtgattagcagtgggt

SEQ ID NO: 8118596 - DNA, 21 bp, Homo sapiens
ctgtgctttttaagtgtgatg

SEQ ID NO: 8118597 - DNA, 22 bp, Homo sapiens
ctgggctagaaggaccaggatg

SEQ ID NO: 8118598 - DNA, 22 bp, Homo sapiens
ctgggagcctggcagttgctga

SEQ ID NO: 8118599 - DNA, 22 bp, Homo sapiens
ctgggagcgcagcaggcacaac

SEQ ID NO: 8118600 - DNA, 22 bp, Homo sapiens
ctgggcagctccataccaccca

SEQ ID NO: 8118601 - DNA, 22 bp, Homo sapiens
ctgggcagctgtatcagggagt

SEQ ID NO: 8118602 - DNA, 22 bp, Homo sapiens
ctgggcagctgtgcaaacaata

SEQ ID NO: 8118603 - DNA, 22 bp, Homo sapiens
ctgggagattcaggtgaagttt

SEQ ID NO: 8118604 - DNA, 22 bp, Homo sapiens
ctgggagatatgaggatctgga

SEQ ID NO: 8118605 - DNA, 22 bp, Homo sapiens
ctgggacctcggggtgatcaaa

SEQ ID NO: 8118606 - DNA, 22 bp, Homo sapiens
ctgggacctcctgaggtggagc

SEQ ID NO: 8118607 - DNA, 22 bp, Homo sapiens
ctgggaagatggtgacagaatt

SEQ ID NO: 8118608 - DNA, 20 bp, Homo sapiens
ctgcttccaggctcaccccc

SEQ ID NO: 8118609 - DNA, 22 bp, Homo sapiens
ctgcttccacacaagcaaagct

SEQ ID NO: 8118610 - DNA, 22 bp, Homo sapiens
ctgcttccaagaaagagatagg

SEQ ID NO: 8118611 - DNA, 22 bp, Homo sapiens
ctgcttccacacaagcaaagct

SEQ ID NO: 8118612 - DNA, 22 bp, Homo sapiens
ctgctgtgattgggagaaaccg

SEQ ID NO: 8118613 - DNA, 22 bp, Homo sapiens
ctgctgttaggttggtgcaaaa

SEQ ID NO: 8118614 - DNA, 19 bp, Homo sapiens
ctgggcttgatgttgagtt

SEQ ID NO: 8118615 - DNA, 19 bp, Homo sapiens
ctgggcttgatgttgagtt

SEQ ID NO: 8118616 - DNA, 22 bp, Homo sapiens
ctgggcttgtgttagctgacaa

SEQ ID NO: 8118617 - DNA, 21 bp, Homo sapiens
ctgggctttctctcaaagaca

SEQ ID NO: 8118618 - DNA, 22 bp, Homo sapiens
ctgggctttggtactgtgatta

SEQ ID NO: 8118619 - DNA, 20 bp, Homo sapiens
ctggtctgccactcacagtt

SEQ ID NO: 8118620 - DNA, 22 bp, Homo sapiens
ctgtaaaacactgtagtatctg

SEQ ID NO: 8118621 - DNA, 22 bp, Homo sapiens
ctgtaaaactgcttaagtatgc

SEQ ID NO: 8118622 - DNA, 22 bp, Homo sapiens
ctgtacagaagctagagcaaat

SEQ ID NO: 8118623 - DNA, 22 bp, Homo sapiens
ctgtacaggtgaggagggggct

SEQ ID NO: 8118624 - DNA, 19 bp, Homo sapiens
ctgtacaggttgcttctgg

SEQ ID NO: 8118625 - DNA, 22 bp, Homo sapiens
ctgtacaggtcaatgataagat

SEQ ID NO: 8118626 - DNA, 22 bp, Homo sapiens
ctgtacaggagacgtctgtgca

SEQ ID NO: 8118627 - DNA, 22 bp, Homo sapiens
ctgtacagacctattagcccag

SEQ ID NO: 8118628 - DNA, 22 bp, Homo sapiens
ctgtacagagttctgagtgtac

SEQ ID NO: 8118629 - DNA, 22 bp, Homo sapiens
ctgtacagcaagttcaccttgg

SEQ ID NO: 8118630 - DNA, 22 bp, Homo sapiens
ctgtacatcccgagagccagta

SEQ ID NO: 8118631 - DNA, 22 bp, Homo sapiens
ctgtcagggggcctggccatca

SEQ ID NO: 8118632 - DNA, 22 bp, Homo sapiens
ctgtcagcttctcctggccaga

SEQ ID NO: 8118633 - DNA, 22 bp, Homo sapiens
ctgtatttgtcctctatttatt

SEQ ID NO: 8118634 - DNA, 22 bp, Homo sapiens
ctgtctgtcaagttcatctcca

SEQ ID NO: 8118635 - DNA, 22 bp, Homo sapiens
ctgtctggtgtccctgtctaca

SEQ ID NO: 8118636 - DNA, 19 bp, Homo sapiens
ctgtctggttcatgtgttc

SEQ ID NO: 8118637 - DNA, 22 bp, Homo sapiens
ctgtctggaatgcagtacatag

SEQ ID NO: 8118638 - DNA, 22 bp, Homo sapiens
ctgtctggaatttaagataaag

SEQ ID NO: 8118639 - DNA, 22 bp, Homo sapiens
ctgtctggagttatgtaaatag

SEQ ID NO: 8118640 - DNA, 22 bp, Homo sapiens
ctgtctggatgtgagtcaccta

SEQ ID NO: 8118641 - DNA, 21 bp, Homo sapiens
ctgtctggccgcgggctccgc

SEQ ID NO: 8118642 - DNA, 22 bp, Homo sapiens
ctgtctggatataccttggcca

SEQ ID NO: 8118643 - DNA, 22 bp, Homo sapiens
ctgtctggtcaacaactgagtg

SEQ ID NO: 8118644 - DNA, 22 bp, Homo sapiens
ctgtctgggtctacatcctctg

SEQ ID NO: 8118645 - DNA, 22 bp, Homo sapiens
ctgtctggccggcccagcttcc

SEQ ID NO: 8118646 - DNA, 22 bp, Homo sapiens
gaggaagaaagcataggtgggg

SEQ ID NO: 8118647 - DNA, 22 bp, Homo sapiens
gaggaagaatcagggtggtgag

SEQ ID NO: 8118648 - DNA, 22 bp, Homo sapiens
gaggaagaattggttattggag

SEQ ID NO: 8118649 - DNA, 22 bp, Homo sapiens
gaggaaaatgggacaggctgta

SEQ ID NO: 8118650 - DNA, 19 bp, Homo sapiens
gagctgccttttgaagacc

SEQ ID NO: 8118651 - DNA, 23 bp, Homo sapiens
gaggaaagaatatagatgcaatc

SEQ ID NO: 8118652 - DNA, 22 bp, Homo sapiens
gaggaaagctggtttaaagtat

SEQ ID NO: 8118653 - DNA, 22 bp, Homo sapiens
gaggaaagagtcaaatctgaag

SEQ ID NO: 8118654 - DNA, 22 bp, Homo sapiens
gaggaaagaaccccagtcaata

SEQ ID NO: 8118655 - DNA, 22 bp, Homo sapiens
gagctgcctacattgccaagag

SEQ ID NO: 8118656 - DNA, 22 bp, Homo sapiens
gagctgcctgtgtgccatgatg

SEQ ID NO: 8118657 - DNA, 22 bp, Homo sapiens
gagccctggcagtctgggatgg

SEQ ID NO: 8118658 - DNA, 22 bp, Homo sapiens
gagccctgtagcaagtcatgtc

SEQ ID NO: 8118659 - DNA, 22 bp, Homo sapiens
gagccctgctgggccttgtctc

SEQ ID NO: 8118660 - DNA, 22 bp, Homo sapiens
gagccctgcttccaagggggca

SEQ ID NO: 8118661 - DNA, 22 bp, Homo sapiens
gagccctgcgtgtctgggggca

SEQ ID NO: 8118662 - DNA, 22 bp, Homo sapiens
gagccctgagagttgtgaggcc

SEQ ID NO: 8118663 - DNA, 22 bp, Homo sapiens
gagccctgatttgcagcatttg

SEQ ID NO: 8118664 - DNA, 22 bp, Homo sapiens
gagcccagctgcggccctcagc

SEQ ID NO: 8118665 - DNA, 22 bp, Homo sapiens
gagcccaggaagtggaggctga

SEQ ID NO: 8118666 - DNA, 22 bp, Homo sapiens
gagccctgaacaacagcaggaa

SEQ ID NO: 8118667 - DNA, 22 bp, Homo sapiens
gagccctgacactgagggagtt

SEQ ID NO: 8118668 - DNA, 22 bp, Homo sapiens
gagcagggagacaactctggtg

SEQ ID NO: 8118669 - DNA, 22 bp, Homo sapiens
gagagggtgcctggaagccagg

SEQ ID NO: 8118670 - DNA, 22 bp, Homo sapiens
gagagggctgcctggtgtgagg

SEQ ID NO: 8118671 - DNA, 22 bp, Homo sapiens
gagcagtggtcacagggaggga

SEQ ID NO: 8118672 - DNA, 22 bp, Homo sapiens
gagcagtgggaaggaacagggt

SEQ ID NO: 8118673 - DNA, 22 bp, Homo sapiens
gagcatgagggaaggcagcaga

SEQ ID NO: 8118674 - DNA, 22 bp, Homo sapiens
gaggagagatggtagattgggt

SEQ ID NO: 8118675 - DNA, 22 bp, Homo sapiens
gaggagcatgggaaggctctgg

SEQ ID NO: 8118676 - DNA, 22 bp, Homo sapiens
gaggagcacatgaggctgaggg

SEQ ID NO: 8118677 - DNA, 22 bp, Homo sapiens
gaggagcacatgaggctgaggg

SEQ ID NO: 8118678 - DNA, 22 bp, Homo sapiens
gaggcatctgggcacagaagtg

SEQ ID NO: 8118679 - DNA, 22 bp, Homo sapiens
gaggctcactgggcaaagactc

SEQ ID NO: 8118680 - DNA, 22 bp, Homo sapiens
gaggcagggtgttgattacaga

SEQ ID NO: 8118681 - DNA, 22 bp, Homo sapiens
gaggctgaatggccagaagcca

SEQ ID NO: 8118682 - DNA, 22 bp, Homo sapiens
gagggagggactagcattctct

SEQ ID NO: 8118683 - DNA, 22 bp, Homo sapiens
gagggagggaaagtttaacact

SEQ ID NO: 8118684 - DNA, 22 bp, Homo sapiens
gagggagggccaggtcccaacc

SEQ ID NO: 8118685 - DNA, 22 bp, Homo sapiens
gagggaggggagctccaccctc

SEQ ID NO: 8118686 - DNA, 22 bp, Homo sapiens
gagggagagtgatggaccattg

SEQ ID NO: 8118687 - DNA, 22 bp, Homo sapiens
gagggaggcatcatgaatccag

SEQ ID NO: 8118688 - DNA, 22 bp, Homo sapiens
gagggaggcatcatgaatccag

SEQ ID NO: 8118689 - DNA, 22 bp, Homo sapiens
gaggctgcactggctaaaggct

SEQ ID NO: 8118690 - DNA, 22 bp, Homo sapiens
gaggctgaggttgcagtgagct

SEQ ID NO: 8118691 - DNA, 22 bp, Homo sapiens
gaggctgaggttgcagtgagcc

SEQ ID NO: 8118692 - DNA, 22 bp, Homo sapiens
gagggctgtgaaggagcgggtt

SEQ ID NO: 8118693 - DNA, 22 bp, Homo sapiens
gagggctgtggggcatgaccag

SEQ ID NO: 8118694 - DNA, 22 bp, Homo sapiens
gaggggaaagtgtgaggctgcg

SEQ ID NO: 8118695 - DNA, 22 bp, Homo sapiens
gaggggctctttaatagtaaca

SEQ ID NO: 8118696 - DNA, 22 bp, Homo sapiens
gagggctgcaatgagacagaga

SEQ ID NO: 8118697 - DNA, 22 bp, Homo sapiens
gagggctgcaatgagacagaga

SEQ ID NO: 8118698 - DNA, 22 bp, Homo sapiens
gagggctgcaatgagacagaga

SEQ ID NO: 8118699 - DNA, 22 bp, Homo sapiens
gagggctgctgccagatatgcc

SEQ ID NO: 8118700 - DNA, 22 bp, Homo sapiens
gagggctgctggaaaaatgcag

SEQ ID NO: 8118701 - DNA, 22 bp, Homo sapiens
gagggaggtgatactgaacgta

SEQ ID NO: 8118702 - DNA, 22 bp, Homo sapiens
gagggaggggagctccaccctc

SEQ ID NO: 8118703 - DNA, 22 bp, Homo sapiens
gagggagtgccagagggccagc

SEQ ID NO: 8118704 - DNA, 18 bp, Homo sapiens
gagggagtagctgaggtt

SEQ ID NO: 8118705 - DNA, 23 bp, Homo sapiens
gaagccacacaaaggtcgccaag

SEQ ID NO: 8118706 - DNA, 22 bp, Homo sapiens
gaagccacaactttttcttagc

SEQ ID NO: 8118707 - DNA, 22 bp, Homo sapiens
gaagccacagagattgtggggg

SEQ ID NO: 8118708 - DNA, 23 bp, Homo sapiens
gaagccacacaaaggtcgccaag

SEQ ID NO: 8118709 - DNA, 22 bp, Homo sapiens
gaagccacagggaaggagaaca

SEQ ID NO: 8118710 - DNA, 22 bp, Homo sapiens
gaagccaccctccttccagccc

SEQ ID NO: 8118711 - DNA, 22 bp, Homo sapiens
gaagccactatagatattctaa

SEQ ID NO: 8118712 - DNA, 20 bp, Homo sapiens
gaagccagaggggaaaggag

SEQ ID NO: 8118713 - DNA, 22 bp, Homo sapiens
gaaggcactgaactccttctgg

SEQ ID NO: 8118714 - DNA, 22 bp, Homo sapiens
gaaggcaggtttttcaaaactg

SEQ ID NO: 8118715 - DNA, 22 bp, Homo sapiens
gaagggagaaggttgggtgacg

SEQ ID NO: 8118716 - DNA, 22 bp, Homo sapiens
gaagggagaaggttgggtgacg

SEQ ID NO: 8118717 - DNA, 22 bp, Homo sapiens
gaagcagcagctggggacagtt

SEQ ID NO: 8118718 - DNA, 22 bp, Homo sapiens
gaaaggagggaaacagagcggt

SEQ ID NO: 8118719 - DNA, 22 bp, Homo sapiens
gaaaggagagggttaaggagct

SEQ ID NO: 8118720 - DNA, 22 bp, Homo sapiens
gaaaggagagggttaaggagct

SEQ ID NO: 8118721 - DNA, 22 bp, Homo sapiens
gaaaggaacttgtgagtgggag

SEQ ID NO: 8118722 - DNA, 18 bp, Homo sapiens
gaaaggagagacagtagg

SEQ ID NO: 8118723 - DNA, 22 bp, Homo sapiens
gaatgaaagatttgcattctat

SEQ ID NO: 8118724 - DNA, 22 bp, Homo sapiens
gaatgaattcagcacatggaat

SEQ ID NO: 8118725 - DNA, 22 bp, Homo sapiens
gacagacaggaggcattcaggg

SEQ ID NO: 8118726 - DNA, 22 bp, Homo sapiens
gacagacaggagctcacaggca

SEQ ID NO: 8118727 - DNA, 22 bp, Homo sapiens
gacagaagaggaacttggacag

SEQ ID NO: 8118728 - DNA, 22 bp, Homo sapiens
gacagaaggcatctagggcacg

SEQ ID NO: 8118729 - DNA, 18 bp, Homo sapiens
gaagggagctggaatgca

SEQ ID NO: 8118730 - DNA, 22 bp, Homo sapiens
gaagggtgtgatttgcctgaga

SEQ ID NO: 8118731 - DNA, 22 bp, Homo sapiens
gaagggtgtgtgtgagggacac

SEQ ID NO: 8118732 - DNA, 22 bp, Homo sapiens
gaagggtgcatggagggaagtc

SEQ ID NO: 8118733 - DNA, 22 bp, Homo sapiens
gaagggggttgcagtctagggt

SEQ ID NO: 8118734 - DNA, 22 bp, Homo sapiens
gaagggggaaaatgacaacaga

SEQ ID NO: 8118735 - DNA, 22 bp, Homo sapiens
gaagggggagctcttcctaatt

SEQ ID NO: 8118736 - DNA, 22 bp, Homo sapiens
gaagggtgtgtgtgagggacac

SEQ ID NO: 8118737 - DNA, 22 bp, Homo sapiens
gaagggtgtgtgtgagggacac

SEQ ID NO: 8118738 - DNA, 22 bp, Homo sapiens
gagagggccagggtgagaacta

SEQ ID NO: 8118739 - DNA, 22 bp, Homo sapiens
gagagggccagggtgagaacta

SEQ ID NO: 8118740 - DNA, 22 bp, Homo sapiens
gagagggctgcctggtgtgagg

SEQ ID NO: 8118741 - DNA, 22 bp, Homo sapiens
gagagggctctgtgtgggtact

SEQ ID NO: 8118742 - DNA, 21 bp, Homo sapiens
gagagggcattataggaagtg

SEQ ID NO: 8118743 - DNA, 21 bp, Homo sapiens
gagagggcattataggaagtg

SEQ ID NO: 8118744 - DNA, 21 bp, Homo sapiens
gagagggcattataggaagtg

SEQ ID NO: 8118745 - DNA, 22 bp, Homo sapiens
gagagggccagggtgagaacta

SEQ ID NO: 8118746 - DNA, 18 bp, Homo sapiens
gagagggatccctcagga

SEQ ID NO: 8118747 - DNA, 22 bp, Homo sapiens
gagagaaaggcttgcaggctgt

SEQ ID NO: 8118748 - DNA, 22 bp, Homo sapiens
gagactgctggtaaagatggga

SEQ ID NO: 8118749 - DNA, 22 bp, Homo sapiens
gagactgcattgtccaagggtt

SEQ ID NO: 8118750 - DNA, 22 bp, Homo sapiens
gagacctctgatgtccctgggg

SEQ ID NO: 8118751 - DNA, 22 bp, Homo sapiens
gagacccaggggtctgctgccc

SEQ ID NO: 8118752 - DNA, 22 bp, Homo sapiens
gagaccccagctcagcctccag

SEQ ID NO: 8118753 - DNA, 22 bp, Homo sapiens
gagacagatgctgctggagcat

SEQ ID NO: 8118754 - DNA, 22 bp, Homo sapiens
gagacattcttaggaacaatgt

SEQ ID NO: 8118755 - DNA, 22 bp, Homo sapiens
gagacagatctcggctccatgc

SEQ ID NO: 8118756 - DNA, 22 bp, Homo sapiens
gactgcagtgaaggcacatggg

SEQ ID NO: 8118757 - DNA, 22 bp, Homo sapiens
gacagcaatgacggggcagctg

SEQ ID NO: 8118758 - DNA, 22 bp, Homo sapiens
gacagagattgaatcaggaaat

SEQ ID NO: 8118759 - DNA, 22 bp, Homo sapiens
gacagagattgaatcaggaaat

SEQ ID NO: 8118760 - DNA, 22 bp, Homo sapiens
gacagagaggctgagcagtaca

SEQ ID NO: 8118761 - DNA, 22 bp, Homo sapiens
gactccaggtgtccaggcctcc

SEQ ID NO: 8118762 - DNA, 22 bp, Homo sapiens
gactcccaagcttggaggaagg

SEQ ID NO: 8118763 - DNA, 22 bp, Homo sapiens
gaccaggagatttgagctaggc

SEQ ID NO: 8118764 - DNA, 22 bp, Homo sapiens
gactgagggacagggcagtgga

SEQ ID NO: 8118765 - DNA, 22 bp, Homo sapiens
gactgaggctcccctaggctca

SEQ ID NO: 8118766 - DNA, 17 bp, Homo sapiens
gactgaggtaaggtgag

SEQ ID NO: 8118767 - DNA, 22 bp, Homo sapiens
gactgaggtattaagatggctt

SEQ ID NO: 8118768 - DNA, 22 bp, Homo sapiens
gactcctgcctcctctgtttgc

SEQ ID NO: 8118769 - DNA, 22 bp, Homo sapiens
ctgaagtcagatggcacaaggt

SEQ ID NO: 8118770 - DNA, 22 bp, Homo sapiens
ctgaagtcatacactgttctga

SEQ ID NO: 8118771 - DNA, 22 bp, Homo sapiens
ctctggagtcctgtatcactcc

SEQ ID NO: 8118772 - DNA, 22 bp, Homo sapiens
ttttcctctgtatttgaaatgc

SEQ ID NO: 8118773 - DNA, 22 bp, Homo sapiens
ttttctcaggtgcttatctaag

SEQ ID NO: 8118774 - DNA, 22 bp, Homo sapiens
ctgagagtgtggcttccaggcc

SEQ ID NO: 8118775 - DNA, 22 bp, Homo sapiens
ctgagatctttatacgaggcac

SEQ ID NO: 8118776 - DNA, 22 bp, Homo sapiens
ctgagccttgatgtcccttgtc

SEQ ID NO: 8118777 - DNA, 22 bp, Homo sapiens
ctgagctgggagcctggcacca

SEQ ID NO: 8118778 - DNA, 22 bp, Homo sapiens
ctgagagtattggcaggcttgg

SEQ ID NO: 8118779 - DNA, 22 bp, Homo sapiens
ctgagaggtaagcagcgcagtg

SEQ ID NO: 8118780 - DNA, 22 bp, Homo sapiens
ctgagaggtaagcagcgcagtg

SEQ ID NO: 8118781 - DNA, 22 bp, Homo sapiens
ctgagaggtaagcagcgcagtg

SEQ ID NO: 8118782 - DNA, 22 bp, Homo sapiens
ctgagaggcggaggttgcagtg

SEQ ID NO: 8118783 - DNA, 22 bp, Homo sapiens
ctgagagatgatatagcttaat

SEQ ID NO: 8118784 - DNA, 22 bp, Homo sapiens
ctgagagatcaagccacaggat

SEQ ID NO: 8118785 - DNA, 22 bp, Homo sapiens
ctgagggcaccgacagagtgga

SEQ ID NO: 8118786 - DNA, 22 bp, Homo sapiens
ctgctcctccccatcaggcagc

SEQ ID NO: 8118787 - DNA, 22 bp, Homo sapiens
ctgctccagtagccccatgtgg

SEQ ID NO: 8118788 - DNA, 22 bp, Homo sapiens
ctgcctctgttgggcatggtct

SEQ ID NO: 8118789 - DNA, 22 bp, Homo sapiens
ctgcctcttaagtggatggagt

SEQ ID NO: 8118790 - DNA, 22 bp, Homo sapiens
ctgcctgcgccaccaccacgtc

SEQ ID NO: 8118791 - DNA, 22 bp, Homo sapiens
ctgcctgccttggcctccagga

SEQ ID NO: 8118792 - DNA, 22 bp, Homo sapiens
ctgctggaagtttgctgtggat

SEQ ID NO: 8118793 - DNA, 22 bp, Homo sapiens
ctgctggaaggtacacatcttg

SEQ ID NO: 8118794 - DNA, 22 bp, Homo sapiens
ctgctggcctcggccatgcctg

SEQ ID NO: 8118795 - DNA, 22 bp, Homo sapiens
ctgctgctgagagctcagcctg

SEQ ID NO: 8118796 - DNA, 22 bp, Homo sapiens
ctgctgctgctatctacccagg

SEQ ID NO: 8118797 - DNA, 22 bp, Homo sapiens
ctgctgcccctgagctcagcct

SEQ ID NO: 8118798 - DNA, 20 bp, Homo sapiens
ctgctgccctgtcagcctct

SEQ ID NO: 8118799 - DNA, 20 bp, Homo sapiens
ctgctgccctgtcagcctct

SEQ ID NO: 8118800 - DNA, 19 bp, Homo sapiens
ctgctgccggagactcgtc

SEQ ID NO: 8118801 - DNA, 22 bp, Homo sapiens
ctgctgccggcgagcctccctt

SEQ ID NO: 8118802 - DNA, 22 bp, Homo sapiens
ctgctctaggttcctgcatatg

SEQ ID NO: 8118803 - DNA, 22 bp, Homo sapiens
ctgctctaactgcattagtttt

SEQ ID NO: 8118804 - DNA, 22 bp, Homo sapiens
ctgctctccccaggccagtctg

SEQ ID NO: 8118805 - DNA, 22 bp, Homo sapiens
ctgcagtgaaatcaggaagcaa

SEQ ID NO: 8118806 - DNA, 22 bp, Homo sapiens
ctgcagtgcaagcccagatgga

SEQ ID NO: 8118807 - DNA, 22 bp, Homo sapiens
ctgcagtgaaatcaggaagcaa

SEQ ID NO: 8118808 - DNA, 22 bp, Homo sapiens
ctgcagtgttctggaatgcatt

SEQ ID NO: 8118809 - DNA, 22 bp, Homo sapiens
ctgcagtgttctggaatgcatt

SEQ ID NO: 8118810 - DNA, 22 bp, Homo sapiens
ctgcatatgagaataggagaaa

SEQ ID NO: 8118811 - DNA, 22 bp, Homo sapiens
ctgcatatgatagatgccttgc

SEQ ID NO: 8118812 - DNA, 22 bp, Homo sapiens
ctgcagggtttttcaaggacaa

SEQ ID NO: 8118813 - DNA, 22 bp, Homo sapiens
ctgcagggtttttcaaggacaa

SEQ ID NO: 8118814 - DNA, 22 bp, Homo sapiens
ctgcaggggcctcgagcacagg

SEQ ID NO: 8118815 - DNA, 22 bp, Homo sapiens
ctgccctgcccaggccttgggc

SEQ ID NO: 8118816 - DNA, 20 bp, Homo sapiens
ctgccctgccctgggtcctg

SEQ ID NO: 8118817 - DNA, 22 bp, Homo sapiens
ctgccctgcttctgagggaagc

SEQ ID NO: 8118818 - DNA, 22 bp, Homo sapiens
ctgccctgcttctgagggaagc

SEQ ID NO: 8118819 - DNA, 22 bp, Homo sapiens
ctgccctgcttgatgacagcga

SEQ ID NO: 8118820 - DNA, 22 bp, Homo sapiens
ctgccctgctggagatcacagt

SEQ ID NO: 8118821 - DNA, 22 bp, Homo sapiens
ctgccctgcagctccacggact

SEQ ID NO: 8118822 - DNA, 22 bp, Homo sapiens
ctgccctgagtcatgccagatg

SEQ ID NO: 8118823 - DNA, 22 bp, Homo sapiens
ctgccctgagggcctgtgtgtt

SEQ ID NO: 8118824 - DNA, 22 bp, Homo sapiens
ctgccctgcttgatgacagcga

SEQ ID NO: 8118825 - DNA, 22 bp, Homo sapiens
ctgccctgggagtacctgtcct

SEQ ID NO: 8118826 - DNA, 22 bp, Homo sapiens
ctgccctggccactgtgcccag

SEQ ID NO: 8118827 - DNA, 22 bp, Homo sapiens
ctgccctggccactgtgcccag

SEQ ID NO: 8118828 - DNA, 22 bp, Homo sapiens
ctgccctggcagcctaccatgg

SEQ ID NO: 8118829 - DNA, 22 bp, Homo sapiens
ctgccctgggatggtctgtgcg

SEQ ID NO: 8118830 - DNA, 22 bp, Homo sapiens
ctgcctctataggagtccacca

SEQ ID NO: 8118831 - DNA, 22 bp, Homo sapiens
ctgccctgggccaggaagcggc

SEQ ID NO: 8118832 - DNA, 22 bp, Homo sapiens
ctgcctctggcctcaggcccag

SEQ ID NO: 8118833 - DNA, 22 bp, Homo sapiens
ctgcctctggttttggtccctg

SEQ ID NO: 8118834 - DNA, 22 bp, Homo sapiens
ctccctggcagccgcactcctg

SEQ ID NO: 8118835 - DNA, 22 bp, Homo sapiens
ctccctgccctgtgagttggcc

SEQ ID NO: 8118836 - DNA, 22 bp, Homo sapiens
ctcctcagctgggaggagtccc

SEQ ID NO: 8118837 - DNA, 21 bp, Homo sapiens
ctcctcaggaccagccacagg

SEQ ID NO: 8118838 - DNA, 22 bp, Homo sapiens
ctcctcagtcaggtctagggtc

SEQ ID NO: 8118839 - DNA, 19 bp, Homo sapiens
ctcctcagtcccagaggtc

SEQ ID NO: 8118840 - DNA, 22 bp, Homo sapiens
ctccccagcattctgacttcct

SEQ ID NO: 8118841 - DNA, 22 bp, Homo sapiens
ctccccacacactaggcctgat

SEQ ID NO: 8118842 - DNA, 22 bp, Homo sapiens
ctcaggcttgggaggaggccca

SEQ ID NO: 8118843 - DNA, 22 bp, Homo sapiens
ctcagggaagctatggtgaggg

SEQ ID NO: 8118844 - DNA, 22 bp, Homo sapiens
ctcaggctgtctaatggattag

SEQ ID NO: 8118845 - DNA, 22 bp, Homo sapiens
tttacacatacctctttaaagt

SEQ ID NO: 8118846 - DNA, 22 bp, Homo sapiens
tttacaattctctaccagtgtt

SEQ ID NO: 8118847 - DNA, 20 bp, Homo sapiens
ctcctcagttccatgggagg

SEQ ID NO: 8118848 - DNA, 22 bp, Homo sapiens
ctcgttgctgaagccaaagtca

SEQ ID NO: 8118849 - DNA, 22 bp, Homo sapiens
tttcaaagttgggaattgtaat

SEQ ID NO: 8118850 - DNA, 22 bp, Homo sapiens
tttcaaataccataaacctaat

SEQ ID NO: 8118851 - DNA, 22 bp, Homo sapiens
tttcaaagtcaatatcattacc

SEQ ID NO: 8118852 - DNA, 22 bp, Homo sapiens
ctcctgtcagaagcatcctgag

SEQ ID NO: 8118853 - DNA, 22 bp, Homo sapiens
tttcttaaatatttgcaggaca

SEQ ID NO: 8118854 - DNA, 21 bp, Homo sapiens
ctctgctgtctaccagctgtt

SEQ ID NO: 8118855 - DNA, 22 bp, Homo sapiens
ctctgctgctttgccagtggaa

SEQ ID NO: 8118856 - DNA, 20 bp, Homo sapiens
ctctgctgcgcatcccactt

SEQ ID NO: 8118857 - DNA, 22 bp, Homo sapiens
ctctggaattaaggaagcctgt

SEQ ID NO: 8118858 - DNA, 22 bp, Homo sapiens
tttgaagtgtatgaaaatacag

SEQ ID NO: 8118859 - DNA, 22 bp, Homo sapiens
ctctggaattgacctgggaggg

SEQ ID NO: 8118860 - DNA, 22 bp, Homo sapiens
ctctggagcatttcacctacat

SEQ ID NO: 8118861 - DNA, 19 bp, Homo sapiens
ctctggagcagacactgga

SEQ ID NO: 8118862 - DNA, 22 bp, Homo sapiens
tttgaagtcaggctttctaccc

SEQ ID NO: 8118863 - DNA, 22 bp, Homo sapiens
tttgaagtgggcattagaacct

SEQ ID NO: 8118864 - DNA, 22 bp, Homo sapiens
tttgaagtcaaagattgattcc

SEQ ID NO: 8118865 - DNA, 22 bp, Homo sapiens
tttgaagggcacgacaatagtt

SEQ ID NO: 8118866 - DNA, 21 bp, Homo sapiens
ctctggaggcaagggagagtg

SEQ ID NO: 8118867 - DNA, 22 bp, Homo sapiens
ctctggagcgctgcttcccgcg

SEQ ID NO: 8118868 - DNA, 22 bp, Homo sapiens
ctctggaggccgttggccctta

SEQ ID NO: 8118869 - DNA, 22 bp, Homo sapiens
ctctggaggcagcaccagccag

SEQ ID NO: 8118870 - DNA, 22 bp, Homo sapiens
ctctggaggcctaaggaagtgg

SEQ ID NO: 8118871 - DNA, 19 bp, Homo sapiens
ctctggagggaccgccgtt

SEQ ID NO: 8118872 - DNA, 22 bp, Homo sapiens
ctctggagggaggctgagctgg

SEQ ID NO: 8118873 - DNA, 22 bp, Homo sapiens
ctctggaggtggaggttgcagt

SEQ ID NO: 8118874 - DNA, 22 bp, Homo sapiens
ctctggaggttgagcccagcaa

SEQ ID NO: 8118875 - DNA, 22 bp, Homo sapiens
ctctggaggtcaggtgtggtgg

SEQ ID NO: 8118876 - DNA, 22 bp, Homo sapiens
ctctggagtcaggcagccctgg

SEQ ID NO: 8118877 - DNA, 19 bp, Homo sapiens
ctctggagtcattgctccc

SEQ ID NO: 8118878 - DNA, 22 bp, Homo sapiens
ctctggagtaagagctatgaaa

SEQ ID NO: 8118879 - DNA, 21 bp, Homo sapiens
ctctggagtcaagagcttcca

SEQ ID NO: 8118880 - DNA, 22 bp, Homo sapiens
ctctagctcccagggagcgtct

SEQ ID NO: 8118881 - DNA, 19 bp, Homo sapiens
tttctctccctcatcccga

SEQ ID NO: 8118882 - DNA, 20 bp, Homo sapiens
ctctctggaaggtgggagcc

SEQ ID NO: 8118883 - DNA, 22 bp, Homo sapiens
ctctctggaattaaagcccaat

SEQ ID NO: 8118884 - DNA, 22 bp, Homo sapiens
ttacagaagagaaagaattcag

SEQ ID NO: 8118885 - DNA, 22 bp, Homo sapiens
ttacagaagagtaacttggcaa

SEQ ID NO: 8118886 - DNA, 22 bp, Homo sapiens
ttacagaagtattgagagatcc

SEQ ID NO: 8118887 - DNA, 22 bp, Homo sapiens
ttacagaaggaacactactcag

SEQ ID NO: 8118888 - DNA, 21 bp, Homo sapiens
ccttctccacagggtctccgg

SEQ ID NO: 8118889 - DNA, 20 bp, Homo sapiens
ccttctctggaattgcctcc

SEQ ID NO: 8118890 - DNA, 21 bp, Homo sapiens
ccttctcttgcttcagcttca

SEQ ID NO: 8118891 - DNA, 20 bp, Homo sapiens
ttacagaaatgatgttattt

SEQ ID NO: 8118892 - DNA, 23 bp, Homo sapiens
ttacagaaagtatgcttttgttt

SEQ ID NO: 8118893 - DNA, 22 bp, Homo sapiens
ttacaatgatgaataaatggca

SEQ ID NO: 8118894 - DNA, 22 bp, Homo sapiens
ttacagaactgtcttgaaattt

SEQ ID NO: 8118895 - DNA, 22 bp, Homo sapiens
ccttctgagtgtggacccctgt

SEQ ID NO: 8118896 - DNA, 22 bp, Homo sapiens
ccttctgagcttcaatttcagt

SEQ ID NO: 8118897 - DNA, 21 bp, Homo sapiens
ccttctcttgcttcagcttca

SEQ ID NO: 8118898 - DNA, 22 bp, Homo sapiens
ttacctaaaatagctcaattta

SEQ ID NO: 8118899 - DNA, 22 bp, Homo sapiens
ttaccattgttccccatgtgta

SEQ ID NO: 8118900 - DNA, 22 bp, Homo sapiens
ttaccattttataagttaaagt

SEQ ID NO: 8118901 - DNA, 22 bp, Homo sapiens
ttaccaagctctgcatgttaag

SEQ ID NO: 8118902 - DNA, 22 bp, Homo sapiens
ttacgaatgttagattgcatct

SEQ ID NO: 8118903 - DNA, 22 bp, Homo sapiens
ccttgcctcattgtgcttctcc

SEQ ID NO: 8118904 - DNA, 22 bp, Homo sapiens
ccttggctggaattactctggg

SEQ ID NO: 8118905 - DNA, 23 bp, Homo sapiens
ccttgtctggctggctggacttt

SEQ ID NO: 8118906 - DNA, 22 bp, Homo sapiens
ccttggggaatatccattcttc

SEQ ID NO: 8118907 - DNA, 22 bp, Homo sapiens
cgcagagggagccgcgggctgc

SEQ ID NO: 8118908 - DNA, 22 bp, Homo sapiens
cgcagagggcaggcagtgctgg

SEQ ID NO: 8118909 - DNA, 21 bp, Homo sapiens
cgcagagcgaacttgcggcgc

SEQ ID NO: 8118910 - DNA, 22 bp, Homo sapiens
ttattattgtggttgcattatc

SEQ ID NO: 8118911 - DNA, 22 bp, Homo sapiens
ttattattttgtgtacagcaaa

SEQ ID NO: 8118912 - DNA, 22 bp, Homo sapiens
ttatgggagcaattggggaggt

SEQ ID NO: 8118913 - DNA, 21 bp, Homo sapiens
ttacaaagctacagatgttgc

SEQ ID NO: 8118914 - DNA, 22 bp, Homo sapiens
cctgtggcgggggccagtgcct

SEQ ID NO: 8118915 - DNA, 22 bp, Homo sapiens
ttacaagtttctggcttcatcc

SEQ ID NO: 8118916 - DNA, 22 bp, Homo sapiens
ttacaatgacaggtgtatcatt

SEQ ID NO: 8118917 - DNA, 22 bp, Homo sapiens
ttacaataccacatcacctcat

SEQ ID NO: 8118918 - DNA, 21 bp, Homo sapiens
ttaagccagcttcttctccta

SEQ ID NO: 8118919 - DNA, 22 bp, Homo sapiens
tgttttctagaaacaatgccta

SEQ ID NO: 8118920 - DNA, 22 bp, Homo sapiens
tgttgatttgtgggctgcaaaa

SEQ ID NO: 8118921 - DNA, 22 bp, Homo sapiens
tgttgattagtgtttagactta

SEQ ID NO: 8118922 - DNA, 22 bp, Homo sapiens
tgttgattagtgtttagactta

SEQ ID NO: 8118923 - DNA, 22 bp, Homo sapiens
tgttcccaagataagattatga

SEQ ID NO: 8118924 - DNA, 22 bp, Homo sapiens
cctgctcctatctgggctcatt

SEQ ID NO: 8118925 - DNA, 22 bp, Homo sapiens
tgttgcccaggttctctcctgc

SEQ ID NO: 8118926 - DNA, 22 bp, Homo sapiens
tgttgcctgactttaaaatgtg

SEQ ID NO: 8118927 - DNA, 17 bp, Homo sapiens
tggttccaaccatacgc

SEQ ID NO: 8118928 - DNA, 22 bp, Homo sapiens
cctgctcagccccagctcaccc

SEQ ID NO: 8118929 - DNA, 22 bp, Homo sapiens
cctgctcagccccagctcaccc

SEQ ID NO: 8118930 - DNA, 22 bp, Homo sapiens
cctgctcagagcgtcttgtgtg

SEQ ID NO: 8118931 - DNA, 23 bp, Homo sapiens
cctgctcaggcgtgtgccctgct

SEQ ID NO: 8118932 - DNA, 22 bp, Homo sapiens
cctgctccatgctcaccatcag

SEQ ID NO: 8118933 - DNA, 23 bp, Homo sapiens
cctggggcacttgagtcctcatc

SEQ ID NO: 8118934 - DNA, 22 bp, Homo sapiens
tgtttcttctcacacaaactca

SEQ ID NO: 8118935 - DNA, 22 bp, Homo sapiens
tgttttcagtcatatagcaggt

SEQ ID NO: 8118936 - DNA, 22 bp, Homo sapiens
tgttttcatggagatggtggcg

SEQ ID NO: 8118937 - DNA, 17 bp, Homo sapiens
tgttttcattcattgct

SEQ ID NO: 8118938 - DNA, 22 bp, Homo sapiens
tgttttcatttgatgtaacaaa

SEQ ID NO: 8118939 - DNA, 22 bp, Homo sapiens
ttccactctactctggccagtc

SEQ ID NO: 8118940 - DNA, 22 bp, Homo sapiens
ttccactctacacactgctggc

SEQ ID NO: 8118941 - DNA, 22 bp, Homo sapiens
ttccactcctcctggtggggtg

SEQ ID NO: 8118942 - DNA, 22 bp, Homo sapiens
ttccactcatgcaaaggtccca

SEQ ID NO: 8118943 - DNA, 22 bp, Homo sapiens
cgtctggacgggaaggagaagt

SEQ ID NO: 8118944 - DNA, 22 bp, Homo sapiens
ttcctaacaaacttcagtgaat

SEQ ID NO: 8118945 - DNA, 21 bp, Homo sapiens
ttcctcctctggagaagaaga

SEQ ID NO: 8118946 - DNA, 17 bp, Homo sapiens
ttcctcctcaccatgtt

SEQ ID NO: 8118947 - DNA, 22 bp, Homo sapiens
ttcctcctacgcttatcacttt

SEQ ID NO: 8118948 - DNA, 17 bp, Homo sapiens
ttcctcctcaccatgtt

SEQ ID NO: 8118949 - DNA, 22 bp, Homo sapiens
ttcctctcctcccaccaggtga

SEQ ID NO: 8118950 - DNA, 22 bp, Homo sapiens
ttcctctcctcacatgagtcac

SEQ ID NO: 8118951 - DNA, 17 bp, Homo sapiens
ttcctctcacatttttt

SEQ ID NO: 8118952 - DNA, 22 bp, Homo sapiens
ttcctctcctcacatgagtcac

SEQ ID NO: 8118953 - DNA, 22 bp, Homo sapiens
ttcctctcaacatgcctgccgg

SEQ ID NO: 8118954 - DNA, 22 bp, Homo sapiens
ttcctctctcttgccagaatgt

SEQ ID NO: 8118955 - DNA, 22 bp, Homo sapiens
ttcctctcgctctccggggccc

SEQ ID NO: 8118956 - DNA, 22 bp, Homo sapiens
ttccactctccagtcaatttca

SEQ ID NO: 8118957 - DNA, 22 bp, Homo sapiens
ttccactctatgatagaagggt

SEQ ID NO: 8118958 - DNA, 22 bp, Homo sapiens
ttccactcttctctggacttat

SEQ ID NO: 8118959 - DNA, 22 bp, Homo sapiens
ttccactctgtcccctgtggga

SEQ ID NO: 8118960 - DNA, 22 bp, Homo sapiens
cgtcctctagagggaagcactt

SEQ ID NO: 8118961 - DNA, 21 bp, Homo sapiens
ttctcctgttttgcaccacag

SEQ ID NO: 8118962 - DNA, 22 bp, Homo sapiens
ttctcctgggaggggttgccca

SEQ ID NO: 8118963 - DNA, 22 bp, Homo sapiens
ctagttctagatccctgaggaa

SEQ ID NO: 8118964 - DNA, 22 bp, Homo sapiens
ctagtggaaactaactggaatt

SEQ ID NO: 8118965 - DNA, 22 bp, Homo sapiens
ctagttgaagaggctgtcatca

SEQ ID NO: 8118966 - DNA, 22 bp, Homo sapiens
ctagttttaagctccttgaggt

SEQ ID NO: 8118967 - DNA, 22 bp, Homo sapiens
ttctcctggagtgcttgttggg

SEQ ID NO: 8118968 - DNA, 22 bp, Homo sapiens
ttctcctgcgcaggcccaggga

SEQ ID NO: 8118969 - DNA, 21 bp, Homo sapiens
ttctacaggatgaatgaaaac

SEQ ID NO: 8118970 - DNA, 22 bp, Homo sapiens
ctaaattatttgcacattagag

SEQ ID NO: 8118971 - DNA, 22 bp, Homo sapiens
ctacataatctggatttgtctg

SEQ ID NO: 8118972 - DNA, 22 bp, Homo sapiens
ctacatgaactcttaagtcaca

SEQ ID NO: 8118973 - DNA, 22 bp, Homo sapiens
ctataaatctacccagcattgg

SEQ ID NO: 8118974 - DNA, 22 bp, Homo sapiens
ttctgaaaccactgaccaacta

SEQ ID NO: 8118975 - DNA, 22 bp, Homo sapiens
ttctgaaaacacactttgcagc

SEQ ID NO: 8118976 - DNA, 22 bp, Homo sapiens
ttctgaaaattgggtcatactt

SEQ ID NO: 8118977 - DNA, 20 bp, Homo sapiens
ttctgaaagcagcagaggga

SEQ ID NO: 8118978 - DNA, 22 bp, Homo sapiens
ttctgaaataggagatagctgt

SEQ ID NO: 8118979 - DNA, 22 bp, Homo sapiens
ttctgaaattcgactatccaat

SEQ ID NO: 8118980 - DNA, 22 bp, Homo sapiens
ttctgtctccctgatgtagagc

SEQ ID NO: 8118981 - DNA, 20 bp, Homo sapiens
ttcttaaagacctcactttg

SEQ ID NO: 8118982 - DNA, 22 bp, Homo sapiens
ttcttaaagaggcaaaacacag

SEQ ID NO: 8118983 - DNA, 22 bp, Homo sapiens
ttcttaagtatgatcttaacgg

SEQ ID NO: 8118984 - DNA, 22 bp, Homo sapiens
ttcttaagtatgatcttaacgg

SEQ ID NO: 8118985 - DNA, 22 bp, Homo sapiens
ttcttaagactgcaaatcaacc

SEQ ID NO: 8118986 - DNA, 22 bp, Homo sapiens
ttcttaagaggaacatttttgt

SEQ ID NO: 8118987 - DNA, 22 bp, Homo sapiens
ttcttaagaaaccatcacattc

SEQ ID NO: 8118988 - DNA, 22 bp, Homo sapiens
ttcttaagaaaccatcacattc

SEQ ID NO: 8118989 - DNA, 19 bp, Homo sapiens
ttcttacaacaccctggga

SEQ ID NO: 8118990 - DNA, 21 bp, Homo sapiens
ttgaaggatcacttctgtacc

SEQ ID NO: 8118991 - DNA, 22 bp, Homo sapiens
ctcactgcaagttccacctacc

SEQ ID NO: 8118992 - DNA, 20 bp, Homo sapiens
ctcacttacctttttctata

SEQ ID NO: 8118993 - DNA, 22 bp, Homo sapiens
ctcacttagcaggttaatatca

SEQ ID NO: 8118994 - DNA, 22 bp, Homo sapiens
ctcactgtgccttttcccaaac

SEQ ID NO: 8118995 - DNA, 22 bp, Homo sapiens
ctcactgcaagctccacctctt

SEQ ID NO: 8118996 - DNA, 22 bp, Homo sapiens
ttgatcaaatcagctactgagg

SEQ ID NO: 8118997 - DNA, 22 bp, Homo sapiens
ttgatttttttctactatgcgc

SEQ ID NO: 8118998 - DNA, 22 bp, Homo sapiens
ttgcaaaaaccacaattacttt

SEQ ID NO: 8118999 - DNA, 22 bp, Homo sapiens
ttgcaaaaactgcaattacttt

SEQ ID NO: 8119000 - DNA, 22 bp, Homo sapiens
ttgcaaaaccatcctaagtaaa

SEQ ID NO: 8119001 - DNA, 22 bp, Homo sapiens
ctcagcccagcccaggaccagg

SEQ ID NO: 8119002 - DNA, 22 bp, Homo sapiens
ctcaggagtagttcagcagctg

SEQ ID NO: 8119003 - DNA, 22 bp, Homo sapiens
ctcaggccattcttccagctgc

SEQ ID NO: 8119004 - DNA, 23 bp, Homo sapiens
ttgctgcctgagccttcctctgg

SEQ ID NO: 8119005 - DNA, 22 bp, Homo sapiens
ctcaggctaagaaggccaagtg

SEQ ID NO: 8119006 - DNA, 18 bp, Homo sapiens
ctcaggcctttccctgtg

SEQ ID NO: 8119007 - DNA, 21 bp, Homo sapiens
ggctggacatcccaggagact

SEQ ID NO: 8119008 - DNA, 22 bp, Homo sapiens
ggctgtgagcaggcagaatgct

SEQ ID NO: 8119009 - DNA, 22 bp, Homo sapiens
ggctgagccatgggcactgcag

SEQ ID NO: 8119010 - DNA, 22 bp, Homo sapiens
ggctcctgaggaccaggcacag

SEQ ID NO: 8119011 - DNA, 22 bp, Homo sapiens
ggctagagtggaactggagcgg

SEQ ID NO: 8119012 - DNA, 22 bp, Homo sapiens
ggctccagtttgtgccttcagc

SEQ ID NO: 8119013 - DNA, 22 bp, Homo sapiens
ggctccctagggagagtgggag

SEQ ID NO: 8119014 - DNA, 22 bp, Homo sapiens
ggctccccaggtccaggagctg

SEQ ID NO: 8119015 - DNA, 22 bp, Homo sapiens
gggaagtgaagtgtagctgtct

SEQ ID NO: 8119016 - DNA, 23 bp, Homo sapiens
gggaagtgaggagcccctcagcc

SEQ ID NO: 8119017 - DNA, 22 bp, Homo sapiens
gggaagtgaggagcccctctgc

SEQ ID NO: 8119018 - DNA, 23 bp, Homo sapiens
gggaagtgaggagcccctctgcc

SEQ ID NO: 8119019 - DNA, 22 bp, Homo sapiens
gggaagggagggcctccagtca

SEQ ID NO: 8119020 - DNA, 22 bp, Homo sapiens
gggaagggctccttttattgca

SEQ ID NO: 8119021 - DNA, 22 bp, Homo sapiens
gggaagggtgttgtcttatctt

SEQ ID NO: 8119022 - DNA, 22 bp, Homo sapiens
gggaagtgccctcttcaggaga

SEQ ID NO: 8119023 - DNA, 22 bp, Homo sapiens
gggaagtgatggagccaggatt

SEQ ID NO: 8119024 - DNA, 23 bp, Homo sapiens
gggaagtggggatttgaagtcat

SEQ ID NO: 8119025 - DNA, 22 bp, Homo sapiens
gggaagtttgtgggaggaatat

SEQ ID NO: 8119026 - DNA, 22 bp, Homo sapiens
gggaagtgtggtttctttacag

SEQ ID NO: 8119027 - DNA, 22 bp, Homo sapiens
gggaagtgtgcagagttctctt

SEQ ID NO: 8119028 - DNA, 23 bp, Homo sapiens
gggaagtggggatttgaagtcat

SEQ ID NO: 8119029 - DNA, 22 bp, Homo sapiens
gggaatatggaagtggacactt

SEQ ID NO: 8119030 - DNA, 22 bp, Homo sapiens
ggctttgcattttgatggaggt

SEQ ID NO: 8119031 - DNA, 22 bp, Homo sapiens
gggaagggagctgggtatttag

SEQ ID NO: 8119032 - DNA, 22 bp, Homo sapiens
gggaagggagggacctcagtct

SEQ ID NO: 8119033 - DNA, 22 bp, Homo sapiens
gggaagggacttgtttaaggtc

SEQ ID NO: 8119034 - DNA, 22 bp, Homo sapiens
gggagggaggtgatgcttggct

SEQ ID NO: 8119035 - DNA, 22 bp, Homo sapiens
gggagggagaggacagttctat

SEQ ID NO: 8119036 - DNA, 22 bp, Homo sapiens
gggagggaggtgctggttcacg

SEQ ID NO: 8119037 - DNA, 16 bp, Homo sapiens
gggagggagttggtgg

SEQ ID NO: 8119038 - DNA, 22 bp, Homo sapiens
gggagggacacaaagagttccc

SEQ ID NO: 8119039 - DNA, 21 bp, Homo sapiens
gggagggatggaaatgatgtt

SEQ ID NO: 8119040 - DNA, 22 bp, Homo sapiens
gggagggattagttctgcctgg

SEQ ID NO: 8119041 - DNA, 22 bp, Homo sapiens
gggagggatctgctaggcaatg

SEQ ID NO: 8119042 - DNA, 21 bp, Homo sapiens
gggagggatggaaatgatgtt

SEQ ID NO: 8119043 - DNA, 22 bp, Homo sapiens
gggcagtgacaaaggggatgaa

SEQ ID NO: 8119044 - DNA, 22 bp, Homo sapiens
gggcactggaggccaaggagct

SEQ ID NO: 8119045 - DNA, 22 bp, Homo sapiens
ggcagtgggttccccaaggcac

SEQ ID NO: 8119046 - DNA, 22 bp, Homo sapiens
ggcagtgggtggatctcaggga

SEQ ID NO: 8119047 - DNA, 21 bp, Homo sapiens
ggcatgagggcagtgagcaga

SEQ ID NO: 8119048 - DNA, 22 bp, Homo sapiens
ggcagtggtgggaggctcgctc

SEQ ID NO: 8119049 - DNA, 19 bp, Homo sapiens
ggcatccacagctggagag

SEQ ID NO: 8119050 - DNA, 22 bp, Homo sapiens
ggcatccaaataccaagatgta

SEQ ID NO: 8119051 - DNA, 19 bp, Homo sapiens
ggcatccacgaatgcagag

SEQ ID NO: 8119052 - DNA, 22 bp, Homo sapiens
ggcatggacgtctctgaggcca

SEQ ID NO: 8119053 - DNA, 22 bp, Homo sapiens
ggcatgagtaacgtgagtgagg

SEQ ID NO: 8119054 - DNA, 19 bp, Homo sapiens
ggccaggctgactgtggtc

SEQ ID NO: 8119055 - DNA, 22 bp, Homo sapiens
ggccaggccaagagggttggaa

SEQ ID NO: 8119056 - DNA, 22 bp, Homo sapiens
ggccaggcgatgacccctccac

SEQ ID NO: 8119057 - DNA, 22 bp, Homo sapiens
ggccaggcactgtgtgagatat

SEQ ID NO: 8119058 - DNA, 22 bp, Homo sapiens
ggccaggagcaagccaggctct

SEQ ID NO: 8119059 - DNA, 22 bp, Homo sapiens
ggccaggaagggaagatcagca

SEQ ID NO: 8119060 - DNA, 22 bp, Homo sapiens
ggccaggagcaagccaggctct

SEQ ID NO: 8119061 - DNA, 22 bp, Homo sapiens
ggcctggaaggacagcgtgatg

SEQ ID NO: 8119062 - DNA, 22 bp, Homo sapiens
ggcctggacacctgaggtctta

SEQ ID NO: 8119063 - DNA, 22 bp, Homo sapiens
ggcctggagcagagactaggga

SEQ ID NO: 8119064 - DNA, 19 bp, Homo sapiens
ggcctggctatccctgctg

SEQ ID NO: 8119065 - DNA, 22 bp, Homo sapiens
ggcagccagcaatgagaagttt

SEQ ID NO: 8119066 - DNA, 22 bp, Homo sapiens
ggcagccatggacactggctag

SEQ ID NO: 8119067 - DNA, 22 bp, Homo sapiens
ggcagccatactcagacctggg

SEQ ID NO: 8119068 - DNA, 22 bp, Homo sapiens
ggcagccatgcacgctgcctgg

SEQ ID NO: 8119069 - DNA, 22 bp, Homo sapiens
ggcagcagggctgtctccctac

SEQ ID NO: 8119070 - DNA, 22 bp, Homo sapiens
ggcagaaggcctcccagctcct

SEQ ID NO: 8119071 - DNA, 22 bp, Homo sapiens
ggattgagagcactggtagctg

SEQ ID NO: 8119072 - DNA, 22 bp, Homo sapiens
ggattctgccttgttgcttcaa

SEQ ID NO: 8119073 - DNA, 19 bp, Homo sapiens
ggattctgcagttttcaca

SEQ ID NO: 8119074 - DNA, 19 bp, Homo sapiens
ggatgagggtcaggcatag

SEQ ID NO: 8119075 - DNA, 22 bp, Homo sapiens
ggatgaggtagatgaacaaggg

SEQ ID NO: 8119076 - DNA, 22 bp, Homo sapiens
ggagttggaggctccagggaac

SEQ ID NO: 8119077 - DNA, 22 bp, Homo sapiens
ggatgaggaaaccacagtgtcc

SEQ ID NO: 8119078 - DNA, 22 bp, Homo sapiens
ggatgaggaagattactgagaa

SEQ ID NO: 8119079 - DNA, 22 bp, Homo sapiens
ggagcaccctgctcagccaagc

SEQ ID NO: 8119080 - DNA, 17 bp, Homo sapiens
gtcaacaggatttcttt

SEQ ID NO: 8119081 - DNA, 22 bp, Homo sapiens
gtaggaaagggagtgaagggaa

SEQ ID NO: 8119082 - DNA, 22 bp, Homo sapiens
gtaaatattccctcggttccta

SEQ ID NO: 8119083 - DNA, 22 bp, Homo sapiens
gtcaccagcaccaatgccacat

SEQ ID NO: 8119084 - DNA, 22 bp, Homo sapiens
gtcaggggatgtgctggtggcc

SEQ ID NO: 8119085 - DNA, 22 bp, Homo sapiens
gtcaggggatgtgctggtggcc

SEQ ID NO: 8119086 - DNA, 22 bp, Homo sapiens
gtcagtgtagcaggtgcaagcc

SEQ ID NO: 8119087 - DNA, 22 bp, Homo sapiens
gtcagtgtgagttgattccata

SEQ ID NO: 8119088 - DNA, 22 bp, Homo sapiens
gtccctggagctgagcagtgct

SEQ ID NO: 8119089 - DNA, 22 bp, Homo sapiens
gtcattgtgtggacatggagaa

SEQ ID NO: 8119090 - DNA, 22 bp, Homo sapiens
gtcattgtaatattctcattta

SEQ ID NO: 8119091 - DNA, 19 bp, Homo sapiens
gtcctctcaacaacccggg

SEQ ID NO: 8119092 - DNA, 19 bp, Homo sapiens
gtcctctcaacaacccggg

SEQ ID NO: 8119093 - DNA, 22 bp, Homo sapiens
gtctcccatcgtttgtgaggaa

SEQ ID NO: 8119094 - DNA, 22 bp, Homo sapiens
gtctcccagcctacatctttct

SEQ ID NO: 8119095 - DNA, 22 bp, Homo sapiens
gtgccgcgacgcagtcggtgcc

SEQ ID NO: 8119096 - DNA, 22 bp, Homo sapiens
gtgcctcccgggaccatgcact

SEQ ID NO: 8119097 - DNA, 22 bp, Homo sapiens
gtgcctccatcagtgcctccaa

SEQ ID NO: 8119098 - DNA, 22 bp, Homo sapiens
gtgcctccatcagtgcctccaa

SEQ ID NO: 8119099 - DNA, 22 bp, Homo sapiens
gtgatttcaggtttttcatact

SEQ ID NO: 8119100 - DNA, 22 bp, Homo sapiens
gtgatttcaaatatagagtgag

SEQ ID NO: 8119101 - DNA, 22 bp, Homo sapiens
gtgattttgagacctatatagt

SEQ ID NO: 8119102 - DNA, 22 bp, Homo sapiens
gtgcacagaaacatacaatgtg

SEQ ID NO: 8119103 - DNA, 22 bp, Homo sapiens
gtgcacagaaattggtaagact

SEQ ID NO: 8119104 - DNA, 22 bp, Homo sapiens
gtgcccaggggccagctgccgg

SEQ ID NO: 8119105 - DNA, 22 bp, Homo sapiens
gtctcctgtcctgcaggatgga

SEQ ID NO: 8119106 - DNA, 22 bp, Homo sapiens
gtctcctggctgcagctaagac

SEQ ID NO: 8119107 - DNA, 22 bp, Homo sapiens
gtctcctgccacactcagtccc

SEQ ID NO: 8119108 - DNA, 22 bp, Homo sapiens
gtctcctgagactgcagtcacc

SEQ ID NO: 8119109 - DNA, 22 bp, Homo sapiens
gtctcctgagccttgactgcaa

SEQ ID NO: 8119110 - DNA, 22 bp, Homo sapiens
gtcttcctaatttgctattagg

SEQ ID NO: 8119111 - DNA, 22 bp, Homo sapiens
gtcttctgatctggttagccat

SEQ ID NO: 8119112 - DNA, 22 bp, Homo sapiens
gtcttctgtttactttgaagtt

SEQ ID NO: 8119113 - DNA, 22 bp, Homo sapiens
gtcttctgttctgtgaggcttc

SEQ ID NO: 8119114 - DNA, 22 bp, Homo sapiens
gtcttctgtctgtctggcatgt

SEQ ID NO: 8119115 - DNA, 22 bp, Homo sapiens
gtcttctgtaagatgaggtccc

SEQ ID NO: 8119116 - DNA, 22 bp, Homo sapiens
gtcttctgcccaggcagacgga

SEQ ID NO: 8119117 - DNA, 22 bp, Homo sapiens
gtcttctgcctccattagagtt

SEQ ID NO: 8119118 - DNA, 22 bp, Homo sapiens
gtcttctgcaactgcacctgcc

SEQ ID NO: 8119119 - DNA, 22 bp, Homo sapiens
gtgatatttttaaagattaagg

SEQ ID NO: 8119120 - DNA, 23 bp, Homo sapiens
gtgatattaaggatagagacaag

SEQ ID NO: 8119121 - DNA, 22 bp, Homo sapiens
gtgatgttatgaagatgaatgt

SEQ ID NO: 8119122 - DNA, 22 bp, Homo sapiens
gtgagtgttaacccactgcttc

SEQ ID NO: 8119123 - DNA, 22 bp, Homo sapiens
gggcatgcctgcgcagtgcatg

SEQ ID NO: 8119124 - DNA, 22 bp, Homo sapiens
gggcctccggggtgagctgtgg

SEQ ID NO: 8119125 - DNA, 22 bp, Homo sapiens
gggcatgagagggcagctggca

SEQ ID NO: 8119126 - DNA, 22 bp, Homo sapiens
gggcatcaccaagaaggaggac

SEQ ID NO: 8119127 - DNA, 22 bp, Homo sapiens
gggctccagttgtccccaggat

SEQ ID NO: 8119128 - DNA, 22 bp, Homo sapiens
gggctccatcacaggctccatc

SEQ ID NO: 8119129 - DNA, 22 bp, Homo sapiens
gggctccagcccgggaccaggt

SEQ ID NO: 8119130 - DNA, 22 bp, Homo sapiens
gggctccagccagctccttgtg

SEQ ID NO: 8119131 - DNA, 22 bp, Homo sapiens
gggctcctggcagtcatgctca

SEQ ID NO: 8119132 - DNA, 22 bp, Homo sapiens
gggctcctgcctcctggcacct

SEQ ID NO: 8119133 - DNA, 22 bp, Homo sapiens
gggctctcgattagaccctggg

SEQ ID NO: 8119134 - DNA, 22 bp, Homo sapiens
ggggcagctcccgagggcagga

SEQ ID NO: 8119135 - DNA, 22 bp, Homo sapiens
ggggcagctcccgagggcagga

SEQ ID NO: 8119136 - DNA, 22 bp, Homo sapiens
ggggcacacttttggtagatat

SEQ ID NO: 8119137 - DNA, 22 bp, Homo sapiens
ggggcaggagcccttcttcagc

SEQ ID NO: 8119138 - DNA, 21 bp, Homo sapiens
gggggaagaggagttgctagt

SEQ ID NO: 8119139 - DNA, 22 bp, Homo sapiens
gggggaagactgggctagtgat

SEQ ID NO: 8119140 - DNA, 22 bp, Homo sapiens
gggggaagaaagaacatggcat

SEQ ID NO: 8119141 - DNA, 22 bp, Homo sapiens
gggtcaggctagcccagacttc

SEQ ID NO: 8119142 - DNA, 22 bp, Homo sapiens
gggtcaggctagcccagacttc

SEQ ID NO: 8119143 - DNA, 22 bp, Homo sapiens
gggtcaggctcagcagggcagc

SEQ ID NO: 8119144 - DNA, 22 bp, Homo sapiens
gggtcaggcctcaaggtgggct

SEQ ID NO: 8119145 - DNA, 22 bp, Homo sapiens
ggtaacacaggtgcagttttaa

SEQ ID NO: 8119146 - DNA, 19 bp, Homo sapiens
ggtaatattgtcagtgaca

SEQ ID NO: 8119147 - DNA, 22 bp, Homo sapiens
ggtactttatacatgcatctgc

SEQ ID NO: 8119148 - DNA, 19 bp, Homo sapiens
ggtagaagggaagtgtttt

SEQ ID NO: 8119149 - DNA, 18 bp, Homo sapiens
ggtcaggggcggagagaa

SEQ ID NO: 8119150 - DNA, 22 bp, Homo sapiens
ggtcaggggctgctctacagag

SEQ ID NO: 8119151 - DNA, 22 bp, Homo sapiens
ggtgcccagagccaggaatgag

SEQ ID NO: 8119152 - DNA, 22 bp, Homo sapiens
ggtgccctgtaaaagccatgca

SEQ ID NO: 8119153 - DNA, 22 bp, Homo sapiens
ggtgccactgcactctggcctg

SEQ ID NO: 8119154 - DNA, 22 bp, Homo sapiens
ggtgggagtggaacgtggaaga

SEQ ID NO: 8119155 - DNA, 22 bp, Homo sapiens
ggtgaagggccttaggagacag

SEQ ID NO: 8119156 - DNA, 22 bp, Homo sapiens
ggtgaaggcacaagagggcaag

SEQ ID NO: 8119157 - DNA, 22 bp, Homo sapiens
ggtgaaggcacaagagggcaag

SEQ ID NO: 8119158 - DNA, 22 bp, Homo sapiens
ggtgaaggtcagagcaggaaaa

SEQ ID NO: 8119159 - DNA, 22 bp, Homo sapiens
ggtgaaggtggaacgcagagca

SEQ ID NO: 8119160 - DNA, 22 bp, Homo sapiens
ggtgcaggcggtggggcaagta

SEQ ID NO: 8119161 - DNA, 22 bp, Homo sapiens
ggtcttctctatgagctggtct

SEQ ID NO: 8119162 - DNA, 22 bp, Homo sapiens
gccagtggcttgccaggcagga

SEQ ID NO: 8119163 - DNA, 22 bp, Homo sapiens
gcccactctggagcctgttccc

SEQ ID NO: 8119164 - DNA, 22 bp, Homo sapiens
gccagtggagcacatggtgaag

SEQ ID NO: 8119165 - DNA, 22 bp, Homo sapiens
gccagtggaggacccatggaga

SEQ ID NO: 8119166 - DNA, 22 bp, Homo sapiens
gccagtggcatgcggcagggac

SEQ ID NO: 8119167 - DNA, 22 bp, Homo sapiens
gccagtggcatgcggcagggac

SEQ ID NO: 8119168 - DNA, 22 bp, Homo sapiens
gccagtggccctctggagaagg

SEQ ID NO: 8119169 - DNA, 22 bp, Homo sapiens
gccagtggcttgccaggcagga

SEQ ID NO: 8119170 - DNA, 22 bp, Homo sapiens
gccagtggccctctggagaagg

SEQ ID NO: 8119171 - DNA, 22 bp, Homo sapiens
gccagtctgctcccacaagttc

SEQ ID NO: 8119172 - DNA, 21 bp, Homo sapiens
gcccagagtcctcccactcca

SEQ ID NO: 8119173 - DNA, 22 bp, Homo sapiens
gcccactctggagcctgttccc

SEQ ID NO: 8119174 - DNA, 22 bp, Homo sapiens
gcccactgagtgactccctcag

SEQ ID NO: 8119175 - DNA, 22 bp, Homo sapiens
gccaggaatttcaagagccact

SEQ ID NO: 8119176 - DNA, 22 bp, Homo sapiens
gccaggaatggagaggtggcct

SEQ ID NO: 8119177 - DNA, 22 bp, Homo sapiens
gccaggagtgtgtggctatgtt

SEQ ID NO: 8119178 - DNA, 22 bp, Homo sapiens
gccaggtgtcctcacagtgagg

SEQ ID NO: 8119179 - DNA, 22 bp, Homo sapiens
gccaggtgtagtggccacacct

SEQ ID NO: 8119180 - DNA, 22 bp, Homo sapiens
gccaggtgggagacagacagca

SEQ ID NO: 8119181 - DNA, 18 bp, Homo sapiens
gccaggtctctctgcttc

SEQ ID NO: 8119182 - DNA, 22 bp, Homo sapiens
gccaggtccagggtggagcgct

SEQ ID NO: 8119183 - DNA, 22 bp, Homo sapiens
gccaggtcgtctccatgtccaa

SEQ ID NO: 8119184 - DNA, 22 bp, Homo sapiens
gccctctgttattgcatcctta

SEQ ID NO: 8119185 - DNA, 22 bp, Homo sapiens
gcctcagctgttgcaggggccc

SEQ ID NO: 8119186 - DNA, 22 bp, Homo sapiens
gcctcagctcccagcccaggct

SEQ ID NO: 8119187 - DNA, 17 bp, Homo sapiens
gcctactcctatactcc

SEQ ID NO: 8119188 - DNA, 22 bp, Homo sapiens
gcccaggctggagtgcagtggt

SEQ ID NO: 8119189 - DNA, 22 bp, Homo sapiens
gcccagggcagggcaagagtga

SEQ ID NO: 8119190 - DNA, 22 bp, Homo sapiens
gccctctgtgtaacaatccaga

SEQ ID NO: 8119191 - DNA, 22 bp, Homo sapiens
gccctctggtgggtgagccccg

SEQ ID NO: 8119192 - DNA, 22 bp, Homo sapiens
gcccaggggcagcgcatagtgg

SEQ ID NO: 8119193 - DNA, 21 bp, Homo sapiens
gccaagggggtagctattcct

SEQ ID NO: 8119194 - DNA, 22 bp, Homo sapiens
gccagagagatggaaaagctta

SEQ ID NO: 8119195 - DNA, 22 bp, Homo sapiens
gccagagaggccgaggtaccca

SEQ ID NO: 8119196 - DNA, 22 bp, Homo sapiens
gccaaggagacacggtgttgta

SEQ ID NO: 8119197 - DNA, 22 bp, Homo sapiens
gccagcccattaacccctgtcc

SEQ ID NO: 8119198 - DNA, 22 bp, Homo sapiens
gccagcccctccatcctgttca

SEQ ID NO: 8119199 - DNA, 22 bp, Homo sapiens
gccagccccagacatcctatcg

SEQ ID NO: 8119200 - DNA, 22 bp, Homo sapiens
gccagccccttagggctctccc

SEQ ID NO: 8119201 - DNA, 22 bp, Homo sapiens
gccagaggcccaaggacagctg

SEQ ID NO: 8119202 - DNA, 22 bp, Homo sapiens
gcagtcagtaaggcagccagaa

SEQ ID NO: 8119203 - DNA, 22 bp, Homo sapiens
gcagtgaaaaagtgcaccctgt

SEQ ID NO: 8119204 - DNA, 22 bp, Homo sapiens
gcagtgaacataacacagaagg

SEQ ID NO: 8119205 - DNA, 18 bp, Homo sapiens
gcagtgaagaaagagctt

SEQ ID NO: 8119206 - DNA, 22 bp, Homo sapiens
gcatgaggggggttaggaagtt

SEQ ID NO: 8119207 - DNA, 22 bp, Homo sapiens
gcatccagaggtagccactgtg

SEQ ID NO: 8119208 - DNA, 20 bp, Homo sapiens
gcatccagacacccagctgc

SEQ ID NO: 8119209 - DNA, 22 bp, Homo sapiens
gcatccagaggtagccactgtg

SEQ ID NO: 8119210 - DNA, 22 bp, Homo sapiens
gcatccaggctgcccctctgcg

SEQ ID NO: 8119211 - DNA, 22 bp, Homo sapiens
gcataacaaatatgctttaaat

SEQ ID NO: 8119212 - DNA, 22 bp, Homo sapiens
gcagctgcctattcagggcttg

SEQ ID NO: 8119213 - DNA, 22 bp, Homo sapiens
gcagctggatttcaagagggag

SEQ ID NO: 8119214 - DNA, 22 bp, Homo sapiens
gcaggaggttgagccaggactg

SEQ ID NO: 8119215 - DNA, 22 bp, Homo sapiens
gcaggctgatagaggattccat

SEQ ID NO: 8119216 - DNA, 22 bp, Homo sapiens
gcaggctgatagaggattccat

SEQ ID NO: 8119217 - DNA, 22 bp, Homo sapiens
gcaggctgatgactggagttgg

SEQ ID NO: 8119218 - DNA, 22 bp, Homo sapiens
gcaggctgatgactggagttgg

SEQ ID NO: 8119219 - DNA, 22 bp, Homo sapiens
gcaggctgccaccttctgagtt

SEQ ID NO: 8119220 - DNA, 22 bp, Homo sapiens
gcaggctgccaccttctgagtt

SEQ ID NO: 8119221 - DNA, 22 bp, Homo sapiens
gcaggctcccttgcagagcagg

SEQ ID NO: 8119222 - DNA, 22 bp, Homo sapiens
gcaggctcttctttctgcccag

SEQ ID NO: 8119223 - DNA, 22 bp, Homo sapiens
gcaggctgaaactcggggtcta

SEQ ID NO: 8119224 - DNA, 22 bp, Homo sapiens
gcaggctgagagtccaagaagg

SEQ ID NO: 8119225 - DNA, 22 bp, Homo sapiens
gcaggctgaaactcggggtcta

SEQ ID NO: 8119226 - DNA, 22 bp, Homo sapiens
gcaggctgagttgggaaaccaa

SEQ ID NO: 8119227 - DNA, 22 bp, Homo sapiens
gcaggctgagttgggaaaccaa

SEQ ID NO: 8119228 - DNA, 22 bp, Homo sapiens
gcaggctgagtattaccctagt

SEQ ID NO: 8119229 - DNA, 22 bp, Homo sapiens
gcaggctgagtattaccctagt

SEQ ID NO: 8119230 - DNA, 22 bp, Homo sapiens
gcaggctgagagtccaagaagg

SEQ ID NO: 8119231 - DNA, 22 bp, Homo sapiens
gcagctgcagaccctcagtgct

SEQ ID NO: 8119232 - DNA, 22 bp, Homo sapiens
gcagctgcaataggcatcaagc

SEQ ID NO: 8119233 - DNA, 22 bp, Homo sapiens
gcagctgcaagcacttctggca

SEQ ID NO: 8119234 - DNA, 22 bp, Homo sapiens
gcagccacagaggagggatgca

SEQ ID NO: 8119235 - DNA, 22 bp, Homo sapiens
gcagctgccagtccccttccag

SEQ ID NO: 8119236 - DNA, 22 bp, Homo sapiens
gcagctgcaggtggtcccatgc

SEQ ID NO: 8119237 - DNA, 22 bp, Homo sapiens
gcagaggaggacccaggaatta

SEQ ID NO: 8119238 - DNA, 22 bp, Homo sapiens
gcagaggaggacccaggaatta

SEQ ID NO: 8119239 - DNA, 23 bp, Homo sapiens
gcagaggagcaagctggacacca

SEQ ID NO: 8119240 - DNA, 22 bp, Homo sapiens
gcagcaggtctgtcaatgtcat

SEQ ID NO: 8119241 - DNA, 22 bp, Homo sapiens
gcagcaggcacggtctcgacat

SEQ ID NO: 8119242 - DNA, 22 bp, Homo sapiens
gcagcaggagagtttgtcctgc

SEQ ID NO: 8119243 - DNA, 22 bp, Homo sapiens
gcagcaggatggccaattgcca

SEQ ID NO: 8119244 - DNA, 22 bp, Homo sapiens
gcagcaggagagtaatagcggt

SEQ ID NO: 8119245 - DNA, 22 bp, Homo sapiens
gcagcaggaataggataagcaa

SEQ ID NO: 8119246 - DNA, 22 bp, Homo sapiens
gcactctcctggctgccacagt

SEQ ID NO: 8119247 - DNA, 22 bp, Homo sapiens
gcacctgggacccagaggcacc

SEQ ID NO: 8119248 - DNA, 22 bp, Homo sapiens
gcacctgggacccagaggcacc

SEQ ID NO: 8119249 - DNA, 22 bp, Homo sapiens
gcacctgggcaaggattcagag

SEQ ID NO: 8119250 - DNA, 22 bp, Homo sapiens
gcactgaatgcttttactgtaa

SEQ ID NO: 8119251 - DNA, 19 bp, Homo sapiens
gcactgaagagttggtcac

SEQ ID NO: 8119252 - DNA, 20 bp, Homo sapiens
gcactgaaattcaatgtttg

SEQ ID NO: 8119253 - DNA, 22 bp, Homo sapiens
gcactgaaattatatgcatttg

SEQ ID NO: 8119254 - DNA, 22 bp, Homo sapiens
gcagaggacacaggagggcaag

SEQ ID NO: 8119255 - DNA, 22 bp, Homo sapiens
gcagaggacacaggagggcaag

SEQ ID NO: 8119256 - DNA, 22 bp, Homo sapiens
gcagaggacacaggagggcaag

SEQ ID NO: 8119257 - DNA, 22 bp, Homo sapiens
gcagaggacacaggagggcaag

SEQ ID NO: 8119258 - DNA, 22 bp, Homo sapiens
gcagaggagcaagctggacacc

SEQ ID NO: 8119259 - DNA, 22 bp, Homo sapiens
gcagaggacacaggagggcaag

SEQ ID NO: 8119260 - DNA, 22 bp, Homo sapiens
gcagaggacacaggagggcaag

SEQ ID NO: 8119261 - DNA, 22 bp, Homo sapiens
gcaagacatgtctaaggtttaa

SEQ ID NO: 8119262 - DNA, 22 bp, Homo sapiens
gcaagacaatggagcataaacg

SEQ ID NO: 8119263 - DNA, 22 bp, Homo sapiens
gagggtcccgagccctgtcaga

SEQ ID NO: 8119264 - DNA, 22 bp, Homo sapiens
gcaaatcctggaccagcctctt

SEQ ID NO: 8119265 - DNA, 22 bp, Homo sapiens
gcaagcaaaatgggagattccc

SEQ ID NO: 8119266 - DNA, 22 bp, Homo sapiens
gcaagacctatctagttgctgt

SEQ ID NO: 8119267 - DNA, 22 bp, Homo sapiens
gagggggagatgtgcacacact

SEQ ID NO: 8119268 - DNA, 22 bp, Homo sapiens
gaggggtgggctggaagttata

SEQ ID NO: 8119269 - DNA, 22 bp, Homo sapiens
gaggggtgggctggaagttata

SEQ ID NO: 8119270 - DNA, 22 bp, Homo sapiens
gaggggtgtggagccatcagtt

SEQ ID NO: 8119271 - DNA, 22 bp, Homo sapiens
gcaagctgctcttatgtggagg

SEQ ID NO: 8119272 - DNA, 22 bp, Homo sapiens
gcaagctgatgtgatagtgaaa

SEQ ID NO: 8119273 - DNA, 22 bp, Homo sapiens
gcacagcatgaagagaggaagc

SEQ ID NO: 8119274 - DNA, 22 bp, Homo sapiens
gcacagcagtggcataaacaat

SEQ ID NO: 8119275 - DNA, 22 bp, Homo sapiens
gcaagctgtgatttatgtgaat

SEQ ID NO: 8119276 - DNA, 22 bp, Homo sapiens
gcacaggcacagagggccactg

SEQ ID NO: 8119277 - DNA, 22 bp, Homo sapiens
gcacaggcaatagatacagcta

SEQ ID NO: 8119278 - DNA, 22 bp, Homo sapiens
gcacagccctgagcgcatgtct

SEQ ID NO: 8119279 - DNA, 22 bp, Homo sapiens
gcacagcctgtccctgtcctgg

SEQ ID NO: 8119280 - DNA, 23 bp, Homo sapiens
gctcacagggtgtaactcctagt

SEQ ID NO: 8119281 - DNA, 22 bp, Homo sapiens
gctcacaggtctgtggctattg

SEQ ID NO: 8119282 - DNA, 21 bp, Homo sapiens
gctcaagtttctctggcaaca

SEQ ID NO: 8119283 - DNA, 22 bp, Homo sapiens
gctcaagatgtggcctctgaag

SEQ ID NO: 8119284 - DNA, 20 bp, Homo sapiens
gctcaagagcccattctgaa

SEQ ID NO: 8119285 - DNA, 22 bp, Homo sapiens
gctatagaaagtaatcactatc

SEQ ID NO: 8119286 - DNA, 17 bp, Homo sapiens
gccttctctgccctcac

SEQ ID NO: 8119287 - DNA, 22 bp, Homo sapiens
gccttctctgtgagctcctagg

SEQ ID NO: 8119288 - DNA, 22 bp, Homo sapiens
gccttctctgtgagctcctagg

SEQ ID NO: 8119289 - DNA, 22 bp, Homo sapiens
gccttgcaggaaggagggacag

SEQ ID NO: 8119290 - DNA, 22 bp, Homo sapiens
gcgccccatctacagtactttt

SEQ ID NO: 8119291 - DNA, 22 bp, Homo sapiens
gcggaggaaactgaggcaagag

SEQ ID NO: 8119292 - DNA, 22 bp, Homo sapiens
gcgctggggctcaaacctcaca

SEQ ID NO: 8119293 - DNA, 22 bp, Homo sapiens
gcgggccaccttggagagcgct

SEQ ID NO: 8119294 - DNA, 23 bp, Homo sapiens
gccttcagctcgggaaggctccc

SEQ ID NO: 8119295 - DNA, 22 bp, Homo sapiens
gccttcagcggccgctcgctgc

SEQ ID NO: 8119296 - DNA, 22 bp, Homo sapiens
gcctggggcatgcagctgatac

SEQ ID NO: 8119297 - DNA, 22 bp, Homo sapiens
gcctggggtctctgactcacag

SEQ ID NO: 8119298 - DNA, 22 bp, Homo sapiens
gcctggctgccggccttggcaa

SEQ ID NO: 8119299 - DNA, 21 bp, Homo sapiens
gcctggctagaagctcctagc

SEQ ID NO: 8119300 - DNA, 22 bp, Homo sapiens
gcctggctagttagtgtcaggt

SEQ ID NO: 8119301 - DNA, 22 bp, Homo sapiens
gcctggctgctcagccactcac

SEQ ID NO: 8119302 - DNA, 22 bp, Homo sapiens
gcctggctgctggttctgagga

SEQ ID NO: 8119303 - DNA, 22 bp, Homo sapiens
gcctggctaagcagaaggaccc

SEQ ID NO: 8119304 - DNA, 22 bp, Homo sapiens
gcctcaggccgccctgctgctc

SEQ ID NO: 8119305 - DNA, 22 bp, Homo sapiens
gcctggctggtcactgcctggc

SEQ ID NO: 8119306 - DNA, 22 bp, Homo sapiens
gcctggctgtctggcaaggttc

SEQ ID NO: 8119307 - DNA, 22 bp, Homo sapiens
gcctggctgcttagcctacttc

SEQ ID NO: 8119308 - DNA, 19 bp, Homo sapiens
gcctggctgggatgagccc

SEQ ID NO: 8119309 - DNA, 22 bp, Homo sapiens
gcctggctgggctgaatgctta

SEQ ID NO: 8119310 - DNA, 22 bp, Homo sapiens
gcctggcttggggctcagtggt

SEQ ID NO: 8119311 - DNA, 22 bp, Homo sapiens
gcctggcttcccttggagcatt

SEQ ID NO: 8119312 - DNA, 22 bp, Homo sapiens
gctctccagctacccctttagc

SEQ ID NO: 8119313 - DNA, 22 bp, Homo sapiens
gctctccagattcaggagggat

SEQ ID NO: 8119314 - DNA, 21 bp, Homo sapiens
gctctccagggccagcccagg

SEQ ID NO: 8119315 - DNA, 22 bp, Homo sapiens
gctctccaaaccctgtggcttt

SEQ ID NO: 8119316 - DNA, 22 bp, Homo sapiens
gctctccactgaccacggggca

SEQ ID NO: 8119317 - DNA, 22 bp, Homo sapiens
gctctgcctggtcgcgtgctgg

SEQ ID NO: 8119318 - DNA, 21 bp, Homo sapiens
gctcctggtgctgcgtggcgc

SEQ ID NO: 8119319 - DNA, 22 bp, Homo sapiens
gctcctgtgaggacacagccgc

SEQ ID NO: 8119320 - DNA, 22 bp, Homo sapiens
gctctatgcatgggagcaggag

SEQ ID NO: 8119321 - DNA, 22 bp, Homo sapiens
gctcctggtctggagcttcaag

SEQ ID NO: 8119322 - DNA, 22 bp, Homo sapiens
gctcagggaactttttgcaggc

SEQ ID NO: 8119323 - DNA, 22 bp, Homo sapiens
gctcagggaaagagctcctgtc

SEQ ID NO: 8119324 - DNA, 22 bp, Homo sapiens
gctcaggctggattgcagtggc

SEQ ID NO: 8119325 - DNA, 22 bp, Homo sapiens
gctcaggctctcccaggggaat

SEQ ID NO: 8119326 - DNA, 22 bp, Homo sapiens
gctgcaggagctggagctgtgg

SEQ ID NO: 8119327 - DNA, 22 bp, Homo sapiens
gctgcaggagattttgagagtc

SEQ ID NO: 8119328 - DNA, 22 bp, Homo sapiens
gctgcagacctcatgcaggtgg

SEQ ID NO: 8119329 - DNA, 22 bp, Homo sapiens
gctgccacgatctctgctgtag

SEQ ID NO: 8119330 - DNA, 22 bp, Homo sapiens
gctgccacttggtcatgtcatg

SEQ ID NO: 8119331 - DNA, 22 bp, Homo sapiens
gctgcaggttgggcaacagagt

SEQ ID NO: 8119332 - DNA, 22 bp, Homo sapiens
gctgcagggggtgggcgtctcc

SEQ ID NO: 8119333 - DNA, 22 bp, Homo sapiens
gctgccagctgcggcccacgcg

SEQ ID NO: 8119334 - DNA, 22 bp, Homo sapiens
gctgccagcgtcagacctgggg

SEQ ID NO: 8119335 - DNA, 22 bp, Homo sapiens
gctgccagtgtggcatgatgca

SEQ ID NO: 8119336 - DNA, 22 bp, Homo sapiens
gctgcacaggagaccccattta

SEQ ID NO: 8119337 - DNA, 22 bp, Homo sapiens
gctgcacagacttgctcattta

SEQ ID NO: 8119338 - DNA, 22 bp, Homo sapiens
gctgcacatggcagaggccttt

SEQ ID NO: 8119339 - DNA, 19 bp, Homo sapiens
gctgcacacccagcaactg

SEQ ID NO: 8119340 - DNA, 22 bp, Homo sapiens
gctgcacaaagtgttggttaag

SEQ ID NO: 8119341 - DNA, 22 bp, Homo sapiens
gctgcacagaacagtcattggc

SEQ ID NO: 8119342 - DNA, 22 bp, Homo sapiens
gctgattttgagaagcacagtc

SEQ ID NO: 8119343 - DNA, 22 bp, Homo sapiens
gctgattttgtcacatagcaag

SEQ ID NO: 8119344 - DNA, 22 bp, Homo sapiens
gctgatgggagctggctcaccc

SEQ ID NO: 8119345 - DNA, 22 bp, Homo sapiens
gctgatggaattgtaaaatagt

SEQ ID NO: 8119346 - DNA, 22 bp, Homo sapiens
gctgatggaaggacaggcgccg

SEQ ID NO: 8119347 - DNA, 22 bp, Homo sapiens
gctgaaggtctctggagaggtc

SEQ ID NO: 8119348 - DNA, 22 bp, Homo sapiens
gctgaaggcccggaggacaggg

SEQ ID NO: 8119349 - DNA, 20 bp, Homo sapiens
gctgaagattcccatgcaag

SEQ ID NO: 8119350 - DNA, 22 bp, Homo sapiens
gctggcaggagcctttcccttt

SEQ ID NO: 8119351 - DNA, 22 bp, Homo sapiens
gctggcagctggaagttgggct

SEQ ID NO: 8119352 - DNA, 22 bp, Homo sapiens
gctggcaggagaaacggggtgc

SEQ ID NO: 8119353 - DNA, 22 bp, Homo sapiens
gctggcagacttcctctggaac

SEQ ID NO: 8119354 - DNA, 22 bp, Homo sapiens
gctggcagggacagctgcgtgt

SEQ ID NO: 8119355 - DNA, 22 bp, Homo sapiens
gctggctcagggactagagttt

SEQ ID NO: 8119356 - DNA, 22 bp, Homo sapiens
gctggcagaagagctggttcaa

SEQ ID NO: 8119357 - DNA, 22 bp, Homo sapiens
gctggcagaatttcttcttgct

SEQ ID NO: 8119358 - DNA, 22 bp, Homo sapiens
gctggcagactgggggcagaac

SEQ ID NO: 8119359 - DNA, 22 bp, Homo sapiens
gctggcagacttcctctggaac

SEQ ID NO: 8119360 - DNA, 22 bp, Homo sapiens
gctggcacatggctcagggcct

SEQ ID NO: 8119361 - DNA, 22 bp, Homo sapiens
gctggcaatggtgtggtctggt

SEQ ID NO: 8119362 - DNA, 21 bp, Homo sapiens
gctggctctctgacgtgcttt

SEQ ID NO: 8119363 - DNA, 22 bp, Homo sapiens
gctgtctgttcgagcgtgtgtt

SEQ ID NO: 8119364 - DNA, 22 bp, Homo sapiens
gctggtagacctcactgcactc

SEQ ID NO: 8119365 - DNA, 22 bp, Homo sapiens
gctgggagtcgcgtctgtggcc

SEQ ID NO: 8119366 - DNA, 20 bp, Homo sapiens
ggaagccagggtgcagggga

SEQ ID NO: 8119367 - DNA, 22 bp, Homo sapiens
ggaagccaggctgggggatctg

SEQ ID NO: 8119368 - DNA, 22 bp, Homo sapiens
ggaagccaggccaatgagaaca

SEQ ID NO: 8119369 - DNA, 20 bp, Homo sapiens
ggaagccagcatccttgagg

SEQ ID NO: 8119370 - DNA, 22 bp, Homo sapiens
ggaagccacccagctttgatag

SEQ ID NO: 8119371 - DNA, 22 bp, Homo sapiens
ggaagccagaaagtgagaatat

SEQ ID NO: 8119372 - DNA, 22 bp, Homo sapiens
ggaagccagagtgctgggcagg

SEQ ID NO: 8119373 - DNA, 22 bp, Homo sapiens
ggaacattttttaaggcagaaa

SEQ ID NO: 8119374 - DNA, 22 bp, Homo sapiens
ggaacatttcctggcagagagg

SEQ ID NO: 8119375 - DNA, 22 bp, Homo sapiens
ggaagccagttgcttggtgtgg

SEQ ID NO: 8119376 - DNA, 22 bp, Homo sapiens
ggaagccatgagggacagttct

SEQ ID NO: 8119377 - DNA, 21 bp, Homo sapiens
ggaagctgtgtccatgctcct

SEQ ID NO: 8119378 - DNA, 21 bp, Homo sapiens
ggaagctgtgtccatgctcct

SEQ ID NO: 8119379 - DNA, 22 bp, Homo sapiens
ggaagctgttgtgagtgcagca

SEQ ID NO: 8119380 - DNA, 22 bp, Homo sapiens
ggaagctgttgtgagtgcagca

SEQ ID NO: 8119381 - DNA, 21 bp, Homo sapiens
ggacaccagtcacactggatt

SEQ ID NO: 8119382 - DNA, 22 bp, Homo sapiens
ggacacagtggaagacagcttg

SEQ ID NO: 8119383 - DNA, 22 bp, Homo sapiens
ggaaggaagtgaccaggatatc

SEQ ID NO: 8119384 - DNA, 22 bp, Homo sapiens
gcttcctcgctgggcagaggca

SEQ ID NO: 8119385 - DNA, 22 bp, Homo sapiens
gcttcctcctggaggtcactca

SEQ ID NO: 8119386 - DNA, 22 bp, Homo sapiens
gcttcctccctgctgctcacta

SEQ ID NO: 8119387 - DNA, 22 bp, Homo sapiens
gcttcctccctgctgctcacta

SEQ ID NO: 8119388 - DNA, 19 bp, Homo sapiens
gcttcccaccagccagccc

SEQ ID NO: 8119389 - DNA, 22 bp, Homo sapiens
gcttcctcaccttctcttgcat

SEQ ID NO: 8119390 - DNA, 22 bp, Homo sapiens
ggaaaggagatattggagagtg

SEQ ID NO: 8119391 - DNA, 22 bp, Homo sapiens
ggaaagtggtggtggaaagagg

SEQ ID NO: 8119392 - DNA, 22 bp, Homo sapiens
ggaaagggcatggccttttcac

SEQ ID NO: 8119393 - DNA, 22 bp, Homo sapiens
ggaaatattgattgctctgtat

SEQ ID NO: 8119394 - DNA, 21 bp, Homo sapiens
ggacagaggagaaggcaccct

SEQ ID NO: 8119395 - DNA, 22 bp, Homo sapiens
ggacagagagtgaatatgacat

SEQ ID NO: 8119396 - DNA, 22 bp, Homo sapiens
ggacagagcagacgagcagcgg

SEQ ID NO: 8119397 - DNA, 22 bp, Homo sapiens
ggacagagccctggtggcctaa

SEQ ID NO: 8119398 - DNA, 22 bp, Homo sapiens
ggacagagccctggtggcctaa

SEQ ID NO: 8119399 - DNA, 22 bp, Homo sapiens
ggacagaaaccatatgagtgta

SEQ ID NO: 8119400 - DNA, 22 bp, Homo sapiens
ggacacgtggctgaaggcggcc

SEQ ID NO: 8119401 - DNA, 22 bp, Homo sapiens
ggacggggagctggaaagggga

SEQ ID NO: 8119402 - DNA, 19 bp, Homo sapiens
ggagaggctggagggatgc

SEQ ID NO: 8119403 - DNA, 22 bp, Homo sapiens
ggagaggagctattgggggctc

SEQ ID NO: 8119404 - DNA, 22 bp, Homo sapiens
ggagaggagctattgggggctc

SEQ ID NO: 8119405 - DNA, 22 bp, Homo sapiens
ggagaggaaatgccagcacttc

SEQ ID NO: 8119406 - DNA, 22 bp, Homo sapiens
ggagaggagattgtggcatttt

SEQ ID NO: 8119407 - DNA, 22 bp, Homo sapiens
ggagaggaaatgccagcacttc

SEQ ID NO: 8119408 - DNA, 22 bp, Homo sapiens
tattcacaggctggagtgatgt

SEQ ID NO: 8119409 - DNA, 22 bp, Homo sapiens
tatgttgcaccaacctaataat

SEQ ID NO: 8119410 - DNA, 22 bp, Homo sapiens
tatgttctgactctacatggga

SEQ ID NO: 8119411 - DNA, 22 bp, Homo sapiens
tatgttctctgctctaggatgt

SEQ ID NO: 8119412 - DNA, 22 bp, Homo sapiens
tatgttctgtctgtacagattt

SEQ ID NO: 8119413 - DNA, 22 bp, Homo sapiens
tatgttctaggaatggttgatg

SEQ ID NO: 8119414 - DNA, 22 bp, Homo sapiens
tatgttctagacttttgctgtg

SEQ ID NO: 8119415 - DNA, 21 bp, Homo sapiens
tattgattcaatttcttgagt

SEQ ID NO: 8119416 - DNA, 22 bp, Homo sapiens
tattttcaccatgtatccctgt

SEQ ID NO: 8119417 - DNA, 22 bp, Homo sapiens
tatttgtatgtgtgtacatata

SEQ ID NO: 8119418 - DNA, 20 bp, Homo sapiens
tatgataattacaaaatagt

SEQ ID NO: 8119419 - DNA, 22 bp, Homo sapiens
tatctttgcaaatatctctaag

SEQ ID NO: 8119420 - DNA, 22 bp, Homo sapiens
tatgcacattctttgtgggagc

SEQ ID NO: 8119421 - DNA, 22 bp, Homo sapiens
tatcttgatcaagtagaagagg

SEQ ID NO: 8119422 - DNA, 22 bp, Homo sapiens
tatcttggactctttgcagtgc

SEQ ID NO: 8119423 - DNA, 22 bp, Homo sapiens
tatcttgttttggcctccaggg

SEQ ID NO: 8119424 - DNA, 22 bp, Homo sapiens
tatcttcaatttattcaaggag

SEQ ID NO: 8119425 - DNA, 22 bp, Homo sapiens
tatcaacattaatattttctgg

SEQ ID NO: 8119426 - DNA, 20 bp, Homo sapiens
tatattttctctttggcctt

SEQ ID NO: 8119427 - DNA, 22 bp, Homo sapiens
tatatttaatcctagagccatt

SEQ ID NO: 8119428 - DNA, 18 bp, Homo sapiens
tatatttcacacatattc

SEQ ID NO: 8119429 - DNA, 22 bp, Homo sapiens
tagttaaagagatccacattcc

SEQ ID NO: 8119430 - DNA, 22 bp, Homo sapiens
tagttaaagattctgttaagag

SEQ ID NO: 8119431 - DNA, 22 bp, Homo sapiens
tagttaaagccctaaattgata

SEQ ID NO: 8119432 - DNA, 22 bp, Homo sapiens
tagttaaaataatggagatgtt

SEQ ID NO: 8119433 - DNA, 22 bp, Homo sapiens
tagtgtttagtacatatgcata

SEQ ID NO: 8119434 - DNA, 22 bp, Homo sapiens
tatagacaagcgtaacaagaag

SEQ ID NO: 8119435 - DNA, 22 bp, Homo sapiens
tatacttatgctaaaaaatgtt

SEQ ID NO: 8119436 - DNA, 22 bp, Homo sapiens
tatactgagagcaaatacattc

SEQ ID NO: 8119437 - DNA, 22 bp, Homo sapiens
tatactctgagaaacgtgtcac

SEQ ID NO: 8119438 - DNA, 22 bp, Homo sapiens
tatagcaactccaaagagactt

SEQ ID NO: 8119439 - DNA, 22 bp, Homo sapiens
tatagcaaggacataatatgct

SEQ ID NO: 8119440 - DNA, 22 bp, Homo sapiens
tatagacaagcgtaacaagaag

SEQ ID NO: 8119441 - DNA, 18 bp, Homo sapiens
tatagacacatatgccag

SEQ ID NO: 8119442 - DNA, 22 bp, Homo sapiens
tatattatcataaaaccattca

SEQ ID NO: 8119443 - DNA, 22 bp, Homo sapiens
tatattcaacaggctaatgtca

SEQ ID NO: 8119444 - DNA, 22 bp, Homo sapiens
tatattaaagtgctttgcagtg

SEQ ID NO: 8119445 - DNA, 22 bp, Homo sapiens
tatatgttgatactaattctgg

SEQ ID NO: 8119446 - DNA, 22 bp, Homo sapiens
tagatgttttgatatttgctga

SEQ ID NO: 8119447 - DNA, 22 bp, Homo sapiens
tagatgtttgagaagtttatgt

SEQ ID NO: 8119448 - DNA, 22 bp, Homo sapiens
tagatgttccacatatatatgt

SEQ ID NO: 8119449 - DNA, 22 bp, Homo sapiens
tagattaacagttttgttgaag

SEQ ID NO: 8119450 - DNA, 21 bp, Homo sapiens
tagcagaaacagttcaggcca

SEQ ID NO: 8119451 - DNA, 22 bp, Homo sapiens
tagaataagttgatgatatatg

SEQ ID NO: 8119452 - DNA, 22 bp, Homo sapiens
tagaaggaggactggcagtgtt

SEQ ID NO: 8119453 - DNA, 22 bp, Homo sapiens
tactttcatgtctatacatatt

SEQ ID NO: 8119454 - DNA, 22 bp, Homo sapiens
tagatggaggctagatgcaggg

SEQ ID NO: 8119455 - DNA, 22 bp, Homo sapiens
tagatgatagggccagaatttg

SEQ ID NO: 8119456 - DNA, 22 bp, Homo sapiens
tagatgaccttgtgttaggcaa

SEQ ID NO: 8119457 - DNA, 22 bp, Homo sapiens
tagaggagcggcgagctgagct

SEQ ID NO: 8119458 - DNA, 21 bp, Homo sapiens
tagagatgtttgctaagtagc

SEQ ID NO: 8119459 - DNA, 22 bp, Homo sapiens
taggtgtgggctcaggaatgtg

SEQ ID NO: 8119460 - DNA, 22 bp, Homo sapiens
tagtaaaagtttagttgaaagt

SEQ ID NO: 8119461 - DNA, 22 bp, Homo sapiens
tagtgtacatttaattttgcaa

SEQ ID NO: 8119462 - DNA, 22 bp, Homo sapiens
tagtgggtgatttgatgaggaa

SEQ ID NO: 8119463 - DNA, 22 bp, Homo sapiens
tagtggatgttcagagatttga

SEQ ID NO: 8119464 - DNA, 22 bp, Homo sapiens
tagtatgttgtctgatgttacc

SEQ ID NO: 8119465 - DNA, 22 bp, Homo sapiens
tagtcatttttccactaagtta

SEQ ID NO: 8119466 - DNA, 22 bp, Homo sapiens
taggaaatggctcagttactgc

SEQ ID NO: 8119467 - DNA, 22 bp, Homo sapiens
taggaagctatgggagatgtga

SEQ ID NO: 8119468 - DNA, 22 bp, Homo sapiens
taggaagctgagcagcattcct

SEQ ID NO: 8119469 - DNA, 22 bp, Homo sapiens
taggaaagcagtagagccagga

SEQ ID NO: 8119470 - DNA, 22 bp, Homo sapiens
taggaaagaaatgagtagtgat

SEQ ID NO: 8119471 - DNA, 20 bp, Homo sapiens
taggacagggcctggcttct

SEQ ID NO: 8119472 - DNA, 19 bp, Homo sapiens
taggccctagctctgcagt

SEQ ID NO: 8119473 - DNA, 20 bp, Homo sapiens
taggacaggcagccgagggg

SEQ ID NO: 8119474 - DNA, 22 bp, Homo sapiens
taggacaggatcatgatgctgg

SEQ ID NO: 8119475 - DNA, 22 bp, Homo sapiens
taggacagggacatctttttga

SEQ ID NO: 8119476 - DNA, 22 bp, Homo sapiens
taggacaggctaaaagggataa

SEQ ID NO: 8119477 - DNA, 21 bp, Homo sapiens
taggacagcccccctgccctc

SEQ ID NO: 8119478 - DNA, 22 bp, Homo sapiens
taggacagagttccctgatggc

SEQ ID NO: 8119479 - DNA, 22 bp, Homo sapiens
taggaatggcagcagccggggg

SEQ ID NO: 8119480 - DNA, 23 bp, Homo sapiens
taggacagaatgcagaaaaatac

SEQ ID NO: 8119481 - DNA, 22 bp, Homo sapiens
taggacagagatttgttttatg

SEQ ID NO: 8119482 - DNA, 22 bp, Homo sapiens
taggacagagctggttacaatg

SEQ ID NO: 8119483 - DNA, 22 bp, Homo sapiens
taggaagtggtagaggccagga

SEQ ID NO: 8119484 - DNA, 21 bp, Homo sapiens
taacacattttggtactttgg

SEQ ID NO: 8119485 - DNA, 22 bp, Homo sapiens
taacacattttcctcatacgga

SEQ ID NO: 8119486 - DNA, 22 bp, Homo sapiens
taacacatggttctgtcaggaa

SEQ ID NO: 8119487 - DNA, 22 bp, Homo sapiens
taacacatgtctgggatgtgaa

SEQ ID NO: 8119488 - DNA, 22 bp, Homo sapiens
taacacattttaagccatttta

SEQ ID NO: 8119489 - DNA, 22 bp, Homo sapiens
taacacattagttctcctagat

SEQ ID NO: 8119490 - DNA, 22 bp, Homo sapiens
taacacatatttcaagagtagt

SEQ ID NO: 8119491 - DNA, 22 bp, Homo sapiens
taacacatggttagtacacaat

SEQ ID NO: 8119492 - DNA, 22 bp, Homo sapiens
taacacatatttgcagtaagca

SEQ ID NO: 8119493 - DNA, 22 bp, Homo sapiens
taacacatgaaagcaccttctt

SEQ ID NO: 8119494 - DNA, 22 bp, Homo sapiens
taacacataagctgagaccatg

SEQ ID NO: 8119495 - DNA, 22 bp, Homo sapiens
taacacatatctacaacatgtg

SEQ ID NO: 8119496 - DNA, 22 bp, Homo sapiens
taacacatagatattttaactt

SEQ ID NO: 8119497 - DNA, 22 bp, Homo sapiens
taacacagacagccactagtaa

SEQ ID NO: 8119498 - DNA, 22 bp, Homo sapiens
taagatattgagtggtaatttg

SEQ ID NO: 8119499 - DNA, 22 bp, Homo sapiens
taaagacaataggaaagttgtt

SEQ ID NO: 8119500 - DNA, 22 bp, Homo sapiens
taaagacaataggaaagttgtt

SEQ ID NO: 8119501 - DNA, 21 bp, Homo sapiens
taaagaagatgaatgtgatca

SEQ ID NO: 8119502 - DNA, 22 bp, Homo sapiens
taaagtttggcagacaataaca

SEQ ID NO: 8119503 - DNA, 17 bp, Homo sapiens
taaatacacaagggtat

SEQ ID NO: 8119504 - DNA, 22 bp, Homo sapiens
gttttatgagacctcaggaata

SEQ ID NO: 8119505 - DNA, 22 bp, Homo sapiens
gttttataattgcttcataaga

SEQ ID NO: 8119506 - DNA, 16 bp, Homo sapiens
taaacagcagacagtt

SEQ ID NO: 8119507 - DNA, 23 bp, Homo sapiens
gttttcaacacaataaatgtaac

SEQ ID NO: 8119508 - DNA, 22 bp, Homo sapiens
taaacatcaccttctgcagttg

SEQ ID NO: 8119509 - DNA, 22 bp, Homo sapiens
gttaggtagaagtttactttga

SEQ ID NO: 8119510 - DNA, 20 bp, Homo sapiens
gttaggaggttggacatgga

SEQ ID NO: 8119511 - DNA, 20 bp, Homo sapiens
gttaggaggttggacatgga

SEQ ID NO: 8119512 - DNA, 20 bp, Homo sapiens
gttagcctcctaaggatttc

SEQ ID NO: 8119513 - DNA, 23 bp, Homo sapiens
gttcattttattgtctgattgct

SEQ ID NO: 8119514 - DNA, 22 bp, Homo sapiens
gttcatttttccctaatgagta

SEQ ID NO: 8119515 - DNA, 22 bp, Homo sapiens
gtgtgtgttcaataaatttaag

SEQ ID NO: 8119516 - DNA, 22 bp, Homo sapiens
gtgtgtgtgcatctcttttatt

SEQ ID NO: 8119517 - DNA, 22 bp, Homo sapiens
gtttaattttaggttgtcaagc

SEQ ID NO: 8119518 - DNA, 22 bp, Homo sapiens
gtttagaaaatagtgaagcaag

SEQ ID NO: 8119519 - DNA, 22 bp, Homo sapiens
gtttagaacacggaaatactga

SEQ ID NO: 8119520 - DNA, 22 bp, Homo sapiens
gtttagaagccaagatttgggt

SEQ ID NO: 8119521 - DNA, 21 bp, Homo sapiens
gtttagaagtagtctggctca

SEQ ID NO: 8119522 - DNA, 22 bp, Homo sapiens
gtttacaaatattttaaatggt

SEQ ID NO: 8119523 - DNA, 22 bp, Homo sapiens
gtttagaattctaactttaagg

SEQ ID NO: 8119524 - DNA, 22 bp, Homo sapiens
gtttagaatggcaaaattaagt

SEQ ID NO: 8119525 - DNA, 22 bp, Homo sapiens
gtttagaatgaaacttttgagc

SEQ ID NO: 8119526 - DNA, 22 bp, Homo sapiens
gtttctgtgttagatgagtctt

SEQ ID NO: 8119527 - DNA, 22 bp, Homo sapiens
gtttctgttgctcagataatgc

SEQ ID NO: 8119528 - DNA, 22 bp, Homo sapiens
gtttctatggtttatattactg

SEQ ID NO: 8119529 - DNA, 22 bp, Homo sapiens
tacacctgggacccatccaaga

SEQ ID NO: 8119530 - DNA, 22 bp, Homo sapiens
tacacctgctgagcctgtcctc

SEQ ID NO: 8119531 - DNA, 22 bp, Homo sapiens
tacacatgatcatttagtagca

SEQ ID NO: 8119532 - DNA, 22 bp, Homo sapiens
tacacatcactgtatctttcag

SEQ ID NO: 8119533 - DNA, 22 bp, Homo sapiens
tacacatcaacctggctttggc

SEQ ID NO: 8119534 - DNA, 22 bp, Homo sapiens
tacacatctggagaagccctgt

SEQ ID NO: 8119535 - DNA, 22 bp, Homo sapiens
tacacatctggtgtgactgcca

SEQ ID NO: 8119536 - DNA, 22 bp, Homo sapiens
tacacatccttctgaacaacct

SEQ ID NO: 8119537 - DNA, 22 bp, Homo sapiens
tacacatctctgtcagtagtga

SEQ ID NO: 8119538 - DNA, 22 bp, Homo sapiens
tacacatcccagactcccagga

SEQ ID NO: 8119539 - DNA, 22 bp, Homo sapiens
tacacatccatgttttgacttt

SEQ ID NO: 8119540 - DNA, 22 bp, Homo sapiens
tacacatcatacactgggatta

SEQ ID NO: 8119541 - DNA, 22 bp, Homo sapiens
tacaatgttaaggaaagagaga

SEQ ID NO: 8119542 - DNA, 22 bp, Homo sapiens
tacaatgttcctagcaggaaag

SEQ ID NO: 8119543 - DNA, 22 bp, Homo sapiens
tacaatgttggtaaagtatcat

SEQ ID NO: 8119544 - DNA, 22 bp, Homo sapiens
taatttcttcatctctgcagct

SEQ ID NO: 8119545 - DNA, 22 bp, Homo sapiens
taatttctaattcattttcagt

SEQ ID NO: 8119546 - DNA, 22 bp, Homo sapiens
taattttgtattgccattgtag

SEQ ID NO: 8119547 - DNA, 22 bp, Homo sapiens
taattttgtcacagtgacatgc

SEQ ID NO: 8119548 - DNA, 22 bp, Homo sapiens
taatttttccacgtacactggg

SEQ ID NO: 8119549 - DNA, 22 bp, Homo sapiens
tacaatgagctgtacatctcca

SEQ ID NO: 8119550 - DNA, 22 bp, Homo sapiens
tacaatgaccatattatgtaag

SEQ ID NO: 8119551 - DNA, 16 bp, Homo sapiens
tacaatgtagaaaaca

SEQ ID NO: 8119552 - DNA, 22 bp, Homo sapiens
tacaatgtaattctgattatgt

SEQ ID NO: 8119553 - DNA, 22 bp, Homo sapiens
taatgaataaacttgagagtca

SEQ ID NO: 8119554 - DNA, 22 bp, Homo sapiens
taatgctggattctttcttgtc

SEQ ID NO: 8119555 - DNA, 22 bp, Homo sapiens
taatttcaccgttgctagaaat

SEQ ID NO: 8119556 - DNA, 22 bp, Homo sapiens
taatttcactgatatgaagtca

SEQ ID NO: 8119557 - DNA, 22 bp, Homo sapiens
taatttcaatagcttgcataat

SEQ ID NO: 8119558 - DNA, 22 bp, Homo sapiens
taataacaattgtaggacatga

SEQ ID NO: 8119559 - DNA, 22 bp, Homo sapiens
taagcacacaatatctggagag

SEQ ID NO: 8119560 - DNA, 22 bp, Homo sapiens
taagttacctgttttgtcatca

SEQ ID NO: 8119561 - DNA, 19 bp, Homo sapiens
tacattccacacaatctct

SEQ ID NO: 8119562 - DNA, 22 bp, Homo sapiens
tacctgtggcttgttggatgga

SEQ ID NO: 8119563 - DNA, 22 bp, Homo sapiens
tacgttttaaacacggagccag

SEQ ID NO: 8119564 - DNA, 22 bp, Homo sapiens
taccttgggttgagttcattct

SEQ ID NO: 8119565 - DNA, 22 bp, Homo sapiens
tactaacaatgagaacaagcca

SEQ ID NO: 8119566 - DNA, 22 bp, Homo sapiens
tacttcctgtttccatgtctgt

SEQ ID NO: 8119567 - DNA, 20 bp, Homo sapiens
tacttctgaggcactctgaa

SEQ ID NO: 8119568 - DNA, 22 bp, Homo sapiens
tacttcctgtttccatgtctgt

SEQ ID NO: 8119569 - DNA, 22 bp, Homo sapiens
tacttataaggaggcacacaaa

SEQ ID NO: 8119570 - DNA, 22 bp, Homo sapiens
tacataattaatctttaagttc

SEQ ID NO: 8119571 - DNA, 22 bp, Homo sapiens
tacataattgtctttgtcctca

SEQ ID NO: 8119572 - DNA, 22 bp, Homo sapiens
tacaggacagatgtttacagga

SEQ ID NO: 8119573 - DNA, 22 bp, Homo sapiens
tacattatcttgttatctttca

SEQ ID NO: 8119574 - DNA, 22 bp, Homo sapiens
tacattatcttgttatctttca

SEQ ID NO: 8119575 - DNA, 22 bp, Homo sapiens
tacatgtatgtttatcttgaga

SEQ ID NO: 8119576 - DNA, 22 bp, Homo sapiens
tccagtcctgggagcctttctg

SEQ ID NO: 8119577 - DNA, 20 bp, Homo sapiens
tccagtggcctgaatctgga

SEQ ID NO: 8119578 - DNA, 22 bp, Homo sapiens
tcccactggacgtctgtgctgg

SEQ ID NO: 8119579 - DNA, 22 bp, Homo sapiens
tcccactggacgtctgtgctgg

SEQ ID NO: 8119580 - DNA, 22 bp, Homo sapiens
tcccactgtgcctgttgtaatc

SEQ ID NO: 8119581 - DNA, 22 bp, Homo sapiens
tcccactgtctgtcttgctgca

SEQ ID NO: 8119582 - DNA, 22 bp, Homo sapiens
tcccacttaactgtgacttctc

SEQ ID NO: 8119583 - DNA, 22 bp, Homo sapiens
tcccagagtattagcaattgct

SEQ ID NO: 8119584 - DNA, 22 bp, Homo sapiens
tcccagcagtcagagctatgtg

SEQ ID NO: 8119585 - DNA, 22 bp, Homo sapiens
tcccagcataacaaactgcccg

SEQ ID NO: 8119586 - DNA, 22 bp, Homo sapiens
tcccagcagggccgaccagcct

SEQ ID NO: 8119587 - DNA, 22 bp, Homo sapiens
tcccagcagatgagctgaccta

SEQ ID NO: 8119588 - DNA, 22 bp, Homo sapiens
tcccagcactgtaattctttgg

SEQ ID NO: 8119589 - DNA, 22 bp, Homo sapiens
tcccagcagagccagcaagccg

SEQ ID NO: 8119590 - DNA, 22 bp, Homo sapiens
tcccagcacgtctgctgtttct

SEQ ID NO: 8119591 - DNA, 22 bp, Homo sapiens
tcccagcacagggcagatgtga

SEQ ID NO: 8119592 - DNA, 21 bp, Homo sapiens
tcccagctgggtcagtgctgc

SEQ ID NO: 8119593 - DNA, 21 bp, Homo sapiens
tcccagctgggtcagtgctgc

SEQ ID NO: 8119594 - DNA, 22 bp, Homo sapiens
tcccagcttagatttgctcatt

SEQ ID NO: 8119595 - DNA, 22 bp, Homo sapiens
tcccagcttagatttgctcatt

SEQ ID NO: 8119596 - DNA, 22 bp, Homo sapiens
tcccagctgagattgagcaagg

SEQ ID NO: 8119597 - DNA, 22 bp, Homo sapiens
tcccagctgctgagatagtgct

SEQ ID NO: 8119598 - DNA, 17 bp, Homo sapiens
tccagccctgcccgacg

SEQ ID NO: 8119599 - DNA, 22 bp, Homo sapiens
tccaggacagcggcaggcagat

SEQ ID NO: 8119600 - DNA, 22 bp, Homo sapiens
tccaggacagcggcaggcagat

SEQ ID NO: 8119601 - DNA, 22 bp, Homo sapiens
tccaggacctgactgggcctgc

SEQ ID NO: 8119602 - DNA, 22 bp, Homo sapiens
tccaggagcatccaggtgaagc

SEQ ID NO: 8119603 - DNA, 22 bp, Homo sapiens
tcatgtgtcctagttcatataa

SEQ ID NO: 8119604 - DNA, 22 bp, Homo sapiens
tccacagaccagtatctgcagc

SEQ ID NO: 8119605 - DNA, 22 bp, Homo sapiens
tccacagaatgtaagatccaca

SEQ ID NO: 8119606 - DNA, 22 bp, Homo sapiens
tccacagaatggaattctccgc

SEQ ID NO: 8119607 - DNA, 22 bp, Homo sapiens
tccacagataaaaacagaggtt

SEQ ID NO: 8119608 - DNA, 22 bp, Homo sapiens
tccacttcatccagggtcacca

SEQ ID NO: 8119609 - DNA, 22 bp, Homo sapiens
tccacttccacgtgtgcagaat

SEQ ID NO: 8119610 - DNA, 22 bp, Homo sapiens
tccacttctattgggtcttggt

SEQ ID NO: 8119611 - DNA, 22 bp, Homo sapiens
tccactgctcattccacaggca

SEQ ID NO: 8119612 - DNA, 22 bp, Homo sapiens
tccactctaattactaccttct

SEQ ID NO: 8119613 - DNA, 22 bp, Homo sapiens
tccactctaattactaccttct

SEQ ID NO: 8119614 - DNA, 22 bp, Homo sapiens
tccactccttatgccagacggt

SEQ ID NO: 8119615 - DNA, 22 bp, Homo sapiens
tccaccatgtaacaagctctgt

SEQ ID NO: 8119616 - DNA, 22 bp, Homo sapiens
tccaccatgatttagcactggc

SEQ ID NO: 8119617 - DNA, 19 bp, Homo sapiens
tccaccccagccagctctg

SEQ ID NO: 8119618 - DNA, 22 bp, Homo sapiens
tcctcagttataaataggaaac

SEQ ID NO: 8119619 - DNA, 22 bp, Homo sapiens
tcctcatagactgactgcttgc

SEQ ID NO: 8119620 - DNA, 22 bp, Homo sapiens
tcctcatacatatctcagtctt

SEQ ID NO: 8119621 - DNA, 22 bp, Homo sapiens
tcctcatctcggaacctgccac

SEQ ID NO: 8119622 - DNA, 22 bp, Homo sapiens
tcctcatctcggaacctgccac

SEQ ID NO: 8119623 - DNA, 22 bp, Homo sapiens
tcctcatctcggaacctgccac

SEQ ID NO: 8119624 - DNA, 22 bp, Homo sapiens
tcctcatctgtaccttggggta

SEQ ID NO: 8119625 - DNA, 22 bp, Homo sapiens
tcctccactttgtctagcaaca

SEQ ID NO: 8119626 - DNA, 23 bp, Homo sapiens
tcctcctgacacagcctgagtga

SEQ ID NO: 8119627 - DNA, 22 bp, Homo sapiens
tcctcctgctgttagtcttgaa

SEQ ID NO: 8119628 - DNA, 22 bp, Homo sapiens
tcctcctgcctttgcttcttgt

SEQ ID NO: 8119629 - DNA, 23 bp, Homo sapiens
tcctcctggatacaaagggaaca

SEQ ID NO: 8119630 - DNA, 23 bp, Homo sapiens
tcctcctgacacagcctgagtga

SEQ ID NO: 8119631 - DNA, 22 bp, Homo sapiens
tcctcctctatcagacagtgcc

SEQ ID NO: 8119632 - DNA, 22 bp, Homo sapiens
tcctcctcctcacagtcacctg

SEQ ID NO: 8119633 - DNA, 22 bp, Homo sapiens
tcctcctcacgctgttgcttgt

SEQ ID NO: 8119634 - DNA, 22 bp, Homo sapiens
tcctcctcctcacagtcacctg

SEQ ID NO: 8119635 - DNA, 22 bp, Homo sapiens
tcctccctgggagcttctgagt

SEQ ID NO: 8119636 - DNA, 22 bp, Homo sapiens
tccctgggcctcctgctatgca

SEQ ID NO: 8119637 - DNA, 22 bp, Homo sapiens
tccctggggatgttggcctgcc

SEQ ID NO: 8119638 - DNA, 19 bp, Homo sapiens
tccctgagttccagcccag

SEQ ID NO: 8119639 - DNA, 22 bp, Homo sapiens
tccctgagggcagctcaagtcc

SEQ ID NO: 8119640 - DNA, 22 bp, Homo sapiens
tccctgagcttcatcaggcttt

SEQ ID NO: 8119641 - DNA, 22 bp, Homo sapiens
tccctgagctgagctcaacagc

SEQ ID NO: 8119642 - DNA, 23 bp, Homo sapiens
tccctgagctggagagactgcac

SEQ ID NO: 8119643 - DNA, 23 bp, Homo sapiens
tccctgagctggagagactgcac

SEQ ID NO: 8119644 - DNA, 19 bp, Homo sapiens
tcccaggcaaaggcttctc

SEQ ID NO: 8119645 - DNA, 23 bp, Homo sapiens
tccctgagatgctgctctgtccc

SEQ ID NO: 8119646 - DNA, 22 bp, Homo sapiens
tccctgccctcagtgcacccgg

SEQ ID NO: 8119647 - DNA, 22 bp, Homo sapiens
tccctgcatttgggagagtgtc

SEQ ID NO: 8119648 - DNA, 22 bp, Homo sapiens
tccctgcagcccctgagccttc

SEQ ID NO: 8119649 - DNA, 22 bp, Homo sapiens
tccctgcaggtggggtggccag

SEQ ID NO: 8119650 - DNA, 22 bp, Homo sapiens
tccctgcaggtggggtggccag

SEQ ID NO: 8119651 - DNA, 22 bp, Homo sapiens
tccctgcaggtgtgcaagctga

SEQ ID NO: 8119652 - DNA, 22 bp, Homo sapiens
tccctgcatttgggagagtgtc

SEQ ID NO: 8119653 - DNA, 22 bp, Homo sapiens
tccctgcagtagtggctaagat

SEQ ID NO: 8119654 - DNA, 22 bp, Homo sapiens
tccctgcagtaggcagccctcc

SEQ ID NO: 8119655 - DNA, 22 bp, Homo sapiens
tccctgcacccttgctgggccc

SEQ ID NO: 8119656 - DNA, 22 bp, Homo sapiens
tcagctgttatcactgtctgtc

SEQ ID NO: 8119657 - DNA, 23 bp, Homo sapiens
tcagctgttcttttccctgggac

SEQ ID NO: 8119658 - DNA, 22 bp, Homo sapiens
tcagctgtgtatcccagggcct

SEQ ID NO: 8119659 - DNA, 22 bp, Homo sapiens
tcagcttcagatcagctagaga

SEQ ID NO: 8119660 - DNA, 22 bp, Homo sapiens
tcagagggcttatgatatattg

SEQ ID NO: 8119661 - DNA, 21 bp, Homo sapiens
tcagagggccctggaggctca

SEQ ID NO: 8119662 - DNA, 17 bp, Homo sapiens
tcagagggatgagcagg

SEQ ID NO: 8119663 - DNA, 22 bp, Homo sapiens
tcaggagggctaagactgtagc

SEQ ID NO: 8119664 - DNA, 22 bp, Homo sapiens
tcaggagcagggggaagctctg

SEQ ID NO: 8119665 - DNA, 22 bp, Homo sapiens
tcaggagctatggactgtcaaa

SEQ ID NO: 8119666 - DNA, 22 bp, Homo sapiens
tcaggagagtgttcagtggagg

SEQ ID NO: 8119667 - DNA, 22 bp, Homo sapiens
tcaggaaatggacatctttgct

SEQ ID NO: 8119668 - DNA, 22 bp, Homo sapiens
tcaggaaatggtgatttggttg

SEQ ID NO: 8119669 - DNA, 22 bp, Homo sapiens
tcaggccttgtcctgacctcct

SEQ ID NO: 8119670 - DNA, 19 bp, Homo sapiens
tcaggaggtcgacctggca

SEQ ID NO: 8119671 - DNA, 22 bp, Homo sapiens
tcaggctgaatcatcctagctt

SEQ ID NO: 8119672 - DNA, 22 bp, Homo sapiens
tcaggctgaatcatcctagctt

SEQ ID NO: 8119673 - DNA, 22 bp, Homo sapiens
tcaggctgaaggaggcctatct

SEQ ID NO: 8119674 - DNA, 22 bp, Homo sapiens
tcaggctgaaaggactccagtt

SEQ ID NO: 8119675 - DNA, 22 bp, Homo sapiens
tcagggcacaggcctgtgggtt

SEQ ID NO: 8119676 - DNA, 22 bp, Homo sapiens
tcaggctgagaaaatctggacc

SEQ ID NO: 8119677 - DNA, 22 bp, Homo sapiens
tcaggctgaccaggttttgctc

SEQ ID NO: 8119678 - DNA, 22 bp, Homo sapiens
tcagggtaaaccttcactgtga

SEQ ID NO: 8119679 - DNA, 22 bp, Homo sapiens
tcagggtgggaggacccttgag

SEQ ID NO: 8119680 - DNA, 22 bp, Homo sapiens
tcagggctgccgggcagaccgt

SEQ ID NO: 8119681 - DNA, 22 bp, Homo sapiens
tcaggggacagccagctggagg

SEQ ID NO: 8119682 - DNA, 22 bp, Homo sapiens
tcaggggacttaggagagaagt

SEQ ID NO: 8119683 - DNA, 22 bp, Homo sapiens
tcataaaaatagactctaaagt

SEQ ID NO: 8119684 - DNA, 19 bp, Homo sapiens
tcagtggagaaaggggaag

SEQ ID NO: 8119685 - DNA, 22 bp, Homo sapiens
tcagtggagagcttccaggatt

SEQ ID NO: 8119686 - DNA, 22 bp, Homo sapiens
tcagtggaactgtctgggtgag

SEQ ID NO: 8119687 - DNA, 22 bp, Homo sapiens
tcagtggattggatgagatctg

SEQ ID NO: 8119688 - DNA, 22 bp, Homo sapiens
tcagtggattgtagaaggctta

SEQ ID NO: 8119689 - DNA, 22 bp, Homo sapiens
tcagtggagctaagcatgagat

SEQ ID NO: 8119690 - DNA, 22 bp, Homo sapiens
tcagtggagtatggatgaagtc

SEQ ID NO: 8119691 - DNA, 22 bp, Homo sapiens
tcagtggatatttctgtggctg

SEQ ID NO: 8119692 - DNA, 22 bp, Homo sapiens
tcagtggattgacatgaaaaag

SEQ ID NO: 8119693 - DNA, 19 bp, Homo sapiens
tcagtggatgaacatgttt

SEQ ID NO: 8119694 - DNA, 22 bp, Homo sapiens
tcatccagtatgactggtgtct

SEQ ID NO: 8119695 - DNA, 22 bp, Homo sapiens
tcatcccagtgtccatgctcag

SEQ ID NO: 8119696 - DNA, 20 bp, Homo sapiens
tcatatttttgccctgggcc

SEQ ID NO: 8119697 - DNA, 22 bp, Homo sapiens
tcatattttgcaaggtcagcta

SEQ ID NO: 8119698 - DNA, 20 bp, Homo sapiens
tcatccaggacaggagtggc

SEQ ID NO: 8119699 - DNA, 22 bp, Homo sapiens
tcagagagcctcaggcactgcc

SEQ ID NO: 8119700 - DNA, 22 bp, Homo sapiens
tcagagagctggtgggcagagg

SEQ ID NO: 8119701 - DNA, 22 bp, Homo sapiens
tcagaggaagccttggtgggag

SEQ ID NO: 8119702 - DNA, 22 bp, Homo sapiens
tcagaggaataatgctgcattt

SEQ ID NO: 8119703 - DNA, 23 bp, Homo sapiens
tcagagagctgttgagagctgcc

SEQ ID NO: 8119704 - DNA, 22 bp, Homo sapiens
tcagaggacaagctccctggtg

SEQ ID NO: 8119705 - DNA, 22 bp, Homo sapiens
tcagaggacagcagctaaataa

SEQ ID NO: 8119706 - DNA, 22 bp, Homo sapiens
tcagaggagaccaaggggaata

SEQ ID NO: 8119707 - DNA, 19 bp, Homo sapiens
tcagaggatttggctatga

SEQ ID NO: 8119708 - DNA, 22 bp, Homo sapiens
tcagaggattgcctcagcgagc

SEQ ID NO: 8119709 - DNA, 22 bp, Homo sapiens
tcagaggagaagttgggaaaat

SEQ ID NO: 8119710 - DNA, 22 bp, Homo sapiens
tcagaggaccttactgagaacc

SEQ ID NO: 8119711 - DNA, 22 bp, Homo sapiens
tcagaggactaccttctccagt

SEQ ID NO: 8119712 - DNA, 22 bp, Homo sapiens
tcagaggactaccttctccagt

SEQ ID NO: 8119713 - DNA, 22 bp, Homo sapiens
tcagaagaaggtatatttatac

SEQ ID NO: 8119714 - DNA, 22 bp, Homo sapiens
tcagaacattgacattcttatt

SEQ ID NO: 8119715 - DNA, 21 bp, Homo sapiens
tcagagaatggcctactctca

SEQ ID NO: 8119716 - DNA, 23 bp, Homo sapiens
tcagagaagttgtaggctgggga

SEQ ID NO: 8119717 - DNA, 22 bp, Homo sapiens
tcagagaagtaaggtggggtgc

SEQ ID NO: 8119718 - DNA, 22 bp, Homo sapiens
tcagagaaggtaagtgacctgc

SEQ ID NO: 8119719 - DNA, 18 bp, Homo sapiens
tcactgggtgtatgtggc

SEQ ID NO: 8119720 - DNA, 22 bp, Homo sapiens
tcactggtgtgagaggagcaaa

SEQ ID NO: 8119721 - DNA, 22 bp, Homo sapiens
tcactggggcctttggtcagga

SEQ ID NO: 8119722 - DNA, 22 bp, Homo sapiens
tcactgtaataggtttgaagat

SEQ ID NO: 8119723 - DNA, 22 bp, Homo sapiens
tcactgtctgaaagaaatggcc

SEQ ID NO: 8119724 - DNA, 21 bp, Homo sapiens
tcacgtggtcacatgagcttt

SEQ ID NO: 8119725 - DNA, 22 bp, Homo sapiens
tcacctctctggccgtctacct

SEQ ID NO: 8119726 - DNA, 22 bp, Homo sapiens
tcaaacactgtaacatggaaaa

SEQ ID NO: 8119727 - DNA, 22 bp, Homo sapiens
tcaaaagtggcctgtaaaatct

SEQ ID NO: 8119728 - DNA, 22 bp, Homo sapiens
tcaaaagtttcacatagagata

SEQ ID NO: 8119729 - DNA, 22 bp, Homo sapiens
tcaaacataaaactaaatcgag

SEQ ID NO: 8119730 - DNA, 23 bp, Homo sapiens
tcaaacatattgtgagacacagg

SEQ ID NO: 8119731 - DNA, 22 bp, Homo sapiens
tcaattcaattgcatttctgtg

SEQ ID NO: 8119732 - DNA, 22 bp, Homo sapiens
tcaattatttgatatgaaaggg

SEQ ID NO: 8119733 - DNA, 22 bp, Homo sapiens
tcacaatttggatacagctatg

SEQ ID NO: 8119734 - DNA, 22 bp, Homo sapiens
tcacagacacattaaacatgtg

SEQ ID NO: 8119735 - DNA, 22 bp, Homo sapiens
tcacagacaccttggccacagt

SEQ ID NO: 8119736 - DNA, 22 bp, Homo sapiens
tcacagacacagggagaagcat

SEQ ID NO: 8119737 - DNA, 22 bp, Homo sapiens
tcacagacactgggttattgca

SEQ ID NO: 8119738 - DNA, 22 bp, Homo sapiens
tcacagacagaagggatgggat

SEQ ID NO: 8119739 - DNA, 19 bp, Homo sapiens
tcacagacagagcaatcac

SEQ ID NO: 8119740 - DNA, 18 bp, Homo sapiens
tcacagacagctgtcttt

SEQ ID NO: 8119741 - DNA, 22 bp, Homo sapiens
tcacagacatggtgaggtaaca

SEQ ID NO: 8119742 - DNA, 22 bp, Homo sapiens
tcacagacccttgctgagctct

SEQ ID NO: 8119743 - DNA, 20 bp, Homo sapiens
tcacagagtagccttgtctg

SEQ ID NO: 8119744 - DNA, 22 bp, Homo sapiens
tcacagacaattgttttggtgt

SEQ ID NO: 8119745 - DNA, 22 bp, Homo sapiens
tcacagcacatggaccgagtcc

SEQ ID NO: 8119746 - DNA, 22 bp, Homo sapiens
tcacagcagggtaacaggaaga

SEQ ID NO: 8119747 - DNA, 22 bp, Homo sapiens
tcacagcagtaaagaaaacact

SEQ ID NO: 8119748 - DNA, 22 bp, Homo sapiens
tcacatcacatgagtgcaagga

SEQ ID NO: 8119749 - DNA, 22 bp, Homo sapiens
tcacatcaacattatagcatga

SEQ ID NO: 8119750 - DNA, 22 bp, Homo sapiens
tttgggaaacttaggggtcaga

SEQ ID NO: 8119751 - DNA, 22 bp, Homo sapiens
tttggccatatctatactcagc

SEQ ID NO: 8119752 - DNA, 21 bp, Homo sapiens
tttgagaattggtcagagtgc

SEQ ID NO: 8119753 - DNA, 22 bp, Homo sapiens
tttgagaatggtaagtggatcg

SEQ ID NO: 8119754 - DNA, 18 bp, Homo sapiens
tttgagaatgcatgactg

SEQ ID NO: 8119755 - DNA, 22 bp, Homo sapiens
tttgaaagtgtttacttgggaa

SEQ ID NO: 8119756 - DNA, 17 bp, Homo sapiens
tttctagattatcctct

SEQ ID NO: 8119757 - DNA, 22 bp, Homo sapiens
tttctagagataactcaaccat

SEQ ID NO: 8119758 - DNA, 22 bp, Homo sapiens
tttctagatattccttgaagtg

SEQ ID NO: 8119759 - DNA, 22 bp, Homo sapiens
tttgacagtaataaagcacaag

SEQ ID NO: 8119760 - DNA, 22 bp, Homo sapiens
tttgacagtaataaagcacaag

SEQ ID NO: 8119761 - DNA, 22 bp, Homo sapiens
tttgagaagtaattcaagacat

SEQ ID NO: 8119762 - DNA, 22 bp, Homo sapiens
tttgagaagcatggctgtattc

SEQ ID NO: 8119763 - DNA, 22 bp, Homo sapiens
tttgagaagctgtcttgggctc

SEQ ID NO: 8119764 - DNA, 22 bp, Homo sapiens
tttgaacaggagtatctatagt

SEQ ID NO: 8119765 - DNA, 22 bp, Homo sapiens
tttgaacatgctgcatgataat

SEQ ID NO: 8119766 - DNA, 22 bp, Homo sapiens
tttgaagacagatcaatataag

SEQ ID NO: 8119767 - DNA, 23 bp, Homo sapiens
tttgaagaagtgaatatcatata

SEQ ID NO: 8119768 - DNA, 22 bp, Homo sapiens
ttttagaaatactgatttagtg

SEQ ID NO: 8119769 - DNA, 22 bp, Homo sapiens
ttttagaaggaatgctatggtg

SEQ ID NO: 8119770 - DNA, 22 bp, Homo sapiens
ttttagaaagatccctggcagg

SEQ ID NO: 8119771 - DNA, 22 bp, Homo sapiens
ttttagaagtgcctatcctatg

SEQ ID NO: 8119772 - DNA, 22 bp, Homo sapiens
ttttcaaagactggaggctgat

SEQ ID NO: 8119773 - DNA, 22 bp, Homo sapiens
tttgtctacaaaaagtgtacag

SEQ ID NO: 8119774 - DNA, 22 bp, Homo sapiens
tttgtcttatccaatctctcag

SEQ ID NO: 8119775 - DNA, 23 bp, Homo sapiens
ttttaatttggacataagaagat

SEQ ID NO: 8119776 - DNA, 22 bp, Homo sapiens
ttttaattttagcccttctggt

SEQ ID NO: 8119777 - DNA, 22 bp, Homo sapiens
ttttacaagctgagtcgttaaa

SEQ ID NO: 8119778 - DNA, 22 bp, Homo sapiens
ttttacaaatgaggagctggag

SEQ ID NO: 8119779 - DNA, 22 bp, Homo sapiens
ttttaattttgcaaatctggtg

SEQ ID NO: 8119780 - DNA, 22 bp, Homo sapiens
ttttaattttagcccttctggt

SEQ ID NO: 8119781 - DNA, 22 bp, Homo sapiens
tttttgttcccagagaatttgt

SEQ ID NO: 8119782 - DNA, 22 bp, Homo sapiens
ttttttatatcaactgaagtct

SEQ ID NO: 8119783 - DNA, 22 bp, Homo sapiens
ttttgtgttgccatgttaagca

SEQ ID NO: 8119784 - DNA, 22 bp, Homo sapiens
ttttcctctgtatgcgtgagat

SEQ ID NO: 8119785 - DNA, 22 bp, Homo sapiens
ttttcctctgcagagcagttag

SEQ ID NO: 8119786 - DNA, 22 bp, Homo sapiens
ttttcctcaggaatgctaagct

SEQ ID NO: 8119787 - DNA, 20 bp, Homo sapiens
ttttcctcgtgtttgttcta

SEQ ID NO: 8119788 - DNA, 22 bp, Homo sapiens
ttttccagatgaattccacagt

SEQ ID NO: 8119789 - DNA, 22 bp, Homo sapiens
ttttcctcacctaactcaaggt

SEQ ID NO: 8119790 - DNA, 22 bp, Homo sapiens
ttttggctctgtctgtatcttt

SEQ ID NO: 8119791 - DNA, 22 bp, Homo sapiens
ttgacataggatgtatcagtca

SEQ ID NO: 8119792 - DNA, 21 bp, Homo sapiens
ttgaccaagggtgcgtgctcc

SEQ ID NO: 8119793 - DNA, 22 bp, Homo sapiens
ttgaaagatatgttaatctttc

SEQ ID NO: 8119794 - DNA, 22 bp, Homo sapiens
ttgaaaggaatacagaggccta

SEQ ID NO: 8119795 - DNA, 22 bp, Homo sapiens
ttctttttatcttcccataaga

SEQ ID NO: 8119796 - DNA, 22 bp, Homo sapiens
ttctttttggatagctgatgaa

SEQ ID NO: 8119797 - DNA, 22 bp, Homo sapiens
ttgaaaaaattggtagaggatg

SEQ ID NO: 8119798 - DNA, 19 bp, Homo sapiens
ttgaggggccaggggagat

SEQ ID NO: 8119799 - DNA, 22 bp, Homo sapiens
ttgagggatttacagaggtggg

SEQ ID NO: 8119800 - DNA, 22 bp, Homo sapiens
ttgagggagcctgggagccatg

SEQ ID NO: 8119801 - DNA, 18 bp, Homo sapiens
ttgagggaggggcagagt

SEQ ID NO: 8119802 - DNA, 22 bp, Homo sapiens
ttgagacaccaaactttcctaa

SEQ ID NO: 8119803 - DNA, 22 bp, Homo sapiens
ttgagacacaaggcacagtaag

SEQ ID NO: 8119804 - DNA, 22 bp, Homo sapiens
ttgagacacagtttcactctgt

SEQ ID NO: 8119805 - DNA, 22 bp, Homo sapiens
ttgagaatgtgttttgctaagt

SEQ ID NO: 8119806 - DNA, 19 bp, Homo sapiens
ttgagaattatctgagtca

SEQ ID NO: 8119807 - DNA, 22 bp, Homo sapiens
ttgagaatggaactttctgaca

SEQ ID NO: 8119808 - DNA, 22 bp, Homo sapiens
ttgagacactttgggcatcact

SEQ ID NO: 8119809 - DNA, 22 bp, Homo sapiens
ttgagacagtggggtgttgccg

SEQ ID NO: 8119810 - DNA, 22 bp, Homo sapiens
ttgagacagtatctttgttggc

SEQ ID NO: 8119811 - DNA, 22 bp, Homo sapiens
ttgagaactctgtatgtccagc

SEQ ID NO: 8119812 - DNA, 22 bp, Homo sapiens
ttgagaataaattagcagacat

SEQ ID NO: 8119813 - DNA, 19 bp, Homo sapiens
ttgagaacaccaagtactg

SEQ ID NO: 8119814 - DNA, 22 bp, Homo sapiens
ttctttgggctcagagagggag

SEQ ID NO: 8119815 - DNA, 22 bp, Homo sapiens
ttcttctgaaacagtgacagac

SEQ ID NO: 8119816 - DNA, 22 bp, Homo sapiens
ttcttctgcctcccacctgata

SEQ ID NO: 8119817 - DNA, 22 bp, Homo sapiens
ttcttcttgaaactttaggttg

SEQ ID NO: 8119818 - DNA, 22 bp, Homo sapiens
ttctgggagagaaagggccttg

SEQ ID NO: 8119819 - DNA, 22 bp, Homo sapiens
ttctgggagaatctaaatggtt

SEQ ID NO: 8119820 - DNA, 22 bp, Homo sapiens
ttctgggacattgcaggtattc

SEQ ID NO: 8119821 - DNA, 22 bp, Homo sapiens
ttctgggaggcctttgtgtctg

SEQ ID NO: 8119822 - DNA, 22 bp, Homo sapiens
ttctgggaggctggctgtcata

SEQ ID NO: 8119823 - DNA, 20 bp, Homo sapiens
ttctgggatgcctgcatctt

SEQ ID NO: 8119824 - DNA, 22 bp, Homo sapiens
ttctgggatgtgaatggtttaa

SEQ ID NO: 8119825 - DNA, 22 bp, Homo sapiens
ttcttccttggtttcctggata

SEQ ID NO: 8119826 - DNA, 22 bp, Homo sapiens
ttcttctcagggtcccacatgg

SEQ ID NO: 8119827 - DNA, 22 bp, Homo sapiens
ttcttctcagggtcccacatgg

SEQ ID NO: 8119828 - DNA, 22 bp, Homo sapiens
ttctggaggttattaggagtct

SEQ ID NO: 8119829 - DNA, 22 bp, Homo sapiens
ttctggaggtgtgaccattagc

SEQ ID NO: 8119830 - DNA, 19 bp, Homo sapiens
ttctggaggttaccctgag

SEQ ID NO: 8119831 - DNA, 22 bp, Homo sapiens
ttctggagggcctgatcacaca

SEQ ID NO: 8119832 - DNA, 22 bp, Homo sapiens
ttctggagggcatgctgctgcc

SEQ ID NO: 8119833 - DNA, 22 bp, Homo sapiens
ttctggaggctccagggaagaa

SEQ ID NO: 8119834 - DNA, 22 bp, Homo sapiens
ttctggaggctctaagggacaa

SEQ ID NO: 8119835 - DNA, 22 bp, Homo sapiens
ttctggagtcattggggctgat

SEQ ID NO: 8119836 - DNA, 22 bp, Homo sapiens
ttctggagtattcctggcagcc

SEQ ID NO: 8119837 - DNA, 22 bp, Homo sapiens
ttctggagtattcctggcacct

SEQ ID NO: 8119838 - DNA, 22 bp, Homo sapiens
ttctggagtgtggaccgctgtt

SEQ ID NO: 8119839 - DNA, 22 bp, Homo sapiens
ttctggagtgtattgggtctgc

SEQ ID NO: 8119840 - DNA, 22 bp, Homo sapiens
ttctggagtgataaaacaccac

SEQ ID NO: 8119841 - DNA, 22 bp, Homo sapiens
ttctggagtcttcaattttaga

SEQ ID NO: 8119842 - DNA, 22 bp, Homo sapiens
ttctggagtcccacagccaggg

SEQ ID NO: 8119843 - DNA, 22 bp, Homo sapiens
ttctggagttgtgacctcaggg

SEQ ID NO: 8119844 - DNA, 22 bp, Homo sapiens
ttctggagttcaggtccctaaa

SEQ ID NO: 8119845 - DNA, 22 bp, Homo sapiens
ttctggagtttgaagatcaggt

SEQ ID NO: 8119846 - DNA, 22 bp, Homo sapiens
ttctgggaacaaagtggagtgg

SEQ ID NO: 8119847 - DNA, 22 bp, Homo sapiens
ttctaaattttggaagatgcag

SEQ ID NO: 8119848 - DNA, 22 bp, Homo sapiens
ttcctttagtgtcatatacttt

SEQ ID NO: 8119849 - DNA, 22 bp, Homo sapiens
ttctcacaggatttcttttagt

SEQ ID NO: 8119850 - DNA, 22 bp, Homo sapiens
ttctcacaattcttgtatttgc

SEQ ID NO: 8119851 - DNA, 22 bp, Homo sapiens
ttctcacaggctggaatgatga

SEQ ID NO: 8119852 - DNA, 22 bp, Homo sapiens
ttctcacagtacctaacatgta

SEQ ID NO: 8119853 - DNA, 22 bp, Homo sapiens
ttctggagcttggcttgtatgt

SEQ ID NO: 8119854 - DNA, 20 bp, Homo sapiens
ttctggaggctacaagtctg

SEQ ID NO: 8119855 - DNA, 22 bp, Homo sapiens
ttctggaggcgggcgacctcgc

SEQ ID NO: 8119856 - DNA, 22 bp, Homo sapiens
ttctggaggccccttccttctc

SEQ ID NO: 8119857 - DNA, 22 bp, Homo sapiens
ttctggaggccagctgccacct

SEQ ID NO: 8119858 - DNA, 22 bp, Homo sapiens
ttctggaggagaaagggtgggc

SEQ ID NO: 8119859 - DNA, 22 bp, Homo sapiens
ttctggaggacaactgttttca

SEQ ID NO: 8119860 - DNA, 22 bp, Homo sapiens
ttctgatggtggaatgcttcag

SEQ ID NO: 8119861 - DNA, 22 bp, Homo sapiens
ttctcctctgttaccttgcaaa

SEQ ID NO: 8119862 - DNA, 22 bp, Homo sapiens
ttctcctctgttggccttccct

SEQ ID NO: 8119863 - DNA, 22 bp, Homo sapiens
ttctccctgccaaagctgcctc

SEQ ID NO: 8119864 - DNA, 22 bp, Homo sapiens
ttctcccatctcagtcttacat

SEQ ID NO: 8119865 - DNA, 22 bp, Homo sapiens
ttctcccactccgtgcttcagt

SEQ ID NO: 8119866 - DNA, 22 bp, Homo sapiens
ttctcccactccgtgcttcagt

SEQ ID NO: 8119867 - DNA, 22 bp, Homo sapiens
ttccaagagctgctggggtaag

SEQ ID NO: 8119868 - DNA, 22 bp, Homo sapiens
ttccaagagcctttcttctaga

SEQ ID NO: 8119869 - DNA, 22 bp, Homo sapiens
ttccccttgcactatcaccctg

SEQ ID NO: 8119870 - DNA, 22 bp, Homo sapiens
ttcaagtcctttggaaggcctg

SEQ ID NO: 8119871 - DNA, 22 bp, Homo sapiens
ttcaatcatttttacatagtcc

SEQ ID NO: 8119872 - DNA, 22 bp, Homo sapiens
ttcaatcaccatcaggacatta

SEQ ID NO: 8119873 - DNA, 22 bp, Homo sapiens
ttcaatcattccaacactttaa

SEQ ID NO: 8119874 - DNA, 22 bp, Homo sapiens
ttcaatatgatattagctgtgg

SEQ ID NO: 8119875 - DNA, 22 bp, Homo sapiens
ttcagaaatcgagtttcatgtc

SEQ ID NO: 8119876 - DNA, 22 bp, Homo sapiens
ttcagaaatgaatattggtatt

SEQ ID NO: 8119877 - DNA, 22 bp, Homo sapiens
ttcactgtgatgtttaagagaa

SEQ ID NO: 8119878 - DNA, 22 bp, Homo sapiens
ttcactgtgatggtgcagaggc

SEQ ID NO: 8119879 - DNA, 22 bp, Homo sapiens
ttcagacatgcaggctgaggct

SEQ ID NO: 8119880 - DNA, 22 bp, Homo sapiens
ttcatagagcagctcactgaat

SEQ ID NO: 8119881 - DNA, 22 bp, Homo sapiens
ttcagacagttttcagattcat

SEQ ID NO: 8119882 - DNA, 22 bp, Homo sapiens
ttcatagtgtttccttccagtg

SEQ ID NO: 8119883 - DNA, 22 bp, Homo sapiens
ttcatatatatgcactacgtac

SEQ ID NO: 8119884 - DNA, 22 bp, Homo sapiens
ttatttatatctctgcagttta

SEQ ID NO: 8119885 - DNA, 18 bp, Homo sapiens
ttatttgttacagcacat

SEQ ID NO: 8119886 - DNA, 22 bp, Homo sapiens
ttatttacaactcttctcttcc

SEQ ID NO: 8119887 - DNA, 22 bp, Homo sapiens
ttattgtttgggtataatttga

SEQ ID NO: 8119888 - DNA, 22 bp, Homo sapiens
ttcaagggaaaacacagtgaat

SEQ ID NO: 8119889 - DNA, 23 bp, Homo sapiens
ttcaagggttatttgttagcact

SEQ ID NO: 8119890 - DNA, 22 bp, Homo sapiens
ttcaaaagtaatcagtattaga

SEQ ID NO: 8119891 - DNA, 22 bp, Homo sapiens
ttattttaccttcctctgagct

SEQ ID NO: 8119892 - DNA, 22 bp, Homo sapiens
ttattttctcctcagaaagtgg

SEQ ID NO: 8119893 - DNA, 21 bp, Homo sapiens
tcctcctgtagagggtcctgg

SEQ ID NO: 8119894 - DNA, 20 bp, Homo sapiens
tcctccttgcagagcccaga

SEQ ID NO: 8119895 - DNA, 22 bp, Homo sapiens
tcctcctttccccgctggagcc

SEQ ID NO: 8119896 - DNA, 21 bp, Homo sapiens
tcctctactgagccatgcaga

SEQ ID NO: 8119897 - DNA, 22 bp, Homo sapiens
tcctcggctgggccccaggctt

SEQ ID NO: 8119898 - DNA, 22 bp, Homo sapiens
tcctctgctcagcattcctcac

SEQ ID NO: 8119899 - DNA, 22 bp, Homo sapiens
tcctctccagcaaactggctat

SEQ ID NO: 8119900 - DNA, 22 bp, Homo sapiens
tcctctccagcaaactggctat

SEQ ID NO: 8119901 - DNA, 22 bp, Homo sapiens
tcctctggaacctcacccttgc

SEQ ID NO: 8119902 - DNA, 22 bp, Homo sapiens
tcctctggatataagcctcacc

SEQ ID NO: 8119903 - DNA, 21 bp, Homo sapiens
tcctctgctctcataccacaa

SEQ ID NO: 8119904 - DNA, 22 bp, Homo sapiens
ttagttaaaattctgctgacat

SEQ ID NO: 8119905 - DNA, 22 bp, Homo sapiens
ttatgtgagatgtttacattgg

SEQ ID NO: 8119906 - DNA, 22 bp, Homo sapiens
ttatgtgaggttcagctttatc

SEQ ID NO: 8119907 - DNA, 22 bp, Homo sapiens
ttataattctggcataggctgt

SEQ ID NO: 8119908 - DNA, 22 bp, Homo sapiens
ttagttaattgactatgttgca

SEQ ID NO: 8119909 - DNA, 22 bp, Homo sapiens
tttacagattctgggtattagg

SEQ ID NO: 8119910 - DNA, 22 bp, Homo sapiens
tttacagatgtggaaagtgagc

SEQ ID NO: 8119911 - DNA, 22 bp, Homo sapiens
tttacagatgaggaaactgaga

SEQ ID NO: 8119912 - DNA, 22 bp, Homo sapiens
tttacagatctgttgatttgtt

SEQ ID NO: 8119913 - DNA, 22 bp, Homo sapiens
tttacagatgaggatactgagg

SEQ ID NO: 8119914 - DNA, 22 bp, Homo sapiens
tttacagaatgttgaatttggg

SEQ ID NO: 8119915 - DNA, 22 bp, Homo sapiens
tttacagaatgtcaatttctat

SEQ ID NO: 8119916 - DNA, 22 bp, Homo sapiens
tttacagagaatgtacataaag

SEQ ID NO: 8119917 - DNA, 22 bp, Homo sapiens
tttacagacaacttaatagggg

SEQ ID NO: 8119918 - DNA, 22 bp, Homo sapiens
tttacaagtttacagaatgatg

SEQ ID NO: 8119919 - DNA, 23 bp, Homo sapiens
tttaactttccaataattcattg

SEQ ID NO: 8119920 - DNA, 22 bp, Homo sapiens
ttgttcttttgcttagacagat

SEQ ID NO: 8119921 - DNA, 22 bp, Homo sapiens
ttgttcttggagcaggcagaga

SEQ ID NO: 8119922 - DNA, 22 bp, Homo sapiens
ttgttcttgccaagacatgaag

SEQ ID NO: 8119923 - DNA, 22 bp, Homo sapiens
tttaggaagatctgaaggaaga

SEQ ID NO: 8119924 - DNA, 21 bp, Homo sapiens
tttaggaagtttaaggcaggt

SEQ ID NO: 8119925 - DNA, 22 bp, Homo sapiens
tttaggaagtttcagataggaa

SEQ ID NO: 8119926 - DNA, 22 bp, Homo sapiens
tttatgtttgacaatgatctgg

SEQ ID NO: 8119927 - DNA, 22 bp, Homo sapiens
tttatttatccttctggattgc

SEQ ID NO: 8119928 - DNA, 23 bp, Homo sapiens
tttcacattaatgtttagcagga

SEQ ID NO: 8119929 - DNA, 23 bp, Homo sapiens
tttcacatttactgttagatggc

SEQ ID NO: 8119930 - DNA, 21 bp, Homo sapiens
tttctaaggaggaagaaaaga

SEQ ID NO: 8119931 - DNA, 22 bp, Homo sapiens
tttctaaggtgaggtagaaaat

SEQ ID NO: 8119932 - DNA, 22 bp, Homo sapiens
tttctaagaaagtaatggttat

SEQ ID NO: 8119933 - DNA, 22 bp, Homo sapiens
tttctaaagggtagatttggcc

SEQ ID NO: 8119934 - DNA, 22 bp, Homo sapiens
tttctaaacaaagggagtttgg

SEQ ID NO: 8119935 - DNA, 22 bp, Homo sapiens
tttctaaaatagattttatggt

SEQ ID NO: 8119936 - DNA, 22 bp, Homo sapiens
tttctaaactggattcagcctg

SEQ ID NO: 8119937 - DNA, 22 bp, Homo sapiens
tttcccaagaaaaataattgga

SEQ ID NO: 8119938 - DNA, 22 bp, Homo sapiens
tttcccaagtgtaaacatggca

SEQ ID NO: 8119939 - DNA, 22 bp, Homo sapiens
tttcccaattgagaggttctgt

SEQ ID NO: 8119940 - DNA, 22 bp, Homo sapiens
tttccagtgcatggcaaatgct

SEQ ID NO: 8119941 - DNA, 22 bp, Homo sapiens
tttccttgcacattggtttcca

SEQ ID NO: 8119942 - DNA, 22 bp, Homo sapiens
tttcatcatgttggcagattgg

SEQ ID NO: 8119943 - DNA, 22 bp, Homo sapiens
tttccaggccagacctttcaat

SEQ ID NO: 8119944 - DNA, 22 bp, Homo sapiens
tttccaggtattaatactgtat

SEQ ID NO: 8119945 - DNA, 22 bp, Homo sapiens
ttgcctgtgaggattctggttg

SEQ ID NO: 8119946 - DNA, 22 bp, Homo sapiens
ttgccattccagggtattaggg

SEQ ID NO: 8119947 - DNA, 22 bp, Homo sapiens
ttgccatttcgtaagccgggag

SEQ ID NO: 8119948 - DNA, 22 bp, Homo sapiens
ttgctaatgccctagaagtatt

SEQ ID NO: 8119949 - DNA, 22 bp, Homo sapiens
ttgctaatttgtataatgaaaa

SEQ ID NO: 8119950 - DNA, 20 bp, Homo sapiens
ttggaacagtggatcagcag

SEQ ID NO: 8119951 - DNA, 22 bp, Homo sapiens
ttggaactcgtgttacttgtat

SEQ ID NO: 8119952 - DNA, 23 bp, Homo sapiens
ttggaacacagtaaatgcacaat

SEQ ID NO: 8119953 - DNA, 22 bp, Homo sapiens
ttggaggatgcaatgagggagt

SEQ ID NO: 8119954 - DNA, 22 bp, Homo sapiens
ttggcaatcaattctgacgtct

SEQ ID NO: 8119955 - DNA, 22 bp, Homo sapiens
ttggcaatatttactgaagttg

SEQ ID NO: 8119956 - DNA, 22 bp, Homo sapiens
ttggcaatgatctcaatcttct

SEQ ID NO: 8119957 - DNA, 22 bp, Homo sapiens
ttgggctttaattccagagagg

SEQ ID NO: 8119958 - DNA, 22 bp, Homo sapiens
ttggggaggttgccacattcca

SEQ ID NO: 8119959 - DNA, 18 bp, Homo sapiens
ttggctttgagaactggt

SEQ ID NO: 8119960 - DNA, 22 bp, Homo sapiens
ttggcttcaatgtcagagacag

SEQ ID NO: 8119961 - DNA, 22 bp, Homo sapiens
ttggcagcaagaggctcttctg

SEQ ID NO: 8119962 - DNA, 22 bp, Homo sapiens
ttggcagcacggggaacgtctg

SEQ ID NO: 8119963 - DNA, 22 bp, Homo sapiens
ttggcagcagagtgtggtgctc

SEQ ID NO: 8119964 - DNA, 22 bp, Homo sapiens
ttggcctacctgggaatgctgg

SEQ ID NO: 8119965 - DNA, 22 bp, Homo sapiens
ttggcctattccagcagctgtg

SEQ ID NO: 8119966 - DNA, 22 bp, Homo sapiens
ttgtgccaagaacatggaattt

SEQ ID NO: 8119967 - DNA, 22 bp, Homo sapiens
ttgtggattgtgttaaattcct

SEQ ID NO: 8119968 - DNA, 22 bp, Homo sapiens
ttgtggattctatttcccagaa

SEQ ID NO: 8119969 - DNA, 22 bp, Homo sapiens
ttgtgcttttgagctgagatga

SEQ ID NO: 8119970 - DNA, 23 bp, Homo sapiens
ttgtggaagggagatggcaacag

SEQ ID NO: 8119971 - DNA, 22 bp, Homo sapiens
ttgtatagcccagagagtgaga

SEQ ID NO: 8119972 - DNA, 22 bp, Homo sapiens
ttgtatgtctcaatatcctgtc

SEQ ID NO: 8119973 - DNA, 22 bp, Homo sapiens
ttgtatgtaccacaggtggtgg

SEQ ID NO: 8119974 - DNA, 22 bp, Homo sapiens
aaagtcaaaatgctctcctgtc

SEQ ID NO: 8119975 - DNA, 22 bp, Homo sapiens
aaagtatatttacttactgtga

SEQ ID NO: 8119976 - DNA, 22 bp, Homo sapiens
aaagtagtctctttcatctttt

SEQ ID NO: 8119977 - DNA, 22 bp, Homo sapiens
aaagtagcttagttgatatttc

SEQ ID NO: 8119978 - DNA, 22 bp, Homo sapiens
aaagtagatttctcatggcgaa

SEQ ID NO: 8119979 - DNA, 20 bp, Homo sapiens
aaagtgtaaggcaaagttgt

SEQ ID NO: 8119980 - DNA, 22 bp, Homo sapiens
aaagtgtaaaagcatgttaggg

SEQ ID NO: 8119981 - DNA, 22 bp, Homo sapiens
aaagtggcgaagctgagtttta

SEQ ID NO: 8119982 - DNA, 22 bp, Homo sapiens
aaagtcaatgatttctcctgga

SEQ ID NO: 8119983 - DNA, 22 bp, Homo sapiens
aaagtgcagtaacttgcccaag

SEQ ID NO: 8119984 - DNA, 22 bp, Homo sapiens
aaagtcacatagcatcacttct

SEQ ID NO: 8119985 - DNA, 22 bp, Homo sapiens
aaagtgctttcccacatttgtt

SEQ ID NO: 8119986 - DNA, 22 bp, Homo sapiens
aaagtgctttaggatatttgga

SEQ ID NO: 8119987 - DNA, 22 bp, Homo sapiens
aaagtgcttctctttggtgggt

SEQ ID NO: 8119988 - DNA, 22 bp, Homo sapiens
aaagtgcttcctttttgagggt

SEQ ID NO: 8119989 - DNA, 22 bp, Homo sapiens
aaagggcctccgcctgggcagg

SEQ ID NO: 8119990 - DNA, 22 bp, Homo sapiens
aaaggttattattactattgtc

SEQ ID NO: 8119991 - DNA, 22 bp, Homo sapiens
aaagtacaaatgttctagccat

SEQ ID NO: 8119992 - DNA, 22 bp, Homo sapiens
aaagtagaggcattgatcaggt

SEQ ID NO: 8119993 - DNA, 22 bp, Homo sapiens
aactaaatctggcatttagagc

SEQ ID NO: 8119994 - DNA, 22 bp, Homo sapiens
aaagccacgtggcctggggagc

SEQ ID NO: 8119995 - DNA, 22 bp, Homo sapiens
aaagccagttcttagagaaagc

SEQ ID NO: 8119996 - DNA, 22 bp, Homo sapiens
aaagccagtggtatgagagaaa

SEQ ID NO: 8119997 - DNA, 22 bp, Homo sapiens
aacagcaccgaagtcgtctaag

SEQ ID NO: 8119998 - DNA, 22 bp, Homo sapiens
aaagctgggggccctggtctag

SEQ ID NO: 8119999 - DNA, 22 bp, Homo sapiens
aaagctgggctaggtttgtttc

SEQ ID NO: 8120000 - DNA, 22 bp, Homo sapiens
aaagctgggctggccaacccag

SEQ ID NO: 8120001 - DNA, 22 bp, Homo sapiens
aaagcttgtgctgtagtattta

SEQ ID NO: 8120002 - DNA, 22 bp, Homo sapiens
aaagctgccctacacggaagca

SEQ ID NO: 8120003 - DNA, 22 bp, Homo sapiens
aaagctgcccagctgcctgttt

SEQ ID NO: 8120004 - DNA, 22 bp, Homo sapiens
aaagctggcctctcaggcttta

SEQ ID NO: 8120005 - DNA, 22 bp, Homo sapiens
aaatagcagcctttagttaaca

SEQ ID NO: 8120006 - DNA, 22 bp, Homo sapiens
aaatagacaggcttaaatagga

SEQ ID NO: 8120007 - DNA, 22 bp, Homo sapiens
aaatagcttttcataattctca

SEQ ID NO: 8120008 - DNA, 22 bp, Homo sapiens
aaataacttggtttcatcagag

SEQ ID NO: 8120009 - DNA, 22 bp, Homo sapiens
aaataacagtcagggacaacat

SEQ ID NO: 8120010 - DNA, 22 bp, Homo sapiens
aaagtgtggagattgaactaaa

SEQ ID NO: 8120011 - DNA, 22 bp, Homo sapiens
aaagtgttatgagaactaagtg

SEQ ID NO: 8120012 - DNA, 22 bp, Homo sapiens
aaagtgttgatatgtgacatcc

SEQ ID NO: 8120013 - DNA, 22 bp, Homo sapiens
aaatggtttaattatgtttaat

SEQ ID NO: 8120014 - DNA, 22 bp, Homo sapiens
aagctcttttacaatcctaggc

SEQ ID NO: 8120015 - DNA, 22 bp, Homo sapiens
aagcacagaaaaggagcatgga

SEQ ID NO: 8120016 - DNA, 22 bp, Homo sapiens
aagcacagagatgggcacgcct

SEQ ID NO: 8120017 - DNA, 22 bp, Homo sapiens
aaatcctaaggagaatatgatt

SEQ ID NO: 8120018 - DNA, 22 bp, Homo sapiens
aaatgcaggaaattatgctttt

SEQ ID NO: 8120019 - DNA, 22 bp, Homo sapiens
aagcacagataaaacaggattc

SEQ ID NO: 8120020 - DNA, 22 bp, Homo sapiens
aaaaaagattgatggtggatgc

SEQ ID NO: 8120021 - DNA, 22 bp, Homo sapiens
aaaaacacaagtggcttggtct

SEQ ID NO: 8120022 - DNA, 22 bp, Homo sapiens
aaaaacactgggctgggagtca

SEQ ID NO: 8120023 - DNA, 22 bp, Homo sapiens
aaacacttcctgtaacatgaca

SEQ ID NO: 8120024 - DNA, 22 bp, Homo sapiens
aaacagagagatgtatgtggag

SEQ ID NO: 8120025 - DNA, 22 bp, Homo sapiens
aaacagagggccactgaggctc

SEQ ID NO: 8120026 - DNA, 22 bp, Homo sapiens
aaacactgtgggacatcttact

SEQ ID NO: 8120027 - DNA, 22 bp, Homo sapiens
aaacacatcattcatgtcgtca

SEQ ID NO: 8120028 - DNA, 22 bp, Homo sapiens
aaaaatagaaggattgactgag

SEQ ID NO: 8120029 - DNA, 22 bp, Homo sapiens
aaaatgaataagttaacccagg

SEQ ID NO: 8120030 - DNA, 22 bp, Homo sapiens
aaagacattagattaacgtaca

SEQ ID NO: 8120031 - DNA, 22 bp, Homo sapiens
aaagacatggcaagagatgggg

SEQ ID NO: 8120032 - DNA, 22 bp, Homo sapiens
aaagacattagcttagatgtca

SEQ ID NO: 8120033 - DNA, 22 bp, Homo sapiens
aaagacattgaagaaggactta

SEQ ID NO: 8120034 - DNA, 22 bp, Homo sapiens
aaactcatgccattaatccttt

SEQ ID NO: 8120035 - DNA, 22 bp, Homo sapiens
aaaagagaaagtggcaggcttt

SEQ ID NO: 8120036 - DNA, 22 bp, Homo sapiens
aaagaaggggtctacatccaat

SEQ ID NO: 8120037 - DNA, 22 bp, Homo sapiens
aaagacatggaactagagatgg

SEQ ID NO: 8120038 - DNA, 22 bp, Homo sapiens
aaagaaggtagggctggtgact

SEQ ID NO: 8120039 - DNA, 22 bp, Homo sapiens
aaacattgtacattctgtagct

SEQ ID NO: 8120040 - DNA, 22 bp, Homo sapiens
aaacattgtaattttagcatgg

SEQ ID NO: 8120041 - DNA, 22 bp, Homo sapiens
aaagttacagtaattcagtgta

SEQ ID NO: 8120042 - DNA, 21 bp, Homo sapiens
aaagttcatgctttaatattc

SEQ ID NO: 8120043 - DNA, 21 bp, Homo sapiens
aaagttcatgctttaatattc

SEQ ID NO: 8120044 - DNA, 20 bp, Homo sapiens
aaagttcatgtttgcacttt

SEQ ID NO: 8120045 - DNA, 22 bp, Homo sapiens
aaacagtgactggtacataata

SEQ ID NO: 8120046 - DNA, 22 bp, Homo sapiens
aaacagttgttatttttatatg

SEQ ID NO: 8120047 - DNA, 22 bp, Homo sapiens
aaacagtttcattttcatgacc

SEQ ID NO: 8120048 - DNA, 22 bp, Homo sapiens
aaacagtttcattttcatgacc

SEQ ID NO: 8120049 - DNA, 22 bp, Homo sapiens
aaacagtttataacatgatact

SEQ ID NO: 8120050 - DNA, 22 bp, Homo sapiens
aaagaataccctgggtcataaa

SEQ ID NO: 8120051 - DNA, 22 bp, Homo sapiens
aaagaatagcctttgtccaaat

SEQ ID NO: 8120052 - DNA, 22 bp, Homo sapiens
aaagaatactccttttgccttg

SEQ ID NO: 8120053 - DNA, 22 bp, Homo sapiens
aaagaatactccttttgccttg

SEQ ID NO: 8120054 - DNA, 22 bp, Homo sapiens
aaagaatagttaagtttagggc

SEQ ID NO: 8120055 - DNA, 21 bp, Homo sapiens
aaactgaccttgcctgagaca

SEQ ID NO: 8120056 - DNA, 22 bp, Homo sapiens
aaagagggacaggcgcagacac

SEQ ID NO: 8120057 - DNA, 22 bp, Homo sapiens
aaatgcagatccctgaatctca

SEQ ID NO: 8120058 - DNA, 22 bp, Homo sapiens
aaatgcagaatgatttcatcta

SEQ ID NO: 8120059 - DNA, 22 bp, Homo sapiens
aagagaggggttgcatggaaat

SEQ ID NO: 8120060 - DNA, 17 bp, Homo sapiens
aagagaggctgagctgg

SEQ ID NO: 8120061 - DNA, 22 bp, Homo sapiens
aagagaggacatggtgaacctg

SEQ ID NO: 8120062 - DNA, 20 bp, Homo sapiens
acaaagactggaaaagcaag

SEQ ID NO: 8120063 - DNA, 20 bp, Homo sapiens
acaaagactggaaaagcaag

SEQ ID NO: 8120064 - DNA, 22 bp, Homo sapiens
acaaagagaccatgagccaaac

SEQ ID NO: 8120065 - DNA, 22 bp, Homo sapiens
aagagctggagtttgcagccct

SEQ ID NO: 8120066 - DNA, 22 bp, Homo sapiens
aagagctgtgggtggtagtcct

SEQ ID NO: 8120067 - DNA, 22 bp, Homo sapiens
aagagctggctcttgcagcagc

SEQ ID NO: 8120068 - DNA, 20 bp, Homo sapiens
aagagctgactcacagtggt

SEQ ID NO: 8120069 - DNA, 22 bp, Homo sapiens
aagaataaattaagatacttag

SEQ ID NO: 8120070 - DNA, 22 bp, Homo sapiens
aattggaaaatgctacatatca

SEQ ID NO: 8120071 - DNA, 22 bp, Homo sapiens
aagacagatgcaacctgctagc

SEQ ID NO: 8120072 - DNA, 22 bp, Homo sapiens
aagacagtgtgtcaggcaggtg

SEQ ID NO: 8120073 - DNA, 22 bp, Homo sapiens
aagacaggaaaagctccaggcc

SEQ ID NO: 8120074 - DNA, 22 bp, Homo sapiens
aagacaggaaaagctccaggcc

SEQ ID NO: 8120075 - DNA, 22 bp, Homo sapiens
aagaaatgctgatgttggatgg

SEQ ID NO: 8120076 - DNA, 22 bp, Homo sapiens
aagaaatgctgatgttggatgg

SEQ ID NO: 8120077 - DNA, 22 bp, Homo sapiens
aatgttttcattatcctaactg

SEQ ID NO: 8120078 - DNA, 22 bp, Homo sapiens
aagcattgtaagcagaagatgc

SEQ ID NO: 8120079 - DNA, 22 bp, Homo sapiens
acagaattctctctgcagaggc

SEQ ID NO: 8120080 - DNA, 22 bp, Homo sapiens
aagaggaactgggggctgagtc

SEQ ID NO: 8120081 - DNA, 22 bp, Homo sapiens
aagatttactagcataatagct

SEQ ID NO: 8120082 - DNA, 18 bp, Homo sapiens
acactgcagcagtctgct

SEQ ID NO: 8120083 - DNA, 21 bp, Homo sapiens
acactgcaggtgaagtgcact

SEQ ID NO: 8120084 - DNA, 17 bp, Homo sapiens
aagatttcattagctga

SEQ ID NO: 8120085 - DNA, 22 bp, Homo sapiens
acactgctcacttcttcccttg

SEQ ID NO: 8120086 - DNA, 22 bp, Homo sapiens
acactgcttctctggcagagcc

SEQ ID NO: 8120087 - DNA, 21 bp, Homo sapiens
acactgctgtagcatattggg

SEQ ID NO: 8120088 - DNA, 22 bp, Homo sapiens
acactggaggagagctgttgct

SEQ ID NO: 8120089 - DNA, 22 bp, Homo sapiens
aagcacagtaaaagcagatttt

SEQ ID NO: 8120090 - DNA, 22 bp, Homo sapiens
aagcacagtgggcagagcagcc

SEQ ID NO: 8120091 - DNA, 22 bp, Homo sapiens
acagaattatcaggaaatgtta

SEQ ID NO: 8120092 - DNA, 22 bp, Homo sapiens
aagcacaggagacgcacagcca

SEQ ID NO: 8120093 - DNA, 22 bp, Homo sapiens
aactgcactgttcttttctaca

SEQ ID NO: 8120094 - DNA, 22 bp, Homo sapiens
aatgatatgcaaattatcatca

SEQ ID NO: 8120095 - DNA, 22 bp, Homo sapiens
aactgtttcagaaatattgttg

SEQ ID NO: 8120096 - DNA, 22 bp, Homo sapiens
aatagttgtagtatctatctcg

SEQ ID NO: 8120097 - DNA, 22 bp, Homo sapiens
aatagtttgaatttatcagatg

SEQ ID NO: 8120098 - DNA, 22 bp, Homo sapiens
aatagtgctgctgtggacatgg

SEQ ID NO: 8120099 - DNA, 22 bp, Homo sapiens
aatagtgttgttcactcaggag

SEQ ID NO: 8120100 - DNA, 22 bp, Homo sapiens
aataacttcatgtaacatttaa

SEQ ID NO: 8120101 - DNA, 22 bp, Homo sapiens
aacatgcatttgtgggatggaa

SEQ ID NO: 8120102 - DNA, 22 bp, Homo sapiens
aacatgcatgttatttatcagt

SEQ ID NO: 8120103 - DNA, 18 bp, Homo sapiens
aacatgcattagaactgc

SEQ ID NO: 8120104 - DNA, 22 bp, Homo sapiens
aacaggtagggactctaacttg

SEQ ID NO: 8120105 - DNA, 22 bp, Homo sapiens
aacagtaaaaatcatttagttg

SEQ ID NO: 8120106 - DNA, 22 bp, Homo sapiens
aacaggtagggttttccttaga

SEQ ID NO: 8120107 - DNA, 22 bp, Homo sapiens
aacatgcatgaagaagttatat

SEQ ID NO: 8120108 - DNA, 22 bp, Homo sapiens
aacatgcatataggtaaatgga

SEQ ID NO: 8120109 - DNA, 22 bp, Homo sapiens
aacatgcaggttttagggttgc

SEQ ID NO: 8120110 - DNA, 22 bp, Homo sapiens
aacatgcagattccccgggccc

SEQ ID NO: 8120111 - DNA, 22 bp, Homo sapiens
aacatgcagtgagccgatgagg

SEQ ID NO: 8120112 - DNA, 22 bp, Homo sapiens
aacaggacatttcagaagcagg

SEQ ID NO: 8120113 - DNA, 22 bp, Homo sapiens
aaattgaatttgggaaacattg

SEQ ID NO: 8120114 - DNA, 22 bp, Homo sapiens
aaattgcacaatatagacatga

SEQ ID NO: 8120115 - DNA, 22 bp, Homo sapiens
aaattgcagatgctaaatgact

SEQ ID NO: 8120116 - DNA, 22 bp, Homo sapiens
aacaaacagttaagtgtggatg

SEQ ID NO: 8120117 - DNA, 21 bp, Homo sapiens
aacaaagggatgctcatcttt

SEQ ID NO: 8120118 - DNA, 22 bp, Homo sapiens
aagctgaggcccatggcaaggt

SEQ ID NO: 8120119 - DNA, 22 bp, Homo sapiens
aagctgaggtcaagtagctagt

SEQ ID NO: 8120120 - DNA, 19 bp, Homo sapiens
aaatgtgcactgttttcca

SEQ ID NO: 8120121 - DNA, 22 bp, Homo sapiens
aaatgtgcatgagtcagaagtg

SEQ ID NO: 8120122 - DNA, 22 bp, Homo sapiens
aaatgtgagttatagcaataga

SEQ ID NO: 8120123 - DNA, 23 bp, Homo sapiens
aaattccttgcagataggtattg

SEQ ID NO: 8120124 - DNA, 22 bp, Homo sapiens
aaattccattttgtgactattc

SEQ ID NO: 8120125 - DNA, 22 bp, Homo sapiens
aacaaatgattgttggttggag

SEQ ID NO: 8120126 - DNA, 22 bp, Homo sapiens
aacacatagacgtttgatatca

SEQ ID NO: 8120127 - DNA, 22 bp, Homo sapiens
aacactctctgttggtaaggct

SEQ ID NO: 8120128 - DNA, 22 bp, Homo sapiens
aacactgagaacaatacagagt

SEQ ID NO: 8120129 - DNA, 22 bp, Homo sapiens
aacactgagaggggagtggcac

SEQ ID NO: 8120130 - DNA, 22 bp, Homo sapiens
aaggtcagagcaggaaggagtc

SEQ ID NO: 8120131 - DNA, 22 bp, Homo sapiens
aagtccaggtccaggaggttcc

SEQ ID NO: 8120132 - DNA, 22 bp, Homo sapiens
aagtccagggatcaaagtaggc

SEQ ID NO: 8120133 - DNA, 17 bp, Homo sapiens
aagtccagagttgagca

SEQ ID NO: 8120134 - DNA, 22 bp, Homo sapiens
aacagcagggacttgaatggaa

SEQ ID NO: 8120135 - DNA, 22 bp, Homo sapiens
aacagcatcaccccataacatt

SEQ ID NO: 8120136 - DNA, 22 bp, Homo sapiens
aacagcagctttcaggatcatc

SEQ ID NO: 8120137 - DNA, 22 bp, Homo sapiens
actgccttataatatgtcaaca

SEQ ID NO: 8120138 - DNA, 22 bp, Homo sapiens
actgccttagaacaaagcagga

SEQ ID NO: 8120139 - DNA, 22 bp, Homo sapiens
actgccttatatgctgtgtgtg

SEQ ID NO: 8120140 - DNA, 22 bp, Homo sapiens
aataattttgagagcctggaaa

SEQ ID NO: 8120141 - DNA, 22 bp, Homo sapiens
aataattatttgagagcagacc

SEQ ID NO: 8120142 - DNA, 22 bp, Homo sapiens
aataattacccatctttttgta

SEQ ID NO: 8120143 - DNA, 22 bp, Homo sapiens
aataattagtgggacagagaac

SEQ ID NO: 8120144 - DNA, 19 bp, Homo sapiens
aataatgttcatgagattg

SEQ ID NO: 8120145 - DNA, 22 bp, Homo sapiens
aagtttcaaatgttgattatgc

SEQ ID NO: 8120146 - DNA, 22 bp, Homo sapiens
aagtttcattgttcatgtaaca

SEQ ID NO: 8120147 - DNA, 22 bp, Homo sapiens
aagtttcatgtggaggtagact

SEQ ID NO: 8120148 - DNA, 22 bp, Homo sapiens
aagtttcatgatgtaattattg

SEQ ID NO: 8120149 - DNA, 22 bp, Homo sapiens
aagtttcatgatgtaattattg

SEQ ID NO: 8120150 - DNA, 22 bp, Homo sapiens
aataagaatttacttgtcaaga

SEQ ID NO: 8120151 - DNA, 22 bp, Homo sapiens
aagttatgctgaagaatatgag

SEQ ID NO: 8120152 - DNA, 22 bp, Homo sapiens
aagttatgaaatttggacagct

SEQ ID NO: 8120153 - DNA, 22 bp, Homo sapiens
aagttactggcaagggctgcag

SEQ ID NO: 8120154 - DNA, 22 bp, Homo sapiens
actacaatactcttagtaaaag

SEQ ID NO: 8120155 - DNA, 22 bp, Homo sapiens
actccaggttttttcactgaag

SEQ ID NO: 8120156 - DNA, 22 bp, Homo sapiens
actccaggttttctctcaagtt

SEQ ID NO: 8120157 - DNA, 22 bp, Homo sapiens
actcccaggttgcctggcaggc

SEQ ID NO: 8120158 - DNA, 18 bp, Homo sapiens
actccccacaggctctgt

SEQ ID NO: 8120159 - DNA, 22 bp, Homo sapiens
aagttcaagagtgacatattag

SEQ ID NO: 8120160 - DNA, 22 bp, Homo sapiens
aagttcaaaaatgtaatcagtg

SEQ ID NO: 8120161 - DNA, 20 bp, Homo sapiens
actccaggtggcatgaggac

SEQ ID NO: 8120162 - DNA, 22 bp, Homo sapiens
actccaggtgtgttggactcta

SEQ ID NO: 8120163 - DNA, 20 bp, Homo sapiens
actccaggtggcatgaggac

SEQ ID NO: 8120164 - DNA, 22 bp, Homo sapiens
actccaggtaggcacattgaca

SEQ ID NO: 8120165 - DNA, 22 bp, Homo sapiens
aagtcagcactccaggaagcca

SEQ ID NO: 8120166 - DNA, 22 bp, Homo sapiens
aagtcaggcttctcccagagcc

SEQ ID NO: 8120167 - DNA, 22 bp, Homo sapiens
aagtgcataagtatgattattt

SEQ ID NO: 8120168 - DNA, 22 bp, Homo sapiens
aagtgcatacactagttaattg

SEQ ID NO: 8120169 - DNA, 22 bp, Homo sapiens
aagtgcttttttcttgaggcca

SEQ ID NO: 8120170 - DNA, 22 bp, Homo sapiens
aagtgctttttcttgagctgct

SEQ ID NO: 8120171 - DNA, 22 bp, Homo sapiens
aagtgctttacaaatgtctgtt

SEQ ID NO: 8120172 - DNA, 22 bp, Homo sapiens
aagtggactaatacaaggacta

SEQ ID NO: 8120173 - DNA, 21 bp, Homo sapiens
aagtggagaagaaaagctgga

SEQ ID NO: 8120174 - DNA, 22 bp, Homo sapiens
aagtggagagccctggaggtct

SEQ ID NO: 8120175 - DNA, 22 bp, Homo sapiens
aagtggagctataggctcagat

SEQ ID NO: 8120176 - DNA, 22 bp, Homo sapiens
aagtggagccagggaaactgaa

SEQ ID NO: 8120177 - DNA, 22 bp, Homo sapiens
acttgataaacaattactgtta

SEQ ID NO: 8120178 - DNA, 23 bp, Homo sapiens
acttgattattgttgatagattc

SEQ ID NO: 8120179 - DNA, 22 bp, Homo sapiens
aatatatttgaatcaggaacaa

SEQ ID NO: 8120180 - DNA, 22 bp, Homo sapiens
aatccatttactctttacaaga

SEQ ID NO: 8120181 - DNA, 22 bp, Homo sapiens
aatcaaagaatgggctagttgg

SEQ ID NO: 8120182 - DNA, 22 bp, Homo sapiens
acttggttggtctcaccctgtt

SEQ ID NO: 8120183 - DNA, 22 bp, Homo sapiens
acttgttaactctcaaagaaca

SEQ ID NO: 8120184 - DNA, 20 bp, Homo sapiens
aatgagttattttgtatatg

SEQ ID NO: 8120185 - DNA, 18 bp, Homo sapiens
agaaggagctatgggcag

SEQ ID NO: 8120186 - DNA, 19 bp, Homo sapiens
aatgagttccatgaaaaga

SEQ ID NO: 8120187 - DNA, 22 bp, Homo sapiens
agaagggaactcagagatgatt

SEQ ID NO: 8120188 - DNA, 22 bp, Homo sapiens
aatgagacacgtgaagcagatg

SEQ ID NO: 8120189 - DNA, 19 bp, Homo sapiens
aatgactgagtacattgtc

SEQ ID NO: 8120190 - DNA, 22 bp, Homo sapiens
aatgactttgaaatatttgagt

SEQ ID NO: 8120191 - DNA, 22 bp, Homo sapiens
aaggaaagacatataaatgact

SEQ ID NO: 8120192 - DNA, 22 bp, Homo sapiens
aaggaaaggatgagcatgcatt

SEQ ID NO: 8120193 - DNA, 22 bp, Homo sapiens
aaggaaagctgtggttctgaga

SEQ ID NO: 8120194 - DNA, 22 bp, Homo sapiens
aaggaaagagtatgcaccttgt

SEQ ID NO: 8120195 - DNA, 22 bp, Homo sapiens
aaggaaagattctctctctaga

SEQ ID NO: 8120196 - DNA, 22 bp, Homo sapiens
aaggaaaggatgagcatgcatt

SEQ ID NO: 8120197 - DNA, 23 bp, Homo sapiens
acagggctggcagctgcaagacc

SEQ ID NO: 8120198 - DNA, 22 bp, Homo sapiens
acagtactaagtgctcacatga

SEQ ID NO: 8120199 - DNA, 22 bp, Homo sapiens
aagccagggattcctgagggag

SEQ ID NO: 8120200 - DNA, 22 bp, Homo sapiens
aagccaggccattctctggttc

SEQ ID NO: 8120201 - DNA, 22 bp, Homo sapiens
aagccaggctgcacttgctggg

SEQ ID NO: 8120202 - DNA, 22 bp, Homo sapiens
aagctgcagcacagagaggtgg

SEQ ID NO: 8120203 - DNA, 22 bp, Homo sapiens
aagctgcaggttgaatccaggt

SEQ ID NO: 8120204 - DNA, 22 bp, Homo sapiens
aagctgcaggttgaatccaggt

SEQ ID NO: 8120205 - DNA, 22 bp, Homo sapiens
aagctgccacacggtgagtact

SEQ ID NO: 8120206 - DNA, 22 bp, Homo sapiens
aagctgccaatggtaagctgct

SEQ ID NO: 8120207 - DNA, 22 bp, Homo sapiens
aagctgccagctgagctgaggc

SEQ ID NO: 8120208 - DNA, 23 bp, Homo sapiens
aagctgccagtctgaagcctggg

SEQ ID NO: 8120209 - DNA, 22 bp, Homo sapiens
aagctgcccaagactgaagcat

SEQ ID NO: 8120210 - DNA, 18 bp, Homo sapiens
aagctgccctcaggcagg

SEQ ID NO: 8120211 - DNA, 22 bp, Homo sapiens
acaggcaggttgagaaacattt

SEQ ID NO: 8120212 - DNA, 22 bp, Homo sapiens
acaggcaggttgagaaacattt

SEQ ID NO: 8120213 - DNA, 22 bp, Homo sapiens
acagttggttaacacaaatatt

SEQ ID NO: 8120214 - DNA, 22 bp, Homo sapiens
aaggcagatataaagactagag

SEQ ID NO: 8120215 - DNA, 22 bp, Homo sapiens
aaggcagtggctggaaaacctg

SEQ ID NO: 8120216 - DNA, 22 bp, Homo sapiens
aaggcagttcactcacgcagcc

SEQ ID NO: 8120217 - DNA, 22 bp, Homo sapiens
aaggcagtttgggccaccatct

SEQ ID NO: 8120218 - DNA, 22 bp, Homo sapiens
aaggcagggaaagtggattagg

SEQ ID NO: 8120219 - DNA, 22 bp, Homo sapiens
aaggcaggatgcggacccatct

SEQ ID NO: 8120220 - DNA, 22 bp, Homo sapiens
aaggcaggatgggaaaagattt

SEQ ID NO: 8120221 - DNA, 22 bp, Homo sapiens
acagtagattggtatgatgtca

SEQ ID NO: 8120222 - DNA, 22 bp, Homo sapiens
acagtataccattgtgactttg

SEQ ID NO: 8120223 - DNA, 22 bp, Homo sapiens
aagggctgagcacagtgagcca

SEQ ID NO: 8120224 - DNA, 22 bp, Homo sapiens
aagggctgaatgaagggttgaa

SEQ ID NO: 8120225 - DNA, 22 bp, Homo sapiens
aaggtggcatgtcccctggcca

SEQ ID NO: 8120226 - DNA, 22 bp, Homo sapiens
accatgggtcagccacctcagc

SEQ ID NO: 8120227 - DNA, 22 bp, Homo sapiens
accatgccagtggcagccagac

SEQ ID NO: 8120228 - DNA, 22 bp, Homo sapiens
accatgcaggctattttcaaat

SEQ ID NO: 8120229 - DNA, 23 bp, Homo sapiens
aagtaacagggataatagcagtt

SEQ ID NO: 8120230 - DNA, 22 bp, Homo sapiens
aagtatgaatcaaagactatct

SEQ ID NO: 8120231 - DNA, 22 bp, Homo sapiens
aagtcacaagcatatatgcatt

SEQ ID NO: 8120232 - DNA, 22 bp, Homo sapiens
aagtcacacagttaacatgagg

SEQ ID NO: 8120233 - DNA, 22 bp, Homo sapiens
accccaggcccagggaagaggc

SEQ ID NO: 8120234 - DNA, 22 bp, Homo sapiens
accccaggtcatctgagagtcc

SEQ ID NO: 8120235 - DNA, 22 bp, Homo sapiens
aagtacatttttaacttacagc

SEQ ID NO: 8120236 - DNA, 22 bp, Homo sapiens
accccaggaagtggaggtcatg

SEQ ID NO: 8120237 - DNA, 22 bp, Homo sapiens
aagtacataaaggaattagcca

SEQ ID NO: 8120238 - DNA, 23 bp, Homo sapiens
aagtacatatatttagatagtga

SEQ ID NO: 8120239 - DNA, 22 bp, Homo sapiens
aagtacatgctgtaatgattgg

SEQ ID NO: 8120240 - DNA, 22 bp, Homo sapiens
aagtacatggaggatagctgct

SEQ ID NO: 8120241 - DNA, 22 bp, Homo sapiens
aagtacatgttgttcaaaagcc

SEQ ID NO: 8120242 - DNA, 22 bp, Homo sapiens
aagtacatgttgctcaacagcc

SEQ ID NO: 8120243 - DNA, 22 bp, Homo sapiens
aaggctgtgtcagaagctccct

SEQ ID NO: 8120244 - DNA, 22 bp, Homo sapiens
aaggctgggaaacatgcaggcc

SEQ ID NO: 8120245 - DNA, 22 bp, Homo sapiens
aaggctggtttccttgatgttt

SEQ ID NO: 8120246 - DNA, 22 bp, Homo sapiens
aaggctgcttttaacatgcata

SEQ ID NO: 8120247 - DNA, 22 bp, Homo sapiens
aagggcccattctctcagaaaa

SEQ ID NO: 8120248 - DNA, 22 bp, Homo sapiens
aagggccatcccagaacagaaa

SEQ ID NO: 8120249 - DNA, 22 bp, Homo sapiens
aagggccattgctgagagcagt

SEQ ID NO: 8120250 - DNA, 22 bp, Homo sapiens
aagggccattgctgagagcagt

SEQ ID NO: 8120251 - DNA, 22 bp, Homo sapiens
aagggccacttactcctgctgt

SEQ ID NO: 8120252 - DNA, 22 bp, Homo sapiens
aagggaaaatagttgatgacca

SEQ ID NO: 8120253 - DNA, 22 bp, Homo sapiens
aagggaaatcctcagcccagga

SEQ ID NO: 8120254 - DNA, 22 bp, Homo sapiens
aagggcaggaaaagatggatgt

SEQ ID NO: 8120255 - DNA, 22 bp, Homo sapiens
acaagggattgttgagtagtct

SEQ ID NO: 8120256 - DNA, 22 bp, Homo sapiens
acaaattctacaatcatatgat

SEQ ID NO: 8120257 - DNA, 22 bp, Homo sapiens
acaaatgtgattgtttctgaaa

SEQ ID NO: 8120258 - DNA, 22 bp, Homo sapiens
acaattcctgagaatacttgtt

SEQ ID NO: 8120259 - DNA, 22 bp, Homo sapiens
agcaagatttttcaggttagta

SEQ ID NO: 8120260 - DNA, 22 bp, Homo sapiens
agaggccatctgctctgtgggg

SEQ ID NO: 8120261 - DNA, 22 bp, Homo sapiens
agaggccatgctagaggcctgg

SEQ ID NO: 8120262 - DNA, 22 bp, Homo sapiens
agagctgggtggtggtgactca

SEQ ID NO: 8120263 - DNA, 22 bp, Homo sapiens
aattttattaactggatgtagc

SEQ ID NO: 8120264 - DNA, 22 bp, Homo sapiens
aattttattagaaggcaagggg

SEQ ID NO: 8120265 - DNA, 22 bp, Homo sapiens
acaaaatcaaaggagtgattca

SEQ ID NO: 8120266 - DNA, 22 bp, Homo sapiens
acaaacagagttgaaaaatagg

SEQ ID NO: 8120267 - DNA, 22 bp, Homo sapiens
acaaacttcccagacaagctcc

SEQ ID NO: 8120268 - DNA, 22 bp, Homo sapiens
acaaatgagaatgtagacagag

SEQ ID NO: 8120269 - DNA, 22 bp, Homo sapiens
aatttacagttgctgatggtac

SEQ ID NO: 8120270 - DNA, 22 bp, Homo sapiens
aatttacaggtgcactcgccat

SEQ ID NO: 8120271 - DNA, 22 bp, Homo sapiens
aatttacacttcatttggaggg

SEQ ID NO: 8120272 - DNA, 22 bp, Homo sapiens
aatttataataaatagggcttt

SEQ ID NO: 8120273 - DNA, 22 bp, Homo sapiens
aatttatatgtaattaggcaca

SEQ ID NO: 8120274 - DNA, 22 bp, Homo sapiens
agagctggggcataaatgccac

SEQ ID NO: 8120275 - DNA, 20 bp, Homo sapiens
aattatataactccaacatt

SEQ ID NO: 8120276 - DNA, 22 bp, Homo sapiens
aatgttgcagagtgattgtcca

SEQ ID NO: 8120277 - DNA, 22 bp, Homo sapiens
aatgttgcagagtgattgtcca

SEQ ID NO: 8120278 - DNA, 22 bp, Homo sapiens
aatgttctgcaactgttttcat

SEQ ID NO: 8120279 - DNA, 22 bp, Homo sapiens
aatgttctgcaactgttttcat

SEQ ID NO: 8120280 - DNA, 22 bp, Homo sapiens
aatgttcctatttaccccctaa

SEQ ID NO: 8120281 - DNA, 22 bp, Homo sapiens
aatgtccaccgtgatgatggaa

SEQ ID NO: 8120282 - DNA, 18 bp, Homo sapiens
aatgtccagtgttcatat

SEQ ID NO: 8120283 - DNA, 22 bp, Homo sapiens
agacagggccactcatcctcac

SEQ ID NO: 8120284 - DNA, 22 bp, Homo sapiens
agacagggccactcatcctcac

SEQ ID NO: 8120285 - DNA, 22 bp, Homo sapiens
agacagggagggagcgcggctg

SEQ ID NO: 8120286 - DNA, 22 bp, Homo sapiens
agacagggagggagcgcggctg

SEQ ID NO: 8120287 - DNA, 22 bp, Homo sapiens
agacagggtgatcgcttgagcc

SEQ ID NO: 8120288 - DNA, 22 bp, Homo sapiens
agacagggtcttgatcagagct

SEQ ID NO: 8120289 - DNA, 22 bp, Homo sapiens
agaaggggcccaaggatgtcag

SEQ ID NO: 8120290 - DNA, 22 bp, Homo sapiens
agaaggggagaagctaccagga

SEQ ID NO: 8120291 - DNA, 22 bp, Homo sapiens
agaagggccagctggacacctg

SEQ ID NO: 8120292 - DNA, 22 bp, Homo sapiens
agaagggctacacgggctctcc

SEQ ID NO: 8120293 - DNA, 23 bp, Homo sapiens
agaagggtccttggcagcgacag

SEQ ID NO: 8120294 - DNA, 22 bp, Homo sapiens
agaagtattctgcatgtactga

SEQ ID NO: 8120295 - DNA, 21 bp, Homo sapiens
agacactggtttagcattcat

SEQ ID NO: 8120296 - DNA, 19 bp, Homo sapiens
agacagagctcagtgggtt

SEQ ID NO: 8120297 - DNA, 19 bp, Homo sapiens
agacagagctcagtgggtt

SEQ ID NO: 8120298 - DNA, 22 bp, Homo sapiens
agcagtggtgtgaggagggctc

SEQ ID NO: 8120299 - DNA, 22 bp, Homo sapiens
agcagtggtgtgaggagggctc

SEQ ID NO: 8120300 - DNA, 22 bp, Homo sapiens
acaccaccgtcccagcctcctg

SEQ ID NO: 8120301 - DNA, 23 bp, Homo sapiens
agcaggaaaccgagggtgatgtt

SEQ ID NO: 8120302 - DNA, 23 bp, Homo sapiens
agcaggaaaccgagggtgatgtt

SEQ ID NO: 8120303 - DNA, 22 bp, Homo sapiens
acactgcagatgtaatttgagt

SEQ ID NO: 8120304 - DNA, 20 bp, Homo sapiens
agcaggaaaagtgccagtct

SEQ ID NO: 8120305 - DNA, 23 bp, Homo sapiens
agcaggaaaccgagggtgatgtt

SEQ ID NO: 8120306 - DNA, 20 bp, Homo sapiens
agcaggaaaagtgccagtct

SEQ ID NO: 8120307 - DNA, 23 bp, Homo sapiens
acacatatattcagatacagatg

SEQ ID NO: 8120308 - DNA, 23 bp, Homo sapiens
acacatatattcagatacagatg

SEQ ID NO: 8120309 - DNA, 22 bp, Homo sapiens
acacatatgccattacagcaaa

SEQ ID NO: 8120310 - DNA, 21 bp, Homo sapiens
acacaggcagtgtcccgaggt

SEQ ID NO: 8120311 - DNA, 22 bp, Homo sapiens
agcagcagtacatataagacta

SEQ ID NO: 8120312 - DNA, 22 bp, Homo sapiens
agcacctgcacagtggaggaaa

SEQ ID NO: 8120313 - DNA, 21 bp, Homo sapiens
agcaccctcccttctggaggg

SEQ ID NO: 8120314 - DNA, 22 bp, Homo sapiens
acaattttaagccagagtgggt

SEQ ID NO: 8120315 - DNA, 22 bp, Homo sapiens
acaattttccccataggttatc

SEQ ID NO: 8120316 - DNA, 23 bp, Homo sapiens
acacaggatacatacggaagcaa

SEQ ID NO: 8120317 - DNA, 23 bp, Homo sapiens
agcccctcatggtgtctagacag

SEQ ID NO: 8120318 - DNA, 22 bp, Homo sapiens
agcccccaggagtctccacgcc

SEQ ID NO: 8120319 - DNA, 22 bp, Homo sapiens
acagagcagtaagaacacagct

SEQ ID NO: 8120320 - DNA, 22 bp, Homo sapiens
acagagcagtaagaacacagct

SEQ ID NO: 8120321 - DNA, 22 bp, Homo sapiens
agccacagtcaacctgtccata

SEQ ID NO: 8120322 - DNA, 22 bp, Homo sapiens
agccacagtctgatgcctgaga

SEQ ID NO: 8120323 - DNA, 22 bp, Homo sapiens
agccacagtcaacctgtccata

SEQ ID NO: 8120324 - DNA, 22 bp, Homo sapiens
acagcaactcctgcttctgagt

SEQ ID NO: 8120325 - DNA, 22 bp, Homo sapiens
agcctgagtgcttaggactgtt

SEQ ID NO: 8120326 - DNA, 22 bp, Homo sapiens
agctcaagcgtgggctgggcgc

SEQ ID NO: 8120327 - DNA, 22 bp, Homo sapiens
agctcaagcgtgggctgggcgc

SEQ ID NO: 8120328 - DNA, 22 bp, Homo sapiens
acagcaggcatgaagaaatgtt

SEQ ID NO: 8120329 - DNA, 20 bp, Homo sapiens
agctctcagcatgctgcctg

SEQ ID NO: 8120330 - DNA, 19 bp, Homo sapiens
agctcctgttcagcagctc

SEQ ID NO: 8120331 - DNA, 22 bp, Homo sapiens
agctctggggcctgtcccacat

SEQ ID NO: 8120332 - DNA, 22 bp, Homo sapiens
agctctccacacataggactag

SEQ ID NO: 8120333 - DNA, 22 bp, Homo sapiens
atttctctgcctcagcttctgc

SEQ ID NO: 8120334 - DNA, 22 bp, Homo sapiens
atttccttcagtgtttaatact

SEQ ID NO: 8120335 - DNA, 17 bp, Homo sapiens
atttcctcagggctgag

SEQ ID NO: 8120336 - DNA, 17 bp, Homo sapiens
atttccagagtggccct

SEQ ID NO: 8120337 - DNA, 22 bp, Homo sapiens
attttaaccctcttatatatac

SEQ ID NO: 8120338 - DNA, 22 bp, Homo sapiens
agagtttgttgaatttacttgg

SEQ ID NO: 8120339 - DNA, 23 bp, Homo sapiens
agagtttgtttctaatgagtgag

SEQ ID NO: 8120340 - DNA, 22 bp, Homo sapiens
agagtttgtgtcctttatcagg

SEQ ID NO: 8120341 - DNA, 22 bp, Homo sapiens
agagtttggaggtgttcctgga

SEQ ID NO: 8120342 - DNA, 22 bp, Homo sapiens
agagtttggagagggtgaggca

SEQ ID NO: 8120343 - DNA, 22 bp, Homo sapiens
agagtttgaattttgaaaagat

SEQ ID NO: 8120344 - DNA, 22 bp, Homo sapiens
agagtttgaattttgaaaagat

SEQ ID NO: 8120345 - DNA, 22 bp, Homo sapiens
agagtttggattttaggacatc

SEQ ID NO: 8120346 - DNA, 22 bp, Homo sapiens
agagtttgggtgggacagcttg

SEQ ID NO: 8120347 - DNA, 20 bp, Homo sapiens
agagtttggggtcattttgg

SEQ ID NO: 8120348 - DNA, 22 bp, Homo sapiens
agagtttggggtatgattgttt

SEQ ID NO: 8120349 - DNA, 22 bp, Homo sapiens
agagtttgtagtggtgaatgta

SEQ ID NO: 8120350 - DNA, 22 bp, Homo sapiens
agagtttgtactttaccctgag

SEQ ID NO: 8120351 - DNA, 22 bp, Homo sapiens
agagtttggtgaagcaatttga

SEQ ID NO: 8120352 - DNA, 22 bp, Homo sapiens
agagtttgtatttttcagtgaa

SEQ ID NO: 8120353 - DNA, 22 bp, Homo sapiens
agagtttgtgggcttttcctcc

SEQ ID NO: 8120354 - DNA, 22 bp, Homo sapiens
atttcacagctgtcagtgttac

SEQ ID NO: 8120355 - DNA, 22 bp, Homo sapiens
agatacatggaacgtcaaacct

SEQ ID NO: 8120356 - DNA, 22 bp, Homo sapiens
agatacagtgttacatttttat

SEQ ID NO: 8120357 - DNA, 17 bp, Homo sapiens
atttcacttagcatgag

SEQ ID NO: 8120358 - DNA, 22 bp, Homo sapiens
agaggtcagaggtcgccaggtc

SEQ ID NO: 8120359 - DNA, 22 bp, Homo sapiens
agaggtcagatttctcctggtg

SEQ ID NO: 8120360 - DNA, 22 bp, Homo sapiens
attgctgaatctaaggcttcca

SEQ ID NO: 8120361 - DNA, 22 bp, Homo sapiens
agaggtgacataggagaggctc

SEQ ID NO: 8120362 - DNA, 22 bp, Homo sapiens
agagttggccaaaaggggcatt

SEQ ID NO: 8120363 - DNA, 22 bp, Homo sapiens
agagtttgaagttatctttgac

SEQ ID NO: 8120364 - DNA, 20 bp, Homo sapiens
attcatgtctttataaaagc

SEQ ID NO: 8120365 - DNA, 22 bp, Homo sapiens
attcatttgctattgtgtatgg

SEQ ID NO: 8120366 - DNA, 22 bp, Homo sapiens
agagggagaagctaaaataact

SEQ ID NO: 8120367 - DNA, 22 bp, Homo sapiens
agagggagaaaagaatcagttg

SEQ ID NO: 8120368 - DNA, 22 bp, Homo sapiens
agagggaaaaactcatgtcatt

SEQ ID NO: 8120369 - DNA, 22 bp, Homo sapiens
agagggaaaaactcatgtcatt

SEQ ID NO: 8120370 - DNA, 17 bp, Homo sapiens
agagggaaaatgcggtt

SEQ ID NO: 8120371 - DNA, 22 bp, Homo sapiens
agagggaaatccaggagtgctt

SEQ ID NO: 8120372 - DNA, 22 bp, Homo sapiens
agagggaaggacagatgtttca

SEQ ID NO: 8120373 - DNA, 22 bp, Homo sapiens
attgataaattgcaatggggct

SEQ ID NO: 8120374 - DNA, 22 bp, Homo sapiens
attgagggctgagaagggccct

SEQ ID NO: 8120375 - DNA, 22 bp, Homo sapiens
attccattgtgtaaggatatcg

SEQ ID NO: 8120376 - DNA, 22 bp, Homo sapiens
attccattgtgtaaggatatcg

SEQ ID NO: 8120377 - DNA, 22 bp, Homo sapiens
attattaaagcttaggtcttat

SEQ ID NO: 8120378 - DNA, 22 bp, Homo sapiens
agaggcagaagtgttcaaaccc

SEQ ID NO: 8120379 - DNA, 21 bp, Homo sapiens
attattatttctgtgtccagc

SEQ ID NO: 8120380 - DNA, 22 bp, Homo sapiens
attattattgttgatgttaggg

SEQ ID NO: 8120381 - DNA, 22 bp, Homo sapiens
agaggaggctgggtccagataa

SEQ ID NO: 8120382 - DNA, 21 bp, Homo sapiens
agagctggtaggtaggtaggt

SEQ ID NO: 8120383 - DNA, 22 bp, Homo sapiens
atgtttactggtttatagaata

SEQ ID NO: 8120384 - DNA, 22 bp, Homo sapiens
atgtttacaattcagtattaca

SEQ ID NO: 8120385 - DNA, 22 bp, Homo sapiens
agacagcagaaactagagcact

SEQ ID NO: 8120386 - DNA, 21 bp, Homo sapiens
agacagactgcctgacccacg

SEQ ID NO: 8120387 - DNA, 22 bp, Homo sapiens
atgcacctgaactccatcagct

SEQ ID NO: 8120388 - DNA, 22 bp, Homo sapiens
atgcactgggccacagtatgac

SEQ ID NO: 8120389 - DNA, 22 bp, Homo sapiens
atgacaaaatgaatgcagctag

SEQ ID NO: 8120390 - DNA, 22 bp, Homo sapiens
agaagttgttcaaggtggtgag

SEQ ID NO: 8120391 - DNA, 22 bp, Homo sapiens
agaagttgtaggtttgcatatt

SEQ ID NO: 8120392 - DNA, 22 bp, Homo sapiens
agaagtgtggtctagcagtggc

SEQ ID NO: 8120393 - DNA, 22 bp, Homo sapiens
agaagtggtctgtcttccagat

SEQ ID NO: 8120394 - DNA, 22 bp, Homo sapiens
agaagtgtcagtgcaggcagct

SEQ ID NO: 8120395 - DNA, 22 bp, Homo sapiens
agaagtgagtgtgactcagcag

SEQ ID NO: 8120396 - DNA, 22 bp, Homo sapiens
agaagtgctccagtgagttggg

SEQ ID NO: 8120397 - DNA, 22 bp, Homo sapiens
agaagtgccgaaaggaagacag

SEQ ID NO: 8120398 - DNA, 22 bp, Homo sapiens
agaagtgctccagtgagttggg

SEQ ID NO: 8120399 - DNA, 22 bp, Homo sapiens
agaagtatttggctaaaagaca

SEQ ID NO: 8120400 - DNA, 22 bp, Homo sapiens
atctcaggaggaccctgatgct

SEQ ID NO: 8120401 - DNA, 22 bp, Homo sapiens
atgaacaatctggcaagaactt

SEQ ID NO: 8120402 - DNA, 22 bp, Homo sapiens
agacaaagacagcatctcaggt

SEQ ID NO: 8120403 - DNA, 22 bp, Homo sapiens
atggcagcctgagcagaggaat

SEQ ID NO: 8120404 - DNA, 22 bp, Homo sapiens
atggcagcctgtggacagtcaa

SEQ ID NO: 8120405 - DNA, 23 bp, Homo sapiens
agacccagagactggctctgctc

SEQ ID NO: 8120406 - DNA, 22 bp, Homo sapiens
agagagttgtatgtttctaaaa

SEQ ID NO: 8120407 - DNA, 22 bp, Homo sapiens
agagaaggaaagctgacatggg

SEQ ID NO: 8120408 - DNA, 21 bp, Homo sapiens
agagacagagaaagtaacatt

SEQ ID NO: 8120409 - DNA, 22 bp, Homo sapiens
agagaaggaaagctgacatggg

SEQ ID NO: 8120410 - DNA, 22 bp, Homo sapiens
agagacagggttttgtcgtgtt

SEQ ID NO: 8120411 - DNA, 22 bp, Homo sapiens
agagccacggcaggcctaggaa

SEQ ID NO: 8120412 - DNA, 22 bp, Homo sapiens
atggggtggagtccgggcagcg

SEQ ID NO: 8120413 - DNA, 22 bp, Homo sapiens
agagatggccttaggtgggaat

SEQ ID NO: 8120414 - DNA, 22 bp, Homo sapiens
agagatgactgatggctgatta

SEQ ID NO: 8120415 - DNA, 22 bp, Homo sapiens
cagagaaagggtgaattccttc

SEQ ID NO: 8120416 - DNA, 22 bp, Homo sapiens
cagactttctgactcccttgcc

SEQ ID NO: 8120417 - DNA, 22 bp, Homo sapiens
agcccactgttttcatttctct

SEQ ID NO: 8120418 - DNA, 22 bp, Homo sapiens
cagagggacagtatgatgaaag

SEQ ID NO: 8120419 - DNA, 22 bp, Homo sapiens
cagagggaaaaggggagtaata

SEQ ID NO: 8120420 - DNA, 22 bp, Homo sapiens
agcccagggaaccaggaagtgg

SEQ ID NO: 8120421 - DNA, 22 bp, Homo sapiens
cagagggagccctccaggagca

SEQ ID NO: 8120422 - DNA, 22 bp, Homo sapiens
cagagggagccctccaggagca

SEQ ID NO: 8120423 - DNA, 22 bp, Homo sapiens
cagagggaccagaacatactgt

SEQ ID NO: 8120424 - DNA, 22 bp, Homo sapiens
cagagggacagtgtaatgcata

SEQ ID NO: 8120425 - DNA, 22 bp, Homo sapiens
agcccaggagtttgaggctgtg

SEQ ID NO: 8120426 - DNA, 22 bp, Homo sapiens
agccagagactgtgtctgtaat

SEQ ID NO: 8120427 - DNA, 22 bp, Homo sapiens
agccagagagccccaggttcta

SEQ ID NO: 8120428 - DNA, 22 bp, Homo sapiens
cagacagggttttggtctttgg

SEQ ID NO: 8120429 - DNA, 22 bp, Homo sapiens
cagacatatgttttaacagatt

SEQ ID NO: 8120430 - DNA, 22 bp, Homo sapiens
cagaatccagaattgctgaggt

SEQ ID NO: 8120431 - DNA, 22 bp, Homo sapiens
agccactgtgcaggagcagtgt

SEQ ID NO: 8120432 - DNA, 22 bp, Homo sapiens
cagaaggcaaacaaaaggattt

SEQ ID NO: 8120433 - DNA, 22 bp, Homo sapiens
cagaaatatttattgagtgaca

SEQ ID NO: 8120434 - DNA, 22 bp, Homo sapiens
cagaaatatcacctggactcta

SEQ ID NO: 8120435 - DNA, 22 bp, Homo sapiens
cagaaatatcagttgaaagtgc

SEQ ID NO: 8120436 - DNA, 22 bp, Homo sapiens
agccacagtgggctaccagctc

SEQ ID NO: 8120437 - DNA, 22 bp, Homo sapiens
agccaccaccactgaaaggtta

SEQ ID NO: 8120438 - DNA, 22 bp, Homo sapiens
cagctcagtttcaataccaggt

SEQ ID NO: 8120439 - DNA, 22 bp, Homo sapiens
cagctcagtgatgccttcacag

SEQ ID NO: 8120440 - DNA, 22 bp, Homo sapiens
cagctcatgacctttgttatct

SEQ ID NO: 8120441 - DNA, 22 bp, Homo sapiens
cagctcagtcttgaagcactgg

SEQ ID NO: 8120442 - DNA, 22 bp, Homo sapiens
cagctccaaagccccactgtcc

SEQ ID NO: 8120443 - DNA, 22 bp, Homo sapiens
cagctcagtctggagagatgca

SEQ ID NO: 8120444 - DNA, 19 bp, Homo sapiens
cagctcaggactcagcccc

SEQ ID NO: 8120445 - DNA, 21 bp, Homo sapiens
agctcagccgggcacagtggc

SEQ ID NO: 8120446 - DNA, 22 bp, Homo sapiens
agctcagcactgtcagcactcc

SEQ ID NO: 8120447 - DNA, 22 bp, Homo sapiens
cagccccagcacttagctgagt

SEQ ID NO: 8120448 - DNA, 22 bp, Homo sapiens
cagccccacacggtctagctct

SEQ ID NO: 8120449 - DNA, 22 bp, Homo sapiens
cagccctgagagaaccatctat

SEQ ID NO: 8120450 - DNA, 22 bp, Homo sapiens
cagccctgagttagcccacgga

SEQ ID NO: 8120451 - DNA, 22 bp, Homo sapiens
cagccctgcagagggcgctcct

SEQ ID NO: 8120452 - DNA, 22 bp, Homo sapiens
cagccctgcagagggcgctcct

SEQ ID NO: 8120453 - DNA, 22 bp, Homo sapiens
cagccctgcacgctgcctccgc

SEQ ID NO: 8120454 - DNA, 22 bp, Homo sapiens
cagcagggtatacagggaattt

SEQ ID NO: 8120455 - DNA, 22 bp, Homo sapiens
cagcaggggaactgtgggccag

SEQ ID NO: 8120456 - DNA, 22 bp, Homo sapiens
cagcagggggcagcgcagatca

SEQ ID NO: 8120457 - DNA, 22 bp, Homo sapiens
cagcagttgaaattgacatgtg

SEQ ID NO: 8120458 - DNA, 22 bp, Homo sapiens
cagcagctccaaagaatagcca

SEQ ID NO: 8120459 - DNA, 22 bp, Homo sapiens
cagcagctcactgaataatgac

SEQ ID NO: 8120460 - DNA, 22 bp, Homo sapiens
cagcagggcccccgggtgcgcc

SEQ ID NO: 8120461 - DNA, 22 bp, Homo sapiens
cagagggatcatcttcctgaag

SEQ ID NO: 8120462 - DNA, 22 bp, Homo sapiens
cagagggagtttctgaggttgc

SEQ ID NO: 8120463 - DNA, 22 bp, Homo sapiens
cagagggagtttctgaggttgc

SEQ ID NO: 8120464 - DNA, 22 bp, Homo sapiens
cagagggcactcggagtgacat

SEQ ID NO: 8120465 - DNA, 22 bp, Homo sapiens
agcctccatctcccatctgtga

SEQ ID NO: 8120466 - DNA, 22 bp, Homo sapiens
cagaggtgcatacaggtcatta

SEQ ID NO: 8120467 - DNA, 22 bp, Homo sapiens
agcctctgctggccctggcact

SEQ ID NO: 8120468 - DNA, 18 bp, Homo sapiens
agcctctggcagagagaa

SEQ ID NO: 8120469 - DNA, 20 bp, Homo sapiens
agcctctgcccttcccactg

SEQ ID NO: 8120470 - DNA, 22 bp, Homo sapiens
agcctctggtcctccctcagct

SEQ ID NO: 8120471 - DNA, 22 bp, Homo sapiens
agcctctgggggagctgggagc

SEQ ID NO: 8120472 - DNA, 22 bp, Homo sapiens
agcctctgtagaaagcagtgtg

SEQ ID NO: 8120473 - DNA, 22 bp, Homo sapiens
caagcagagaggtcaactaata

SEQ ID NO: 8120474 - DNA, 22 bp, Homo sapiens
agcagcaggctagggaactgct

SEQ ID NO: 8120475 - DNA, 22 bp, Homo sapiens
agcagcaggctgggatgagtct

SEQ ID NO: 8120476 - DNA, 21 bp, Homo sapiens
cacaagacacatagggtgttt

SEQ ID NO: 8120477 - DNA, 22 bp, Homo sapiens
cacaagacttatttgtgtagaa

SEQ ID NO: 8120478 - DNA, 21 bp, Homo sapiens
agcagcagggaagcctcatcc

SEQ ID NO: 8120479 - DNA, 22 bp, Homo sapiens
agcagccacacgcctccttctc

SEQ ID NO: 8120480 - DNA, 22 bp, Homo sapiens
agcagccacagtctgggacagg

SEQ ID NO: 8120481 - DNA, 22 bp, Homo sapiens
agcagccacccagctgctcatt

SEQ ID NO: 8120482 - DNA, 22 bp, Homo sapiens
agcagccagaaatccagaggtg

SEQ ID NO: 8120483 - DNA, 22 bp, Homo sapiens
agcagccagaaagggcagtcga

SEQ ID NO: 8120484 - DNA, 22 bp, Homo sapiens
cacaagctgggcaagtgtatat

SEQ ID NO: 8120485 - DNA, 22 bp, Homo sapiens
cacaagctccttatgtggagaa

SEQ ID NO: 8120486 - DNA, 22 bp, Homo sapiens
caagacattgattttgtacaga

SEQ ID NO: 8120487 - DNA, 21 bp, Homo sapiens
caagacatatgagtactctgg

SEQ ID NO: 8120488 - DNA, 22 bp, Homo sapiens
caagacatgcaattgccacttt

SEQ ID NO: 8120489 - DNA, 22 bp, Homo sapiens
agcacatttaagtatgaaatat

SEQ ID NO: 8120490 - DNA, 22 bp, Homo sapiens
caaatagtgtcacattgtgagg

SEQ ID NO: 8120491 - DNA, 22 bp, Homo sapiens
caaattaccctcaacatctaga

SEQ ID NO: 8120492 - DNA, 22 bp, Homo sapiens
agcacagtggcttctatgtcta

SEQ ID NO: 8120493 - DNA, 22 bp, Homo sapiens
agcacagtttcttttccttgtc

SEQ ID NO: 8120494 - DNA, 19 bp, Homo sapiens
agcacagtttccacatgca

SEQ ID NO: 8120495 - DNA, 22 bp, Homo sapiens
agcaaagaagacacaggcttca

SEQ ID NO: 8120496 - DNA, 22 bp, Homo sapiens
cacagttatatgttcacaagga

SEQ ID NO: 8120497 - DNA, 22 bp, Homo sapiens
agcaggctgagcacccaggggg

SEQ ID NO: 8120498 - DNA, 22 bp, Homo sapiens
agcaggctccaggctggccatc

SEQ ID NO: 8120499 - DNA, 22 bp, Homo sapiens
agcaggcactatgccaggatct

SEQ ID NO: 8120500 - DNA, 22 bp, Homo sapiens
cactgctattattagacaatgt

SEQ ID NO: 8120501 - DNA, 22 bp, Homo sapiens
cactgctagtctgaagtactgg

SEQ ID NO: 8120502 - DNA, 22 bp, Homo sapiens
cactgctcgctgcagcatggcc

SEQ ID NO: 8120503 - DNA, 20 bp, Homo sapiens
agcatacatcataagaaacc

SEQ ID NO: 8120504 - DNA, 22 bp, Homo sapiens
agcatacaccctaaactgctta

SEQ ID NO: 8120505 - DNA, 22 bp, Homo sapiens
cacctagggtttcgcctttctt

SEQ ID NO: 8120506 - DNA, 22 bp, Homo sapiens
cacctagggcatccctgcccca

SEQ ID NO: 8120507 - DNA, 22 bp, Homo sapiens
cacccaggctggagtgcagtga

SEQ ID NO: 8120508 - DNA, 22 bp, Homo sapiens
cacccagggctgtgcctgccca

SEQ ID NO: 8120509 - DNA, 22 bp, Homo sapiens
cacccaggctggattgcagtgg

SEQ ID NO: 8120510 - DNA, 22 bp, Homo sapiens
cacccaggctggagtgcagtgg

SEQ ID NO: 8120511 - DNA, 22 bp, Homo sapiens
cacccaggctggagtgcattgg

SEQ ID NO: 8120512 - DNA, 22 bp, Homo sapiens
agcagggtatgttagagctgta

SEQ ID NO: 8120513 - DNA, 22 bp, Homo sapiens
cacccaggctggagagcagtgg

SEQ ID NO: 8120514 - DNA, 22 bp, Homo sapiens
cacccaggctggagagcagtgg

SEQ ID NO: 8120515 - DNA, 22 bp, Homo sapiens
cacccaggctggaatgcagtgg

SEQ ID NO: 8120516 - DNA, 22 bp, Homo sapiens
caccaggttccgggcagagctg

SEQ ID NO: 8120517 - DNA, 22 bp, Homo sapiens
cacccaggctggagtgcagggg

SEQ ID NO: 8120518 - DNA, 23 bp, Homo sapiens
agcaggctgcttctccacagctg

SEQ ID NO: 8120519 - DNA, 22 bp, Homo sapiens
agcaggggtaacagaaggaaag

SEQ ID NO: 8120520 - DNA, 22 bp, Homo sapiens
ataaacagctccatttagtgcc

SEQ ID NO: 8120521 - DNA, 22 bp, Homo sapiens
actgtagagaatctgagaaaaa

SEQ ID NO: 8120522 - DNA, 22 bp, Homo sapiens
actgtacctcaaactctggaac

SEQ ID NO: 8120523 - DNA, 22 bp, Homo sapiens
actgtcagggatcatgaaagct

SEQ ID NO: 8120524 - DNA, 22 bp, Homo sapiens
atacagatgttgaatgttatat

SEQ ID NO: 8120525 - DNA, 22 bp, Homo sapiens
ataatgcatttagaataattca

SEQ ID NO: 8120526 - DNA, 22 bp, Homo sapiens
acttaacagacattatttacct

SEQ ID NO: 8120527 - DNA, 22 bp, Homo sapiens
atacaggatgctgaacatctct

SEQ ID NO: 8120528 - DNA, 22 bp, Homo sapiens
atacagcagtgaataagataaa

SEQ ID NO: 8120529 - DNA, 22 bp, Homo sapiens
atacagattgctatacttacaa

SEQ ID NO: 8120530 - DNA, 22 bp, Homo sapiens
acttctgattaaggatgaatgc

SEQ ID NO: 8120531 - DNA, 22 bp, Homo sapiens
acttctgataaagagcatgtgc

SEQ ID NO: 8120532 - DNA, 22 bp, Homo sapiens
acttctgagaaatttaaggaca

SEQ ID NO: 8120533 - DNA, 19 bp, Homo sapiens
acttctgaggaactgcaca

SEQ ID NO: 8120534 - DNA, 22 bp, Homo sapiens
atacattagctcatatgattaa

SEQ ID NO: 8120535 - DNA, 22 bp, Homo sapiens
agaacaggaggaagccagctcc

SEQ ID NO: 8120536 - DNA, 22 bp, Homo sapiens
agaacaggcagttggttggatt

SEQ ID NO: 8120537 - DNA, 22 bp, Homo sapiens
atctcaaagcatggagcagaat

SEQ ID NO: 8120538 - DNA, 21 bp, Homo sapiens
atctcacagcccagagaagcc

SEQ ID NO: 8120539 - DNA, 22 bp, Homo sapiens
atctaaagtgtttcatgaaaga

SEQ ID NO: 8120540 - DNA, 22 bp, Homo sapiens
atctaacactgtaaactgtctt

SEQ ID NO: 8120541 - DNA, 22 bp, Homo sapiens
atctaaaaggagctctttatct

SEQ ID NO: 8120542 - DNA, 22 bp, Homo sapiens
agaaagtacagatgagacactt

SEQ ID NO: 8120543 - DNA, 22 bp, Homo sapiens
agaaagggtcactgaaagagga

SEQ ID NO: 8120544 - DNA, 22 bp, Homo sapiens
agaaagggtcactgaaagagga

SEQ ID NO: 8120545 - DNA, 22 bp, Homo sapiens
agaaagggctattttgaggtag

SEQ ID NO: 8120546 - DNA, 22 bp, Homo sapiens
agaaagttaaacagtgataaga

SEQ ID NO: 8120547 - DNA, 22 bp, Homo sapiens
agaaagtgcttccctttggact

SEQ ID NO: 8120548 - DNA, 22 bp, Homo sapiens
agaaagtgcttccctttggtga

SEQ ID NO: 8120549 - DNA, 22 bp, Homo sapiens
agaaagtgcctcccttgggagc

SEQ ID NO: 8120550 - DNA, 22 bp, Homo sapiens
agaaagtgaccttgaaaactgg

SEQ ID NO: 8120551 - DNA, 22 bp, Homo sapiens
agaaagtgaacgtgttcagttt

SEQ ID NO: 8120552 - DNA, 21 bp, Homo sapiens
agaaaagtagagttttcagag

SEQ ID NO: 8120553 - DNA, 21 bp, Homo sapiens
atatttcagatttccgtaatc

SEQ ID NO: 8120554 - DNA, 22 bp, Homo sapiens
atatttataaggcaggcaagta

SEQ ID NO: 8120555 - DNA, 22 bp, Homo sapiens
atatttcagctttacttaggaa

SEQ ID NO: 8120556 - DNA, 22 bp, Homo sapiens
atattcttatccttttctctgt

SEQ ID NO: 8120557 - DNA, 22 bp, Homo sapiens
atatttataagcaagcaggact

SEQ ID NO: 8120558 - DNA, 22 bp, Homo sapiens
actttcaagccctctagagaca

SEQ ID NO: 8120559 - DNA, 22 bp, Homo sapiens
actttctaattgtctccagtgt

SEQ ID NO: 8120560 - DNA, 22 bp, Homo sapiens
actttcctggccctgtcctctg

SEQ ID NO: 8120561 - DNA, 22 bp, Homo sapiens
actttctcaggaattcacagac

SEQ ID NO: 8120562 - DNA, 22 bp, Homo sapiens
agaaaaggttgaaagtaggatt

SEQ ID NO: 8120563 - DNA, 22 bp, Homo sapiens
accctccaggctgcagctcctg

SEQ ID NO: 8120564 - DNA, 19 bp, Homo sapiens
accctctgccacaagcctc

SEQ ID NO: 8120565 - DNA, 22 bp, Homo sapiens
accctctgagaggcacactttg

SEQ ID NO: 8120566 - DNA, 22 bp, Homo sapiens
acctggcaggaaggtgggtgat

SEQ ID NO: 8120567 - DNA, 22 bp, Homo sapiens
acctggcataagggcttgagtc

SEQ ID NO: 8120568 - DNA, 22 bp, Homo sapiens
acctggcactacaggcacctgt

SEQ ID NO: 8120569 - DNA, 22 bp, Homo sapiens
acctggcacattctaccacagt

SEQ ID NO: 8120570 - DNA, 22 bp, Homo sapiens
acctggcacagagtatgctctc

SEQ ID NO: 8120571 - DNA, 22 bp, Homo sapiens
acctggcatgaagcatgcctta

SEQ ID NO: 8120572 - DNA, 22 bp, Homo sapiens
acctggcataagggcttgagtc

SEQ ID NO: 8120573 - DNA, 22 bp, Homo sapiens
acctggctgagaacgtgcagct

SEQ ID NO: 8120574 - DNA, 22 bp, Homo sapiens
aggtggccaagactgtttgaca

SEQ ID NO: 8120575 - DNA, 22 bp, Homo sapiens
aggtggcatttacaccatggga

SEQ ID NO: 8120576 - DNA, 22 bp, Homo sapiens
aggtggcccagctgacagatag

SEQ ID NO: 8120577 - DNA, 22 bp, Homo sapiens
acctggcacacactggggagtg

SEQ ID NO: 8120578 - DNA, 22 bp, Homo sapiens
agtcaacaaaaatgtggagcct

SEQ ID NO: 8120579 - DNA, 22 bp, Homo sapiens
actcaggaaatgagaggctctc

SEQ ID NO: 8120580 - DNA, 22 bp, Homo sapiens
actcagcttgcacacatcaatg

SEQ ID NO: 8120581 - DNA, 22 bp, Homo sapiens
agtccaggcgggtatagaggct

SEQ ID NO: 8120582 - DNA, 22 bp, Homo sapiens
agtatactgaaagtaaatatga

SEQ ID NO: 8120583 - DNA, 22 bp, Homo sapiens
agtcaaagatgaccgagttcct

SEQ ID NO: 8120584 - DNA, 17 bp, Homo sapiens
actagaccttaatattt

SEQ ID NO: 8120585 - DNA, 22 bp, Homo sapiens
agtaaacactgtctttatatat

SEQ ID NO: 8120586 - DNA, 22 bp, Homo sapiens
acgcccagactcccatactttg

SEQ ID NO: 8120587 - DNA, 20 bp, Homo sapiens
acgatgcaggggcttcacag

SEQ ID NO: 8120588 - DNA, 22 bp, Homo sapiens
agtgtgtgaccttttaatttaa

SEQ ID NO: 8120589 - DNA, 22 bp, Homo sapiens
agtgttctttgcatgaggatag

SEQ ID NO: 8120590 - DNA, 22 bp, Homo sapiens
actggctttgcctctgcctctc

SEQ ID NO: 8120591 - DNA, 22 bp, Homo sapiens
actgcagaggtggggtgcagag

SEQ ID NO: 8120592 - DNA, 22 bp, Homo sapiens
actgcagaggtggggtgcagag

SEQ ID NO: 8120593 - DNA, 20 bp, Homo sapiens
agtgtacagacactagaaat

SEQ ID NO: 8120594 - DNA, 22 bp, Homo sapiens
agtgtacagtttgtagtactac

SEQ ID NO: 8120595 - DNA, 22 bp, Homo sapiens
agtgtacatcagaacatatcaa

SEQ ID NO: 8120596 - DNA, 22 bp, Homo sapiens
agtggcagtggctgggcagagc

SEQ ID NO: 8120597 - DNA, 22 bp, Homo sapiens
agtggcagtagatgagctggtt

SEQ ID NO: 8120598 - DNA, 22 bp, Homo sapiens
actcctgggttgcagtcctcaa

SEQ ID NO: 8120599 - DNA, 20 bp, Homo sapiens
actcctggtaacttttgtga

SEQ ID NO: 8120600 - DNA, 22 bp, Homo sapiens
actcctggttcccagttgagat

SEQ ID NO: 8120601 - DNA, 17 bp, Homo sapiens
actcctggtctgaaggg

SEQ ID NO: 8120602 - DNA, 19 bp, Homo sapiens
agtcccaggcccgaaagag

SEQ ID NO: 8120603 - DNA, 21 bp, Homo sapiens
agtcccaggggtgagtgatgt

SEQ ID NO: 8120604 - DNA, 22 bp, Homo sapiens
agtcttggacatattctacttc

SEQ ID NO: 8120605 - DNA, 22 bp, Homo sapiens
actctgtactctagaggaagtg

SEQ ID NO: 8120606 - DNA, 22 bp, Homo sapiens
agtcttggttttgacagggaaa

SEQ ID NO: 8120607 - DNA, 22 bp, Homo sapiens
agtcttggttttcttaggtctg

SEQ ID NO: 8120608 - DNA, 22 bp, Homo sapiens
agtcttgggttgcctgatattg

SEQ ID NO: 8120609 - DNA, 22 bp, Homo sapiens
agtcttggtctccctggcagct

SEQ ID NO: 8120610 - DNA, 22 bp, Homo sapiens
agtcttggtgtcagtggtctga

SEQ ID NO: 8120611 - DNA, 22 bp, Homo sapiens
agtcttggtttcattggcaatg

SEQ ID NO: 8120612 - DNA, 22 bp, Homo sapiens
agtcttggctatgcatagagct

SEQ ID NO: 8120613 - DNA, 20 bp, Homo sapiens
agtcttggcatgtggttttc

SEQ ID NO: 8120614 - DNA, 22 bp, Homo sapiens
agtcttggctgccgccgtctcc

SEQ ID NO: 8120615 - DNA, 22 bp, Homo sapiens
agtcttgggagaggctggcagt

SEQ ID NO: 8120616 - DNA, 22 bp, Homo sapiens
agtcttggtccaggctcatttc

SEQ ID NO: 8120617 - DNA, 22 bp, Homo sapiens
agtgcatatatgaagagtatga

SEQ ID NO: 8120618 - DNA, 22 bp, Homo sapiens
agtgcataaaggaaaaactgaa

SEQ ID NO: 8120619 - DNA, 22 bp, Homo sapiens
agtgcagggggaaagggtgtct

SEQ ID NO: 8120620 - DNA, 21 bp, Homo sapiens
actctgtcttgagccatctgt

SEQ ID NO: 8120621 - DNA, 22 bp, Homo sapiens
actctgtagatgtggaaatgcg

SEQ ID NO: 8120622 - DNA, 20 bp, Homo sapiens
actctgtaggtaatgagact

SEQ ID NO: 8120623 - DNA, 22 bp, Homo sapiens
actctgtcacctactcactgta

SEQ ID NO: 8120624 - DNA, 22 bp, Homo sapiens
agggctgctcctccttcaggcc

SEQ ID NO: 8120625 - DNA, 22 bp, Homo sapiens
agggctgctgaggaagccttgc

SEQ ID NO: 8120626 - DNA, 22 bp, Homo sapiens
acccaggctggagtgcagtgac

SEQ ID NO: 8120627 - DNA, 22 bp, Homo sapiens
agggctgcctgactccagagcc

SEQ ID NO: 8120628 - DNA, 22 bp, Homo sapiens
acccaggctggagtgcagtggg

SEQ ID NO: 8120629 - DNA, 22 bp, Homo sapiens
acccaggctggagtgcagtggt

SEQ ID NO: 8120630 - DNA, 22 bp, Homo sapiens
acccaggctggagtgcagtgtc

SEQ ID NO: 8120631 - DNA, 22 bp, Homo sapiens
acccaggctggcagaggctcct

SEQ ID NO: 8120632 - DNA, 22 bp, Homo sapiens
acccaggctggagtgcagtggc

SEQ ID NO: 8120633 - DNA, 22 bp, Homo sapiens
acccaggctggagtgcagtgat

SEQ ID NO: 8120634 - DNA, 22 bp, Homo sapiens
acccaggctggcagaggctcct

SEQ ID NO: 8120635 - DNA, 22 bp, Homo sapiens
agggggagtttcagttagaaag

SEQ ID NO: 8120636 - DNA, 22 bp, Homo sapiens
agggggcaggagagacctgctg

SEQ ID NO: 8120637 - DNA, 22 bp, Homo sapiens
agggggcattatgaggcttttc

SEQ ID NO: 8120638 - DNA, 22 bp, Homo sapiens
agggggcccttgcaggtgagcg

SEQ ID NO: 8120639 - DNA, 22 bp, Homo sapiens
agggggctcagtgactgaagtg

SEQ ID NO: 8120640 - DNA, 22 bp, Homo sapiens
accaggctgtgaagtgagacta

SEQ ID NO: 8120641 - DNA, 22 bp, Homo sapiens
accaggctggagtgcagtggcg

SEQ ID NO: 8120642 - DNA, 22 bp, Homo sapiens
accaggctctgccagtgtttac

SEQ ID NO: 8120643 - DNA, 22 bp, Homo sapiens
accaggctggagtgcagtggcg

SEQ ID NO: 8120644 - DNA, 22 bp, Homo sapiens
accaggctccccttggatcctg

SEQ ID NO: 8120645 - DNA, 22 bp, Homo sapiens
acccaggacatgggcacccgtg

SEQ ID NO: 8120646 - DNA, 22 bp, Homo sapiens
acccaggacttggcaacctcat

SEQ ID NO: 8120647 - DNA, 22 bp, Homo sapiens
acccaggagacggaggtgcagt

SEQ ID NO: 8120648 - DNA, 22 bp, Homo sapiens
acccagctggatgcatggaggc

SEQ ID NO: 8120649 - DNA, 20 bp, Homo sapiens
acccagctctgtgccctggg

SEQ ID NO: 8120650 - DNA, 22 bp, Homo sapiens
acccagctgtttcccgtgtcat

SEQ ID NO: 8120651 - DNA, 22 bp, Homo sapiens
acccaggacaaaataaccaggt

SEQ ID NO: 8120652 - DNA, 22 bp, Homo sapiens
agggagacaaaagcagctgcca

SEQ ID NO: 8120653 - DNA, 19 bp, Homo sapiens
agggagaattccaagagga

SEQ ID NO: 8120654 - DNA, 22 bp, Homo sapiens
agggagacacatgaggaagtca

SEQ ID NO: 8120655 - DNA, 22 bp, Homo sapiens
agggagacacatgaggaagtca

SEQ ID NO: 8120656 - DNA, 22 bp, Homo sapiens
aggcttgtggattggagcgagt

SEQ ID NO: 8120657 - DNA, 19 bp, Homo sapiens
aggcttggttgcagcaagc

SEQ ID NO: 8120658 - DNA, 22 bp, Homo sapiens
accagagctggctctgagcacc

SEQ ID NO: 8120659 - DNA, 22 bp, Homo sapiens
acatttgtatgcgtttttactg

SEQ ID NO: 8120660 - DNA, 22 bp, Homo sapiens
agggagaggagcgtttcacatc

SEQ ID NO: 8120661 - DNA, 22 bp, Homo sapiens
agggagaggagggtcttgttga

SEQ ID NO: 8120662 - DNA, 16 bp, Homo sapiens
agggagagaggaacat

SEQ ID NO: 8120663 - DNA, 18 bp, Homo sapiens
agggagagaccgcgggtc

SEQ ID NO: 8120664 - DNA, 22 bp, Homo sapiens
agggagagacatttccttcttg

SEQ ID NO: 8120665 - DNA, 22 bp, Homo sapiens
agggagagaagttatacaagat

SEQ ID NO: 8120666 - DNA, 22 bp, Homo sapiens
agggcagcaatgcagctgctgc

SEQ ID NO: 8120667 - DNA, 22 bp, Homo sapiens
accagctcataattttcaaaac

SEQ ID NO: 8120668 - DNA, 22 bp, Homo sapiens
accagctctctagccctggtcc

SEQ ID NO: 8120669 - DNA, 22 bp, Homo sapiens
agggcagcacaaggcatggact

SEQ ID NO: 8120670 - DNA, 22 bp, Homo sapiens
acatttctagttgttcatctcc

SEQ ID NO: 8120671 - DNA, 22 bp, Homo sapiens
acatttctaatttaatgtaaca

SEQ ID NO: 8120672 - DNA, 18 bp, Homo sapiens
acatttctaggtgaaagc

SEQ ID NO: 8120673 - DNA, 22 bp, Homo sapiens
acatttctagttgttcatctcc

SEQ ID NO: 8120674 - DNA, 22 bp, Homo sapiens
acattgtagttgttctgcagca

SEQ ID NO: 8120675 - DNA, 22 bp, Homo sapiens
acattgtactcttagcgttgtt

SEQ ID NO: 8120676 - DNA, 22 bp, Homo sapiens
aggctgaaaacgagatggcaat

SEQ ID NO: 8120677 - DNA, 22 bp, Homo sapiens
acattgatgtgatgcagaagtg

SEQ ID NO: 8120678 - DNA, 22 bp, Homo sapiens
aggctgagactgtgcattagtg

SEQ ID NO: 8120679 - DNA, 22 bp, Homo sapiens
aggctgagaaagtgggaagatg

SEQ ID NO: 8120680 - DNA, 22 bp, Homo sapiens
aggctgaggagggatgttgctt

SEQ ID NO: 8120681 - DNA, 22 bp, Homo sapiens
aggctgagctggtagtgagtac

SEQ ID NO: 8120682 - DNA, 22 bp, Homo sapiens
aggctgagctggcccttgaaat

SEQ ID NO: 8120683 - DNA, 22 bp, Homo sapiens
acatttctttctattcagtagc

SEQ ID NO: 8120684 - DNA, 22 bp, Homo sapiens
acatttcttttcatctctatat

SEQ ID NO: 8120685 - DNA, 22 bp, Homo sapiens
acatttctttctattcagtagc

SEQ ID NO: 8120686 - DNA, 22 bp, Homo sapiens
acatttctttctattcagtagc

SEQ ID NO: 8120687 - DNA, 22 bp, Homo sapiens
acatttgaaatgccatgtgagg

SEQ ID NO: 8120688 - DNA, 22 bp, Homo sapiens
acatttgactgtagatacttgc

SEQ ID NO: 8120689 - DNA, 22 bp, Homo sapiens
acatttgactgtagatacttgc

SEQ ID NO: 8120690 - DNA, 22 bp, Homo sapiens
acatttgactacatttatatat

SEQ ID NO: 8120691 - DNA, 22 bp, Homo sapiens
acatttgacatttagtatcagc

SEQ ID NO: 8120692 - DNA, 22 bp, Homo sapiens
acatttgaggatgttaagaatg

SEQ ID NO: 8120693 - DNA, 22 bp, Homo sapiens
acatgctaattgcaaagtcttg

SEQ ID NO: 8120694 - DNA, 22 bp, Homo sapiens
acatgctaggtacagatctaaa

SEQ ID NO: 8120695 - DNA, 22 bp, Homo sapiens
acatgctatgagagattacttc

SEQ ID NO: 8120696 - DNA, 22 bp, Homo sapiens
acatgccagcccatttaaatgg

SEQ ID NO: 8120697 - DNA, 22 bp, Homo sapiens
acatgttagaaatgcagaatct

SEQ ID NO: 8120698 - DNA, 22 bp, Homo sapiens
acatgttaaacatcatggaatg

SEQ ID NO: 8120699 - DNA, 22 bp, Homo sapiens
aggccaggcctttctccattcc

SEQ ID NO: 8120700 - DNA, 22 bp, Homo sapiens
acatgtttggctctatgctata

SEQ ID NO: 8120701 - DNA, 22 bp, Homo sapiens
aggcctctgggtctcctctgac

SEQ ID NO: 8120702 - DNA, 22 bp, Homo sapiens
agctgaagtttagaattgtgaa

SEQ ID NO: 8120703 - DNA, 21 bp, Homo sapiens
acagctgcctgccatgggggt

SEQ ID NO: 8120704 - DNA, 22 bp, Homo sapiens
acaggaggggcatgaaagacgg

SEQ ID NO: 8120705 - DNA, 22 bp, Homo sapiens
acaggagtagggctggtggaga

SEQ ID NO: 8120706 - DNA, 22 bp, Homo sapiens
agctggcaatgtaagtccctgg

SEQ ID NO: 8120707 - DNA, 22 bp, Homo sapiens
agctggcagaaagctttgcccg

SEQ ID NO: 8120708 - DNA, 22 bp, Homo sapiens
acaggcaggcttcggccagagc

SEQ ID NO: 8120709 - DNA, 22 bp, Homo sapiens
acaggcagccctctccctggtt

SEQ ID NO: 8120710 - DNA, 23 bp, Homo sapiens
acaggcaggcatggccaaatgtg

SEQ ID NO: 8120711 - DNA, 22 bp, Homo sapiens
acagggctcccagcaggtctgt

SEQ ID NO: 8120712 - DNA, 22 bp, Homo sapiens
aggaagaaatgtgacttcaaac

SEQ ID NO: 8120713 - DNA, 22 bp, Homo sapiens
aggaagaacctaagaaagtctc

SEQ ID NO: 8120714 - DNA, 22 bp, Homo sapiens
aggaagaaactgagctctgaca

SEQ ID NO: 8120715 - DNA, 18 bp, Homo sapiens
acagggagggcgctgggg

SEQ ID NO: 8120716 - DNA, 22 bp, Homo sapiens
acagggcttttaatcagtagtt

SEQ ID NO: 8120717 - DNA, 22 bp, Homo sapiens
aggagcaaatgatgagacagca

SEQ ID NO: 8120718 - DNA, 22 bp, Homo sapiens
aggagcagaatttaatgtgcag

SEQ ID NO: 8120719 - DNA, 22 bp, Homo sapiens
aggagcagaccgtagtcctgca

SEQ ID NO: 8120720 - DNA, 22 bp, Homo sapiens
acagtctgcatatgacctgtag

SEQ ID NO: 8120721 - DNA, 22 bp, Homo sapiens
acagtctgcttgtctccatggt

SEQ ID NO: 8120722 - DNA, 22 bp, Homo sapiens
acagtgggatgaggctggcccc

SEQ ID NO: 8120723 - DNA, 23 bp, Homo sapiens
acagtcgtaggtatccttttcct

SEQ ID NO: 8120724 - DNA, 22 bp, Homo sapiens
aggatgagccgcgcaagctgac

SEQ ID NO: 8120725 - DNA, 22 bp, Homo sapiens
aggatgaggctggacacttctt

SEQ ID NO: 8120726 - DNA, 22 bp, Homo sapiens
aggatgaggctggcaggtcttg

SEQ ID NO: 8120727 - DNA, 22 bp, Homo sapiens
aggatgagagatacatggagca

SEQ ID NO: 8120728 - DNA, 22 bp, Homo sapiens
aggatgagattccagggtcaat

SEQ ID NO: 8120729 - DNA, 22 bp, Homo sapiens
aggatgagattccagggtcaat

SEQ ID NO: 8120730 - DNA, 22 bp, Homo sapiens
aggatgagattgctgtgttgta

SEQ ID NO: 8120731 - DNA, 22 bp, Homo sapiens
acagtttatggtgttttatata

SEQ ID NO: 8120732 - DNA, 22 bp, Homo sapiens
acatatttccatgcagcatgtc

SEQ ID NO: 8120733 - DNA, 22 bp, Homo sapiens
acatattgaggctttgatttaa

SEQ ID NO: 8120734 - DNA, 22 bp, Homo sapiens
aggcagctggaaaactccaggc

SEQ ID NO: 8120735 - DNA, 22 bp, Homo sapiens
acatagcataaagaatgactct

SEQ ID NO: 8120736 - DNA, 22 bp, Homo sapiens
acatagcacgtctcaatttgga

SEQ ID NO: 8120737 - DNA, 20 bp, Homo sapiens
acatagatcagtgattgaca

SEQ ID NO: 8120738 - DNA, 22 bp, Homo sapiens
acatagaacttcgatgtctttt

SEQ ID NO: 8120739 - DNA, 22 bp, Homo sapiens
acatagaacttcccagtgagca

SEQ ID NO: 8120740 - DNA, 22 bp, Homo sapiens
acatagaacttcccagtgagca

SEQ ID NO: 8120741 - DNA, 22 bp, Homo sapiens
catttgaaattcttagaacaaa

SEQ ID NO: 8120742 - DNA, 22 bp, Homo sapiens
cattttaaatgatttaagccaa

SEQ ID NO: 8120743 - DNA, 21 bp, Homo sapiens
aggcagcaggatccagggaca

SEQ ID NO: 8120744 - DNA, 19 bp, Homo sapiens
aggcagcaggccagggatg

SEQ ID NO: 8120745 - DNA, 19 bp, Homo sapiens
aggcagcaggccagggatg

SEQ ID NO: 8120746 - DNA, 22 bp, Homo sapiens
cattttaaatgatttaagccaa

SEQ ID NO: 8120747 - DNA, 22 bp, Homo sapiens
ccaagcatttctagccagtcac

SEQ ID NO: 8120748 - DNA, 22 bp, Homo sapiens
ccaagcatggggttcagtagga

SEQ ID NO: 8120749 - DNA, 23 bp, Homo sapiens
aggcagcaggttgtccagggtga

SEQ ID NO: 8120750 - DNA, 22 bp, Homo sapiens
aggcagcagtcatgaggaaaga

SEQ ID NO: 8120751 - DNA, 22 bp, Homo sapiens
catgtataggtccatagtgaat

SEQ ID NO: 8120752 - DNA, 22 bp, Homo sapiens
catgtacattctgtagatggag

SEQ ID NO: 8120753 - DNA, 22 bp, Homo sapiens
catgggggtctggacaacaggc

SEQ ID NO: 8120754 - DNA, 22 bp, Homo sapiens
catggaggaccctcagggagct

SEQ ID NO: 8120755 - DNA, 22 bp, Homo sapiens
aggagggcaggctggctgccta

SEQ ID NO: 8120756 - DNA, 22 bp, Homo sapiens
aggagggctaggaaaaccagga

SEQ ID NO: 8120757 - DNA, 22 bp, Homo sapiens
aggagggcaggctggctgccta

SEQ ID NO: 8120758 - DNA, 22 bp, Homo sapiens
aggagggagcttaagccaggca

SEQ ID NO: 8120759 - DNA, 21 bp, Homo sapiens
aggagggcacaaggccaggaa

SEQ ID NO: 8120760 - DNA, 22 bp, Homo sapiens
aggagggatagaaaaatacttg

SEQ ID NO: 8120761 - DNA, 16 bp, Homo sapiens
aggaggggaattagga

SEQ ID NO: 8120762 - DNA, 22 bp, Homo sapiens
aggaggggcaatgatagtctgg

SEQ ID NO: 8120763 - DNA, 20 bp, Homo sapiens
aggaggggatagaatcaaag

SEQ ID NO: 8120764 - DNA, 22 bp, Homo sapiens
aggagaaggaagtgcatcacta

SEQ ID NO: 8120765 - DNA, 22 bp, Homo sapiens
cagtgcaggtggcagaggacag

SEQ ID NO: 8120766 - DNA, 22 bp, Homo sapiens
aggactgacttttgccatgaaa

SEQ ID NO: 8120767 - DNA, 22 bp, Homo sapiens
cagtgcccttccaggactgcag

SEQ ID NO: 8120768 - DNA, 19 bp, Homo sapiens
cagtgcccgacgcaggtct

SEQ ID NO: 8120769 - DNA, 22 bp, Homo sapiens
aggagaaggaagtgcatcacta

SEQ ID NO: 8120770 - DNA, 22 bp, Homo sapiens
aggagaaggaggcccctcacac

SEQ ID NO: 8120771 - DNA, 22 bp, Homo sapiens
aggagaagtaaggctagatgat

SEQ ID NO: 8120772 - DNA, 22 bp, Homo sapiens
aggagaagtaaggctagatgat

SEQ ID NO: 8120773 - DNA, 22 bp, Homo sapiens
aggagaagtaaggctagatgat

SEQ ID NO: 8120774 - DNA, 19 bp, Homo sapiens
aggagaagtagcagaaatt

SEQ ID NO: 8120775 - DNA, 19 bp, Homo sapiens
cagtggcctggaggtctct

SEQ ID NO: 8120776 - DNA, 22 bp, Homo sapiens
cagtggccgcggggctgtgggt

SEQ ID NO: 8120777 - DNA, 22 bp, Homo sapiens
cagtggccatggtggcaggggt

SEQ ID NO: 8120778 - DNA, 22 bp, Homo sapiens
cagtggagaggcatgcttggca

SEQ ID NO: 8120779 - DNA, 22 bp, Homo sapiens
aggacaggattccttgccttgc

SEQ ID NO: 8120780 - DNA, 22 bp, Homo sapiens
caggtgcagctggatggaagcc

SEQ ID NO: 8120781 - DNA, 22 bp, Homo sapiens
aggacccacgcacaggaacccc

SEQ ID NO: 8120782 - DNA, 22 bp, Homo sapiens
cagttttaaattgttagataat

SEQ ID NO: 8120783 - DNA, 16 bp, Homo sapiens
cagttttaaggcccaa

SEQ ID NO: 8120784 - DNA, 22 bp, Homo sapiens
cagttttaaattttgaatgtct

SEQ ID NO: 8120785 - DNA, 22 bp, Homo sapiens
cagttttatacactgcagctcc

SEQ ID NO: 8120786 - DNA, 22 bp, Homo sapiens
cagttttagggcaatgtgaaga

SEQ ID NO: 8120787 - DNA, 22 bp, Homo sapiens
cagttttaggacatgtggatgt

SEQ ID NO: 8120788 - DNA, 22 bp, Homo sapiens
cagttttacccaagcttatttt

SEQ ID NO: 8120789 - DNA, 22 bp, Homo sapiens
cagttttagctagagcaaacca

SEQ ID NO: 8120790 - DNA, 22 bp, Homo sapiens
cagtggtatttgagagaatgga

SEQ ID NO: 8120791 - DNA, 22 bp, Homo sapiens
aggagggagcttaagccaggca

SEQ ID NO: 8120792 - DNA, 22 bp, Homo sapiens
aggagggagcactatatgggga

SEQ ID NO: 8120793 - DNA, 22 bp, Homo sapiens
catatttattcttctgccagtg

SEQ ID NO: 8120794 - DNA, 22 bp, Homo sapiens
catatttagtgtttggagatcg

SEQ ID NO: 8120795 - DNA, 22 bp, Homo sapiens
catatttattcttctgccagtg

SEQ ID NO: 8120796 - DNA, 22 bp, Homo sapiens
catatttatagatctggcattt

SEQ ID NO: 8120797 - DNA, 22 bp, Homo sapiens
catattaaggtctgtaaggggt

SEQ ID NO: 8120798 - DNA, 22 bp, Homo sapiens
catattctgttggtcacataga

SEQ ID NO: 8120799 - DNA, 22 bp, Homo sapiens
catattctgttggtcacataga

SEQ ID NO: 8120800 - DNA, 22 bp, Homo sapiens
catattctttaagcaatgctct

SEQ ID NO: 8120801 - DNA, 22 bp, Homo sapiens
catattgctgtcattgtccctc

SEQ ID NO: 8120802 - DNA, 22 bp, Homo sapiens
cagttttatgtcgaatgtatac

SEQ ID NO: 8120803 - DNA, 22 bp, Homo sapiens
cagttttatgaatgcttattag

SEQ ID NO: 8120804 - DNA, 22 bp, Homo sapiens
cagttttatcatctgtgaaatg

SEQ ID NO: 8120805 - DNA, 22 bp, Homo sapiens
cagggatgggatggagtcagtt

SEQ ID NO: 8120806 - DNA, 22 bp, Homo sapiens
cagggagctggctggctgtgcc

SEQ ID NO: 8120807 - DNA, 22 bp, Homo sapiens
caggctggagtgcagttgtgca

SEQ ID NO: 8120808 - DNA, 22 bp, Homo sapiens
caggctggagtgcagttgtgca

SEQ ID NO: 8120809 - DNA, 22 bp, Homo sapiens
caggctggagtgcagtgtcgcc

SEQ ID NO: 8120810 - DNA, 22 bp, Homo sapiens
caggctggagttacctttaggg

SEQ ID NO: 8120811 - DNA, 22 bp, Homo sapiens
caggctgctgtccacaaagcat

SEQ ID NO: 8120812 - DNA, 22 bp, Homo sapiens
caggctgctgcctagaatgaca

SEQ ID NO: 8120813 - DNA, 22 bp, Homo sapiens
caggctggacattagatacata

SEQ ID NO: 8120814 - DNA, 22 bp, Homo sapiens
agctgtggaagactgtcagggt

SEQ ID NO: 8120815 - DNA, 22 bp, Homo sapiens
agctgtggaagactgtcagggt

SEQ ID NO: 8120816 - DNA, 22 bp, Homo sapiens
caggctcagctctggccagtgc

SEQ ID NO: 8120817 - DNA, 22 bp, Homo sapiens
caggctcagatgccctgcgctg

SEQ ID NO: 8120818 - DNA, 22 bp, Homo sapiens
caggctcactgtaaggtcagct

SEQ ID NO: 8120819 - DNA, 22 bp, Homo sapiens
cagggctccatgcagggactcc

SEQ ID NO: 8120820 - DNA, 22 bp, Homo sapiens
cagggctccccagagagcctct

SEQ ID NO: 8120821 - DNA, 22 bp, Homo sapiens
cagggctccccgcaccgcagcc

SEQ ID NO: 8120822 - DNA, 22 bp, Homo sapiens
cagggcctcgaagcctctgggc

SEQ ID NO: 8120823 - DNA, 22 bp, Homo sapiens
cagggatgtctctggaagggag

SEQ ID NO: 8120824 - DNA, 22 bp, Homo sapiens
cagggccaggctgatggcctgg

SEQ ID NO: 8120825 - DNA, 22 bp, Homo sapiens
caggggctgtggcacatggtgt

SEQ ID NO: 8120826 - DNA, 22 bp, Homo sapiens
caggggctgaaatgttggggtt

SEQ ID NO: 8120827 - DNA, 22 bp, Homo sapiens
caggggctccctgggtgccagt

SEQ ID NO: 8120828 - DNA, 22 bp, Homo sapiens
caggggctccctgggtgccagt

SEQ ID NO: 8120829 - DNA, 22 bp, Homo sapiens
caggggctctaatgcatgatca

SEQ ID NO: 8120830 - DNA, 22 bp, Homo sapiens
caggggctgtgggcggagcctc

SEQ ID NO: 8120831 - DNA, 22 bp, Homo sapiens
cagggtgcagagctagggtagt

SEQ ID NO: 8120832 - DNA, 22 bp, Homo sapiens
caggccagcagggcctccgtgg

SEQ ID NO: 8120833 - DNA, 22 bp, Homo sapiens
caggcactgtgctgagctctgc

SEQ ID NO: 8120834 - DNA, 22 bp, Homo sapiens
caggcactgtgttaggcactgt

SEQ ID NO: 8120835 - DNA, 22 bp, Homo sapiens
caggcacactgtctacactgag

SEQ ID NO: 8120836 - DNA, 22 bp, Homo sapiens
caggagcccagagtcctcagct

SEQ ID NO: 8120837 - DNA, 22 bp, Homo sapiens
agctgccacatggtgtcactgt

SEQ ID NO: 8120838 - DNA, 22 bp, Homo sapiens
caggaggacatactggctcaca

SEQ ID NO: 8120839 - DNA, 22 bp, Homo sapiens
caggaggagctggccgcctcat

SEQ ID NO: 8120840 - DNA, 22 bp, Homo sapiens
caggaggagggtacaccatcag

SEQ ID NO: 8120841 - DNA, 20 bp, Homo sapiens
cagctctgggcaggtcgagg

SEQ ID NO: 8120842 - DNA, 22 bp, Homo sapiens
agctgcagcactccagtagccg

SEQ ID NO: 8120843 - DNA, 23 bp, Homo sapiens
agctgcagatgctcagcgggcag

SEQ ID NO: 8120844 - DNA, 22 bp, Homo sapiens
agctgcagatcaataggctcac

SEQ ID NO: 8120845 - DNA, 22 bp, Homo sapiens
agctgcagagaaaagaggctgg

SEQ ID NO: 8120846 - DNA, 18 bp, Homo sapiens
agctgcagaccaggaggt

SEQ ID NO: 8120847 - DNA, 20 bp, Homo sapiens
agctgcagaacccactggac

SEQ ID NO: 8120848 - DNA, 22 bp, Homo sapiens
caggaaggcgcggctgtgcctg

SEQ ID NO: 8120849 - DNA, 22 bp, Homo sapiens
agctgccacagagcctggccag

SEQ ID NO: 8120850 - DNA, 22 bp, Homo sapiens
agctgcagtcaagctgggccac

SEQ ID NO: 8120851 - DNA, 22 bp, Homo sapiens
agctgcagtgaactgttttgtc

SEQ ID NO: 8120852 - DNA, 22 bp, Homo sapiens
cctcctgcacttgctttccttc

SEQ ID NO: 8120853 - DNA, 22 bp, Homo sapiens
cctcctgcggcgtccgcgctct

SEQ ID NO: 8120854 - DNA, 22 bp, Homo sapiens
cctcctggaggctctaagggag

SEQ ID NO: 8120855 - DNA, 23 bp, Homo sapiens
agggctgatgccattgcagctct

SEQ ID NO: 8120856 - DNA, 22 bp, Homo sapiens
agggctgatgcaccatgtagcc

SEQ ID NO: 8120857 - DNA, 22 bp, Homo sapiens
agggctgagtggtgcagtcaaa

SEQ ID NO: 8120858 - DNA, 22 bp, Homo sapiens
agggctgagtgggagagagttg

SEQ ID NO: 8120859 - DNA, 22 bp, Homo sapiens
cctctgggcaggtagcagcagc

SEQ ID NO: 8120860 - DNA, 19 bp, Homo sapiens
cctctgccagcccgcctct

SEQ ID NO: 8120861 - DNA, 19 bp, Homo sapiens
cctctgccagcccgcctct

SEQ ID NO: 8120862 - DNA, 22 bp, Homo sapiens
agggctgcaggcaagatatggc

SEQ ID NO: 8120863 - DNA, 22 bp, Homo sapiens
agggctgcaatgggagataact

SEQ ID NO: 8120864 - DNA, 22 bp, Homo sapiens
aggggctgggacagagccaagc

SEQ ID NO: 8120865 - DNA, 22 bp, Homo sapiens
cctgaggagattgtggctgggg

SEQ ID NO: 8120866 - DNA, 22 bp, Homo sapiens
cctgaggattgttggtgcttcc

SEQ ID NO: 8120867 - DNA, 17 bp, Homo sapiens
aggggagagtgggaaga

SEQ ID NO: 8120868 - DNA, 22 bp, Homo sapiens
cctgaggacacacgctgcagga

SEQ ID NO: 8120869 - DNA, 22 bp, Homo sapiens
cctgaggaccagcacccatctg

SEQ ID NO: 8120870 - DNA, 22 bp, Homo sapiens
aggggagaatttcaactcaggt

SEQ ID NO: 8120871 - DNA, 22 bp, Homo sapiens
cctcctctgtgcagctgtgggt

SEQ ID NO: 8120872 - DNA, 22 bp, Homo sapiens
agggctctgttggggtcagcac

SEQ ID NO: 8120873 - DNA, 22 bp, Homo sapiens
agggctctgtgactatcactgc

SEQ ID NO: 8120874 - DNA, 22 bp, Homo sapiens
agggctctgtccccagaggccc

SEQ ID NO: 8120875 - DNA, 22 bp, Homo sapiens
agggctctggggtggcagagat

SEQ ID NO: 8120876 - DNA, 22 bp, Homo sapiens
agggcccttacgcaggcccttc

SEQ ID NO: 8120877 - DNA, 22 bp, Homo sapiens
agggccctctggcaggccaggc

SEQ ID NO: 8120878 - DNA, 22 bp, Homo sapiens
agggccctctggcaggccaggc

SEQ ID NO: 8120879 - DNA, 22 bp, Homo sapiens
agggccctctggcaggccaggc

SEQ ID NO: 8120880 - DNA, 22 bp, Homo sapiens
agggctccaaggaagtgtagct

SEQ ID NO: 8120881 - DNA, 22 bp, Homo sapiens
agggccctaaggaaggcacaca

SEQ ID NO: 8120882 - DNA, 22 bp, Homo sapiens
agggccccatagtcactgcccg

SEQ ID NO: 8120883 - DNA, 22 bp, Homo sapiens
cccttcagtgcgtgagaatgag

SEQ ID NO: 8120884 - DNA, 22 bp, Homo sapiens
ccctttcttccgtgacttctgc

SEQ ID NO: 8120885 - DNA, 22 bp, Homo sapiens
agggccagaatccctcagtcta

SEQ ID NO: 8120886 - DNA, 22 bp, Homo sapiens
agggccagagtacatcagggct

SEQ ID NO: 8120887 - DNA, 22 bp, Homo sapiens
agggccagagtacatcagggct

SEQ ID NO: 8120888 - DNA, 22 bp, Homo sapiens
cccaggaggtggagcttgcagt

SEQ ID NO: 8120889 - DNA, 23 bp, Homo sapiens
agggaagaaacatgaagggctgt

SEQ ID NO: 8120890 - DNA, 22 bp, Homo sapiens
cccagggctgcagatggaggct

SEQ ID NO: 8120891 - DNA, 22 bp, Homo sapiens
agggaactccatgaggccagag

SEQ ID NO: 8120892 - DNA, 23 bp, Homo sapiens
cccaggagtttcactgcaaaggt

SEQ ID NO: 8120893 - DNA, 22 bp, Homo sapiens
cccaggagtttgagttcagcat

SEQ ID NO: 8120894 - DNA, 20 bp, Homo sapiens
cccaggagtttgctcttact

SEQ ID NO: 8120895 - DNA, 22 bp, Homo sapiens
agggagaaggtttagctgtgag

SEQ ID NO: 8120896 - DNA, 22 bp, Homo sapiens
agggagtggttaagaaggtgca

SEQ ID NO: 8120897 - DNA, 22 bp, Homo sapiens
agggagaaaattggatgcacaa

SEQ ID NO: 8120898 - DNA, 22 bp, Homo sapiens
agggagaacagttgcagcagac

SEQ ID NO: 8120899 - DNA, 22 bp, Homo sapiens
agggagaaaattggatgcacaa

SEQ ID NO: 8120900 - DNA, 22 bp, Homo sapiens
agggatgatggaaagaagcagg

SEQ ID NO: 8120901 - DNA, 22 bp, Homo sapiens
agggagtgttacataatgggtt

SEQ ID NO: 8120902 - DNA, 22 bp, Homo sapiens
agggatgatcagggtagaggct

SEQ ID NO: 8120903 - DNA, 22 bp, Homo sapiens
agggatgactcttggctgattc

SEQ ID NO: 8120904 - DNA, 22 bp, Homo sapiens
ccctctgcctgcgccctggtgt

SEQ ID NO: 8120905 - DNA, 22 bp, Homo sapiens
ccctcccaggagtggccagaga

SEQ ID NO: 8120906 - DNA, 22 bp, Homo sapiens
agggatggcaagttaacctgag

SEQ ID NO: 8120907 - DNA, 22 bp, Homo sapiens
ccctctcttagaagaaacacag

SEQ ID NO: 8120908 - DNA, 22 bp, Homo sapiens
ccctctctcggttgctgtggtt

SEQ ID NO: 8120909 - DNA, 22 bp, Homo sapiens
ccctctctgacttctgaacttg

SEQ ID NO: 8120910 - DNA, 22 bp, Homo sapiens
agggcagagatctgagtgggca

SEQ ID NO: 8120911 - DNA, 19 bp, Homo sapiens
ccagcagacacagctgccc

SEQ ID NO: 8120912 - DNA, 22 bp, Homo sapiens
aggcagggtgatgataatgatt

SEQ ID NO: 8120913 - DNA, 22 bp, Homo sapiens
aggcaggggagctggaagggta

SEQ ID NO: 8120914 - DNA, 22 bp, Homo sapiens
aggcaggggagctggaagggta

SEQ ID NO: 8120915 - DNA, 22 bp, Homo sapiens
ccagcctcatcatattcctgct

SEQ ID NO: 8120916 - DNA, 22 bp, Homo sapiens
ccaggacaagtgtggccatggc

SEQ ID NO: 8120917 - DNA, 22 bp, Homo sapiens
ccagggagcctggtgtgtcagc

SEQ ID NO: 8120918 - DNA, 17 bp, Homo sapiens
aggctcctcctaaggtc

SEQ ID NO: 8120919 - DNA, 20 bp, Homo sapiens
aggctcctgtacctgaggaa

SEQ ID NO: 8120920 - DNA, 22 bp, Homo sapiens
aggctcagttcacgtcaacttt

SEQ ID NO: 8120921 - DNA, 22 bp, Homo sapiens
aggctcagttctgtggtgagcc

SEQ ID NO: 8120922 - DNA, 22 bp, Homo sapiens
ccaggctgtaaacaccttcaaa

SEQ ID NO: 8120923 - DNA, 23 bp, Homo sapiens
aggctccacatgggcactttgca

SEQ ID NO: 8120924 - DNA, 22 bp, Homo sapiens
aggctcagtcccggcccgcgcc

SEQ ID NO: 8120925 - DNA, 22 bp, Homo sapiens
aggctgagtcgggaggatcact

SEQ ID NO: 8120926 - DNA, 22 bp, Homo sapiens
aggctgagtcaagttagggtga

SEQ ID NO: 8120927 - DNA, 22 bp, Homo sapiens
aggctgaggtgtgctgtgatcg

SEQ ID NO: 8120928 - DNA, 19 bp, Homo sapiens
ccatgcagcctgggggcag

SEQ ID NO: 8120929 - DNA, 22 bp, Homo sapiens
aggctctgtgactaaagaggat

SEQ ID NO: 8120930 - DNA, 22 bp, Homo sapiens
aggctgaggtaggaggatcgct

SEQ ID NO: 8120931 - DNA, 20 bp, Homo sapiens
aggctgagggtgattgtgtc

SEQ ID NO: 8120932 - DNA, 22 bp, Homo sapiens
aggctgaggggcgagggaccct

SEQ ID NO: 8120933 - DNA, 22 bp, Homo sapiens
aggctgaggcgggtagatcacc

SEQ ID NO: 8120934 - DNA, 22 bp, Homo sapiens
cccagagccggtggtgctcaca

SEQ ID NO: 8120935 - DNA, 20 bp, Homo sapiens
aggctgcctaaggctctgca

SEQ ID NO: 8120936 - DNA, 19 bp, Homo sapiens
aggctgcctcaccctccct

SEQ ID NO: 8120937 - DNA, 22 bp, Homo sapiens
aggctgcctaggttcaacacct

SEQ ID NO: 8120938 - DNA, 22 bp, Homo sapiens
aggctgcctcttttgagagggt

SEQ ID NO: 8120939 - DNA, 22 bp, Homo sapiens
aggctgcctcgtgagctcgctg

SEQ ID NO: 8120940 - DNA, 18 bp, Homo sapiens
cccactgtccccacaggc

SEQ ID NO: 8120941 - DNA, 22 bp, Homo sapiens
aggctgcgttagcctcactccc

SEQ ID NO: 8120942 - DNA, 21 bp, Homo sapiens
atacagaaggtggcaaagtac

SEQ ID NO: 8120943 - DNA, 22 bp, Homo sapiens
atacagaagcctgtatttctgg

SEQ ID NO: 8120944 - DNA, 22 bp, Homo sapiens
atacagaagttttccacttatt

SEQ ID NO: 8120945 - DNA, 22 bp, Homo sapiens
atacatatatggtacttcctgg

SEQ ID NO: 8120946 - DNA, 22 bp, Homo sapiens
ataatgtaggtatgtgtattta

SEQ ID NO: 8120947 - DNA, 22 bp, Homo sapiens
ataatgtacaactgcttttaat

SEQ ID NO: 8120948 - DNA, 20 bp, Homo sapiens
ataattatttacttttgtgc

SEQ ID NO: 8120949 - DNA, 22 bp, Homo sapiens
ataattatctcagacacttgtt

SEQ ID NO: 8120950 - DNA, 22 bp, Homo sapiens
atacagaactctcagttgtata

SEQ ID NO: 8120951 - DNA, 22 bp, Homo sapiens
atacagaagaactatagccact

SEQ ID NO: 8120952 - DNA, 22 bp, Homo sapiens
atacagaaaatgatgcagagtt

SEQ ID NO: 8120953 - DNA, 22 bp, Homo sapiens
atacagaacaagcctcacctcc

SEQ ID NO: 8120954 - DNA, 21 bp, Homo sapiens
atacagaacattgatccaaga

SEQ ID NO: 8120955 - DNA, 22 bp, Homo sapiens
atagaaacagggaagcaaagca

SEQ ID NO: 8120956 - DNA, 22 bp, Homo sapiens
atagaaacagggaagcaaagca

SEQ ID NO: 8120957 - DNA, 22 bp, Homo sapiens
atagaaaacagatgtccttaaa

SEQ ID NO: 8120958 - DNA, 22 bp, Homo sapiens
atagaatagcatagaaaattga

SEQ ID NO: 8120959 - DNA, 22 bp, Homo sapiens
ctggccagaggttcctctgccc

SEQ ID NO: 8120960 - DNA, 22 bp, Homo sapiens
ctggccaggcttgggacagaca

SEQ ID NO: 8120961 - DNA, 22 bp, Homo sapiens
ctggccagtgactgctcacccg

SEQ ID NO: 8120962 - DNA, 22 bp, Homo sapiens
atagaatgtattatagtacaga

SEQ ID NO: 8120963 - DNA, 20 bp, Homo sapiens
atagacaaagacatgccaga

SEQ ID NO: 8120964 - DNA, 22 bp, Homo sapiens
atagacaaacacgaagatgaca

SEQ ID NO: 8120965 - DNA, 22 bp, Homo sapiens
atagacattataacacagagct

SEQ ID NO: 8120966 - DNA, 22 bp, Homo sapiens
atagacaatcccccatcctacc

SEQ ID NO: 8120967 - DNA, 22 bp, Homo sapiens
atagggaggaactgagtcagga

SEQ ID NO: 8120968 - DNA, 22 bp, Homo sapiens
atagacattttgcattcaagca

SEQ ID NO: 8120969 - DNA, 23 bp, Homo sapiens
atagactgatttggatgtgaaag

SEQ ID NO: 8120970 - DNA, 22 bp, Homo sapiens
ataggcacaaccattaaaataa

SEQ ID NO: 8120971 - DNA, 22 bp, Homo sapiens
ataggtgtgtggttcatggccc

SEQ ID NO: 8120972 - DNA, 22 bp, Homo sapiens
ataggggcagatgaggaatggg

SEQ ID NO: 8120973 - DNA, 22 bp, Homo sapiens
ctgccctgtggctctgagtcat

SEQ ID NO: 8120974 - DNA, 22 bp, Homo sapiens
ctgccctgtttggacagcccgg

SEQ ID NO: 8120975 - DNA, 22 bp, Homo sapiens
ctgccctgtatcttctcccaat

SEQ ID NO: 8120976 - DNA, 18 bp, Homo sapiens
ctgcctgctctccagctt

SEQ ID NO: 8120977 - DNA, 20 bp, Homo sapiens
agttttcagcagaacaccca

SEQ ID NO: 8120978 - DNA, 18 bp, Homo sapiens
ctgcccagagcacttgtg

SEQ ID NO: 8120979 - DNA, 18 bp, Homo sapiens
ctgcccagagcatttcat

SEQ ID NO: 8120980 - DNA, 22 bp, Homo sapiens
ctgccctctagaggaggactga

SEQ ID NO: 8120981 - DNA, 22 bp, Homo sapiens
ctgccctgacctgcctcagagt

SEQ ID NO: 8120982 - DNA, 22 bp, Homo sapiens
ctgccctgacctgcctcagagt

SEQ ID NO: 8120983 - DNA, 22 bp, Homo sapiens
agtgttagtgaaaggtgtttat

SEQ ID NO: 8120984 - DNA, 22 bp, Homo sapiens
agtgttaatggtgtatattagg

SEQ ID NO: 8120985 - DNA, 22 bp, Homo sapiens
agttttattaaatccacagaag

SEQ ID NO: 8120986 - DNA, 22 bp, Homo sapiens
agtttcttgaagactgatgttt

SEQ ID NO: 8120987 - DNA, 22 bp, Homo sapiens
agtttcatgtagccatatttac

SEQ ID NO: 8120988 - DNA, 22 bp, Homo sapiens
agtttcatgagacagattttca

SEQ ID NO: 8120989 - DNA, 22 bp, Homo sapiens
ctgtccagcgactaggggatgg

SEQ ID NO: 8120990 - DNA, 21 bp, Homo sapiens
ctgtccacatcacagagcctc

SEQ ID NO: 8120991 - DNA, 22 bp, Homo sapiens
ctgtatctgtgttggatgagtt

SEQ ID NO: 8120992 - DNA, 22 bp, Homo sapiens
ctggggaggcagggctgcccct

SEQ ID NO: 8120993 - DNA, 22 bp, Homo sapiens
ctggtggagagtgggctctgga

SEQ ID NO: 8120994 - DNA, 22 bp, Homo sapiens
ctggtggcatcttgagatggtt

SEQ ID NO: 8120995 - DNA, 22 bp, Homo sapiens
ctgggcagtttacattcctacc

SEQ ID NO: 8120996 - DNA, 22 bp, Homo sapiens
atatattttgcggtcacgtggc

SEQ ID NO: 8120997 - DNA, 22 bp, Homo sapiens
atagtagaaggcatatttggaa

SEQ ID NO: 8120998 - DNA, 22 bp, Homo sapiens
atagtcactctgttaggtgttt

SEQ ID NO: 8120999 - DNA, 22 bp, Homo sapiens
atcattaaatataagcttcaca

SEQ ID NO: 8121000 - DNA, 22 bp, Homo sapiens
ctgtgcctccctttactttgag

SEQ ID NO: 8121001 - DNA, 22 bp, Homo sapiens
ctgtgcctccagtctcgcttct

SEQ ID NO: 8121002 - DNA, 22 bp, Homo sapiens
ctgtgcctgcaggccacatcaa

SEQ ID NO: 8121003 - DNA, 22 bp, Homo sapiens
ctgtgcctgccttgttcactga

SEQ ID NO: 8121004 - DNA, 22 bp, Homo sapiens
ctgtgccttctgcctggaacat

SEQ ID NO: 8121005 - DNA, 22 bp, Homo sapiens
ctgtgcctccaagtggtctctg

SEQ ID NO: 8121006 - DNA, 22 bp, Homo sapiens
ctgtgcagtaggtcagggctgg

SEQ ID NO: 8121007 - DNA, 22 bp, Homo sapiens
ctgtgggagcacatgacagata

SEQ ID NO: 8121008 - DNA, 22 bp, Homo sapiens
atcaggccagcaatccctgggc

SEQ ID NO: 8121009 - DNA, 22 bp, Homo sapiens
atctcaggggttccttctagag

SEQ ID NO: 8121010 - DNA, 22 bp, Homo sapiens
atctcaggtgaaacttctaggt

SEQ ID NO: 8121011 - DNA, 22 bp, Homo sapiens
atctcccaaattagcctcttga

SEQ ID NO: 8121012 - DNA, 22 bp, Homo sapiens
atctcccaattccctgataaat

SEQ ID NO: 8121013 - DNA, 22 bp, Homo sapiens
atctcccagccacagcattctt

SEQ ID NO: 8121014 - DNA, 22 bp, Homo sapiens
atctcccacaggctgctacttc

SEQ ID NO: 8121015 - DNA, 22 bp, Homo sapiens
atctcccaaactcatttcttca

SEQ ID NO: 8121016 - DNA, 22 bp, Homo sapiens
atctggaaaacacagtgtagac

SEQ ID NO: 8121017 - DNA, 22 bp, Homo sapiens
atctggaaataaatacgagttc

SEQ ID NO: 8121018 - DNA, 19 bp, Homo sapiens
atctggaactcgtttgttt

SEQ ID NO: 8121019 - DNA, 21 bp, Homo sapiens
atctggaaattctgccagaga

SEQ ID NO: 8121020 - DNA, 22 bp, Homo sapiens
atctggaacaaagcttaggaat

SEQ ID NO: 8121021 - DNA, 22 bp, Homo sapiens
atctggaagccagatactcagt

SEQ ID NO: 8121022 - DNA, 22 bp, Homo sapiens
atctggaagattgaaggggagt

SEQ ID NO: 8121023 - DNA, 21 bp, Homo sapiens
atctggaagaactggtaagtg

SEQ ID NO: 8121024 - DNA, 22 bp, Homo sapiens
cttcataatctgaaatttgtaa

SEQ ID NO: 8121025 - DNA, 22 bp, Homo sapiens
atccttccagagttattctcaa

SEQ ID NO: 8121026 - DNA, 22 bp, Homo sapiens
agtgactgggcagggcagggcc

SEQ ID NO: 8121027 - DNA, 22 bp, Homo sapiens
agtgaccgaggcacttggcaac

SEQ ID NO: 8121028 - DNA, 22 bp, Homo sapiens
agtgcagatttttagtcagctt

SEQ ID NO: 8121029 - DNA, 22 bp, Homo sapiens
agtgcacaccttagtacaaagt

SEQ ID NO: 8121030 - DNA, 22 bp, Homo sapiens
agtgcactggcaccatctcagc

SEQ ID NO: 8121031 - DNA, 22 bp, Homo sapiens
agtgacagtctcagagatcagg

SEQ ID NO: 8121032 - DNA, 22 bp, Homo sapiens
agtgacatgaccacaaagcagc

SEQ ID NO: 8121033 - DNA, 22 bp, Homo sapiens
ctccagttggccccagttggtt

SEQ ID NO: 8121034 - DNA, 22 bp, Homo sapiens
ctccagtgggggtgagcctaga

SEQ ID NO: 8121035 - DNA, 22 bp, Homo sapiens
ctcctccctctttgccacacat

SEQ ID NO: 8121036 - DNA, 22 bp, Homo sapiens
ctcctccctgcgattgctctgc

SEQ ID NO: 8121037 - DNA, 22 bp, Homo sapiens
ctcctccctgggaggctggcat

SEQ ID NO: 8121038 - DNA, 22 bp, Homo sapiens
ctcctctcaggctggatggcgc

SEQ ID NO: 8121039 - DNA, 22 bp, Homo sapiens
ctcctctcaaaagtaggttgac

SEQ ID NO: 8121040 - DNA, 22 bp, Homo sapiens
ctcctctcaaaagtaggttgac

SEQ ID NO: 8121041 - DNA, 22 bp, Homo sapiens
agtgcagccgagatcaggtgct

SEQ ID NO: 8121042 - DNA, 22 bp, Homo sapiens
ctcccaggttccgacgcctctt

SEQ ID NO: 8121043 - DNA, 22 bp, Homo sapiens
agtctggagtttgctactggac

SEQ ID NO: 8121044 - DNA, 22 bp, Homo sapiens
agtctggagtgttttgtagcaa

SEQ ID NO: 8121045 - DNA, 22 bp, Homo sapiens
agtctggattagttgggggcaa

SEQ ID NO: 8121046 - DNA, 22 bp, Homo sapiens
agtctggagtgcggcggcagga

SEQ ID NO: 8121047 - DNA, 22 bp, Homo sapiens
agtctggagtgattatgtggga

SEQ ID NO: 8121048 - DNA, 22 bp, Homo sapiens
agtctggagtagagcctagaaa

SEQ ID NO: 8121049 - DNA, 19 bp, Homo sapiens
agtctggagtaaaaggaat

SEQ ID NO: 8121050 - DNA, 22 bp, Homo sapiens
agtctggaggtggcaggtgtgt

SEQ ID NO: 8121051 - DNA, 22 bp, Homo sapiens
agtctggagctcagacttggga

SEQ ID NO: 8121052 - DNA, 22 bp, Homo sapiens
agtctggacctgctgggtctcc

SEQ ID NO: 8121053 - DNA, 22 bp, Homo sapiens
agtctggagcagcagtattggt

SEQ ID NO: 8121054 - DNA, 22 bp, Homo sapiens
agtctggaatttggcctgagca

SEQ ID NO: 8121055 - DNA, 22 bp, Homo sapiens
agtctggacatgctgaacttgg

SEQ ID NO: 8121056 - DNA, 22 bp, Homo sapiens
agtctggaataaaactacttac

SEQ ID NO: 8121057 - DNA, 23 bp, Homo sapiens
agtctggaagtgcagtggctgga

SEQ ID NO: 8121058 - DNA, 22 bp, Homo sapiens
agtctgcttttgtgaagagctg

SEQ ID NO: 8121059 - DNA, 22 bp, Homo sapiens
agtctggaaaatgcatgtttca

SEQ ID NO: 8121060 - DNA, 21 bp, Homo sapiens
agtctggaaaacacattcatg

SEQ ID NO: 8121061 - DNA, 22 bp, Homo sapiens
agtctgcttcctggagaactca

SEQ ID NO: 8121062 - DNA, 22 bp, Homo sapiens
ctcaggagttggaggctacagt

SEQ ID NO: 8121063 - DNA, 22 bp, Homo sapiens
ctcaggcacttttgtcacagac

SEQ ID NO: 8121064 - DNA, 22 bp, Homo sapiens
agtctcttttgcgaagagtgtt

SEQ ID NO: 8121065 - DNA, 20 bp, Homo sapiens
agtctgcagctgcatgaccc

SEQ ID NO: 8121066 - DNA, 20 bp, Homo sapiens
agtctgcagctgcatgaccc

SEQ ID NO: 8121067 - DNA, 22 bp, Homo sapiens
ctgaagcagatgtggctgagat

SEQ ID NO: 8121068 - DNA, 22 bp, Homo sapiens
agtgtgtttaggctgcgggttg

SEQ ID NO: 8121069 - DNA, 21 bp, Homo sapiens
agtgtgtgtggaatgagaata

SEQ ID NO: 8121070 - DNA, 22 bp, Homo sapiens
agtgtgtgcatgcattcgtgca

SEQ ID NO: 8121071 - DNA, 18 bp, Homo sapiens
agtgtgtgccctttcagg

SEQ ID NO: 8121072 - DNA, 22 bp, Homo sapiens
ctgagaggcggagcttgcagtg

SEQ ID NO: 8121073 - DNA, 22 bp, Homo sapiens
ctgagaggcggagcttgcagtg

SEQ ID NO: 8121074 - DNA, 20 bp, Homo sapiens
ctcttaaatgtaaagtaggc

SEQ ID NO: 8121075 - DNA, 20 bp, Homo sapiens
ctcttaaatgtaaagtaggc

SEQ ID NO: 8121076 - DNA, 22 bp, Homo sapiens
agtggggacaatgagagcaggt

SEQ ID NO: 8121077 - DNA, 20 bp, Homo sapiens
agtggggagtcaggagtgcc

SEQ ID NO: 8121078 - DNA, 22 bp, Homo sapiens
agtggggaggtccaggccaccc

SEQ ID NO: 8121079 - DNA, 22 bp, Homo sapiens
agtggggacttatgccagcatt

SEQ ID NO: 8121080 - DNA, 22 bp, Homo sapiens
agtgggctggtggcagggagaa

SEQ ID NO: 8121081 - DNA, 20 bp, Homo sapiens
agtgggagagggcagactgc

SEQ ID NO: 8121082 - DNA, 22 bp, Homo sapiens
agtgggcaggcagggtgcgcag

SEQ ID NO: 8121083 - DNA, 22 bp, Homo sapiens
ctctctgggggccatgccaaga

SEQ ID NO: 8121084 - DNA, 22 bp, Homo sapiens
ctctctggggttccagacgtgg

SEQ ID NO: 8121085 - DNA, 22 bp, Homo sapiens
ctctctgggcccagttggcacc

SEQ ID NO: 8121086 - DNA, 22 bp, Homo sapiens
agtggcaggcggagatgtagga

SEQ ID NO: 8121087 - DNA, 17 bp, Homo sapiens
agtggcaggcagatggg

SEQ ID NO: 8121088 - DNA, 22 bp, Homo sapiens
cggtcaggtgcagcgttggcac

SEQ ID NO: 8121089 - DNA, 22 bp, Homo sapiens
cgtgaggggggtaaggcgtccg

SEQ ID NO: 8121090 - DNA, 22 bp, Homo sapiens
cgcctgggagtccacacctgct

SEQ ID NO: 8121091 - DNA, 22 bp, Homo sapiens
agtcaccaacatggttcccagg

SEQ ID NO: 8121092 - DNA, 23 bp, Homo sapiens
agtcagagagtgtgagacaactg

SEQ ID NO: 8121093 - DNA, 22 bp, Homo sapiens
agtaatagagattttaatgtcc

SEQ ID NO: 8121094 - DNA, 22 bp, Homo sapiens
agtaatgtgcctgaaatacttg

SEQ ID NO: 8121095 - DNA, 22 bp, Homo sapiens
agtaatttgttataaagcaata

SEQ ID NO: 8121096 - DNA, 22 bp, Homo sapiens
aggtgtctgggctttggagtca

SEQ ID NO: 8121097 - DNA, 22 bp, Homo sapiens
aggtgtctggatgggtgtcctt

SEQ ID NO: 8121098 - DNA, 22 bp, Homo sapiens
aggtgtctttgcggcccgccgc

SEQ ID NO: 8121099 - DNA, 22 bp, Homo sapiens
aggtgtcttcagggtgagacag

SEQ ID NO: 8121100 - DNA, 22 bp, Homo sapiens
aggtgtctgtgatgggagcgat

SEQ ID NO: 8121101 - DNA, 22 bp, Homo sapiens
aggtgtggctggggcagaggcc

SEQ ID NO: 8121102 - DNA, 19 bp, Homo sapiens
aggtgtgggggctgcagac

SEQ ID NO: 8121103 - DNA, 22 bp, Homo sapiens
aggttacagtcatctcagaatc

SEQ ID NO: 8121104 - DNA, 22 bp, Homo sapiens
aggttacataggctttaaaagt

SEQ ID NO: 8121105 - DNA, 23 bp, Homo sapiens
aggttacagttgttaagttgcaa

SEQ ID NO: 8121106 - DNA, 19 bp, Homo sapiens
aggttacaggtgtcacaga

SEQ ID NO: 8121107 - DNA, 22 bp, Homo sapiens
agggtggcactggtggctctat

SEQ ID NO: 8121108 - DNA, 22 bp, Homo sapiens
agggtggagggagtccctgagc

SEQ ID NO: 8121109 - DNA, 22 bp, Homo sapiens
agggtggaagatggcactatct

SEQ ID NO: 8121110 - DNA, 22 bp, Homo sapiens
cctggctcaggcacgcatggct

SEQ ID NO: 8121111 - DNA, 22 bp, Homo sapiens
aggtataagtctcatttctgtt

SEQ ID NO: 8121112 - DNA, 22 bp, Homo sapiens
cctggctcaaggcgaggactcc

SEQ ID NO: 8121113 - DNA, 22 bp, Homo sapiens
agggtggcagttactggagcaa

SEQ ID NO: 8121114 - DNA, 22 bp, Homo sapiens
cctggagcgcgggtcaagctgg

SEQ ID NO: 8121115 - DNA, 22 bp, Homo sapiens
cctgggcagggagaccaggctc

SEQ ID NO: 8121116 - DNA, 22 bp, Homo sapiens
cctgggcagggagaccaggctc

SEQ ID NO: 8121117 - DNA, 22 bp, Homo sapiens
cctgggcagggctggactctca

SEQ ID NO: 8121118 - DNA, 22 bp, Homo sapiens
cctgggcagtgctggagttgaa

SEQ ID NO: 8121119 - DNA, 22 bp, Homo sapiens
cctgggcagcctgctcaaggac

SEQ ID NO: 8121120 - DNA, 21 bp, Homo sapiens
aggtgcagagccagggaccag

SEQ ID NO: 8121121 - DNA, 22 bp, Homo sapiens
aggtgcacctgagggtgtcatc

SEQ ID NO: 8121122 - DNA, 22 bp, Homo sapiens
aggtggagttaagtgtgaactg

SEQ ID NO: 8121123 - DNA, 22 bp, Homo sapiens
aggtggagttaagtgtgaactg

SEQ ID NO: 8121124 - DNA, 22 bp, Homo sapiens
aggtggagttggctgtagttca

SEQ ID NO: 8121125 - DNA, 22 bp, Homo sapiens
aggtggagtgtgcagggagagc

SEQ ID NO: 8121126 - DNA, 21 bp, Homo sapiens
aggtggagtgcttagcatcca

SEQ ID NO: 8121127 - DNA, 22 bp, Homo sapiens
aggtggagtgaaggaaaggcag

SEQ ID NO: 8121128 - DNA, 22 bp, Homo sapiens
aggtggagtgaaggaaaggcag

SEQ ID NO: 8121129 - DNA, 23 bp, Homo sapiens
aggtggagctgtgcagccggggc

SEQ ID NO: 8121130 - DNA, 22 bp, Homo sapiens
aggtggagatcagggactaagg

SEQ ID NO: 8121131 - DNA, 22 bp, Homo sapiens
aggtctgggagttcattccctg

SEQ ID NO: 8121132 - DNA, 22 bp, Homo sapiens
aggtctggctcttctccacaga

SEQ ID NO: 8121133 - DNA, 22 bp, Homo sapiens
aggtctggaaacagcagggaga

SEQ ID NO: 8121134 - DNA, 22 bp, Homo sapiens
gcaccaggcagctgagcaggcc

SEQ ID NO: 8121135 - DNA, 22 bp, Homo sapiens
gcacagggctgccaggcggctt

SEQ ID NO: 8121136 - DNA, 22 bp, Homo sapiens
gcaccaggcttagagccccagg

SEQ ID NO: 8121137 - DNA, 21 bp, Homo sapiens
gcagagaatgaactttggctt

SEQ ID NO: 8121138 - DNA, 22 bp, Homo sapiens
gcagagattatgccatggaaag

SEQ ID NO: 8121139 - DNA, 22 bp, Homo sapiens
gcacccagaataaggacaggac

SEQ ID NO: 8121140 - DNA, 22 bp, Homo sapiens
gcacccagaataaggacaggac

SEQ ID NO: 8121141 - DNA, 22 bp, Homo sapiens
attatcttgataaaatggcagt

SEQ ID NO: 8121142 - DNA, 22 bp, Homo sapiens
attattaaaatgtgtttctctt

SEQ ID NO: 8121143 - DNA, 22 bp, Homo sapiens
gcagacaatttattagcagatt

SEQ ID NO: 8121144 - DNA, 22 bp, Homo sapiens
gcagaattttctgttttctaga

SEQ ID NO: 8121145 - DNA, 22 bp, Homo sapiens
attatggctttcatgggcaata

SEQ ID NO: 8121146 - DNA, 22 bp, Homo sapiens
gattcataccgtttcttctcca

SEQ ID NO: 8121147 - DNA, 22 bp, Homo sapiens
gatgtgaggactcatgtggagg

SEQ ID NO: 8121148 - DNA, 22 bp, Homo sapiens
gatggccacatacatggctggg

SEQ ID NO: 8121149 - DNA, 22 bp, Homo sapiens
gagtggggaaagccaggacaga

SEQ ID NO: 8121150 - DNA, 21 bp, Homo sapiens
gatgatggcaggcagcactgg

SEQ ID NO: 8121151 - DNA, 22 bp, Homo sapiens
gatgatgggatccagcaatgta

SEQ ID NO: 8121152 - DNA, 22 bp, Homo sapiens
gatggaggagatggcagggtgc

SEQ ID NO: 8121153 - DNA, 22 bp, Homo sapiens
gatggcacacagacatccccgc

SEQ ID NO: 8121154 - DNA, 22 bp, Homo sapiens
attctcataggagcgtgaacct

SEQ ID NO: 8121155 - DNA, 22 bp, Homo sapiens
attctcatttttatagatgaga

SEQ ID NO: 8121156 - DNA, 22 bp, Homo sapiens
gcaggattgggctgaaggagtg

SEQ ID NO: 8121157 - DNA, 22 bp, Homo sapiens
gcaggcaggagcccaactgcct

SEQ ID NO: 8121158 - DNA, 22 bp, Homo sapiens
attctgctggtaactctataaa

SEQ ID NO: 8121159 - DNA, 22 bp, Homo sapiens
attgcaaatgagtcttaatata

SEQ ID NO: 8121160 - DNA, 22 bp, Homo sapiens
attgcaaatgagtcttaatata

SEQ ID NO: 8121161 - DNA, 22 bp, Homo sapiens
attgcaaatggtttggtcatct

SEQ ID NO: 8121162 - DNA, 22 bp, Homo sapiens
attgcaaaggtcccattcaaga

SEQ ID NO: 8121163 - DNA, 22 bp, Homo sapiens
attgcaaagcattgtgagcgca

SEQ ID NO: 8121164 - DNA, 22 bp, Homo sapiens
caaagaatgagtgagtacataa

SEQ ID NO: 8121165 - DNA, 22 bp, Homo sapiens
caaagactgcataacacatgaa

SEQ ID NO: 8121166 - DNA, 22 bp, Homo sapiens
gctcccagggacactggccact

SEQ ID NO: 8121167 - DNA, 22 bp, Homo sapiens
gctcccaggcatggaggtaatt

SEQ ID NO: 8121168 - DNA, 22 bp, Homo sapiens
gctcccaggcatggaggtaatt

SEQ ID NO: 8121169 - DNA, 22 bp, Homo sapiens
gctcccaggatgaggagccagg

SEQ ID NO: 8121170 - DNA, 22 bp, Homo sapiens
gctcccaggatgaggagccagg

SEQ ID NO: 8121171 - DNA, 22 bp, Homo sapiens
gctccagggaacagaatgtact

SEQ ID NO: 8121172 - DNA, 22 bp, Homo sapiens
gctcccagtctgatggaggaga

SEQ ID NO: 8121173 - DNA, 22 bp, Homo sapiens
gctcccagggcagcgcagaaga

SEQ ID NO: 8121174 - DNA, 22 bp, Homo sapiens
gctcccagggcagcgcagaaga

SEQ ID NO: 8121175 - DNA, 22 bp, Homo sapiens
gctcccagggaccgcagggcag

SEQ ID NO: 8121176 - DNA, 22 bp, Homo sapiens
gctcccaggttcttgggccttg

SEQ ID NO: 8121177 - DNA, 22 bp, Homo sapiens
caaaagatacttgcatctaact

SEQ ID NO: 8121178 - DNA, 19 bp, Homo sapiens
gctcagagacacctgttgc

SEQ ID NO: 8121179 - DNA, 22 bp, Homo sapiens
gctcagagaatttactgctgcc

SEQ ID NO: 8121180 - DNA, 22 bp, Homo sapiens
gctcagagaagttaaggaattt

SEQ ID NO: 8121181 - DNA, 22 bp, Homo sapiens
gctcagagaaattataggaatt

SEQ ID NO: 8121182 - DNA, 22 bp, Homo sapiens
gctcagagaaaactggggcttg

SEQ ID NO: 8121183 - DNA, 22 bp, Homo sapiens
gccttccttttaccaccagcca

SEQ ID NO: 8121184 - DNA, 22 bp, Homo sapiens
attttgaatcaccttggaagaa

SEQ ID NO: 8121185 - DNA, 17 bp, Homo sapiens
gccttccttcctccaca

SEQ ID NO: 8121186 - DNA, 17 bp, Homo sapiens
gccttccttcctccaca

SEQ ID NO: 8121187 - DNA, 22 bp, Homo sapiens
attttgataatcatgttagaga

SEQ ID NO: 8121188 - DNA, 22 bp, Homo sapiens
gccttccttacacctgctcagc

SEQ ID NO: 8121189 - DNA, 22 bp, Homo sapiens
gccttccttacacctgctcagc

SEQ ID NO: 8121190 - DNA, 22 bp, Homo sapiens
attttccaaaataattgttact

SEQ ID NO: 8121191 - DNA, 22 bp, Homo sapiens
attttccagcctttctagaact

SEQ ID NO: 8121192 - DNA, 22 bp, Homo sapiens
attttcattttgcagggtgaga

SEQ ID NO: 8121193 - DNA, 22 bp, Homo sapiens
attttcatcatgggtttaacat

SEQ ID NO: 8121194 - DNA, 22 bp, Homo sapiens
atttggtagtgattgaaattat

SEQ ID NO: 8121195 - DNA, 22 bp, Homo sapiens
atttggtttcaggattctcagg

SEQ ID NO: 8121196 - DNA, 22 bp, Homo sapiens
attttagatttaagaataaggt

SEQ ID NO: 8121197 - DNA, 22 bp, Homo sapiens
gcccaggagttgaagggctgac

SEQ ID NO: 8121198 - DNA, 22 bp, Homo sapiens
gcccagtctccaggagactctc

SEQ ID NO: 8121199 - DNA, 22 bp, Homo sapiens
gccatgcttggtatgctgtgag

SEQ ID NO: 8121200 - DNA, 22 bp, Homo sapiens
gcccagtggtaaaagcaggcct

SEQ ID NO: 8121201 - DNA, 22 bp, Homo sapiens
gccctggttttagaggagcagg

SEQ ID NO: 8121202 - DNA, 22 bp, Homo sapiens
atttctgtttgctactataagt

SEQ ID NO: 8121203 - DNA, 22 bp, Homo sapiens
gccagctggaaatctgcttgaa

SEQ ID NO: 8121204 - DNA, 21 bp, Homo sapiens
atttagaaggaaattttgcaa

SEQ ID NO: 8121205 - DNA, 22 bp, Homo sapiens
atttatcaccagttagctgact

SEQ ID NO: 8121206 - DNA, 22 bp, Homo sapiens
atttattacctcggagtttctg

SEQ ID NO: 8121207 - DNA, 22 bp, Homo sapiens
atttattaagcatctgctatgt

SEQ ID NO: 8121208 - DNA, 22 bp, Homo sapiens
gccagaggttcaacaactgtct

SEQ ID NO: 8121209 - DNA, 22 bp, Homo sapiens
attgtacagatgaggtaagtga

SEQ ID NO: 8121210 - DNA, 22 bp, Homo sapiens
gccagctgctggaacagcgcga

SEQ ID NO: 8121211 - DNA, 22 bp, Homo sapiens
atggcaaaaactgcagttacct

SEQ ID NO: 8121212 - DNA, 22 bp, Homo sapiens
atggattggatttttatggacc

SEQ ID NO: 8121213 - DNA, 22 bp, Homo sapiens
atggatgagtccttgagacaca

SEQ ID NO: 8121214 - DNA, 22 bp, Homo sapiens
atggatgaaggcgaggatgagg

SEQ ID NO: 8121215 - DNA, 22 bp, Homo sapiens
gagaatatattgaagtagttcc

SEQ ID NO: 8121216 - DNA, 22 bp, Homo sapiens
gagaatatttttagctttcctc

SEQ ID NO: 8121217 - DNA, 22 bp, Homo sapiens
gagacaggcagctagtgggtca

SEQ ID NO: 8121218 - DNA, 22 bp, Homo sapiens
atggagggtgtcagagagcgaa

SEQ ID NO: 8121219 - DNA, 22 bp, Homo sapiens
gagaaggtggacctgaaggagc

SEQ ID NO: 8121220 - DNA, 22 bp, Homo sapiens
atgggcagacagggagctcacg

SEQ ID NO: 8121221 - DNA, 21 bp, Homo sapiens
atgggcagaggcagagaggct

SEQ ID NO: 8121222 - DNA, 22 bp, Homo sapiens
gagcccatcctcgaggggctgc

SEQ ID NO: 8121223 - DNA, 22 bp, Homo sapiens
gagcccagtctgctcctgcgcc

SEQ ID NO: 8121224 - DNA, 22 bp, Homo sapiens
gagccccagccctgcttctata

SEQ ID NO: 8121225 - DNA, 22 bp, Homo sapiens
gagccccaccctagacattctg

SEQ ID NO: 8121226 - DNA, 22 bp, Homo sapiens
gagccccaggacagctctagtt

SEQ ID NO: 8121227 - DNA, 22 bp, Homo sapiens
gagccccttctgcagtcaggtt

SEQ ID NO: 8121228 - DNA, 19 bp, Homo sapiens
gagccctctccatggccac

SEQ ID NO: 8121229 - DNA, 22 bp, Homo sapiens
gagctgcacatctgaggctaat

SEQ ID NO: 8121230 - DNA, 22 bp, Homo sapiens
gagctgcagacatagataagcg

SEQ ID NO: 8121231 - DNA, 22 bp, Homo sapiens
gagctgcagacttgatacagga

SEQ ID NO: 8121232 - DNA, 22 bp, Homo sapiens
gagctgcagagctcgaaggaac

SEQ ID NO: 8121233 - DNA, 22 bp, Homo sapiens
gagctgcagcggctgacgcaac

SEQ ID NO: 8121234 - DNA, 22 bp, Homo sapiens
gagctgccagacatgggaatga

SEQ ID NO: 8121235 - DNA, 22 bp, Homo sapiens
atgggcagagtggggacaggaa

SEQ ID NO: 8121236 - DNA, 22 bp, Homo sapiens
gagctgccctgagctttgcatg

SEQ ID NO: 8121237 - DNA, 22 bp, Homo sapiens
gagctgccggcccacagtacta

SEQ ID NO: 8121238 - DNA, 22 bp, Homo sapiens
gagcacagctggaggtagcatt

SEQ ID NO: 8121239 - DNA, 22 bp, Homo sapiens
gagcacaggctgctgtgaactg

SEQ ID NO: 8121240 - DNA, 22 bp, Homo sapiens
atggcagacctgggctggagaa

SEQ ID NO: 8121241 - DNA, 22 bp, Homo sapiens
atggctccagcttggcttcacc

SEQ ID NO: 8121242 - DNA, 22 bp, Homo sapiens
gaggctccagcgacacctaggc

SEQ ID NO: 8121243 - DNA, 22 bp, Homo sapiens
atgtatcacagcaatgtagtca

SEQ ID NO: 8121244 - DNA, 22 bp, Homo sapiens
gaggaggggacagtacttgtgc

SEQ ID NO: 8121245 - DNA, 23 bp, Homo sapiens
gaggagggtcgtgctgtgttcct

SEQ ID NO: 8121246 - DNA, 22 bp, Homo sapiens
gaggaggggcacttgtctccta

SEQ ID NO: 8121247 - DNA, 22 bp, Homo sapiens
gaggaggggcacttgtctccta

SEQ ID NO: 8121248 - DNA, 22 bp, Homo sapiens
gaggcacaatacatgtctcaag

SEQ ID NO: 8121249 - DNA, 22 bp, Homo sapiens
gaggagggagctggaagctctt

SEQ ID NO: 8121250 - DNA, 22 bp, Homo sapiens
gaggagggagctggaagctctt

SEQ ID NO: 8121251 - DNA, 22 bp, Homo sapiens
gaggagggagctggaagctctt

SEQ ID NO: 8121252 - DNA, 22 bp, Homo sapiens
gaggagggcctggtgtcccttc

SEQ ID NO: 8121253 - DNA, 22 bp, Homo sapiens
gaggagctgggtcagggagaca

SEQ ID NO: 8121254 - DNA, 22 bp, Homo sapiens
atgggcaggcactggctctcag

SEQ ID NO: 8121255 - DNA, 22 bp, Homo sapiens
atgggcagctgcagcagtggtg

SEQ ID NO: 8121256 - DNA, 16 bp, Homo sapiens
atgttacagaagtaat

SEQ ID NO: 8121257 - DNA, 22 bp, Homo sapiens
atgttacagagaaagtggaagc

SEQ ID NO: 8121258 - DNA, 22 bp, Homo sapiens
atgttacagttgagtaaattaa

SEQ ID NO: 8121259 - DNA, 22 bp, Homo sapiens
gaggtgtgatgcagagtggtgg

SEQ ID NO: 8121260 - DNA, 23 bp, Homo sapiens
gaggtgtgaattctgggtgctgc

SEQ ID NO: 8121261 - DNA, 22 bp, Homo sapiens
atgtgcttgaagcctcagagaa

SEQ ID NO: 8121262 - DNA, 22 bp, Homo sapiens
atgtgcttggaaaagcagtggt

SEQ ID NO: 8121263 - DNA, 22 bp, Homo sapiens
atgtgctttattaagtaaaaat

SEQ ID NO: 8121264 - DNA, 22 bp, Homo sapiens
atgtgctttctttccaaggggc

SEQ ID NO: 8121265 - DNA, 22 bp, Homo sapiens
atgtggaatgaacaaaggaggc

SEQ ID NO: 8121266 - DNA, 22 bp, Homo sapiens
atgtgctttgctggaaatgtca

SEQ ID NO: 8121267 - DNA, 22 bp, Homo sapiens
atgtggatttgggagtgatcag

SEQ ID NO: 8121268 - DNA, 22 bp, Homo sapiens
atgtggcctagtatagaaatga

SEQ ID NO: 8121269 - DNA, 22 bp, Homo sapiens
atgtcagaatctacattctact

SEQ ID NO: 8121270 - DNA, 22 bp, Homo sapiens
atgtgctaaactcaacaaatct

SEQ ID NO: 8121271 - DNA, 22 bp, Homo sapiens
atgtgccatctactgtcccaag

SEQ ID NO: 8121272 - DNA, 22 bp, Homo sapiens
gaagtccagaatactgctctga

SEQ ID NO: 8121273 - DNA, 22 bp, Homo sapiens
gaagtctgctgctcaggagttt

SEQ ID NO: 8121274 - DNA, 22 bp, Homo sapiens
atgccactgcactccagcctag

SEQ ID NO: 8121275 - DNA, 22 bp, Homo sapiens
atgccactgcactccagcctgg

SEQ ID NO: 8121276 - DNA, 22 bp, Homo sapiens
gacaggaaacaagaaggcagga

SEQ ID NO: 8121277 - DNA, 22 bp, Homo sapiens
gacaggaaacaagaaggcagga

SEQ ID NO: 8121278 - DNA, 22 bp, Homo sapiens
atgctacagagataggttgggt

SEQ ID NO: 8121279 - DNA, 22 bp, Homo sapiens
gaagctccgtactatgactttt

SEQ ID NO: 8121280 - DNA, 22 bp, Homo sapiens
gaagcctggagaccagatgttg

SEQ ID NO: 8121281 - DNA, 22 bp, Homo sapiens
atgcagtgtttggaagcttaag

SEQ ID NO: 8121282 - DNA, 22 bp, Homo sapiens
gaaggatttgagattatcctag

SEQ ID NO: 8121283 - DNA, 22 bp, Homo sapiens
gaaggcaacaccaggatgcact

SEQ ID NO: 8121284 - DNA, 22 bp, Homo sapiens
atgcaggaggactaaagggatg

SEQ ID NO: 8121285 - DNA, 22 bp, Homo sapiens
gaaggagggagcggcgcggatt

SEQ ID NO: 8121286 - DNA, 22 bp, Homo sapiens
gaagagagcagcaaactggagt

SEQ ID NO: 8121287 - DNA, 22 bp, Homo sapiens
gaagagagagtggggttctgcg

SEQ ID NO: 8121288 - DNA, 22 bp, Homo sapiens
gaagagagccgcgggacatcag

SEQ ID NO: 8121289 - DNA, 22 bp, Homo sapiens
gaagagaaggtgtaggccatcc

SEQ ID NO: 8121290 - DNA, 22 bp, Homo sapiens
atgagcaggaagagcacaaaga

SEQ ID NO: 8121291 - DNA, 21 bp, Homo sapiens
gaagagagtcctcatcctgag

SEQ ID NO: 8121292 - DNA, 22 bp, Homo sapiens
atgatggaggtgtcctggattt

SEQ ID NO: 8121293 - DNA, 22 bp, Homo sapiens
atgatggaggccgtgatggacg

SEQ ID NO: 8121294 - DNA, 22 bp, Homo sapiens
gaagagctaaaggcacaggctt

SEQ ID NO: 8121295 - DNA, 22 bp, Homo sapiens
atgagatgtgtctaatggaacc

SEQ ID NO: 8121296 - DNA, 22 bp, Homo sapiens
atgagaaatttattacaagcta

SEQ ID NO: 8121297 - DNA, 22 bp, Homo sapiens
atgagaaggacataaattatag

SEQ ID NO: 8121298 - DNA, 22 bp, Homo sapiens
atgagacaagagtctaaattca

SEQ ID NO: 8121299 - DNA, 22 bp, Homo sapiens
atgagacacatgtgacttcttt

SEQ ID NO: 8121300 - DNA, 22 bp, Homo sapiens
atgagagactgtgtgttgggag

SEQ ID NO: 8121301 - DNA, 22 bp, Homo sapiens
ctttttatctcttaatgatgtt

SEQ ID NO: 8121302 - DNA, 22 bp, Homo sapiens
ctttttatctcttaatgatgtt

SEQ ID NO: 8121303 - DNA, 22 bp, Homo sapiens
ctttttatagctatgtcctatg

SEQ ID NO: 8121304 - DNA, 22 bp, Homo sapiens
cttttgttgcccttgtcgcagg

SEQ ID NO: 8121305 - DNA, 22 bp, Homo sapiens
ctttctttgcagtgagccagag

SEQ ID NO: 8121306 - DNA, 22 bp, Homo sapiens
ctttggaaagtaagcagctaga

SEQ ID NO: 8121307 - DNA, 22 bp, Homo sapiens
ctttggaacaagaagaaatggc

SEQ ID NO: 8121308 - DNA, 22 bp, Homo sapiens
ctttggaaaaatacctggcata

SEQ ID NO: 8121309 - DNA, 22 bp, Homo sapiens
ctttggaaaaagtgactggctc

SEQ ID NO: 8121310 - DNA, 22 bp, Homo sapiens
atgacactgtcctagtaaggaa

SEQ ID NO: 8121311 - DNA, 22 bp, Homo sapiens
atgacaaaagaagacatgaggt

SEQ ID NO: 8121312 - DNA, 22 bp, Homo sapiens
atgaatttttctaagcttttgt

SEQ ID NO: 8121313 - DNA, 22 bp, Homo sapiens
atctttcatctctattatttga

SEQ ID NO: 8121314 - DNA, 22 bp, Homo sapiens
atctttcagggccatttgtatt

SEQ ID NO: 8121315 - DNA, 22 bp, Homo sapiens
atctttcttatttgaagaaaga

SEQ ID NO: 8121316 - DNA, 22 bp, Homo sapiens
cttctccctggcttctgcacac

SEQ ID NO: 8121317 - DNA, 22 bp, Homo sapiens
cttctcctaaggtcagaattgc

SEQ ID NO: 8121318 - DNA, 22 bp, Homo sapiens
cttctcccaagtatgcagtttg

SEQ ID NO: 8121319 - DNA, 22 bp, Homo sapiens
cttctccccagaaaagatttct

SEQ ID NO: 8121320 - DNA, 18 bp, Homo sapiens
cttctcccatcttggcca

SEQ ID NO: 8121321 - DNA, 22 bp, Homo sapiens
atctggaatagcatggggttga

SEQ ID NO: 8121322 - DNA, 22 bp, Homo sapiens
atctggaatccttgtggacaat

SEQ ID NO: 8121323 - DNA, 22 bp, Homo sapiens
atctggaatcttgctgaccctg

SEQ ID NO: 8121324 - DNA, 22 bp, Homo sapiens
atctggaatgtctcattgggaa

SEQ ID NO: 8121325 - DNA, 22 bp, Homo sapiens
atctggaagttaagcttggtgc

SEQ ID NO: 8121326 - DNA, 22 bp, Homo sapiens
atctggaagtctccgaaggcag

SEQ ID NO: 8121327 - DNA, 22 bp, Homo sapiens
atctggaagtcagaggtttgca

SEQ ID NO: 8121328 - DNA, 17 bp, Homo sapiens
atctggaagctagctga

SEQ ID NO: 8121329 - DNA, 22 bp, Homo sapiens
atctggaagtaggagagtgggc

SEQ ID NO: 8121330 - DNA, 22 bp, Homo sapiens
atctggagaaaccgccaaggga

SEQ ID NO: 8121331 - DNA, 22 bp, Homo sapiens
atctggaattaagagaaagtga

SEQ ID NO: 8121332 - DNA, 22 bp, Homo sapiens
atctggaattgaagaggtttga

SEQ ID NO: 8121333 - DNA, 22 bp, Homo sapiens
ctttacagcctccagaaggaac

SEQ ID NO: 8121334 - DNA, 22 bp, Homo sapiens
atctttggccacttgtgctgca

SEQ ID NO: 8121335 - DNA, 22 bp, Homo sapiens
ctttagaaatctggatgtattt

SEQ ID NO: 8121336 - DNA, 22 bp, Homo sapiens
gtactattatatctaaatcact

SEQ ID NO: 8121337 - DNA, 22 bp, Homo sapiens
gtagaaatatttatctctgaga

SEQ ID NO: 8121338 - DNA, 22 bp, Homo sapiens
gtcagcacttttccgaggcaga

SEQ ID NO: 8121339 - DNA, 22 bp, Homo sapiens
gtcagcacctctttggggagct

SEQ ID NO: 8121340 - DNA, 19 bp, Homo sapiens
gtcagcaccatggacaggg

SEQ ID NO: 8121341 - DNA, 22 bp, Homo sapiens
cagcatccctcaggggcctctg

SEQ ID NO: 8121342 - DNA, 22 bp, Homo sapiens
cagcagtgtctccagcatcaca

SEQ ID NO: 8121343 - DNA, 22 bp, Homo sapiens
cagcatctaatcttcatgccgg

SEQ ID NO: 8121344 - DNA, 22 bp, Homo sapiens
gtattttatggcatgcagtggc

SEQ ID NO: 8121345 - DNA, 22 bp, Homo sapiens
gtattttacttacgcatgactt

SEQ ID NO: 8121346 - DNA, 22 bp, Homo sapiens
cagccctgtccaatgtctgctc

SEQ ID NO: 8121347 - DNA, 22 bp, Homo sapiens
cagccctgtccaatgtctgctc

SEQ ID NO: 8121348 - DNA, 22 bp, Homo sapiens
cagccctgtccagcagagggtg

SEQ ID NO: 8121349 - DNA, 22 bp, Homo sapiens
cagccctcctaccctgccaggc

SEQ ID NO: 8121350 - DNA, 22 bp, Homo sapiens
cagccctcctttcactcccagg

SEQ ID NO: 8121351 - DNA, 22 bp, Homo sapiens
cagccctcctaccctgccaggc

SEQ ID NO: 8121352 - DNA, 22 bp, Homo sapiens
gtgagagtgtttggaaatagaa

SEQ ID NO: 8121353 - DNA, 18 bp, Homo sapiens
gtgagcagagagcatcac

SEQ ID NO: 8121354 - DNA, 22 bp, Homo sapiens
gtgagagctgctccagatctct

SEQ ID NO: 8121355 - DNA, 22 bp, Homo sapiens
gtgagagggctgggctcatgat

SEQ ID NO: 8121356 - DNA, 22 bp, Homo sapiens
cagagccaacgccacctgccca

SEQ ID NO: 8121357 - DNA, 22 bp, Homo sapiens
cagagcattaaaaccagctctg

SEQ ID NO: 8121358 - DNA, 22 bp, Homo sapiens
gggatgagagctgggacagaag

SEQ ID NO: 8121359 - DNA, 22 bp, Homo sapiens
gggatgagagctgggacagaag

SEQ ID NO: 8121360 - DNA, 22 bp, Homo sapiens
gggatgagagctgggacagaag

SEQ ID NO: 8121361 - DNA, 22 bp, Homo sapiens
cagagaagaaagtgactataat

SEQ ID NO: 8121362 - DNA, 22 bp, Homo sapiens
cagagacaacctggtagagaaa

SEQ ID NO: 8121363 - DNA, 22 bp, Homo sapiens
cagagacaacctggtagagaaa

SEQ ID NO: 8121364 - DNA, 22 bp, Homo sapiens
cagagacacttaacaggaatgg

SEQ ID NO: 8121365 - DNA, 22 bp, Homo sapiens
cagacagaaggaaggccaacat

SEQ ID NO: 8121366 - DNA, 22 bp, Homo sapiens
cagacacacaccctggcctagc

SEQ ID NO: 8121367 - DNA, 22 bp, Homo sapiens
gggaggagtgaagattcacctg

SEQ ID NO: 8121368 - DNA, 22 bp, Homo sapiens
gggaggagtgaagattcacctg

SEQ ID NO: 8121369 - DNA, 22 bp, Homo sapiens
cagacacacaagcaatctaagt

SEQ ID NO: 8121370 - DNA, 22 bp, Homo sapiens
ggctggcaagtgtctgctcatg

SEQ ID NO: 8121371 - DNA, 22 bp, Homo sapiens
ggctggcaagtgtctgctcatg

SEQ ID NO: 8121372 - DNA, 22 bp, Homo sapiens
ggctggcacgaagccctgctgg

SEQ ID NO: 8121373 - DNA, 22 bp, Homo sapiens
ggctggcactgaggagagctct

SEQ ID NO: 8121374 - DNA, 20 bp, Homo sapiens
cagatatcagaagcacagcc

SEQ ID NO: 8121375 - DNA, 22 bp, Homo sapiens
ggtattagttgtatggctctgc

SEQ ID NO: 8121376 - DNA, 22 bp, Homo sapiens
cagatgaggacagatgactggg

SEQ ID NO: 8121377 - DNA, 22 bp, Homo sapiens
ggtattcacaatatttaaagag

SEQ ID NO: 8121378 - DNA, 22 bp, Homo sapiens
ggtattcaatcagtgttcattc

SEQ ID NO: 8121379 - DNA, 22 bp, Homo sapiens
gggttcagtccctcttgctact

SEQ ID NO: 8121380 - DNA, 22 bp, Homo sapiens
gggctggaggtgagcaggacag

SEQ ID NO: 8121381 - DNA, 19 bp, Homo sapiens
gggctggagggatagagcc

SEQ ID NO: 8121382 - DNA, 22 bp, Homo sapiens
gggctgtaggagctggaatggg

SEQ ID NO: 8121383 - DNA, 22 bp, Homo sapiens
gggctgtgcctcaggtggggtc

SEQ ID NO: 8121384 - DNA, 22 bp, Homo sapiens
ggggcagctaccggaagtaggg

SEQ ID NO: 8121385 - DNA, 21 bp, Homo sapiens
ggggcctctccacacagccgg

SEQ ID NO: 8121386 - DNA, 21 bp, Homo sapiens
ggggttggcaagagcagagac

SEQ ID NO: 8121387 - DNA, 22 bp, Homo sapiens
gggtacagttcttccagtgtca

SEQ ID NO: 8121388 - DNA, 22 bp, Homo sapiens
gctgccctgcatctgtgccttc

SEQ ID NO: 8121389 - DNA, 22 bp, Homo sapiens
gctgccctctctggccccacac

SEQ ID NO: 8121390 - DNA, 22 bp, Homo sapiens
gctgccctctctggccccacac

SEQ ID NO: 8121391 - DNA, 22 bp, Homo sapiens
caaagtgcagaaggaactgggt

SEQ ID NO: 8121392 - DNA, 22 bp, Homo sapiens
caaagtgctaggattacaggcc

SEQ ID NO: 8121393 - DNA, 22 bp, Homo sapiens
caaagtgcctgtaccactttgc

SEQ ID NO: 8121394 - DNA, 22 bp, Homo sapiens
gctgccctccagttcccacagt

SEQ ID NO: 8121395 - DNA, 18 bp, Homo sapiens
gctgccctagctcccctc

SEQ ID NO: 8121396 - DNA, 22 bp, Homo sapiens
caaagtgctaggattacaggcg

SEQ ID NO: 8121397 - DNA, 22 bp, Homo sapiens
caaagtgctaggattataggtg

SEQ ID NO: 8121398 - DNA, 22 bp, Homo sapiens
caaagtccatagtttacaatag

SEQ ID NO: 8121399 - DNA, 22 bp, Homo sapiens
caaagtcctagaacagtgcttg

SEQ ID NO: 8121400 - DNA, 22 bp, Homo sapiens
gctctggatccggctgggtctg

SEQ ID NO: 8121401 - DNA, 22 bp, Homo sapiens
gctctggaggctggaagaccat

SEQ ID NO: 8121402 - DNA, 23 bp, Homo sapiens
gctctggagctgggcctggcagg

SEQ ID NO: 8121403 - DNA, 22 bp, Homo sapiens
caagaaattctgttcagatagc

SEQ ID NO: 8121404 - DNA, 22 bp, Homo sapiens
caagaaatttcttaagaactaa

SEQ ID NO: 8121405 - DNA, 22 bp, Homo sapiens
gctgcctgatgtccagcaggac

SEQ ID NO: 8121406 - DNA, 22 bp, Homo sapiens
caacacattgaagctatgatga

SEQ ID NO: 8121407 - DNA, 22 bp, Homo sapiens
caacacaggttctgcaaaggaa

SEQ ID NO: 8121408 - DNA, 22 bp, Homo sapiens
caacacagccattcccctagaa

SEQ ID NO: 8121409 - DNA, 22 bp, Homo sapiens
caacaatatgccagactcaatt

SEQ ID NO: 8121410 - DNA, 22 bp, Homo sapiens
gctgccctgtccggctctcctg

SEQ ID NO: 8121411 - DNA, 22 bp, Homo sapiens
caagcctcagaatcttctccat

SEQ ID NO: 8121412 - DNA, 22 bp, Homo sapiens
caagctccttacatccacaggg

SEQ ID NO: 8121413 - DNA, 20 bp, Homo sapiens
gctgggctttgactgacaca

SEQ ID NO: 8121414 - DNA, 20 bp, Homo sapiens
gctggaagggctagagggct

SEQ ID NO: 8121415 - DNA, 22 bp, Homo sapiens
caagaatataaatactttcaaa

SEQ ID NO: 8121416 - DNA, 22 bp, Homo sapiens
caagaatataaatactttcaaa

SEQ ID NO: 8121417 - DNA, 22 bp, Homo sapiens
caagaatatatatggagtggag

SEQ ID NO: 8121418 - DNA, 22 bp, Homo sapiens
caagaatagctacctcccatat

SEQ ID NO: 8121419 - DNA, 22 bp, Homo sapiens
caagaataaccagacaatagca

SEQ ID NO: 8121420 - DNA, 22 bp, Homo sapiens
gctggaattggacccagggctc

SEQ ID NO: 8121421 - DNA, 22 bp, Homo sapiens
gctggacttcatgcattcctgt

SEQ ID NO: 8121422 - DNA, 22 bp, Homo sapiens
caagaataaaatacatgttgat

SEQ ID NO: 8121423 - DNA, 22 bp, Homo sapiens
caagaagaggtgattggtaagt

SEQ ID NO: 8121424 - DNA, 22 bp, Homo sapiens
caattgtcgttgacatccttca

SEQ ID NO: 8121425 - DNA, 22 bp, Homo sapiens
caatttcaatacaaaatacatt

SEQ ID NO: 8121426 - DNA, 22 bp, Homo sapiens
caatttcaatgaggccacaggg

SEQ ID NO: 8121427 - DNA, 22 bp, Homo sapiens
caatttcagtgctgtggagagg

SEQ ID NO: 8121428 - DNA, 22 bp, Homo sapiens
caatttcactaatgatgtgggg

SEQ ID NO: 8121429 - DNA, 20 bp, Homo sapiens
caatttcatcatttcctgtg

SEQ ID NO: 8121430 - DNA, 22 bp, Homo sapiens
caaggctgcttcagactagtga

SEQ ID NO: 8121431 - DNA, 22 bp, Homo sapiens
caaggctgtgcagggtccatat

SEQ ID NO: 8121432 - DNA, 22 bp, Homo sapiens
caaggctgcaaaactacatggg

SEQ ID NO: 8121433 - DNA, 22 bp, Homo sapiens
caatatataatgagtactttcc

SEQ ID NO: 8121434 - DNA, 22 bp, Homo sapiens
caatagtatttattgaacacct

SEQ ID NO: 8121435 - DNA, 20 bp, Homo sapiens
ggaagctgtgggtccccagg

SEQ ID NO: 8121436 - DNA, 22 bp, Homo sapiens
ggaagctgtgctctcaggcctc

SEQ ID NO: 8121437 - DNA, 22 bp, Homo sapiens
ggaagctggtaattgttgggac

SEQ ID NO: 8121438 - DNA, 22 bp, Homo sapiens
ggaagctgccagtccaccagct

SEQ ID NO: 8121439 - DNA, 22 bp, Homo sapiens
ggacattgaagctggaaaggga

SEQ ID NO: 8121440 - DNA, 22 bp, Homo sapiens
ggagaaggcgaagtcattcttt

SEQ ID NO: 8121441 - DNA, 22 bp, Homo sapiens
cacacaggagagtgctggaggt

SEQ ID NO: 8121442 - DNA, 22 bp, Homo sapiens
ggagaagggtatgtgtggcgga

SEQ ID NO: 8121443 - DNA, 22 bp, Homo sapiens
ggagaagggcatggtagtttta

SEQ ID NO: 8121444 - DNA, 22 bp, Homo sapiens
ggagaaggtgctggtcactgtg

SEQ ID NO: 8121445 - DNA, 22 bp, Homo sapiens
cacaggtgtatgaatatgtcca

SEQ ID NO: 8121446 - DNA, 22 bp, Homo sapiens
cacaggtgtccaatacctgctt

SEQ ID NO: 8121447 - DNA, 23 bp, Homo sapiens
cacaggtgtttcatcttctcagt

SEQ ID NO: 8121448 - DNA, 22 bp, Homo sapiens
cacaggtgtttgttatactcag

SEQ ID NO: 8121449 - DNA, 22 bp, Homo sapiens
cacaggtgttcttgcagtgaaa

SEQ ID NO: 8121450 - DNA, 22 bp, Homo sapiens
ggcaaggtgatgaatgtctaca

SEQ ID NO: 8121451 - DNA, 23 bp, Homo sapiens
cacaggcagaaatcaagacggta

SEQ ID NO: 8121452 - DNA, 22 bp, Homo sapiens
cacaggcacgcctctggccagg

SEQ ID NO: 8121453 - DNA, 18 bp, Homo sapiens
cacaggcaggtgataggt

SEQ ID NO: 8121454 - DNA, 22 bp, Homo sapiens
ggcagaggtgacagtgtctttt

SEQ ID NO: 8121455 - DNA, 22 bp, Homo sapiens
cacatgcaggagccaatgtaca

SEQ ID NO: 8121456 - DNA, 22 bp, Homo sapiens
cacatgcaagtcctcagttcta

SEQ ID NO: 8121457 - DNA, 22 bp, Homo sapiens
cacatgcaccagaaatcaacat

SEQ ID NO: 8121458 - DNA, 22 bp, Homo sapiens
ggcaattacgtattagtcatgt

SEQ ID NO: 8121459 - DNA, 21 bp, Homo sapiens
ggcaattaggcttctgagtat

SEQ ID NO: 8121460 - DNA, 22 bp, Homo sapiens
ggcaatatggaagctacagaga

SEQ ID NO: 8121461 - DNA, 22 bp, Homo sapiens
ggcaatatttatataggcaagg

SEQ ID NO: 8121462 - DNA, 22 bp, Homo sapiens
cacatgttcttgaagccaactc

SEQ ID NO: 8121463 - DNA, 22 bp, Homo sapiens
cacattccccagagctggggct

SEQ ID NO: 8121464 - DNA, 22 bp, Homo sapiens
cacttcagctacaatcacatga

SEQ ID NO: 8121465 - DNA, 22 bp, Homo sapiens
cactgtactgggttgaaggacg

SEQ ID NO: 8121466 - DNA, 21 bp, Homo sapiens
cactgtatagcaggagaaaac

SEQ ID NO: 8121467 - DNA, 22 bp, Homo sapiens
cactgcactccagcctgggtca

SEQ ID NO: 8121468 - DNA, 22 bp, Homo sapiens
cactgcactccagcctgggcaa

SEQ ID NO: 8121469 - DNA, 22 bp, Homo sapiens
cactgcactccagcttgggtga

SEQ ID NO: 8121470 - DNA, 22 bp, Homo sapiens
cactgcactccagcctgggtga

SEQ ID NO: 8121471 - DNA, 22 bp, Homo sapiens
caccaggctggagtgcagaggt

SEQ ID NO: 8121472 - DNA, 22 bp, Homo sapiens
caccaggctggagtgcagaggt

SEQ ID NO: 8121473 - DNA, 22 bp, Homo sapiens
caccctggctggaggtgcagtg

SEQ ID NO: 8121474 - DNA, 22 bp, Homo sapiens
cacctgcctgcaggggctccac

SEQ ID NO: 8121475 - DNA, 22 bp, Homo sapiens
caccaggctgaaccagagggga

SEQ ID NO: 8121476 - DNA, 22 bp, Homo sapiens
caccaggcacagctctcctgct

SEQ ID NO: 8121477 - DNA, 22 bp, Homo sapiens
caccaggctgaaccagagggga

SEQ ID NO: 8121478 - DNA, 22 bp, Homo sapiens
caccaggctgaaccagagggga

SEQ ID NO: 8121479 - DNA, 22 bp, Homo sapiens
caccaggctgcccaggacaggg

SEQ ID NO: 8121480 - DNA, 22 bp, Homo sapiens
caccaggctgcccaggacaggg

SEQ ID NO: 8121481 - DNA, 22 bp, Homo sapiens
cacctgggctaaactatgcagg

SEQ ID NO: 8121482 - DNA, 22 bp, Homo sapiens
cacctggctgtgaagcctgggt

SEQ ID NO: 8121483 - DNA, 22 bp, Homo sapiens
ggccaggctggtctcagacttc

SEQ ID NO: 8121484 - DNA, 22 bp, Homo sapiens
ggccaggctggttccttgacct

SEQ ID NO: 8121485 - DNA, 22 bp, Homo sapiens
ggccaggctgccctgggagcag

SEQ ID NO: 8121486 - DNA, 22 bp, Homo sapiens
ggccaggctggtctcagacttc

SEQ ID NO: 8121487 - DNA, 22 bp, Homo sapiens
ggccaggctgctgggaccccgc

SEQ ID NO: 8121488 - DNA, 22 bp, Homo sapiens
ggccaggctgccctgggagcag

SEQ ID NO: 8121489 - DNA, 22 bp, Homo sapiens
ggccaggctgctgggaccccgc

SEQ ID NO: 8121490 - DNA, 22 bp, Homo sapiens
cacgcctgtaatcccagcactt

SEQ ID NO: 8121491 - DNA, 22 bp, Homo sapiens
cacgctggtcattgtagtccag

SEQ ID NO: 8121492 - DNA, 21 bp, Homo sapiens
cactatttatatatgccagct

SEQ ID NO: 8121493 - DNA, 22 bp, Homo sapiens
cactcatattggaacaagcttg

SEQ ID NO: 8121494 - DNA, 22 bp, Homo sapiens
cactctccagcacaccccattt

SEQ ID NO: 8121495 - DNA, 22 bp, Homo sapiens
cactctccagcacaccccattt

SEQ ID NO: 8121496 - DNA, 22 bp, Homo sapiens
cactccctctagttgcattctg

SEQ ID NO: 8121497 - DNA, 22 bp, Homo sapiens
cactgcactccagcctgggaga

SEQ ID NO: 8121498 - DNA, 21 bp, Homo sapiens
cactctcccaatccttgctga

SEQ ID NO: 8121499 - DNA, 22 bp, Homo sapiens
caggctgggcagcctccccggc

SEQ ID NO: 8121500 - DNA, 22 bp, Homo sapiens
tagaatatgattaattttctta

SEQ ID NO: 8121501 - DNA, 22 bp, Homo sapiens
caggctgggctccggagataaa

SEQ ID NO: 8121502 - DNA, 22 bp, Homo sapiens
caggctgggctggtgttagagt

SEQ ID NO: 8121503 - DNA, 22 bp, Homo sapiens
caggctggtcccagagcattgc

SEQ ID NO: 8121504 - DNA, 22 bp, Homo sapiens
tagataaaagggcaaagggcat

SEQ ID NO: 8121505 - DNA, 22 bp, Homo sapiens
tagagtgtaatacaaactaaac

SEQ ID NO: 8121506 - DNA, 19 bp, Homo sapiens
tagaggagaagggaagtgg

SEQ ID NO: 8121507 - DNA, 22 bp, Homo sapiens
tagcaatgcttcattatttaaa

SEQ ID NO: 8121508 - DNA, 22 bp, Homo sapiens
tagataatttggcatcatattg

SEQ ID NO: 8121509 - DNA, 22 bp, Homo sapiens
cagccctgtctatgactgatga

SEQ ID NO: 8121510 - DNA, 20 bp, Homo sapiens
cagccctgtgacctggccct

SEQ ID NO: 8121511 - DNA, 22 bp, Homo sapiens
gtgaggggagtaaagccatgtt

SEQ ID NO: 8121512 - DNA, 22 bp, Homo sapiens
gtgaggggtctggacgcacagt

SEQ ID NO: 8121513 - DNA, 22 bp, Homo sapiens
gtgaggggccaagagtagggca

SEQ ID NO: 8121514 - DNA, 22 bp, Homo sapiens
gtgaggggtggctgagcagttt

SEQ ID NO: 8121515 - DNA, 22 bp, Homo sapiens
tactatttggaattttaaattg

SEQ ID NO: 8121516 - DNA, 22 bp, Homo sapiens
tactgtctctgccctggccagg

SEQ ID NO: 8121517 - DNA, 22 bp, Homo sapiens
tactgtctggagttgccaaagg

SEQ ID NO: 8121518 - DNA, 18 bp, Homo sapiens
tagaatataggtcattct

SEQ ID NO: 8121519 - DNA, 22 bp, Homo sapiens
tagaatatacactacagcttaa

SEQ ID NO: 8121520 - DNA, 19 bp, Homo sapiens
tagaatagttacacagatt

SEQ ID NO: 8121521 - DNA, 22 bp, Homo sapiens
tagaatagtggctggcatattt

SEQ ID NO: 8121522 - DNA, 22 bp, Homo sapiens
tagaatagtgttttcattatgg

SEQ ID NO: 8121523 - DNA, 22 bp, Homo sapiens
caggctggagtgcagtggggcg

SEQ ID NO: 8121524 - DNA, 22 bp, Homo sapiens
caggctggagtgcagtggcgct

SEQ ID NO: 8121525 - DNA, 22 bp, Homo sapiens
caggctggagtgcaatggtgct

SEQ ID NO: 8121526 - DNA, 22 bp, Homo sapiens
caggctggagtgcagtggcgcc

SEQ ID NO: 8121527 - DNA, 22 bp, Homo sapiens
caggctggagtgcaatggcaca

SEQ ID NO: 8121528 - DNA, 22 bp, Homo sapiens
caggctggagtgcaatgacgcc

SEQ ID NO: 8121529 - DNA, 22 bp, Homo sapiens
caggctggagtgagtgtagtgg

SEQ ID NO: 8121530 - DNA, 22 bp, Homo sapiens
caggctggagtacaattgtgtg

SEQ ID NO: 8121531 - DNA, 22 bp, Homo sapiens
caggctgcctggaagaggactg

SEQ ID NO: 8121532 - DNA, 22 bp, Homo sapiens
tactgtgacagagtacttaaac

SEQ ID NO: 8121533 - DNA, 22 bp, Homo sapiens
tactgtctgggttcccaagcaa

SEQ ID NO: 8121534 - DNA, 22 bp, Homo sapiens
tactgtgaatacaaaataaatt

SEQ ID NO: 8121535 - DNA, 22 bp, Homo sapiens
cagggtggcaggcaccatggcc

SEQ ID NO: 8121536 - DNA, 22 bp, Homo sapiens
tatcataagttaattaaacagt

SEQ ID NO: 8121537 - DNA, 22 bp, Homo sapiens
caggggaaggagccttgaaact

SEQ ID NO: 8121538 - DNA, 22 bp, Homo sapiens
caggggaagatgccaagggaga

SEQ ID NO: 8121539 - DNA, 18 bp, Homo sapiens
cagggctgtggggtcact

SEQ ID NO: 8121540 - DNA, 22 bp, Homo sapiens
taggtacacagtaagtgctcaa

SEQ ID NO: 8121541 - DNA, 22 bp, Homo sapiens
taggtacatggaattggacatt

SEQ ID NO: 8121542 - DNA, 22 bp, Homo sapiens
taggtacagtttctggtgtctt

SEQ ID NO: 8121543 - DNA, 22 bp, Homo sapiens
tagggcaggtgaagaaaagcta

SEQ ID NO: 8121544 - DNA, 22 bp, Homo sapiens
tagggcaggggaggaatctgaa

SEQ ID NO: 8121545 - DNA, 21 bp, Homo sapiens
tagggcaggcattggaagaga

SEQ ID NO: 8121546 - DNA, 21 bp, Homo sapiens
tagggcaggcattggaagaga

SEQ ID NO: 8121547 - DNA, 22 bp, Homo sapiens
tagggctccactcccagagatt

SEQ ID NO: 8121548 - DNA, 22 bp, Homo sapiens
tagggtagtaccatgctgccag

SEQ ID NO: 8121549 - DNA, 22 bp, Homo sapiens
tagctatttggaaaattccaat

SEQ ID NO: 8121550 - DNA, 22 bp, Homo sapiens
tagctattgttggtagttaccc

SEQ ID NO: 8121551 - DNA, 22 bp, Homo sapiens
taggaaattttactggtctggg

SEQ ID NO: 8121552 - DNA, 22 bp, Homo sapiens
cagggctcactcggctggcgtc

SEQ ID NO: 8121553 - DNA, 22 bp, Homo sapiens
cagggctcaggctctgggattc

SEQ ID NO: 8121554 - DNA, 22 bp, Homo sapiens
cagggctcagggactgcagaaa

SEQ ID NO: 8121555 - DNA, 22 bp, Homo sapiens
cagggcctggagctgggcctgc

SEQ ID NO: 8121556 - DNA, 22 bp, Homo sapiens
cagttacataaatgataaaatg

SEQ ID NO: 8121557 - DNA, 22 bp, Homo sapiens
tcagagaaatgaagtagggatt

SEQ ID NO: 8121558 - DNA, 22 bp, Homo sapiens
tcagagaaataattgctgagtt

SEQ ID NO: 8121559 - DNA, 22 bp, Homo sapiens
tcagagaacacagaggtgatgt

SEQ ID NO: 8121560 - DNA, 22 bp, Homo sapiens
tcagagaaatgctgagctcatg

SEQ ID NO: 8121561 - DNA, 23 bp, Homo sapiens
tcagaagtgggatacaaagctga

SEQ ID NO: 8121562 - DNA, 22 bp, Homo sapiens
tcagaagtgctgtccttatccc

SEQ ID NO: 8121563 - DNA, 21 bp, Homo sapiens
tcagaagtgcagcccaggaat

SEQ ID NO: 8121564 - DNA, 20 bp, Homo sapiens
tcagaagtgcagctgcccct

SEQ ID NO: 8121565 - DNA, 22 bp, Homo sapiens
tcagactgaccgaagcatctgg

SEQ ID NO: 8121566 - DNA, 22 bp, Homo sapiens
tcagactgtgtcataagtaggt

SEQ ID NO: 8121567 - DNA, 22 bp, Homo sapiens
tcagactgtttgcaccataggc

SEQ ID NO: 8121568 - DNA, 23 bp, Homo sapiens
cagtgtgacgaggtgaggcaggc

SEQ ID NO: 8121569 - DNA, 22 bp, Homo sapiens
cagtgcccaagatgtgccatgc

SEQ ID NO: 8121570 - DNA, 22 bp, Homo sapiens
cagtggctgtgaccagggacct

SEQ ID NO: 8121571 - DNA, 22 bp, Homo sapiens
cagtggctgagagtggacactg

SEQ ID NO: 8121572 - DNA, 22 bp, Homo sapiens
cagtggctgtttctggaaggca

SEQ ID NO: 8121573 - DNA, 20 bp, Homo sapiens
cagtggcttctgtggaatat

SEQ ID NO: 8121574 - DNA, 22 bp, Homo sapiens
tatttcatgtgcaccataattc

SEQ ID NO: 8121575 - DNA, 22 bp, Homo sapiens
tatttccaaaaaggccatattc

SEQ ID NO: 8121576 - DNA, 22 bp, Homo sapiens
tatttataacagtgagaacggg

SEQ ID NO: 8121577 - DNA, 22 bp, Homo sapiens
caggttctgggtcctgggtcct

SEQ ID NO: 8121578 - DNA, 22 bp, Homo sapiens
caggtgttatacatgaaattta

SEQ ID NO: 8121579 - DNA, 22 bp, Homo sapiens
caggtgttttttattctgaaag

SEQ ID NO: 8121580 - DNA, 22 bp, Homo sapiens
tatttctttcaggtatgtgttg

SEQ ID NO: 8121581 - DNA, 22 bp, Homo sapiens
tatttcttgttccctccaagtt

SEQ ID NO: 8121582 - DNA, 22 bp, Homo sapiens
tatttccaagctgaatccaatg

SEQ ID NO: 8121583 - DNA, 22 bp, Homo sapiens
tatttccaagctgaatccaatg

SEQ ID NO: 8121584 - DNA, 22 bp, Homo sapiens
cagtatatgctctttcatcaaa

SEQ ID NO: 8121585 - DNA, 22 bp, Homo sapiens
cagtagtctttttcctcctaga

SEQ ID NO: 8121586 - DNA, 22 bp, Homo sapiens
cagtaggaaggatgcagaaaaa

SEQ ID NO: 8121587 - DNA, 22 bp, Homo sapiens
cagtgagaccttctaaggtggt

SEQ ID NO: 8121588 - DNA, 22 bp, Homo sapiens
cagtgaagtttaaagtgtagat

SEQ ID NO: 8121589 - DNA, 22 bp, Homo sapiens
tcacagacgcctcccctcgcct

SEQ ID NO: 8121590 - DNA, 22 bp, Homo sapiens
tcacagacgcatcctcaggtag

SEQ ID NO: 8121591 - DNA, 22 bp, Homo sapiens
tcacagactcaagggcatagga

SEQ ID NO: 8121592 - DNA, 22 bp, Homo sapiens
tcacagacctggtgggaggtgg

SEQ ID NO: 8121593 - DNA, 22 bp, Homo sapiens
cagtgaggaagctgtctggacc

SEQ ID NO: 8121594 - DNA, 22 bp, Homo sapiens
tcacaaatattttaacagtagg

SEQ ID NO: 8121595 - DNA, 22 bp, Homo sapiens
tcacaaatcattttatctgtgt

SEQ ID NO: 8121596 - DNA, 22 bp, Homo sapiens
tcacaaatcgaagccttataat

SEQ ID NO: 8121597 - DNA, 22 bp, Homo sapiens
tcacaacaggaaggaccagctg

SEQ ID NO: 8121598 - DNA, 22 bp, Homo sapiens
tcacagactcttgattgtctaa

SEQ ID NO: 8121599 - DNA, 22 bp, Homo sapiens
tcacagactggtcagtcaactt

SEQ ID NO: 8121600 - DNA, 21 bp, Homo sapiens
tcacagactggtcagtgaggc

SEQ ID NO: 8121601 - DNA, 22 bp, Homo sapiens
tcacagactgtgttgctactca

SEQ ID NO: 8121602 - DNA, 22 bp, Homo sapiens
tcacagacttgtctccagggat

SEQ ID NO: 8121603 - DNA, 18 bp, Homo sapiens
tcacagacttactgggcc

SEQ ID NO: 8121604 - DNA, 22 bp, Homo sapiens
tcacaggaccctgagggtggcg

SEQ ID NO: 8121605 - DNA, 22 bp, Homo sapiens
tcacaggaccctgagggtggcg

SEQ ID NO: 8121606 - DNA, 22 bp, Homo sapiens
tcacaggagagctgatgctggt

SEQ ID NO: 8121607 - DNA, 22 bp, Homo sapiens
tcacaggaggaacctggcctgg

SEQ ID NO: 8121608 - DNA, 22 bp, Homo sapiens
tcacaggagattatgtgtgcta

SEQ ID NO: 8121609 - DNA, 20 bp, Homo sapiens
tcacaggagggaaggcaggt

SEQ ID NO: 8121610 - DNA, 22 bp, Homo sapiens
tcccagccacagtttccacctg

SEQ ID NO: 8121611 - DNA, 22 bp, Homo sapiens
tcccagccaggctctaccactt

SEQ ID NO: 8121612 - DNA, 22 bp, Homo sapiens
tcccagccaggctctaccactt

SEQ ID NO: 8121613 - DNA, 21 bp, Homo sapiens
tcccactctaaatggactgaa

SEQ ID NO: 8121614 - DNA, 22 bp, Homo sapiens
catgttatttatccattaaaca

SEQ ID NO: 8121615 - DNA, 17 bp, Homo sapiens
cattcagagtaattaca

SEQ ID NO: 8121616 - DNA, 22 bp, Homo sapiens
tccccactcctgggcagatgcg

SEQ ID NO: 8121617 - DNA, 22 bp, Homo sapiens
tcccaggaggtgcttcctagga

SEQ ID NO: 8121618 - DNA, 22 bp, Homo sapiens
cattgaaatatggaaactgatg

SEQ ID NO: 8121619 - DNA, 22 bp, Homo sapiens
cattgaaacctaacataggctg

SEQ ID NO: 8121620 - DNA, 22 bp, Homo sapiens
cattgaaagagataaagccttt

SEQ ID NO: 8121621 - DNA, 22 bp, Homo sapiens
tccccactgggcctcctctttc

SEQ ID NO: 8121622 - DNA, 22 bp, Homo sapiens
tccccactctgggccaccacaa

SEQ ID NO: 8121623 - DNA, 22 bp, Homo sapiens
tccccactctctcctggagctt

SEQ ID NO: 8121624 - DNA, 22 bp, Homo sapiens
tccccactctgggccaccacaa

SEQ ID NO: 8121625 - DNA, 22 bp, Homo sapiens
tcctctccaggtgagccgaaat

SEQ ID NO: 8121626 - DNA, 21 bp, Homo sapiens
tcctctccatgatctgtttgt

SEQ ID NO: 8121627 - DNA, 22 bp, Homo sapiens
tcctctccatattttctgattt

SEQ ID NO: 8121628 - DNA, 22 bp, Homo sapiens
tcctctccatattttctgattt

SEQ ID NO: 8121629 - DNA, 22 bp, Homo sapiens
tcctcagcttttatttcacttg

SEQ ID NO: 8121630 - DNA, 22 bp, Homo sapiens
tccctagtcgcatctgtggaga

SEQ ID NO: 8121631 - DNA, 22 bp, Homo sapiens
tcctagaagatggatcagagaa

SEQ ID NO: 8121632 - DNA, 22 bp, Homo sapiens
tccagctcttcagttctgcaaa

SEQ ID NO: 8121633 - DNA, 19 bp, Homo sapiens
tccagactgtccaggctat

SEQ ID NO: 8121634 - DNA, 22 bp, Homo sapiens
tccagactgttcacattggcat

SEQ ID NO: 8121635 - DNA, 22 bp, Homo sapiens
tccagactggggccatgtctgc

SEQ ID NO: 8121636 - DNA, 22 bp, Homo sapiens
tccaggctcccctgcgtgctcc

SEQ ID NO: 8121637 - DNA, 19 bp, Homo sapiens
tccaggctccattggcaga

SEQ ID NO: 8121638 - DNA, 22 bp, Homo sapiens
tccaggctcagtcaagcacttc

SEQ ID NO: 8121639 - DNA, 18 bp, Homo sapiens
tccaggctccaggctaac

SEQ ID NO: 8121640 - DNA, 22 bp, Homo sapiens
tccaggctccctcaggatgcac

SEQ ID NO: 8121641 - DNA, 22 bp, Homo sapiens
tccaggctcccctgcgtgctcc

SEQ ID NO: 8121642 - DNA, 22 bp, Homo sapiens
tcatttatcatttgtgctgtag

SEQ ID NO: 8121643 - DNA, 22 bp, Homo sapiens
tcatttatgcaggaatggcata

SEQ ID NO: 8121644 - DNA, 21 bp, Homo sapiens
tcatttattgagaaatgactg

SEQ ID NO: 8121645 - DNA, 22 bp, Homo sapiens
tcatttatgtctttgccatcca

SEQ ID NO: 8121646 - DNA, 22 bp, Homo sapiens
tcatttatgcaggaatggcata

SEQ ID NO: 8121647 - DNA, 22 bp, Homo sapiens
tcattccttatccgtatctttt

SEQ ID NO: 8121648 - DNA, 20 bp, Homo sapiens
tccaagccctccttccattc

SEQ ID NO: 8121649 - DNA, 17 bp, Homo sapiens
tccaagccagcttgcct

SEQ ID NO: 8121650 - DNA, 22 bp, Homo sapiens
tccagacattttatagcagtct

SEQ ID NO: 8121651 - DNA, 22 bp, Homo sapiens
catctttgtttcatctgtccag

SEQ ID NO: 8121652 - DNA, 22 bp, Homo sapiens
tctccctcattcctgcttccat

SEQ ID NO: 8121653 - DNA, 22 bp, Homo sapiens
tctccctctttgtctgctttgg

SEQ ID NO: 8121654 - DNA, 22 bp, Homo sapiens
tctccagaggtcccttgtctct

SEQ ID NO: 8121655 - DNA, 22 bp, Homo sapiens
tctccactctgagtgcctttca

SEQ ID NO: 8121656 - DNA, 22 bp, Homo sapiens
tctccactattttctagctctt

SEQ ID NO: 8121657 - DNA, 18 bp, Homo sapiens
tctccacttctgtgagaa

SEQ ID NO: 8121658 - DNA, 22 bp, Homo sapiens
tctccacaagctttctcctttt

SEQ ID NO: 8121659 - DNA, 22 bp, Homo sapiens
tctccacactttctctcccagg

SEQ ID NO: 8121660 - DNA, 22 bp, Homo sapiens
tctccacaccagaaggagctga

SEQ ID NO: 8121661 - DNA, 22 bp, Homo sapiens
tctccacagaaggttccaggcc

SEQ ID NO: 8121662 - DNA, 22 bp, Homo sapiens
tctccacagtcccacctcgctt

SEQ ID NO: 8121663 - DNA, 22 bp, Homo sapiens
ccacctcctcggccatgtgacg

SEQ ID NO: 8121664 - DNA, 22 bp, Homo sapiens
ccacctcctaggcctggagaag

SEQ ID NO: 8121665 - DNA, 22 bp, Homo sapiens
ccacctctcagggtttcctaat

SEQ ID NO: 8121666 - DNA, 22 bp, Homo sapiens
ccaccagcagtgtgcaaggatt

SEQ ID NO: 8121667 - DNA, 22 bp, Homo sapiens
tcgcccaggctggaagtgcagt

SEQ ID NO: 8121668 - DNA, 22 bp, Homo sapiens
tcgctgaggctgcacggctgcc

SEQ ID NO: 8121669 - DNA, 22 bp, Homo sapiens
ccaccaggacagccctgagggg

SEQ ID NO: 8121670 - DNA, 22 bp, Homo sapiens
ccacccttccattcttcctctt

SEQ ID NO: 8121671 - DNA, 21 bp, Homo sapiens
tcctctgcagtgaggtggcct

SEQ ID NO: 8121672 - DNA, 22 bp, Homo sapiens
tcctctccatgtctcacgccac

SEQ ID NO: 8121673 - DNA, 21 bp, Homo sapiens
tcctctccatgatctgtttgt

SEQ ID NO: 8121674 - DNA, 22 bp, Homo sapiens
tcctctccatgtctcacgccac

SEQ ID NO: 8121675 - DNA, 18 bp, Homo sapiens
tcctctctttccccaggg

SEQ ID NO: 8121676 - DNA, 18 bp, Homo sapiens
tcctctctttccccaggg

SEQ ID NO: 8121677 - DNA, 22 bp, Homo sapiens
ccacatttggagaagatacttt

SEQ ID NO: 8121678 - DNA, 22 bp, Homo sapiens
ccacattgactgtctgtagatt

SEQ ID NO: 8121679 - DNA, 22 bp, Homo sapiens
ccacatctgcagtcccttctgt

SEQ ID NO: 8121680 - DNA, 22 bp, Homo sapiens
ccacatctcggtcccctctttg

SEQ ID NO: 8121681 - DNA, 22 bp, Homo sapiens
ccagcagcaggccaggccctcc

SEQ ID NO: 8121682 - DNA, 22 bp, Homo sapiens
ccagcagccaccttctcgaaat

SEQ ID NO: 8121683 - DNA, 22 bp, Homo sapiens
ccagcagcatcctgcagcactt

SEQ ID NO: 8121684 - DNA, 22 bp, Homo sapiens
ccagcagcccacaggcgtccct

SEQ ID NO: 8121685 - DNA, 22 bp, Homo sapiens
ccagcagggaaaaacccaccaa

SEQ ID NO: 8121686 - DNA, 22 bp, Homo sapiens
ccagcagggcagtgccctggac

SEQ ID NO: 8121687 - DNA, 22 bp, Homo sapiens
ccagcagctttattggctctcc

SEQ ID NO: 8121688 - DNA, 21 bp, Homo sapiens
ccagcagctcaaggatctctt

SEQ ID NO: 8121689 - DNA, 22 bp, Homo sapiens
ccagcagctccctcagggtccg

SEQ ID NO: 8121690 - DNA, 22 bp, Homo sapiens
ccagcagctgacaccagtccca

SEQ ID NO: 8121691 - DNA, 22 bp, Homo sapiens
ccagcagctgacaccagtccca

SEQ ID NO: 8121692 - DNA, 22 bp, Homo sapiens
tctcctggctcaccaggctgga

SEQ ID NO: 8121693 - DNA, 22 bp, Homo sapiens
tctctcttgtcaccccatctgc

SEQ ID NO: 8121694 - DNA, 23 bp, Homo sapiens
tctctgagttgtactttcccttg

SEQ ID NO: 8121695 - DNA, 22 bp, Homo sapiens
tctctgccacagcttctgcctt

SEQ ID NO: 8121696 - DNA, 22 bp, Homo sapiens
tctctgcccaagtttctcaagt

SEQ ID NO: 8121697 - DNA, 22 bp, Homo sapiens
tctctgcccaagtttctcaagt

SEQ ID NO: 8121698 - DNA, 19 bp, Homo sapiens
ccagccctgtcacttcttg

SEQ ID NO: 8121699 - DNA, 22 bp, Homo sapiens
ccagcccttagataaacctggc

SEQ ID NO: 8121700 - DNA, 19 bp, Homo sapiens
ccagccctgtcacttcttg

SEQ ID NO: 8121701 - DNA, 22 bp, Homo sapiens
ccagcatttgcatggtgttaaa

SEQ ID NO: 8121702 - DNA, 22 bp, Homo sapiens
tctgcagaaggaatcagctgag

SEQ ID NO: 8121703 - DNA, 19 bp, Homo sapiens
tctgcagaaggcatacatg

SEQ ID NO: 8121704 - DNA, 19 bp, Homo sapiens
tctgaagtccagggcatac

SEQ ID NO: 8121705 - DNA, 19 bp, Homo sapiens
tctgaagtccagggcatac

SEQ ID NO: 8121706 - DNA, 22 bp, Homo sapiens
tctgaagttcttaaattagttt

SEQ ID NO: 8121707 - DNA, 22 bp, Homo sapiens
tctgaaatgacctttccccact

SEQ ID NO: 8121708 - DNA, 22 bp, Homo sapiens
tctcttaaaggtcttcagctga

SEQ ID NO: 8121709 - DNA, 22 bp, Homo sapiens
ccagcaggtgtagggctcatgg

SEQ ID NO: 8121710 - DNA, 22 bp, Homo sapiens
ccaggctgagcatgattggagc

SEQ ID NO: 8121711 - DNA, 22 bp, Homo sapiens
ccaggctgccgaggaaagaaag

SEQ ID NO: 8121712 - DNA, 22 bp, Homo sapiens
ccaggctgcagtcaaggggcat

SEQ ID NO: 8121713 - DNA, 22 bp, Homo sapiens
ccaggctgcagtcaaggggcat

SEQ ID NO: 8121714 - DNA, 22 bp, Homo sapiens
ccaggctgctcacaagctgccc

SEQ ID NO: 8121715 - DNA, 22 bp, Homo sapiens
tgaaaggaaagtacagtgatgc

SEQ ID NO: 8121716 - DNA, 17 bp, Homo sapiens
tgaagatgcatggcagc

SEQ ID NO: 8121717 - DNA, 22 bp, Homo sapiens
tgaaggaagaataggcagtgtt

SEQ ID NO: 8121718 - DNA, 22 bp, Homo sapiens
tgaaggagaaatggaaagtggg

SEQ ID NO: 8121719 - DNA, 22 bp, Homo sapiens
tgaaggagaaatggaaagtggg

SEQ ID NO: 8121720 - DNA, 22 bp, Homo sapiens
tgaaggaatgagtatactgttt

SEQ ID NO: 8121721 - DNA, 22 bp, Homo sapiens
tgaacagatcaatagaactgac

SEQ ID NO: 8121722 - DNA, 22 bp, Homo sapiens
tgaacagatggcccagcagagg

SEQ ID NO: 8121723 - DNA, 22 bp, Homo sapiens
tctgcagagcattatagcaaaa

SEQ ID NO: 8121724 - DNA, 17 bp, Homo sapiens
tctgcagaggcaaacct

SEQ ID NO: 8121725 - DNA, 22 bp, Homo sapiens
tctgcagagcctcaggagaaca

SEQ ID NO: 8121726 - DNA, 22 bp, Homo sapiens
tctgcagagattctgggctgag

SEQ ID NO: 8121727 - DNA, 22 bp, Homo sapiens
tctgcagagacaaagtgttatt

SEQ ID NO: 8121728 - DNA, 22 bp, Homo sapiens
tctgcagaattcgaggaagaaa

SEQ ID NO: 8121729 - DNA, 22 bp, Homo sapiens
tctgcagaattgtctcaagcta

SEQ ID NO: 8121730 - DNA, 22 bp, Homo sapiens
tctgcagacactggggtctgga

SEQ ID NO: 8121731 - DNA, 22 bp, Homo sapiens
tctgcagacactggggtctgga

SEQ ID NO: 8121732 - DNA, 23 bp, Homo sapiens
tctgcagacgctgttctattgtc

SEQ ID NO: 8121733 - DNA, 19 bp, Homo sapiens
tctgcagactatattgtga

SEQ ID NO: 8121734 - DNA, 20 bp, Homo sapiens
tctgcagataagggaaagac

SEQ ID NO: 8121735 - DNA, 22 bp, Homo sapiens
tctgcagatccctttagtgagg

SEQ ID NO: 8121736 - DNA, 22 bp, Homo sapiens
tctgcagaggtaatttacagat

SEQ ID NO: 8121737 - DNA, 22 bp, Homo sapiens
ccagcctcactggcatcaccta

SEQ ID NO: 8121738 - DNA, 22 bp, Homo sapiens
ccaggctcacagcatcccagga

SEQ ID NO: 8121739 - DNA, 22 bp, Homo sapiens
ccaggctcagcgcgcacgtctg

SEQ ID NO: 8121740 - DNA, 22 bp, Homo sapiens
ccaggctcaggcctgctcgttg

SEQ ID NO: 8121741 - DNA, 17 bp, Homo sapiens
ccaggctccatcactgt

SEQ ID NO: 8121742 - DNA, 22 bp, Homo sapiens
tgagcagaagccctcctggact

SEQ ID NO: 8121743 - DNA, 22 bp, Homo sapiens
tgagcagaatgttcagataaat

SEQ ID NO: 8121744 - DNA, 23 bp, Homo sapiens
ccagtggcgtaaactagaggata

SEQ ID NO: 8121745 - DNA, 22 bp, Homo sapiens
tgaggacattggtcaggacatg

SEQ ID NO: 8121746 - DNA, 22 bp, Homo sapiens
tgagataacaaaattatcttca

SEQ ID NO: 8121747 - DNA, 22 bp, Homo sapiens
tgagagttttgacgcttgtaac

SEQ ID NO: 8121748 - DNA, 22 bp, Homo sapiens
tgagagttctctcttcaggtgg

SEQ ID NO: 8121749 - DNA, 22 bp, Homo sapiens
tgagataactctgatttatgtt

SEQ ID NO: 8121750 - DNA, 22 bp, Homo sapiens
tgagataacatggaagagtagc

SEQ ID NO: 8121751 - DNA, 22 bp, Homo sapiens
tgagagtgaaatgtcacatgtc

SEQ ID NO: 8121752 - DNA, 22 bp, Homo sapiens
tgagagttattctgaatttagc

SEQ ID NO: 8121753 - DNA, 22 bp, Homo sapiens
tgacaattgcagacacagaagt

SEQ ID NO: 8121754 - DNA, 22 bp, Homo sapiens
tgacagagacagattgaagctt

SEQ ID NO: 8121755 - DNA, 22 bp, Homo sapiens
tgacagagacttcagagccaaa

SEQ ID NO: 8121756 - DNA, 22 bp, Homo sapiens
tgacagagacttcagagccaaa

SEQ ID NO: 8121757 - DNA, 22 bp, Homo sapiens
ccaggctttcccagcctctcca

SEQ ID NO: 8121758 - DNA, 22 bp, Homo sapiens
tgacagagttcggattgagttt

SEQ ID NO: 8121759 - DNA, 22 bp, Homo sapiens
tgacagagtgacactcttgtct

SEQ ID NO: 8121760 - DNA, 22 bp, Homo sapiens
tgacagagtccagaagtagtgt

SEQ ID NO: 8121761 - DNA, 22 bp, Homo sapiens
tgacagaggctgagttagtctg

SEQ ID NO: 8121762 - DNA, 23 bp, Homo sapiens
tgacagagcaagacttggtctca

SEQ ID NO: 8121763 - DNA, 22 bp, Homo sapiens
tgacagagagcttttgactgtc

SEQ ID NO: 8121764 - DNA, 22 bp, Homo sapiens
tgacagagctggagaataattt

SEQ ID NO: 8121765 - DNA, 22 bp, Homo sapiens
tgacagaggagctggaatgatt

SEQ ID NO: 8121766 - DNA, 22 bp, Homo sapiens
tgagaaaacagtttgtaataat

SEQ ID NO: 8121767 - DNA, 22 bp, Homo sapiens
ccagggtctctgctgcctgaga

SEQ ID NO: 8121768 - DNA, 21 bp, Homo sapiens
ccagggtccagctgccatggt

SEQ ID NO: 8121769 - DNA, 22 bp, Homo sapiens
tgaccaggatactgcagggatg

SEQ ID NO: 8121770 - DNA, 22 bp, Homo sapiens
tgcctcagtctaaagtctctca

SEQ ID NO: 8121771 - DNA, 20 bp, Homo sapiens
cccaggagtgagcagcttta

SEQ ID NO: 8121772 - DNA, 22 bp, Homo sapiens
cccaggaggttggggctacagt

SEQ ID NO: 8121773 - DNA, 21 bp, Homo sapiens
cccaggagtcctatttaaatg

SEQ ID NO: 8121774 - DNA, 22 bp, Homo sapiens
tgccctcagaattgctccctgc

SEQ ID NO: 8121775 - DNA, 22 bp, Homo sapiens
tgccctcagcagcagctcctgc

SEQ ID NO: 8121776 - DNA, 22 bp, Homo sapiens
tgccctcagccacctccaagtt

SEQ ID NO: 8121777 - DNA, 21 bp, Homo sapiens
cccaggaggctgagaagagca

SEQ ID NO: 8121778 - DNA, 22 bp, Homo sapiens
tgccctccacagtggctccacc

SEQ ID NO: 8121779 - DNA, 23 bp, Homo sapiens
tgccctcccaatgcttcggtcac

SEQ ID NO: 8121780 - DNA, 22 bp, Homo sapiens
tgccctcccacattatggctgt

SEQ ID NO: 8121781 - DNA, 22 bp, Homo sapiens
tgccctctgcaggccgccatgg

SEQ ID NO: 8121782 - DNA, 22 bp, Homo sapiens
cccaggagacagaaacagaggt

SEQ ID NO: 8121783 - DNA, 22 bp, Homo sapiens
tgcatatatcttatttttctgt

SEQ ID NO: 8121784 - DNA, 22 bp, Homo sapiens
tgcatattgtccttgatattat

SEQ ID NO: 8121785 - DNA, 22 bp, Homo sapiens
tgcatatttgtatgatgtttag

SEQ ID NO: 8121786 - DNA, 22 bp, Homo sapiens
cccaggagataacgttcccaag

SEQ ID NO: 8121787 - DNA, 22 bp, Homo sapiens
cccaggaggcagagcttgcagt

SEQ ID NO: 8121788 - DNA, 22 bp, Homo sapiens
cccaggaggaggaaaaagctcg

SEQ ID NO: 8121789 - DNA, 22 bp, Homo sapiens
cccaggaggcagaagttgcagt

SEQ ID NO: 8121790 - DNA, 22 bp, Homo sapiens
cccaggaggcagaagttgcagt

SEQ ID NO: 8121791 - DNA, 22 bp, Homo sapiens
cccaggaggcagatgttgcagt

SEQ ID NO: 8121792 - DNA, 22 bp, Homo sapiens
cccagccaaaagcaagtttacc

SEQ ID NO: 8121793 - DNA, 22 bp, Homo sapiens
cccagcccccgagtgtctggaa

SEQ ID NO: 8121794 - DNA, 22 bp, Homo sapiens
cccagcccatctcaaaggtcta

SEQ ID NO: 8121795 - DNA, 22 bp, Homo sapiens
cccagccctgacctattggaaa

SEQ ID NO: 8121796 - DNA, 18 bp, Homo sapiens
cccagcccaccatttctc

SEQ ID NO: 8121797 - DNA, 22 bp, Homo sapiens
cccagcccagcgttcgaggggt

SEQ ID NO: 8121798 - DNA, 21 bp, Homo sapiens
cccaggagaagaaaagatgca

SEQ ID NO: 8121799 - DNA, 22 bp, Homo sapiens
cccaggagaatataatgttctt

SEQ ID NO: 8121800 - DNA, 22 bp, Homo sapiens
cccaggaattggaggctgcagt

SEQ ID NO: 8121801 - DNA, 22 bp, Homo sapiens
tgcagtcttccagctgcacaaa

SEQ ID NO: 8121802 - DNA, 22 bp, Homo sapiens
tgcagtggaaagactcagactt

SEQ ID NO: 8121803 - DNA, 22 bp, Homo sapiens
tgcagtggaagaggtggagatc

SEQ ID NO: 8121804 - DNA, 22 bp, Homo sapiens
tgcagtggaggccgtgagacag

SEQ ID NO: 8121805 - DNA, 22 bp, Homo sapiens
tgcagtggaatctggagagcag

SEQ ID NO: 8121806 - DNA, 22 bp, Homo sapiens
tgcagtggaatctggagagcag

SEQ ID NO: 8121807 - DNA, 22 bp, Homo sapiens
tgcagtggaagaggtggagatc

SEQ ID NO: 8121808 - DNA, 22 bp, Homo sapiens
tgcagaggtttccaggcaagtt

SEQ ID NO: 8121809 - DNA, 22 bp, Homo sapiens
tgcagaggtttgtggtgttgct

SEQ ID NO: 8121810 - DNA, 22 bp, Homo sapiens
tgcagcaggtatggcaagctcc

SEQ ID NO: 8121811 - DNA, 22 bp, Homo sapiens
cccagcagaccgctgtgatggc

SEQ ID NO: 8121812 - DNA, 22 bp, Homo sapiens
cccagcagatggctatgtgcta

SEQ ID NO: 8121813 - DNA, 22 bp, Homo sapiens
tgcagaggtgaaagactagcaa

SEQ ID NO: 8121814 - DNA, 22 bp, Homo sapiens
tgcagaggtgttgctgagataa

SEQ ID NO: 8121815 - DNA, 22 bp, Homo sapiens
cccacccactctgaccagaagc

SEQ ID NO: 8121816 - DNA, 22 bp, Homo sapiens
cccacccagcctggctgagggg

SEQ ID NO: 8121817 - DNA, 22 bp, Homo sapiens
cccacccagctgagccgctcac

SEQ ID NO: 8121818 - DNA, 22 bp, Homo sapiens
cccacccagctgagccgctcac

SEQ ID NO: 8121819 - DNA, 22 bp, Homo sapiens
cccacaggccctgctgccttga

SEQ ID NO: 8121820 - DNA, 22 bp, Homo sapiens
tgattacattggtaatgtttat

SEQ ID NO: 8121821 - DNA, 22 bp, Homo sapiens
tgattacagtatttgagatcca

SEQ ID NO: 8121822 - DNA, 23 bp, Homo sapiens
tgattacaggaagttcaagtgtt

SEQ ID NO: 8121823 - DNA, 22 bp, Homo sapiens
tgattacacagcagtaatttca

SEQ ID NO: 8121824 - DNA, 22 bp, Homo sapiens
tgattacactatttgggaatag

SEQ ID NO: 8121825 - DNA, 21 bp, Homo sapiens
cccaacccatttccagttcat

SEQ ID NO: 8121826 - DNA, 22 bp, Homo sapiens
cccaaccccaacttcctatgtt

SEQ ID NO: 8121827 - DNA, 22 bp, Homo sapiens
ccatggcctcgctctacgtggg

SEQ ID NO: 8121828 - DNA, 20 bp, Homo sapiens
cccaaagcttcatatgagcc

SEQ ID NO: 8121829 - DNA, 22 bp, Homo sapiens
cccaaagcagggtcattgggcc

SEQ ID NO: 8121830 - DNA, 22 bp, Homo sapiens
ccatggagcgggtgagtgagtg

SEQ ID NO: 8121831 - DNA, 22 bp, Homo sapiens
tgaggcagtgctgggaagcctg

SEQ ID NO: 8121832 - DNA, 18 bp, Homo sapiens
tgaggcagtcagtgatgg

SEQ ID NO: 8121833 - DNA, 22 bp, Homo sapiens
tgatgacaaactttcctgatgc

SEQ ID NO: 8121834 - DNA, 22 bp, Homo sapiens
tgatgagggcagttcttgttgc

SEQ ID NO: 8121835 - DNA, 22 bp, Homo sapiens
tgatgagggagatttgagccca

SEQ ID NO: 8121836 - DNA, 22 bp, Homo sapiens
tgatgaggggctcagaggtcag

SEQ ID NO: 8121837 - DNA, 21 bp, Homo sapiens
tgatgaggtcatagcaccctc

SEQ ID NO: 8121838 - DNA, 22 bp, Homo sapiens
tgatgagggggaacagagattt

SEQ ID NO: 8121839 - DNA, 22 bp, Homo sapiens
tgatgaggagactgtggcttgg

SEQ ID NO: 8121840 - DNA, 22 bp, Homo sapiens
tgatgaggacctggtctctgct

SEQ ID NO: 8121841 - DNA, 22 bp, Homo sapiens
tgatgagggaactggttcatac

SEQ ID NO: 8121842 - DNA, 22 bp, Homo sapiens
tgatgaggcttcttggtgaaca

SEQ ID NO: 8121843 - DNA, 22 bp, Homo sapiens
tgatgaggcatatgctacacat

SEQ ID NO: 8121844 - DNA, 22 bp, Homo sapiens
tgatgaggacccatcacctggt

SEQ ID NO: 8121845 - DNA, 22 bp, Homo sapiens
tggaagggaacaggtgggtgtt

SEQ ID NO: 8121846 - DNA, 21 bp, Homo sapiens
tggaagggaagtcttggttgt

SEQ ID NO: 8121847 - DNA, 22 bp, Homo sapiens
ccctgcagacgtcttgatgcct

SEQ ID NO: 8121848 - DNA, 22 bp, Homo sapiens
ccctgcagagaccactgacctt

SEQ ID NO: 8121849 - DNA, 22 bp, Homo sapiens
ccctgcagagaccactgacctt

SEQ ID NO: 8121850 - DNA, 22 bp, Homo sapiens
ccctgcagaaccacagacaaac

SEQ ID NO: 8121851 - DNA, 22 bp, Homo sapiens
ccctgcagaccaatgccataga

SEQ ID NO: 8121852 - DNA, 22 bp, Homo sapiens
ccctgcagagccagccctgacc

SEQ ID NO: 8121853 - DNA, 22 bp, Homo sapiens
ccctgcagatcagtgagaactt

SEQ ID NO: 8121854 - DNA, 22 bp, Homo sapiens
ccctgcagagggatgggggcag

SEQ ID NO: 8121855 - DNA, 22 bp, Homo sapiens
ccctgcagagggatgggggcag

SEQ ID NO: 8121856 - DNA, 22 bp, Homo sapiens
ccctgcagatcagtgagaactt

SEQ ID NO: 8121857 - DNA, 20 bp, Homo sapiens
ccctgcagccatgggagtgg

SEQ ID NO: 8121858 - DNA, 22 bp, Homo sapiens
tggacaggtgcacacagcagcc

SEQ ID NO: 8121859 - DNA, 22 bp, Homo sapiens
ccctgcagccggccagctcatt

SEQ ID NO: 8121860 - DNA, 22 bp, Homo sapiens
ccctgcctgtgggcatcaacat

SEQ ID NO: 8121861 - DNA, 22 bp, Homo sapiens
ccctgcagtcctttcttggctc

SEQ ID NO: 8121862 - DNA, 22 bp, Homo sapiens
tggacaggttgagtaggaggag

SEQ ID NO: 8121863 - DNA, 22 bp, Homo sapiens
tggacaggtttgggtgcctgtt

SEQ ID NO: 8121864 - DNA, 22 bp, Homo sapiens
ccctgccttggggtccacaccg

SEQ ID NO: 8121865 - DNA, 22 bp, Homo sapiens
ccctgccttggggtccacaccg

SEQ ID NO: 8121866 - DNA, 22 bp, Homo sapiens
ccctgccttgttggagcctatg

SEQ ID NO: 8121867 - DNA, 22 bp, Homo sapiens
ccctgccttgtctgggctaggt

SEQ ID NO: 8121868 - DNA, 22 bp, Homo sapiens
tggaggtgacggggcctcgttg

SEQ ID NO: 8121869 - DNA, 22 bp, Homo sapiens
tggaggtgagtgtggtacagca

SEQ ID NO: 8121870 - DNA, 22 bp, Homo sapiens
tggaggtactcaggcacagagt

SEQ ID NO: 8121871 - DNA, 22 bp, Homo sapiens
tggaggggcaatggagcgcgga

SEQ ID NO: 8121872 - DNA, 22 bp, Homo sapiens
tggaggtacataatgagagggt

SEQ ID NO: 8121873 - DNA, 19 bp, Homo sapiens
tggaggggtttgaatgtgg

SEQ ID NO: 8121874 - DNA, 22 bp, Homo sapiens
tgctttcaatgaattgtatact

SEQ ID NO: 8121875 - DNA, 22 bp, Homo sapiens
tgctttcacaccatgcctataa

SEQ ID NO: 8121876 - DNA, 22 bp, Homo sapiens
tgctttcacttctctgcagcca

SEQ ID NO: 8121877 - DNA, 22 bp, Homo sapiens
tgctttcactgatgtatcattt

SEQ ID NO: 8121878 - DNA, 22 bp, Homo sapiens
tgctttcattgtgataggaagc

SEQ ID NO: 8121879 - DNA, 22 bp, Homo sapiens
tgctttcagtttacatcagaac

SEQ ID NO: 8121880 - DNA, 22 bp, Homo sapiens
tgctttcagggatgtctgtgag

SEQ ID NO: 8121881 - DNA, 22 bp, Homo sapiens
tgctttcatattgcctatgact

SEQ ID NO: 8121882 - DNA, 22 bp, Homo sapiens
tgctttcatgaagtctatagag

SEQ ID NO: 8121883 - DNA, 22 bp, Homo sapiens
tgcctcataacactcctggagt

SEQ ID NO: 8121884 - DNA, 22 bp, Homo sapiens
tggaagggaaagtttggggtcc

SEQ ID NO: 8121885 - DNA, 22 bp, Homo sapiens
tggaagaataggatagaagaac

SEQ ID NO: 8121886 - DNA, 22 bp, Homo sapiens
tggaagaaggcagagaggcatt

SEQ ID NO: 8121887 - DNA, 22 bp, Homo sapiens
tggaaagacattcagccgctgg

SEQ ID NO: 8121888 - DNA, 22 bp, Homo sapiens
tggaaagagaaactcttgctaa

SEQ ID NO: 8121889 - DNA, 22 bp, Homo sapiens
ccctagaacacgcagacactga

SEQ ID NO: 8121890 - DNA, 22 bp, Homo sapiens
ccctactctgccactttttctg

SEQ ID NO: 8121891 - DNA, 22 bp, Homo sapiens
ccctactccatagtcaattcat

SEQ ID NO: 8121892 - DNA, 22 bp, Homo sapiens
cccgtgtgtgcgaggctcccgc

SEQ ID NO: 8121893 - DNA, 22 bp, Homo sapiens
tggcctcaaccgtcctaagcac

SEQ ID NO: 8121894 - DNA, 22 bp, Homo sapiens
tggcctcccctaacagcctctt

SEQ ID NO: 8121895 - DNA, 19 bp, Homo sapiens
cctcaccctgcagaggagg

SEQ ID NO: 8121896 - DNA, 22 bp, Homo sapiens
cctcagctcccatgagatctgc

SEQ ID NO: 8121897 - DNA, 22 bp, Homo sapiens
cctccctccattgccatcgtct

SEQ ID NO: 8121898 - DNA, 22 bp, Homo sapiens
ccctggaggaaaatctgaggct

SEQ ID NO: 8121899 - DNA, 22 bp, Homo sapiens
ccctgtcacaatggatgacatt

SEQ ID NO: 8121900 - DNA, 22 bp, Homo sapiens
ccctgtcctgctaggccctggt

SEQ ID NO: 8121901 - DNA, 22 bp, Homo sapiens
ccctgtcctgctaggccctggt

SEQ ID NO: 8121902 - DNA, 22 bp, Homo sapiens
ccctttcattggcagagctctc

SEQ ID NO: 8121903 - DNA, 22 bp, Homo sapiens
ccggagtgtctggcctgctggg

SEQ ID NO: 8121904 - DNA, 22 bp, Homo sapiens
ccggaatgattcaggatccacg

SEQ ID NO: 8121905 - DNA, 21 bp, Homo sapiens
cctcaaagatgatggggtttc

SEQ ID NO: 8121906 - DNA, 22 bp, Homo sapiens
cctatttgtaggctgggccagt

SEQ ID NO: 8121907 - DNA, 22 bp, Homo sapiens
cctcacccactacactcaaggg

SEQ ID NO: 8121908 - DNA, 22 bp, Homo sapiens
cctcacccagtcacctaggtgg

SEQ ID NO: 8121909 - DNA, 20 bp, Homo sapiens
cctcacagggcagagagggg

SEQ ID NO: 8121910 - DNA, 22 bp, Homo sapiens
ccgggagcaggcgccaccgcca

SEQ ID NO: 8121911 - DNA, 22 bp, Homo sapiens
ccgggagcaggcgccaccgcca

SEQ ID NO: 8121912 - DNA, 22 bp, Homo sapiens
ccgtggagttgtgctgagtatg

SEQ ID NO: 8121913 - DNA, 22 bp, Homo sapiens
cctggagggcagcccattctgg

SEQ ID NO: 8121914 - DNA, 22 bp, Homo sapiens
cctggagggaccctggccctgt

SEQ ID NO: 8121915 - DNA, 22 bp, Homo sapiens
cctggagggaccctggccctgt

SEQ ID NO: 8121916 - DNA, 22 bp, Homo sapiens
cctggaggctctgggagggcag

SEQ ID NO: 8121917 - DNA, 22 bp, Homo sapiens
cctggaggcggaggttgcagtg

SEQ ID NO: 8121918 - DNA, 22 bp, Homo sapiens
cctggaggagcgctgaccagct

SEQ ID NO: 8121919 - DNA, 22 bp, Homo sapiens
cctggaggcagaaataggactt

SEQ ID NO: 8121920 - DNA, 18 bp, Homo sapiens
cctggaggtcttcggggt

SEQ ID NO: 8121921 - DNA, 22 bp, Homo sapiens
cctggaggggaccaggaccagg

SEQ ID NO: 8121922 - DNA, 16 bp, Homo sapiens
cctggaggtcacttca

SEQ ID NO: 8121923 - DNA, 22 bp, Homo sapiens
cctggagggcgccgcacagtcc

SEQ ID NO: 8121924 - DNA, 22 bp, Homo sapiens
cctggagcactctccctggctg

SEQ ID NO: 8121925 - DNA, 22 bp, Homo sapiens
cctggaaaacatgggaatcaca

SEQ ID NO: 8121926 - DNA, 22 bp, Homo sapiens
tgtaatataagcattaatagtt

SEQ ID NO: 8121927 - DNA, 22 bp, Homo sapiens
tgtaatgatgtacttagaagga

SEQ ID NO: 8121928 - DNA, 22 bp, Homo sapiens
tgtaatgagaaagagagtgaat

SEQ ID NO: 8121929 - DNA, 19 bp, Homo sapiens
tgtaatctttgctgttgct

SEQ ID NO: 8121930 - DNA, 22 bp, Homo sapiens
cctgcctgtctttatcccctgt

SEQ ID NO: 8121931 - DNA, 22 bp, Homo sapiens
cctgcctgtactagagacccag

SEQ ID NO: 8121932 - DNA, 22 bp, Homo sapiens
cctgccaggcgagtctaggcca

SEQ ID NO: 8121933 - DNA, 22 bp, Homo sapiens
cctgccagggccagaggccagc

SEQ ID NO: 8121934 - DNA, 22 bp, Homo sapiens
tgggtaggtgctggggattcag

SEQ ID NO: 8121935 - DNA, 22 bp, Homo sapiens
cctgccttcagccctgaagtct

SEQ ID NO: 8121936 - DNA, 22 bp, Homo sapiens
cctgctgctatgaaggtgacag

SEQ ID NO: 8121937 - DNA, 22 bp, Homo sapiens
tggtctgctgaacagccgtatc

SEQ ID NO: 8121938 - DNA, 22 bp, Homo sapiens
tggtctggaactcctggcttca

SEQ ID NO: 8121939 - DNA, 22 bp, Homo sapiens
cctgctggcattcttgctccct

SEQ ID NO: 8121940 - DNA, 22 bp, Homo sapiens
cctgctggccactgctccacct

SEQ ID NO: 8121941 - DNA, 22 bp, Homo sapiens
cctgctgtccctctgggctcca

SEQ ID NO: 8121942 - DNA, 22 bp, Homo sapiens
cctgctgtgaccggggagcagg

SEQ ID NO: 8121943 - DNA, 21 bp, Homo sapiens
tgggggagaattggttgcttt

SEQ ID NO: 8121944 - DNA, 22 bp, Homo sapiens
cctgaggtcacaacttgcttat

SEQ ID NO: 8121945 - DNA, 22 bp, Homo sapiens
cctgcacccaggccgcacctct

SEQ ID NO: 8121946 - DNA, 22 bp, Homo sapiens
cctgcacctaacacaacgctct

SEQ ID NO: 8121947 - DNA, 22 bp, Homo sapiens
cctgccaggagctggtgctgca

SEQ ID NO: 8121948 - DNA, 22 bp, Homo sapiens
cctgcagaagagtccagctcat

SEQ ID NO: 8121949 - DNA, 22 bp, Homo sapiens
cctgcacaggccaggcatctga

SEQ ID NO: 8121950 - DNA, 22 bp, Homo sapiens
cctgcacagttctttttgccaa

SEQ ID NO: 8121951 - DNA, 22 bp, Homo sapiens
cctgcacatgtgtgcgcctgta

SEQ ID NO: 8121952 - DNA, 22 bp, Homo sapiens
cctgcacataggcttttcagaa

SEQ ID NO: 8121953 - DNA, 22 bp, Homo sapiens
cctgcacagccttggctgacac

SEQ ID NO: 8121954 - DNA, 22 bp, Homo sapiens
cctgcacagccggacccctgct

SEQ ID NO: 8121955 - DNA, 22 bp, Homo sapiens
cctgcacaatgccagcgggtgg

SEQ ID NO: 8121956 - DNA, 22 bp, Homo sapiens
cctgcacagaccaaagaggaca

SEQ ID NO: 8121957 - DNA, 20 bp, Homo sapiens
tggggtcctggaggggatcc

SEQ ID NO: 8121958 - DNA, 22 bp, Homo sapiens
cctgaccctccttagagtccag

SEQ ID NO: 8121959 - DNA, 22 bp, Homo sapiens
cctgaggctccacctccagaga

SEQ ID NO: 8121960 - DNA, 22 bp, Homo sapiens
cctcttctgagtgagactccct

SEQ ID NO: 8121961 - DNA, 22 bp, Homo sapiens
cctgaagcaagggtaggcaggt

SEQ ID NO: 8121962 - DNA, 22 bp, Homo sapiens
tgggccacgtgacccttaccct

SEQ ID NO: 8121963 - DNA, 22 bp, Homo sapiens
tgggccagatccatggcaataa

SEQ ID NO: 8121964 - DNA, 22 bp, Homo sapiens
tgggccacttgaaagtggatgt

SEQ ID NO: 8121965 - DNA, 22 bp, Homo sapiens
cctccctctttcagtcccacag

SEQ ID NO: 8121966 - DNA, 21 bp, Homo sapiens
tgggagagcgttgctgtcctc

SEQ ID NO: 8121967 - DNA, 22 bp, Homo sapiens
cctctggcaacttcacagccca

SEQ ID NO: 8121968 - DNA, 18 bp, Homo sapiens
ctgcctgttgctgagagg

SEQ ID NO: 8121969 - DNA, 22 bp, Homo sapiens
ctgccttctttcaagggtaagc

SEQ ID NO: 8121970 - DNA, 22 bp, Homo sapiens
ctgccttggaaaatgtggtaat

SEQ ID NO: 8121971 - DNA, 22 bp, Homo sapiens
ctgctctgtttcttagctgggt

SEQ ID NO: 8121972 - DNA, 22 bp, Homo sapiens
ctgctctgtggtccatgagaca

SEQ ID NO: 8121973 - DNA, 22 bp, Homo sapiens
ctgctgacttacactgtttatt

SEQ ID NO: 8121974 - DNA, 22 bp, Homo sapiens
ctgctgagaaccagggagaatt

SEQ ID NO: 8121975 - DNA, 22 bp, Homo sapiens
ctgctgagactggctttgtgtc

SEQ ID NO: 8121976 - DNA, 22 bp, Homo sapiens
ctgctgaaaacaataatgatga

SEQ ID NO: 8121977 - DNA, 22 bp, Homo sapiens
ctgctgacagccctgcttcagg

SEQ ID NO: 8121978 - DNA, 22 bp, Homo sapiens
ctgctgacaaaataaaatgctc

SEQ ID NO: 8121979 - DNA, 22 bp, Homo sapiens
ctgctgactcttcctggagtga

SEQ ID NO: 8121980 - DNA, 22 bp, Homo sapiens
ctgctgactcattttcaacact

SEQ ID NO: 8121981 - DNA, 22 bp, Homo sapiens
ctgctgactcattttcaacact

SEQ ID NO: 8121982 - DNA, 22 bp, Homo sapiens
ctgctgagatgccaggagctct

SEQ ID NO: 8121983 - DNA, 22 bp, Homo sapiens
ctgctgagagctgaaggctgta

SEQ ID NO: 8121984 - DNA, 22 bp, Homo sapiens
ctgctgtcccagcctcctcaca

SEQ ID NO: 8121985 - DNA, 22 bp, Homo sapiens
ctggaagggtcagagtgatgag

SEQ ID NO: 8121986 - DNA, 22 bp, Homo sapiens
ctggaagggtctacttagcaga

SEQ ID NO: 8121987 - DNA, 22 bp, Homo sapiens
ctggaaggtaacaaggccatta

SEQ ID NO: 8121988 - DNA, 19 bp, Homo sapiens
ctggaaggagggactgttc

SEQ ID NO: 8121989 - DNA, 22 bp, Homo sapiens
ctggaaggagaaggaggctgtg

SEQ ID NO: 8121990 - DNA, 22 bp, Homo sapiens
ctggaagggaaatctcttggca

SEQ ID NO: 8121991 - DNA, 22 bp, Homo sapiens
ctggaagaggaagccagctgga

SEQ ID NO: 8121992 - DNA, 22 bp, Homo sapiens
ctggaaagtgcttttctgagag

SEQ ID NO: 8121993 - DNA, 22 bp, Homo sapiens
ctggagagttggaagatggact

SEQ ID NO: 8121994 - DNA, 19 bp, Homo sapiens
ctggagatagggcctttaa

SEQ ID NO: 8121995 - DNA, 22 bp, Homo sapiens
ctggagccccaggctgtgcaga

SEQ ID NO: 8121996 - DNA, 22 bp, Homo sapiens
ctggagcctaggttgacctggg

SEQ ID NO: 8121997 - DNA, 22 bp, Homo sapiens
ctggagcctgcagttttcactt

SEQ ID NO: 8121998 - DNA, 19 bp, Homo sapiens
ctgagcagcggcagcactt

SEQ ID NO: 8121999 - DNA, 22 bp, Homo sapiens
ctgagcaggatattcacagcag

SEQ ID NO: 8122000 - DNA, 22 bp, Homo sapiens
ctgagcagtctgactcaagcta

SEQ ID NO: 8122001 - DNA, 22 bp, Homo sapiens
ctgagcagtgctttgcagtggg

SEQ ID NO: 8122002 - DNA, 22 bp, Homo sapiens
ttttgcttgagtgcacaaaatg

SEQ ID NO: 8122003 - DNA, 22 bp, Homo sapiens
ctcttctgtacctcggcctcca

SEQ ID NO: 8122004 - DNA, 22 bp, Homo sapiens
ctgaggcctggtgaggtggtga

SEQ ID NO: 8122005 - DNA, 23 bp, Homo sapiens
ctgaggggaaaagggcttcaggc

SEQ ID NO: 8122006 - DNA, 22 bp, Homo sapiens
ctgaggggaaaagtcaggatga

SEQ ID NO: 8122007 - DNA, 22 bp, Homo sapiens
ctgaggtctattttgaaactgc

SEQ ID NO: 8122008 - DNA, 22 bp, Homo sapiens
ctgcccaggctgaaggaacatc

SEQ ID NO: 8122009 - DNA, 22 bp, Homo sapiens
ctgcccagtttgggagcctttc

SEQ ID NO: 8122010 - DNA, 22 bp, Homo sapiens
ctgccccacaggcttggtaggg

SEQ ID NO: 8122011 - DNA, 20 bp, Homo sapiens
ctgcccagccactgagggat

SEQ ID NO: 8122012 - DNA, 20 bp, Homo sapiens
ctgcccagccactgagggat

SEQ ID NO: 8122013 - DNA, 22 bp, Homo sapiens
ctgcccagattttaccacctgc

SEQ ID NO: 8122014 - DNA, 20 bp, Homo sapiens
ctgcccagccactgagggat

SEQ ID NO: 8122015 - DNA, 22 bp, Homo sapiens
ctgcccacagttctctgccatg

SEQ ID NO: 8122016 - DNA, 18 bp, Homo sapiens
ctgccatgtcctactgtc

SEQ ID NO: 8122017 - DNA, 22 bp, Homo sapiens
ctgccatgttacctgcacaggt

SEQ ID NO: 8122018 - DNA, 22 bp, Homo sapiens
ctgcaggagggctggggaagcc

SEQ ID NO: 8122019 - DNA, 22 bp, Homo sapiens
ctgcaggagtgaaagcaggcct

SEQ ID NO: 8122020 - DNA, 22 bp, Homo sapiens
ctgcaggagtgaaagcaggcct

SEQ ID NO: 8122021 - DNA, 22 bp, Homo sapiens
ctgaggtttgtccatccttggt

SEQ ID NO: 8122022 - DNA, 16 bp, Homo sapiens
ctgaggtttggccaca

SEQ ID NO: 8122023 - DNA, 22 bp, Homo sapiens
ctgcagcctcaacctcctgagc

SEQ ID NO: 8122024 - DNA, 22 bp, Homo sapiens
ctgcaggaatctgtgctaggtg

SEQ ID NO: 8122025 - DNA, 22 bp, Homo sapiens
ctgcaggacagggaggagcaag

SEQ ID NO: 8122026 - DNA, 22 bp, Homo sapiens
ctgcaggactgaaagatgaggt

SEQ ID NO: 8122027 - DNA, 22 bp, Homo sapiens
ctgcaggactgaaagatgaggt

SEQ ID NO: 8122028 - DNA, 22 bp, Homo sapiens
ctgaggtttacaagctattgct

SEQ ID NO: 8122029 - DNA, 23 bp, Homo sapiens
ctgaggtctgcaattctagtagt

SEQ ID NO: 8122030 - DNA, 22 bp, Homo sapiens
tttcagaagtcacagttgactg

SEQ ID NO: 8122031 - DNA, 22 bp, Homo sapiens
tttcagaatatcgattcagtga

SEQ ID NO: 8122032 - DNA, 22 bp, Homo sapiens
ctccaggagtggcctggacacc

SEQ ID NO: 8122033 - DNA, 22 bp, Homo sapiens
ctccaggactgaggacagagct

SEQ ID NO: 8122034 - DNA, 22 bp, Homo sapiens
tttctcaagtactgcacatgaa

SEQ ID NO: 8122035 - DNA, 22 bp, Homo sapiens
tttctcaaggtgtcatgtattt

SEQ ID NO: 8122036 - DNA, 22 bp, Homo sapiens
tttctcaagttcagatatttga

SEQ ID NO: 8122037 - DNA, 22 bp, Homo sapiens
tttctcaagttcagatatttga

SEQ ID NO: 8122038 - DNA, 22 bp, Homo sapiens
tttctcaacctcaacactattt

SEQ ID NO: 8122039 - DNA, 22 bp, Homo sapiens
ctctgaaagacaagctctcatt

SEQ ID NO: 8122040 - DNA, 18 bp, Homo sapiens
ctctctggtctggatccc

SEQ ID NO: 8122041 - DNA, 22 bp, Homo sapiens
ctctctgttatgctttcatgaa

SEQ ID NO: 8122042 - DNA, 22 bp, Homo sapiens
tttctacagctggtgcaacttt

SEQ ID NO: 8122043 - DNA, 22 bp, Homo sapiens
tttccacactcactgcactcat

SEQ ID NO: 8122044 - DNA, 22 bp, Homo sapiens
tttccacactcactgcactcat

SEQ ID NO: 8122045 - DNA, 22 bp, Homo sapiens
tttcattacgtgtttgacttgt

SEQ ID NO: 8122046 - DNA, 21 bp, Homo sapiens
tttgttcaggggcaaagttaa

SEQ ID NO: 8122047 - DNA, 22 bp, Homo sapiens
tttgagaaaaagtgatgatgat

SEQ ID NO: 8122048 - DNA, 22 bp, Homo sapiens
tttgcaaacacttaagaagaga

SEQ ID NO: 8122049 - DNA, 22 bp, Homo sapiens
tttgcaaaccggagctctgcaa

SEQ ID NO: 8122050 - DNA, 22 bp, Homo sapiens
tttgagaagataggggaatact

SEQ ID NO: 8122051 - DNA, 22 bp, Homo sapiens
tttgagaagatgtaatgttaag

SEQ ID NO: 8122052 - DNA, 22 bp, Homo sapiens
tttgagaagagtttgaggtatt

SEQ ID NO: 8122053 - DNA, 22 bp, Homo sapiens
tttgcaaaatgaggtgaagagt

SEQ ID NO: 8122054 - DNA, 22 bp, Homo sapiens
tttgcaaaattattcccagcat

SEQ ID NO: 8122055 - DNA, 22 bp, Homo sapiens
tttgcaaactttcctctggacc

SEQ ID NO: 8122056 - DNA, 22 bp, Homo sapiens
tttgcaaagaaattattgctgt

SEQ ID NO: 8122057 - DNA, 18 bp, Homo sapiens
tttgcaaaggaagtatgg

SEQ ID NO: 8122058 - DNA, 22 bp, Homo sapiens
tttgcaaagtccattgaagtta

SEQ ID NO: 8122059 - DNA, 22 bp, Homo sapiens
tttgcaaagtgactattatatg

SEQ ID NO: 8122060 - DNA, 20 bp, Homo sapiens
ctctggcaaaggatgcctat

SEQ ID NO: 8122061 - DNA, 22 bp, Homo sapiens
ctctggagtgcagcctggtggc

SEQ ID NO: 8122062 - DNA, 21 bp, Homo sapiens
tttgaatagaaatagtgctta

SEQ ID NO: 8122063 - DNA, 22 bp, Homo sapiens
tttgaaagaaaccagtgagtga

SEQ ID NO: 8122064 - DNA, 22 bp, Homo sapiens
tttgaaagaaaccagtgagtga

SEQ ID NO: 8122065 - DNA, 21 bp, Homo sapiens
tgtcagcaacaatactttctc

SEQ ID NO: 8122066 - DNA, 22 bp, Homo sapiens
tgtcagagcaaggccaggccag

SEQ ID NO: 8122067 - DNA, 22 bp, Homo sapiens
tgtcaatagttttgagttctct

SEQ ID NO: 8122068 - DNA, 22 bp, Homo sapiens
tgtcagcagctggtttgctgtt

SEQ ID NO: 8122069 - DNA, 22 bp, Homo sapiens
ttaaattgtcatttgagcaatg

SEQ ID NO: 8122070 - DNA, 22 bp, Homo sapiens
ttaaattccagcctcataatag

SEQ ID NO: 8122071 - DNA, 22 bp, Homo sapiens
ttaaattcattccaacttttga

SEQ ID NO: 8122072 - DNA, 22 bp, Homo sapiens
ttacaaagattatattcagtta

SEQ ID NO: 8122073 - DNA, 22 bp, Homo sapiens
ttacaaagcaggtcagctgaaa

SEQ ID NO: 8122074 - DNA, 22 bp, Homo sapiens
ttacaaagcgctttacctctga

SEQ ID NO: 8122075 - DNA, 22 bp, Homo sapiens
ttacaaagcgttgagacaagta

SEQ ID NO: 8122076 - DNA, 22 bp, Homo sapiens
ttacaaagcgttgagacaagta

SEQ ID NO: 8122077 - DNA, 22 bp, Homo sapiens
ttagcaaatatcttgaaacagg

SEQ ID NO: 8122078 - DNA, 21 bp, Homo sapiens
ttagcaaagcaaacacatgct

SEQ ID NO: 8122079 - DNA, 22 bp, Homo sapiens
ttagcaaagaagatgtgagttt

SEQ ID NO: 8122080 - DNA, 21 bp, Homo sapiens
ttagcaaagcaaacacatgct

SEQ ID NO: 8122081 - DNA, 22 bp, Homo sapiens
ttagcaaatttccaggtgatgc

SEQ ID NO: 8122082 - DNA, 22 bp, Homo sapiens
ttagcaaatttccaggtgatgc

SEQ ID NO: 8122083 - DNA, 22 bp, Homo sapiens
ccttcaaatttagaacaagtga

SEQ ID NO: 8122084 - DNA, 22 bp, Homo sapiens
ccttcacacaggtagaagcaga

SEQ ID NO: 8122085 - DNA, 23 bp, Homo sapiens
ccttcagaagaagtaacaggggc

SEQ ID NO: 8122086 - DNA, 22 bp, Homo sapiens
ttacataacggtatgaaaaatg

SEQ ID NO: 8122087 - DNA, 22 bp, Homo sapiens
ccttcaaactttcattaaccag

SEQ ID NO: 8122088 - DNA, 22 bp, Homo sapiens
ttacatagttaaatagtacagc

SEQ ID NO: 8122089 - DNA, 22 bp, Homo sapiens
ttataacatcaatcagagttaa

SEQ ID NO: 8122090 - DNA, 22 bp, Homo sapiens
ttataacattataaagtggaga

SEQ ID NO: 8122091 - DNA, 22 bp, Homo sapiens
ttataacaacagtttactttaa

SEQ ID NO: 8122092 - DNA, 22 bp, Homo sapiens
ttataacatcaatcagagttaa

SEQ ID NO: 8122093 - DNA, 22 bp, Homo sapiens
ccttttcttgccactgactcgg

SEQ ID NO: 8122094 - DNA, 22 bp, Homo sapiens
ccttttctggccaccaagcgct

SEQ ID NO: 8122095 - DNA, 22 bp, Homo sapiens
ccttttgctctcccatccagaa

SEQ ID NO: 8122096 - DNA, 22 bp, Homo sapiens
cctttttccctggagggacagc

SEQ ID NO: 8122097 - DNA, 22 bp, Homo sapiens
ttatccaacatgacttatgtcc

SEQ ID NO: 8122098 - DNA, 22 bp, Homo sapiens
ttatttattgtgtacctactgt

SEQ ID NO: 8122099 - DNA, 22 bp, Homo sapiens
cgccgtaaatgcaagcctgtag

SEQ ID NO: 8122100 - DNA, 22 bp, Homo sapiens
cgctgcagatgggagctggttg

SEQ ID NO: 8122101 - DNA, 21 bp, Homo sapiens
cgctgccttgggagtggacct

SEQ ID NO: 8122102 - DNA, 22 bp, Homo sapiens
cgctgccttcatcccacgccta

SEQ ID NO: 8122103 - DNA, 22 bp, Homo sapiens
cggggccctggggctgaaggtc

SEQ ID NO: 8122104 - DNA, 22 bp, Homo sapiens
cggggaggcttcggattaaagc

SEQ ID NO: 8122105 - DNA, 22 bp, Homo sapiens
cgggctggctgcagctgctgga

SEQ ID NO: 8122106 - DNA, 22 bp, Homo sapiens
cggggagggcagaggctccctc

SEQ ID NO: 8122107 - DNA, 22 bp, Homo sapiens
cggggcagagggtcttctccag

SEQ ID NO: 8122108 - DNA, 22 bp, Homo sapiens
ttcaaagtgtgacctgacaagc

SEQ ID NO: 8122109 - DNA, 21 bp, Homo sapiens
ttcaaagtttgcctaaagatt

SEQ ID NO: 8122110 - DNA, 22 bp, Homo sapiens
cggagtcttgctatgttgccca

SEQ ID NO: 8122111 - DNA, 22 bp, Homo sapiens
ctcagaggcaagcaaggagctg

SEQ ID NO: 8122112 - DNA, 22 bp, Homo sapiens
ctcagccccaatttgccctctt

SEQ ID NO: 8122113 - DNA, 22 bp, Homo sapiens
ctcaggagatgacagaaggtat

SEQ ID NO: 8122114 - DNA, 22 bp, Homo sapiens
ctcaggacccggtccaggtggg

SEQ ID NO: 8122115 - DNA, 22 bp, Homo sapiens
ctcaggacttggttagtgtttt

SEQ ID NO: 8122116 - DNA, 22 bp, Homo sapiens
ctcaggaaggaagcagggagcc

SEQ ID NO: 8122117 - DNA, 22 bp, Homo sapiens
ctcaggaggatgactgccttgg

SEQ ID NO: 8122118 - DNA, 22 bp, Homo sapiens
ctcaggaggtggtagaggccct

SEQ ID NO: 8122119 - DNA, 22 bp, Homo sapiens
ctcaggaggtttcctgtctagg

SEQ ID NO: 8122120 - DNA, 22 bp, Homo sapiens
ctcaggtacagatttgtggatt

SEQ ID NO: 8122121 - DNA, 22 bp, Homo sapiens
ctcagggatggtgaagcaccca

SEQ ID NO: 8122122 - DNA, 22 bp, Homo sapiens
ctcagggatggtgaagcaccca

SEQ ID NO: 8122123 - DNA, 22 bp, Homo sapiens
ctcagggatggtgaagcaccca

SEQ ID NO: 8122124 - DNA, 22 bp, Homo sapiens
ctcagggatgggcagatgttaa

SEQ ID NO: 8122125 - DNA, 23 bp, Homo sapiens
ctcagggatagaaaggaagacag

SEQ ID NO: 8122126 - DNA, 22 bp, Homo sapiens
ctcagggaattatttctgtcct

SEQ ID NO: 8122127 - DNA, 22 bp, Homo sapiens
ttgcatccgggctacttccaca

SEQ ID NO: 8122128 - DNA, 22 bp, Homo sapiens
ttgcatatcctccaacacatgg

SEQ ID NO: 8122129 - DNA, 22 bp, Homo sapiens
ttgccctgcgggtcctgcgcaa

SEQ ID NO: 8122130 - DNA, 22 bp, Homo sapiens
ttgccctgcgttaccatctctt

SEQ ID NO: 8122131 - DNA, 22 bp, Homo sapiens
ttgccctgaagaacgtcccaga

SEQ ID NO: 8122132 - DNA, 22 bp, Homo sapiens
ttggctctttcctcacacagga

SEQ ID NO: 8122133 - DNA, 22 bp, Homo sapiens
ttggctcttctcccagtggcct

SEQ ID NO: 8122134 - DNA, 22 bp, Homo sapiens
ctccaggacagattcagggcca

SEQ ID NO: 8122135 - DNA, 22 bp, Homo sapiens
ctccaggactcaggcccctggg

SEQ ID NO: 8122136 - DNA, 22 bp, Homo sapiens
ctccaggacccagtggctccag

SEQ ID NO: 8122137 - DNA, 22 bp, Homo sapiens
ctccaggacccagtggctccag

SEQ ID NO: 8122138 - DNA, 22 bp, Homo sapiens
ctccaggaccagggctcctgga

SEQ ID NO: 8122139 - DNA, 20 bp, Homo sapiens
ttggctctgatcagtggagc

SEQ ID NO: 8122140 - DNA, 22 bp, Homo sapiens
ttggaaggatttagagatgtct

SEQ ID NO: 8122141 - DNA, 19 bp, Homo sapiens
ttggaaggagccagagtgg

SEQ ID NO: 8122142 - DNA, 19 bp, Homo sapiens
ctcagtctggctctgcctg

SEQ ID NO: 8122143 - DNA, 19 bp, Homo sapiens
ctcagtctggctctgcctg

SEQ ID NO: 8122144 - DNA, 22 bp, Homo sapiens
ctcagtgcagctaggcatgaga

SEQ ID NO: 8122145 - DNA, 22 bp, Homo sapiens
ctcagtgcttctagcttgatga

SEQ ID NO: 8122146 - DNA, 22 bp, Homo sapiens
ttggaaggccctgcctagcagg

SEQ ID NO: 8122147 - DNA, 20 bp, Homo sapiens
ttggaaggtggagaagagga

SEQ ID NO: 8122148 - DNA, 22 bp, Homo sapiens
ttggagggactgagcttcagtc

SEQ ID NO: 8122149 - DNA, 22 bp, Homo sapiens
ttggagggacagatggctaggc

SEQ ID NO: 8122150 - DNA, 22 bp, Homo sapiens
ttggaggggccactgcagagct

SEQ ID NO: 8122151 - DNA, 22 bp, Homo sapiens
ttggagggtcttccacagccat

SEQ ID NO: 8122152 - DNA, 22 bp, Homo sapiens
ctccactcaacaagcccagtgt

SEQ ID NO: 8122153 - DNA, 22 bp, Homo sapiens
ttctggaagatacctctcctaa

SEQ ID NO: 8122154 - DNA, 22 bp, Homo sapiens
ttctggaagagtaaaataagcc

SEQ ID NO: 8122155 - DNA, 22 bp, Homo sapiens
ttctggaagaggtgtaagtata

SEQ ID NO: 8122156 - DNA, 22 bp, Homo sapiens
ttctggaagaataatgggcaaa

SEQ ID NO: 8122157 - DNA, 22 bp, Homo sapiens
ttctggaactatactgttggtg

SEQ ID NO: 8122158 - DNA, 22 bp, Homo sapiens
ttctggaaccaacatgccagtt

SEQ ID NO: 8122159 - DNA, 22 bp, Homo sapiens
ttctggaaccagcctgcctggg

SEQ ID NO: 8122160 - DNA, 22 bp, Homo sapiens
ttctggaacatagcaagaagtt

SEQ ID NO: 8122161 - DNA, 22 bp, Homo sapiens
ttctggaagctggaaaaggcaa

SEQ ID NO: 8122162 - DNA, 22 bp, Homo sapiens
ttctggaagctgggcagcaccc

SEQ ID NO: 8122163 - DNA, 22 bp, Homo sapiens
ttctggaaggatgtttctatct

SEQ ID NO: 8122164 - DNA, 22 bp, Homo sapiens
ttctggaagcttttggagagaa

SEQ ID NO: 8122165 - DNA, 22 bp, Homo sapiens
ttctggaaggcagggagaaccc

SEQ ID NO: 8122166 - DNA, 22 bp, Homo sapiens
ttctggaagccccagagtcaga

SEQ ID NO: 8122167 - DNA, 22 bp, Homo sapiens
ttctggaagccctaagggagaa

SEQ ID NO: 8122168 - DNA, 22 bp, Homo sapiens
ttctggaagctgcaggtggccg

SEQ ID NO: 8122169 - DNA, 23 bp, Homo sapiens
ttctggaagatttacttgagaca

SEQ ID NO: 8122170 - DNA, 22 bp, Homo sapiens
ttctggaagcagtggggagtga

SEQ ID NO: 8122171 - DNA, 22 bp, Homo sapiens
ttctggaagccatgggaacagg

SEQ ID NO: 8122172 - DNA, 20 bp, Homo sapiens
ttctatggaccagtatattt

SEQ ID NO: 8122173 - DNA, 22 bp, Homo sapiens
ctaaaaatccacactaggtgaa

SEQ ID NO: 8122174 - DNA, 22 bp, Homo sapiens
cgtgtggacatgactagctgcc

SEQ ID NO: 8122175 - DNA, 22 bp, Homo sapiens
ctagatccattttctgtctctg

SEQ ID NO: 8122176 - DNA, 22 bp, Homo sapiens
ctagagggatgttaggatagca

SEQ ID NO: 8122177 - DNA, 22 bp, Homo sapiens
ctagaaatattttacagtcaag

SEQ ID NO: 8122178 - DNA, 22 bp, Homo sapiens
ctcagagaacctaagcggagga

SEQ ID NO: 8122179 - DNA, 17 bp, Homo sapiens
ctcagagagggtaagta

SEQ ID NO: 8122180 - DNA, 21 bp, Homo sapiens
ctcagagcagttcagagggat

SEQ ID NO: 8122181 - DNA, 17 bp, Homo sapiens
ctcagagcaggacagaa

SEQ ID NO: 8122182 - DNA, 22 bp, Homo sapiens
ctcagagccagttagcaggtgc

SEQ ID NO: 8122183 - DNA, 22 bp, Homo sapiens
ctcagagctgaggccagggaca

SEQ ID NO: 8122184 - DNA, 22 bp, Homo sapiens
ctcactcagacatccagtgcag

SEQ ID NO: 8122185 - DNA, 22 bp, Homo sapiens
ctcacccatatctccatgactc

SEQ ID NO: 8122186 - DNA, 22 bp, Homo sapiens
ctcacccctgtaattccagcac

SEQ ID NO: 8122187 - DNA, 22 bp, Homo sapiens
ctatagaaaattgtatcacacg

SEQ ID NO: 8122188 - DNA, 22 bp, Homo sapiens
ctatagaaaattgtatcacacg

SEQ ID NO: 8122189 - DNA, 22 bp, Homo sapiens
ctcacccatatctccatgactc

SEQ ID NO: 8122190 - DNA, 22 bp, Homo sapiens
ctatagaaacaacctctctttc

SEQ ID NO: 8122191 - DNA, 22 bp, Homo sapiens
ctgtcccagatgttctcagcac

SEQ ID NO: 8122192 - DNA, 19 bp, Homo sapiens
ctgtcccagactctgctct

SEQ ID NO: 8122193 - DNA, 22 bp, Homo sapiens
ctgtccccgcgagtccagagct

SEQ ID NO: 8122194 - DNA, 21 bp, Homo sapiens
ctgtccccagtgagcaccccc

SEQ ID NO: 8122195 - DNA, 18 bp, Homo sapiens
ctgtcccatcctcaggtt

SEQ ID NO: 8122196 - DNA, 22 bp, Homo sapiens
ctggttttgtcagaagctttat

SEQ ID NO: 8122197 - DNA, 22 bp, Homo sapiens
ctggttttctagtccactggct

SEQ ID NO: 8122198 - DNA, 22 bp, Homo sapiens
ctggtttttagtgcttaggagt

SEQ ID NO: 8122199 - DNA, 22 bp, Homo sapiens
ctggttttgaaaacgcaagctg

SEQ ID NO: 8122200 - DNA, 22 bp, Homo sapiens
ctggttttccaatgttttgact

SEQ ID NO: 8122201 - DNA, 22 bp, Homo sapiens
ctggttttatgttatagatgga

SEQ ID NO: 8122202 - DNA, 22 bp, Homo sapiens
ctggttttgaatatgtctgctt

SEQ ID NO: 8122203 - DNA, 22 bp, Homo sapiens
ctggttttgcccagtcttgcac

SEQ ID NO: 8122204 - DNA, 22 bp, Homo sapiens
ctggttttggctggcaaggttg

SEQ ID NO: 8122205 - DNA, 22 bp, Homo sapiens
ctggttttaagctgtcagagag

SEQ ID NO: 8122206 - DNA, 22 bp, Homo sapiens
ctggttttaatgttatgtttat

SEQ ID NO: 8122207 - DNA, 22 bp, Homo sapiens
ctgtgaatcttgatgttatttc

SEQ ID NO: 8122208 - DNA, 22 bp, Homo sapiens
ctgtgaattaagtattgttatc

SEQ ID NO: 8122209 - DNA, 22 bp, Homo sapiens
ctgtccctcagttctgggcaaa

SEQ ID NO: 8122210 - DNA, 22 bp, Homo sapiens
ctgtccctcagttctgggcaaa

SEQ ID NO: 8122211 - DNA, 21 bp, Homo sapiens
ctgtccctctttgcttccctc

SEQ ID NO: 8122212 - DNA, 22 bp, Homo sapiens
ctgtgaggcctttggccagata

SEQ ID NO: 8122213 - DNA, 22 bp, Homo sapiens
ctgtgagactgatagggaagag

SEQ ID NO: 8122214 - DNA, 22 bp, Homo sapiens
ctgtgactgggtgacagtcctc

SEQ ID NO: 8122215 - DNA, 22 bp, Homo sapiens
ctgtgacttccactactgatca

SEQ ID NO: 8122216 - DNA, 22 bp, Homo sapiens
ctgtggcaaatgatacctccca

SEQ ID NO: 8122217 - DNA, 22 bp, Homo sapiens
ctgtggcattgccgaggctggc

SEQ ID NO: 8122218 - DNA, 23 bp, Homo sapiens
ctgtggccacccctagctggagg

SEQ ID NO: 8122219 - DNA, 19 bp, Homo sapiens
ctgtgggcggaggaggggc

SEQ ID NO: 8122220 - DNA, 19 bp, Homo sapiens
ctgtgggcggaggaggggc

SEQ ID NO: 8122221 - DNA, 22 bp, Homo sapiens
ctgtgtttctaagtaaaggagc

SEQ ID NO: 8122222 - DNA, 22 bp, Homo sapiens
ctgtgtgtttatatcatttcct

SEQ ID NO: 8122223 - DNA, 22 bp, Homo sapiens
ctgtgtgtgtctgcagcatact

SEQ ID NO: 8122224 - DNA, 22 bp, Homo sapiens
ctgtgtgtgctacaggcttcca

SEQ ID NO: 8122225 - DNA, 23 bp, Homo sapiens
ctgtgtgtgccgagggtggccac

SEQ ID NO: 8122226 - DNA, 22 bp, Homo sapiens
ctgtgtgtgagaagcaggttga

SEQ ID NO: 8122227 - DNA, 22 bp, Homo sapiens
ctgggctccactcccacagtgt

SEQ ID NO: 8122228 - DNA, 22 bp, Homo sapiens
ctgggctcctaaccatccaggt

SEQ ID NO: 8122229 - DNA, 22 bp, Homo sapiens
ctgggctcctaaccatccaggt

SEQ ID NO: 8122230 - DNA, 18 bp, Homo sapiens
ctgggctcgagagatcct

SEQ ID NO: 8122231 - DNA, 22 bp, Homo sapiens
ctgggctctaagggagcaccgt

SEQ ID NO: 8122232 - DNA, 22 bp, Homo sapiens
ctggggctggtgaggcaggctc

SEQ ID NO: 8122233 - DNA, 22 bp, Homo sapiens
ctggggtggaggagctcccctg

SEQ ID NO: 8122234 - DNA, 22 bp, Homo sapiens
ctggggtggtgcaggcctcatg

SEQ ID NO: 8122235 - DNA, 22 bp, Homo sapiens
ctggtgtccgcaacgggcagcg

SEQ ID NO: 8122236 - DNA, 22 bp, Homo sapiens
ctgggtttagggtctccccttg

SEQ ID NO: 8122237 - DNA, 22 bp, Homo sapiens
ctgggttgatctcagccctaag

SEQ ID NO: 8122238 - DNA, 22 bp, Homo sapiens
ctgggttttattacagtgagct

SEQ ID NO: 8122239 - DNA, 22 bp, Homo sapiens
ctggtacatagtaagaacacaa

SEQ ID NO: 8122240 - DNA, 22 bp, Homo sapiens
ctgggctcagtggctcatggct

SEQ ID NO: 8122241 - DNA, 22 bp, Homo sapiens
ctgggcctccacgggccatcac

SEQ ID NO: 8122242 - DNA, 22 bp, Homo sapiens
ctgggagtggtgacagctctcg

SEQ ID NO: 8122243 - DNA, 22 bp, Homo sapiens
ctgggataggaaggtttccagc

SEQ ID NO: 8122244 - DNA, 22 bp, Homo sapiens
ctttggcacagtctcatttgat

SEQ ID NO: 8122245 - DNA, 22 bp, Homo sapiens
ctttggaagtaaagtcagcagg

SEQ ID NO: 8122246 - DNA, 22 bp, Homo sapiens
ctttggagggcctttcctagcc

SEQ ID NO: 8122247 - DNA, 19 bp, Homo sapiens
ctttggagtcttttactct

SEQ ID NO: 8122248 - DNA, 22 bp, Homo sapiens
gaaaaaggataaatacagtgtt

SEQ ID NO: 8122249 - DNA, 22 bp, Homo sapiens
ctttttgttgtataagcccttt

SEQ ID NO: 8122250 - DNA, 22 bp, Homo sapiens
gaaaacactttgatctgaaagt

SEQ ID NO: 8122251 - DNA, 22 bp, Homo sapiens
gaaaaatgctccaaatctgtgg

SEQ ID NO: 8122252 - DNA, 22 bp, Homo sapiens
gaaatattcttgtcttgttttc

SEQ ID NO: 8122253 - DNA, 19 bp, Homo sapiens
gaagaagcttgagaagtag

SEQ ID NO: 8122254 - DNA, 22 bp, Homo sapiens
gaagaagcaggagtgtgtagca

SEQ ID NO: 8122255 - DNA, 22 bp, Homo sapiens
ctgttaaagatagttaagcttc

SEQ ID NO: 8122256 - DNA, 22 bp, Homo sapiens
cttccctgataagagcctcaga

SEQ ID NO: 8122257 - DNA, 22 bp, Homo sapiens
cttccctggtgttagcccaatg

SEQ ID NO: 8122258 - DNA, 22 bp, Homo sapiens
cttccctgataagagcctcaga

SEQ ID NO: 8122259 - DNA, 22 bp, Homo sapiens
cttccccgccggttcgctgagt

SEQ ID NO: 8122260 - DNA, 22 bp, Homo sapiens
cttccctcctggattccagact

SEQ ID NO: 8122261 - DNA, 22 bp, Homo sapiens
ctttctagagtatggagtctgt

SEQ ID NO: 8122262 - DNA, 22 bp, Homo sapiens
ctttctctgtgtttcacatgct

SEQ ID NO: 8122263 - DNA, 22 bp, Homo sapiens
ctttcctctggcactgtctggt

SEQ ID NO: 8122264 - DNA, 22 bp, Homo sapiens
ctttcctctggcactgtctggt

SEQ ID NO: 8122265 - DNA, 22 bp, Homo sapiens
cttggaggaaaggcagggagac

SEQ ID NO: 8122266 - DNA, 22 bp, Homo sapiens
cttggaaaggaatcttttacca

SEQ ID NO: 8122267 - DNA, 22 bp, Homo sapiens
cttggaaagaatatatgatgct

SEQ ID NO: 8122268 - DNA, 22 bp, Homo sapiens
cttggaaaggttttacaaagcg

SEQ ID NO: 8122269 - DNA, 22 bp, Homo sapiens
cttggaaagttatcattttcct

SEQ ID NO: 8122270 - DNA, 22 bp, Homo sapiens
cttggaaactttccctgggcac

SEQ ID NO: 8122271 - DNA, 22 bp, Homo sapiens
cttggagaccagtgacattgct

SEQ ID NO: 8122272 - DNA, 22 bp, Homo sapiens
gaggacaggagactcactgttt

SEQ ID NO: 8122273 - DNA, 22 bp, Homo sapiens
gagcaggcattctagtggctga

SEQ ID NO: 8122274 - DNA, 22 bp, Homo sapiens
gagcaggatgggagctggggcc

SEQ ID NO: 8122275 - DNA, 22 bp, Homo sapiens
gagcaggacgtgggaatgggaa

SEQ ID NO: 8122276 - DNA, 22 bp, Homo sapiens
gagctcagcccaaagagcagtg

SEQ ID NO: 8122277 - DNA, 22 bp, Homo sapiens
gaggccacggttttccttgggg

SEQ ID NO: 8122278 - DNA, 22 bp, Homo sapiens
gaggccactgtccctgccttcc

SEQ ID NO: 8122279 - DNA, 22 bp, Homo sapiens
gaggatggaggtgtgagctatg

SEQ ID NO: 8122280 - DNA, 22 bp, Homo sapiens
gaggagtggagttgctgggttg

SEQ ID NO: 8122281 - DNA, 18 bp, Homo sapiens
gaggatggaaggagatgc

SEQ ID NO: 8122282 - DNA, 22 bp, Homo sapiens
gaggagtgccagccgtggagtc

SEQ ID NO: 8122283 - DNA, 22 bp, Homo sapiens
gaggagagaagctaacggtgct

SEQ ID NO: 8122284 - DNA, 22 bp, Homo sapiens
gaggaggtggagtcatgcagag

SEQ ID NO: 8122285 - DNA, 22 bp, Homo sapiens
gaggaggttccgggtggagaag

SEQ ID NO: 8122286 - DNA, 22 bp, Homo sapiens
gaggacagtgtgatctgccagc

SEQ ID NO: 8122287 - DNA, 17 bp, Homo sapiens
gaggacagggaagtagg

SEQ ID NO: 8122288 - DNA, 17 bp, Homo sapiens
gaggacagggaagtagg

SEQ ID NO: 8122289 - DNA, 17 bp, Homo sapiens
gaggacagggaagtagg

SEQ ID NO: 8122290 - DNA, 22 bp, Homo sapiens
gaggagaaagcagtgatttgtg

SEQ ID NO: 8122291 - DNA, 22 bp, Homo sapiens
gaggagaaattatccttggtgt

SEQ ID NO: 8122292 - DNA, 22 bp, Homo sapiens
gaggagagaagctaacggtgct

SEQ ID NO: 8122293 - DNA, 22 bp, Homo sapiens
gagggctgataacaggaataca

SEQ ID NO: 8122294 - DNA, 22 bp, Homo sapiens
gagggctgataaatgcgcatgg

SEQ ID NO: 8122295 - DNA, 22 bp, Homo sapiens
gagggccagcagcctcagcatg

SEQ ID NO: 8122296 - DNA, 22 bp, Homo sapiens
gagggccaggcggagacaggcg

SEQ ID NO: 8122297 - DNA, 22 bp, Homo sapiens
gagggccacgttcagggctctc

SEQ ID NO: 8122298 - DNA, 22 bp, Homo sapiens
gagggacagctaaagagaaatt

SEQ ID NO: 8122299 - DNA, 22 bp, Homo sapiens
gagggaccccaggctggccctt

SEQ ID NO: 8122300 - DNA, 22 bp, Homo sapiens
gagggaatggtgtgcaagaggt

SEQ ID NO: 8122301 - DNA, 22 bp, Homo sapiens
gagggaatggtgtgcaagaggt

SEQ ID NO: 8122302 - DNA, 22 bp, Homo sapiens
gaggctggttctgaagtactgt

SEQ ID NO: 8122303 - DNA, 22 bp, Homo sapiens
gaggcgagaagctggagatggt

SEQ ID NO: 8122304 - DNA, 19 bp, Homo sapiens
gaggcgaggcgtgcaggag

SEQ ID NO: 8122305 - DNA, 19 bp, Homo sapiens
gagtacaggtgcagaaatg

SEQ ID NO: 8122306 - DNA, 22 bp, Homo sapiens
gaggtgagaagggggtcagatg

SEQ ID NO: 8122307 - DNA, 22 bp, Homo sapiens
gaggtgagtggatcacgaggtc

SEQ ID NO: 8122308 - DNA, 22 bp, Homo sapiens
gagggtgcaggcaagagcaaaa

SEQ ID NO: 8122309 - DNA, 22 bp, Homo sapiens
gagggtcttacctaagcagggt

SEQ ID NO: 8122310 - DNA, 22 bp, Homo sapiens
gagggctgataacaggaataca

SEQ ID NO: 8122311 - DNA, 22 bp, Homo sapiens
gagggctgatgttgccacctca

SEQ ID NO: 8122312 - DNA, 22 bp, Homo sapiens
gagggtggagctccagaatctg

SEQ ID NO: 8122313 - DNA, 22 bp, Homo sapiens
gagggtggcctttagagcccat

SEQ ID NO: 8122314 - DNA, 22 bp, Homo sapiens
gagggtggcctttagagcccat

SEQ ID NO: 8122315 - DNA, 22 bp, Homo sapiens
gagggtgggccagatatgaggg

SEQ ID NO: 8122316 - DNA, 22 bp, Homo sapiens
gagggtggtggcttaaggtgct

SEQ ID NO: 8122317 - DNA, 22 bp, Homo sapiens
gaggtctgccttcaggagagtt

SEQ ID NO: 8122318 - DNA, 22 bp, Homo sapiens
gaattacaaagtgagacaagct

SEQ ID NO: 8122319 - DNA, 22 bp, Homo sapiens
gaattacagccagaagaatgaa

SEQ ID NO: 8122320 - DNA, 19 bp, Homo sapiens
gaatgggttctgtagggag

SEQ ID NO: 8122321 - DNA, 22 bp, Homo sapiens
gaatggctgaatgtcttaaatt

SEQ ID NO: 8122322 - DNA, 22 bp, Homo sapiens
gaatgcagatggctggtgtatg

SEQ ID NO: 8122323 - DNA, 22 bp, Homo sapiens
gaatgctaagcatgtgggagtt

SEQ ID NO: 8122324 - DNA, 22 bp, Homo sapiens
gaatgcatgtgaagcaaagaat

SEQ ID NO: 8122325 - DNA, 22 bp, Homo sapiens
gaagaatattcttgatcttaga

SEQ ID NO: 8122326 - DNA, 22 bp, Homo sapiens
gaagaatatggctctcagcaat

SEQ ID NO: 8122327 - DNA, 22 bp, Homo sapiens
gaagaatatataatgattttgt

SEQ ID NO: 8122328 - DNA, 22 bp, Homo sapiens
gacaaataggtcaacaggaggg

SEQ ID NO: 8122329 - DNA, 22 bp, Homo sapiens
gacagcaggatgtgaggggatg

SEQ ID NO: 8122330 - DNA, 20 bp, Homo sapiens
gacaacagagtaccaggaag

SEQ ID NO: 8122331 - DNA, 22 bp, Homo sapiens
gacaacagcatatggactgtca

SEQ ID NO: 8122332 - DNA, 18 bp, Homo sapiens
gacaaaagtacagacaga

SEQ ID NO: 8122333 - DNA, 22 bp, Homo sapiens
gacaaaagtgttttgaacaagg

SEQ ID NO: 8122334 - DNA, 21 bp, Homo sapiens
gacaaacatttcatagcttta

SEQ ID NO: 8122335 - DNA, 22 bp, Homo sapiens
gacatgcattaagacacactga

SEQ ID NO: 8122336 - DNA, 22 bp, Homo sapiens
gacatgcaacaatttggcattt

SEQ ID NO: 8122337 - DNA, 22 bp, Homo sapiens
gacatgcaatgcagtggtaagt

SEQ ID NO: 8122338 - DNA, 22 bp, Homo sapiens
gacatgcagttctcaagggtag

SEQ ID NO: 8122339 - DNA, 22 bp, Homo sapiens
gacatgcataacaagattggaa

SEQ ID NO: 8122340 - DNA, 22 bp, Homo sapiens
gacatgcatattcactcttctt

SEQ ID NO: 8122341 - DNA, 22 bp, Homo sapiens
gacatgcatgaatgcaggtctc

SEQ ID NO: 8122342 - DNA, 22 bp, Homo sapiens
gacatatttgaaaccaagagaa

SEQ ID NO: 8122343 - DNA, 22 bp, Homo sapiens
gacagtgacagcttggaaagca

SEQ ID NO: 8122344 - DNA, 22 bp, Homo sapiens
gacagtctgggcacacatgaaa

SEQ ID NO: 8122345 - DNA, 17 bp, Homo sapiens
gacagctggttcctggc

SEQ ID NO: 8122346 - DNA, 18 bp, Homo sapiens
gacagctgtcctgagccc

SEQ ID NO: 8122347 - DNA, 22 bp, Homo sapiens
gacagctgtacactcctggtta

SEQ ID NO: 8122348 - DNA, 22 bp, Homo sapiens
gacagcaggtgcttgggaaagg

SEQ ID NO: 8122349 - DNA, 22 bp, Homo sapiens
gacagctggcagtggaaaggtg

SEQ ID NO: 8122350 - DNA, 22 bp, Homo sapiens
gagaggcagaggcctgaaaccg

SEQ ID NO: 8122351 - DNA, 22 bp, Homo sapiens
gagaggagtccctatcacagtt

SEQ ID NO: 8122352 - DNA, 22 bp, Homo sapiens
gagaggatccacaaaccaggaa

SEQ ID NO: 8122353 - DNA, 22 bp, Homo sapiens
gagcacagaactaaatgctggt

SEQ ID NO: 8122354 - DNA, 22 bp, Homo sapiens
gagcacagatcctggagccaca

SEQ ID NO: 8122355 - DNA, 22 bp, Homo sapiens
gagcagaaagttatgtcttgca

SEQ ID NO: 8122356 - DNA, 22 bp, Homo sapiens
gagcacattcctcctgtgaatt

SEQ ID NO: 8122357 - DNA, 23 bp, Homo sapiens
gagcagagcgggcgggggtcctg

SEQ ID NO: 8122358 - DNA, 22 bp, Homo sapiens
gagcaggaactgaaaatgagac

SEQ ID NO: 8122359 - DNA, 22 bp, Homo sapiens
gagcaggaaggccagaagggtc

SEQ ID NO: 8122360 - DNA, 19 bp, Homo sapiens
gactccaactttaagcatg

SEQ ID NO: 8122361 - DNA, 22 bp, Homo sapiens
gagaaagggaacttacagagtg

SEQ ID NO: 8122362 - DNA, 22 bp, Homo sapiens
gagaaagggaacttacagagtg

SEQ ID NO: 8122363 - DNA, 22 bp, Homo sapiens
gagaacaggctctggagtcaga

SEQ ID NO: 8122364 - DNA, 22 bp, Homo sapiens
gagaaagggataatttgaagag

SEQ ID NO: 8122365 - DNA, 22 bp, Homo sapiens
gagaagaaatagaatcacattt

SEQ ID NO: 8122366 - DNA, 16 bp, Homo sapiens
gagaagagcccggcag

SEQ ID NO: 8122367 - DNA, 22 bp, Homo sapiens
gagaagcaatcgtgacatctcc

SEQ ID NO: 8122368 - DNA, 22 bp, Homo sapiens
gagaagcaggtttagcagacaa

SEQ ID NO: 8122369 - DNA, 22 bp, Homo sapiens
gagaaggaagttgagccagcat

SEQ ID NO: 8122370 - DNA, 22 bp, Homo sapiens
gagaaggaagttgagccagcat

SEQ ID NO: 8122371 - DNA, 22 bp, Homo sapiens
gagagaagaacaatgtcattca

SEQ ID NO: 8122372 - DNA, 22 bp, Homo sapiens
gagagaagaaagccatggtcct

SEQ ID NO: 8122373 - DNA, 22 bp, Homo sapiens
gagagaagaatgttccgaggcc

SEQ ID NO: 8122374 - DNA, 22 bp, Homo sapiens
gagagaagggacttctacactt

SEQ ID NO: 8122375 - DNA, 22 bp, Homo sapiens
gagagaagggggatatgagcct

SEQ ID NO: 8122376 - DNA, 18 bp, Homo sapiens
gagagcccagcaggtggt

SEQ ID NO: 8122377 - DNA, 22 bp, Homo sapiens
gagagagaaggcctgtgggtgt

SEQ ID NO: 8122378 - DNA, 22 bp, Homo sapiens
gagagacagcagaacgtgcagc

SEQ ID NO: 8122379 - DNA, 22 bp, Homo sapiens
gagagaatgtacatgctagggg

SEQ ID NO: 8122380 - DNA, 22 bp, Homo sapiens
gagaggaggtggctatgacagc

SEQ ID NO: 8122381 - DNA, 22 bp, Homo sapiens
gagaggagtagacactttggtt

SEQ ID NO: 8122382 - DNA, 22 bp, Homo sapiens
gagaggagtaggctgatggtgc

SEQ ID NO: 8122383 - DNA, 22 bp, Homo sapiens
gagaggagacttatccagattg

SEQ ID NO: 8122384 - DNA, 18 bp, Homo sapiens
gagaggagccagaatttt

SEQ ID NO: 8122385 - DNA, 22 bp, Homo sapiens
tatgtacatacatgtgcatacg

SEQ ID NO: 8122386 - DNA, 22 bp, Homo sapiens
tatgtacatatacacgtgtgtg

SEQ ID NO: 8122387 - DNA, 21 bp, Homo sapiens
tatggctttactaagctgcac

SEQ ID NO: 8122388 - DNA, 22 bp, Homo sapiens
tatgctttgatttcctcagctg

SEQ ID NO: 8122389 - DNA, 22 bp, Homo sapiens
tattaaattatggatttaggag

SEQ ID NO: 8122390 - DNA, 21 bp, Homo sapiens
tatgtagactcgttagaatgc

SEQ ID NO: 8122391 - DNA, 22 bp, Homo sapiens
tatgtagacaggctgcttttcc

SEQ ID NO: 8122392 - DNA, 22 bp, Homo sapiens
tatgtagatgtcatataaattg

SEQ ID NO: 8122393 - DNA, 22 bp, Homo sapiens
tatgtattctgagtacaagttc

SEQ ID NO: 8122394 - DNA, 22 bp, Homo sapiens
tatccaaagagattcatgttct

SEQ ID NO: 8122395 - DNA, 22 bp, Homo sapiens
tatcattttactgtgacatttt

SEQ ID NO: 8122396 - DNA, 22 bp, Homo sapiens
tatcatttagagtatttcttca

SEQ ID NO: 8122397 - DNA, 22 bp, Homo sapiens
tatcatttgttattattagtgg

SEQ ID NO: 8122398 - DNA, 22 bp, Homo sapiens
tatgaaaaggtggccaatgtag

SEQ ID NO: 8122399 - DNA, 19 bp, Homo sapiens
tatcactgggcactgagga

SEQ ID NO: 8122400 - DNA, 18 bp, Homo sapiens
tatcactgctgaacaaga

SEQ ID NO: 8122401 - DNA, 19 bp, Homo sapiens
tatcactgggcactgagga

SEQ ID NO: 8122402 - DNA, 22 bp, Homo sapiens
tatcacagtaaatctgggtgca

SEQ ID NO: 8122403 - DNA, 22 bp, Homo sapiens
tcaaagggtagcccagggaaga

SEQ ID NO: 8122404 - DNA, 22 bp, Homo sapiens
tcaaagggtccttaacatgaga

SEQ ID NO: 8122405 - DNA, 22 bp, Homo sapiens
tcaaagggtccttaacatgaga

SEQ ID NO: 8122406 - DNA, 22 bp, Homo sapiens
tcaaagggtaatgtaatagtct

SEQ ID NO: 8122407 - DNA, 22 bp, Homo sapiens
tcaaagtatatcccttcgaaac

SEQ ID NO: 8122408 - DNA, 22 bp, Homo sapiens
tcaaagtattttaactgtatcc

SEQ ID NO: 8122409 - DNA, 17 bp, Homo sapiens
tcaaagtattctgatgc

SEQ ID NO: 8122410 - DNA, 22 bp, Homo sapiens
tcaaaaataagatattctggac

SEQ ID NO: 8122411 - DNA, 22 bp, Homo sapiens
tatttgaccgtgaggaatatga

SEQ ID NO: 8122412 - DNA, 22 bp, Homo sapiens
tatttgaccgtgaggaatatga

SEQ ID NO: 8122413 - DNA, 22 bp, Homo sapiens
tatttgactcttaggaagactc

SEQ ID NO: 8122414 - DNA, 22 bp, Homo sapiens
tatttaattagtgattgtagag

SEQ ID NO: 8122415 - DNA, 22 bp, Homo sapiens
tatttcttgttattctcgttga

SEQ ID NO: 8122416 - DNA, 22 bp, Homo sapiens
tatttgctgtgcttattccatt

SEQ ID NO: 8122417 - DNA, 22 bp, Homo sapiens
tatttaaccagttaaatttcca

SEQ ID NO: 8122418 - DNA, 23 bp, Homo sapiens
tattacaattggtcttattaaga

SEQ ID NO: 8122419 - DNA, 22 bp, Homo sapiens
tattacaatttacattgcactt

SEQ ID NO: 8122420 - DNA, 22 bp, Homo sapiens
tagatacctgctggacctcatt

SEQ ID NO: 8122421 - DNA, 22 bp, Homo sapiens
tagatataaggtccttagaaca

SEQ ID NO: 8122422 - DNA, 22 bp, Homo sapiens
tagagaggtttgaattggctgc

SEQ ID NO: 8122423 - DNA, 23 bp, Homo sapiens
tagacctctgctctaaccattag

SEQ ID NO: 8122424 - DNA, 22 bp, Homo sapiens
tagaagataagacaagtgctgc

SEQ ID NO: 8122425 - DNA, 22 bp, Homo sapiens
tacttacattagcaaacaaggt

SEQ ID NO: 8122426 - DNA, 22 bp, Homo sapiens
tagaaatggggaagtagttagg

SEQ ID NO: 8122427 - DNA, 22 bp, Homo sapiens
tagcaacaagtgactatctata

SEQ ID NO: 8122428 - DNA, 22 bp, Homo sapiens
tagcaacatggttatcacatta

SEQ ID NO: 8122429 - DNA, 22 bp, Homo sapiens
tagcaacataagaaacattttg

SEQ ID NO: 8122430 - DNA, 22 bp, Homo sapiens
tagcaacaatggaagtaacttc

SEQ ID NO: 8122431 - DNA, 22 bp, Homo sapiens
tagcaaatgcctggttaattag

SEQ ID NO: 8122432 - DNA, 21 bp, Homo sapiens
tagatgaaatcagagtatttc

SEQ ID NO: 8122433 - DNA, 22 bp, Homo sapiens
tagatgaagcaacatgtgtaat

SEQ ID NO: 8122434 - DNA, 22 bp, Homo sapiens
tagcaaactcatacatgtgggt

SEQ ID NO: 8122435 - DNA, 22 bp, Homo sapiens
tagctgccaaaagggtgggcta

SEQ ID NO: 8122436 - DNA, 22 bp, Homo sapiens
tagctgcacaggaagtaagatt

SEQ ID NO: 8122437 - DNA, 22 bp, Homo sapiens
tagctgccagaccattcttact

SEQ ID NO: 8122438 - DNA, 19 bp, Homo sapiens
tagctgcctgttacctcca

SEQ ID NO: 8122439 - DNA, 22 bp, Homo sapiens
tagctgcctttgggctcctgct

SEQ ID NO: 8122440 - DNA, 22 bp, Homo sapiens
tagggcagagtccaggatgggc

SEQ ID NO: 8122441 - DNA, 22 bp, Homo sapiens
tagggcagccacccaggctgct

SEQ ID NO: 8122442 - DNA, 22 bp, Homo sapiens
tagggcagccacccaggctgct

SEQ ID NO: 8122443 - DNA, 22 bp, Homo sapiens
tagggcagctgcatcaggcact

SEQ ID NO: 8122444 - DNA, 22 bp, Homo sapiens
tagggctgtgtctccaggacca

SEQ ID NO: 8122445 - DNA, 16 bp, Homo sapiens
tagggctgggaaggag

SEQ ID NO: 8122446 - DNA, 22 bp, Homo sapiens
tagggctgtttaaaagtgaggt

SEQ ID NO: 8122447 - DNA, 22 bp, Homo sapiens
tagggctgctgcagatgacagg

SEQ ID NO: 8122448 - DNA, 22 bp, Homo sapiens
tagggctgcctatggctagata

SEQ ID NO: 8122449 - DNA, 22 bp, Homo sapiens
tagtgccctcccctttgggata

SEQ ID NO: 8122450 - DNA, 22 bp, Homo sapiens
tagtgcttaaaagtggaagaga

SEQ ID NO: 8122451 - DNA, 22 bp, Homo sapiens
tagtggagaagtggagtctgtg

SEQ ID NO: 8122452 - DNA, 22 bp, Homo sapiens
tagttacagagaaatgatttga

SEQ ID NO: 8122453 - DNA, 22 bp, Homo sapiens
tagttacagcaggcaggatata

SEQ ID NO: 8122454 - DNA, 22 bp, Homo sapiens
tagttacagagaaatgatttga

SEQ ID NO: 8122455 - DNA, 22 bp, Homo sapiens
tagttacaatgggttctgtgac

SEQ ID NO: 8122456 - DNA, 22 bp, Homo sapiens
tagtggagggtgtagctgctgg

SEQ ID NO: 8122457 - DNA, 22 bp, Homo sapiens
tagtggaggtggtctgtgaact

SEQ ID NO: 8122458 - DNA, 22 bp, Homo sapiens
tagtggagtagaaaccaaagaa

SEQ ID NO: 8122459 - DNA, 19 bp, Homo sapiens
tagtggagtgacaagttct

SEQ ID NO: 8122460 - DNA, 22 bp, Homo sapiens
tagtggaggcctgttgtgtgca

SEQ ID NO: 8122461 - DNA, 22 bp, Homo sapiens
tagtggagagttgttttgtgca

SEQ ID NO: 8122462 - DNA, 22 bp, Homo sapiens
tagtggaggggatgcaaagctt

SEQ ID NO: 8122463 - DNA, 22 bp, Homo sapiens
tagtggagaggatgtggagaaa

SEQ ID NO: 8122464 - DNA, 22 bp, Homo sapiens
taggggaactggcacagggcag

SEQ ID NO: 8122465 - DNA, 23 bp, Homo sapiens
taggggctggcgtggagcctgcg

SEQ ID NO: 8122466 - DNA, 21 bp, Homo sapiens
taggggctggggctccagctg

SEQ ID NO: 8122467 - DNA, 22 bp, Homo sapiens
taggggcttgtaatttaataga

SEQ ID NO: 8122468 - DNA, 22 bp, Homo sapiens
tagtctctggagactctagggg

SEQ ID NO: 8122469 - DNA, 22 bp, Homo sapiens
tagtctctgctttgcccttggc

SEQ ID NO: 8122470 - DNA, 22 bp, Homo sapiens
tagtgcatacctaacatttttg

SEQ ID NO: 8122471 - DNA, 22 bp, Homo sapiens
tagtgcatataactagaatacc

SEQ ID NO: 8122472 - DNA, 22 bp, Homo sapiens
tagtgcattcatctgatcctgt

SEQ ID NO: 8122473 - DNA, 23 bp, Homo sapiens
tagttattttctctgtaatttgc

SEQ ID NO: 8122474 - DNA, 22 bp, Homo sapiens
tagttacataaagtggactgtt

SEQ ID NO: 8122475 - DNA, 22 bp, Homo sapiens
tagttacaggagtttctgaaat

SEQ ID NO: 8122476 - DNA, 22 bp, Homo sapiens
tagtttactcatctataaaatg

SEQ ID NO: 8122477 - DNA, 22 bp, Homo sapiens
tagtttcatctccaccctgccc

SEQ ID NO: 8122478 - DNA, 22 bp, Homo sapiens
taccaggcagctgcacagaggc

SEQ ID NO: 8122479 - DNA, 22 bp, Homo sapiens
taccactgataccttggagttc

SEQ ID NO: 8122480 - DNA, 22 bp, Homo sapiens
taccattttgaaacatttcatc

SEQ ID NO: 8122481 - DNA, 22 bp, Homo sapiens
tactataacttcgaagtcctgg

SEQ ID NO: 8122482 - DNA, 22 bp, Homo sapiens
tactgttaatgttaaattcagg

SEQ ID NO: 8122483 - DNA, 22 bp, Homo sapiens
tactgtactcaacatgtgagtt

SEQ ID NO: 8122484 - DNA, 22 bp, Homo sapiens
tactcccaccatggctgatttc

SEQ ID NO: 8122485 - DNA, 22 bp, Homo sapiens
tacttacactgaagcaaagata

SEQ ID NO: 8122486 - DNA, 22 bp, Homo sapiens
tactgttttttagactcatggt

SEQ ID NO: 8122487 - DNA, 22 bp, Homo sapiens
tactgttttctttacaccatgt

SEQ ID NO: 8122488 - DNA, 18 bp, Homo sapiens
tactgtttaattgattac

SEQ ID NO: 8122489 - DNA, 22 bp, Homo sapiens
tactgttatatatagcagcagt

SEQ ID NO: 8122490 - DNA, 22 bp, Homo sapiens
tactgttttctataatggctgt

SEQ ID NO: 8122491 - DNA, 22 bp, Homo sapiens
tacagtggtgacaatatggaca

SEQ ID NO: 8122492 - DNA, 22 bp, Homo sapiens
tacagtggaaaactcagtgtgt

SEQ ID NO: 8122493 - DNA, 22 bp, Homo sapiens
tacagacagtttttcagatatt

SEQ ID NO: 8122494 - DNA, 22 bp, Homo sapiens
tacagagatttattgctaaggc

SEQ ID NO: 8122495 - DNA, 22 bp, Homo sapiens
tacagagatgccgaagagtgaa

SEQ ID NO: 8122496 - DNA, 22 bp, Homo sapiens
tacagaggagaccaaggctcag

SEQ ID NO: 8122497 - DNA, 22 bp, Homo sapiens
tacagagatttattgctaaggc

SEQ ID NO: 8122498 - DNA, 22 bp, Homo sapiens
tacatgtatgtgttaatatctg

SEQ ID NO: 8122499 - DNA, 22 bp, Homo sapiens
tacatgtaggtgacattttaat

SEQ ID NO: 8122500 - DNA, 22 bp, Homo sapiens
tacatgcattggatggcaatag

SEQ ID NO: 8122501 - DNA, 22 bp, Homo sapiens
tacatgcatgtgtgtaaatata

SEQ ID NO: 8122502 - DNA, 22 bp, Homo sapiens
tacatgcatgtcacagaatgaa

SEQ ID NO: 8122503 - DNA, 22 bp, Homo sapiens
tacatgcatacttgtgtgtgta

SEQ ID NO: 8122504 - DNA, 22 bp, Homo sapiens
tacatgcatgatacaaagttgc

SEQ ID NO: 8122505 - DNA, 19 bp, Homo sapiens
tacatgcagcaggcacgca

SEQ ID NO: 8122506 - DNA, 18 bp, Homo sapiens
tacatgcataaatgaagc

SEQ ID NO: 8122507 - DNA, 19 bp, Homo sapiens
tacatgcacatgtgcgtgc

SEQ ID NO: 8122508 - DNA, 22 bp, Homo sapiens
tacatgaatttgagtcagagga

SEQ ID NO: 8122509 - DNA, 22 bp, Homo sapiens
tacatgcaattaagagggtgaa

SEQ ID NO: 8122510 - DNA, 22 bp, Homo sapiens
tacatgcaaggatatttgtgcg

SEQ ID NO: 8122511 - DNA, 22 bp, Homo sapiens
tacatgcaatgaggattctagt

SEQ ID NO: 8122512 - DNA, 22 bp, Homo sapiens
tacatgcacatgaacatgtgtg

SEQ ID NO: 8122513 - DNA, 22 bp, Homo sapiens
taatccagggtattctagtttc

SEQ ID NO: 8122514 - DNA, 22 bp, Homo sapiens
taatatatttctgctaagctca

SEQ ID NO: 8122515 - DNA, 22 bp, Homo sapiens
taattattatgacaacaattgc

SEQ ID NO: 8122516 - DNA, 22 bp, Homo sapiens
taatcttagacatgtatttttc

SEQ ID NO: 8122517 - DNA, 22 bp, Homo sapiens
taattgaactaacatgcaaaca

SEQ ID NO: 8122518 - DNA, 22 bp, Homo sapiens
taattatttgaagacattagag

SEQ ID NO: 8122519 - DNA, 21 bp, Homo sapiens
taattccagaggtcactgaag

SEQ ID NO: 8122520 - DNA, 22 bp, Homo sapiens
taattccacctttttccaactt

SEQ ID NO: 8122521 - DNA, 22 bp, Homo sapiens
taattccaagttgagacatgca

SEQ ID NO: 8122522 - DNA, 22 bp, Homo sapiens
taaggacattagaaatgatgct

SEQ ID NO: 8122523 - DNA, 22 bp, Homo sapiens
taaggacattggttttgagtaa

SEQ ID NO: 8122524 - DNA, 22 bp, Homo sapiens
taaggacaatttgtcgcttgca

SEQ ID NO: 8122525 - DNA, 22 bp, Homo sapiens
taaggacagcagctacttttcc

SEQ ID NO: 8122526 - DNA, 22 bp, Homo sapiens
taaggacaatcaggttagtagc

SEQ ID NO: 8122527 - DNA, 22 bp, Homo sapiens
taatatatacctttgttaggaa

SEQ ID NO: 8122528 - DNA, 22 bp, Homo sapiens
taaggaaggggaaagacatgtc

SEQ ID NO: 8122529 - DNA, 22 bp, Homo sapiens
taagctcactgtaagaactgat

SEQ ID NO: 8122530 - DNA, 21 bp, Homo sapiens
taagccaccatgtgaaaccag

SEQ ID NO: 8122531 - DNA, 22 bp, Homo sapiens
taagccactagtctgttatgaa

SEQ ID NO: 8122532 - DNA, 22 bp, Homo sapiens
taagccccctcaccctggcttc

SEQ ID NO: 8122533 - DNA, 21 bp, Homo sapiens
taagccaccatgtgaaaccag

SEQ ID NO: 8122534 - DNA, 21 bp, Homo sapiens
tacaagatagaggtaatatat

SEQ ID NO: 8122535 - DNA, 22 bp, Homo sapiens
tacaagaatgtcttaaaagctc

SEQ ID NO: 8122536 - DNA, 22 bp, Homo sapiens
tacaagacgagggaagttcttt

SEQ ID NO: 8122537 - DNA, 21 bp, Homo sapiens
tacaagaccggattcgggccc

SEQ ID NO: 8122538 - DNA, 22 bp, Homo sapiens
taatttcaatagcttgcataat

SEQ ID NO: 8122539 - DNA, 22 bp, Homo sapiens
tacaagaaatttctgcatatat

SEQ ID NO: 8122540 - DNA, 22 bp, Homo sapiens
tacacataggagggtaataaaa

SEQ ID NO: 8122541 - DNA, 22 bp, Homo sapiens
taagacagggtctattcttagt

SEQ ID NO: 8122542 - DNA, 22 bp, Homo sapiens
taacatgcattgacaaatattt

SEQ ID NO: 8122543 - DNA, 21 bp, Homo sapiens
taagacagtatgaatactttc

SEQ ID NO: 8122544 - DNA, 22 bp, Homo sapiens
taagacatttgaaatgtgatcc

SEQ ID NO: 8122545 - DNA, 22 bp, Homo sapiens
taagacatggttgatctagtgt

SEQ ID NO: 8122546 - DNA, 22 bp, Homo sapiens
taacaggatgacagcagacatt

SEQ ID NO: 8122547 - DNA, 22 bp, Homo sapiens
taaatgctcagaccttattcca

SEQ ID NO: 8122548 - DNA, 22 bp, Homo sapiens
taaatgctccatacatacacca

SEQ ID NO: 8122549 - DNA, 22 bp, Homo sapiens
taaatgctatcgcataaaacct

SEQ ID NO: 8122550 - DNA, 22 bp, Homo sapiens
taacatgagagctaagacatta

SEQ ID NO: 8122551 - DNA, 22 bp, Homo sapiens
taacagtatagcctaacatttc

SEQ ID NO: 8122552 - DNA, 20 bp, Homo sapiens
taacagtaagtgatgttaca

SEQ ID NO: 8122553 - DNA, 22 bp, Homo sapiens
taacagtaaagtaagttagctt

SEQ ID NO: 8122554 - DNA, 22 bp, Homo sapiens
taacagtattgaagataaacta

SEQ ID NO: 8122555 - DNA, 23 bp, Homo sapiens
taaagacagccttcaggattctg

SEQ ID NO: 8122556 - DNA, 22 bp, Homo sapiens
taaagacataggatcagggaga

SEQ ID NO: 8122557 - DNA, 22 bp, Homo sapiens
taaaagacatataactgtagga

SEQ ID NO: 8122558 - DNA, 22 bp, Homo sapiens
taaaagattttataggaacaag

SEQ ID NO: 8122559 - DNA, 22 bp, Homo sapiens
taaagcaaaaatgaactgccat

SEQ ID NO: 8122560 - DNA, 22 bp, Homo sapiens
taaagcaaggcaaattgttggt

SEQ ID NO: 8122561 - DNA, 18 bp, Homo sapiens
taaatgcatgttaataac

SEQ ID NO: 8122562 - DNA, 22 bp, Homo sapiens
taaatgcagttagtacttgcca

SEQ ID NO: 8122563 - DNA, 22 bp, Homo sapiens
taaatgataataatgctagtgt

SEQ ID NO: 8122564 - DNA, 22 bp, Homo sapiens
taaatgatttatgtatgtgaaa

SEQ ID NO: 8122565 - DNA, 22 bp, Homo sapiens
gttctgctgtaatatctctgct

SEQ ID NO: 8122566 - DNA, 22 bp, Homo sapiens
gttatacgcctgtcaggaagct

SEQ ID NO: 8122567 - DNA, 22 bp, Homo sapiens
gttatgctgagttgcatgaggt

SEQ ID NO: 8122568 - DNA, 22 bp, Homo sapiens
gttgaagtaaggcagccacagg

SEQ ID NO: 8122569 - DNA, 22 bp, Homo sapiens
gtttcaaagtcagaaaaggagg

SEQ ID NO: 8122570 - DNA, 22 bp, Homo sapiens
gtttatattcaacggagtatct

SEQ ID NO: 8122571 - DNA, 22 bp, Homo sapiens
tcatttataaggatgcaattaa

SEQ ID NO: 8122572 - DNA, 22 bp, Homo sapiens
tcatttataaggatgcaattaa

SEQ ID NO: 8122573 - DNA, 22 bp, Homo sapiens
tcatttacatagaaacaatata

SEQ ID NO: 8122574 - DNA, 22 bp, Homo sapiens
tcatttacacttcacaaatgga

SEQ ID NO: 8122575 - DNA, 22 bp, Homo sapiens
tcattgttgcgttaatgtcttc

SEQ ID NO: 8122576 - DNA, 22 bp, Homo sapiens
tcatttctccgacctgctgtcc

SEQ ID NO: 8122577 - DNA, 22 bp, Homo sapiens
tcatttctattgctactgtctg

SEQ ID NO: 8122578 - DNA, 21 bp, Homo sapiens
tcatttctctatgtatttcac

SEQ ID NO: 8122579 - DNA, 22 bp, Homo sapiens
tcatttctcctaagtgaaatat

SEQ ID NO: 8122580 - DNA, 22 bp, Homo sapiens
tcatttctgagccttccatgat

SEQ ID NO: 8122581 - DNA, 22 bp, Homo sapiens
tcatttctctgagtctgataat

SEQ ID NO: 8122582 - DNA, 22 bp, Homo sapiens
tcatttatattgtattctgtag

SEQ ID NO: 8122583 - DNA, 22 bp, Homo sapiens
tcatttatcatttgtgctgtag

SEQ ID NO: 8122584 - DNA, 21 bp, Homo sapiens
tccaagccttcaacacattca

SEQ ID NO: 8122585 - DNA, 22 bp, Homo sapiens
tccaactccacctttgtctccc

SEQ ID NO: 8122586 - DNA, 22 bp, Homo sapiens
tccaagggttcatgtgcattca

SEQ ID NO: 8122587 - DNA, 22 bp, Homo sapiens
tccaagggcatgctgaaataag

SEQ ID NO: 8122588 - DNA, 23 bp, Homo sapiens
tccaagggctacaaacacagacc

SEQ ID NO: 8122589 - DNA, 22 bp, Homo sapiens
tccaagggctttggcgtgaagt

SEQ ID NO: 8122590 - DNA, 22 bp, Homo sapiens
tccaagggcagcagccatagcc

SEQ ID NO: 8122591 - DNA, 20 bp, Homo sapiens
tccaagggcagcagaatcag

SEQ ID NO: 8122592 - DNA, 22 bp, Homo sapiens
tccaaggctccggccctggcgt

SEQ ID NO: 8122593 - DNA, 22 bp, Homo sapiens
tccaagggaaactgcacttcta

SEQ ID NO: 8122594 - DNA, 22 bp, Homo sapiens
tccaaagaacctggctactgtc

SEQ ID NO: 8122595 - DNA, 21 bp, Homo sapiens
tccaaacctgtctctggctct

SEQ ID NO: 8122596 - DNA, 21 bp, Homo sapiens
tcatttgtgatctgatttcca

SEQ ID NO: 8122597 - DNA, 22 bp, Homo sapiens
tcagtagtgttagcaatgttaa

SEQ ID NO: 8122598 - DNA, 22 bp, Homo sapiens
tcagggccctggacaaccctcc

SEQ ID NO: 8122599 - DNA, 22 bp, Homo sapiens
tcagggctgcatacaggagata

SEQ ID NO: 8122600 - DNA, 17 bp, Homo sapiens
tcaggctgggtgcagtg

SEQ ID NO: 8122601 - DNA, 20 bp, Homo sapiens
tcaggctggtgggctttccc

SEQ ID NO: 8122602 - DNA, 22 bp, Homo sapiens
tcaggctggtccccacagtgga

SEQ ID NO: 8122603 - DNA, 22 bp, Homo sapiens
tcaggctgtagggcccctggag

SEQ ID NO: 8122604 - DNA, 22 bp, Homo sapiens
tcaggctgtaaatggtgtgggt

SEQ ID NO: 8122605 - DNA, 22 bp, Homo sapiens
tcaggctggtggtcagatggct

SEQ ID NO: 8122606 - DNA, 22 bp, Homo sapiens
tcaggctgtagggcccctggag

SEQ ID NO: 8122607 - DNA, 22 bp, Homo sapiens
tcaggctgttcctgtccaaaat

SEQ ID NO: 8122608 - DNA, 22 bp, Homo sapiens
tcataaatgcagtgtcataaat

SEQ ID NO: 8122609 - DNA, 23 bp, Homo sapiens
tcataaatattagcacagtagga

SEQ ID NO: 8122610 - DNA, 22 bp, Homo sapiens
tcacatttctgattataccaaa

SEQ ID NO: 8122611 - DNA, 22 bp, Homo sapiens
tcacatttatttcaaagttact

SEQ ID NO: 8122612 - DNA, 22 bp, Homo sapiens
tcaaccagagtttttcttaata

SEQ ID NO: 8122613 - DNA, 23 bp, Homo sapiens
tcagaagtttggttgtaacatgg

SEQ ID NO: 8122614 - DNA, 22 bp, Homo sapiens
tcagaagtttcaatcccagctg

SEQ ID NO: 8122615 - DNA, 20 bp, Homo sapiens
tcagaagtttcctggagcat

SEQ ID NO: 8122616 - DNA, 22 bp, Homo sapiens
tcagaagttgataaagtagttg

SEQ ID NO: 8122617 - DNA, 22 bp, Homo sapiens
tcagaagttgagatattcaggg

SEQ ID NO: 8122618 - DNA, 22 bp, Homo sapiens
tcagaagttaatatataaattt

SEQ ID NO: 8122619 - DNA, 22 bp, Homo sapiens
tcagaagttgaaggctcttttt

SEQ ID NO: 8122620 - DNA, 22 bp, Homo sapiens
tcagaagttaatacgaggagaa

SEQ ID NO: 8122621 - DNA, 22 bp, Homo sapiens
tcacattttatctattttaagt

SEQ ID NO: 8122622 - DNA, 22 bp, Homo sapiens
tcacattttatctattttaagt

SEQ ID NO: 8122623 - DNA, 22 bp, Homo sapiens
tcacatttgcaattgcattgtt

SEQ ID NO: 8122624 - DNA, 22 bp, Homo sapiens
tcacatttgcaattgcattgtt

SEQ ID NO: 8122625 - DNA, 22 bp, Homo sapiens
tcacatttgtgttttattagag

SEQ ID NO: 8122626 - DNA, 22 bp, Homo sapiens
tcacatttgttcttgaatctaa

SEQ ID NO: 8122627 - DNA, 22 bp, Homo sapiens
tcacatttgttcctctgcactt

SEQ ID NO: 8122628 - DNA, 22 bp, Homo sapiens
tcactgctcgataacatgatta

SEQ ID NO: 8122629 - DNA, 22 bp, Homo sapiens
tcagctgctgtggtatgtacat

SEQ ID NO: 8122630 - DNA, 22 bp, Homo sapiens
tcagctgctcaaatttatgtca

SEQ ID NO: 8122631 - DNA, 22 bp, Homo sapiens
tcagctctgcactccactgtgg

SEQ ID NO: 8122632 - DNA, 22 bp, Homo sapiens
tcagctggtgagtggatagaca

SEQ ID NO: 8122633 - DNA, 22 bp, Homo sapiens
tcaggagaaggcaatgtggaaa

SEQ ID NO: 8122634 - DNA, 22 bp, Homo sapiens
tcaggacacttggcacaaggtc

SEQ ID NO: 8122635 - DNA, 22 bp, Homo sapiens
tcagcaaaggcaattcattatt

SEQ ID NO: 8122636 - DNA, 22 bp, Homo sapiens
tcagatgtccttccagagattt

SEQ ID NO: 8122637 - DNA, 22 bp, Homo sapiens
tcagattttattttcctgttac

SEQ ID NO: 8122638 - DNA, 22 bp, Homo sapiens
tcctgcctcttttcttattcca

SEQ ID NO: 8122639 - DNA, 22 bp, Homo sapiens
tcctgcctctccatgctaacta

SEQ ID NO: 8122640 - DNA, 22 bp, Homo sapiens
tcctgcagccactgcaggcaga

SEQ ID NO: 8122641 - DNA, 22 bp, Homo sapiens
tcctgcagacctcagtcaggtc

SEQ ID NO: 8122642 - DNA, 19 bp, Homo sapiens
tcctgcagaccagacctgt

SEQ ID NO: 8122643 - DNA, 22 bp, Homo sapiens
tcctgagataggagttgaaggc

SEQ ID NO: 8122644 - DNA, 22 bp, Homo sapiens
tcctgagataaatctcatgtga

SEQ ID NO: 8122645 - DNA, 22 bp, Homo sapiens
tcctgaggaaagttcatgaatg

SEQ ID NO: 8122646 - DNA, 22 bp, Homo sapiens
tcctgagagccttggcttcaga

SEQ ID NO: 8122647 - DNA, 22 bp, Homo sapiens
tcctgagagcagagtccaggtg

SEQ ID NO: 8122648 - DNA, 22 bp, Homo sapiens
tcctcttgggaatacctttcta

SEQ ID NO: 8122649 - DNA, 22 bp, Homo sapiens
tcctcttcagagggacctcggg

SEQ ID NO: 8122650 - DNA, 22 bp, Homo sapiens
tcctcttccttctgtccaaatg

SEQ ID NO: 8122651 - DNA, 22 bp, Homo sapiens
tcctctgggctccctgcaacag

SEQ ID NO: 8122652 - DNA, 22 bp, Homo sapiens
tccctggcacaagaaggctgtc

SEQ ID NO: 8122653 - DNA, 22 bp, Homo sapiens
tccctggcacaagaaggctgtc

SEQ ID NO: 8122654 - DNA, 22 bp, Homo sapiens
tccctggcactgctgtgattag

SEQ ID NO: 8122655 - DNA, 22 bp, Homo sapiens
tccctggcagctaagggtggtc

SEQ ID NO: 8122656 - DNA, 22 bp, Homo sapiens
tccctggcagctgtcctttcag

SEQ ID NO: 8122657 - DNA, 22 bp, Homo sapiens
tccctggctgggggctgccttg

SEQ ID NO: 8122658 - DNA, 22 bp, Homo sapiens
tccctgggaccggcagctcaca

SEQ ID NO: 8122659 - DNA, 22 bp, Homo sapiens
tcctagaataatctttgactgc

SEQ ID NO: 8122660 - DNA, 22 bp, Homo sapiens
tcctagaatagtgtgtctggag

SEQ ID NO: 8122661 - DNA, 22 bp, Homo sapiens
tcctagaatctttgtaagattg

SEQ ID NO: 8122662 - DNA, 22 bp, Homo sapiens
tcctagaatgcacctctgctgt

SEQ ID NO: 8122663 - DNA, 22 bp, Homo sapiens
tcctagaatgcacctctgctgt

SEQ ID NO: 8122664 - DNA, 22 bp, Homo sapiens
tcctcactgcagtgctccgagc

SEQ ID NO: 8122665 - DNA, 22 bp, Homo sapiens
tcctcacatggtgagccacaca

SEQ ID NO: 8122666 - DNA, 22 bp, Homo sapiens
tcctcacacccataccactgac

SEQ ID NO: 8122667 - DNA, 22 bp, Homo sapiens
tcctcacaagcatcctgtctca

SEQ ID NO: 8122668 - DNA, 22 bp, Homo sapiens
tcctcacagctggttcattcag

SEQ ID NO: 8122669 - DNA, 22 bp, Homo sapiens
tcctcaaaggatacccaggctt

SEQ ID NO: 8122670 - DNA, 22 bp, Homo sapiens
tcctcagcattagcacagacat

SEQ ID NO: 8122671 - DNA, 21 bp, Homo sapiens
tcctcagggccccagagcact

SEQ ID NO: 8122672 - DNA, 23 bp, Homo sapiens
tcctcagcatgttttgtcatgta

SEQ ID NO: 8122673 - DNA, 23 bp, Homo sapiens
tcctcagcatgttttgtcatgta

SEQ ID NO: 8122674 - DNA, 22 bp, Homo sapiens
tcctcagcaaacacttcactct

SEQ ID NO: 8122675 - DNA, 22 bp, Homo sapiens
tccctcagatgagctcctagca

SEQ ID NO: 8122676 - DNA, 22 bp, Homo sapiens
tccctcagagggcaagcgcaga

SEQ ID NO: 8122677 - DNA, 22 bp, Homo sapiens
tcccaggctgggggcctgaagt

SEQ ID NO: 8122678 - DNA, 22 bp, Homo sapiens
tcccaggctggcaggcagcagt

SEQ ID NO: 8122679 - DNA, 22 bp, Homo sapiens
tcccaggctaggcctctgcgtt

SEQ ID NO: 8122680 - DNA, 22 bp, Homo sapiens
tccctcagtccctggacaggca

SEQ ID NO: 8122681 - DNA, 22 bp, Homo sapiens
tccctcagcttgtctccatgca

SEQ ID NO: 8122682 - DNA, 20 bp, Homo sapiens
tccctcagtttccagccctg

SEQ ID NO: 8122683 - DNA, 22 bp, Homo sapiens
tccatgggaagattttgagtgg

SEQ ID NO: 8122684 - DNA, 22 bp, Homo sapiens
tcccagcataacaaactgcccg

SEQ ID NO: 8122685 - DNA, 22 bp, Homo sapiens
tcccagcattaatgcctgtcag

SEQ ID NO: 8122686 - DNA, 22 bp, Homo sapiens
tcccaggccataaaactcagag

SEQ ID NO: 8122687 - DNA, 22 bp, Homo sapiens
tcccaggcaggtgacaggggga

SEQ ID NO: 8122688 - DNA, 22 bp, Homo sapiens
tcccagcctggaccctgccagt

SEQ ID NO: 8122689 - DNA, 22 bp, Homo sapiens
tcccagcctggaccctgccagt

SEQ ID NO: 8122690 - DNA, 22 bp, Homo sapiens
tcccagcctgacagtgcatcaa

SEQ ID NO: 8122691 - DNA, 22 bp, Homo sapiens
tccacaaggcagctcctccagg

SEQ ID NO: 8122692 - DNA, 22 bp, Homo sapiens
tccaggctaattttgcattgtt

SEQ ID NO: 8122693 - DNA, 22 bp, Homo sapiens
tccaggctaattttgcattgtt

SEQ ID NO: 8122694 - DNA, 22 bp, Homo sapiens
tccaggctagcctggtagagaa

SEQ ID NO: 8122695 - DNA, 21 bp, Homo sapiens
tccaggctggaaggggcgttg

SEQ ID NO: 8122696 - DNA, 22 bp, Homo sapiens
tccaggctagagtgcagtggcc

SEQ ID NO: 8122697 - DNA, 22 bp, Homo sapiens
tccaggctagaagtcacaggcc

SEQ ID NO: 8122698 - DNA, 22 bp, Homo sapiens
tccaggctacttggattcctgg

SEQ ID NO: 8122699 - DNA, 22 bp, Homo sapiens
tccaggctagaagtcacaggcc

SEQ ID NO: 8122700 - DNA, 22 bp, Homo sapiens
tccaggctggagtgcagtggca

SEQ ID NO: 8122701 - DNA, 22 bp, Homo sapiens
tccaggctggacatgaggcggg

SEQ ID NO: 8122702 - DNA, 22 bp, Homo sapiens
tccaggctggagtgcagtggcg

SEQ ID NO: 8122703 - DNA, 22 bp, Homo sapiens
tccaggctggcctcgcgtgaca

SEQ ID NO: 8122704 - DNA, 18 bp, Homo sapiens
tccaggctggattgatga

SEQ ID NO: 8122705 - DNA, 22 bp, Homo sapiens
tccaggctggctcttcaaaatt

SEQ ID NO: 8122706 - DNA, 22 bp, Homo sapiens
tccaggctggcctcgcgtgaca

SEQ ID NO: 8122707 - DNA, 22 bp, Homo sapiens
tccaggctgggctgaagggtgc

SEQ ID NO: 8122708 - DNA, 23 bp, Homo sapiens
tccaggctgggacttcaactggc

SEQ ID NO: 8122709 - DNA, 22 bp, Homo sapiens
gcagacacttttattctgcata

SEQ ID NO: 8122710 - DNA, 22 bp, Homo sapiens
gcagaagggaataaggagcttt

SEQ ID NO: 8122711 - DNA, 22 bp, Homo sapiens
gcagacagatgagggtgctggg

SEQ ID NO: 8122712 - DNA, 22 bp, Homo sapiens
gcagaaggatccgcaggtgcaa

SEQ ID NO: 8122713 - DNA, 22 bp, Homo sapiens
gcacccagaggtcagcagtgct

SEQ ID NO: 8122714 - DNA, 22 bp, Homo sapiens
gcacatttaactgagctcagga

SEQ ID NO: 8122715 - DNA, 22 bp, Homo sapiens
gcaccactaagagcagggaccg

SEQ ID NO: 8122716 - DNA, 22 bp, Homo sapiens
gcaccagagggggctctgcagg

SEQ ID NO: 8122717 - DNA, 22 bp, Homo sapiens
gcacccagaggtcagcagtgct

SEQ ID NO: 8122718 - DNA, 22 bp, Homo sapiens
gcaccaggaggcccttctcatc

SEQ ID NO: 8122719 - DNA, 22 bp, Homo sapiens
gcagagtgggagcccagggctg

SEQ ID NO: 8122720 - DNA, 22 bp, Homo sapiens
gcagaggtgctcagtggcagaa

SEQ ID NO: 8122721 - DNA, 22 bp, Homo sapiens
gcagacagggctacagaggtac

SEQ ID NO: 8122722 - DNA, 22 bp, Homo sapiens
gcagacagggctacagaggtac

SEQ ID NO: 8122723 - DNA, 22 bp, Homo sapiens
gcagaggtgtgggaggggccac

SEQ ID NO: 8122724 - DNA, 22 bp, Homo sapiens
gcaaggactccctgggtcattc

SEQ ID NO: 8122725 - DNA, 22 bp, Homo sapiens
gagtagggtttccaggttagag

SEQ ID NO: 8122726 - DNA, 18 bp, Homo sapiens
gcaaggctcaggccaggc

SEQ ID NO: 8122727 - DNA, 17 bp, Homo sapiens
gcacagaggccaaagga

SEQ ID NO: 8122728 - DNA, 22 bp, Homo sapiens
gcacagagagtcccgggtgccc

SEQ ID NO: 8122729 - DNA, 22 bp, Homo sapiens
gcacagagagcagtgggggaca

SEQ ID NO: 8122730 - DNA, 22 bp, Homo sapiens
gcacagactttgattgcagtca

SEQ ID NO: 8122731 - DNA, 22 bp, Homo sapiens
gcacagactgtatcttaatcat

SEQ ID NO: 8122732 - DNA, 22 bp, Homo sapiens
gcacagactcaccttaatttga

SEQ ID NO: 8122733 - DNA, 22 bp, Homo sapiens
gcacagacaccattaaatattt

SEQ ID NO: 8122734 - DNA, 22 bp, Homo sapiens
gcacagacagaatccctactcc

SEQ ID NO: 8122735 - DNA, 22 bp, Homo sapiens
gcacagacccaccatctatagt

SEQ ID NO: 8122736 - DNA, 22 bp, Homo sapiens
gcacagacatatccatatttac

SEQ ID NO: 8122737 - DNA, 22 bp, Homo sapiens
gcagggcagtaagagctagagt

SEQ ID NO: 8122738 - DNA, 20 bp, Homo sapiens
gcaggtccctggcatgcaga

SEQ ID NO: 8122739 - DNA, 22 bp, Homo sapiens
gcaggtgaatgatggactagga

SEQ ID NO: 8122740 - DNA, 22 bp, Homo sapiens
gcagcacaaagtccccagggac

SEQ ID NO: 8122741 - DNA, 22 bp, Homo sapiens
gcagcagaagtagaagtacagg

SEQ ID NO: 8122742 - DNA, 22 bp, Homo sapiens
gcagccaccctcaaggctgaat

SEQ ID NO: 8122743 - DNA, 17 bp, Homo sapiens
gcagccagtgcagcagg

SEQ ID NO: 8122744 - DNA, 19 bp, Homo sapiens
gcctcatttccacctcccc

SEQ ID NO: 8122745 - DNA, 20 bp, Homo sapiens
gcctccaccccaggcttcag

SEQ ID NO: 8122746 - DNA, 20 bp, Homo sapiens
gcctccacactcacccctta

SEQ ID NO: 8122747 - DNA, 22 bp, Homo sapiens
gccctgcctgtctgctgggagg

SEQ ID NO: 8122748 - DNA, 22 bp, Homo sapiens
gcccctctccttgtgcacctgc

SEQ ID NO: 8122749 - DNA, 22 bp, Homo sapiens
gccccaggggaggtgccctgca

SEQ ID NO: 8122750 - DNA, 22 bp, Homo sapiens
gcccaaggtcccatggcagcac

SEQ ID NO: 8122751 - DNA, 22 bp, Homo sapiens
gccctcagaggacagctgactt

SEQ ID NO: 8122752 - DNA, 22 bp, Homo sapiens
gccctcagaggacagctgactt

SEQ ID NO: 8122753 - DNA, 22 bp, Homo sapiens
gcccgcagagatctttaacaaa

SEQ ID NO: 8122754 - DNA, 22 bp, Homo sapiens
gcccctgggagcagagccacca

SEQ ID NO: 8122755 - DNA, 22 bp, Homo sapiens
gcctccctccaccactgcaggt

SEQ ID NO: 8122756 - DNA, 22 bp, Homo sapiens
gcctccaccgaacgctctcttg

SEQ ID NO: 8122757 - DNA, 22 bp, Homo sapiens
gcctccactgatcagacttgac

SEQ ID NO: 8122758 - DNA, 22 bp, Homo sapiens
gcctccacttctttagtatgac

SEQ ID NO: 8122759 - DNA, 22 bp, Homo sapiens
gcctccctgtttcctgctccaa

SEQ ID NO: 8122760 - DNA, 22 bp, Homo sapiens
gcctccctgttcttccacaata

SEQ ID NO: 8122761 - DNA, 22 bp, Homo sapiens
gcctccctgtttcctgctccaa

SEQ ID NO: 8122762 - DNA, 22 bp, Homo sapiens
gcctgcagctgcttccacacac

SEQ ID NO: 8122763 - DNA, 21 bp, Homo sapiens
gcctgcagaccccaccaggct

SEQ ID NO: 8122764 - DNA, 22 bp, Homo sapiens
gcctggagacagcagaggcggc

SEQ ID NO: 8122765 - DNA, 22 bp, Homo sapiens
gcctggagaaaggaaggtggga

SEQ ID NO: 8122766 - DNA, 22 bp, Homo sapiens
gcctgcagtgagtgcagaaggt

SEQ ID NO: 8122767 - DNA, 22 bp, Homo sapiens
gcctgcagggcctgggcctacc

SEQ ID NO: 8122768 - DNA, 22 bp, Homo sapiens
gccaggcgggtctcaaactcct

SEQ ID NO: 8122769 - DNA, 22 bp, Homo sapiens
gccaggcattattccgatccct

SEQ ID NO: 8122770 - DNA, 22 bp, Homo sapiens
gccaggctaagaaaggtgtgat

SEQ ID NO: 8122771 - DNA, 22 bp, Homo sapiens
gccaggctcagtagcgattcct

SEQ ID NO: 8122772 - DNA, 22 bp, Homo sapiens
gccaggctcagcagtcaacctg

SEQ ID NO: 8122773 - DNA, 23 bp, Homo sapiens
gccaggctccggtctgtggccac

SEQ ID NO: 8122774 - DNA, 22 bp, Homo sapiens
gccaggctccccggatccctgg

SEQ ID NO: 8122775 - DNA, 22 bp, Homo sapiens
gccaggctccccggatccctgg

SEQ ID NO: 8122776 - DNA, 22 bp, Homo sapiens
gccaggctccaggccctcctga

SEQ ID NO: 8122777 - DNA, 19 bp, Homo sapiens
gccaggctccatagccggc

SEQ ID NO: 8122778 - DNA, 22 bp, Homo sapiens
gccaggctccaggccctcctga

SEQ ID NO: 8122779 - DNA, 20 bp, Homo sapiens
gcccaaggtccagaaggggg

SEQ ID NO: 8122780 - DNA, 22 bp, Homo sapiens
gcccaagggcatcaagttctac

SEQ ID NO: 8122781 - DNA, 22 bp, Homo sapiens
gcccaaggtatatcagagacag

SEQ ID NO: 8122782 - DNA, 22 bp, Homo sapiens
gcccaagccggagctgggagag

SEQ ID NO: 8122783 - DNA, 22 bp, Homo sapiens
gcccaagctggactgcagtggc

SEQ ID NO: 8122784 - DNA, 22 bp, Homo sapiens
gcccaagctccgcctcctgtcg

SEQ ID NO: 8122785 - DNA, 22 bp, Homo sapiens
gccacttctgcctggcagggcc

SEQ ID NO: 8122786 - DNA, 22 bp, Homo sapiens
gccagaagactggagtcagctg

SEQ ID NO: 8122787 - DNA, 22 bp, Homo sapiens
gccagaaggggtggatccaggc

SEQ ID NO: 8122788 - DNA, 22 bp, Homo sapiens
gccaggaaaaaccggccctgct

SEQ ID NO: 8122789 - DNA, 22 bp, Homo sapiens
gccaggaaaagaagctggtgct

SEQ ID NO: 8122790 - DNA, 22 bp, Homo sapiens
gccaggaagttgggccagtcta

SEQ ID NO: 8122791 - DNA, 22 bp, Homo sapiens
gccaggaagtgcagccctgcca

SEQ ID NO: 8122792 - DNA, 22 bp, Homo sapiens
gccaggaatcactgctgagtaa

SEQ ID NO: 8122793 - DNA, 22 bp, Homo sapiens
gccaggaagtcagccaagccca

SEQ ID NO: 8122794 - DNA, 18 bp, Homo sapiens
gccaggaagcatggggac

SEQ ID NO: 8122795 - DNA, 22 bp, Homo sapiens
gccaggaaggctccctggtcac

SEQ ID NO: 8122796 - DNA, 22 bp, Homo sapiens
gccacccttgcgtcactgacat

SEQ ID NO: 8122797 - DNA, 21 bp, Homo sapiens
gccacctcgtctcggagcagc

SEQ ID NO: 8122798 - DNA, 22 bp, Homo sapiens
gccacctctagcaaagctcagc

SEQ ID NO: 8122799 - DNA, 20 bp, Homo sapiens
gccacctctctagcagtaga

SEQ ID NO: 8122800 - DNA, 22 bp, Homo sapiens
gccacctctctcttgactcgag

SEQ ID NO: 8122801 - DNA, 22 bp, Homo sapiens
gccacctgtttcgcttgcccag

SEQ ID NO: 8122802 - DNA, 22 bp, Homo sapiens
gccacctggacagctgtgccct

SEQ ID NO: 8122803 - DNA, 17 bp, Homo sapiens
gcagttaaattaagatg

SEQ ID NO: 8122804 - DNA, 22 bp, Homo sapiens
gcaggtgattcaccctgggcct

SEQ ID NO: 8122805 - DNA, 22 bp, Homo sapiens
gcagttttagagctttaagatg

SEQ ID NO: 8122806 - DNA, 22 bp, Homo sapiens
ggactgggaatcagggagatgc

SEQ ID NO: 8122807 - DNA, 22 bp, Homo sapiens
ggactgggtcactaagatagta

SEQ ID NO: 8122808 - DNA, 22 bp, Homo sapiens
ggagaaagctgtagtggaatgt

SEQ ID NO: 8122809 - DNA, 23 bp, Homo sapiens
ggacagggccctgccctatggcc

SEQ ID NO: 8122810 - DNA, 22 bp, Homo sapiens
ggacagggatcattatctgagc

SEQ ID NO: 8122811 - DNA, 19 bp, Homo sapiens
ggacagggggagcttttat

SEQ ID NO: 8122812 - DNA, 22 bp, Homo sapiens
ggacaggggcgtggggattgtt

SEQ ID NO: 8122813 - DNA, 22 bp, Homo sapiens
ggacaggggcgtggggattgtt

SEQ ID NO: 8122814 - DNA, 22 bp, Homo sapiens
ggacagggctcttggcactcct

SEQ ID NO: 8122815 - DNA, 22 bp, Homo sapiens
ggacagagggttgacagagtat

SEQ ID NO: 8122816 - DNA, 22 bp, Homo sapiens
ggacaggataagagacactgcc

SEQ ID NO: 8122817 - DNA, 22 bp, Homo sapiens
ggacaggatgctgaagatgaag

SEQ ID NO: 8122818 - DNA, 18 bp, Homo sapiens
ggacaggagacatgggtg

SEQ ID NO: 8122819 - DNA, 22 bp, Homo sapiens
ggaaggaggggcaaagcagttc

SEQ ID NO: 8122820 - DNA, 22 bp, Homo sapiens
ggagaagcagcttcttgatgaa

SEQ ID NO: 8122821 - DNA, 22 bp, Homo sapiens
ggagaagaggagctggaagcct

SEQ ID NO: 8122822 - DNA, 22 bp, Homo sapiens
ggagcccaagtctgcactcggc

SEQ ID NO: 8122823 - DNA, 18 bp, Homo sapiens
ggagcccagaggacagga

SEQ ID NO: 8122824 - DNA, 18 bp, Homo sapiens
ggagcccagaggtgagtt

SEQ ID NO: 8122825 - DNA, 22 bp, Homo sapiens
ggaggaggcggcagaagttcct

SEQ ID NO: 8122826 - DNA, 22 bp, Homo sapiens
ggaggaggggtgactgaatgct

SEQ ID NO: 8122827 - DNA, 22 bp, Homo sapiens
ggagctggctacagagaactcc

SEQ ID NO: 8122828 - DNA, 20 bp, Homo sapiens
ggagctgccctgggctggag

SEQ ID NO: 8122829 - DNA, 21 bp, Homo sapiens
ggagctgcaggagccgaaggc

SEQ ID NO: 8122830 - DNA, 22 bp, Homo sapiens
gcttaaatcccaatgctagacc

SEQ ID NO: 8122831 - DNA, 22 bp, Homo sapiens
gcttaaatcccaatgctagacc

SEQ ID NO: 8122832 - DNA, 22 bp, Homo sapiens
gcttaaattgtttgtggatagt

SEQ ID NO: 8122833 - DNA, 22 bp, Homo sapiens
gctgtatttatatgaaggcatg

SEQ ID NO: 8122834 - DNA, 22 bp, Homo sapiens
gctgtccaacctgcactcgcgt

SEQ ID NO: 8122835 - DNA, 22 bp, Homo sapiens
gctgtctagggaggctgtcacc

SEQ ID NO: 8122836 - DNA, 22 bp, Homo sapiens
gctgtctgctgtgcactgagca

SEQ ID NO: 8122837 - DNA, 22 bp, Homo sapiens
gctgtcctcgtctctcacgcaa

SEQ ID NO: 8122838 - DNA, 22 bp, Homo sapiens
gctgtcctctgatctctggagg

SEQ ID NO: 8122839 - DNA, 22 bp, Homo sapiens
gctgtctggcatggcgtggctg

SEQ ID NO: 8122840 - DNA, 21 bp, Homo sapiens
gctgcagggcccagggcaccc

SEQ ID NO: 8122841 - DNA, 22 bp, Homo sapiens
gctgcagggctctcacaggggg

SEQ ID NO: 8122842 - DNA, 22 bp, Homo sapiens
gctgcaggggggtctggacttg

SEQ ID NO: 8122843 - DNA, 22 bp, Homo sapiens
gctgcctccaatctgtgccccg

SEQ ID NO: 8122844 - DNA, 22 bp, Homo sapiens
gctgcagggagctggaaggctc

SEQ ID NO: 8122845 - DNA, 22 bp, Homo sapiens
gctgcagggagctggaaggctc

SEQ ID NO: 8122846 - DNA, 22 bp, Homo sapiens
gctgcaggctgtggcaggggag

SEQ ID NO: 8122847 - DNA, 22 bp, Homo sapiens
gctgcagggaatgtatggattt

SEQ ID NO: 8122848 - DNA, 22 bp, Homo sapiens
gctgcaggcgcctgcggtctct

SEQ ID NO: 8122849 - DNA, 22 bp, Homo sapiens
gctgcaggcggccgtggtggcg

SEQ ID NO: 8122850 - DNA, 22 bp, Homo sapiens
gctgcaggctctgcaggaattg

SEQ ID NO: 8122851 - DNA, 22 bp, Homo sapiens
gctgcctcctgaaagcgctctg

SEQ ID NO: 8122852 - DNA, 22 bp, Homo sapiens
gctgcctcctgagatttgggca

SEQ ID NO: 8122853 - DNA, 23 bp, Homo sapiens
gctgcctcctacaaaagcccagc

SEQ ID NO: 8122854 - DNA, 22 bp, Homo sapiens
gctgcctctgcgactctgggcg

SEQ ID NO: 8122855 - DNA, 22 bp, Homo sapiens
gctgcctctgcgactctgggcg

SEQ ID NO: 8122856 - DNA, 22 bp, Homo sapiens
gctgcctctgcacagctcactc

SEQ ID NO: 8122857 - DNA, 22 bp, Homo sapiens
gctgcctctgcacagctcactc

SEQ ID NO: 8122858 - DNA, 22 bp, Homo sapiens
gctgcctctcctgagttgacag

SEQ ID NO: 8122859 - DNA, 22 bp, Homo sapiens
gctgcctcccccatggctggaa

SEQ ID NO: 8122860 - DNA, 22 bp, Homo sapiens
gctgcctccgccggctccacag

SEQ ID NO: 8122861 - DNA, 22 bp, Homo sapiens
gctgcctccactggctcccagt

SEQ ID NO: 8122862 - DNA, 22 bp, Homo sapiens
gctgcctcccagagccctgcag

SEQ ID NO: 8122863 - DNA, 18 bp, Homo sapiens
gctgcaggcgcctgcggt

SEQ ID NO: 8122864 - DNA, 22 bp, Homo sapiens
gctgcaggcattttcctgggca

SEQ ID NO: 8122865 - DNA, 18 bp, Homo sapiens
gctgcaggccctccgagg

SEQ ID NO: 8122866 - DNA, 22 bp, Homo sapiens
gctgcaggatgaggctctgctc

SEQ ID NO: 8122867 - DNA, 22 bp, Homo sapiens
gctgcaggcagaatctcccaat

SEQ ID NO: 8122868 - DNA, 22 bp, Homo sapiens
gctgagttgaaagcagaggata

SEQ ID NO: 8122869 - DNA, 22 bp, Homo sapiens
gctgagtgaggtccagagcttg

SEQ ID NO: 8122870 - DNA, 22 bp, Homo sapiens
gctctgtggtggggcagagttt

SEQ ID NO: 8122871 - DNA, 22 bp, Homo sapiens
gctggagtctacattcaagaat

SEQ ID NO: 8122872 - DNA, 22 bp, Homo sapiens
gctggagtgagtatgtgtagtc

SEQ ID NO: 8122873 - DNA, 22 bp, Homo sapiens
gctggagtcttgaaagtggact

SEQ ID NO: 8122874 - DNA, 22 bp, Homo sapiens
gctggaggtggtgagaaaaggt

SEQ ID NO: 8122875 - DNA, 22 bp, Homo sapiens
gctggaggtagggaggtcctgt

SEQ ID NO: 8122876 - DNA, 22 bp, Homo sapiens
gctggaggtttcacctgagttt

SEQ ID NO: 8122877 - DNA, 22 bp, Homo sapiens
gctggcagtgtattgttagctg

SEQ ID NO: 8122878 - DNA, 22 bp, Homo sapiens
gctggcagtaaagggtttggca

SEQ ID NO: 8122879 - DNA, 22 bp, Homo sapiens
gctggcagtcccatcagctggg

SEQ ID NO: 8122880 - DNA, 22 bp, Homo sapiens
gctggcagggttctcactgaaa

SEQ ID NO: 8122881 - DNA, 22 bp, Homo sapiens
gctggcaggtaaagccccgggg

SEQ ID NO: 8122882 - DNA, 22 bp, Homo sapiens
gctgctggcttcctgctgtttt

SEQ ID NO: 8122883 - DNA, 23 bp, Homo sapiens
gctgcctctgttggtcttcagtt

SEQ ID NO: 8122884 - DNA, 22 bp, Homo sapiens
gctgcctctgtagctttggacc

SEQ ID NO: 8122885 - DNA, 22 bp, Homo sapiens
gctggaggggtaataggatggg

SEQ ID NO: 8122886 - DNA, 16 bp, Homo sapiens
gctggagggaggggtt

SEQ ID NO: 8122887 - DNA, 22 bp, Homo sapiens
gctggaggggtaataggatggg

SEQ ID NO: 8122888 - DNA, 22 bp, Homo sapiens
gctgctgtcagtctgaatctga

SEQ ID NO: 8122889 - DNA, 22 bp, Homo sapiens
gctgctgtcagtggtggcagtt

SEQ ID NO: 8122890 - DNA, 22 bp, Homo sapiens
gctctgtgaccttaggcaagtt

SEQ ID NO: 8122891 - DNA, 22 bp, Homo sapiens
gctctgtgctagaactaagaat

SEQ ID NO: 8122892 - DNA, 22 bp, Homo sapiens
gctctctgttattaagatcttt

SEQ ID NO: 8122893 - DNA, 22 bp, Homo sapiens
gctctctggaggccatggacag

SEQ ID NO: 8122894 - DNA, 22 bp, Homo sapiens
gctctctgggtgtgtctagata

SEQ ID NO: 8122895 - DNA, 22 bp, Homo sapiens
gctctctggctagtccatcggg

SEQ ID NO: 8122896 - DNA, 22 bp, Homo sapiens
gctcccaggaagagaagggcca

SEQ ID NO: 8122897 - DNA, 22 bp, Homo sapiens
gctctcccgcagcctggtgggc

SEQ ID NO: 8122898 - DNA, 19 bp, Homo sapiens
gctctccctctcagttgag

SEQ ID NO: 8122899 - DNA, 22 bp, Homo sapiens
gctctccaggtctcatgcactg

SEQ ID NO: 8122900 - DNA, 22 bp, Homo sapiens
gctctccaggtccaagaatcca

SEQ ID NO: 8122901 - DNA, 22 bp, Homo sapiens
gctctccaggggctcccaggat

SEQ ID NO: 8122902 - DNA, 21 bp, Homo sapiens
gctctccagggccagcccagg

SEQ ID NO: 8122903 - DNA, 22 bp, Homo sapiens
gctctctgaggtgctggcagag

SEQ ID NO: 8122904 - DNA, 22 bp, Homo sapiens
gctctctccctaggcaagtgag

SEQ ID NO: 8122905 - DNA, 22 bp, Homo sapiens
gctctctgcaagtcagcagcct

SEQ ID NO: 8122906 - DNA, 22 bp, Homo sapiens
gctctctgaggtgctggcagag

SEQ ID NO: 8122907 - DNA, 22 bp, Homo sapiens
gctctctgcagcctccttggag

SEQ ID NO: 8122908 - DNA, 22 bp, Homo sapiens
gctcagggaaggccacgtgaga

SEQ ID NO: 8122909 - DNA, 22 bp, Homo sapiens
gctcagggaatgagaagatgtt

SEQ ID NO: 8122910 - DNA, 22 bp, Homo sapiens
gctcagggcctggctgcggact

SEQ ID NO: 8122911 - DNA, 22 bp, Homo sapiens
gctcagggccatggaccagcag

SEQ ID NO: 8122912 - DNA, 20 bp, Homo sapiens
gctcagggcctgggtctgga

SEQ ID NO: 8122913 - DNA, 22 bp, Homo sapiens
gctcagggagagagggcagccg

SEQ ID NO: 8122914 - DNA, 22 bp, Homo sapiens
gctcagggagtttcacagtgta

SEQ ID NO: 8122915 - DNA, 22 bp, Homo sapiens
gctcccagcaattgaggcagcc

SEQ ID NO: 8122916 - DNA, 22 bp, Homo sapiens
gctcccagcaattgaggcagcc

SEQ ID NO: 8122917 - DNA, 22 bp, Homo sapiens
gctcagggcgcgagggacgtgg

SEQ ID NO: 8122918 - DNA, 22 bp, Homo sapiens
gctcagtgcatcattccaggct

SEQ ID NO: 8122919 - DNA, 22 bp, Homo sapiens
gctcagtgttcatctgtatgca

SEQ ID NO: 8122920 - DNA, 23 bp, Homo sapiens
gctcatcaggcttagagtcaagg

SEQ ID NO: 8122921 - DNA, 22 bp, Homo sapiens
gcctggcacgggctcggcccac

SEQ ID NO: 8122922 - DNA, 22 bp, Homo sapiens
gcctggcactcactgaagaggc

SEQ ID NO: 8122923 - DNA, 22 bp, Homo sapiens
gcctggcactcaatcatctgct

SEQ ID NO: 8122924 - DNA, 22 bp, Homo sapiens
gcctggcactgggctcctggcc

SEQ ID NO: 8122925 - DNA, 22 bp, Homo sapiens
gcctggcagattgacatagcca

SEQ ID NO: 8122926 - DNA, 22 bp, Homo sapiens
gcctggcagcctccaaccttca

SEQ ID NO: 8122927 - DNA, 22 bp, Homo sapiens
gcctggcaggaatctcagtgct

SEQ ID NO: 8122928 - DNA, 22 bp, Homo sapiens
gcctggcaccacagcctttcag

SEQ ID NO: 8122929 - DNA, 20 bp, Homo sapiens
gcctggcacccggggctggc

SEQ ID NO: 8122930 - DNA, 22 bp, Homo sapiens
gctagaatattgggtaggcaag

SEQ ID NO: 8122931 - DNA, 22 bp, Homo sapiens
ggggagtgttttcatgggcttg

SEQ ID NO: 8122932 - DNA, 22 bp, Homo sapiens
ggggagtgacgcagggccatag

SEQ ID NO: 8122933 - DNA, 22 bp, Homo sapiens
ggggcaggaggtgttctctttt

SEQ ID NO: 8122934 - DNA, 22 bp, Homo sapiens
ggggcagggaggttatcgccga

SEQ ID NO: 8122935 - DNA, 22 bp, Homo sapiens
ggggaggacctttccaaggctt

SEQ ID NO: 8122936 - DNA, 22 bp, Homo sapiens
ggggaggagccatgtaactagt

SEQ ID NO: 8122937 - DNA, 22 bp, Homo sapiens
ggggaggaagctggaacacggg

SEQ ID NO: 8122938 - DNA, 22 bp, Homo sapiens
ggggtggattcctacaggtcca

SEQ ID NO: 8122939 - DNA, 22 bp, Homo sapiens
ggggtggatttcaggcggtgtc

SEQ ID NO: 8122940 - DNA, 22 bp, Homo sapiens
ggggtggccaaggactctgacc

SEQ ID NO: 8122941 - DNA, 22 bp, Homo sapiens
ggggtggatcaggcaggcccag

SEQ ID NO: 8122942 - DNA, 22 bp, Homo sapiens
ggggtggagctaaatgtctact

SEQ ID NO: 8122943 - DNA, 19 bp, Homo sapiens
ggggtgctagggagggatc

SEQ ID NO: 8122944 - DNA, 22 bp, Homo sapiens
ggggtggagatggtggcccttt

SEQ ID NO: 8122945 - DNA, 22 bp, Homo sapiens
ggggcccagggcagcagtgcag

SEQ ID NO: 8122946 - DNA, 22 bp, Homo sapiens
gggtggagagaaagaaacgtga

SEQ ID NO: 8122947 - DNA, 22 bp, Homo sapiens
gggtggagaggctaagtccagt

SEQ ID NO: 8122948 - DNA, 22 bp, Homo sapiens
gggtgaggcccatttgaggcca

SEQ ID NO: 8122949 - DNA, 22 bp, Homo sapiens
gggtgaggagctgccagtcatg

SEQ ID NO: 8122950 - DNA, 18 bp, Homo sapiens
ggtgagggagctggaagc

SEQ ID NO: 8122951 - DNA, 21 bp, Homo sapiens
ggtgctcgctgatgaggagtg

SEQ ID NO: 8122952 - DNA, 22 bp, Homo sapiens
ggtgagggagtggaacgaggtg

SEQ ID NO: 8122953 - DNA, 22 bp, Homo sapiens
ggtggaaggcctggaaggaggc

SEQ ID NO: 8122954 - DNA, 22 bp, Homo sapiens
ggtggaaggcctggaaggaggc

SEQ ID NO: 8122955 - DNA, 22 bp, Homo sapiens
ggtgaggaattggggactgacc

SEQ ID NO: 8122956 - DNA, 22 bp, Homo sapiens
ggtgaggaaagatggtgacagt

SEQ ID NO: 8122957 - DNA, 22 bp, Homo sapiens
ggtccctgcctgaggctggcct

SEQ ID NO: 8122958 - DNA, 22 bp, Homo sapiens
ggtccctgctgaagccttggtg

SEQ ID NO: 8122959 - DNA, 22 bp, Homo sapiens
ggtgagaggcctgagagctgga

SEQ ID NO: 8122960 - DNA, 22 bp, Homo sapiens
ggtcccaggctgcgggctggtg

SEQ ID NO: 8122961 - DNA, 22 bp, Homo sapiens
ggtcccaggttgacagggagac

SEQ ID NO: 8122962 - DNA, 22 bp, Homo sapiens
gggttggattacttagggagaa

SEQ ID NO: 8122963 - DNA, 17 bp, Homo sapiens
gggttttgggagcagct

SEQ ID NO: 8122964 - DNA, 21 bp, Homo sapiens
ggttacaacagttaaacagag

SEQ ID NO: 8122965 - DNA, 16 bp, Homo sapiens
ggttaccataaccgcc

SEQ ID NO: 8122966 - DNA, 22 bp, Homo sapiens
ggttcagggatgtgggtgatgc

SEQ ID NO: 8122967 - DNA, 21 bp, Homo sapiens
gtaattctgcctcatcttcac

SEQ ID NO: 8122968 - DNA, 22 bp, Homo sapiens
ggtggagagctggatgagaggt

SEQ ID NO: 8122969 - DNA, 22 bp, Homo sapiens
ggtggcaccttgatcttggact

SEQ ID NO: 8122970 - DNA, 22 bp, Homo sapiens
ggtgggcaggcgaggcccaggt

SEQ ID NO: 8122971 - DNA, 22 bp, Homo sapiens
gtgcagcaaagtttgagatata

SEQ ID NO: 8122972 - DNA, 22 bp, Homo sapiens
gtgcaggaggtaacatagcaaa

SEQ ID NO: 8122973 - DNA, 22 bp, Homo sapiens
gtgcaggagtaggagagggctt

SEQ ID NO: 8122974 - DNA, 22 bp, Homo sapiens
gtgcagggagcccagaaggtcc

SEQ ID NO: 8122975 - DNA, 22 bp, Homo sapiens
gtgccactgcactctagcctag

SEQ ID NO: 8122976 - DNA, 22 bp, Homo sapiens
gtgcagggcagccgaatgggct

SEQ ID NO: 8122977 - DNA, 22 bp, Homo sapiens
gtgcagggctggcaccggaggc

SEQ ID NO: 8122978 - DNA, 17 bp, Homo sapiens
gtgcagggatgaaggat

SEQ ID NO: 8122979 - DNA, 22 bp, Homo sapiens
gtgctgccggcatagcagtgaa

SEQ ID NO: 8122980 - DNA, 22 bp, Homo sapiens
gtgctggaccctggaaggtggt

SEQ ID NO: 8122981 - DNA, 20 bp, Homo sapiens
gtgctggagttaggaaaggt

SEQ ID NO: 8122982 - DNA, 22 bp, Homo sapiens
gtgccagggggcactgaacaga

SEQ ID NO: 8122983 - DNA, 18 bp, Homo sapiens
gtgccaggaggcgcagcc

SEQ ID NO: 8122984 - DNA, 22 bp, Homo sapiens
gtgccagggagtggaggagctt

SEQ ID NO: 8122985 - DNA, 22 bp, Homo sapiens
gtgccaggcccagggagcgggg

SEQ ID NO: 8122986 - DNA, 22 bp, Homo sapiens
gtgagcagtttgttccagaatc

SEQ ID NO: 8122987 - DNA, 22 bp, Homo sapiens
gtgagcagttgtataaagactt

SEQ ID NO: 8122988 - DNA, 22 bp, Homo sapiens
gtctttttctacgatagcgcct

SEQ ID NO: 8122989 - DNA, 22 bp, Homo sapiens
gtctttttattatagagtggag

SEQ ID NO: 8122990 - DNA, 22 bp, Homo sapiens
gtcttttttacaccttacatca

SEQ ID NO: 8122991 - DNA, 22 bp, Homo sapiens
gtctttttgtctggcagaggtc

SEQ ID NO: 8122992 - DNA, 20 bp, Homo sapiens
gtctttatgttttatgacct

SEQ ID NO: 8122993 - DNA, 22 bp, Homo sapiens
gtctcccaacccctgtgcccag

SEQ ID NO: 8122994 - DNA, 22 bp, Homo sapiens
gtctcccaaactctgatggtcc

SEQ ID NO: 8122995 - DNA, 22 bp, Homo sapiens
gtctagggtctgtagtgcatgt

SEQ ID NO: 8122996 - DNA, 22 bp, Homo sapiens
gtacaacaggattgatgtacca

SEQ ID NO: 8122997 - DNA, 22 bp, Homo sapiens
gtaggtcagacataagaggaca

SEQ ID NO: 8122998 - DNA, 22 bp, Homo sapiens
gtaggggccagaaagacttaga

SEQ ID NO: 8122999 - DNA, 22 bp, Homo sapiens
gtaggggtcaggtagggactct

SEQ ID NO: 8123000 - DNA, 22 bp, Homo sapiens
gtaggggtgctgagatctggaa

SEQ ID NO: 8123001 - DNA, 22 bp, Homo sapiens
gtaggggtgctgagatctggaa

SEQ ID NO: 8123002 - DNA, 22 bp, Homo sapiens
gtattttatggcatgcagtggc

SEQ ID NO: 8123003 - DNA, 22 bp, Homo sapiens
gtattttcatgatttcagacca

SEQ ID NO: 8123004 - DNA, 22 bp, Homo sapiens
gtcaaagatcctatgagttaaa

SEQ ID NO: 8123005 - DNA, 22 bp, Homo sapiens
gtccagctccagggaggcaggc

SEQ ID NO: 8123006 - DNA, 22 bp, Homo sapiens
gtcacctgaggggaggtgacag

SEQ ID NO: 8123007 - DNA, 22 bp, Homo sapiens
gtcactgtatccaggttccagc

SEQ ID NO: 8123008 - DNA, 22 bp, Homo sapiens
gtcactgtatccaggttccagc

SEQ ID NO: 8123009 - DNA, 22 bp, Homo sapiens
gtcacttaccagagtattttat

SEQ ID NO: 8123010 - DNA, 22 bp, Homo sapiens
gtcctgctctggcccaggtttg

SEQ ID NO: 8123011 - DNA, 22 bp, Homo sapiens
gtcctggaatcctagaacagtg

SEQ ID NO: 8123012 - DNA, 22 bp, Homo sapiens
gtcctggcccaggagtacacat

SEQ ID NO: 8123013 - DNA, 20 bp, Homo sapiens
gtccaggacccagcaggagg

SEQ ID NO: 8123014 - DNA, 22 bp, Homo sapiens
ggctgccagtgagtgcagaccg

SEQ ID NO: 8123015 - DNA, 22 bp, Homo sapiens
ggctgcaggttggttggcagct

SEQ ID NO: 8123016 - DNA, 22 bp, Homo sapiens
ggctgcagggcagctggtgtgg

SEQ ID NO: 8123017 - DNA, 17 bp, Homo sapiens
ggctgcagtccaggagg

SEQ ID NO: 8123018 - DNA, 21 bp, Homo sapiens
ggctgcagggagccctggggt

SEQ ID NO: 8123019 - DNA, 21 bp, Homo sapiens
ggctgcagggagccctggggt

SEQ ID NO: 8123020 - DNA, 22 bp, Homo sapiens
ggctgcaggcttccctccagca

SEQ ID NO: 8123021 - DNA, 19 bp, Homo sapiens
ggctggagtggccatctgt

SEQ ID NO: 8123022 - DNA, 22 bp, Homo sapiens
gggagccacagtgaggtgcatg

SEQ ID NO: 8123023 - DNA, 23 bp, Homo sapiens
gggagatgggaaatgaaggctct

SEQ ID NO: 8123024 - DNA, 22 bp, Homo sapiens
gggaagagtaactagcccatgt

SEQ ID NO: 8123025 - DNA, 22 bp, Homo sapiens
gggaagagggagctggaatgat

SEQ ID NO: 8123026 - DNA, 22 bp, Homo sapiens
gggaagatagtgttgagggccc

SEQ ID NO: 8123027 - DNA, 22 bp, Homo sapiens
gggaagagtgtcggttgaagtg

SEQ ID NO: 8123028 - DNA, 22 bp, Homo sapiens
gggaagcagcattgtgctggct

SEQ ID NO: 8123029 - DNA, 18 bp, Homo sapiens
gggaagccgggaagccgg

SEQ ID NO: 8123030 - DNA, 22 bp, Homo sapiens
gggaagccatgctcagaggtac

SEQ ID NO: 8123031 - DNA, 22 bp, Homo sapiens
ggctgtggcattaggtgaggcc

SEQ ID NO: 8123032 - DNA, 22 bp, Homo sapiens
ggctgtggcagctggaagtggt

SEQ ID NO: 8123033 - DNA, 22 bp, Homo sapiens
ggctgtggtcattaggaggttg

SEQ ID NO: 8123034 - DNA, 22 bp, Homo sapiens
ggctgtggggccgggtacagtg

SEQ ID NO: 8123035 - DNA, 22 bp, Homo sapiens
ggctgtggggaccaacaggact

SEQ ID NO: 8123036 - DNA, 22 bp, Homo sapiens
ggctgtggccagcggggctgag

SEQ ID NO: 8123037 - DNA, 22 bp, Homo sapiens
gggctctggacccaggcaagag

SEQ ID NO: 8123038 - DNA, 22 bp, Homo sapiens
gggctctggagttctagaaaga

SEQ ID NO: 8123039 - DNA, 22 bp, Homo sapiens
gggctccaacggtgagcatgga

SEQ ID NO: 8123040 - DNA, 22 bp, Homo sapiens
gggctccaacggtgagcatgga

SEQ ID NO: 8123041 - DNA, 22 bp, Homo sapiens
gggctcagcctcctcacttcga

SEQ ID NO: 8123042 - DNA, 22 bp, Homo sapiens
gggcccagtaccctctgccaag

SEQ ID NO: 8123043 - DNA, 22 bp, Homo sapiens
gggctatagcactatgtatggg

SEQ ID NO: 8123044 - DNA, 22 bp, Homo sapiens
gggagtggagagcaatggatga

SEQ ID NO: 8123045 - DNA, 22 bp, Homo sapiens
gggagtggttgatggtgaaaat

SEQ ID NO: 8123046 - DNA, 22 bp, Homo sapiens
gggagtggtcctttcctatctg

SEQ ID NO: 8123047 - DNA, 22 bp, Homo sapiens
gggagtgggtttggcctaggcc

SEQ ID NO: 8123048 - DNA, 22 bp, Homo sapiens
gggagtggggcttaccttgaag

SEQ ID NO: 8123049 - DNA, 22 bp, Homo sapiens
gggcagagactcagaaacagaa

SEQ ID NO: 8123050 - DNA, 20 bp, Homo sapiens
gggcagagccagccagtccc

SEQ ID NO: 8123051 - DNA, 22 bp, Homo sapiens
gggcagagagctggaactcctt

SEQ ID NO: 8123052 - DNA, 20 bp, Homo sapiens
gggcagagccagccagtccc

SEQ ID NO: 8123053 - DNA, 22 bp, Homo sapiens
ggcagaggtgaagttcacaagg

SEQ ID NO: 8123054 - DNA, 22 bp, Homo sapiens
ggcagcagaactggccctgtat

SEQ ID NO: 8123055 - DNA, 21 bp, Homo sapiens
ggcagcactacctgaagcata

SEQ ID NO: 8123056 - DNA, 22 bp, Homo sapiens
ggcagcacgacaggagtggaag

SEQ ID NO: 8123057 - DNA, 22 bp, Homo sapiens
ggcagcaactcggagagaagag

SEQ ID NO: 8123058 - DNA, 18 bp, Homo sapiens
ggcagcaagaagggaggg

SEQ ID NO: 8123059 - DNA, 22 bp, Homo sapiens
ggcagcaaatattgtcagctgt

SEQ ID NO: 8123060 - DNA, 22 bp, Homo sapiens
ggaggagtgtggggcactctgc

SEQ ID NO: 8123061 - DNA, 22 bp, Homo sapiens
ggaggagtcagttgggctgctt

SEQ ID NO: 8123062 - DNA, 22 bp, Homo sapiens
ggaggatgccaagctgtgcaca

SEQ ID NO: 8123063 - DNA, 16 bp, Homo sapiens
ggcaccagtgaacaca

SEQ ID NO: 8123064 - DNA, 22 bp, Homo sapiens
ggaggcacttcccgtctcagcc

SEQ ID NO: 8123065 - DNA, 22 bp, Homo sapiens
ggcagcccaccagcccacgtct

SEQ ID NO: 8123066 - DNA, 22 bp, Homo sapiens
ggcagccatgtcccagggcttc

SEQ ID NO: 8123067 - DNA, 22 bp, Homo sapiens
ggcagccatgtgggcagcgagt

SEQ ID NO: 8123068 - DNA, 21 bp, Homo sapiens
ggcagcctgacccccagagag

SEQ ID NO: 8123069 - DNA, 22 bp, Homo sapiens
ggcagcctccagggcactggtg

SEQ ID NO: 8123070 - DNA, 22 bp, Homo sapiens
ggcagctcctcctagtctgccc

SEQ ID NO: 8123071 - DNA, 22 bp, Homo sapiens
ggcagtgagctggagggaagga

SEQ ID NO: 8123072 - DNA, 22 bp, Homo sapiens
ggcagtgagctggagggaagga

SEQ ID NO: 8123073 - DNA, 21 bp, Homo sapiens
ggcagtgatgtgaagtgcatc

SEQ ID NO: 8123074 - DNA, 22 bp, Homo sapiens
ggcagtgatgtcaaacagtgaa

SEQ ID NO: 8123075 - DNA, 22 bp, Homo sapiens
ggcagtgagtcccggagaggcc

SEQ ID NO: 8123076 - DNA, 22 bp, Homo sapiens
ggcagtggcagagcttggtcta

SEQ ID NO: 8123077 - DNA, 17 bp, Homo sapiens
ggcagtggaggaagaga

SEQ ID NO: 8123078 - DNA, 17 bp, Homo sapiens
ggcagtggaggaagaga

SEQ ID NO: 8123079 - DNA, 22 bp, Homo sapiens
ggcagtgggaaataagtgagaa

SEQ ID NO: 8123080 - DNA, 22 bp, Homo sapiens
ggcagtggctgtagtctcttgg

SEQ ID NO: 8123081 - DNA, 22 bp, Homo sapiens
ggcagtggctcctctctactcc

SEQ ID NO: 8123082 - DNA, 22 bp, Homo sapiens
ggccacagagggcgggatgctg

SEQ ID NO: 8123083 - DNA, 22 bp, Homo sapiens
ggccacagtctctggaaggatg

SEQ ID NO: 8123084 - DNA, 22 bp, Homo sapiens
ggccacctctgccctactgagt

SEQ ID NO: 8123085 - DNA, 19 bp, Homo sapiens
ggccacctctcttcccagg

SEQ ID NO: 8123086 - DNA, 22 bp, Homo sapiens
ggccagagtctatatgcagaca

SEQ ID NO: 8123087 - DNA, 22 bp, Homo sapiens
ggccagcagacctcagggactc

SEQ ID NO: 8123088 - DNA, 22 bp, Homo sapiens
ggctctgcctgcccagcagcac

SEQ ID NO: 8123089 - DNA, 22 bp, Homo sapiens
ggctctctggaggagctcaccc

SEQ ID NO: 8123090 - DNA, 19 bp, Homo sapiens
ggcctctgcaggccgcccc

SEQ ID NO: 8123091 - DNA, 21 bp, Homo sapiens
ggcctctgccttgccccactc

SEQ ID NO: 8123092 - DNA, 22 bp, Homo sapiens
ggcctctgccccagccacacct

SEQ ID NO: 8123093 - DNA, 22 bp, Homo sapiens
ggcctctctgagagcagacgtt

SEQ ID NO: 8123094 - DNA, 20 bp, Homo sapiens
ggcctctgaggacaaggaga

SEQ ID NO: 8123095 - DNA, 22 bp, Homo sapiens
ggcctctcttgggacagctgtc

SEQ ID NO: 8123096 - DNA, 22 bp, Homo sapiens
ggctcaccatggcctccctgct

SEQ ID NO: 8123097 - DNA, 23 bp, Homo sapiens
ggctcacacggagtgcctccacc

SEQ ID NO: 8123098 - DNA, 22 bp, Homo sapiens
ggctcaccattttcactctctg

SEQ ID NO: 8123099 - DNA, 22 bp, Homo sapiens
ggcctctggggtcctgagccca

SEQ ID NO: 8123100 - DNA, 22 bp, Homo sapiens
ggcctctggtcaagacaagcat

SEQ ID NO: 8123101 - DNA, 22 bp, Homo sapiens
ggcctctggcaggcaggccctc

SEQ ID NO: 8123102 - DNA, 18 bp, Homo sapiens
ggcctctggactggcagc

SEQ ID NO: 8123103 - DNA, 22 bp, Homo sapiens
tttttataccacctctcactta

SEQ ID NO: 8123104 - DNA, 22 bp, Homo sapiens
tttttatatgaaggatagtgcg

SEQ ID NO: 8123105 - DNA, 22 bp, Homo sapiens
tttttatactttgctcaagatt

SEQ ID NO: 8123106 - DNA, 22 bp, Homo sapiens
tttgcttgttcaagatttctgt

SEQ ID NO: 8123107 - DNA, 22 bp, Homo sapiens
tttgctttgggaggttgtctgg

SEQ ID NO: 8123108 - DNA, 20 bp, Homo sapiens
tttgattgcccctctgactt

SEQ ID NO: 8123109 - DNA, 18 bp, Homo sapiens
tttgattgctgtcatcca

SEQ ID NO: 8123110 - DNA, 22 bp, Homo sapiens
tttgatcctttagccatttgac

SEQ ID NO: 8123111 - DNA, 22 bp, Homo sapiens
tttgatccagggcttacacata

SEQ ID NO: 8123112 - DNA, 22 bp, Homo sapiens
tttgatatcttggtatacagat

SEQ ID NO: 8123113 - DNA, 22 bp, Homo sapiens
tttgatatcctatacaagtaaa

SEQ ID NO: 8123114 - DNA, 22 bp, Homo sapiens
tttggtcatgtcgtcatttggg

SEQ ID NO: 8123115 - DNA, 22 bp, Homo sapiens
tttggaaattttcatccagaca

SEQ ID NO: 8123116 - DNA, 22 bp, Homo sapiens
tttggaaacatctcagaaaata

SEQ ID NO: 8123117 - DNA, 22 bp, Homo sapiens
tttggaaactgatggtacattc

SEQ ID NO: 8123118 - DNA, 22 bp, Homo sapiens
tttggaaactgcctcagctctt

SEQ ID NO: 8123119 - DNA, 22 bp, Homo sapiens
tttggaaacacggtcatcttcc

SEQ ID NO: 8123120 - DNA, 22 bp, Homo sapiens
tttggaaaatattgaactggtt

SEQ ID NO: 8123121 - DNA, 22 bp, Homo sapiens
tttggaaaattttctaagtctg

SEQ ID NO: 8123122 - DNA, 22 bp, Homo sapiens
tttggaaaaagcctgaacatag

SEQ ID NO: 8123123 - DNA, 22 bp, Homo sapiens
tttggaaaaagacagcttatga

SEQ ID NO: 8123124 - DNA, 22 bp, Homo sapiens
tttggaaagtgtgatttcaagg

SEQ ID NO: 8123125 - DNA, 22 bp, Homo sapiens
tttggaaagttgtcactttaga

SEQ ID NO: 8123126 - DNA, 22 bp, Homo sapiens
tttggaaagacacacagtttta

SEQ ID NO: 8123127 - DNA, 22 bp, Homo sapiens
tttggaaaggtttggccattat

SEQ ID NO: 8123128 - DNA, 17 bp, Homo sapiens
tttggaaagtgatcatt

SEQ ID NO: 8123129 - DNA, 22 bp, Homo sapiens
tttggaaagtgtacaaatttga

SEQ ID NO: 8123130 - DNA, 22 bp, Homo sapiens
tttggaaatttcatcaatagcc

SEQ ID NO: 8123131 - DNA, 22 bp, Homo sapiens
tttggaaatgagaagccacctt

SEQ ID NO: 8123132 - DNA, 22 bp, Homo sapiens
tttggaaattactcattgtcct

SEQ ID NO: 8123133 - DNA, 22 bp, Homo sapiens
tttggaaataattccatctcat

SEQ ID NO: 8123134 - DNA, 22 bp, Homo sapiens
tttggaaatgaccccgtctaag

SEQ ID NO: 8123135 - DNA, 22 bp, Homo sapiens
tttggaaatacgcgtaggcaga

SEQ ID NO: 8123136 - DNA, 22 bp, Homo sapiens
tttctttgagtctcagtttgct

SEQ ID NO: 8123137 - DNA, 22 bp, Homo sapiens
tttctttgagtctcagtttgct

SEQ ID NO: 8123138 - DNA, 22 bp, Homo sapiens
tttcttttacagtgtggctatt

SEQ ID NO: 8123139 - DNA, 22 bp, Homo sapiens
tttcttttccaatatccctact

SEQ ID NO: 8123140 - DNA, 22 bp, Homo sapiens
tttctttgttgttatcacatca

SEQ ID NO: 8123141 - DNA, 22 bp, Homo sapiens
tttcctctaaacgcatttgctt

SEQ ID NO: 8123142 - DNA, 22 bp, Homo sapiens
tttcctcatttatctgctggga

SEQ ID NO: 8123143 - DNA, 22 bp, Homo sapiens
tttcctcagaagtgtctactat

SEQ ID NO: 8123144 - DNA, 22 bp, Homo sapiens
tttcctcacttcatgagagttt

SEQ ID NO: 8123145 - DNA, 22 bp, Homo sapiens
tttcctcagaagtgtctactat

SEQ ID NO: 8123146 - DNA, 19 bp, Homo sapiens
tttcctaaaaagctgtgct

SEQ ID NO: 8123147 - DNA, 22 bp, Homo sapiens
tttgaagataaatatggagaaa

SEQ ID NO: 8123148 - DNA, 22 bp, Homo sapiens
tttgaaagggttatgagactga

SEQ ID NO: 8123149 - DNA, 22 bp, Homo sapiens
tttgaaaggtgtcgagatgtgt

SEQ ID NO: 8123150 - DNA, 21 bp, Homo sapiens
tttgaaagctacatctatagc

SEQ ID NO: 8123151 - DNA, 22 bp, Homo sapiens
tttgaaaggaattaggatgaca

SEQ ID NO: 8123152 - DNA, 22 bp, Homo sapiens
tttgacaacagcaaatgtcaca

SEQ ID NO: 8123153 - DNA, 22 bp, Homo sapiens
tttgacaacgttgttgtgagga

SEQ ID NO: 8123154 - DNA, 22 bp, Homo sapiens
tttgacaattaggtagaaaaag

SEQ ID NO: 8123155 - DNA, 22 bp, Homo sapiens
tttgacagaaagttattatttt

SEQ ID NO: 8123156 - DNA, 22 bp, Homo sapiens
ttttcatttttgtagatgcaag

SEQ ID NO: 8123157 - DNA, 22 bp, Homo sapiens
ttttcatttacattagggaaga

SEQ ID NO: 8123158 - DNA, 22 bp, Homo sapiens
ttttctgtattattgtgcttca

SEQ ID NO: 8123159 - DNA, 20 bp, Homo sapiens
ttttctgtgccaagaaaact

SEQ ID NO: 8123160 - DNA, 22 bp, Homo sapiens
ttttctgtttgcttcaagacat

SEQ ID NO: 8123161 - DNA, 22 bp, Homo sapiens
ttttatgttcctgaagctatct

SEQ ID NO: 8123162 - DNA, 22 bp, Homo sapiens
ttttatgtgtgaaatgctgtct

SEQ ID NO: 8123163 - DNA, 22 bp, Homo sapiens
ttttcattgagcacctgagtaa

SEQ ID NO: 8123164 - DNA, 22 bp, Homo sapiens
ttttcattagaatgactgagaa

SEQ ID NO: 8123165 - DNA, 22 bp, Homo sapiens
ttttcattgttcctcgagcatt

SEQ ID NO: 8123166 - DNA, 22 bp, Homo sapiens
ttttcattgttactatgagcta

SEQ ID NO: 8123167 - DNA, 22 bp, Homo sapiens
ttttcattgtaaatcaggaaac

SEQ ID NO: 8123168 - DNA, 22 bp, Homo sapiens
ttttcatctctgctttgtacct

SEQ ID NO: 8123169 - DNA, 22 bp, Homo sapiens
ttttaattgcaattatggtccc

SEQ ID NO: 8123170 - DNA, 22 bp, Homo sapiens
ttttaattcaaagtgaatagtg

SEQ ID NO: 8123171 - DNA, 22 bp, Homo sapiens
ttttatgtaatccttactgtcg

SEQ ID NO: 8123172 - DNA, 18 bp, Homo sapiens
ttttaatttcaggggtgg

SEQ ID NO: 8123173 - DNA, 22 bp, Homo sapiens
ttttaacactcagcactatctc

SEQ ID NO: 8123174 - DNA, 22 bp, Homo sapiens
tttgtgtttatgaagttattct

SEQ ID NO: 8123175 - DNA, 22 bp, Homo sapiens
tttgtgtgtgtataggaaagga

SEQ ID NO: 8123176 - DNA, 22 bp, Homo sapiens
tttgtgttttcccatactattg

SEQ ID NO: 8123177 - DNA, 22 bp, Homo sapiens
tttgtgtgcgtctggcctgggg

SEQ ID NO: 8123178 - DNA, 22 bp, Homo sapiens
tttgtgtgcaacgcatggagtc

SEQ ID NO: 8123179 - DNA, 22 bp, Homo sapiens
ttctctaggttttagatgaaga

SEQ ID NO: 8123180 - DNA, 22 bp, Homo sapiens
ttctctagcagatcataatgaa

SEQ ID NO: 8123181 - DNA, 22 bp, Homo sapiens
ttctctaatacattttgacaaa

SEQ ID NO: 8123182 - DNA, 22 bp, Homo sapiens
ttctctaatggtgatgattaga

SEQ ID NO: 8123183 - DNA, 21 bp, Homo sapiens
ttctctccatatgcccagccc

SEQ ID NO: 8123184 - DNA, 22 bp, Homo sapiens
ttctctccagtcctggattctg

SEQ ID NO: 8123185 - DNA, 22 bp, Homo sapiens
ttctctcattcaaattaaagtg

SEQ ID NO: 8123186 - DNA, 22 bp, Homo sapiens
ttctctccagactgcagtgggt

SEQ ID NO: 8123187 - DNA, 22 bp, Homo sapiens
ttctctcccatgaagcttctat

SEQ ID NO: 8123188 - DNA, 22 bp, Homo sapiens
ttctctcctcctagaggctttt

SEQ ID NO: 8123189 - DNA, 22 bp, Homo sapiens
ttctctctgtggtcccattttg

SEQ ID NO: 8123190 - DNA, 22 bp, Homo sapiens
ttctctcttccagttcccactt

SEQ ID NO: 8123191 - DNA, 22 bp, Homo sapiens
ttctctcttccagttcccactt

SEQ ID NO: 8123192 - DNA, 22 bp, Homo sapiens
ttctctcttactgccatgctgt

SEQ ID NO: 8123193 - DNA, 22 bp, Homo sapiens
ttctcagctttccttgcagtta

SEQ ID NO: 8123194 - DNA, 22 bp, Homo sapiens
ttctcctctgttggccttccct

SEQ ID NO: 8123195 - DNA, 20 bp, Homo sapiens
ttccttggattgtgtcttga

SEQ ID NO: 8123196 - DNA, 22 bp, Homo sapiens
ttccttcttccagaggctgccc

SEQ ID NO: 8123197 - DNA, 22 bp, Homo sapiens
ttccttcttccaaacccatcat

SEQ ID NO: 8123198 - DNA, 22 bp, Homo sapiens
ttccttcttccagaggctgccc

SEQ ID NO: 8123199 - DNA, 22 bp, Homo sapiens
ttccttctggaggctccagggg

SEQ ID NO: 8123200 - DNA, 22 bp, Homo sapiens
ttccagttggtagaatgtaagg

SEQ ID NO: 8123201 - DNA, 22 bp, Homo sapiens
ttctggagattgagaaggcatt

SEQ ID NO: 8123202 - DNA, 22 bp, Homo sapiens
ttctggagatctgcctatggga

SEQ ID NO: 8123203 - DNA, 22 bp, Homo sapiens
ttctggagatgacttttagaaa

SEQ ID NO: 8123204 - DNA, 22 bp, Homo sapiens
ttctggagatagtcaggcatta

SEQ ID NO: 8123205 - DNA, 22 bp, Homo sapiens
ttctggagaggaacagaaaggt

SEQ ID NO: 8123206 - DNA, 22 bp, Homo sapiens
ttctggagctaaagtccactct

SEQ ID NO: 8123207 - DNA, 22 bp, Homo sapiens
ttctggagctctcgaccccact

SEQ ID NO: 8123208 - DNA, 22 bp, Homo sapiens
ttctggagccgggcctgggcag

SEQ ID NO: 8123209 - DNA, 22 bp, Homo sapiens
ttctggagccccaagatctgta

SEQ ID NO: 8123210 - DNA, 22 bp, Homo sapiens
ttctggaatgcctgttctaatt

SEQ ID NO: 8123211 - DNA, 22 bp, Homo sapiens
ttctggaattctggctatggta

SEQ ID NO: 8123212 - DNA, 22 bp, Homo sapiens
ttctggaatatttgacacaatt

SEQ ID NO: 8123213 - DNA, 22 bp, Homo sapiens
ttctggaatcctcaaaacatga

SEQ ID NO: 8123214 - DNA, 22 bp, Homo sapiens
ttctggaattcttgcagccact

SEQ ID NO: 8123215 - DNA, 22 bp, Homo sapiens
ttctggagacccagcaacaggg

SEQ ID NO: 8123216 - DNA, 22 bp, Homo sapiens
ttctggagagaaaccttacaaa

SEQ ID NO: 8123217 - DNA, 22 bp, Homo sapiens
ttctggagagaagaccagtgtg

SEQ ID NO: 8123218 - DNA, 23 bp, Homo sapiens
ttctggagaaaggaccatagctt

SEQ ID NO: 8123219 - DNA, 22 bp, Homo sapiens
ttctggagaaaattctgtcatt

SEQ ID NO: 8123220 - DNA, 22 bp, Homo sapiens
ttctggagaaaattctgtcatt

SEQ ID NO: 8123221 - DNA, 22 bp, Homo sapiens
ttctggagaatcaccaccaggc

SEQ ID NO: 8123222 - DNA, 22 bp, Homo sapiens
ttctggagaataatcagcattg

SEQ ID NO: 8123223 - DNA, 22 bp, Homo sapiens
ttctggaagtgttagaatctgg

SEQ ID NO: 8123224 - DNA, 22 bp, Homo sapiens
ttctggaagggtggagtagctt

SEQ ID NO: 8123225 - DNA, 22 bp, Homo sapiens
ttctggaagtggaatttttgta

SEQ ID NO: 8123226 - DNA, 22 bp, Homo sapiens
ttctggaagttttctcctgtgg

SEQ ID NO: 8123227 - DNA, 22 bp, Homo sapiens
ttctggaagttggaaatagcag

SEQ ID NO: 8123228 - DNA, 22 bp, Homo sapiens
ttctggaatactaagttccttt

SEQ ID NO: 8123229 - DNA, 22 bp, Homo sapiens
ttctggaaatgttgctgaggcc

SEQ ID NO: 8123230 - DNA, 22 bp, Homo sapiens
ttctggaaatgggtatagagca

SEQ ID NO: 8123231 - DNA, 22 bp, Homo sapiens
ttctggaaatcagcagagggtg

SEQ ID NO: 8123232 - DNA, 22 bp, Homo sapiens
ttctggaaatgcacaactaatt

SEQ ID NO: 8123233 - DNA, 22 bp, Homo sapiens
ttctggaaatgaatgctaggaa

SEQ ID NO: 8123234 - DNA, 22 bp, Homo sapiens
ttctctggggactgtctctatt

SEQ ID NO: 8123235 - DNA, 22 bp, Homo sapiens
ttcttacattactttacatgtg

SEQ ID NO: 8123236 - DNA, 22 bp, Homo sapiens
ttctgtgtgctgtcttggcttt

SEQ ID NO: 8123237 - DNA, 22 bp, Homo sapiens
ttctgtgtgggtagctcctgtt

SEQ ID NO: 8123238 - DNA, 22 bp, Homo sapiens
ttcttatagaagcaaccattgt

SEQ ID NO: 8123239 - DNA, 22 bp, Homo sapiens
ttcttatattgggtcatggata

SEQ ID NO: 8123240 - DNA, 22 bp, Homo sapiens
ttcttagagatggttaaaaata

SEQ ID NO: 8123241 - DNA, 22 bp, Homo sapiens
ttcttagaagaaacatctaaaa

SEQ ID NO: 8123242 - DNA, 19 bp, Homo sapiens
ttctgtaaggacattaatc

SEQ ID NO: 8123243 - DNA, 22 bp, Homo sapiens
ttctgtgaatcttttttcccac

SEQ ID NO: 8123244 - DNA, 22 bp, Homo sapiens
ttctgtgaatcttttttcccac

SEQ ID NO: 8123245 - DNA, 22 bp, Homo sapiens
ttcttttctgcagctggtattt

SEQ ID NO: 8123246 - DNA, 22 bp, Homo sapiens
ttcttttcttggcaggagtaga

SEQ ID NO: 8123247 - DNA, 22 bp, Homo sapiens
ttcttcaaaatccagcatgatt

SEQ ID NO: 8123248 - DNA, 22 bp, Homo sapiens
ttcttcaaaatccagcatgatt

SEQ ID NO: 8123249 - DNA, 22 bp, Homo sapiens
ttcttcaaacaaaagtggcatg

SEQ ID NO: 8123250 - DNA, 22 bp, Homo sapiens
ttcttcaagggtaaaggcaacg

SEQ ID NO: 8123251 - DNA, 22 bp, Homo sapiens
ttgaacaatttggtatacaaac

SEQ ID NO: 8123252 - DNA, 22 bp, Homo sapiens
ttgaaatggcagcagctgacct

SEQ ID NO: 8123253 - DNA, 22 bp, Homo sapiens
ttgaaatatggattgaccttga

SEQ ID NO: 8123254 - DNA, 22 bp, Homo sapiens
ttgaaatgctctttggaatcta

SEQ ID NO: 8123255 - DNA, 22 bp, Homo sapiens
ttctttttaaagtgtgtatgca

SEQ ID NO: 8123256 - DNA, 22 bp, Homo sapiens
ttcttttctttaggcattgtgt

SEQ ID NO: 8123257 - DNA, 18 bp, Homo sapiens
tcctgcctgtgccccagg

SEQ ID NO: 8123258 - DNA, 22 bp, Homo sapiens
tcctgcctgcaatcccagcact

SEQ ID NO: 8123259 - DNA, 18 bp, Homo sapiens
tcctgcctgcgggctccc

SEQ ID NO: 8123260 - DNA, 22 bp, Homo sapiens
tcctgcctgtttacctgtactt

SEQ ID NO: 8123261 - DNA, 22 bp, Homo sapiens
ttagctttcagcctttctcacc

SEQ ID NO: 8123262 - DNA, 22 bp, Homo sapiens
ttagctatggctattactagtt

SEQ ID NO: 8123263 - DNA, 22 bp, Homo sapiens
ttagctatagtatgtctgcttt

SEQ ID NO: 8123264 - DNA, 22 bp, Homo sapiens
ttagctctggattaagcagaaa

SEQ ID NO: 8123265 - DNA, 22 bp, Homo sapiens
ttataggaaatagttcatgcga

SEQ ID NO: 8123266 - DNA, 22 bp, Homo sapiens
ttatagtattaggtactcaaca

SEQ ID NO: 8123267 - DNA, 22 bp, Homo sapiens
ttatataactcaggtgggctca

SEQ ID NO: 8123268 - DNA, 22 bp, Homo sapiens
ttatactgtagtctgaaagttg

SEQ ID NO: 8123269 - DNA, 22 bp, Homo sapiens
ttattggattcttgccccaggt

SEQ ID NO: 8123270 - DNA, 22 bp, Homo sapiens
ttcaaacagttgcacaacttat

SEQ ID NO: 8123271 - DNA, 22 bp, Homo sapiens
ttattctttaaacatatatgtt

SEQ ID NO: 8123272 - DNA, 22 bp, Homo sapiens
ttattctttaaacatatatgtt

SEQ ID NO: 8123273 - DNA, 22 bp, Homo sapiens
ttatatatatgtagaggtcacg

SEQ ID NO: 8123274 - DNA, 22 bp, Homo sapiens
ttattaaaatgcggatttggct

SEQ ID NO: 8123275 - DNA, 23 bp, Homo sapiens
ttcatttaggagttcataagagc

SEQ ID NO: 8123276 - DNA, 21 bp, Homo sapiens
ttcataaaccattctcatgca

SEQ ID NO: 8123277 - DNA, 22 bp, Homo sapiens
ttccagggttaatttatatggt

SEQ ID NO: 8123278 - DNA, 22 bp, Homo sapiens
ttccagggctaggtaatgggta

SEQ ID NO: 8123279 - DNA, 22 bp, Homo sapiens
ttccagttcaaattggccaata

SEQ ID NO: 8123280 - DNA, 23 bp, Homo sapiens
ttcaaagatcttctgaaatctgt

SEQ ID NO: 8123281 - DNA, 22 bp, Homo sapiens
ttcagagaacttcatggaagag

SEQ ID NO: 8123282 - DNA, 22 bp, Homo sapiens
ttcagagagaaaccagtgggaa

SEQ ID NO: 8123283 - DNA, 22 bp, Homo sapiens
ttcagagagtttgtgagtcctt

SEQ ID NO: 8123284 - DNA, 22 bp, Homo sapiens
ttgcagatgaagaaactgaagc

SEQ ID NO: 8123285 - DNA, 22 bp, Homo sapiens
ttgcagcccgggttggtttgtg

SEQ ID NO: 8123286 - DNA, 22 bp, Homo sapiens
ttgcagaacttaaagacagagt

SEQ ID NO: 8123287 - DNA, 22 bp, Homo sapiens
ttgacagagaaaagtgtgactt

SEQ ID NO: 8123288 - DNA, 22 bp, Homo sapiens
ttgacaaagtttagtaataatc

SEQ ID NO: 8123289 - DNA, 22 bp, Homo sapiens
ttgacaaaggaattgaatctct

SEQ ID NO: 8123290 - DNA, 22 bp, Homo sapiens
ttgacaaatacccattagacca

SEQ ID NO: 8123291 - DNA, 22 bp, Homo sapiens
ttgacaaagtttagtaataatc

SEQ ID NO: 8123292 - DNA, 22 bp, Homo sapiens
ttggaaaggagattctattgtg

SEQ ID NO: 8123293 - DNA, 22 bp, Homo sapiens
ttggaaaggagtttttagctat

SEQ ID NO: 8123294 - DNA, 22 bp, Homo sapiens
ttggaaaggtgcttttgtctgt

SEQ ID NO: 8123295 - DNA, 22 bp, Homo sapiens
ttggaaagcaagctggacatac

SEQ ID NO: 8123296 - DNA, 22 bp, Homo sapiens
ttggaaagaccgaattcctgtt

SEQ ID NO: 8123297 - DNA, 22 bp, Homo sapiens
ttggaaagaagggctgagcaag

SEQ ID NO: 8123298 - DNA, 22 bp, Homo sapiens
ttgctttccgtcatgtgctaat

SEQ ID NO: 8123299 - DNA, 22 bp, Homo sapiens
ttggaaaatgtatttctagaag

SEQ ID NO: 8123300 - DNA, 22 bp, Homo sapiens
ttgcttatttgattaaatgtct

SEQ ID NO: 8123301 - DNA, 22 bp, Homo sapiens
ttggaaatacagcagttacttt

SEQ ID NO: 8123302 - DNA, 21 bp, Homo sapiens
ttggaacaagcagcagtttgc

SEQ ID NO: 8123303 - DNA, 20 bp, Homo sapiens
ttggacagacgcattgacac

SEQ ID NO: 8123304 - DNA, 22 bp, Homo sapiens
ttgcttatttgattaaatgtct

SEQ ID NO: 8123305 - DNA, 22 bp, Homo sapiens
ttgctgacctttgctctccgtt

SEQ ID NO: 8123306 - DNA, 23 bp, Homo sapiens
ttgtacagcccagattcctcttc

SEQ ID NO: 8123307 - DNA, 22 bp, Homo sapiens
ttgtacagggaagtaatacaag

SEQ ID NO: 8123308 - DNA, 22 bp, Homo sapiens
ttgtacagtttaagtgggtgaa

SEQ ID NO: 8123309 - DNA, 22 bp, Homo sapiens
ttgtaagtcacaccagggcagg

SEQ ID NO: 8123310 - DNA, 22 bp, Homo sapiens
ttgtaagggttacaagaaaaca

SEQ ID NO: 8123311 - DNA, 22 bp, Homo sapiens
ttgtacaagtattatgtgaaca

SEQ ID NO: 8123312 - DNA, 22 bp, Homo sapiens
ttgtacagaccctgaaaagctc

SEQ ID NO: 8123313 - DNA, 19 bp, Homo sapiens
ttgtacagcaaccaaccct

SEQ ID NO: 8123314 - DNA, 22 bp, Homo sapiens
ttgtcctgcaacctcacatggc

SEQ ID NO: 8123315 - DNA, 22 bp, Homo sapiens
ttgtccaaggtcccacagttag

SEQ ID NO: 8123316 - DNA, 22 bp, Homo sapiens
ttgggcagtctggctgcagagt

SEQ ID NO: 8123317 - DNA, 22 bp, Homo sapiens
ttggcccacagtaccatgctgt

SEQ ID NO: 8123318 - DNA, 22 bp, Homo sapiens
ttgggaagtttaatgacagact

SEQ ID NO: 8123319 - DNA, 22 bp, Homo sapiens
ttgggacagaaaaggagaagat

SEQ ID NO: 8123320 - DNA, 22 bp, Homo sapiens
ttggccatctaagcccagccac

SEQ ID NO: 8123321 - DNA, 22 bp, Homo sapiens
ttggcagggcatcagacacgtg

SEQ ID NO: 8123322 - DNA, 22 bp, Homo sapiens
ttggcagctgttggaccttgac

SEQ ID NO: 8123323 - DNA, 22 bp, Homo sapiens
ttggcagctcttgatggcaccc

SEQ ID NO: 8123324 - DNA, 22 bp, Homo sapiens
ttggcagcattccagccaagca

SEQ ID NO: 8123325 - DNA, 22 bp, Homo sapiens
ttggcagcggggaccctggctg

SEQ ID NO: 8123326 - DNA, 23 bp, Homo sapiens
ttggcagcgggtcaggctgtggg

SEQ ID NO: 8123327 - DNA, 22 bp, Homo sapiens
ttggaggaggcattggaggatt

SEQ ID NO: 8123328 - DNA, 22 bp, Homo sapiens
ttggcagcagggagttggccgc

SEQ ID NO: 8123329 - DNA, 20 bp, Homo sapiens
ttggcagcagttccaagtga

SEQ ID NO: 8123330 - DNA, 22 bp, Homo sapiens
ttggaggactagttaagagacc

SEQ ID NO: 8123331 - DNA, 22 bp, Homo sapiens
ttggaggaagctcatgggggat

SEQ ID NO: 8123332 - DNA, 22 bp, Homo sapiens
tttaaagaaattcctcatcttt

SEQ ID NO: 8123333 - DNA, 22 bp, Homo sapiens
ttgtgtgtactggttatgggca

SEQ ID NO: 8123334 - DNA, 17 bp, Homo sapiens
ttgtgtgtagttctgat

SEQ ID NO: 8123335 - DNA, 22 bp, Homo sapiens
tttaaacatcttgttgccttaa

SEQ ID NO: 8123336 - DNA, 22 bp, Homo sapiens
ttgtgtgtagactcagccattg

SEQ ID NO: 8123337 - DNA, 22 bp, Homo sapiens
tttaaatgtgttcttagtagct

SEQ ID NO: 8123338 - DNA, 22 bp, Homo sapiens
tttaagatggtattttataaag

SEQ ID NO: 8123339 - DNA, 19 bp, Homo sapiens
tttacagggaatggagacc

SEQ ID NO: 8123340 - DNA, 22 bp, Homo sapiens
tttaatgtgacatcttttagag

SEQ ID NO: 8123341 - DNA, 22 bp, Homo sapiens
tttaccaagctttaattacata

SEQ ID NO: 8123342 - DNA, 22 bp, Homo sapiens
tttaccaaatagattatgtcag

SEQ ID NO: 8123343 - DNA, 22 bp, Homo sapiens
tttatccagaatcaggattttt

SEQ ID NO: 8123344 - DNA, 22 bp, Homo sapiens
tttatcacagaataagaagtca

SEQ ID NO: 8123345 - DNA, 22 bp, Homo sapiens
tttatccattcaccagttgaac

SEQ ID NO: 8123346 - DNA, 22 bp, Homo sapiens
tttatccatatcattaaaatct

SEQ ID NO: 8123347 - DNA, 22 bp, Homo sapiens
tttatattgtaaaaatggttct

SEQ ID NO: 8123348 - DNA, 22 bp, Homo sapiens
tttagcaatatcataaggaaga

SEQ ID NO: 8123349 - DNA, 22 bp, Homo sapiens
tttattctataggcattaagca

SEQ ID NO: 8123350 - DNA, 22 bp, Homo sapiens
tttcccaggctggaatgcagtg

SEQ ID NO: 8123351 - DNA, 23 bp, Homo sapiens
tttcacagcttttattctgcatc

SEQ ID NO: 8123352 - DNA, 22 bp, Homo sapiens
tttcagaaaacttatcatcagt

SEQ ID NO: 8123353 - DNA, 18 bp, Homo sapiens
aaatggcagaatggatag

SEQ ID NO: 8123354 - DNA, 21 bp, Homo sapiens
aaatggatagggcaatggaag

SEQ ID NO: 8123355 - DNA, 22 bp, Homo sapiens
aaggagtctgggccattcagag

SEQ ID NO: 8123356 - DNA, 22 bp, Homo sapiens
aaggagtctgggccattcagag

SEQ ID NO: 8123357 - DNA, 22 bp, Homo sapiens
aaggagggttcccaggtcctgg

SEQ ID NO: 8123358 - DNA, 22 bp, Homo sapiens
aaggagtgatatatgggtgcta

SEQ ID NO: 8123359 - DNA, 22 bp, Homo sapiens
aaggatatgggtagtatgatgt

SEQ ID NO: 8123360 - DNA, 22 bp, Homo sapiens
aagggaggccagaggttttgca

SEQ ID NO: 8123361 - DNA, 22 bp, Homo sapiens
aagggcaggagaagacggatat

SEQ ID NO: 8123362 - DNA, 22 bp, Homo sapiens
aaggctgaattcaagggtaggc

SEQ ID NO: 8123363 - DNA, 22 bp, Homo sapiens
aaggtgtgaagagatgggaaga

SEQ ID NO: 8123364 - DNA, 22 bp, Homo sapiens
aaggtgtcgggttagctcagcc

SEQ ID NO: 8123365 - DNA, 22 bp, Homo sapiens
aaggtgtcggcagagccgcttc

SEQ ID NO: 8123366 - DNA, 22 bp, Homo sapiens
aagggctgcatttgatgtgtca

SEQ ID NO: 8123367 - DNA, 22 bp, Homo sapiens
aagggctgccagggggtgccag

SEQ ID NO: 8123368 - DNA, 22 bp, Homo sapiens
aagggctgctgtagaagcagag

SEQ ID NO: 8123369 - DNA, 22 bp, Homo sapiens
aagggctggaatatctcttaga

SEQ ID NO: 8123370 - DNA, 22 bp, Homo sapiens
aagtccagtgaaatagaatgca

SEQ ID NO: 8123371 - DNA, 22 bp, Homo sapiens
aagtacaacgcatacagagaaa

SEQ ID NO: 8123372 - DNA, 22 bp, Homo sapiens
aagtaatataattgttgttgtt

SEQ ID NO: 8123373 - DNA, 22 bp, Homo sapiens
aagtaacatgggaacatctgaa

SEQ ID NO: 8123374 - DNA, 22 bp, Homo sapiens
aaggttactcagaataacttcc

SEQ ID NO: 8123375 - DNA, 22 bp, Homo sapiens
aagtaacaggtgcttagtttat

SEQ ID NO: 8123376 - DNA, 22 bp, Homo sapiens
aagtaacatctgaacatgatgt

SEQ ID NO: 8123377 - DNA, 22 bp, Homo sapiens
aagtaacatctgaacatgatgt

SEQ ID NO: 8123378 - DNA, 22 bp, Homo sapiens
aagtaacatctgaacatgatgt

SEQ ID NO: 8123379 - DNA, 22 bp, Homo sapiens
aagtcttaaccaaataaatgtt

SEQ ID NO: 8123380 - DNA, 22 bp, Homo sapiens
aagtcttaggaaatagcaaaga

SEQ ID NO: 8123381 - DNA, 22 bp, Homo sapiens
aagtcttacataatagtttgga

SEQ ID NO: 8123382 - DNA, 22 bp, Homo sapiens
aagtgcatatttttgttgtaga

SEQ ID NO: 8123383 - DNA, 22 bp, Homo sapiens
aagtgctaggattacaggtgtg

SEQ ID NO: 8123384 - DNA, 22 bp, Homo sapiens
aagtgcattagatagaatgatg

SEQ ID NO: 8123385 - DNA, 22 bp, Homo sapiens
aagtgccatcatagcatggctg

SEQ ID NO: 8123386 - DNA, 22 bp, Homo sapiens
aagtgcttccatgtttgagtgt

SEQ ID NO: 8123387 - DNA, 22 bp, Homo sapiens
aagtgcttcaactagtgtggtc

SEQ ID NO: 8123388 - DNA, 22 bp, Homo sapiens
aacagttacccttaagatcttt

SEQ ID NO: 8123389 - DNA, 22 bp, Homo sapiens
aacagttatctcacatatggaa

SEQ ID NO: 8123390 - DNA, 22 bp, Homo sapiens
aatatttctccttcgttatagc

SEQ ID NO: 8123391 - DNA, 22 bp, Homo sapiens
aatattgtttcaagatcacaga

SEQ ID NO: 8123392 - DNA, 22 bp, Homo sapiens
aatatttatatttctcttccct

SEQ ID NO: 8123393 - DNA, 22 bp, Homo sapiens
aatatttatgacaggaagtagc

SEQ ID NO: 8123394 - DNA, 22 bp, Homo sapiens
aatatctgtggccatacaattt

SEQ ID NO: 8123395 - DNA, 22 bp, Homo sapiens
aatatctgtctctaatgcatat

SEQ ID NO: 8123396 - DNA, 22 bp, Homo sapiens
aagttacagtctgcttgctgac

SEQ ID NO: 8123397 - DNA, 22 bp, Homo sapiens
aagttacagttatgaaactcac

SEQ ID NO: 8123398 - DNA, 20 bp, Homo sapiens
aagttacattgtattgtacc

SEQ ID NO: 8123399 - DNA, 22 bp, Homo sapiens
aagttacagttattatttaaaa

SEQ ID NO: 8123400 - DNA, 22 bp, Homo sapiens
aagttacagttggaactgtgaa

SEQ ID NO: 8123401 - DNA, 22 bp, Homo sapiens
aagttacataaatgtcctctag

SEQ ID NO: 8123402 - DNA, 22 bp, Homo sapiens
aacagtttatcaagtttttaca

SEQ ID NO: 8123403 - DNA, 22 bp, Homo sapiens
aacagtttatgagatatgctat

SEQ ID NO: 8123404 - DNA, 22 bp, Homo sapiens
aagttacaagactaaatggaag

SEQ ID NO: 8123405 - DNA, 22 bp, Homo sapiens
aagttacacattttcattgtaa

SEQ ID NO: 8123406 - DNA, 22 bp, Homo sapiens
aagttacaggagaaagagatca

SEQ ID NO: 8123407 - DNA, 22 bp, Homo sapiens
aataatattcctctgtgtgcgt

SEQ ID NO: 8123408 - DNA, 22 bp, Homo sapiens
aatacagatggcatgtgaagat

SEQ ID NO: 8123409 - DNA, 22 bp, Homo sapiens
aatctgaatatttatgtgtatt

SEQ ID NO: 8123410 - DNA, 22 bp, Homo sapiens
aatgatgaactcagagggaacc

SEQ ID NO: 8123411 - DNA, 21 bp, Homo sapiens
aatgatgaaagatgacagagt

SEQ ID NO: 8123412 - DNA, 22 bp, Homo sapiens
aatgtacaaaccttctttgtag

SEQ ID NO: 8123413 - DNA, 22 bp, Homo sapiens
aatgtacaaaagtcagccaact

SEQ ID NO: 8123414 - DNA, 22 bp, Homo sapiens
aactttacactgctttacatga

SEQ ID NO: 8123415 - DNA, 22 bp, Homo sapiens
aatgcagtgagccattaaatgg

SEQ ID NO: 8123416 - DNA, 22 bp, Homo sapiens
aatgcaggttcttgggccacat

SEQ ID NO: 8123417 - DNA, 22 bp, Homo sapiens
aatgcaggcacgtgcaagcaag

SEQ ID NO: 8123418 - DNA, 22 bp, Homo sapiens
aatgcagtttcatttgtagaat

SEQ ID NO: 8123419 - DNA, 22 bp, Homo sapiens
acacttgtaatggagaacacta

SEQ ID NO: 8123420 - DNA, 22 bp, Homo sapiens
acacttgtgttgaaagctgtta

SEQ ID NO: 8123421 - DNA, 22 bp, Homo sapiens
acacttcatgcattcttcactc

SEQ ID NO: 8123422 - DNA, 22 bp, Homo sapiens
acacttctattccctgcacaaa

SEQ ID NO: 8123423 - DNA, 22 bp, Homo sapiens
acacttctcccatctcctgttg

SEQ ID NO: 8123424 - DNA, 22 bp, Homo sapiens
acacttctcccatctcctgttg

SEQ ID NO: 8123425 - DNA, 22 bp, Homo sapiens
acacttctctttgaagaacaat

SEQ ID NO: 8123426 - DNA, 20 bp, Homo sapiens
acacatatagcagcataaac

SEQ ID NO: 8123427 - DNA, 22 bp, Homo sapiens
aagatacacgttgtattgaata

SEQ ID NO: 8123428 - DNA, 22 bp, Homo sapiens
aagatacatcaaagcaaattgg

SEQ ID NO: 8123429 - DNA, 22 bp, Homo sapiens
aagcaggacgtatttctatcct

SEQ ID NO: 8123430 - DNA, 22 bp, Homo sapiens
aagcagtgttcccagctggccc

SEQ ID NO: 8123431 - DNA, 22 bp, Homo sapiens
aagcagtgactctcagaggcag

SEQ ID NO: 8123432 - DNA, 21 bp, Homo sapiens
acagcagggctggcatgacag

SEQ ID NO: 8123433 - DNA, 22 bp, Homo sapiens
acagccaggagccatgggcagg

SEQ ID NO: 8123434 - DNA, 23 bp, Homo sapiens
aagccccaaggaacttcctggga

SEQ ID NO: 8123435 - DNA, 22 bp, Homo sapiens
aagcccctcgggtgcgcacgcg

SEQ ID NO: 8123436 - DNA, 22 bp, Homo sapiens
aagaagagaactggcatcctaa

SEQ ID NO: 8123437 - DNA, 22 bp, Homo sapiens
aattttatctctaagcaggctt

SEQ ID NO: 8123438 - DNA, 22 bp, Homo sapiens
aagaagagaaatgtgctgctgg

SEQ ID NO: 8123439 - DNA, 19 bp, Homo sapiens
aagaactatgtgattacag

SEQ ID NO: 8123440 - DNA, 22 bp, Homo sapiens
aagaacattttgtagaatgaca

SEQ ID NO: 8123441 - DNA, 22 bp, Homo sapiens
aatgtacaataagacaaagagg

SEQ ID NO: 8123442 - DNA, 22 bp, Homo sapiens
aatgtacaagggttccagtttt

SEQ ID NO: 8123443 - DNA, 22 bp, Homo sapiens
aagaacatgttaaaagattcac

SEQ ID NO: 8123444 - DNA, 22 bp, Homo sapiens
aagaatcattgtaaagttctgt

SEQ ID NO: 8123445 - DNA, 22 bp, Homo sapiens
aagaatatttcctgcacttggg

SEQ ID NO: 8123446 - DNA, 22 bp, Homo sapiens
acaaaagtgtaggaattcctta

SEQ ID NO: 8123447 - DNA, 22 bp, Homo sapiens
acaaaagtgtaggaattcctta

SEQ ID NO: 8123448 - DNA, 22 bp, Homo sapiens
acaatattgtacccagaagttt

SEQ ID NO: 8123449 - DNA, 22 bp, Homo sapiens
acaatgtagttgtcatgagaca

SEQ ID NO: 8123450 - DNA, 20 bp, Homo sapiens
acacagactcagcttggatg

SEQ ID NO: 8123451 - DNA, 17 bp, Homo sapiens
acacagacaggcagaca

SEQ ID NO: 8123452 - DNA, 22 bp, Homo sapiens
acacagagctggaactgcttca

SEQ ID NO: 8123453 - DNA, 22 bp, Homo sapiens
aagataatgttctagctgtcag

SEQ ID NO: 8123454 - DNA, 22 bp, Homo sapiens
aagatacaaatgtcaatattgg

SEQ ID NO: 8123455 - DNA, 22 bp, Homo sapiens
aagagtttccatgctctgtgct

SEQ ID NO: 8123456 - DNA, 22 bp, Homo sapiens
aaagtacacacagagccaagaa

SEQ ID NO: 8123457 - DNA, 22 bp, Homo sapiens
aaagtacatagcatattccaac

SEQ ID NO: 8123458 - DNA, 22 bp, Homo sapiens
aaagtacagccacatccaagta

SEQ ID NO: 8123459 - DNA, 22 bp, Homo sapiens
aaagtcacttccttctgtcagc

SEQ ID NO: 8123460 - DNA, 22 bp, Homo sapiens
aaagtacatgagattcaagggg

SEQ ID NO: 8123461 - DNA, 22 bp, Homo sapiens
aaaattgtgaaggtttctgaaa

SEQ ID NO: 8123462 - DNA, 22 bp, Homo sapiens
aaagccagggacagtgtgcatg

SEQ ID NO: 8123463 - DNA, 22 bp, Homo sapiens
aaaggactggatattaaagagt

SEQ ID NO: 8123464 - DNA, 22 bp, Homo sapiens
aaaggagaaaacatacaggact

SEQ ID NO: 8123465 - DNA, 22 bp, Homo sapiens
aaaggacatgtcaatatcaggc

SEQ ID NO: 8123466 - DNA, 22 bp, Homo sapiens
aaaggacacacaggaggtgtct

SEQ ID NO: 8123467 - DNA, 21 bp, Homo sapiens
aaatgaatgtggtagtgcaag

SEQ ID NO: 8123468 - DNA, 22 bp, Homo sapiens
aaactgtgagctagtaaatagg

SEQ ID NO: 8123469 - DNA, 22 bp, Homo sapiens
aaataaaggtccactttagggc

SEQ ID NO: 8123470 - DNA, 22 bp, Homo sapiens
aaataacagtcagggacaacat

SEQ ID NO: 8123471 - DNA, 22 bp, Homo sapiens
aaatacacgtacatgtgtaaaa

SEQ ID NO: 8123472 - DNA, 22 bp, Homo sapiens
aaatacaatttcaggctgtaat

SEQ ID NO: 8123473 - DNA, 22 bp, Homo sapiens
aaagacatatttctaagtttat

SEQ ID NO: 8123474 - DNA, 22 bp, Homo sapiens
aaagacagagctgtaggggaaa

SEQ ID NO: 8123475 - DNA, 22 bp, Homo sapiens
aaaacacaagaagcagggtaca

SEQ ID NO: 8123476 - DNA, 22 bp, Homo sapiens
aaaaatgaaacggctggttggc

SEQ ID NO: 8123477 - DNA, 22 bp, Homo sapiens
aaaagcaagttgcctaggttga

SEQ ID NO: 8123478 - DNA, 22 bp, Homo sapiens
aaaacaggagttttggtaggct

SEQ ID NO: 8123479 - DNA, 22 bp, Homo sapiens
aaaacagtttttgctaactgct

SEQ ID NO: 8123480 - DNA, 22 bp, Homo sapiens
aaaacagtttaggcatcacagt

SEQ ID NO: 8123481 - DNA, 22 bp, Homo sapiens
aaaacacactggaccaatttaa

SEQ ID NO: 8123482 - DNA, 22 bp, Homo sapiens
aaaagcagagactctggagcta

SEQ ID NO: 8123483 - DNA, 20 bp, Homo sapiens
aaaagcagccagagatggta

SEQ ID NO: 8123484 - DNA, 22 bp, Homo sapiens
aaaagcagagactctggagcta

SEQ ID NO: 8123485 - DNA, 22 bp, Homo sapiens
aaaagcagttatctgggaggaa

SEQ ID NO: 8123486 - DNA, 22 bp, Homo sapiens
aaaagctctttctgctgtagat

SEQ ID NO: 8123487 - DNA, 22 bp, Homo sapiens
aaaataacttctactatttgca

SEQ ID NO: 8123488 - DNA, 18 bp, Homo sapiens
aaaataacaaagttggct

SEQ ID NO: 8123489 - DNA, 22 bp, Homo sapiens
aaagcagcagcacctgcatttc

SEQ ID NO: 8123490 - DNA, 22 bp, Homo sapiens
aaagcagcagcacgtggaagag

SEQ ID NO: 8123491 - DNA, 18 bp, Homo sapiens
aaaatgcaggcgacatgg

SEQ ID NO: 8123492 - DNA, 20 bp, Homo sapiens
aaaatgatgggcagggcagg

SEQ ID NO: 8123493 - DNA, 22 bp, Homo sapiens
aaaatgcaaacctacctacata

SEQ ID NO: 8123494 - DNA, 22 bp, Homo sapiens
aaaatgatgctgtaatttggca

SEQ ID NO: 8123495 - DNA, 22 bp, Homo sapiens
aaaatgatatcctgacttttat

SEQ ID NO: 8123496 - DNA, 22 bp, Homo sapiens
aaagttacacgactatttatgt

SEQ ID NO: 8123497 - DNA, 22 bp, Homo sapiens
aaagttctcctggattgtgctg

SEQ ID NO: 8123498 - DNA, 22 bp, Homo sapiens
aaagttctgggggagaagaacg

SEQ ID NO: 8123499 - DNA, 22 bp, Homo sapiens
aaagttctttctcttatttggt

SEQ ID NO: 8123500 - DNA, 22 bp, Homo sapiens
aaagttctgggggagaagaacg

SEQ ID NO: 8123501 - DNA, 22 bp, Homo sapiens
aaagttctggagaaaataatga

SEQ ID NO: 8123502 - DNA, 22 bp, Homo sapiens
aaagtcttaatgtaagtttagt

SEQ ID NO: 8123503 - DNA, 22 bp, Homo sapiens
aaagtcttcacggcactagtgt

SEQ ID NO: 8123504 - DNA, 20 bp, Homo sapiens
aaagtcttatggttaatttt

SEQ ID NO: 8123505 - DNA, 22 bp, Homo sapiens
aaagtcctttttgccatgcaag

SEQ ID NO: 8123506 - DNA, 22 bp, Homo sapiens
aaagtcctgttaactgttaaca

SEQ ID NO: 8123507 - DNA, 22 bp, Homo sapiens
aaagtccagggaaagagcgtct

SEQ ID NO: 8123508 - DNA, 22 bp, Homo sapiens
aaagtcctagcgatccacagaa

SEQ ID NO: 8123509 - DNA, 20 bp, Homo sapiens
aaagtcccttagtgggagca

SEQ ID NO: 8123510 - DNA, 22 bp, Homo sapiens
aaagtccaggggctggaggcgg

SEQ ID NO: 8123511 - DNA, 22 bp, Homo sapiens
aaagggaggggcgataagccgg

SEQ ID NO: 8123512 - DNA, 22 bp, Homo sapiens
aaagggagcatggctgcaggga

SEQ ID NO: 8123513 - DNA, 22 bp, Homo sapiens
aaagggagcatggctgcaggga

SEQ ID NO: 8123514 - DNA, 22 bp, Homo sapiens
aaagggaagttgcacatgttcc

SEQ ID NO: 8123515 - DNA, 22 bp, Homo sapiens
aacatgcaaagctatgatgtat

SEQ ID NO: 8123516 - DNA, 22 bp, Homo sapiens
aaagccaaatgaaagatggttc

SEQ ID NO: 8123517 - DNA, 20 bp, Homo sapiens
aaagcatttacttgtgattg

SEQ ID NO: 8123518 - DNA, 22 bp, Homo sapiens
aaattccattatgataatttcg

SEQ ID NO: 8123519 - DNA, 22 bp, Homo sapiens
aaattccagaaactcagtatat

SEQ ID NO: 8123520 - DNA, 22 bp, Homo sapiens
aaattccattttgtgactattc

SEQ ID NO: 8123521 - DNA, 22 bp, Homo sapiens
aaattccaccagaatcagtaat

SEQ ID NO: 8123522 - DNA, 22 bp, Homo sapiens
aaattccagaaactcagtatat

SEQ ID NO: 8123523 - DNA, 22 bp, Homo sapiens
aaattccaccagaatcagtaat

SEQ ID NO: 8123524 - DNA, 22 bp, Homo sapiens
aaatacataaaggttgtaccag

SEQ ID NO: 8123525 - DNA, 22 bp, Homo sapiens
aaatacatacactgtacgtggc

SEQ ID NO: 8123526 - DNA, 22 bp, Homo sapiens
aagaaggtgtggaaagatgctc

SEQ ID NO: 8123527 - DNA, 22 bp, Homo sapiens
aaagttgctgtcctagctggct

SEQ ID NO: 8123528 - DNA, 22 bp, Homo sapiens
aaagttgctggctttggttcat

SEQ ID NO: 8123529 - DNA, 22 bp, Homo sapiens
aaagttgcacaactttgtatac

SEQ ID NO: 8123530 - DNA, 22 bp, Homo sapiens
aaagttctttttctataaatcc

SEQ ID NO: 8123531 - DNA, 22 bp, Homo sapiens
aaagttgactactaaggaatgt

SEQ ID NO: 8123532 - DNA, 22 bp, Homo sapiens
aaagttgaccgaaagattttga

SEQ ID NO: 8123533 - DNA, 19 bp, Homo sapiens
aaagttgagaaacaatgga

SEQ ID NO: 8123534 - DNA, 22 bp, Homo sapiens
aagaagcagctgccaggccagt

SEQ ID NO: 8123535 - DNA, 22 bp, Homo sapiens
aagagttttctataatcttggc

SEQ ID NO: 8123536 - DNA, 22 bp, Homo sapiens
aagagttttagacaaactgatt

SEQ ID NO: 8123537 - DNA, 22 bp, Homo sapiens
aagagtttgggcaagtcataaa

SEQ ID NO: 8123538 - DNA, 22 bp, Homo sapiens
aagagtttgacctgtgccatcc

SEQ ID NO: 8123539 - DNA, 22 bp, Homo sapiens
aagagtttgtcagatctgcacg

SEQ ID NO: 8123540 - DNA, 22 bp, Homo sapiens
aaatatagtgacacttatagtc

SEQ ID NO: 8123541 - DNA, 22 bp, Homo sapiens
aagagtttctttattaaccttt

SEQ ID NO: 8123542 - DNA, 22 bp, Homo sapiens
aagagtttctgattcagtaggt

SEQ ID NO: 8123543 - DNA, 22 bp, Homo sapiens
aagagtttctgggtcaaggatt

SEQ ID NO: 8123544 - DNA, 22 bp, Homo sapiens
aaatatacggtccctaacagtc

SEQ ID NO: 8123545 - DNA, 22 bp, Homo sapiens
aagagagagttcctaggcaaaa

SEQ ID NO: 8123546 - DNA, 22 bp, Homo sapiens
aagagagaccatgggggacagg

SEQ ID NO: 8123547 - DNA, 22 bp, Homo sapiens
aagagagacaataggtagcatt

SEQ ID NO: 8123548 - DNA, 22 bp, Homo sapiens
aagagagaagtctctctggttc

SEQ ID NO: 8123549 - DNA, 22 bp, Homo sapiens
aaatgactaatgatcctgggca

SEQ ID NO: 8123550 - DNA, 22 bp, Homo sapiens
aaatcactaagttatagtgtgg

SEQ ID NO: 8123551 - DNA, 17 bp, Homo sapiens
aaatcactgtcagttca

SEQ ID NO: 8123552 - DNA, 22 bp, Homo sapiens
aaatcactgattaaagttagaa

SEQ ID NO: 8123553 - DNA, 22 bp, Homo sapiens
aaatggaactgggctactaggt

SEQ ID NO: 8123554 - DNA, 22 bp, Homo sapiens
aaatgcaattgtatgtactcca

SEQ ID NO: 8123555 - DNA, 22 bp, Homo sapiens
aaatgcaaggccatgtgaagga

SEQ ID NO: 8123556 - DNA, 22 bp, Homo sapiens
aaatgatggaaatgaggctgaa

SEQ ID NO: 8123557 - DNA, 20 bp, Homo sapiens
aaatgatgggaataatctat

SEQ ID NO: 8123558 - DNA, 22 bp, Homo sapiens
aaatgatggtactcatgtttag

SEQ ID NO: 8123559 - DNA, 22 bp, Homo sapiens
agacagggtgatcgcttgagcc

SEQ ID NO: 8123560 - DNA, 22 bp, Homo sapiens
agacatgcattgcaatatccat

SEQ ID NO: 8123561 - DNA, 22 bp, Homo sapiens
aatgctcaaaatgtttcatcta

SEQ ID NO: 8123562 - DNA, 22 bp, Homo sapiens
aatgctacagaagtgatcttgg

SEQ ID NO: 8123563 - DNA, 22 bp, Homo sapiens
aatgctgagggatgagagaggc

SEQ ID NO: 8123564 - DNA, 22 bp, Homo sapiens
agacatttattcacacatttat

SEQ ID NO: 8123565 - DNA, 22 bp, Homo sapiens
agagaaggggtaaagagtcctg

SEQ ID NO: 8123566 - DNA, 22 bp, Homo sapiens
agagaagggggaaagatctcac

SEQ ID NO: 8123567 - DNA, 22 bp, Homo sapiens
agagaagggggaaagatctcac

SEQ ID NO: 8123568 - DNA, 19 bp, Homo sapiens
agagaaggatcctatggtt

SEQ ID NO: 8123569 - DNA, 21 bp, Homo sapiens
agagaagggactcttccagtc

SEQ ID NO: 8123570 - DNA, 21 bp, Homo sapiens
agagaagggattccaggccct

SEQ ID NO: 8123571 - DNA, 22 bp, Homo sapiens
agagaagggcctgtatgtaatc

SEQ ID NO: 8123572 - DNA, 22 bp, Homo sapiens
agagcaagtgacagaaacaggg

SEQ ID NO: 8123573 - DNA, 20 bp, Homo sapiens
agagattttagtagccacag

SEQ ID NO: 8123574 - DNA, 22 bp, Homo sapiens
agagatttgtcaatgatttcca

SEQ ID NO: 8123575 - DNA, 22 bp, Homo sapiens
agagatttctactgcactcttt

SEQ ID NO: 8123576 - DNA, 22 bp, Homo sapiens
aattccacagatgtctatctgt

SEQ ID NO: 8123577 - DNA, 20 bp, Homo sapiens
aattccagcatgatatttat

SEQ ID NO: 8123578 - DNA, 22 bp, Homo sapiens
aattccagaccacaagtgattt

SEQ ID NO: 8123579 - DNA, 22 bp, Homo sapiens
agaggaatttctggaaggaggc

SEQ ID NO: 8123580 - DNA, 22 bp, Homo sapiens
agaggaatgtatttccctgcaa

SEQ ID NO: 8123581 - DNA, 21 bp, Homo sapiens
agaggaagtgattggtctggc

SEQ ID NO: 8123582 - DNA, 22 bp, Homo sapiens
agaggattcactgcagaagaca

SEQ ID NO: 8123583 - DNA, 18 bp, Homo sapiens
aatttccatatgaattgc

SEQ ID NO: 8123584 - DNA, 22 bp, Homo sapiens
aatttcacagtgaactttgagg

SEQ ID NO: 8123585 - DNA, 22 bp, Homo sapiens
agaggaatttctggaaggaggc

SEQ ID NO: 8123586 - DNA, 22 bp, Homo sapiens
agaggaggtggtgatgctttaa

SEQ ID NO: 8123587 - DNA, 22 bp, Homo sapiens
agaggatggttgaggaagacct

SEQ ID NO: 8123588 - DNA, 22 bp, Homo sapiens
agaggatgattttaaggacact

SEQ ID NO: 8123589 - DNA, 22 bp, Homo sapiens
agaggagtattttctaagggaa

SEQ ID NO: 8123590 - DNA, 22 bp, Homo sapiens
agaggagtgggaagcagtgcaa

SEQ ID NO: 8123591 - DNA, 22 bp, Homo sapiens
agagctgccgagctggggccat

SEQ ID NO: 8123592 - DNA, 22 bp, Homo sapiens
agagctgccctgccagttctaa

SEQ ID NO: 8123593 - DNA, 22 bp, Homo sapiens
agagctgcccacacagcagatt

SEQ ID NO: 8123594 - DNA, 22 bp, Homo sapiens
agagctgcacctatgcagacct

SEQ ID NO: 8123595 - DNA, 22 bp, Homo sapiens
agagctgcaatttcatgtggtg

SEQ ID NO: 8123596 - DNA, 22 bp, Homo sapiens
agagctgcaatttcatgtggtg

SEQ ID NO: 8123597 - DNA, 22 bp, Homo sapiens
agagctgagcaccaagcatggt

SEQ ID NO: 8123598 - DNA, 21 bp, Homo sapiens
acacaacaggcagtcattttc

SEQ ID NO: 8123599 - DNA, 22 bp, Homo sapiens
acacaagaagttaatgggcaaa

SEQ ID NO: 8123600 - DNA, 22 bp, Homo sapiens
acaattttccccataggttatc

SEQ ID NO: 8123601 - DNA, 22 bp, Homo sapiens
agcacagggcccagcctaggcc

SEQ ID NO: 8123602 - DNA, 22 bp, Homo sapiens
agcacaggaccaaggaagctgt

SEQ ID NO: 8123603 - DNA, 22 bp, Homo sapiens
agcacaggacgtagagcttgga

SEQ ID NO: 8123604 - DNA, 22 bp, Homo sapiens
agcacaggaacatggagatggg

SEQ ID NO: 8123605 - DNA, 22 bp, Homo sapiens
agcacaagtttctggcagacag

SEQ ID NO: 8123606 - DNA, 22 bp, Homo sapiens
agcacacaggccacctccactt

SEQ ID NO: 8123607 - DNA, 22 bp, Homo sapiens
agcacacaggacttgattcatg

SEQ ID NO: 8123608 - DNA, 22 bp, Homo sapiens
agcaaatacttgaataaaaaga

SEQ ID NO: 8123609 - DNA, 22 bp, Homo sapiens
acaatactattttcagtatcct

SEQ ID NO: 8123610 - DNA, 22 bp, Homo sapiens
acaatacaggcttctggactta

SEQ ID NO: 8123611 - DNA, 22 bp, Homo sapiens
acaaagtgaattgcatcgagtt

SEQ ID NO: 8123612 - DNA, 22 bp, Homo sapiens
acaaagtttcttctaacatctg

SEQ ID NO: 8123613 - DNA, 22 bp, Homo sapiens
acaaagtttcttctaacatctg

SEQ ID NO: 8123614 - DNA, 22 bp, Homo sapiens
agatgcatgtttatgtctttcc

SEQ ID NO: 8123615 - DNA, 22 bp, Homo sapiens
agagtgtggttcttgcccgcat

SEQ ID NO: 8123616 - DNA, 22 bp, Homo sapiens
aatttcttgggagctcagagaa

SEQ ID NO: 8123617 - DNA, 22 bp, Homo sapiens
aatttcttgggagctcagagaa

SEQ ID NO: 8123618 - DNA, 22 bp, Homo sapiens
aatttggagctttgtttctaga

SEQ ID NO: 8123619 - DNA, 22 bp, Homo sapiens
agccagagatccatccctagga

SEQ ID NO: 8123620 - DNA, 22 bp, Homo sapiens
agccagaggaagcctggccctc

SEQ ID NO: 8123621 - DNA, 22 bp, Homo sapiens
agccagaggccagcctgcctca

SEQ ID NO: 8123622 - DNA, 22 bp, Homo sapiens
agccaaggtatcatgagaggca

SEQ ID NO: 8123623 - DNA, 18 bp, Homo sapiens
agccaaggaggaggagga

SEQ ID NO: 8123624 - DNA, 22 bp, Homo sapiens
acacccagagcgccagtgccga

SEQ ID NO: 8123625 - DNA, 22 bp, Homo sapiens
acaccattcaccatcagtacct

SEQ ID NO: 8123626 - DNA, 22 bp, Homo sapiens
acaccagggatatgaggaagga

SEQ ID NO: 8123627 - DNA, 22 bp, Homo sapiens
agcaggtgtagggctctttgta

SEQ ID NO: 8123628 - DNA, 22 bp, Homo sapiens
acacaatttcataaacaccatg

SEQ ID NO: 8123629 - DNA, 19 bp, Homo sapiens
acacaatgacacatatata

SEQ ID NO: 8123630 - DNA, 22 bp, Homo sapiens
acacaagtccctccatactctc

SEQ ID NO: 8123631 - DNA, 22 bp, Homo sapiens
acacaagtccctccatactctc

SEQ ID NO: 8123632 - DNA, 22 bp, Homo sapiens
acacaagaataatgatgaaggt

SEQ ID NO: 8123633 - DNA, 22 bp, Homo sapiens
agcaggcttggtccccagcctc

SEQ ID NO: 8123634 - DNA, 22 bp, Homo sapiens
acacatctatctctacacaagg

SEQ ID NO: 8123635 - DNA, 22 bp, Homo sapiens
acagatacaaatatacaaatac

SEQ ID NO: 8123636 - DNA, 22 bp, Homo sapiens
acagcagagtgtgagatagcca

SEQ ID NO: 8123637 - DNA, 22 bp, Homo sapiens
acagcagagtggagatgagcac

SEQ ID NO: 8123638 - DNA, 22 bp, Homo sapiens
acagcagatctggctacaggtt

SEQ ID NO: 8123639 - DNA, 18 bp, Homo sapiens
agctgaggggactgaaga

SEQ ID NO: 8123640 - DNA, 17 bp, Homo sapiens
acagcagggaagtgttg

SEQ ID NO: 8123641 - DNA, 22 bp, Homo sapiens
acagcaggcatgaatgacactg

SEQ ID NO: 8123642 - DNA, 21 bp, Homo sapiens
agcgtcaatatcgtcaacagg

SEQ ID NO: 8123643 - DNA, 22 bp, Homo sapiens
agcggcgccgagcttggccagg

SEQ ID NO: 8123644 - DNA, 22 bp, Homo sapiens
acagaggcctcggcctgcccag

SEQ ID NO: 8123645 - DNA, 19 bp, Homo sapiens
acagagggcaactgagaaa

SEQ ID NO: 8123646 - DNA, 22 bp, Homo sapiens
acagagggtctgggcacaggac

SEQ ID NO: 8123647 - DNA, 22 bp, Homo sapiens
acagagggtttctaaggatttg

SEQ ID NO: 8123648 - DNA, 22 bp, Homo sapiens
acagagggtctgggcacaggac

SEQ ID NO: 8123649 - DNA, 22 bp, Homo sapiens
acagagggtgtggaggaagacg

SEQ ID NO: 8123650 - DNA, 22 bp, Homo sapiens
acagaacttccagggaacatac

SEQ ID NO: 8123651 - DNA, 22 bp, Homo sapiens
acagaacttcctgctggagtgg

SEQ ID NO: 8123652 - DNA, 22 bp, Homo sapiens
acagaaggcggggacaaggcgg

SEQ ID NO: 8123653 - DNA, 22 bp, Homo sapiens
acagaaggacttgagaaagaca

SEQ ID NO: 8123654 - DNA, 20 bp, Homo sapiens
aagggcagagggaacagact

SEQ ID NO: 8123655 - DNA, 22 bp, Homo sapiens
aagggcagaatagagaagatgg

SEQ ID NO: 8123656 - DNA, 22 bp, Homo sapiens
aagggaggtaaagctatttaaa

SEQ ID NO: 8123657 - DNA, 22 bp, Homo sapiens
aagggaggggatgtaagcctgg

SEQ ID NO: 8123658 - DNA, 22 bp, Homo sapiens
acatttcagattcatgaagtga

SEQ ID NO: 8123659 - DNA, 22 bp, Homo sapiens
aagggctgcaatccaaaacact

SEQ ID NO: 8123660 - DNA, 22 bp, Homo sapiens
aagggctgggtctggttaaccc

SEQ ID NO: 8123661 - DNA, 22 bp, Homo sapiens
aagggctggccctgggaagagt

SEQ ID NO: 8123662 - DNA, 22 bp, Homo sapiens
aagggctggatctctctgagca

SEQ ID NO: 8123663 - DNA, 22 bp, Homo sapiens
accagagtaatgtgtggaaatt

SEQ ID NO: 8123664 - DNA, 22 bp, Homo sapiens
aaggggggcacctgcatgcccg

SEQ ID NO: 8123665 - DNA, 22 bp, Homo sapiens
aaggggtgagcagaggcttcgc

SEQ ID NO: 8123666 - DNA, 22 bp, Homo sapiens
aagggtgggccctggcagccat

SEQ ID NO: 8123667 - DNA, 22 bp, Homo sapiens
aagggtgggcaccgccaggtca

SEQ ID NO: 8123668 - DNA, 22 bp, Homo sapiens
aaggggtgggcattagagcagt

SEQ ID NO: 8123669 - DNA, 22 bp, Homo sapiens
aagggttgaagataaataaggt

SEQ ID NO: 8123670 - DNA, 22 bp, Homo sapiens
acccaggcagcaggagctaaag

SEQ ID NO: 8123671 - DNA, 22 bp, Homo sapiens
aaggtacagaaattaacaagga

SEQ ID NO: 8123672 - DNA, 22 bp, Homo sapiens
aaggtacagggaaggagcaaga

SEQ ID NO: 8123673 - DNA, 22 bp, Homo sapiens
aaggtacaggcattgctgcagc

SEQ ID NO: 8123674 - DNA, 22 bp, Homo sapiens
aaggtacaaagtattatttaaa

SEQ ID NO: 8123675 - DNA, 22 bp, Homo sapiens
acctctcttgtagctgctggtg

SEQ ID NO: 8123676 - DNA, 22 bp, Homo sapiens
aaggtgtcaccagattggcagg

SEQ ID NO: 8123677 - DNA, 22 bp, Homo sapiens
acctatttatgcaattatgaaa

SEQ ID NO: 8123678 - DNA, 22 bp, Homo sapiens
acccaggccattggcaagagtc

SEQ ID NO: 8123679 - DNA, 22 bp, Homo sapiens
acctgcctatcagctgcctgct

SEQ ID NO: 8123680 - DNA, 22 bp, Homo sapiens
aagtcccatctgcctccatgta

SEQ ID NO: 8123681 - DNA, 22 bp, Homo sapiens
aagtcccatctgcctccatgta

SEQ ID NO: 8123682 - DNA, 22 bp, Homo sapiens
aagtccctggttcctagcaaaa

SEQ ID NO: 8123683 - DNA, 22 bp, Homo sapiens
aagtccctttaatcagtgcctt

SEQ ID NO: 8123684 - DNA, 22 bp, Homo sapiens
aagtcagtgaaaaggcatcatc

SEQ ID NO: 8123685 - DNA, 22 bp, Homo sapiens
aagtccagtgctttagattcca

SEQ ID NO: 8123686 - DNA, 22 bp, Homo sapiens
aagtccagtttttccaggtggt

SEQ ID NO: 8123687 - DNA, 22 bp, Homo sapiens
aagtatacttaggcataatggt

SEQ ID NO: 8123688 - DNA, 22 bp, Homo sapiens
aagtagcaaggaagattatgat

SEQ ID NO: 8123689 - DNA, 22 bp, Homo sapiens
acatgaagcaagaaagatgcta

SEQ ID NO: 8123690 - DNA, 22 bp, Homo sapiens
acatctcagaactgagtaaccg

SEQ ID NO: 8123691 - DNA, 20 bp, Homo sapiens
acatgaacagggctacagca

SEQ ID NO: 8123692 - DNA, 22 bp, Homo sapiens
acatcctcccgatctactggct

SEQ ID NO: 8123693 - DNA, 22 bp, Homo sapiens
acatgactataattacttaaat

SEQ ID NO: 8123694 - DNA, 22 bp, Homo sapiens
acatgacagtgcttagcaaact

SEQ ID NO: 8123695 - DNA, 22 bp, Homo sapiens
acatgacagtgactttataaga

SEQ ID NO: 8123696 - DNA, 22 bp, Homo sapiens
aaggcacagaggcagggcactt

SEQ ID NO: 8123697 - DNA, 17 bp, Homo sapiens
aaggcacagggcactgg

SEQ ID NO: 8123698 - DNA, 22 bp, Homo sapiens
aaggccagagcagactggagtt

SEQ ID NO: 8123699 - DNA, 22 bp, Homo sapiens
aaggccagcagtttgagaccag

SEQ ID NO: 8123700 - DNA, 22 bp, Homo sapiens
aaggccagagtactagaggctg

SEQ ID NO: 8123701 - DNA, 21 bp, Homo sapiens
aaggaatgaatggatggatga

SEQ ID NO: 8123702 - DNA, 22 bp, Homo sapiens
aaggaagcagccagagaccctc

SEQ ID NO: 8123703 - DNA, 22 bp, Homo sapiens
aaggaagggaaatagtgatgtc

SEQ ID NO: 8123704 - DNA, 22 bp, Homo sapiens
aaggacagagagccattccaga

SEQ ID NO: 8123705 - DNA, 22 bp, Homo sapiens
aaggacagaaacagattgctgg

SEQ ID NO: 8123706 - DNA, 22 bp, Homo sapiens
aaggacaggagaaaacgggatc

SEQ ID NO: 8123707 - DNA, 22 bp, Homo sapiens
aagcttgattgtagtctagaca

SEQ ID NO: 8123708 - DNA, 22 bp, Homo sapiens
aagcttgaatcaatggatatcc

SEQ ID NO: 8123709 - DNA, 22 bp, Homo sapiens
aagcttgaggtcagtagatgtt

SEQ ID NO: 8123710 - DNA, 22 bp, Homo sapiens
aagcttgatgcagagtcaggga

SEQ ID NO: 8123711 - DNA, 22 bp, Homo sapiens
aagctggagagtttcacagatg

SEQ ID NO: 8123712 - DNA, 22 bp, Homo sapiens
aagctggatgtaggatccccct

SEQ ID NO: 8123713 - DNA, 22 bp, Homo sapiens
acagctggaggggctgcagagg

SEQ ID NO: 8123714 - DNA, 22 bp, Homo sapiens
agaaagggaactggcaaagcca

SEQ ID NO: 8123715 - DNA, 22 bp, Homo sapiens
agaaagggaactggcaaagcca

SEQ ID NO: 8123716 - DNA, 22 bp, Homo sapiens
agaaagggagagccagcacacg

SEQ ID NO: 8123717 - DNA, 22 bp, Homo sapiens
agaaagggaccagttcttttga

SEQ ID NO: 8123718 - DNA, 22 bp, Homo sapiens
agaaagggatgaggtagctgct

SEQ ID NO: 8123719 - DNA, 22 bp, Homo sapiens
aatcacagccagcttccgctat

SEQ ID NO: 8123720 - DNA, 22 bp, Homo sapiens
aatcacagagtccagcagatga

SEQ ID NO: 8123721 - DNA, 22 bp, Homo sapiens
actttgttttcatgaaacagct

SEQ ID NO: 8123722 - DNA, 22 bp, Homo sapiens
actttgttgaagaatatgttag

SEQ ID NO: 8123723 - DNA, 22 bp, Homo sapiens
actttgttgttccttgtctaaa

SEQ ID NO: 8123724 - DNA, 22 bp, Homo sapiens
actttgttgatgaaatagtttt

SEQ ID NO: 8123725 - DNA, 22 bp, Homo sapiens
aataggaaaatatttaacaaga

SEQ ID NO: 8123726 - DNA, 22 bp, Homo sapiens
aataggtagccagatatataaa

SEQ ID NO: 8123727 - DNA, 17 bp, Homo sapiens
aatagctgctcagagag

SEQ ID NO: 8123728 - DNA, 22 bp, Homo sapiens
agaagccagattgtagtgggac

SEQ ID NO: 8123729 - DNA, 22 bp, Homo sapiens
agaagccagtcgctctcccgca

SEQ ID NO: 8123730 - DNA, 22 bp, Homo sapiens
agaagccagcttcagctgcccg

SEQ ID NO: 8123731 - DNA, 22 bp, Homo sapiens
agaaggaaggctgagtgctgat

SEQ ID NO: 8123732 - DNA, 22 bp, Homo sapiens
agaaggaagccaggagggtgca

SEQ ID NO: 8123733 - DNA, 22 bp, Homo sapiens
agaactattgcaataacaagaa

SEQ ID NO: 8123734 - DNA, 22 bp, Homo sapiens
agaactgtgaagtatgtgaaat

SEQ ID NO: 8123735 - DNA, 22 bp, Homo sapiens
agaagaaactgtcggggatatt

SEQ ID NO: 8123736 - DNA, 22 bp, Homo sapiens
agaagaaatgaggccgttctgc

SEQ ID NO: 8123737 - DNA, 22 bp, Homo sapiens
aatgaagaaatggacatcttta

SEQ ID NO: 8123738 - DNA, 22 bp, Homo sapiens
agaagaaagattgaaggttcct

SEQ ID NO: 8123739 - DNA, 22 bp, Homo sapiens
agaagccactggaggttgagat

SEQ ID NO: 8123740 - DNA, 18 bp, Homo sapiens
agaagccacgaggagtcc

SEQ ID NO: 8123741 - DNA, 22 bp, Homo sapiens
agaagccagaggcagtgggtac

SEQ ID NO: 8123742 - DNA, 22 bp, Homo sapiens
agaagccagaatattcatggat

SEQ ID NO: 8123743 - DNA, 22 bp, Homo sapiens
agaagcagctttcaaggtgatt

SEQ ID NO: 8123744 - DNA, 22 bp, Homo sapiens
aatgaataacaatcctctggag

SEQ ID NO: 8123745 - DNA, 22 bp, Homo sapiens
aataagtgatgatgagtcactc

SEQ ID NO: 8123746 - DNA, 22 bp, Homo sapiens
actgggcaccatcatgagatag

SEQ ID NO: 8123747 - DNA, 22 bp, Homo sapiens
actgggcaccatcatgagatgg

SEQ ID NO: 8123748 - DNA, 22 bp, Homo sapiens
actgggcaaggatatgatgggt

SEQ ID NO: 8123749 - DNA, 22 bp, Homo sapiens
actgggagtcatgaggaaggag

SEQ ID NO: 8123750 - DNA, 22 bp, Homo sapiens
actgtcctgaatactgcatgac

SEQ ID NO: 8123751 - DNA, 22 bp, Homo sapiens
actgtcctagaacctgcagctc

SEQ ID NO: 8123752 - DNA, 22 bp, Homo sapiens
aatagcatcctaaaacatactt

SEQ ID NO: 8123753 - DNA, 22 bp, Homo sapiens
actgtacacagtggtgtactgt

SEQ ID NO: 8123754 - DNA, 22 bp, Homo sapiens
actgtacaaatattgcaaaata

SEQ ID NO: 8123755 - DNA, 22 bp, Homo sapiens
actgtacaaatattgcaaaata

SEQ ID NO: 8123756 - DNA, 22 bp, Homo sapiens
actgcaggatgtgctcctattg

SEQ ID NO: 8123757 - DNA, 18 bp, Homo sapiens
actgcaggagaggtgagg

SEQ ID NO: 8123758 - DNA, 18 bp, Homo sapiens
actgcaggagaggtgagg

SEQ ID NO: 8123759 - DNA, 22 bp, Homo sapiens
actgcaggagacacagctgctg

SEQ ID NO: 8123760 - DNA, 22 bp, Homo sapiens
actgcatctgaactgtgaatgg

SEQ ID NO: 8123761 - DNA, 22 bp, Homo sapiens
actgcaggccttggtgccagca

SEQ ID NO: 8123762 - DNA, 19 bp, Homo sapiens
actgcagggaggaggtgtg

SEQ ID NO: 8123763 - DNA, 22 bp, Homo sapiens
actgcaggtggatggcacttta

SEQ ID NO: 8123764 - DNA, 22 bp, Homo sapiens
actgcagggcatcctggccaag

SEQ ID NO: 8123765 - DNA, 22 bp, Homo sapiens
actgcagttggtgacaataacc

SEQ ID NO: 8123766 - DNA, 22 bp, Homo sapiens
acctgcctatggagccacatgg

SEQ ID NO: 8123767 - DNA, 22 bp, Homo sapiens
acctgcctcagtgcagctggat

SEQ ID NO: 8123768 - DNA, 22 bp, Homo sapiens
attcgcgggcctggagggtggg

SEQ ID NO: 8123769 - DNA, 22 bp, Homo sapiens
attctacaacccaataataatt

SEQ ID NO: 8123770 - DNA, 22 bp, Homo sapiens
attcaaacaggaagaaatcatt

SEQ ID NO: 8123771 - DNA, 22 bp, Homo sapiens
attcaaagaacctttagcattg

SEQ ID NO: 8123772 - DNA, 22 bp, Homo sapiens
attctctggctaaaacctgaag

SEQ ID NO: 8123773 - DNA, 22 bp, Homo sapiens
attaatatacactgttagcatg

SEQ ID NO: 8123774 - DNA, 22 bp, Homo sapiens
agaggaacccagacagggcttt

SEQ ID NO: 8123775 - DNA, 22 bp, Homo sapiens
agaggaagccattgcttactga

SEQ ID NO: 8123776 - DNA, 22 bp, Homo sapiens
agaggccggccgagcccatggg

SEQ ID NO: 8123777 - DNA, 22 bp, Homo sapiens
attattttatgtgcggcctgat

SEQ ID NO: 8123778 - DNA, 22 bp, Homo sapiens
attgagaatgcaatctactatg

SEQ ID NO: 8123779 - DNA, 22 bp, Homo sapiens
attgagaatgaagggacatttt

SEQ ID NO: 8123780 - DNA, 22 bp, Homo sapiens
attgagaatctgagagcctagg

SEQ ID NO: 8123781 - DNA, 22 bp, Homo sapiens
attgagaatattgtgacagtgt

SEQ ID NO: 8123782 - DNA, 22 bp, Homo sapiens
attgagaatatgatttagtata

SEQ ID NO: 8123783 - DNA, 22 bp, Homo sapiens
attgagaaaattcgagcaagtt

SEQ ID NO: 8123784 - DNA, 23 bp, Homo sapiens
attgagaaggatacattgttctc

SEQ ID NO: 8123785 - DNA, 22 bp, Homo sapiens
attgaaagtcctatctaaggga

SEQ ID NO: 8123786 - DNA, 22 bp, Homo sapiens
attgttaaactgaagcattact

SEQ ID NO: 8123787 - DNA, 22 bp, Homo sapiens
attgttaaactgaagcattact

SEQ ID NO: 8123788 - DNA, 22 bp, Homo sapiens
attgttaataactattacattg

SEQ ID NO: 8123789 - DNA, 22 bp, Homo sapiens
attgtgctttagatcacagtct

SEQ ID NO: 8123790 - DNA, 22 bp, Homo sapiens
agatacaactgtttaaacatta

SEQ ID NO: 8123791 - DNA, 22 bp, Homo sapiens
agcaatgttggcctatatacct

SEQ ID NO: 8123792 - DNA, 22 bp, Homo sapiens
caaagttgcagttatgtgatta

SEQ ID NO: 8123793 - DNA, 22 bp, Homo sapiens
agcaatatgacattgctacatc

SEQ ID NO: 8123794 - DNA, 22 bp, Homo sapiens
caaacattgctaccagaggttt

SEQ ID NO: 8123795 - DNA, 22 bp, Homo sapiens
caaagggctctagactcagcag

SEQ ID NO: 8123796 - DNA, 22 bp, Homo sapiens
caaagtgctgggattacaggtg

SEQ ID NO: 8123797 - DNA, 22 bp, Homo sapiens
caaagtgctgggattagtgctg

SEQ ID NO: 8123798 - DNA, 22 bp, Homo sapiens
caaagtgctgggattataggca

SEQ ID NO: 8123799 - DNA, 22 bp, Homo sapiens
caaagtgctgggattacaggct

SEQ ID NO: 8123800 - DNA, 22 bp, Homo sapiens
attttgttgatggtggagtagc

SEQ ID NO: 8123801 - DNA, 22 bp, Homo sapiens
atttgaagaaagttttctagat

SEQ ID NO: 8123802 - DNA, 19 bp, Homo sapiens
atttgaaagctgtgcttgc

SEQ ID NO: 8123803 - DNA, 23 bp, Homo sapiens
agatgaggcttctccatgttggt

SEQ ID NO: 8123804 - DNA, 22 bp, Homo sapiens
agatgaggggtagaaaggactt

SEQ ID NO: 8123805 - DNA, 21 bp, Homo sapiens
agatgaggatactgaggccta

SEQ ID NO: 8123806 - DNA, 22 bp, Homo sapiens
atttcttttcaagagggtgctt

SEQ ID NO: 8123807 - DNA, 22 bp, Homo sapiens
atttctttctggccacggtttt

SEQ ID NO: 8123808 - DNA, 22 bp, Homo sapiens
atttacagccttgccatctata

SEQ ID NO: 8123809 - DNA, 22 bp, Homo sapiens
atttacaggtagaattttaagt

SEQ ID NO: 8123810 - DNA, 19 bp, Homo sapiens
agatttacctcatatagtt

SEQ ID NO: 8123811 - DNA, 22 bp, Homo sapiens
agattccagggggacattggag

SEQ ID NO: 8123812 - DNA, 22 bp, Homo sapiens
agattgcattgacttgatacga

SEQ ID NO: 8123813 - DNA, 22 bp, Homo sapiens
agattgacaaaacagaagattt

SEQ ID NO: 8123814 - DNA, 22 bp, Homo sapiens
agattccagatcccaaaaatga

SEQ ID NO: 8123815 - DNA, 22 bp, Homo sapiens
atgttacagaaagcaaagatga

SEQ ID NO: 8123816 - DNA, 22 bp, Homo sapiens
agagccaggaagtggcgtgggg

SEQ ID NO: 8123817 - DNA, 22 bp, Homo sapiens
atgtgcatgcacttacatgtgt

SEQ ID NO: 8123818 - DNA, 22 bp, Homo sapiens
atgtgcatactcttggccagct

SEQ ID NO: 8123819 - DNA, 22 bp, Homo sapiens
atgtcttctgtggagacaggta

SEQ ID NO: 8123820 - DNA, 21 bp, Homo sapiens
atgttcactgggtcaattaga

SEQ ID NO: 8123821 - DNA, 22 bp, Homo sapiens
agagctatgatcaaggcagggt

SEQ ID NO: 8123822 - DNA, 22 bp, Homo sapiens
atgggcagttaggaggccagga

SEQ ID NO: 8123823 - DNA, 22 bp, Homo sapiens
atgggcagtaacagtggcagtc

SEQ ID NO: 8123824 - DNA, 22 bp, Homo sapiens
atggacaggtactgcagtgggt

SEQ ID NO: 8123825 - DNA, 23 bp, Homo sapiens
atggacagaatgtttgtgttccc

SEQ ID NO: 8123826 - DNA, 22 bp, Homo sapiens
atggacagctcttatgtgggca

SEQ ID NO: 8123827 - DNA, 22 bp, Homo sapiens
atggacagctgacactcacatt

SEQ ID NO: 8123828 - DNA, 22 bp, Homo sapiens
agagactgcgtgtcagcgctgg

SEQ ID NO: 8123829 - DNA, 22 bp, Homo sapiens
agagactgctttatattgtact

SEQ ID NO: 8123830 - DNA, 22 bp, Homo sapiens
atgtaggattgagtgatagagg

SEQ ID NO: 8123831 - DNA, 21 bp, Homo sapiens
agagactgtcactgcagtacc

SEQ ID NO: 8123832 - DNA, 22 bp, Homo sapiens
agagacttctgccttagcaaga

SEQ ID NO: 8123833 - DNA, 22 bp, Homo sapiens
atgtatatgcatgcattcaaag

SEQ ID NO: 8123834 - DNA, 22 bp, Homo sapiens
atgtatatgcatgcattcaaag

SEQ ID NO: 8123835 - DNA, 22 bp, Homo sapiens
atgaggatgttagtggactgga

SEQ ID NO: 8123836 - DNA, 22 bp, Homo sapiens
atgaggagaccaaggcctgatg

SEQ ID NO: 8123837 - DNA, 22 bp, Homo sapiens
atgacttcgttttctctctgca

SEQ ID NO: 8123838 - DNA, 22 bp, Homo sapiens
atcttagggttctgtttttaag

SEQ ID NO: 8123839 - DNA, 22 bp, Homo sapiens
atcttagaagtttgataaaatc

SEQ ID NO: 8123840 - DNA, 22 bp, Homo sapiens
atcttagagagtcgtgttttgt

SEQ ID NO: 8123841 - DNA, 22 bp, Homo sapiens
atcttagacccttggtagaaaa

SEQ ID NO: 8123842 - DNA, 22 bp, Homo sapiens
atctgggttcaccatgctcctg

SEQ ID NO: 8123843 - DNA, 22 bp, Homo sapiens
atctggggaggtatctgtagtc

SEQ ID NO: 8123844 - DNA, 22 bp, Homo sapiens
atctggggtcagacagccctgg

SEQ ID NO: 8123845 - DNA, 22 bp, Homo sapiens
atgccagacattaacgactatg

SEQ ID NO: 8123846 - DNA, 22 bp, Homo sapiens
atgccacttcattccagcctcg

SEQ ID NO: 8123847 - DNA, 22 bp, Homo sapiens
atgccaggaacaaacagtggtg

SEQ ID NO: 8123848 - DNA, 19 bp, Homo sapiens
agacagtggctaggactta

SEQ ID NO: 8123849 - DNA, 22 bp, Homo sapiens
agacataattaattagttctac

SEQ ID NO: 8123850 - DNA, 22 bp, Homo sapiens
agacatagaaaatcattaggaa

SEQ ID NO: 8123851 - DNA, 22 bp, Homo sapiens
agacatagataggcactgattg

SEQ ID NO: 8123852 - DNA, 22 bp, Homo sapiens
atgctgatgctgcttttgccct

SEQ ID NO: 8123853 - DNA, 22 bp, Homo sapiens
atgctgatgaggtcaggaagac

SEQ ID NO: 8123854 - DNA, 22 bp, Homo sapiens
atgctgattcctgggctccacc

SEQ ID NO: 8123855 - DNA, 22 bp, Homo sapiens
agacataggattccacatagca

SEQ ID NO: 8123856 - DNA, 22 bp, Homo sapiens
atgctgaagagtgcacaggcta

SEQ ID NO: 8123857 - DNA, 22 bp, Homo sapiens
atgctgacagactattaactat

SEQ ID NO: 8123858 - DNA, 22 bp, Homo sapiens
atgctgacttctctctgcagtg

SEQ ID NO: 8123859 - DNA, 22 bp, Homo sapiens
atgctgaattgatgcgagggag

SEQ ID NO: 8123860 - DNA, 22 bp, Homo sapiens
atgcttgaaaaccccatgaata

SEQ ID NO: 8123861 - DNA, 22 bp, Homo sapiens
agccaacacatgtaaatgcacc

SEQ ID NO: 8123862 - DNA, 22 bp, Homo sapiens
cagaaagacctgggctcaagag

SEQ ID NO: 8123863 - DNA, 22 bp, Homo sapiens
cagaaactatgtaagaaagtga

SEQ ID NO: 8123864 - DNA, 20 bp, Homo sapiens
cactgggctggagtcagggc

SEQ ID NO: 8123865 - DNA, 23 bp, Homo sapiens
cactgggggctgctacagagagg

SEQ ID NO: 8123866 - DNA, 22 bp, Homo sapiens
cactgcactccatcctgggaaa

SEQ ID NO: 8123867 - DNA, 22 bp, Homo sapiens
cactgcactccagcccgggcaa

SEQ ID NO: 8123868 - DNA, 22 bp, Homo sapiens
cactgcactccagcccgggcaa

SEQ ID NO: 8123869 - DNA, 22 bp, Homo sapiens
cactgcacaatgtagcaaagaa

SEQ ID NO: 8123870 - DNA, 22 bp, Homo sapiens
cactgcaccctcaaactcctgg

SEQ ID NO: 8123871 - DNA, 22 bp, Homo sapiens
cactgcactccagcactccagc

SEQ ID NO: 8123872 - DNA, 22 bp, Homo sapiens
cactgcacttcagcctgggtga

SEQ ID NO: 8123873 - DNA, 22 bp, Homo sapiens
agcaggtgggcatgaaagctga

SEQ ID NO: 8123874 - DNA, 22 bp, Homo sapiens
agcaggcctcatgcaccagcta

SEQ ID NO: 8123875 - DNA, 22 bp, Homo sapiens
cacatgaacatgctggaaaagc

SEQ ID NO: 8123876 - DNA, 22 bp, Homo sapiens
cacaggctccggccttgcagcc

SEQ ID NO: 8123877 - DNA, 22 bp, Homo sapiens
cacacatcttatcccagttatt

SEQ ID NO: 8123878 - DNA, 22 bp, Homo sapiens
cacagaaaggctcaaatcccaa

SEQ ID NO: 8123879 - DNA, 22 bp, Homo sapiens
cacagaaaaaggcttgaaaatc

SEQ ID NO: 8123880 - DNA, 22 bp, Homo sapiens
cacagaaattattaggatgctt

SEQ ID NO: 8123881 - DNA, 22 bp, Homo sapiens
cacagaaatattgtgtcccttg

SEQ ID NO: 8123882 - DNA, 22 bp, Homo sapiens
cacagctgcacagaggaggtgc

SEQ ID NO: 8123883 - DNA, 22 bp, Homo sapiens
cacagctgccatgcagtcagtg

SEQ ID NO: 8123884 - DNA, 22 bp, Homo sapiens
cacagctggggaagctgaggcc

SEQ ID NO: 8123885 - DNA, 21 bp, Homo sapiens
caattacagatggctcagggg

SEQ ID NO: 8123886 - DNA, 22 bp, Homo sapiens
caagggagttactgagggcggg

SEQ ID NO: 8123887 - DNA, 22 bp, Homo sapiens
caagggaaggctaagggcaaca

SEQ ID NO: 8123888 - DNA, 22 bp, Homo sapiens
caagtcccccaagaacagaacc

SEQ ID NO: 8123889 - DNA, 22 bp, Homo sapiens
caagtccatgttagatgctggc

SEQ ID NO: 8123890 - DNA, 22 bp, Homo sapiens
caagctgggtgcgggcagtata

SEQ ID NO: 8123891 - DNA, 22 bp, Homo sapiens
agcaatttcccatctcttctgc

SEQ ID NO: 8123892 - DNA, 21 bp, Homo sapiens
agcagacagcccaagaaaatc

SEQ ID NO: 8123893 - DNA, 22 bp, Homo sapiens
agcagacaggtaggaggataaa

SEQ ID NO: 8123894 - DNA, 22 bp, Homo sapiens
caagggaaggctaagggcaaca

SEQ ID NO: 8123895 - DNA, 22 bp, Homo sapiens
agccaggctgcagttggctggc

SEQ ID NO: 8123896 - DNA, 22 bp, Homo sapiens
agccaggctcaaggcctgctcc

SEQ ID NO: 8123897 - DNA, 16 bp, Homo sapiens
agccaggctgcctcgg

SEQ ID NO: 8123898 - DNA, 22 bp, Homo sapiens
agccaactccagcccctgcagc

SEQ ID NO: 8123899 - DNA, 20 bp, Homo sapiens
agccaagaacaggcagaacc

SEQ ID NO: 8123900 - DNA, 22 bp, Homo sapiens
agccaggcgcagtggcttatgc

SEQ ID NO: 8123901 - DNA, 22 bp, Homo sapiens
agccaggccttttctcaaggtt

SEQ ID NO: 8123902 - DNA, 22 bp, Homo sapiens
cagagctgtgataaatagatat

SEQ ID NO: 8123903 - DNA, 20 bp, Homo sapiens
cagagctgttatggatgatg

SEQ ID NO: 8123904 - DNA, 22 bp, Homo sapiens
cagagccaggcctgccctcttt

SEQ ID NO: 8123905 - DNA, 22 bp, Homo sapiens
cagagccaggcctgccctcttt

SEQ ID NO: 8123906 - DNA, 22 bp, Homo sapiens
cagagccagggttgcacccctg

SEQ ID NO: 8123907 - DNA, 22 bp, Homo sapiens
cagatcatgaatgactgacaga

SEQ ID NO: 8123908 - DNA, 22 bp, Homo sapiens
agcccttggtattttccgatcc

SEQ ID NO: 8123909 - DNA, 22 bp, Homo sapiens
cagaggagaattgcgggatcat

SEQ ID NO: 8123910 - DNA, 22 bp, Homo sapiens
cagagtgaaataggggatcaag

SEQ ID NO: 8123911 - DNA, 22 bp, Homo sapiens
cagagtgaacagtgggatgtgc

SEQ ID NO: 8123912 - DNA, 22 bp, Homo sapiens
cagagtgatggcacctgctggg

SEQ ID NO: 8123913 - DNA, 22 bp, Homo sapiens
cagagtggagatgtgtgtggaa

SEQ ID NO: 8123914 - DNA, 22 bp, Homo sapiens
agccctcctggggccacgctgg

SEQ ID NO: 8123915 - DNA, 22 bp, Homo sapiens
agccctcctttgttcatgctgc

SEQ ID NO: 8123916 - DNA, 22 bp, Homo sapiens
cagcatgtaagccactgccctg

SEQ ID NO: 8123917 - DNA, 22 bp, Homo sapiens
agcgagggaggtctgaggacag

SEQ ID NO: 8123918 - DNA, 22 bp, Homo sapiens
agcgccactgcactccagcctg

SEQ ID NO: 8123919 - DNA, 22 bp, Homo sapiens
agcgccactgcactccagcctg

SEQ ID NO: 8123920 - DNA, 22 bp, Homo sapiens
agcgccactgcactccagcctg

SEQ ID NO: 8123921 - DNA, 22 bp, Homo sapiens
cagcactgcttcgcagccaggg

SEQ ID NO: 8123922 - DNA, 22 bp, Homo sapiens
cagcactgttcccagaccactg

SEQ ID NO: 8123923 - DNA, 22 bp, Homo sapiens
cagcctctaagcacagcctctc

SEQ ID NO: 8123924 - DNA, 22 bp, Homo sapiens
cagcctcctgggacactcaccg

SEQ ID NO: 8123925 - DNA, 22 bp, Homo sapiens
cagcccatggtttgtggccagt

SEQ ID NO: 8123926 - DNA, 22 bp, Homo sapiens
cagcccatttctgggacctgag

SEQ ID NO: 8123927 - DNA, 20 bp, Homo sapiens
cagcctccactcactcagct

SEQ ID NO: 8123928 - DNA, 22 bp, Homo sapiens
cagccctgggtccctgccctgg

SEQ ID NO: 8123929 - DNA, 22 bp, Homo sapiens
cagcccaggtctctcttccagt

SEQ ID NO: 8123930 - DNA, 22 bp, Homo sapiens
cagcccacgtcagggccactca

SEQ ID NO: 8123931 - DNA, 22 bp, Homo sapiens
cagccagtgtgaccgaggagga

SEQ ID NO: 8123932 - DNA, 22 bp, Homo sapiens
cagcccagaactcacgtctcca

SEQ ID NO: 8123933 - DNA, 22 bp, Homo sapiens
cagcccagagaaggggcccgtg

SEQ ID NO: 8123934 - DNA, 22 bp, Homo sapiens
cagcctctctgtatctcaggat

SEQ ID NO: 8123935 - DNA, 22 bp, Homo sapiens
cagcctctgtggctgccacacc

SEQ ID NO: 8123936 - DNA, 22 bp, Homo sapiens
cagctgccatgacatgtcctgc

SEQ ID NO: 8123937 - DNA, 22 bp, Homo sapiens
cagctgccagcttctctccatc

SEQ ID NO: 8123938 - DNA, 18 bp, Homo sapiens
cagctgccagctcatgga

SEQ ID NO: 8123939 - DNA, 22 bp, Homo sapiens
cagctggcaagtggagcagggt

SEQ ID NO: 8123940 - DNA, 22 bp, Homo sapiens
agtggggtccatcccttccctc

SEQ ID NO: 8123941 - DNA, 22 bp, Homo sapiens
agtggggtctcctccagccccc

SEQ ID NO: 8123942 - DNA, 22 bp, Homo sapiens
agttacatgtgaatagaaagta

SEQ ID NO: 8123943 - DNA, 22 bp, Homo sapiens
agttacaactgtttgaatgtca

SEQ ID NO: 8123944 - DNA, 22 bp, Homo sapiens
actggggcaggaaagtatgctg

SEQ ID NO: 8123945 - DNA, 22 bp, Homo sapiens
actggggcagtgggcagtggtt

SEQ ID NO: 8123946 - DNA, 22 bp, Homo sapiens
agttaataatggaaagacacat

SEQ ID NO: 8123947 - DNA, 22 bp, Homo sapiens
actggtttcctagaataagact

SEQ ID NO: 8123948 - DNA, 22 bp, Homo sapiens
agtgagcattcgtttggaaccc

SEQ ID NO: 8123949 - DNA, 22 bp, Homo sapiens
agtgagcagtacttactcctgc

SEQ ID NO: 8123950 - DNA, 23 bp, Homo sapiens
agtgagcagctgtagggcaagga

SEQ ID NO: 8123951 - DNA, 22 bp, Homo sapiens
agtgaatgagaggtgagtattg

SEQ ID NO: 8123952 - DNA, 22 bp, Homo sapiens
agtgagagtattaatgtgaact

SEQ ID NO: 8123953 - DNA, 22 bp, Homo sapiens
agtgagatactgagaacatctc

SEQ ID NO: 8123954 - DNA, 23 bp, Homo sapiens
agtgctgaattgaaagctccagg

SEQ ID NO: 8123955 - DNA, 22 bp, Homo sapiens
agtgcaaagcagcctgtacacc

SEQ ID NO: 8123956 - DNA, 22 bp, Homo sapiens
agtgcaaagggctgttgagaag

SEQ ID NO: 8123957 - DNA, 22 bp, Homo sapiens
agtgcaaaattcagaagcaatt

SEQ ID NO: 8123958 - DNA, 22 bp, Homo sapiens
agtgcttaggatttgagaggcg

SEQ ID NO: 8123959 - DNA, 20 bp, Homo sapiens
agtgcttattttcatggctg

SEQ ID NO: 8123960 - DNA, 22 bp, Homo sapiens
agtgcttaatagatgtccagca

SEQ ID NO: 8123961 - DNA, 22 bp, Homo sapiens
agtgcttagttccatgctggaa

SEQ ID NO: 8123962 - DNA, 22 bp, Homo sapiens
agtggcagacacaatgtgggca

SEQ ID NO: 8123963 - DNA, 22 bp, Homo sapiens
agtggcagagcaggtgctggaa

SEQ ID NO: 8123964 - DNA, 22 bp, Homo sapiens
agtggcagagccaagtagagcc

SEQ ID NO: 8123965 - DNA, 22 bp, Homo sapiens
agtgggaggcggctgacgggcg

SEQ ID NO: 8123966 - DNA, 22 bp, Homo sapiens
agtcctgtgaggggtgcagctt

SEQ ID NO: 8123967 - DNA, 22 bp, Homo sapiens
agtcctgtaattgtgagttaac

SEQ ID NO: 8123968 - DNA, 22 bp, Homo sapiens
agtcactttatgagagaaccat

SEQ ID NO: 8123969 - DNA, 22 bp, Homo sapiens
agtcagtgggcttggcacagaa

SEQ ID NO: 8123970 - DNA, 22 bp, Homo sapiens
agtcagtgggagaagtgtgaag

SEQ ID NO: 8123971 - DNA, 22 bp, Homo sapiens
agtcagtggtatttaggggaat

SEQ ID NO: 8123972 - DNA, 22 bp, Homo sapiens
actcagcttcctacagctagaa

SEQ ID NO: 8123973 - DNA, 23 bp, Homo sapiens
agtaacatgcaaataacagtctg

SEQ ID NO: 8123974 - DNA, 22 bp, Homo sapiens
actcagagcttggctccttgct

SEQ ID NO: 8123975 - DNA, 22 bp, Homo sapiens
actcagagtgcatctcctattt

SEQ ID NO: 8123976 - DNA, 22 bp, Homo sapiens
actcagctcaggagctggctgg

SEQ ID NO: 8123977 - DNA, 21 bp, Homo sapiens
aggtgcaggcctcaagcccca

SEQ ID NO: 8123978 - DNA, 22 bp, Homo sapiens
agggtccatcaaggactgcaca

SEQ ID NO: 8123979 - DNA, 22 bp, Homo sapiens
agggtccagtaacagatgccag

SEQ ID NO: 8123980 - DNA, 22 bp, Homo sapiens
agggtcagtgatgagggagccc

SEQ ID NO: 8123981 - DNA, 22 bp, Homo sapiens
agggtcagttctgtgaggtgtt

SEQ ID NO: 8123982 - DNA, 22 bp, Homo sapiens
agggtgcagggacaggtgtgca

SEQ ID NO: 8123983 - DNA, 22 bp, Homo sapiens
aggtggagaagagatgggcagt

SEQ ID NO: 8123984 - DNA, 22 bp, Homo sapiens
aggtggagacccagagaaggcg

SEQ ID NO: 8123985 - DNA, 16 bp, Homo sapiens
aggtggagaagttcac

SEQ ID NO: 8123986 - DNA, 22 bp, Homo sapiens
aggtggagacccagagaaggcg

SEQ ID NO: 8123987 - DNA, 22 bp, Homo sapiens
aggtgtcatttctctgcaggtg

SEQ ID NO: 8123988 - DNA, 22 bp, Homo sapiens
actcacagtccctgtaggagtg

SEQ ID NO: 8123989 - DNA, 22 bp, Homo sapiens
agaagccaaatgccagtgacct

SEQ ID NO: 8123990 - DNA, 22 bp, Homo sapiens
agaagccaaatgccagtgacct

SEQ ID NO: 8123991 - DNA, 22 bp, Homo sapiens
agaagccaacagggcaggagag

SEQ ID NO: 8123992 - DNA, 22 bp, Homo sapiens
agaagcaggcagatttcagctc

SEQ ID NO: 8123993 - DNA, 22 bp, Homo sapiens
agaaatgtgaatttcatttcct

SEQ ID NO: 8123994 - DNA, 22 bp, Homo sapiens
agaaatgtcaggaaagaagtcc

SEQ ID NO: 8123995 - DNA, 22 bp, Homo sapiens
agaagccatgtttagtaggatg

SEQ ID NO: 8123996 - DNA, 22 bp, Homo sapiens
agaagccattccctgtaggctc

SEQ ID NO: 8123997 - DNA, 22 bp, Homo sapiens
agaagccatggggtcaccagag

SEQ ID NO: 8123998 - DNA, 22 bp, Homo sapiens
agaagccatggtatgcaactac

SEQ ID NO: 8123999 - DNA, 21 bp, Homo sapiens
agaagccatgtggtggagaac

SEQ ID NO: 8124000 - DNA, 22 bp, Homo sapiens
agaagccatagtatctcagggt

SEQ ID NO: 8124001 - DNA, 22 bp, Homo sapiens
agaagccatagtctgggaggca

SEQ ID NO: 8124002 - DNA, 22 bp, Homo sapiens
agaagccaccagctgaggaaga

SEQ ID NO: 8124003 - DNA, 22 bp, Homo sapiens
atcctgctgctgtggacttctc

SEQ ID NO: 8124004 - DNA, 22 bp, Homo sapiens
atcctggcccaggtgtggaggg

SEQ ID NO: 8124005 - DNA, 22 bp, Homo sapiens
atcctggctttaggtcagaggc

SEQ ID NO: 8124006 - DNA, 22 bp, Homo sapiens
agaaatctttcctgaagtgttt

SEQ ID NO: 8124007 - DNA, 18 bp, Homo sapiens
atcaaggaggggaaggtc

SEQ ID NO: 8124008 - DNA, 22 bp, Homo sapiens
agaaatcaatatctatatgttg

SEQ ID NO: 8124009 - DNA, 20 bp, Homo sapiens
agaaatattgagttcagagg

SEQ ID NO: 8124010 - DNA, 22 bp, Homo sapiens
atattaatgggatttagtcagg

SEQ ID NO: 8124011 - DNA, 22 bp, Homo sapiens
atattaattatttacacatgag

SEQ ID NO: 8124012 - DNA, 22 bp, Homo sapiens
atattaatgggatttagtcagg

SEQ ID NO: 8124013 - DNA, 22 bp, Homo sapiens
agaaagaggatgcagatctcat

SEQ ID NO: 8124014 - DNA, 22 bp, Homo sapiens
atattaaatggattttgggagc

SEQ ID NO: 8124015 - DNA, 22 bp, Homo sapiens
agaaagagctcgggattaacag

SEQ ID NO: 8124016 - DNA, 19 bp, Homo sapiens
atatagcattattcaattt

SEQ ID NO: 8124017 - DNA, 22 bp, Homo sapiens
agaaactttctagggcttcagg

SEQ ID NO: 8124018 - DNA, 22 bp, Homo sapiens
agttcagccatttgttaactat

SEQ ID NO: 8124019 - DNA, 22 bp, Homo sapiens
agttgaaggttggctgatccat

SEQ ID NO: 8124020 - DNA, 22 bp, Homo sapiens
atacactgatctttttatgggg

SEQ ID NO: 8124021 - DNA, 22 bp, Homo sapiens
agaaaaggattgatggatcaga

SEQ ID NO: 8124022 - DNA, 22 bp, Homo sapiens
atagttgtgtggggattctggt

SEQ ID NO: 8124023 - DNA, 23 bp, Homo sapiens
atagaagattattgcaacagtcc

SEQ ID NO: 8124024 - DNA, 22 bp, Homo sapiens
atagaacagaaacagatgcaca

SEQ ID NO: 8124025 - DNA, 22 bp, Homo sapiens
atacactggcctttgcagagcc

SEQ ID NO: 8124026 - DNA, 22 bp, Homo sapiens
atacactgttcactagatcttc

SEQ ID NO: 8124027 - DNA, 22 bp, Homo sapiens
atactgttttgtgacttatctt

SEQ ID NO: 8124028 - DNA, 22 bp, Homo sapiens
atagcatataagttataaaact

SEQ ID NO: 8124029 - DNA, 22 bp, Homo sapiens
acagcatccctgaagataacca

SEQ ID NO: 8124030 - DNA, 22 bp, Homo sapiens
acagcatccttctaaagtagct

SEQ ID NO: 8124031 - DNA, 22 bp, Homo sapiens
acagcatctagtacagtctagt

SEQ ID NO: 8124032 - DNA, 22 bp, Homo sapiens
acaggacaatttataatgggca

SEQ ID NO: 8124033 - DNA, 22 bp, Homo sapiens
acaggacaggctgggctagact

SEQ ID NO: 8124034 - DNA, 22 bp, Homo sapiens
acaggacttaagtcatttataa

SEQ ID NO: 8124035 - DNA, 18 bp, Homo sapiens
aggaaagaaaggcaggtg

SEQ ID NO: 8124036 - DNA, 22 bp, Homo sapiens
acaggatgagaatatcatattt

SEQ ID NO: 8124037 - DNA, 22 bp, Homo sapiens
acaggatggagataatagaaaa

SEQ ID NO: 8124038 - DNA, 22 bp, Homo sapiens
acaggatggccagctgatattg

SEQ ID NO: 8124039 - DNA, 22 bp, Homo sapiens
aggacaggtgtagtgggctctg

SEQ ID NO: 8124040 - DNA, 22 bp, Homo sapiens
aggactggcagtgtgaggggtc

SEQ ID NO: 8124041 - DNA, 22 bp, Homo sapiens
aggactggccctgaggggaggc

SEQ ID NO: 8124042 - DNA, 22 bp, Homo sapiens
acagggccattggaggattata

SEQ ID NO: 8124043 - DNA, 22 bp, Homo sapiens
aggacacaggtaagccagtgga

SEQ ID NO: 8124044 - DNA, 22 bp, Homo sapiens
aggacaggattgagctgaactg

SEQ ID NO: 8124045 - DNA, 22 bp, Homo sapiens
aggacagggattcaaactccca

SEQ ID NO: 8124046 - DNA, 22 bp, Homo sapiens
acaggcctgtgtgcacacgagg

SEQ ID NO: 8124047 - DNA, 22 bp, Homo sapiens
aggaaaggtgagagcggccgcg

SEQ ID NO: 8124048 - DNA, 22 bp, Homo sapiens
aggaaaggggtaggtgtggacg

SEQ ID NO: 8124049 - DNA, 22 bp, Homo sapiens
acagggcacctgaggtaggaag

SEQ ID NO: 8124050 - DNA, 19 bp, Homo sapiens
acagggcagcaataggata

SEQ ID NO: 8124051 - DNA, 22 bp, Homo sapiens
aggcagagaaaaaccagatatg

SEQ ID NO: 8124052 - DNA, 22 bp, Homo sapiens
acatataagggatcagtgacag

SEQ ID NO: 8124053 - DNA, 22 bp, Homo sapiens
acatatatgtaaagtactttgt

SEQ ID NO: 8124054 - DNA, 22 bp, Homo sapiens
acatatatgctgggactgtgac

SEQ ID NO: 8124055 - DNA, 22 bp, Homo sapiens
acatatatgtgcacatgtgcag

SEQ ID NO: 8124056 - DNA, 22 bp, Homo sapiens
acatatattactagtaaagaca

SEQ ID NO: 8124057 - DNA, 22 bp, Homo sapiens
acatatattactagtaaagaca

SEQ ID NO: 8124058 - DNA, 22 bp, Homo sapiens
acagtggaaagaacatggattt

SEQ ID NO: 8124059 - DNA, 22 bp, Homo sapiens
acagtggaaagaaacgaattag

SEQ ID NO: 8124060 - DNA, 22 bp, Homo sapiens
aggacttagaacattatgtact

SEQ ID NO: 8124061 - DNA, 22 bp, Homo sapiens
aggacttagaacattatgtact

SEQ ID NO: 8124062 - DNA, 22 bp, Homo sapiens
acagtggaggccatatggtcct

SEQ ID NO: 8124063 - DNA, 22 bp, Homo sapiens
acagtggagctcagatgaaaat

SEQ ID NO: 8124064 - DNA, 22 bp, Homo sapiens
acagtggatatattaaatgaga

SEQ ID NO: 8124065 - DNA, 22 bp, Homo sapiens
acagtggagttggggtagccct

SEQ ID NO: 8124066 - DNA, 22 bp, Homo sapiens
acagtggatgtgatgtccaggt

SEQ ID NO: 8124067 - DNA, 22 bp, Homo sapiens
acagtggatgacatccttttgc

SEQ ID NO: 8124068 - DNA, 20 bp, Homo sapiens
acagtggaaattgatgtctg

SEQ ID NO: 8124069 - DNA, 22 bp, Homo sapiens
acagtggaaatgtgggagggga

SEQ ID NO: 8124070 - DNA, 22 bp, Homo sapiens
acagtggaagcatgatgctatc

SEQ ID NO: 8124071 - DNA, 22 bp, Homo sapiens
acagtggaagaagcactgaact

SEQ ID NO: 8124072 - DNA, 22 bp, Homo sapiens
acagtggagaaggcatgaggct

SEQ ID NO: 8124073 - DNA, 22 bp, Homo sapiens
acagtggagaagcaaatgcagt

SEQ ID NO: 8124074 - DNA, 22 bp, Homo sapiens
acagtggaatttgtagatgtgt

SEQ ID NO: 8124075 - DNA, 22 bp, Homo sapiens
acagtggaatggtgggcctgca

SEQ ID NO: 8124076 - DNA, 22 bp, Homo sapiens
aggcactctgggtttaaattct

SEQ ID NO: 8124077 - DNA, 22 bp, Homo sapiens
aggctcagggactccctccctc

SEQ ID NO: 8124078 - DNA, 22 bp, Homo sapiens
aggctctctctgccagccgtgc

SEQ ID NO: 8124079 - DNA, 22 bp, Homo sapiens
aggctctgacgtcacacgtggc

SEQ ID NO: 8124080 - DNA, 22 bp, Homo sapiens
aggctctgacccatgggaccca

SEQ ID NO: 8124081 - DNA, 22 bp, Homo sapiens
aggctcagggacggggcccctt

SEQ ID NO: 8124082 - DNA, 23 bp, Homo sapiens
acatgtggagagaacagatatct

SEQ ID NO: 8124083 - DNA, 22 bp, Homo sapiens
accactgggcgggcagcctgct

SEQ ID NO: 8124084 - DNA, 22 bp, Homo sapiens
accactgtactatttgagtggc

SEQ ID NO: 8124085 - DNA, 22 bp, Homo sapiens
accacttcctttaggaccttgt

SEQ ID NO: 8124086 - DNA, 22 bp, Homo sapiens
accactgtctacacattgactc

SEQ ID NO: 8124087 - DNA, 19 bp, Homo sapiens
aggctgtgagggaggactc

SEQ ID NO: 8124088 - DNA, 22 bp, Homo sapiens
aggctgtgagcaagaacaccta

SEQ ID NO: 8124089 - DNA, 22 bp, Homo sapiens
aggctgggaaatgtagtcttcc

SEQ ID NO: 8124090 - DNA, 22 bp, Homo sapiens
acatttctcaggtaagtcattt

SEQ ID NO: 8124091 - DNA, 22 bp, Homo sapiens
aggctctggcaacagctggtgt

SEQ ID NO: 8124092 - DNA, 22 bp, Homo sapiens
acatttctcagggagttttgct

SEQ ID NO: 8124093 - DNA, 22 bp, Homo sapiens
agggctgaaacataatccttct

SEQ ID NO: 8124094 - DNA, 22 bp, Homo sapiens
agggctgaagggaggtgctcat

SEQ ID NO: 8124095 - DNA, 22 bp, Homo sapiens
agggctgacaaatggcagtgac

SEQ ID NO: 8124096 - DNA, 23 bp, Homo sapiens
agggctgaatgcagagaagcaga

SEQ ID NO: 8124097 - DNA, 22 bp, Homo sapiens
agggctgacacaccttatcctc

SEQ ID NO: 8124098 - DNA, 22 bp, Homo sapiens
agggctgacagtaaaagtatga

SEQ ID NO: 8124099 - DNA, 22 bp, Homo sapiens
agggctgacagtgaggagtcaa

SEQ ID NO: 8124100 - DNA, 23 bp, Homo sapiens
aggggtggtcagtacccgcagtg

SEQ ID NO: 8124101 - DNA, 22 bp, Homo sapiens
aggggtgtgcatcctggaggat

SEQ ID NO: 8124102 - DNA, 22 bp, Homo sapiens
aggggtgtgcatcctggaggat

SEQ ID NO: 8124103 - DNA, 22 bp, Homo sapiens
aggggttggatttggcctagag

SEQ ID NO: 8124104 - DNA, 22 bp, Homo sapiens
aggggtggagagtgttgccagt

SEQ ID NO: 8124105 - DNA, 22 bp, Homo sapiens
aggggtggcctgccttactccc

SEQ ID NO: 8124106 - DNA, 22 bp, Homo sapiens
aggggtgacacatatcagtgca

SEQ ID NO: 8124107 - DNA, 20 bp, Homo sapiens
aggggtgatcgggtgacact

SEQ ID NO: 8124108 - DNA, 22 bp, Homo sapiens
aggggtgatttgggacaggaca

SEQ ID NO: 8124109 - DNA, 22 bp, Homo sapiens
aggggccatgtaagtgtatcac

SEQ ID NO: 8124110 - DNA, 22 bp, Homo sapiens
aggggccattgttctgcccgct

SEQ ID NO: 8124111 - DNA, 22 bp, Homo sapiens
aggggccacctgtggcaccctg

SEQ ID NO: 8124112 - DNA, 22 bp, Homo sapiens
aggggccacctgtggcaccctg

SEQ ID NO: 8124113 - DNA, 22 bp, Homo sapiens
aggggccaccaccaaggaaggt

SEQ ID NO: 8124114 - DNA, 22 bp, Homo sapiens
accctttcttactcacacgctc

SEQ ID NO: 8124115 - DNA, 18 bp, Homo sapiens
accctttccaaactgcag

SEQ ID NO: 8124116 - DNA, 22 bp, Homo sapiens
acctcagctatttcaaaacaga

SEQ ID NO: 8124117 - DNA, 22 bp, Homo sapiens
agggccagtaccaggtgggtgg

SEQ ID NO: 8124118 - DNA, 22 bp, Homo sapiens
agggccagtgggttgaaaggca

SEQ ID NO: 8124119 - DNA, 22 bp, Homo sapiens
agggccagtattaaggtaatta

SEQ ID NO: 8124120 - DNA, 22 bp, Homo sapiens
agggccagcactcctggcagga

SEQ ID NO: 8124121 - DNA, 22 bp, Homo sapiens
agggccagcccataatgccaaa

SEQ ID NO: 8124122 - DNA, 22 bp, Homo sapiens
agggcatgctggaggagagaca

SEQ ID NO: 8124123 - DNA, 22 bp, Homo sapiens
accagagctcttcagcacagga

SEQ ID NO: 8124124 - DNA, 22 bp, Homo sapiens
agggaggcattagctactgcga

SEQ ID NO: 8124125 - DNA, 19 bp, Homo sapiens
agggcacagggacagaagg

SEQ ID NO: 8124126 - DNA, 22 bp, Homo sapiens
ccagctccctgaagcctggtct

SEQ ID NO: 8124127 - DNA, 22 bp, Homo sapiens
ccaggaggtgctggaagaaagc

SEQ ID NO: 8124128 - DNA, 22 bp, Homo sapiens
ccaggaggtggagattgcagtg

SEQ ID NO: 8124129 - DNA, 22 bp, Homo sapiens
aggcctgggacgggagccgtga

SEQ ID NO: 8124130 - DNA, 22 bp, Homo sapiens
ccaggaggttgaggctgcagtg

SEQ ID NO: 8124131 - DNA, 22 bp, Homo sapiens
aggctcagagagctgtgtccat

SEQ ID NO: 8124132 - DNA, 22 bp, Homo sapiens
aggcctgggcaagaaggggcgt

SEQ ID NO: 8124133 - DNA, 22 bp, Homo sapiens
aggcctgggtctcgtgcctacc

SEQ ID NO: 8124134 - DNA, 22 bp, Homo sapiens
ccaggcacaggtgggcctcaga

SEQ ID NO: 8124135 - DNA, 22 bp, Homo sapiens
ccaggcacggtggctcatgcct

SEQ ID NO: 8124136 - DNA, 22 bp, Homo sapiens
ccagaggtggtggtgtctagaa

SEQ ID NO: 8124137 - DNA, 18 bp, Homo sapiens
ccagccctgcagcacctg

SEQ ID NO: 8124138 - DNA, 17 bp, Homo sapiens
ccagccctcgcgctttt

SEQ ID NO: 8124139 - DNA, 22 bp, Homo sapiens
ccagccaggctggctgtggagg

SEQ ID NO: 8124140 - DNA, 18 bp, Homo sapiens
ccaggtggtgacagagat

SEQ ID NO: 8124141 - DNA, 20 bp, Homo sapiens
ccaggtggtgcctggagagg

SEQ ID NO: 8124142 - DNA, 22 bp, Homo sapiens
aggctgagtgctcccctagatg

SEQ ID NO: 8124143 - DNA, 19 bp, Homo sapiens
ccaggcctggcgtctccgc

SEQ ID NO: 8124144 - DNA, 20 bp, Homo sapiens
ccaggcctgggcctgctcta

SEQ ID NO: 8124145 - DNA, 22 bp, Homo sapiens
aggctcagatccttgtgtcctg

SEQ ID NO: 8124146 - DNA, 22 bp, Homo sapiens
ccaggccttccagtacgcagaa

SEQ ID NO: 8124147 - DNA, 22 bp, Homo sapiens
ccaggccttctgaggacactct

SEQ ID NO: 8124148 - DNA, 21 bp, Homo sapiens
aggctcagcaggtgtataaag

SEQ ID NO: 8124149 - DNA, 22 bp, Homo sapiens
aggctcagcccctgggaggaga

SEQ ID NO: 8124150 - DNA, 22 bp, Homo sapiens
aggctcagcccaaggtggagag

SEQ ID NO: 8124151 - DNA, 22 bp, Homo sapiens
aggctgcagaggtgctgccaga

SEQ ID NO: 8124152 - DNA, 22 bp, Homo sapiens
aggctgcagtgcaggtaggatt

SEQ ID NO: 8124153 - DNA, 22 bp, Homo sapiens
aggctgccagaagccttcagga

SEQ ID NO: 8124154 - DNA, 22 bp, Homo sapiens
ccagtgggtgctgggctctgcc

SEQ ID NO: 8124155 - DNA, 19 bp, Homo sapiens
aggctgcccagtctctgcc

SEQ ID NO: 8124156 - DNA, 22 bp, Homo sapiens
aggctgccatagggaactgcat

SEQ ID NO: 8124157 - DNA, 22 bp, Homo sapiens
aggctgccatagggaactgcat

SEQ ID NO: 8124158 - DNA, 20 bp, Homo sapiens
aggctgccaggtctcacatc

SEQ ID NO: 8124159 - DNA, 20 bp, Homo sapiens
cccacacccttcccacttgg

SEQ ID NO: 8124160 - DNA, 19 bp, Homo sapiens
ccagtgtctagcgcacagc

SEQ ID NO: 8124161 - DNA, 22 bp, Homo sapiens
ccagtgtctactgtggcatatc

SEQ ID NO: 8124162 - DNA, 22 bp, Homo sapiens
cccacgtcgaacttgctccaga

SEQ ID NO: 8124163 - DNA, 22 bp, Homo sapiens
cccactccctacgacacgctcc

SEQ ID NO: 8124164 - DNA, 22 bp, Homo sapiens
cccacgtcgaacttgctccaga

SEQ ID NO: 8124165 - DNA, 22 bp, Homo sapiens
cccacgttgaaccgcttacaga

SEQ ID NO: 8124166 - DNA, 22 bp, Homo sapiens
cccacctctcagagagccttgc

SEQ ID NO: 8124167 - DNA, 22 bp, Homo sapiens
cccactctggctcccttctagt

SEQ ID NO: 8124168 - DNA, 22 bp, Homo sapiens
cccactcctggagctagggctc

SEQ ID NO: 8124169 - DNA, 22 bp, Homo sapiens
cccactccctgcacgcctgccg

SEQ ID NO: 8124170 - DNA, 22 bp, Homo sapiens
aggctgtgcacagggcacctgc

SEQ ID NO: 8124171 - DNA, 22 bp, Homo sapiens
ccctggcataaaacttctccag

SEQ ID NO: 8124172 - DNA, 22 bp, Homo sapiens
ccctggcataaaacttctccag

SEQ ID NO: 8124173 - DNA, 22 bp, Homo sapiens
ccctggcatgcatgtccctggc

SEQ ID NO: 8124174 - DNA, 22 bp, Homo sapiens
ccctggcagaatgtctctgggc

SEQ ID NO: 8124175 - DNA, 22 bp, Homo sapiens
ccctggcagagggggcaggtgc

SEQ ID NO: 8124176 - DNA, 19 bp, Homo sapiens
ccctggcaggcaagcctgg

SEQ ID NO: 8124177 - DNA, 19 bp, Homo sapiens
ccctggcaggcaagcctgg

SEQ ID NO: 8124178 - DNA, 22 bp, Homo sapiens
agggcccaggacagcatcaggg

SEQ ID NO: 8124179 - DNA, 22 bp, Homo sapiens
agggcccagtggagagctgagc

SEQ ID NO: 8124180 - DNA, 22 bp, Homo sapiens
agggcccagtggagagctgagc

SEQ ID NO: 8124181 - DNA, 22 bp, Homo sapiens
ccctggcacatgcgctgtgtgg

SEQ ID NO: 8124182 - DNA, 22 bp, Homo sapiens
ccctggcaagtgctgtgtagct

SEQ ID NO: 8124183 - DNA, 22 bp, Homo sapiens
agggcccatgtgggagcacttg

SEQ ID NO: 8124184 - DNA, 22 bp, Homo sapiens
ccctggcaaaatccctggtaca

SEQ ID NO: 8124185 - DNA, 22 bp, Homo sapiens
cctaagtttatcatagttttac

SEQ ID NO: 8124186 - DNA, 22 bp, Homo sapiens
cctactctgagcgcctccgcat

SEQ ID NO: 8124187 - DNA, 22 bp, Homo sapiens
agggctgacctaagctccactt

SEQ ID NO: 8124188 - DNA, 22 bp, Homo sapiens
agggctgacagtggcgtggcgt

SEQ ID NO: 8124189 - DNA, 22 bp, Homo sapiens
cctactctgtgagccactttgc

SEQ ID NO: 8124190 - DNA, 22 bp, Homo sapiens
agggctgagcccaggcatgtag

SEQ ID NO: 8124191 - DNA, 22 bp, Homo sapiens
agggctgagactaaggccagat

SEQ ID NO: 8124192 - DNA, 22 bp, Homo sapiens
cctcagggtggcatcagatctt

SEQ ID NO: 8124193 - DNA, 22 bp, Homo sapiens
cctcaggggtcactgtgaggag

SEQ ID NO: 8124194 - DNA, 22 bp, Homo sapiens
cctcagggaggcctctgtggct

SEQ ID NO: 8124195 - DNA, 22 bp, Homo sapiens
aggggggtggatcacctgaggt

SEQ ID NO: 8124196 - DNA, 22 bp, Homo sapiens
aggggtcagtgaccattgagga

SEQ ID NO: 8124197 - DNA, 20 bp, Homo sapiens
aggggtctagcagcagtgct

SEQ ID NO: 8124198 - DNA, 22 bp, Homo sapiens
aggggtctatcctgagatggtc

SEQ ID NO: 8124199 - DNA, 22 bp, Homo sapiens
aggggtcttgaggactccagca

SEQ ID NO: 8124200 - DNA, 22 bp, Homo sapiens
aggggtcttgggagtcctggct

SEQ ID NO: 8124201 - DNA, 22 bp, Homo sapiens
agggggtgcccagatgaaggat

SEQ ID NO: 8124202 - DNA, 22 bp, Homo sapiens
agggggtgcatttgtgaatgaa

SEQ ID NO: 8124203 - DNA, 22 bp, Homo sapiens
agggggtgcatttgtgaatgaa

SEQ ID NO: 8124204 - DNA, 22 bp, Homo sapiens
cctcctggtgggcgcttctggc

SEQ ID NO: 8124205 - DNA, 22 bp, Homo sapiens
cctccttcctgggacagagctg

SEQ ID NO: 8124206 - DNA, 22 bp, Homo sapiens
cctcgacctccccaggctcagg

SEQ ID NO: 8124207 - DNA, 22 bp, Homo sapiens
cctccttctggggccttctgct

SEQ ID NO: 8124208 - DNA, 22 bp, Homo sapiens
cctccttctggggccttctgct

SEQ ID NO: 8124209 - DNA, 22 bp, Homo sapiens
cctcctggtgacaaggcaaagc

SEQ ID NO: 8124210 - DNA, 22 bp, Homo sapiens
cctcctggtccagcatctcttt

SEQ ID NO: 8124211 - DNA, 22 bp, Homo sapiens
aggggaaggccagcctgtagag

SEQ ID NO: 8124212 - DNA, 22 bp, Homo sapiens
aggggctcctctctgagagtag

SEQ ID NO: 8124213 - DNA, 22 bp, Homo sapiens
aggggctcctggcctggagagc

SEQ ID NO: 8124214 - DNA, 22 bp, Homo sapiens
aggggctcaaagtgtgcaggga

SEQ ID NO: 8124215 - DNA, 18 bp, Homo sapiens
aggggcagcttgtgtgga

SEQ ID NO: 8124216 - DNA, 22 bp, Homo sapiens
agggatgggtctaacccagaac

SEQ ID NO: 8124217 - DNA, 22 bp, Homo sapiens
agggcagactaggatggaagtg

SEQ ID NO: 8124218 - DNA, 22 bp, Homo sapiens
cccctggggatcagctggaatt

SEQ ID NO: 8124219 - DNA, 22 bp, Homo sapiens
agggcatgtgggagaggagcct

SEQ ID NO: 8124220 - DNA, 22 bp, Homo sapiens
agggcatgctggaggagagaca

SEQ ID NO: 8124221 - DNA, 22 bp, Homo sapiens
agggccacagtggggcctgaga

SEQ ID NO: 8124222 - DNA, 22 bp, Homo sapiens
agggccaccagagcagggcagt

SEQ ID NO: 8124223 - DNA, 22 bp, Homo sapiens
agggccacagtggggcctgaga

SEQ ID NO: 8124224 - DNA, 23 bp, Homo sapiens
agggccactgggaaggattactg

SEQ ID NO: 8124225 - DNA, 22 bp, Homo sapiens
agggccacctctctgggttccc

SEQ ID NO: 8124226 - DNA, 23 bp, Homo sapiens
agggcccaagcctggacagcagg

SEQ ID NO: 8124227 - DNA, 23 bp, Homo sapiens
agggcccaagcctggacagcagg

SEQ ID NO: 8124228 - DNA, 20 bp, Homo sapiens
agggcccaggaagagagtta

SEQ ID NO: 8124229 - DNA, 22 bp, Homo sapiens
ccctgaggatagggcaggaccc

SEQ ID NO: 8124230 - DNA, 22 bp, Homo sapiens
ccctgaggggagtggtgaggtg

SEQ ID NO: 8124231 - DNA, 22 bp, Homo sapiens
agggagccttcctggctgtggt

SEQ ID NO: 8124232 - DNA, 22 bp, Homo sapiens
agggaatggatgatggcaggtt

SEQ ID NO: 8124233 - DNA, 21 bp, Homo sapiens
agggaaaaggctgagtgaggg

SEQ ID NO: 8124234 - DNA, 22 bp, Homo sapiens
aggctttggggcattctgtgtt

SEQ ID NO: 8124235 - DNA, 22 bp, Homo sapiens
agggaaaggtagtgaggtcaca

SEQ ID NO: 8124236 - DNA, 22 bp, Homo sapiens
cagtatcttgcttatagacaca

SEQ ID NO: 8124237 - DNA, 22 bp, Homo sapiens
cagtatttgttccctatcaatg

SEQ ID NO: 8124238 - DNA, 22 bp, Homo sapiens
cagtatttggtaattggctacc

SEQ ID NO: 8124239 - DNA, 22 bp, Homo sapiens
cagtattcatctaaggagcttg

SEQ ID NO: 8124240 - DNA, 22 bp, Homo sapiens
cagtatttcctcttcttaactt

SEQ ID NO: 8124241 - DNA, 22 bp, Homo sapiens
aggacagatttttggccaccag

SEQ ID NO: 8124242 - DNA, 21 bp, Homo sapiens
aggaagtggccagattgggaa

SEQ ID NO: 8124243 - DNA, 22 bp, Homo sapiens
aggaagtgcagggggaagtact

SEQ ID NO: 8124244 - DNA, 22 bp, Homo sapiens
caggtgtctaattctcaccccc

SEQ ID NO: 8124245 - DNA, 22 bp, Homo sapiens
aggaagtgactaggtaacccaa

SEQ ID NO: 8124246 - DNA, 22 bp, Homo sapiens
caggtgtcaaaatactaagtgg

SEQ ID NO: 8124247 - DNA, 22 bp, Homo sapiens
aggaatatagttggaatgtagg

SEQ ID NO: 8124248 - DNA, 22 bp, Homo sapiens
aggaagtgggaagggtctgcca

SEQ ID NO: 8124249 - DNA, 21 bp, Homo sapiens
aggaagtggccagattgggaa

SEQ ID NO: 8124250 - DNA, 22 bp, Homo sapiens
aggaagtggggttctctcactg

SEQ ID NO: 8124251 - DNA, 22 bp, Homo sapiens
aggaagtgtcagggataacgat

SEQ ID NO: 8124252 - DNA, 22 bp, Homo sapiens
aggaatattctcaagtggtcgt

SEQ ID NO: 8124253 - DNA, 22 bp, Homo sapiens
aggaatatggatttgctcagct

SEQ ID NO: 8124254 - DNA, 22 bp, Homo sapiens
aggaatattactttgcttttat

SEQ ID NO: 8124255 - DNA, 18 bp, Homo sapiens
aggaatattcaaggtgct

SEQ ID NO: 8124256 - DNA, 22 bp, Homo sapiens
aggacaagacaaggaccagaga

SEQ ID NO: 8124257 - DNA, 22 bp, Homo sapiens
aggacacatgcacaccctgcgt

SEQ ID NO: 8124258 - DNA, 22 bp, Homo sapiens
aggacagagcctgtgcagaccg

SEQ ID NO: 8124259 - DNA, 22 bp, Homo sapiens
aggacagacctaggactggagc

SEQ ID NO: 8124260 - DNA, 22 bp, Homo sapiens
aggacagacctaggactggagc

SEQ ID NO: 8124261 - DNA, 22 bp, Homo sapiens
cagggctggctgtggcaatctc

SEQ ID NO: 8124262 - DNA, 22 bp, Homo sapiens
cagggctggatttcatttctag

SEQ ID NO: 8124263 - DNA, 22 bp, Homo sapiens
cagggctggctcatgaaaagtt

SEQ ID NO: 8124264 - DNA, 22 bp, Homo sapiens
cagggctctgccttgagggatg

SEQ ID NO: 8124265 - DNA, 22 bp, Homo sapiens
cagggatgtgatgagctgagcc

SEQ ID NO: 8124266 - DNA, 22 bp, Homo sapiens
cagggatgtgatgagctgagcc

SEQ ID NO: 8124267 - DNA, 22 bp, Homo sapiens
cagggattcagctgaaggaggc

SEQ ID NO: 8124268 - DNA, 22 bp, Homo sapiens
caggctcttttggtggcaagga

SEQ ID NO: 8124269 - DNA, 22 bp, Homo sapiens
cagggctgggttaaaagcaggg

SEQ ID NO: 8124270 - DNA, 22 bp, Homo sapiens
aggaaaggcctcagcagaaacc

SEQ ID NO: 8124271 - DNA, 22 bp, Homo sapiens
aggaagagctggaccagaggac

SEQ ID NO: 8124272 - DNA, 22 bp, Homo sapiens
aggaagagctggaccagaggac

SEQ ID NO: 8124273 - DNA, 22 bp, Homo sapiens
cagctgtcagccggtgcaggct

SEQ ID NO: 8124274 - DNA, 22 bp, Homo sapiens
caggacagagcccagactgtgt

SEQ ID NO: 8124275 - DNA, 20 bp, Homo sapiens
caggacagcgcaatcggagg

SEQ ID NO: 8124276 - DNA, 22 bp, Homo sapiens
caggacctgaagacaggcaggt

SEQ ID NO: 8124277 - DNA, 22 bp, Homo sapiens
caggactgaagggcacagggaa

SEQ ID NO: 8124278 - DNA, 22 bp, Homo sapiens
caggagaaacataattttctgg

SEQ ID NO: 8124279 - DNA, 22 bp, Homo sapiens
caggcacaatgagcgccatctt

SEQ ID NO: 8124280 - DNA, 22 bp, Homo sapiens
caggagccagctgtcccaacca

SEQ ID NO: 8124281 - DNA, 22 bp, Homo sapiens
caggagtctgttcctcatttgt

SEQ ID NO: 8124282 - DNA, 22 bp, Homo sapiens
caggcagggagctggaaaggat

SEQ ID NO: 8124283 - DNA, 22 bp, Homo sapiens
caggcagctcaaccttgggagc

SEQ ID NO: 8124284 - DNA, 22 bp, Homo sapiens
caggcagcctgcggtctgcaca

SEQ ID NO: 8124285 - DNA, 22 bp, Homo sapiens
caggcagcgctcgtggcctggc

SEQ ID NO: 8124286 - DNA, 22 bp, Homo sapiens
caggcagtgtcccaggaagcca

SEQ ID NO: 8124287 - DNA, 22 bp, Homo sapiens
caggcaggtgcagattcctctt

SEQ ID NO: 8124288 - DNA, 22 bp, Homo sapiens
caggcccatgagggcagccaca

SEQ ID NO: 8124289 - DNA, 22 bp, Homo sapiens
caggcccatgagggcagccaca

SEQ ID NO: 8124290 - DNA, 22 bp, Homo sapiens
agctgtctgtgaacacagcatt

SEQ ID NO: 8124291 - DNA, 22 bp, Homo sapiens
caggcccagtgatcagggctct

SEQ ID NO: 8124292 - DNA, 22 bp, Homo sapiens
caggcccagtgatcagggctct

SEQ ID NO: 8124293 - DNA, 22 bp, Homo sapiens
agcttccttggcgctgaggcct

SEQ ID NO: 8124294 - DNA, 21 bp, Homo sapiens
agcttcctgcagtgggaggtc

SEQ ID NO: 8124295 - DNA, 22 bp, Homo sapiens
agcttcctgtcttctgcacaaa

SEQ ID NO: 8124296 - DNA, 22 bp, Homo sapiens
caggctctgctgctacagctgt

SEQ ID NO: 8124297 - DNA, 23 bp, Homo sapiens
ccacgtctgcactgtagctgttg

SEQ ID NO: 8124298 - DNA, 22 bp, Homo sapiens
ccacccagaccagggatctggg

SEQ ID NO: 8124299 - DNA, 21 bp, Homo sapiens
ccaccaggtcttctgctcggg

SEQ ID NO: 8124300 - DNA, 22 bp, Homo sapiens
ccacatctccctattgctcttt

SEQ ID NO: 8124301 - DNA, 22 bp, Homo sapiens
ccacatctaagccttcatgata

SEQ ID NO: 8124302 - DNA, 22 bp, Homo sapiens
ccaccatgggaagagagactaa

SEQ ID NO: 8124303 - DNA, 22 bp, Homo sapiens
ccacagaccttggcttccacct

SEQ ID NO: 8124304 - DNA, 19 bp, Homo sapiens
ccacagagactagaagaca

SEQ ID NO: 8124305 - DNA, 22 bp, Homo sapiens
ccacagagagtgtcagcctttg

SEQ ID NO: 8124306 - DNA, 19 bp, Homo sapiens
ccacagagcatgctgaggc

SEQ ID NO: 8124307 - DNA, 22 bp, Homo sapiens
cattggtcttctaacagagaga

SEQ ID NO: 8124308 - DNA, 22 bp, Homo sapiens
aggcaagattaggaccagaaga

SEQ ID NO: 8124309 - DNA, 22 bp, Homo sapiens
aggcaatcccctgaggatactt

SEQ ID NO: 8124310 - DNA, 22 bp, Homo sapiens
aggcaaggtgctacagacagtg

SEQ ID NO: 8124311 - DNA, 22 bp, Homo sapiens
cagtccaggcctggaggagcca

SEQ ID NO: 8124312 - DNA, 22 bp, Homo sapiens
cagtccagccagtagggtgtgg

SEQ ID NO: 8124313 - DNA, 22 bp, Homo sapiens
aggagccagaatccagactcgg

SEQ ID NO: 8124314 - DNA, 22 bp, Homo sapiens
aggaggcctctatccagagaga

SEQ ID NO: 8124315 - DNA, 22 bp, Homo sapiens
aggagctgtgaatgggaggggt

SEQ ID NO: 8124316 - DNA, 22 bp, Homo sapiens
cataacattaagcctctatttc

SEQ ID NO: 8124317 - DNA, 22 bp, Homo sapiens
cataacatgtacatataaatgc

SEQ ID NO: 8124318 - DNA, 22 bp, Homo sapiens
cataacatgtacatataaatgc

SEQ ID NO: 8124319 - DNA, 22 bp, Homo sapiens
cagttttattggttgaaatctg

SEQ ID NO: 8124320 - DNA, 22 bp, Homo sapiens
aggatgagagatacatggagca

SEQ ID NO: 8124321 - DNA, 22 bp, Homo sapiens
catcttgagacatgaaaggtgt

SEQ ID NO: 8124322 - DNA, 22 bp, Homo sapiens
catcttgatgctttgacaggtt

SEQ ID NO: 8124323 - DNA, 22 bp, Homo sapiens
catcttgaaggtttctttagct

SEQ ID NO: 8124324 - DNA, 20 bp, Homo sapiens
catcttgaaggtcttccaca

SEQ ID NO: 8124325 - DNA, 22 bp, Homo sapiens
catgagatctgcagggatgggc

SEQ ID NO: 8124326 - DNA, 22 bp, Homo sapiens
catgaggatccaggtgacaggc

SEQ ID NO: 8124327 - DNA, 22 bp, Homo sapiens
catgagggttggggtggagctt

SEQ ID NO: 8124328 - DNA, 22 bp, Homo sapiens
catgagggttggggtggagctt

SEQ ID NO: 8124329 - DNA, 22 bp, Homo sapiens
catctctccacggcagctctcg

SEQ ID NO: 8124330 - DNA, 22 bp, Homo sapiens
catctcttcattagcattattg

SEQ ID NO: 8124331 - DNA, 22 bp, Homo sapiens
catacatatgtggatgtcatat

SEQ ID NO: 8124332 - DNA, 22 bp, Homo sapiens
catctcctttggtctacttcca

SEQ ID NO: 8124333 - DNA, 22 bp, Homo sapiens
atattatagacagagtcttctg

SEQ ID NO: 8124334 - DNA, 22 bp, Homo sapiens
atattataagttatttcaagtt

SEQ ID NO: 8124335 - DNA, 22 bp, Homo sapiens
atattacataaacatgagtgaa

SEQ ID NO: 8124336 - DNA, 20 bp, Homo sapiens
ctgggctcaagtgatcctcc

SEQ ID NO: 8124337 - DNA, 22 bp, Homo sapiens
ctggctgtggattatcacaggc

SEQ ID NO: 8124338 - DNA, 19 bp, Homo sapiens
ctggcttcaagcagtcctc

SEQ ID NO: 8124339 - DNA, 22 bp, Homo sapiens
ctggcttcagctgccatcaatg

SEQ ID NO: 8124340 - DNA, 22 bp, Homo sapiens
ctggcttccatgctgtagtggc

SEQ ID NO: 8124341 - DNA, 22 bp, Homo sapiens
ctggcttcctgagtccattacc

SEQ ID NO: 8124342 - DNA, 20 bp, Homo sapiens
atcaaaggctgattcagtcc

SEQ ID NO: 8124343 - DNA, 22 bp, Homo sapiens
atcaaagaatgtgactgaaata

SEQ ID NO: 8124344 - DNA, 22 bp, Homo sapiens
atcaaagagcttgacaatccta

SEQ ID NO: 8124345 - DNA, 19 bp, Homo sapiens
atcaaagactgcaggattt

SEQ ID NO: 8124346 - DNA, 22 bp, Homo sapiens
atattcttgtgattataaagta

SEQ ID NO: 8124347 - DNA, 22 bp, Homo sapiens
atattgatcttggaactgattt

SEQ ID NO: 8124348 - DNA, 22 bp, Homo sapiens
atcagaagaaatggatgtgact

SEQ ID NO: 8124349 - DNA, 22 bp, Homo sapiens
cttcttaatgcataaactgtgt

SEQ ID NO: 8124350 - DNA, 22 bp, Homo sapiens
atctgaagggaagtggaaggca

SEQ ID NO: 8124351 - DNA, 19 bp, Homo sapiens
atctgaagtaggtgcagct

SEQ ID NO: 8124352 - DNA, 21 bp, Homo sapiens
atctgaaaggttagtgttgag

SEQ ID NO: 8124353 - DNA, 21 bp, Homo sapiens
atctgaaatgtcaaagcagat

SEQ ID NO: 8124354 - DNA, 22 bp, Homo sapiens
cttcctcccggcccatgctctg

SEQ ID NO: 8124355 - DNA, 22 bp, Homo sapiens
cttcctctagcctagtaatgcc

SEQ ID NO: 8124356 - DNA, 22 bp, Homo sapiens
cttcctcccggcccatgctctg

SEQ ID NO: 8124357 - DNA, 22 bp, Homo sapiens
cttcctcatgtgcaatgcaagc

SEQ ID NO: 8124358 - DNA, 22 bp, Homo sapiens
cttcctcccccacacactcact

SEQ ID NO: 8124359 - DNA, 18 bp, Homo sapiens
cttcctcatcgctctccc

SEQ ID NO: 8124360 - DNA, 18 bp, Homo sapiens
cttcctcatcgctctccc

SEQ ID NO: 8124361 - DNA, 18 bp, Homo sapiens
cttcctcatcgctctccc

SEQ ID NO: 8124362 - DNA, 22 bp, Homo sapiens
cttcctcaggcattagctggac

SEQ ID NO: 8124363 - DNA, 22 bp, Homo sapiens
cttcctcacggtgcaacaggaa

SEQ ID NO: 8124364 - DNA, 22 bp, Homo sapiens
cttcctagagccggcagtgagg

SEQ ID NO: 8124365 - DNA, 22 bp, Homo sapiens
cttcctagagccggcagtgagg

SEQ ID NO: 8124366 - DNA, 22 bp, Homo sapiens
cttcccacagaattcaatcagt

SEQ ID NO: 8124367 - DNA, 19 bp, Homo sapiens
ctgtggcctccaggaggga

SEQ ID NO: 8124368 - DNA, 22 bp, Homo sapiens
ctgtggctcaaaatcccatgat

SEQ ID NO: 8124369 - DNA, 22 bp, Homo sapiens
ctgtgggagaagctagcacagg

SEQ ID NO: 8124370 - DNA, 22 bp, Homo sapiens
atccagggtgtggagagagctc

SEQ ID NO: 8124371 - DNA, 22 bp, Homo sapiens
atccactcggagggaatgttta

SEQ ID NO: 8124372 - DNA, 22 bp, Homo sapiens
atccactcctggaggtgcccca

SEQ ID NO: 8124373 - DNA, 22 bp, Homo sapiens
atccactccctaacaccatgtt

SEQ ID NO: 8124374 - DNA, 22 bp, Homo sapiens
atccagggataaaagtaaggtt

SEQ ID NO: 8124375 - DNA, 22 bp, Homo sapiens
atagattagccctatagtttta

SEQ ID NO: 8124376 - DNA, 22 bp, Homo sapiens
atagattatttgctcattactt

SEQ ID NO: 8124377 - DNA, 22 bp, Homo sapiens
atagcaaaaatgaacaaagctt

SEQ ID NO: 8124378 - DNA, 22 bp, Homo sapiens
atagcaaaaatgaacaaagctt

SEQ ID NO: 8124379 - DNA, 22 bp, Homo sapiens
atactatattaccttctcaact

SEQ ID NO: 8124380 - DNA, 22 bp, Homo sapiens
ctggccccaggcagcctgctgg

SEQ ID NO: 8124381 - DNA, 22 bp, Homo sapiens
ctggccccagagtttcacttgg

SEQ ID NO: 8124382 - DNA, 22 bp, Homo sapiens
ctggcccccacacctgtcaggg

SEQ ID NO: 8124383 - DNA, 22 bp, Homo sapiens
ctggcccctgtggctaaaatca

SEQ ID NO: 8124384 - DNA, 22 bp, Homo sapiens
ctggccccggttcctaaaaacc

SEQ ID NO: 8124385 - DNA, 22 bp, Homo sapiens
ctggccccatctggagtctgag

SEQ ID NO: 8124386 - DNA, 22 bp, Homo sapiens
atagcaaaggacaatagtcagt

SEQ ID NO: 8124387 - DNA, 22 bp, Homo sapiens
atagcaaagcctggcacaatga

SEQ ID NO: 8124388 - DNA, 22 bp, Homo sapiens
atagcaaagcctggcacaatga

SEQ ID NO: 8124389 - DNA, 22 bp, Homo sapiens
atagcaaaggacaatagtcagt

SEQ ID NO: 8124390 - DNA, 22 bp, Homo sapiens
atagcaaaagcatgtgcaatac

SEQ ID NO: 8124391 - DNA, 22 bp, Homo sapiens
atagcaaaagcatgtgcaatac

SEQ ID NO: 8124392 - DNA, 22 bp, Homo sapiens
atagcaaactggagcttgcttt

SEQ ID NO: 8124393 - DNA, 22 bp, Homo sapiens
atagcaattaagctccagaatt

SEQ ID NO: 8124394 - DNA, 22 bp, Homo sapiens
ctggctcccggggatcgagcac

SEQ ID NO: 8124395 - DNA, 22 bp, Homo sapiens
ctggctcccgtctggtggccat

SEQ ID NO: 8124396 - DNA, 22 bp, Homo sapiens
ctggctccatctttgcttcctg

SEQ ID NO: 8124397 - DNA, 22 bp, Homo sapiens
ctggctcacaggtgagatgcat

SEQ ID NO: 8124398 - DNA, 22 bp, Homo sapiens
ctggaatgtctgctcaatgttt

SEQ ID NO: 8124399 - DNA, 22 bp, Homo sapiens
ctggaataaacgatcttcagca

SEQ ID NO: 8124400 - DNA, 22 bp, Homo sapiens
ctggaatgagcagggcttatgg

SEQ ID NO: 8124401 - DNA, 22 bp, Homo sapiens
ctggaatgagagcccggggatc

SEQ ID NO: 8124402 - DNA, 22 bp, Homo sapiens
ctggaatatttgtaggatgaaa

SEQ ID NO: 8124403 - DNA, 22 bp, Homo sapiens
ctggaatgggaatcaggaaaga

SEQ ID NO: 8124404 - DNA, 22 bp, Homo sapiens
ctggaatgcggagagttggaga

SEQ ID NO: 8124405 - DNA, 22 bp, Homo sapiens
ctggaatgtatgggaacccaaa

SEQ ID NO: 8124406 - DNA, 22 bp, Homo sapiens
ctggaatgggtttcaggcactg

SEQ ID NO: 8124407 - DNA, 21 bp, Homo sapiens
ataccatttgccaaaaggatc

SEQ ID NO: 8124408 - DNA, 22 bp, Homo sapiens
ataccatttatcaagtacagtg

SEQ ID NO: 8124409 - DNA, 22 bp, Homo sapiens
ataccatttccatgttacatta

SEQ ID NO: 8124410 - DNA, 22 bp, Homo sapiens
atacctgtgtatccacaagcgt

SEQ ID NO: 8124411 - DNA, 22 bp, Homo sapiens
ataccacaacatggctcagagg

SEQ ID NO: 8124412 - DNA, 22 bp, Homo sapiens
atacatacatgtatgcacatac

SEQ ID NO: 8124413 - DNA, 22 bp, Homo sapiens
ctgcaagcaaatcaactctttg

SEQ ID NO: 8124414 - DNA, 22 bp, Homo sapiens
ctgcaagctggtaataagcaga

SEQ ID NO: 8124415 - DNA, 22 bp, Homo sapiens
ctgcaagctggtaataagcaga

SEQ ID NO: 8124416 - DNA, 22 bp, Homo sapiens
ctgcaagccagggagagatgcc

SEQ ID NO: 8124417 - DNA, 22 bp, Homo sapiens
ctgcaagccagggagagatgcc

SEQ ID NO: 8124418 - DNA, 22 bp, Homo sapiens
ctgcaagccaagctgagagcct

SEQ ID NO: 8124419 - DNA, 22 bp, Homo sapiens
ctgcaaatcaagttcttataat

SEQ ID NO: 8124420 - DNA, 22 bp, Homo sapiens
ctgcaaataggggtgtgaataa

SEQ ID NO: 8124421 - DNA, 22 bp, Homo sapiens
ctgatatttgcccaactgccct

SEQ ID NO: 8124422 - DNA, 22 bp, Homo sapiens
agttatttaaaatgattgtcct

SEQ ID NO: 8124423 - DNA, 22 bp, Homo sapiens
agttatttactcctttgtctct

SEQ ID NO: 8124424 - DNA, 20 bp, Homo sapiens
ctgcagggttagaggctcca

SEQ ID NO: 8124425 - DNA, 22 bp, Homo sapiens
ctgcagggtttcgccagttgtg

SEQ ID NO: 8124426 - DNA, 22 bp, Homo sapiens
ctgcatcctggaaatagctaag

SEQ ID NO: 8124427 - DNA, 22 bp, Homo sapiens
ctgcatcctaacctccatgcag

SEQ ID NO: 8124428 - DNA, 22 bp, Homo sapiens
ctgcatcccagggagcaatggg

SEQ ID NO: 8124429 - DNA, 22 bp, Homo sapiens
ctgcatccatgttgctgcaaag

SEQ ID NO: 8124430 - DNA, 22 bp, Homo sapiens
ctgcagggagaggggacagcct

SEQ ID NO: 8124431 - DNA, 22 bp, Homo sapiens
ctgcagagatgaagaaggtggc

SEQ ID NO: 8124432 - DNA, 22 bp, Homo sapiens
ctgcagagatgaagaaggtggc

SEQ ID NO: 8124433 - DNA, 22 bp, Homo sapiens
ctgcagagacctaggtcaggtt

SEQ ID NO: 8124434 - DNA, 22 bp, Homo sapiens
ctgcagagaattgtggggcttc

SEQ ID NO: 8124435 - DNA, 23 bp, Homo sapiens
ctgcagagaactgagggacagcc

SEQ ID NO: 8124436 - DNA, 22 bp, Homo sapiens
ctgcctctgcgtcccacagagt

SEQ ID NO: 8124437 - DNA, 22 bp, Homo sapiens
ctgcctctccccagagtggccc

SEQ ID NO: 8124438 - DNA, 22 bp, Homo sapiens
ctgcctctattcactgaggcag

SEQ ID NO: 8124439 - DNA, 22 bp, Homo sapiens
ctgcctctcagcctgaccgcca

SEQ ID NO: 8124440 - DNA, 22 bp, Homo sapiens
ctgcctctcaggtccctgagat

SEQ ID NO: 8124441 - DNA, 22 bp, Homo sapiens
ctgcctctcaggtccctgagat

SEQ ID NO: 8124442 - DNA, 22 bp, Homo sapiens
ctgcctctcagcctgaccgcca

SEQ ID NO: 8124443 - DNA, 22 bp, Homo sapiens
ataagaataattaagttagtcc

SEQ ID NO: 8124444 - DNA, 22 bp, Homo sapiens
atacaaagctaaatatggtttc

SEQ ID NO: 8124445 - DNA, 22 bp, Homo sapiens
atacaaatttatagatgcattt

SEQ ID NO: 8124446 - DNA, 22 bp, Homo sapiens
ctgctgatcgaatcagtcaccc

SEQ ID NO: 8124447 - DNA, 22 bp, Homo sapiens
ctgctgatcagggcaaagcaaa

SEQ ID NO: 8124448 - DNA, 22 bp, Homo sapiens
ctgctgatgacctcaaactctt

SEQ ID NO: 8124449 - DNA, 22 bp, Homo sapiens
ctgctgatgtaagccatgctct

SEQ ID NO: 8124450 - DNA, 22 bp, Homo sapiens
ctgctgcaactctttagagggt

SEQ ID NO: 8124451 - DNA, 22 bp, Homo sapiens
ctgctgaggggaggaaagacgg

SEQ ID NO: 8124452 - DNA, 22 bp, Homo sapiens
ctgagcagcaacccagagcctc

SEQ ID NO: 8124453 - DNA, 22 bp, Homo sapiens
ctgagcagcacagggcgccagg

SEQ ID NO: 8124454 - DNA, 22 bp, Homo sapiens
ctgagcagccccaccagccatt

SEQ ID NO: 8124455 - DNA, 22 bp, Homo sapiens
agttacttgagacgtttatgaa

SEQ ID NO: 8124456 - DNA, 22 bp, Homo sapiens
ctgaaatatatactgggaaaaa

SEQ ID NO: 8124457 - DNA, 17 bp, Homo sapiens
ctgaaatattatgataa

SEQ ID NO: 8124458 - DNA, 22 bp, Homo sapiens
ctgaaatattttaatctcagga

SEQ ID NO: 8124459 - DNA, 22 bp, Homo sapiens
ctctggggaagcagccagctgg

SEQ ID NO: 8124460 - DNA, 22 bp, Homo sapiens
ctctgctcaccagccatgtgat

SEQ ID NO: 8124461 - DNA, 22 bp, Homo sapiens
ctctgcctgtgtcgccaccaca

SEQ ID NO: 8124462 - DNA, 22 bp, Homo sapiens
ctctgcctgtctcatcctgcaa

SEQ ID NO: 8124463 - DNA, 22 bp, Homo sapiens
ctctgcctgccactgttcaggc

SEQ ID NO: 8124464 - DNA, 22 bp, Homo sapiens
ctctgcaggcacccagggtggg

SEQ ID NO: 8124465 - DNA, 22 bp, Homo sapiens
ctctgcaggcacccagggtggg

SEQ ID NO: 8124466 - DNA, 22 bp, Homo sapiens
ctctgcaggggaggcatgcact

SEQ ID NO: 8124467 - DNA, 21 bp, Homo sapiens
ctctgcagtgcccaccttgcc

SEQ ID NO: 8124468 - DNA, 20 bp, Homo sapiens
ctctgcagcaaggcctgggt

SEQ ID NO: 8124469 - DNA, 22 bp, Homo sapiens
ctctcaggcttgggtcgtggca

SEQ ID NO: 8124470 - DNA, 19 bp, Homo sapiens
ctctcagcctgtctccttg

SEQ ID NO: 8124471 - DNA, 22 bp, Homo sapiens
ctctcagggtccctgcggagga

SEQ ID NO: 8124472 - DNA, 22 bp, Homo sapiens
ctccaggaaaatagggaatgag

SEQ ID NO: 8124473 - DNA, 22 bp, Homo sapiens
ctccagctgagtaagaacacta

SEQ ID NO: 8124474 - DNA, 22 bp, Homo sapiens
ctccagcttccctcagctgtgg

SEQ ID NO: 8124475 - DNA, 22 bp, Homo sapiens
ctcattgcagctgcattactgt

SEQ ID NO: 8124476 - DNA, 22 bp, Homo sapiens
ctcattgcagttaatgagatgt

SEQ ID NO: 8124477 - DNA, 22 bp, Homo sapiens
ctcatggcagagtcacctgtcc

SEQ ID NO: 8124478 - DNA, 22 bp, Homo sapiens
ctcctgggaatttagttgtgag

SEQ ID NO: 8124479 - DNA, 22 bp, Homo sapiens
agtggcagagtgcactcaggca

SEQ ID NO: 8124480 - DNA, 22 bp, Homo sapiens
agtggcagaggttgactgcagt

SEQ ID NO: 8124481 - DNA, 19 bp, Homo sapiens
agtggcagatctggaagta

SEQ ID NO: 8124482 - DNA, 22 bp, Homo sapiens
agtggcagatctctggtctgga

SEQ ID NO: 8124483 - DNA, 22 bp, Homo sapiens
ctctcagaagtttatgtcagaa

SEQ ID NO: 8124484 - DNA, 22 bp, Homo sapiens
ctccctcaggccttagccctgc

SEQ ID NO: 8124485 - DNA, 22 bp, Homo sapiens
ctccctccaaataagactcggg

SEQ ID NO: 8124486 - DNA, 22 bp, Homo sapiens
ctccctctcaccggagccctgg

SEQ ID NO: 8124487 - DNA, 22 bp, Homo sapiens
ctcctcagaagagggtaacaca

SEQ ID NO: 8124488 - DNA, 22 bp, Homo sapiens
ctcctggctctgccacttacta

SEQ ID NO: 8124489 - DNA, 22 bp, Homo sapiens
ctcctcacacccactgcaacca

SEQ ID NO: 8124490 - DNA, 22 bp, Homo sapiens
ctcctagatgtcttcagagaaa

SEQ ID NO: 8124491 - DNA, 23 bp, Homo sapiens
cctgcagctgccacgccctgctc

SEQ ID NO: 8124492 - DNA, 18 bp, Homo sapiens
cctgcagcccaggaggcc

SEQ ID NO: 8124493 - DNA, 22 bp, Homo sapiens
cctgcagatgtgggacagctgt

SEQ ID NO: 8124494 - DNA, 22 bp, Homo sapiens
cctgcagaggtcaggccagaaa

SEQ ID NO: 8124495 - DNA, 22 bp, Homo sapiens
cctgcagagtccctttgttcag

SEQ ID NO: 8124496 - DNA, 22 bp, Homo sapiens
cctgcagaccacactcagtcct

SEQ ID NO: 8124497 - DNA, 22 bp, Homo sapiens
cctgcagaccacactcagtcct

SEQ ID NO: 8124498 - DNA, 22 bp, Homo sapiens
cctgcagagcaggagaggcatc

SEQ ID NO: 8124499 - DNA, 22 bp, Homo sapiens
cctgcagagccacgtgccagcg

SEQ ID NO: 8124500 - DNA, 22 bp, Homo sapiens
cctgcagagggagggccttatt

SEQ ID NO: 8124501 - DNA, 22 bp, Homo sapiens
cctgcagagggactggcaggaa

SEQ ID NO: 8124502 - DNA, 22 bp, Homo sapiens
cctgccagctgtgggccagcct

SEQ ID NO: 8124503 - DNA, 22 bp, Homo sapiens
aggtaggagttgatggatgttc

SEQ ID NO: 8124504 - DNA, 21 bp, Homo sapiens
aggtacaggtcttgtgagtct

SEQ ID NO: 8124505 - DNA, 22 bp, Homo sapiens
aggtacaggaggttggggctac

SEQ ID NO: 8124506 - DNA, 22 bp, Homo sapiens
aggtaggatagataggaagacc

SEQ ID NO: 8124507 - DNA, 22 bp, Homo sapiens
aggtccctgcagcagactgcca

SEQ ID NO: 8124508 - DNA, 22 bp, Homo sapiens
cctggaggtggaggttgcagtg

SEQ ID NO: 8124509 - DNA, 22 bp, Homo sapiens
aggtagtgtagctgagtgggat

SEQ ID NO: 8124510 - DNA, 22 bp, Homo sapiens
cctggctctgcgtgcagctccg

SEQ ID NO: 8124511 - DNA, 22 bp, Homo sapiens
cctgtcagttgctgtcagggat

SEQ ID NO: 8124512 - DNA, 22 bp, Homo sapiens
cctgtgagtcaacccctccttg

SEQ ID NO: 8124513 - DNA, 22 bp, Homo sapiens
cctgtgcatccggtggtcattg

SEQ ID NO: 8124514 - DNA, 22 bp, Homo sapiens
cctgtgcagcccttgccagttt

SEQ ID NO: 8124515 - DNA, 20 bp, Homo sapiens
cctgtccaagctccacccca

SEQ ID NO: 8124516 - DNA, 22 bp, Homo sapiens
cctgtcccctcacaatgccact

SEQ ID NO: 8124517 - DNA, 22 bp, Homo sapiens
agtccaccggcagagatgctga

SEQ ID NO: 8124518 - DNA, 22 bp, Homo sapiens
agtccagtcggcctggagaaat

SEQ ID NO: 8124519 - DNA, 22 bp, Homo sapiens
agtattctggaattctatgtga

SEQ ID NO: 8124520 - DNA, 22 bp, Homo sapiens
agtattctggtttttcaggtgg

SEQ ID NO: 8124521 - DNA, 22 bp, Homo sapiens
agtatttagcatagtggttagt

SEQ ID NO: 8124522 - DNA, 22 bp, Homo sapiens
ctacatttgttcaaataagctg

SEQ ID NO: 8124523 - DNA, 22 bp, Homo sapiens
cgcaggggaggaaggtacacct

SEQ ID NO: 8124524 - DNA, 22 bp, Homo sapiens
agtacagatttagacacgatag

SEQ ID NO: 8124525 - DNA, 22 bp, Homo sapiens
agtacaagtagaatgctacaag

SEQ ID NO: 8124526 - DNA, 22 bp, Homo sapiens
cgggcgcactccgggcagctgt

SEQ ID NO: 8124527 - DNA, 22 bp, Homo sapiens
cgggcagcggcgtggccatggt

SEQ ID NO: 8124528 - DNA, 17 bp, Homo sapiens
cgggcatggagggcagg

SEQ ID NO: 8124529 - DNA, 22 bp, Homo sapiens
ggtctggaagcgtcccaaaggt

SEQ ID NO: 8124530 - DNA, 22 bp, Homo sapiens
ggtctggaagcgcagtaggctg

SEQ ID NO: 8124531 - DNA, 22 bp, Homo sapiens
ggtctggaacccctcaagtgac

SEQ ID NO: 8124532 - DNA, 22 bp, Homo sapiens
ggtctggaacgaggtctaagcc

SEQ ID NO: 8124533 - DNA, 22 bp, Homo sapiens
ggtctgagcttgagcccatgct

SEQ ID NO: 8124534 - DNA, 22 bp, Homo sapiens
ggtgactggagggacccaggcc

SEQ ID NO: 8124535 - DNA, 22 bp, Homo sapiens
ggtgctgcctatagtctgaaac

SEQ ID NO: 8124536 - DNA, 22 bp, Homo sapiens
cagagggaaaaggggagtaata

SEQ ID NO: 8124537 - DNA, 22 bp, Homo sapiens
cagagggctgtgtaaggatgtt

SEQ ID NO: 8124538 - DNA, 22 bp, Homo sapiens
ggggagagtcctttccagttcc

SEQ ID NO: 8124539 - DNA, 22 bp, Homo sapiens
ggggagagtattttattcaagt

SEQ ID NO: 8124540 - DNA, 22 bp, Homo sapiens
cagagtctgcgagcagaggggc

SEQ ID NO: 8124541 - DNA, 22 bp, Homo sapiens
cagagtccaattgctcagagcg

SEQ ID NO: 8124542 - DNA, 22 bp, Homo sapiens
gggctgaaaggccgcctcagat

SEQ ID NO: 8124543 - DNA, 22 bp, Homo sapiens
gggctgacaaccatctgacaag

SEQ ID NO: 8124544 - DNA, 22 bp, Homo sapiens
gggctgaccccacccctcactc

SEQ ID NO: 8124545 - DNA, 17 bp, Homo sapiens
gggctgacagtggcctc

SEQ ID NO: 8124546 - DNA, 22 bp, Homo sapiens
gggctgacaccacccaggcgca

SEQ ID NO: 8124547 - DNA, 22 bp, Homo sapiens
gggctgactcaaccttgcaaag

SEQ ID NO: 8124548 - DNA, 22 bp, Homo sapiens
gggctgagaagttgatcccaag

SEQ ID NO: 8124549 - DNA, 22 bp, Homo sapiens
gggccacggaaggaccagtggg

SEQ ID NO: 8124550 - DNA, 22 bp, Homo sapiens
gggccagagcacagaggatgtt

SEQ ID NO: 8124551 - DNA, 22 bp, Homo sapiens
gggctgagtgggcctcttactt

SEQ ID NO: 8124552 - DNA, 22 bp, Homo sapiens
gggctgagtctgctgcctgtca

SEQ ID NO: 8124553 - DNA, 22 bp, Homo sapiens
gggctgagtgacctcaggccaa

SEQ ID NO: 8124554 - DNA, 22 bp, Homo sapiens
gggctgaggggtatctcatggg

SEQ ID NO: 8124555 - DNA, 22 bp, Homo sapiens
gggctgagtcatctggggcctc

SEQ ID NO: 8124556 - DNA, 22 bp, Homo sapiens
cagagctgggatcccatgggcg

SEQ ID NO: 8124557 - DNA, 22 bp, Homo sapiens
cagagctggctctgcatgtaca

SEQ ID NO: 8124558 - DNA, 22 bp, Homo sapiens
cagagctgggatcccatgggcg

SEQ ID NO: 8124559 - DNA, 22 bp, Homo sapiens
cagagctgggtttgggaaacct

SEQ ID NO: 8124560 - DNA, 22 bp, Homo sapiens
cagagctggggactgttggatg

SEQ ID NO: 8124561 - DNA, 22 bp, Homo sapiens
cagagctggctctgcatgtaca

SEQ ID NO: 8124562 - DNA, 22 bp, Homo sapiens
cagaccagtagggctcatccca

SEQ ID NO: 8124563 - DNA, 22 bp, Homo sapiens
cagaccagccatttgcctcttc

SEQ ID NO: 8124564 - DNA, 22 bp, Homo sapiens
cagacctcaaagctgcagtgct

SEQ ID NO: 8124565 - DNA, 22 bp, Homo sapiens
cagacctcaattatgtaagtaa

SEQ ID NO: 8124566 - DNA, 22 bp, Homo sapiens
cagacctcagtcctcagtagga

SEQ ID NO: 8124567 - DNA, 22 bp, Homo sapiens
cagacctctttttagcactccc

SEQ ID NO: 8124568 - DNA, 17 bp, Homo sapiens
cagacctctgtgaagcc

SEQ ID NO: 8124569 - DNA, 22 bp, Homo sapiens
cagacctctatggggtaaatct

SEQ ID NO: 8124570 - DNA, 22 bp, Homo sapiens
cagacgggtggtctgcgaggcc

SEQ ID NO: 8124571 - DNA, 22 bp, Homo sapiens
gggcagagaaatggacagttgg

SEQ ID NO: 8124572 - DNA, 22 bp, Homo sapiens
cagagacaggatctcgaagact

SEQ ID NO: 8124573 - DNA, 22 bp, Homo sapiens
cagagacaggaatcagctgcag

SEQ ID NO: 8124574 - DNA, 22 bp, Homo sapiens
gggcagtggttacacagctgag

SEQ ID NO: 8124575 - DNA, 22 bp, Homo sapiens
gggcagtgggtggctgcagcct

SEQ ID NO: 8124576 - DNA, 22 bp, Homo sapiens
cagagacagcctgggagggaca

SEQ ID NO: 8124577 - DNA, 22 bp, Homo sapiens
gtgcccagtaaatgaaagcttt

SEQ ID NO: 8124578 - DNA, 22 bp, Homo sapiens
gtgcccagtgcaggcccgcagg

SEQ ID NO: 8124579 - DNA, 22 bp, Homo sapiens
cagctattctctgaaatgaata

SEQ ID NO: 8124580 - DNA, 22 bp, Homo sapiens
gtgcccagtaaatgaaagcttt

SEQ ID NO: 8124581 - DNA, 22 bp, Homo sapiens
cagccctgccatggagcctcct

SEQ ID NO: 8124582 - DNA, 22 bp, Homo sapiens
cagccctgcagccatggcctgt

SEQ ID NO: 8124583 - DNA, 22 bp, Homo sapiens
cagccctgaaacaacctcctct

SEQ ID NO: 8124584 - DNA, 22 bp, Homo sapiens
cagccctgcttccccgctagtt

SEQ ID NO: 8124585 - DNA, 22 bp, Homo sapiens
cagccctgctggcaatgatgag

SEQ ID NO: 8124586 - DNA, 22 bp, Homo sapiens
cagccctgctcttagtgtctcc

SEQ ID NO: 8124587 - DNA, 22 bp, Homo sapiens
cagccctgctcttagtgtctcc

SEQ ID NO: 8124588 - DNA, 22 bp, Homo sapiens
cagccctgctgacactgtctga

SEQ ID NO: 8124589 - DNA, 22 bp, Homo sapiens
cagccctgctgacactgtctga

SEQ ID NO: 8124590 - DNA, 23 bp, Homo sapiens
cagccctggagatgtgggaggca

SEQ ID NO: 8124591 - DNA, 22 bp, Homo sapiens
cagccctggaacagctgactca

SEQ ID NO: 8124592 - DNA, 22 bp, Homo sapiens
cagcctctttccacatcaggca

SEQ ID NO: 8124593 - DNA, 22 bp, Homo sapiens
cagcctgactatggctgcaggt

SEQ ID NO: 8124594 - DNA, 22 bp, Homo sapiens
gtgcccagttgaggccaggact

SEQ ID NO: 8124595 - DNA, 22 bp, Homo sapiens
gtgccctcatgaaacgaaggat

SEQ ID NO: 8124596 - DNA, 22 bp, Homo sapiens
gtgccctcacaaagtggaaaga

SEQ ID NO: 8124597 - DNA, 22 bp, Homo sapiens
gtgccctcctgaagccatcaca

SEQ ID NO: 8124598 - DNA, 22 bp, Homo sapiens
gtgccctcctgaagccatcaca

SEQ ID NO: 8124599 - DNA, 22 bp, Homo sapiens
gtgctgagtagaatgaatgcct

SEQ ID NO: 8124600 - DNA, 22 bp, Homo sapiens
gtctcttttatggtgagttgat

SEQ ID NO: 8124601 - DNA, 22 bp, Homo sapiens
gtccctggggaatcagctggag

SEQ ID NO: 8124602 - DNA, 22 bp, Homo sapiens
gtcccaggctccatggcagcca

SEQ ID NO: 8124603 - DNA, 22 bp, Homo sapiens
gtctggagacttgggtcatcaa

SEQ ID NO: 8124604 - DNA, 22 bp, Homo sapiens
gtctggagagctgagcagagtt

SEQ ID NO: 8124605 - DNA, 22 bp, Homo sapiens
gtctggagccaccctaagcatt

SEQ ID NO: 8124606 - DNA, 22 bp, Homo sapiens
gtctggagccactgctgctgct

SEQ ID NO: 8124607 - DNA, 22 bp, Homo sapiens
gtctggagccccagtcaatgag

SEQ ID NO: 8124608 - DNA, 22 bp, Homo sapiens
gtctggaagctctaggggagaa

SEQ ID NO: 8124609 - DNA, 22 bp, Homo sapiens
gtctggaaggaggagatggagc

SEQ ID NO: 8124610 - DNA, 22 bp, Homo sapiens
gtctggaagaactagggatgtt

SEQ ID NO: 8124611 - DNA, 22 bp, Homo sapiens
gtctggaagagcaggaataaac

SEQ ID NO: 8124612 - DNA, 22 bp, Homo sapiens
gtctggaatatagcaagctctt

SEQ ID NO: 8124613 - DNA, 22 bp, Homo sapiens
gtctggaagtgtcttgttaagt

SEQ ID NO: 8124614 - DNA, 22 bp, Homo sapiens
gtctggaagggagtgcattttc

SEQ ID NO: 8124615 - DNA, 22 bp, Homo sapiens
gtctggaaatattgacttcaga

SEQ ID NO: 8124616 - DNA, 22 bp, Homo sapiens
gtctggaaattaagaggaggtt

SEQ ID NO: 8124617 - DNA, 22 bp, Homo sapiens
gtctggaaattcaatttaatgc

SEQ ID NO: 8124618 - DNA, 22 bp, Homo sapiens
gtctggaaaggggcttttatct

SEQ ID NO: 8124619 - DNA, 22 bp, Homo sapiens
gtctggaaaggtatttgtctca

SEQ ID NO: 8124620 - DNA, 22 bp, Homo sapiens
gtctggaaagagctgaggttca

SEQ ID NO: 8124621 - DNA, 22 bp, Homo sapiens
gtctggaaccaatatttgaggg

SEQ ID NO: 8124622 - DNA, 22 bp, Homo sapiens
gtctggaagaacctgtgccagt

SEQ ID NO: 8124623 - DNA, 22 bp, Homo sapiens
gtctggaagaactagggatgtt

SEQ ID NO: 8124624 - DNA, 22 bp, Homo sapiens
gtctggaaccaagacgtgtagc

SEQ ID NO: 8124625 - DNA, 22 bp, Homo sapiens
gtctggaaatttaaggtatgag

SEQ ID NO: 8124626 - DNA, 22 bp, Homo sapiens
cagccctcaaaccacttccagg

SEQ ID NO: 8124627 - DNA, 22 bp, Homo sapiens
cagccccatggtgtgctccagc

SEQ ID NO: 8124628 - DNA, 22 bp, Homo sapiens
cagcccaggccgacagttcctc

SEQ ID NO: 8124629 - DNA, 22 bp, Homo sapiens
cagccagggtcaggcagcttct

SEQ ID NO: 8124630 - DNA, 22 bp, Homo sapiens
gtctgtatttatgcaatgaggg

SEQ ID NO: 8124631 - DNA, 22 bp, Homo sapiens
gtctgtattcctgtcggcagcc

SEQ ID NO: 8124632 - DNA, 20 bp, Homo sapiens
cagcaggctatggggcaccc

SEQ ID NO: 8124633 - DNA, 22 bp, Homo sapiens
gtcccagaggctttggccacag

SEQ ID NO: 8124634 - DNA, 22 bp, Homo sapiens
cagcaggctctgagtggctgcc

SEQ ID NO: 8124635 - DNA, 22 bp, Homo sapiens
cagcagctgcctcagctgggga

SEQ ID NO: 8124636 - DNA, 22 bp, Homo sapiens
cagcagctacttggagcagcag

SEQ ID NO: 8124637 - DNA, 22 bp, Homo sapiens
cagcaggaaacttaaaggtaat

SEQ ID NO: 8124638 - DNA, 22 bp, Homo sapiens
cacagggaaccaaggctgggcc

SEQ ID NO: 8124639 - DNA, 22 bp, Homo sapiens
cacaggcttttttggctgatgt

SEQ ID NO: 8124640 - DNA, 22 bp, Homo sapiens
cacattcttggtcaccttgtgg

SEQ ID NO: 8124641 - DNA, 22 bp, Homo sapiens
ggcaggcagtgtggtgtgaaac

SEQ ID NO: 8124642 - DNA, 22 bp, Homo sapiens
ggcagggagagcatgctgataa

SEQ ID NO: 8124643 - DNA, 23 bp, Homo sapiens
ggccactgaattttctgcatctt

SEQ ID NO: 8124644 - DNA, 22 bp, Homo sapiens
ggcccttggagcctccacagtg

SEQ ID NO: 8124645 - DNA, 22 bp, Homo sapiens
ggccccagggattaggccaacc

SEQ ID NO: 8124646 - DNA, 22 bp, Homo sapiens
ggccacgtgacctctggctcct

SEQ ID NO: 8124647 - DNA, 20 bp, Homo sapiens
ggctgtcccgcggctgccgg

SEQ ID NO: 8124648 - DNA, 22 bp, Homo sapiens
ggctgtccttggccaaggcact

SEQ ID NO: 8124649 - DNA, 22 bp, Homo sapiens
ggcttaaaaggaaaatgagagt

SEQ ID NO: 8124650 - DNA, 22 bp, Homo sapiens
ggctgtgaaccctggcagtgtg

SEQ ID NO: 8124651 - DNA, 22 bp, Homo sapiens
cagaaatacccagcatttggag

SEQ ID NO: 8124652 - DNA, 22 bp, Homo sapiens
ggctgggaggatgacttgctac

SEQ ID NO: 8124653 - DNA, 22 bp, Homo sapiens
cactttggttcacctgagtttc

SEQ ID NO: 8124654 - DNA, 22 bp, Homo sapiens
cagaaacatgtataaagttgta

SEQ ID NO: 8124655 - DNA, 22 bp, Homo sapiens
ggctgccctcggggtcgcaggc

SEQ ID NO: 8124656 - DNA, 22 bp, Homo sapiens
ggctccagggtctctccttgtg

SEQ ID NO: 8124657 - DNA, 18 bp, Homo sapiens
ggctccagtcttcagtgg

SEQ ID NO: 8124658 - DNA, 22 bp, Homo sapiens
ggctccaggtgcatgccaggct

SEQ ID NO: 8124659 - DNA, 22 bp, Homo sapiens
ggctgagccccctctgcgtagg

SEQ ID NO: 8124660 - DNA, 22 bp, Homo sapiens
ggctgagcctggagcatctggt

SEQ ID NO: 8124661 - DNA, 22 bp, Homo sapiens
ggctgagcgtggctgccgtggg

SEQ ID NO: 8124662 - DNA, 22 bp, Homo sapiens
ggctgaggctcatgccatcttg

SEQ ID NO: 8124663 - DNA, 22 bp, Homo sapiens
ggcctgggctccgggagttact

SEQ ID NO: 8124664 - DNA, 22 bp, Homo sapiens
ggcctgaggccaccagcagccc

SEQ ID NO: 8124665 - DNA, 22 bp, Homo sapiens
ggcctgaggcgtcccagctgtg

SEQ ID NO: 8124666 - DNA, 22 bp, Homo sapiens
gctggaggatggactggaagaa

SEQ ID NO: 8124667 - DNA, 22 bp, Homo sapiens
gctggaggatcacttgagccca

SEQ ID NO: 8124668 - DNA, 22 bp, Homo sapiens
gctggaggaggaagtgtgaggg

SEQ ID NO: 8124669 - DNA, 22 bp, Homo sapiens
gctggagcttgagaggacaggg

SEQ ID NO: 8124670 - DNA, 22 bp, Homo sapiens
caagccagtcagctcagtagat

SEQ ID NO: 8124671 - DNA, 22 bp, Homo sapiens
caagccagctcctgccacagag

SEQ ID NO: 8124672 - DNA, 22 bp, Homo sapiens
caagcaggatgaagcccaggga

SEQ ID NO: 8124673 - DNA, 20 bp, Homo sapiens
caagggtttgcattggcttt

SEQ ID NO: 8124674 - DNA, 22 bp, Homo sapiens
caagggggcaggatcacacttg

SEQ ID NO: 8124675 - DNA, 22 bp, Homo sapiens
caagggaagaggacagggacct

SEQ ID NO: 8124676 - DNA, 22 bp, Homo sapiens
caagggggagatttagggtaat

SEQ ID NO: 8124677 - DNA, 19 bp, Homo sapiens
caagggtcatgacaggaac

SEQ ID NO: 8124678 - DNA, 22 bp, Homo sapiens
caagggtggtattgggagcata

SEQ ID NO: 8124679 - DNA, 22 bp, Homo sapiens
gctggaggcagttcagacacca

SEQ ID NO: 8124680 - DNA, 22 bp, Homo sapiens
gctggaggatggactggaagaa

SEQ ID NO: 8124681 - DNA, 22 bp, Homo sapiens
caagtactttgaaaagttgaat

SEQ ID NO: 8124682 - DNA, 22 bp, Homo sapiens
caagtacaaaatgatatttagt

SEQ ID NO: 8124683 - DNA, 22 bp, Homo sapiens
caagtaattctgcaagaaacca

SEQ ID NO: 8124684 - DNA, 22 bp, Homo sapiens
caagtaatggttttataatagt

SEQ ID NO: 8124685 - DNA, 20 bp, Homo sapiens
gctgttctgaagcagaaggc

SEQ ID NO: 8124686 - DNA, 22 bp, Homo sapiens
cacagaggtctgggcccagcag

SEQ ID NO: 8124687 - DNA, 22 bp, Homo sapiens
cacagaggtctgggcccagcag

SEQ ID NO: 8124688 - DNA, 23 bp, Homo sapiens
ggagcctccggtgtgtgagaggc

SEQ ID NO: 8124689 - DNA, 22 bp, Homo sapiens
ggagctgctcagagccagtccc

SEQ ID NO: 8124690 - DNA, 22 bp, Homo sapiens
ggagctgctttgatctgaagaa

SEQ ID NO: 8124691 - DNA, 23 bp, Homo sapiens
ggagctgctgttgggggagctgc

SEQ ID NO: 8124692 - DNA, 22 bp, Homo sapiens
cacaggcttgtcagcatgaggc

SEQ ID NO: 8124693 - DNA, 22 bp, Homo sapiens
cacaggcttgtcagcatgaggc

SEQ ID NO: 8124694 - DNA, 22 bp, Homo sapiens
cacaggctgggaagcctaggcc

SEQ ID NO: 8124695 - DNA, 22 bp, Homo sapiens
cacaggactcgactgcagacag

SEQ ID NO: 8124696 - DNA, 22 bp, Homo sapiens
cacaggaccaattcacattcca

SEQ ID NO: 8124697 - DNA, 22 bp, Homo sapiens
cacaggactcgactgcagacag

SEQ ID NO: 8124698 - DNA, 22 bp, Homo sapiens
cacagaactggttaatagcaga

SEQ ID NO: 8124699 - DNA, 20 bp, Homo sapiens
ggaaggggcaaagtgtgtga

SEQ ID NO: 8124700 - DNA, 22 bp, Homo sapiens
ggaaggggagctggaaagggta

SEQ ID NO: 8124701 - DNA, 22 bp, Homo sapiens
ggaaggggagctaaatctactg

SEQ ID NO: 8124702 - DNA, 22 bp, Homo sapiens
ggactgggccaggggttggact

SEQ ID NO: 8124703 - DNA, 17 bp, Homo sapiens
ggactgggcggggcagg

SEQ ID NO: 8124704 - DNA, 22 bp, Homo sapiens
ggactgggattctggatctgct

SEQ ID NO: 8124705 - DNA, 22 bp, Homo sapiens
cacagagaaaatgttggtgctt

SEQ ID NO: 8124706 - DNA, 22 bp, Homo sapiens
ggactgggagaatggaggcaag

SEQ ID NO: 8124707 - DNA, 22 bp, Homo sapiens
cacagaggaatgcatcagcaga

SEQ ID NO: 8124708 - DNA, 22 bp, Homo sapiens
cacagaggcatgaccctgccct

SEQ ID NO: 8124709 - DNA, 22 bp, Homo sapiens
cacagaggctcaaagccaggtg

SEQ ID NO: 8124710 - DNA, 22 bp, Homo sapiens
cacagaggagtgcacactctct

SEQ ID NO: 8124711 - DNA, 22 bp, Homo sapiens
cacagaggagtgcacactctct

SEQ ID NO: 8124712 - DNA, 22 bp, Homo sapiens
cacagaggatgcccaagcgatc

SEQ ID NO: 8124713 - DNA, 22 bp, Homo sapiens
atggagggtggtaagacagaga

SEQ ID NO: 8124714 - DNA, 22 bp, Homo sapiens
gagagtccaggtctgggtcctt

SEQ ID NO: 8124715 - DNA, 22 bp, Homo sapiens
atggagggtggtaagacagaga

SEQ ID NO: 8124716 - DNA, 21 bp, Homo sapiens
atggagggaccagggaagcag

SEQ ID NO: 8124717 - DNA, 21 bp, Homo sapiens
atggagggaccagggaagcag

SEQ ID NO: 8124718 - DNA, 22 bp, Homo sapiens
atggagggaaaagtggagagcc

SEQ ID NO: 8124719 - DNA, 22 bp, Homo sapiens
atggagggaaaagtggagagcc

SEQ ID NO: 8124720 - DNA, 22 bp, Homo sapiens
atggaggatgtgcagcatgggc

SEQ ID NO: 8124721 - DNA, 22 bp, Homo sapiens
gagagagaggtgctgccaggca

SEQ ID NO: 8124722 - DNA, 22 bp, Homo sapiens
atggctttcagatggtgaaaga

SEQ ID NO: 8124723 - DNA, 22 bp, Homo sapiens
atggctgtttagcttctctgct

SEQ ID NO: 8124724 - DNA, 22 bp, Homo sapiens
atggccagagaggccagcctgg

SEQ ID NO: 8124725 - DNA, 22 bp, Homo sapiens
atggccagagagagcacacctg

SEQ ID NO: 8124726 - DNA, 22 bp, Homo sapiens
atggcttatggtaaatatttct

SEQ ID NO: 8124727 - DNA, 22 bp, Homo sapiens
atgggaagtgttagaagatttt

SEQ ID NO: 8124728 - DNA, 22 bp, Homo sapiens
atgggaagtgttagaagatttt

SEQ ID NO: 8124729 - DNA, 22 bp, Homo sapiens
atgggaaggttttgagagcggg

SEQ ID NO: 8124730 - DNA, 22 bp, Homo sapiens
atgggagaaacatcatgaggca

SEQ ID NO: 8124731 - DNA, 20 bp, Homo sapiens
atgggctggttaggaagtgt

SEQ ID NO: 8124732 - DNA, 22 bp, Homo sapiens
atggggagagaagggctgagct

SEQ ID NO: 8124733 - DNA, 22 bp, Homo sapiens
atggggagagaagggctgagct

SEQ ID NO: 8124734 - DNA, 22 bp, Homo sapiens
atggggaagagccagtgagctg

SEQ ID NO: 8124735 - DNA, 22 bp, Homo sapiens
gaggagaagggcacggagaaaa

SEQ ID NO: 8124736 - DNA, 22 bp, Homo sapiens
gaggagaagctattggaaggac

SEQ ID NO: 8124737 - DNA, 22 bp, Homo sapiens
atggtcttgggcttaggcagag

SEQ ID NO: 8124738 - DNA, 22 bp, Homo sapiens
gaggagaagctattggaaggac

SEQ ID NO: 8124739 - DNA, 22 bp, Homo sapiens
gaggagaagctattggaaggac

SEQ ID NO: 8124740 - DNA, 22 bp, Homo sapiens
gaggaaggctaaggggcttaga

SEQ ID NO: 8124741 - DNA, 22 bp, Homo sapiens
gaggagaaatttggggacctga

SEQ ID NO: 8124742 - DNA, 22 bp, Homo sapiens
gaggagaagctaagaaacacag

SEQ ID NO: 8124743 - DNA, 22 bp, Homo sapiens
gaggcagcattcgcatagacag

SEQ ID NO: 8124744 - DNA, 22 bp, Homo sapiens
gaggcagccagaggttctcatt

SEQ ID NO: 8124745 - DNA, 22 bp, Homo sapiens
gaggcacatatatacagagccc

SEQ ID NO: 8124746 - DNA, 22 bp, Homo sapiens
atggtggatttgtgattcagct

SEQ ID NO: 8124747 - DNA, 22 bp, Homo sapiens
atggtggactcttgattcaggc

SEQ ID NO: 8124748 - DNA, 22 bp, Homo sapiens
atggtggacgggagacaggact

SEQ ID NO: 8124749 - DNA, 22 bp, Homo sapiens
gataattataggctaagccact

SEQ ID NO: 8124750 - DNA, 22 bp, Homo sapiens
atgttggagtcgtaaggcatgg

SEQ ID NO: 8124751 - DNA, 22 bp, Homo sapiens
atgttggagtcgtaaggcatgg

SEQ ID NO: 8124752 - DNA, 22 bp, Homo sapiens
atgtccttccattttgatctgt

SEQ ID NO: 8124753 - DNA, 22 bp, Homo sapiens
gaggcagcggctcacagagaaa

SEQ ID NO: 8124754 - DNA, 22 bp, Homo sapiens
atgtagagtagaatagtacaac

SEQ ID NO: 8124755 - DNA, 22 bp, Homo sapiens
gagggctcactgagaaagcagt

SEQ ID NO: 8124756 - DNA, 20 bp, Homo sapiens
gagggctcgtggatggataa

SEQ ID NO: 8124757 - DNA, 22 bp, Homo sapiens
gagggctctaccaagtaactct

SEQ ID NO: 8124758 - DNA, 22 bp, Homo sapiens
gagggctcaactactactaggc

SEQ ID NO: 8124759 - DNA, 22 bp, Homo sapiens
gactggagcccccaaggacacc

SEQ ID NO: 8124760 - DNA, 22 bp, Homo sapiens
gactggagcccccaaggacacc

SEQ ID NO: 8124761 - DNA, 22 bp, Homo sapiens
atgctcattttattgagaatga

SEQ ID NO: 8124762 - DNA, 22 bp, Homo sapiens
atgctcagtagctggctgaccc

SEQ ID NO: 8124763 - DNA, 18 bp, Homo sapiens
gacacatccccaggcctc

SEQ ID NO: 8124764 - DNA, 22 bp, Homo sapiens
gaccacacgtcccagagagccc

SEQ ID NO: 8124765 - DNA, 22 bp, Homo sapiens
gaccaaggccctcagtgggagg

SEQ ID NO: 8124766 - DNA, 22 bp, Homo sapiens
gacataataatctgacctagat

SEQ ID NO: 8124767 - DNA, 22 bp, Homo sapiens
gaataattttgatcagaaggga

SEQ ID NO: 8124768 - DNA, 22 bp, Homo sapiens
gaataatattgactttgcaggc

SEQ ID NO: 8124769 - DNA, 22 bp, Homo sapiens
gaataacattttttcctttaca

SEQ ID NO: 8124770 - DNA, 22 bp, Homo sapiens
gaataatagcagaaattagcag

SEQ ID NO: 8124771 - DNA, 22 bp, Homo sapiens
atgcacaggctgtgggctggtt

SEQ ID NO: 8124772 - DNA, 22 bp, Homo sapiens
atgcacaggtgctgatgcacgc

SEQ ID NO: 8124773 - DNA, 22 bp, Homo sapiens
gaatattttcagtacagatggt

SEQ ID NO: 8124774 - DNA, 22 bp, Homo sapiens
gaaggctgtttctggtagtgat

SEQ ID NO: 8124775 - DNA, 22 bp, Homo sapiens
gaaggctgtcagagaggagggc

SEQ ID NO: 8124776 - DNA, 22 bp, Homo sapiens
atgcacagctgaacactctaaa

SEQ ID NO: 8124777 - DNA, 22 bp, Homo sapiens
atgcacagacccaaaggccatc

SEQ ID NO: 8124778 - DNA, 22 bp, Homo sapiens
atgcacagaacaattttaagag

SEQ ID NO: 8124779 - DNA, 22 bp, Homo sapiens
gaaggctggaaggcaagtagga

SEQ ID NO: 8124780 - DNA, 22 bp, Homo sapiens
gaaggctggctttctgagagca

SEQ ID NO: 8124781 - DNA, 22 bp, Homo sapiens
gaaggctgctgggaagtgtggt

SEQ ID NO: 8124782 - DNA, 22 bp, Homo sapiens
gaaacatttgttgagtacttgc

SEQ ID NO: 8124783 - DNA, 22 bp, Homo sapiens
ctttctttcgaagacgtgatta

SEQ ID NO: 8124784 - DNA, 22 bp, Homo sapiens
gaaacattcagtcaacagtgtt

SEQ ID NO: 8124785 - DNA, 22 bp, Homo sapiens
gaaacattcagtcaacagtgtt

SEQ ID NO: 8124786 - DNA, 22 bp, Homo sapiens
gaaacattgtgttctacagatt

SEQ ID NO: 8124787 - DNA, 22 bp, Homo sapiens
gaaacattgtgttctacagatt

SEQ ID NO: 8124788 - DNA, 22 bp, Homo sapiens
gaaagtgcagtcagacaaggca

SEQ ID NO: 8124789 - DNA, 22 bp, Homo sapiens
gaaatagaggacagctggatca

SEQ ID NO: 8124790 - DNA, 22 bp, Homo sapiens
gaaatagtacagcatagttctt

SEQ ID NO: 8124791 - DNA, 22 bp, Homo sapiens
atgaaacagagtacttaatata

SEQ ID NO: 8124792 - DNA, 22 bp, Homo sapiens
atgaaacagtgaattagtcaag

SEQ ID NO: 8124793 - DNA, 22 bp, Homo sapiens
atctggagatcagctggtggca

SEQ ID NO: 8124794 - DNA, 22 bp, Homo sapiens
atctggagagctggcagcccag

SEQ ID NO: 8124795 - DNA, 22 bp, Homo sapiens
atctggagagatcttcacaaaa

SEQ ID NO: 8124796 - DNA, 22 bp, Homo sapiens
atctggagaatgtttgtctccg

SEQ ID NO: 8124797 - DNA, 22 bp, Homo sapiens
atctggagaataaatgtccaag

SEQ ID NO: 8124798 - DNA, 22 bp, Homo sapiens
atctggaggattctgggacttg

SEQ ID NO: 8124799 - DNA, 22 bp, Homo sapiens
atctggagcttgttagatgttt

SEQ ID NO: 8124800 - DNA, 22 bp, Homo sapiens
atctggagcttaagcttatata

SEQ ID NO: 8124801 - DNA, 22 bp, Homo sapiens
atctggagctctgcacacctgg

SEQ ID NO: 8124802 - DNA, 22 bp, Homo sapiens
atctggagcagggccacaaggc

SEQ ID NO: 8124803 - DNA, 22 bp, Homo sapiens
atctggagcaagattaagagat

SEQ ID NO: 8124804 - DNA, 22 bp, Homo sapiens
atctggagatttcttttcaata

SEQ ID NO: 8124805 - DNA, 22 bp, Homo sapiens
atctggagatgggtctgtcacc

SEQ ID NO: 8124806 - DNA, 22 bp, Homo sapiens
atctggagatctgaattttgtg

SEQ ID NO: 8124807 - DNA, 22 bp, Homo sapiens
atctggagtagaaaaatcgctt

SEQ ID NO: 8124808 - DNA, 22 bp, Homo sapiens
atctggaggtcatcgtttgttc

SEQ ID NO: 8124809 - DNA, 22 bp, Homo sapiens
atctggaggctaagtcatttgc

SEQ ID NO: 8124810 - DNA, 22 bp, Homo sapiens
atctggaggcctgtcttatccc

SEQ ID NO: 8124811 - DNA, 22 bp, Homo sapiens
atctggaggcattactctgtct

SEQ ID NO: 8124812 - DNA, 22 bp, Homo sapiens
atctggaggcaaaggggcgtga

SEQ ID NO: 8124813 - DNA, 22 bp, Homo sapiens
atctggagtgggacacagaaat

SEQ ID NO: 8124814 - DNA, 23 bp, Homo sapiens
atctggagtgttgagtaggtact

SEQ ID NO: 8124815 - DNA, 22 bp, Homo sapiens
atctggagtttcagttttctgg

SEQ ID NO: 8124816 - DNA, 22 bp, Homo sapiens
ctttccagtttctaagtacagt

SEQ ID NO: 8124817 - DNA, 22 bp, Homo sapiens
ctttccaggtctaaaggcaggg

SEQ ID NO: 8124818 - DNA, 22 bp, Homo sapiens
ctttccagtaccaggaagcgga

SEQ ID NO: 8124819 - DNA, 22 bp, Homo sapiens
gctgacccctacaggttgtgtt

SEQ ID NO: 8124820 - DNA, 22 bp, Homo sapiens
gctgacccctacaggttgtgtt

SEQ ID NO: 8124821 - DNA, 22 bp, Homo sapiens
gctctggttccagttccgcacc

SEQ ID NO: 8124822 - DNA, 22 bp, Homo sapiens
gctcttgtcaaaaattagttga

SEQ ID NO: 8124823 - DNA, 22 bp, Homo sapiens
caaatgcatagtttataagaag

SEQ ID NO: 8124824 - DNA, 22 bp, Homo sapiens
caaatgatacctattactaggc

SEQ ID NO: 8124825 - DNA, 22 bp, Homo sapiens
caaatactttatatacttcaaa

SEQ ID NO: 8124826 - DNA, 22 bp, Homo sapiens
caaatactgagtttattttcaa

SEQ ID NO: 8124827 - DNA, 22 bp, Homo sapiens
caaagtgctggaattacaggtg

SEQ ID NO: 8124828 - DNA, 22 bp, Homo sapiens
caaagctgatactcagcaagta

SEQ ID NO: 8124829 - DNA, 22 bp, Homo sapiens
caaacattcaagtacaagtctt

SEQ ID NO: 8124830 - DNA, 22 bp, Homo sapiens
caaagaggttttgagggcagct

SEQ ID NO: 8124831 - DNA, 22 bp, Homo sapiens
caaagaggttttgagggcagct

SEQ ID NO: 8124832 - DNA, 22 bp, Homo sapiens
caaagagttttttcatataatg

SEQ ID NO: 8124833 - DNA, 22 bp, Homo sapiens
caaagccatagagtagataaga

SEQ ID NO: 8124834 - DNA, 21 bp, Homo sapiens
caaagccaggcaactctctcc

SEQ ID NO: 8124835 - DNA, 22 bp, Homo sapiens
caaagccaggctttctaatgta

SEQ ID NO: 8124836 - DNA, 21 bp, Homo sapiens
caaagccaggcaactctctcc

SEQ ID NO: 8124837 - DNA, 22 bp, Homo sapiens
caaacaatttgcatttccttag

SEQ ID NO: 8124838 - DNA, 22 bp, Homo sapiens
caaaatgatgtgattttattgt

SEQ ID NO: 8124839 - DNA, 22 bp, Homo sapiens
caaaagcagttctatctgagtt

SEQ ID NO: 8124840 - DNA, 22 bp, Homo sapiens
attttgtttcctttggagtaga

SEQ ID NO: 8124841 - DNA, 22 bp, Homo sapiens
attttagagctccaagtacagc

SEQ ID NO: 8124842 - DNA, 22 bp, Homo sapiens
atttggaagtttggagtgaagg

SEQ ID NO: 8124843 - DNA, 23 bp, Homo sapiens
gcctggcaaagcactaccgagag

SEQ ID NO: 8124844 - DNA, 21 bp, Homo sapiens
gcctggcaaaaaccggccctg

SEQ ID NO: 8124845 - DNA, 22 bp, Homo sapiens
gcctggcacaggaattaggagg

SEQ ID NO: 8124846 - DNA, 22 bp, Homo sapiens
gcctggcaatggcctcaggaag

SEQ ID NO: 8124847 - DNA, 22 bp, Homo sapiens
gcctggcacattgcagtggatt

SEQ ID NO: 8124848 - DNA, 22 bp, Homo sapiens
gcccccgtagtagatgaggcgc

SEQ ID NO: 8124849 - DNA, 22 bp, Homo sapiens
atttctgtatcctgctgtcaga

SEQ ID NO: 8124850 - DNA, 22 bp, Homo sapiens
atttctgttgcttataaattac

SEQ ID NO: 8124851 - DNA, 17 bp, Homo sapiens
gcccacccttaggagct

SEQ ID NO: 8124852 - DNA, 23 bp, Homo sapiens
gcccaccctcagcgtcctcacgg

SEQ ID NO: 8124853 - DNA, 23 bp, Homo sapiens
gcccaccctcagcgtcctcacgg

SEQ ID NO: 8124854 - DNA, 22 bp, Homo sapiens
gccaggctggtcttgaactcct

SEQ ID NO: 8124855 - DNA, 22 bp, Homo sapiens
gccaggctggccagcaccttct

SEQ ID NO: 8124856 - DNA, 22 bp, Homo sapiens
gccaggctggggggagatgtct

SEQ ID NO: 8124857 - DNA, 22 bp, Homo sapiens
gccaggctggccagcaccttct

SEQ ID NO: 8124858 - DNA, 22 bp, Homo sapiens
gccaggctggcaaaaggaaacc

SEQ ID NO: 8124859 - DNA, 22 bp, Homo sapiens
gccaggctggaaagaacagaca

SEQ ID NO: 8124860 - DNA, 22 bp, Homo sapiens
gccacaggtgggctctgggaaa

SEQ ID NO: 8124861 - DNA, 22 bp, Homo sapiens
gccaggctgctggctgctgtcc

SEQ ID NO: 8124862 - DNA, 22 bp, Homo sapiens
gccaggtggctgagcagctgca

SEQ ID NO: 8124863 - DNA, 22 bp, Homo sapiens
gccaggtgcacctgccctggcc

SEQ ID NO: 8124864 - DNA, 22 bp, Homo sapiens
gccaggtggaggttgcagtgag

SEQ ID NO: 8124865 - DNA, 19 bp, Homo sapiens
gccaggtcttgggtccagg

SEQ ID NO: 8124866 - DNA, 22 bp, Homo sapiens
gccaggctggtgcaaggatatt

SEQ ID NO: 8124867 - DNA, 22 bp, Homo sapiens
gccaggtctgggtagcagagga

SEQ ID NO: 8124868 - DNA, 22 bp, Homo sapiens
attcaaagtctagatgtagtgt

SEQ ID NO: 8124869 - DNA, 22 bp, Homo sapiens
gatatgtattccactataaagg

SEQ ID NO: 8124870 - DNA, 22 bp, Homo sapiens
gatatgtgcttgtaatatttat

SEQ ID NO: 8124871 - DNA, 22 bp, Homo sapiens
gatatttaactctcacaggtcc

SEQ ID NO: 8124872 - DNA, 22 bp, Homo sapiens
attacatatgttggcaacattt

SEQ ID NO: 8124873 - DNA, 23 bp, Homo sapiens
attacagttaattacaacatctt

SEQ ID NO: 8124874 - DNA, 23 bp, Homo sapiens
attagaaaggctttctggtgaaa

SEQ ID NO: 8124875 - DNA, 22 bp, Homo sapiens
gcagcagagaccccaggaagga

SEQ ID NO: 8124876 - DNA, 22 bp, Homo sapiens
attcatatcatagagttattga

SEQ ID NO: 8124877 - DNA, 22 bp, Homo sapiens
gcagcagagtttgggagatggt

SEQ ID NO: 8124878 - DNA, 22 bp, Homo sapiens
gcagcagagtagacagagccct

SEQ ID NO: 8124879 - DNA, 22 bp, Homo sapiens
gcacctggggtacacagctaca

SEQ ID NO: 8124880 - DNA, 22 bp, Homo sapiens
gcacctggtttatataatcata

SEQ ID NO: 8124881 - DNA, 22 bp, Homo sapiens
gcacggctaatttttgtatttt

SEQ ID NO: 8124882 - DNA, 22 bp, Homo sapiens
gcactatagctgcagcacagag

SEQ ID NO: 8124883 - DNA, 22 bp, Homo sapiens
gcacgtggaatgctcatgagcc

SEQ ID NO: 8124884 - DNA, 22 bp, Homo sapiens
gcacggctaatttttgtatttt

SEQ ID NO: 8124885 - DNA, 22 bp, Homo sapiens
attcactgtggtgtctgatata

SEQ ID NO: 8124886 - DNA, 22 bp, Homo sapiens
attcactgtggtgactgatata

SEQ ID NO: 8124887 - DNA, 22 bp, Homo sapiens
attcactgtcagcttgcatggg

SEQ ID NO: 8124888 - DNA, 22 bp, Homo sapiens
attcactggcagacagaactca

SEQ ID NO: 8124889 - DNA, 22 bp, Homo sapiens
attctttacattggcttcttcc

SEQ ID NO: 8124890 - DNA, 22 bp, Homo sapiens
gcagctggacccacacggctta

SEQ ID NO: 8124891 - DNA, 22 bp, Homo sapiens
gcagctgctggagggaggcagg

SEQ ID NO: 8124892 - DNA, 22 bp, Homo sapiens
gcagctgctggaagttcctgcc

SEQ ID NO: 8124893 - DNA, 22 bp, Homo sapiens
attgatttctgcttactcactg

SEQ ID NO: 8124894 - DNA, 22 bp, Homo sapiens
attgatgttagaatctactcct

SEQ ID NO: 8124895 - DNA, 22 bp, Homo sapiens
attgatttttgaggactggtat

SEQ ID NO: 8124896 - DNA, 22 bp, Homo sapiens
attgcaaaattgtcctgtggaa

SEQ ID NO: 8124897 - DNA, 22 bp, Homo sapiens
attgcaaagcattgtgagcgca

SEQ ID NO: 8124898 - DNA, 22 bp, Homo sapiens
attgcaaagaaatacatgctta

SEQ ID NO: 8124899 - DNA, 22 bp, Homo sapiens
attgatgtgtcacaagagattt

SEQ ID NO: 8124900 - DNA, 22 bp, Homo sapiens
attgatgtagtttcagatttca

SEQ ID NO: 8124901 - DNA, 22 bp, Homo sapiens
attgatgtgccgaaatagaggc

SEQ ID NO: 8124902 - DNA, 22 bp, Homo sapiens
gcaggcctgggagtcatcttgt

SEQ ID NO: 8124903 - DNA, 22 bp, Homo sapiens
gcatattttcacaagctcttgg

SEQ ID NO: 8124904 - DNA, 17 bp, Homo sapiens
gcatcacagataacacg

SEQ ID NO: 8124905 - DNA, 22 bp, Homo sapiens
gcatattttcacaagctcttgg

SEQ ID NO: 8124906 - DNA, 22 bp, Homo sapiens
attgtctcttaaatgtggaaat

SEQ ID NO: 8124907 - DNA, 22 bp, Homo sapiens
attgtgattagagaatatagag

SEQ ID NO: 8124908 - DNA, 22 bp, Homo sapiens
attgtgaattgagagtacttct

SEQ ID NO: 8124909 - DNA, 22 bp, Homo sapiens
gccaagcctgggaagagcccat

SEQ ID NO: 8124910 - DNA, 22 bp, Homo sapiens
gccaagaggctcattagcattc

SEQ ID NO: 8124911 - DNA, 22 bp, Homo sapiens
ccccttctggtcttcaatggtg

SEQ ID NO: 8124912 - DNA, 22 bp, Homo sapiens
ccccttctctgcaagcctgctc

SEQ ID NO: 8124913 - DNA, 22 bp, Homo sapiens
cccctttctcccgcgactggcc

SEQ ID NO: 8124914 - DNA, 22 bp, Homo sapiens
ccccttctgtgtcctgtcagcc

SEQ ID NO: 8124915 - DNA, 23 bp, Homo sapiens
cccctctggtggctcagctcctg

SEQ ID NO: 8124916 - DNA, 23 bp, Homo sapiens
cccctctggtggctcagctcctg

SEQ ID NO: 8124917 - DNA, 22 bp, Homo sapiens
ccccacactctttacattcata

SEQ ID NO: 8124918 - DNA, 22 bp, Homo sapiens
ccccaccctcgctccatttcgg

SEQ ID NO: 8124919 - DNA, 22 bp, Homo sapiens
ccccacccacctaagagaaact

SEQ ID NO: 8124920 - DNA, 22 bp, Homo sapiens
ccccaccagcaccctctctatc

SEQ ID NO: 8124921 - DNA, 23 bp, Homo sapiens
cccaggtcaaaattcacaggcct

SEQ ID NO: 8124922 - DNA, 22 bp, Homo sapiens
cccaggtcccgccccagctcta

SEQ ID NO: 8124923 - DNA, 22 bp, Homo sapiens
cccaggtcccggggccagctgc

SEQ ID NO: 8124924 - DNA, 22 bp, Homo sapiens
cccaggtcgtcagcagtgtggt

SEQ ID NO: 8124925 - DNA, 22 bp, Homo sapiens
cccagttgttgccggctctgga

SEQ ID NO: 8124926 - DNA, 22 bp, Homo sapiens
cccattccctttactgttgcat

SEQ ID NO: 8124927 - DNA, 22 bp, Homo sapiens
ccctctccctgcagaatgtggc

SEQ ID NO: 8124928 - DNA, 18 bp, Homo sapiens
ccctctcctgctagtggg

SEQ ID NO: 8124929 - DNA, 18 bp, Homo sapiens
ccctctcctgctagtggg

SEQ ID NO: 8124930 - DNA, 22 bp, Homo sapiens
ccctctcctggctgcatggagc

SEQ ID NO: 8124931 - DNA, 22 bp, Homo sapiens
ccctcctctccctaagagtcac

SEQ ID NO: 8124932 - DNA, 22 bp, Homo sapiens
tggaagggagctggaatttgga

SEQ ID NO: 8124933 - DNA, 22 bp, Homo sapiens
tgccagtctcaccctgggtcct

SEQ ID NO: 8124934 - DNA, 22 bp, Homo sapiens
tgccagtgagccctgggatgtg

SEQ ID NO: 8124935 - DNA, 22 bp, Homo sapiens
tgccagtgaaacatggaagaat

SEQ ID NO: 8124936 - DNA, 22 bp, Homo sapiens
cccaggagagaggccagttggc

SEQ ID NO: 8124937 - DNA, 22 bp, Homo sapiens
cccaggagagaggggataaagc

SEQ ID NO: 8124938 - DNA, 22 bp, Homo sapiens
cccaggagacctgtgaaaggac

SEQ ID NO: 8124939 - DNA, 22 bp, Homo sapiens
cccaggagacatatagaaggac

SEQ ID NO: 8124940 - DNA, 22 bp, Homo sapiens
tgccagtgggtgtgcagagact

SEQ ID NO: 8124941 - DNA, 22 bp, Homo sapiens
tgccagtgtggaactaggaaga

SEQ ID NO: 8124942 - DNA, 22 bp, Homo sapiens
tgcccagccaatttgttatgtt

SEQ ID NO: 8124943 - DNA, 22 bp, Homo sapiens
tgcccagctgtcaaagtagata

SEQ ID NO: 8124944 - DNA, 23 bp, Homo sapiens
cccaggctacaaattatgctctg

SEQ ID NO: 8124945 - DNA, 22 bp, Homo sapiens
cccaggctcccaggtgggacaa

SEQ ID NO: 8124946 - DNA, 22 bp, Homo sapiens
tgccctggggagcccagccagg

SEQ ID NO: 8124947 - DNA, 22 bp, Homo sapiens
cccaggctagaaaggccaacaa

SEQ ID NO: 8124948 - DNA, 22 bp, Homo sapiens
cccaggctagtatgatatcagt

SEQ ID NO: 8124949 - DNA, 19 bp, Homo sapiens
cccaggctacatggagagg

SEQ ID NO: 8124950 - DNA, 22 bp, Homo sapiens
cccaggctagaaaggccaacaa

SEQ ID NO: 8124951 - DNA, 22 bp, Homo sapiens
cccaggctcagactggcttgtt

SEQ ID NO: 8124952 - DNA, 22 bp, Homo sapiens
cccaggctcactgtccgcttcc

SEQ ID NO: 8124953 - DNA, 22 bp, Homo sapiens
tgcctgtgtggggtctgccgcc

SEQ ID NO: 8124954 - DNA, 22 bp, Homo sapiens
tgcctgtgtggtctgcgcatta

SEQ ID NO: 8124955 - DNA, 22 bp, Homo sapiens
tgccttcaagacccatcctcca

SEQ ID NO: 8124956 - DNA, 22 bp, Homo sapiens
tgccttcatccatgttatagtg

SEQ ID NO: 8124957 - DNA, 22 bp, Homo sapiens
tgccttcactgagcttatggga

SEQ ID NO: 8124958 - DNA, 22 bp, Homo sapiens
tgccttcaccaggccttcagcc

SEQ ID NO: 8124959 - DNA, 22 bp, Homo sapiens
cccaggggttcaaggctgcagt

SEQ ID NO: 8124960 - DNA, 22 bp, Homo sapiens
cccagggtagctgagctggcag

SEQ ID NO: 8124961 - DNA, 22 bp, Homo sapiens
cccaggctgagttagaggtgtc

SEQ ID NO: 8124962 - DNA, 22 bp, Homo sapiens
cccaggctggaattccaggcct

SEQ ID NO: 8124963 - DNA, 22 bp, Homo sapiens
cccaggctggagggcagtgtca

SEQ ID NO: 8124964 - DNA, 22 bp, Homo sapiens
cccaggctggagtgcaatggca

SEQ ID NO: 8124965 - DNA, 22 bp, Homo sapiens
cccaggctggagtgcaatggca

SEQ ID NO: 8124966 - DNA, 22 bp, Homo sapiens
cccaggctggagtgcaatggtg

SEQ ID NO: 8124967 - DNA, 22 bp, Homo sapiens
cccaggctggagtgcaatggtg

SEQ ID NO: 8124968 - DNA, 22 bp, Homo sapiens
cccaggctggagtgcagtggcg

SEQ ID NO: 8124969 - DNA, 22 bp, Homo sapiens
cccaggctggagtgcagtggcg

SEQ ID NO: 8124970 - DNA, 22 bp, Homo sapiens
cccaggctggatttcggtggca

SEQ ID NO: 8124971 - DNA, 22 bp, Homo sapiens
cccaggctggagtgtaatggtg

SEQ ID NO: 8124972 - DNA, 22 bp, Homo sapiens
cccaggctgggaacgattctag

SEQ ID NO: 8124973 - DNA, 22 bp, Homo sapiens
cccaggctggggctcctccagc

SEQ ID NO: 8124974 - DNA, 22 bp, Homo sapiens
cccaggctggcctccgcagtgc

SEQ ID NO: 8124975 - DNA, 22 bp, Homo sapiens
cccaggctggcactgctgaagt

SEQ ID NO: 8124976 - DNA, 21 bp, Homo sapiens
cccagggaagccgcagtcacc

SEQ ID NO: 8124977 - DNA, 18 bp, Homo sapiens
cctcagaggcaaattgtt

SEQ ID NO: 8124978 - DNA, 22 bp, Homo sapiens
cctcagaggtgaacatcagtgc

SEQ ID NO: 8124979 - DNA, 22 bp, Homo sapiens
tggcaggtagagttctgagatg

SEQ ID NO: 8124980 - DNA, 22 bp, Homo sapiens
cctagcagaagctgcaatgcct

SEQ ID NO: 8124981 - DNA, 22 bp, Homo sapiens
cctagcagggaagcagtgagga

SEQ ID NO: 8124982 - DNA, 22 bp, Homo sapiens
cctagccccagatatctcacac

SEQ ID NO: 8124983 - DNA, 22 bp, Homo sapiens
ccctgcaggctcagactggagt

SEQ ID NO: 8124984 - DNA, 22 bp, Homo sapiens
ccctgcagccttgcatgccttc

SEQ ID NO: 8124985 - DNA, 22 bp, Homo sapiens
ccctgcaggggacctgcagcct

SEQ ID NO: 8124986 - DNA, 22 bp, Homo sapiens
ccctgcagccttgcatgccttc

SEQ ID NO: 8124987 - DNA, 22 bp, Homo sapiens
cccttctgtaaatgctgactgg

SEQ ID NO: 8124988 - DNA, 22 bp, Homo sapiens
cccttctctttcactcactatt

SEQ ID NO: 8124989 - DNA, 22 bp, Homo sapiens
cccttcctggagtaccctctgt

SEQ ID NO: 8124990 - DNA, 22 bp, Homo sapiens
cccttcctcctcgcctgtcaga

SEQ ID NO: 8124991 - DNA, 22 bp, Homo sapiens
cctcatttatagccaaagtaaa

SEQ ID NO: 8124992 - DNA, 22 bp, Homo sapiens
tggcctgggcctgccggtgcaa

SEQ ID NO: 8124993 - DNA, 22 bp, Homo sapiens
cctcagagttggccacgagagc

SEQ ID NO: 8124994 - DNA, 22 bp, Homo sapiens
cctcagagtaggtctcagctgt

SEQ ID NO: 8124995 - DNA, 22 bp, Homo sapiens
cctcagagttggaatcacattt

SEQ ID NO: 8124996 - DNA, 22 bp, Homo sapiens
cctcaggctgggctgcccctgg

SEQ ID NO: 8124997 - DNA, 22 bp, Homo sapiens
cctcaggctgctcacacttgtc

SEQ ID NO: 8124998 - DNA, 22 bp, Homo sapiens
cctcaggcttgtgagccttcag

SEQ ID NO: 8124999 - DNA, 22 bp, Homo sapiens
cctcaggctgtcttccttctgg

SEQ ID NO: 8125000 - DNA, 19 bp, Homo sapiens
cctcttcctctgacactat

SEQ ID NO: 8125001 - DNA, 22 bp, Homo sapiens
cctcttctaggtttcagcctgc

SEQ ID NO: 8125002 - DNA, 22 bp, Homo sapiens
cctcttctaggacgtccttgtg

SEQ ID NO: 8125003 - DNA, 22 bp, Homo sapiens
tgggagtggggcatagaaggta

SEQ ID NO: 8125004 - DNA, 19 bp, Homo sapiens
tgggagtggggaaggtcct

SEQ ID NO: 8125005 - DNA, 22 bp, Homo sapiens
cctcttctcaactccagccaga

SEQ ID NO: 8125006 - DNA, 19 bp, Homo sapiens
tgggagtggggaaggtcct

SEQ ID NO: 8125007 - DNA, 22 bp, Homo sapiens
tgggctgctgagaatgagagag

SEQ ID NO: 8125008 - DNA, 22 bp, Homo sapiens
tgggctgctgtctgcacatgct

SEQ ID NO: 8125009 - DNA, 22 bp, Homo sapiens
tgggctctagactttagtgtgg

SEQ ID NO: 8125010 - DNA, 20 bp, Homo sapiens
cctctgcctttctagtctga

SEQ ID NO: 8125011 - DNA, 20 bp, Homo sapiens
cctctgcctttctagtctga

SEQ ID NO: 8125012 - DNA, 18 bp, Homo sapiens
cctctgcctttgtagagc

SEQ ID NO: 8125013 - DNA, 22 bp, Homo sapiens
cctctgcctgcacatcatcctg

SEQ ID NO: 8125014 - DNA, 22 bp, Homo sapiens
cctctgcctgcacatcatcctg

SEQ ID NO: 8125015 - DNA, 18 bp, Homo sapiens
cctctgccatagccagca

SEQ ID NO: 8125016 - DNA, 22 bp, Homo sapiens
cctctgcccttttcctgtatca

SEQ ID NO: 8125017 - DNA, 22 bp, Homo sapiens
cctctgcccttttcctgtatca

SEQ ID NO: 8125018 - DNA, 19 bp, Homo sapiens
tggcttccatctctctcat

SEQ ID NO: 8125019 - DNA, 22 bp, Homo sapiens
tggcttccagagctgctccacc

SEQ ID NO: 8125020 - DNA, 22 bp, Homo sapiens
tggctgagaatgggatgatgcc

SEQ ID NO: 8125021 - DNA, 22 bp, Homo sapiens
tggctgagaccatcagggtgta

SEQ ID NO: 8125022 - DNA, 16 bp, Homo sapiens
tggctgagagagggtt

SEQ ID NO: 8125023 - DNA, 22 bp, Homo sapiens
tggctgagagaagacggggaag

SEQ ID NO: 8125024 - DNA, 22 bp, Homo sapiens
tggctgagaccttcccaaattc

SEQ ID NO: 8125025 - DNA, 22 bp, Homo sapiens
ccaggaggttgaggctgcagtg

SEQ ID NO: 8125026 - DNA, 22 bp, Homo sapiens
ccaggaggttgaggctgcagtg

SEQ ID NO: 8125027 - DNA, 21 bp, Homo sapiens
tcttccctcaggatgtcctgc

SEQ ID NO: 8125028 - DNA, 19 bp, Homo sapiens
tcttccctggctgtcagtc

SEQ ID NO: 8125029 - DNA, 22 bp, Homo sapiens
ccaggctggagtgcaatggcat

SEQ ID NO: 8125030 - DNA, 22 bp, Homo sapiens
ccaggctggagtgcaatggcgt

SEQ ID NO: 8125031 - DNA, 23 bp, Homo sapiens
ccaggctctttcacctgctattc

SEQ ID NO: 8125032 - DNA, 22 bp, Homo sapiens
ccaggctgaatatgttccaggg

SEQ ID NO: 8125033 - DNA, 22 bp, Homo sapiens
ccaggctctgtgtgggctagag

SEQ ID NO: 8125034 - DNA, 22 bp, Homo sapiens
ccaggctctgtctggtcagaag

SEQ ID NO: 8125035 - DNA, 21 bp, Homo sapiens
ccaggctcctgaggctggtca

SEQ ID NO: 8125036 - DNA, 22 bp, Homo sapiens
ccaggcctggaccatgccaggg

SEQ ID NO: 8125037 - DNA, 22 bp, Homo sapiens
ccaggcctggacgggtggcctg

SEQ ID NO: 8125038 - DNA, 22 bp, Homo sapiens
ccaggcctgcatctgctgcgca

SEQ ID NO: 8125039 - DNA, 22 bp, Homo sapiens
ccaggcctgcattccctctcag

SEQ ID NO: 8125040 - DNA, 22 bp, Homo sapiens
ccaggcccagggtactgaccaa

SEQ ID NO: 8125041 - DNA, 22 bp, Homo sapiens
ccaggcccagggtactgaccaa

SEQ ID NO: 8125042 - DNA, 22 bp, Homo sapiens
ccaggcccaccttggccactta

SEQ ID NO: 8125043 - DNA, 22 bp, Homo sapiens
ccagctgctgtgaggaccacag

SEQ ID NO: 8125044 - DNA, 22 bp, Homo sapiens
tctggaggcaggctgccaggat

SEQ ID NO: 8125045 - DNA, 22 bp, Homo sapiens
ccagctgcccaagaggcatcct

SEQ ID NO: 8125046 - DNA, 22 bp, Homo sapiens
ccagctgcaggtgttccagatg

SEQ ID NO: 8125047 - DNA, 22 bp, Homo sapiens
ccagctgcccaagaggcatcct

SEQ ID NO: 8125048 - DNA, 22 bp, Homo sapiens
ccagctctctgcagaaaggact

SEQ ID NO: 8125049 - DNA, 23 bp, Homo sapiens
tctcagacccgaagccagaggaa

SEQ ID NO: 8125050 - DNA, 22 bp, Homo sapiens
tctcagagaacagttggtgctt

SEQ ID NO: 8125051 - DNA, 18 bp, Homo sapiens
tctggaacaacttcatgt

SEQ ID NO: 8125052 - DNA, 22 bp, Homo sapiens
tctggcagctctcctcggcgga

SEQ ID NO: 8125053 - DNA, 22 bp, Homo sapiens
tctggcagctatcctctggcca

SEQ ID NO: 8125054 - DNA, 22 bp, Homo sapiens
tctggcagctatcctctggcca

SEQ ID NO: 8125055 - DNA, 22 bp, Homo sapiens
tctggcaggaccatgaagcgta

SEQ ID NO: 8125056 - DNA, 22 bp, Homo sapiens
tctggcaggacatgctgaccat

SEQ ID NO: 8125057 - DNA, 21 bp, Homo sapiens
tctggcaggcacgggcccagc

SEQ ID NO: 8125058 - DNA, 22 bp, Homo sapiens
tctggcaggccttgtcaatctg

SEQ ID NO: 8125059 - DNA, 22 bp, Homo sapiens
tctggcaggggttctgcacttg

SEQ ID NO: 8125060 - DNA, 22 bp, Homo sapiens
tctggcaggggttctgcacttg

SEQ ID NO: 8125061 - DNA, 21 bp, Homo sapiens
ccaggaaggactgagctccct

SEQ ID NO: 8125062 - DNA, 22 bp, Homo sapiens
tctggtttcaatgggtacgatt

SEQ ID NO: 8125063 - DNA, 22 bp, Homo sapiens
tctggtttcccagttcctccgt

SEQ ID NO: 8125064 - DNA, 22 bp, Homo sapiens
tctggtgtcagtattctttgaa

SEQ ID NO: 8125065 - DNA, 22 bp, Homo sapiens
tctgggagatccaagcagaact

SEQ ID NO: 8125066 - DNA, 22 bp, Homo sapiens
tctgggagcagatgatggtata

SEQ ID NO: 8125067 - DNA, 22 bp, Homo sapiens
tctgggagcacacgcagtgatc

SEQ ID NO: 8125068 - DNA, 22 bp, Homo sapiens
tctgggagagtcacaggcattg

SEQ ID NO: 8125069 - DNA, 22 bp, Homo sapiens
tctgggagatccaagcagaact

SEQ ID NO: 8125070 - DNA, 22 bp, Homo sapiens
tctgggagcagctcagcagatt

SEQ ID NO: 8125071 - DNA, 22 bp, Homo sapiens
tctgggagcctgaaagtgaatg

SEQ ID NO: 8125072 - DNA, 22 bp, Homo sapiens
tctgggagcctgaaagtgaatg

SEQ ID NO: 8125073 - DNA, 22 bp, Homo sapiens
ccatgcctggactccactctca

SEQ ID NO: 8125074 - DNA, 22 bp, Homo sapiens
ccatgccttcctttccctggaa

SEQ ID NO: 8125075 - DNA, 22 bp, Homo sapiens
ccatgcctggactccactctca

SEQ ID NO: 8125076 - DNA, 22 bp, Homo sapiens
ccatgctggagtccctagctgt

SEQ ID NO: 8125077 - DNA, 22 bp, Homo sapiens
ccatgctgggatgctccaagtg

SEQ ID NO: 8125078 - DNA, 22 bp, Homo sapiens
ccatgtggtgggaaggagaatg

SEQ ID NO: 8125079 - DNA, 22 bp, Homo sapiens
tgaggcagcattcttcaagaca

SEQ ID NO: 8125080 - DNA, 22 bp, Homo sapiens
ccagtcccgcatggtccagaat

SEQ ID NO: 8125081 - DNA, 22 bp, Homo sapiens
tgagggctgtggaaggctaacc

SEQ ID NO: 8125082 - DNA, 22 bp, Homo sapiens
tgagggctgcttccagagctag

SEQ ID NO: 8125083 - DNA, 22 bp, Homo sapiens
tgagggctgacaggaggacagc

SEQ ID NO: 8125084 - DNA, 20 bp, Homo sapiens
tgagggctaaccagactctg

SEQ ID NO: 8125085 - DNA, 22 bp, Homo sapiens
tgagggcagagcactggggagc

SEQ ID NO: 8125086 - DNA, 20 bp, Homo sapiens
ccattctgggtgcagtctgg

SEQ ID NO: 8125087 - DNA, 22 bp, Homo sapiens
tgattttacttagcatgatgtt

SEQ ID NO: 8125088 - DNA, 22 bp, Homo sapiens
tgattttacttagcatgatgtt

SEQ ID NO: 8125089 - DNA, 22 bp, Homo sapiens
tgattttattggtgaggaaatt

SEQ ID NO: 8125090 - DNA, 23 bp, Homo sapiens
tgattttaaaaagtaagttatca

SEQ ID NO: 8125091 - DNA, 22 bp, Homo sapiens
ccattgtaaattctgtggaagt

SEQ ID NO: 8125092 - DNA, 22 bp, Homo sapiens
tgcaaataaatttctgttcatt

SEQ ID NO: 8125093 - DNA, 22 bp, Homo sapiens
tgcaaatacaaaatggtacagc

SEQ ID NO: 8125094 - DNA, 22 bp, Homo sapiens
cccacttcatgggcaggaagga

SEQ ID NO: 8125095 - DNA, 22 bp, Homo sapiens
tgcaaatagcctatatttatag

SEQ ID NO: 8125096 - DNA, 23 bp, Homo sapiens
cccagaccttgtgctgcccttgg

SEQ ID NO: 8125097 - DNA, 22 bp, Homo sapiens
cccagacattgcagggactggt

SEQ ID NO: 8125098 - DNA, 22 bp, Homo sapiens
ccaggggaaacagggagcactc

SEQ ID NO: 8125099 - DNA, 22 bp, Homo sapiens
ccaggctggagtgcagtggcac

SEQ ID NO: 8125100 - DNA, 22 bp, Homo sapiens
ccaggctggagtgcagtggcac

SEQ ID NO: 8125101 - DNA, 22 bp, Homo sapiens
ccaggctggagtgcagtggcac

SEQ ID NO: 8125102 - DNA, 22 bp, Homo sapiens
ccaggctggagtgcaatggtgc

SEQ ID NO: 8125103 - DNA, 22 bp, Homo sapiens
ccaggctggagtgcagtagtgt

SEQ ID NO: 8125104 - DNA, 22 bp, Homo sapiens
ccaggctggattttgcagttca

SEQ ID NO: 8125105 - DNA, 22 bp, Homo sapiens
ccaggctggagtgtagtcgcat

SEQ ID NO: 8125106 - DNA, 20 bp, Homo sapiens
ccaggctggcaaatgggggc

SEQ ID NO: 8125107 - DNA, 21 bp, Homo sapiens
ccaggctggccatggtattga

SEQ ID NO: 8125108 - DNA, 19 bp, Homo sapiens
ccaggtggaactgaggtag

SEQ ID NO: 8125109 - DNA, 22 bp, Homo sapiens
tgagaatagcagactggtaact

SEQ ID NO: 8125110 - DNA, 22 bp, Homo sapiens
tgagaatactgcattgttagga

SEQ ID NO: 8125111 - DNA, 22 bp, Homo sapiens
tgagaatagtaataatttctgg

SEQ ID NO: 8125112 - DNA, 22 bp, Homo sapiens
tgagaaggctcaggcttagaga

SEQ ID NO: 8125113 - DNA, 22 bp, Homo sapiens
tgagaagggttggagaaataat

SEQ ID NO: 8125114 - DNA, 22 bp, Homo sapiens
tgagacagttctgcagctgggt

SEQ ID NO: 8125115 - DNA, 22 bp, Homo sapiens
tgagacagtttttctatttcca

SEQ ID NO: 8125116 - DNA, 22 bp, Homo sapiens
tgagacagttggtgaaatctaa

SEQ ID NO: 8125117 - DNA, 22 bp, Homo sapiens
ccaggtgtagcactgctcacag

SEQ ID NO: 8125118 - DNA, 22 bp, Homo sapiens
ccaggtgtaggacaccaaggga

SEQ ID NO: 8125119 - DNA, 22 bp, Homo sapiens
ccaggtgtcatgcgtgtgaccc

SEQ ID NO: 8125120 - DNA, 22 bp, Homo sapiens
ccaggtgtctgtggccagccct

SEQ ID NO: 8125121 - DNA, 22 bp, Homo sapiens
tgaggcagaaaatagcagttca

SEQ ID NO: 8125122 - DNA, 22 bp, Homo sapiens
ccaggtgtggggaggactcaca

SEQ ID NO: 8125123 - DNA, 22 bp, Homo sapiens
ccaggtgtgctctgcagtggat

SEQ ID NO: 8125124 - DNA, 22 bp, Homo sapiens
ccaggtgtgccagcagggactg

SEQ ID NO: 8125125 - DNA, 22 bp, Homo sapiens
ccaggtgtgatttggcagtgtc

SEQ ID NO: 8125126 - DNA, 22 bp, Homo sapiens
taagtcccccacttgccacagg

SEQ ID NO: 8125127 - DNA, 23 bp, Homo sapiens
cagctcagagtgtgtcctgtttc

SEQ ID NO: 8125128 - DNA, 22 bp, Homo sapiens
caggcagcagccactctggtat

SEQ ID NO: 8125129 - DNA, 22 bp, Homo sapiens
caggccagagcgcgtggttggg

SEQ ID NO: 8125130 - DNA, 22 bp, Homo sapiens
caggcatttcgcaaaggctgag

SEQ ID NO: 8125131 - DNA, 22 bp, Homo sapiens
caggcccacgaggcacacagag

SEQ ID NO: 8125132 - DNA, 22 bp, Homo sapiens
caggcccacgaggcacacagag

SEQ ID NO: 8125133 - DNA, 22 bp, Homo sapiens
caggccattaccgctgagaccc

SEQ ID NO: 8125134 - DNA, 22 bp, Homo sapiens
taatgtacctcattctttctag

SEQ ID NO: 8125135 - DNA, 22 bp, Homo sapiens
taatcacaattcagatgtctta

SEQ ID NO: 8125136 - DNA, 22 bp, Homo sapiens
caggcatggagaggcagagact

SEQ ID NO: 8125137 - DNA, 22 bp, Homo sapiens
taatgtcagtgacctggtttaa

SEQ ID NO: 8125138 - DNA, 22 bp, Homo sapiens
caggcctcttccatgcagcagc

SEQ ID NO: 8125139 - DNA, 19 bp, Homo sapiens
caggcctcttaccctctct

SEQ ID NO: 8125140 - DNA, 19 bp, Homo sapiens
caggcctcttaccctctct

SEQ ID NO: 8125141 - DNA, 22 bp, Homo sapiens
caggcctgaccctgagcttcac

SEQ ID NO: 8125142 - DNA, 22 bp, Homo sapiens
caggcctctatggtcagctgag

SEQ ID NO: 8125143 - DNA, 22 bp, Homo sapiens
caggcctcgaggagacagctac

SEQ ID NO: 8125144 - DNA, 22 bp, Homo sapiens
caggcctctatggtcagctgag

SEQ ID NO: 8125145 - DNA, 22 bp, Homo sapiens
caggcctctccttagtctggca

SEQ ID NO: 8125146 - DNA, 19 bp, Homo sapiens
caggcctctggtctgctgt

SEQ ID NO: 8125147 - DNA, 22 bp, Homo sapiens
caggcccagcccttagccaggt

SEQ ID NO: 8125148 - DNA, 22 bp, Homo sapiens
caggcctcctatgagcactagc

SEQ ID NO: 8125149 - DNA, 22 bp, Homo sapiens
tactttaaagaggtgtaatgag

SEQ ID NO: 8125150 - DNA, 22 bp, Homo sapiens
tactttacagtattagataatt

SEQ ID NO: 8125151 - DNA, 22 bp, Homo sapiens
tacttgttatcatcttttcctt

SEQ ID NO: 8125152 - DNA, 22 bp, Homo sapiens
tactttaaaaactgataattca

SEQ ID NO: 8125153 - DNA, 22 bp, Homo sapiens
caggctgccgaggctgcagaat

SEQ ID NO: 8125154 - DNA, 22 bp, Homo sapiens
caggctgccgtgaagcaggcct

SEQ ID NO: 8125155 - DNA, 22 bp, Homo sapiens
caggctgccgaggctgcagaat

SEQ ID NO: 8125156 - DNA, 22 bp, Homo sapiens
caggctgccgtgaagcaggcct

SEQ ID NO: 8125157 - DNA, 22 bp, Homo sapiens
caggctggagtgcagtggtgcc

SEQ ID NO: 8125158 - DNA, 22 bp, Homo sapiens
caggctggagttcagtggtgtg

SEQ ID NO: 8125159 - DNA, 22 bp, Homo sapiens
caggctggcaatgcgtcaagca

SEQ ID NO: 8125160 - DNA, 22 bp, Homo sapiens
caggctgggaacgccacccgct

SEQ ID NO: 8125161 - DNA, 22 bp, Homo sapiens
caggctgggactgacccctgct

SEQ ID NO: 8125162 - DNA, 22 bp, Homo sapiens
tagattcttctaggtctttagc

SEQ ID NO: 8125163 - DNA, 22 bp, Homo sapiens
tagattctgaccctctttttac

SEQ ID NO: 8125164 - DNA, 22 bp, Homo sapiens
cagggacagcactaaactcttg

SEQ ID NO: 8125165 - DNA, 20 bp, Homo sapiens
cagggacagcagtgggtttt

SEQ ID NO: 8125166 - DNA, 20 bp, Homo sapiens
cagggacagcagtgggtttt

SEQ ID NO: 8125167 - DNA, 22 bp, Homo sapiens
cagggacaatggcagagcctga

SEQ ID NO: 8125168 - DNA, 22 bp, Homo sapiens
cagggacaaacaaggttgggga

SEQ ID NO: 8125169 - DNA, 22 bp, Homo sapiens
caggctgtccaggctcctttgg

SEQ ID NO: 8125170 - DNA, 22 bp, Homo sapiens
taggctgggctgagctggacgg

SEQ ID NO: 8125171 - DNA, 22 bp, Homo sapiens
cagggctgagaatttagagaca

SEQ ID NO: 8125172 - DNA, 22 bp, Homo sapiens
cagggctgaagaaattcaaaag

SEQ ID NO: 8125173 - DNA, 22 bp, Homo sapiens
cagggctcttccggagcaggga

SEQ ID NO: 8125174 - DNA, 22 bp, Homo sapiens
cagggctcttccggagcaggga

SEQ ID NO: 8125175 - DNA, 22 bp, Homo sapiens
cagggctgtaaattagtgctga

SEQ ID NO: 8125176 - DNA, 22 bp, Homo sapiens
cagggctgtctccaaaggcccc

SEQ ID NO: 8125177 - DNA, 23 bp, Homo sapiens
cagggctggtagggaagagcgtg

SEQ ID NO: 8125178 - DNA, 22 bp, Homo sapiens
tagggaaatatagatttagggc

SEQ ID NO: 8125179 - DNA, 22 bp, Homo sapiens
cagggctgtgcccatcttcccc

SEQ ID NO: 8125180 - DNA, 22 bp, Homo sapiens
cagggctgtggaaaactggtgc

SEQ ID NO: 8125181 - DNA, 22 bp, Homo sapiens
cagggctgtggctttgtgctgt

SEQ ID NO: 8125182 - DNA, 22 bp, Homo sapiens
caggggggcaggagtcattgat

SEQ ID NO: 8125183 - DNA, 22 bp, Homo sapiens
caggggcctgtcctggcttctg

SEQ ID NO: 8125184 - DNA, 22 bp, Homo sapiens
caggggcctgtcctggcttctg

SEQ ID NO: 8125185 - DNA, 22 bp, Homo sapiens
caggggtgtttttggccaggag

SEQ ID NO: 8125186 - DNA, 22 bp, Homo sapiens
cagggtagacagtaggtgtctg

SEQ ID NO: 8125187 - DNA, 22 bp, Homo sapiens
caggggtggctgcagcagaggt

SEQ ID NO: 8125188 - DNA, 22 bp, Homo sapiens
cagggtccggctgcctggctgt

SEQ ID NO: 8125189 - DNA, 22 bp, Homo sapiens
cagggtcatggcacctgcacgg

SEQ ID NO: 8125190 - DNA, 22 bp, Homo sapiens
cagggtcaagagactccagcag

SEQ ID NO: 8125191 - DNA, 20 bp, Homo sapiens
tagcttgaagaactccagag

SEQ ID NO: 8125192 - DNA, 22 bp, Homo sapiens
taggagggccctgaaaatggca

SEQ ID NO: 8125193 - DNA, 22 bp, Homo sapiens
taggcatgcaaataaatgtgca

SEQ ID NO: 8125194 - DNA, 22 bp, Homo sapiens
cagggcccagtccctgctgtca

SEQ ID NO: 8125195 - DNA, 22 bp, Homo sapiens
cagggcccaggccactgggttg

SEQ ID NO: 8125196 - DNA, 22 bp, Homo sapiens
cagggcctcatcctcagagatt

SEQ ID NO: 8125197 - DNA, 20 bp, Homo sapiens
cagggcctatgattgagctt

SEQ ID NO: 8125198 - DNA, 22 bp, Homo sapiens
cagggctccatgcagggactcc

SEQ ID NO: 8125199 - DNA, 23 bp, Homo sapiens
cagggccctgctcaatttctcca

SEQ ID NO: 8125200 - DNA, 22 bp, Homo sapiens
cagggcccatggctcaggtagg

SEQ ID NO: 8125201 - DNA, 22 bp, Homo sapiens
cagggagatcttggctcctggt

SEQ ID NO: 8125202 - DNA, 22 bp, Homo sapiens
cagggagcagcccctagaagta

SEQ ID NO: 8125203 - DNA, 22 bp, Homo sapiens
tagatttgtttccttctctcca

SEQ ID NO: 8125204 - DNA, 22 bp, Homo sapiens
tagattgtgaacaagtatttgg

SEQ ID NO: 8125205 - DNA, 22 bp, Homo sapiens
cagggagcaggctctgtccatc

SEQ ID NO: 8125206 - DNA, 22 bp, Homo sapiens
cagggccatgaggcacagggtc

SEQ ID NO: 8125207 - DNA, 22 bp, Homo sapiens
cagggccatatcttgtgcacca

SEQ ID NO: 8125208 - DNA, 22 bp, Homo sapiens
tattattaaatggcagaatttt

SEQ ID NO: 8125209 - DNA, 19 bp, Homo sapiens
caggtggcgctctacaggg

SEQ ID NO: 8125210 - DNA, 22 bp, Homo sapiens
caggtggatctctaaggactga

SEQ ID NO: 8125211 - DNA, 22 bp, Homo sapiens
caggtggcaaatgagtagcatt

SEQ ID NO: 8125212 - DNA, 22 bp, Homo sapiens
caggtgcccagctcctgctgtg

SEQ ID NO: 8125213 - DNA, 22 bp, Homo sapiens
caggtgcccaggggacagtggc

SEQ ID NO: 8125214 - DNA, 22 bp, Homo sapiens
caggtcagaggcgcagccccca

SEQ ID NO: 8125215 - DNA, 22 bp, Homo sapiens
caggtacaaagctactgcctga

SEQ ID NO: 8125216 - DNA, 22 bp, Homo sapiens
tcaagcggactgagatactctg

SEQ ID NO: 8125217 - DNA, 18 bp, Homo sapiens
tcaagccattctcctgcc

SEQ ID NO: 8125218 - DNA, 22 bp, Homo sapiens
tattttatctgccagagtggag

SEQ ID NO: 8125219 - DNA, 22 bp, Homo sapiens
tattttaggtaatatccattgt

SEQ ID NO: 8125220 - DNA, 22 bp, Homo sapiens
tattttcaccatgtatccctgt

SEQ ID NO: 8125221 - DNA, 22 bp, Homo sapiens
tattttatctgccagagtggag

SEQ ID NO: 8125222 - DNA, 19 bp, Homo sapiens
tcaaaacacaaatggttga

SEQ ID NO: 8125223 - DNA, 19 bp, Homo sapiens
tcaaaacacaaatggttga

SEQ ID NO: 8125224 - DNA, 22 bp, Homo sapiens
tcaaaacaacactcaggtgtaa

SEQ ID NO: 8125225 - DNA, 22 bp, Homo sapiens
cagtcactggaatagctgagga

SEQ ID NO: 8125226 - DNA, 22 bp, Homo sapiens
cagtcaccaccaggtggcagta

SEQ ID NO: 8125227 - DNA, 22 bp, Homo sapiens
cagtattttcaggatttggaag

SEQ ID NO: 8125228 - DNA, 22 bp, Homo sapiens
cagtatttttaagctgctttgt

SEQ ID NO: 8125229 - DNA, 22 bp, Homo sapiens
cagtattttccttgttaactta

SEQ ID NO: 8125230 - DNA, 22 bp, Homo sapiens
cagtcagggacaccagctagga

SEQ ID NO: 8125231 - DNA, 22 bp, Homo sapiens
cagtcacttacaaaaatataat

SEQ ID NO: 8125232 - DNA, 22 bp, Homo sapiens
tattttaaagtgaagggtcttg

SEQ ID NO: 8125233 - DNA, 22 bp, Homo sapiens
tattttaaagactgccagccta

SEQ ID NO: 8125234 - DNA, 22 bp, Homo sapiens
tattttaaagactgccagccta

SEQ ID NO: 8125235 - DNA, 22 bp, Homo sapiens
tattttaaagtgaagggtcttg

SEQ ID NO: 8125236 - DNA, 22 bp, Homo sapiens
tcagtgcctactttgatcaatt

SEQ ID NO: 8125237 - DNA, 22 bp, Homo sapiens
tcagggattgcaaaattcatcc

SEQ ID NO: 8125238 - DNA, 19 bp, Homo sapiens
catctggatgattctcctg

SEQ ID NO: 8125239 - DNA, 22 bp, Homo sapiens
catctgctgttccttggactca

SEQ ID NO: 8125240 - DNA, 21 bp, Homo sapiens
catgcatacatatacaagctt

SEQ ID NO: 8125241 - DNA, 22 bp, Homo sapiens
catgcatagtttttctagaagg

SEQ ID NO: 8125242 - DNA, 22 bp, Homo sapiens
catgcagtgactcagacacagg

SEQ ID NO: 8125243 - DNA, 22 bp, Homo sapiens
catgcacactgcaacaaggact

SEQ ID NO: 8125244 - DNA, 22 bp, Homo sapiens
catggcagtgattcagcctttg

SEQ ID NO: 8125245 - DNA, 22 bp, Homo sapiens
catggcattgcataacggggct

SEQ ID NO: 8125246 - DNA, 22 bp, Homo sapiens
catggcaggaaggacatgcact

SEQ ID NO: 8125247 - DNA, 23 bp, Homo sapiens
catggcagcaagagctcatggcc

SEQ ID NO: 8125248 - DNA, 22 bp, Homo sapiens
tcaggctgtggctttgaccgca

SEQ ID NO: 8125249 - DNA, 22 bp, Homo sapiens
tcaggctgtggcttcagttctt

SEQ ID NO: 8125250 - DNA, 22 bp, Homo sapiens
tcaggctgttagccacctcctc

SEQ ID NO: 8125251 - DNA, 22 bp, Homo sapiens
tcaggctgtgggcactggccat

SEQ ID NO: 8125252 - DNA, 22 bp, Homo sapiens
tcaggctgtgtctttaaacaat

SEQ ID NO: 8125253 - DNA, 17 bp, Homo sapiens
tcaggctgtgcctggta

SEQ ID NO: 8125254 - DNA, 17 bp, Homo sapiens
tcaggctgtgcctggta

SEQ ID NO: 8125255 - DNA, 21 bp, Homo sapiens
tcaggctgtctgctggttcca

SEQ ID NO: 8125256 - DNA, 22 bp, Homo sapiens
tcaggctgcctatcagactgtg

SEQ ID NO: 8125257 - DNA, 22 bp, Homo sapiens
tcaggctgtatatcttgcactc

SEQ ID NO: 8125258 - DNA, 22 bp, Homo sapiens
catagaaatcaggtgagaatct

SEQ ID NO: 8125259 - DNA, 22 bp, Homo sapiens
catagaaactgagacaaggatt

SEQ ID NO: 8125260 - DNA, 22 bp, Homo sapiens
tcaggccccttgtcagctctgt

SEQ ID NO: 8125261 - DNA, 22 bp, Homo sapiens
cataattaaattctgggcaaga

SEQ ID NO: 8125262 - DNA, 22 bp, Homo sapiens
cataattactgatatgctgatt

SEQ ID NO: 8125263 - DNA, 22 bp, Homo sapiens
cataattagagaattcatgtta

SEQ ID NO: 8125264 - DNA, 22 bp, Homo sapiens
cataatttctaccagggccata

SEQ ID NO: 8125265 - DNA, 22 bp, Homo sapiens
cataatttcccaagagattgaa

SEQ ID NO: 8125266 - DNA, 22 bp, Homo sapiens
cataattaggcagttgatcatt

SEQ ID NO: 8125267 - DNA, 22 bp, Homo sapiens
cataattagtcatgttatgcat

SEQ ID NO: 8125268 - DNA, 22 bp, Homo sapiens
cataattataaacgcaagttca

SEQ ID NO: 8125269 - DNA, 18 bp, Homo sapiens
cataattttctttcttta

SEQ ID NO: 8125270 - DNA, 18 bp, Homo sapiens
cataattttctttcttta

SEQ ID NO: 8125271 - DNA, 22 bp, Homo sapiens
cataatatctccgattacttgc

SEQ ID NO: 8125272 - DNA, 21 bp, Homo sapiens
tcagagagtcacagtgaactg

SEQ ID NO: 8125273 - DNA, 22 bp, Homo sapiens
tcaatcacgtgttccatgttct

SEQ ID NO: 8125274 - DNA, 22 bp, Homo sapiens
cagttctggagtttcattcttt

SEQ ID NO: 8125275 - DNA, 22 bp, Homo sapiens
tcagaggatgctgttctttaat

SEQ ID NO: 8125276 - DNA, 22 bp, Homo sapiens
tcagagtttgtactgacaggag

SEQ ID NO: 8125277 - DNA, 22 bp, Homo sapiens
tcagaggagggactcagaccca

SEQ ID NO: 8125278 - DNA, 22 bp, Homo sapiens
tcagaggagctgcagaacgctg

SEQ ID NO: 8125279 - DNA, 22 bp, Homo sapiens
tcagaggatagaaatacttatt

SEQ ID NO: 8125280 - DNA, 22 bp, Homo sapiens
tcagaggatcatgtccctactc

SEQ ID NO: 8125281 - DNA, 22 bp, Homo sapiens
tcagaggagcaaaagaggggat

SEQ ID NO: 8125282 - DNA, 22 bp, Homo sapiens
tcagaggagccaaagttctgag

SEQ ID NO: 8125283 - DNA, 22 bp, Homo sapiens
tcagaggagcaaaagaggggat

SEQ ID NO: 8125284 - DNA, 18 bp, Homo sapiens
tcagaggagatacctaaa

SEQ ID NO: 8125285 - DNA, 22 bp, Homo sapiens
catttattcatgatctgtagct

SEQ ID NO: 8125286 - DNA, 22 bp, Homo sapiens
catttattcatgatctgtagct

SEQ ID NO: 8125287 - DNA, 22 bp, Homo sapiens
tccctctacagggaagcgcttt

SEQ ID NO: 8125288 - DNA, 22 bp, Homo sapiens
tccctctctagcctgttcagta

SEQ ID NO: 8125289 - DNA, 22 bp, Homo sapiens
tccctgggtcattctctggcac

SEQ ID NO: 8125290 - DNA, 22 bp, Homo sapiens
tccctggggttcctccagccac

SEQ ID NO: 8125291 - DNA, 22 bp, Homo sapiens
catttaatcctcacaagcctat

SEQ ID NO: 8125292 - DNA, 22 bp, Homo sapiens
catttacaatgtacaggttgtg

SEQ ID NO: 8125293 - DNA, 22 bp, Homo sapiens
catttacacacagaggtgtgct

SEQ ID NO: 8125294 - DNA, 22 bp, Homo sapiens
catttacacttctaaccacaag

SEQ ID NO: 8125295 - DNA, 22 bp, Homo sapiens
tcccactcactgtctctgacac

SEQ ID NO: 8125296 - DNA, 22 bp, Homo sapiens
tcccactcactgtctctgacac

SEQ ID NO: 8125297 - DNA, 22 bp, Homo sapiens
tcccactcccaggcaggcctct

SEQ ID NO: 8125298 - DNA, 22 bp, Homo sapiens
cattctcaatagtagatgagta

SEQ ID NO: 8125299 - DNA, 22 bp, Homo sapiens
cattctccctattgaaaaagta

SEQ ID NO: 8125300 - DNA, 22 bp, Homo sapiens
tcccaaacatttttggccttga

SEQ ID NO: 8125301 - DNA, 22 bp, Homo sapiens
tcccaccccctccaaggaggaa

SEQ ID NO: 8125302 - DNA, 22 bp, Homo sapiens
tcccaccccggtcaagggctga

SEQ ID NO: 8125303 - DNA, 22 bp, Homo sapiens
tcccaccccttgactctttaag

SEQ ID NO: 8125304 - DNA, 22 bp, Homo sapiens
tcccaccccttgactctttaag

SEQ ID NO: 8125305 - DNA, 22 bp, Homo sapiens
tcccacccatcctgcatctctt

SEQ ID NO: 8125306 - DNA, 22 bp, Homo sapiens
tcccacccatcctgcatctctt

SEQ ID NO: 8125307 - DNA, 22 bp, Homo sapiens
cattctgacagctgaggtcgtg

SEQ ID NO: 8125308 - DNA, 22 bp, Homo sapiens
cattctctgatcttcacatacc

SEQ ID NO: 8125309 - DNA, 22 bp, Homo sapiens
cattctctgatcttcacatacc

SEQ ID NO: 8125310 - DNA, 22 bp, Homo sapiens
catgggcaccttaaaatgaggc

SEQ ID NO: 8125311 - DNA, 23 bp, Homo sapiens
catgggagtgagaatgccagctc

SEQ ID NO: 8125312 - DNA, 22 bp, Homo sapiens
tccattttcatctcatgtataa

SEQ ID NO: 8125313 - DNA, 22 bp, Homo sapiens
tccattttctaagtatcactta

SEQ ID NO: 8125314 - DNA, 22 bp, Homo sapiens
tccatcaccacagaggacagag

SEQ ID NO: 8125315 - DNA, 22 bp, Homo sapiens
tccatattgcagcatgtgtcag

SEQ ID NO: 8125316 - DNA, 22 bp, Homo sapiens
catgggcagttggcagggctca

SEQ ID NO: 8125317 - DNA, 22 bp, Homo sapiens
tctaagggaaggtgatatgtta

SEQ ID NO: 8125318 - DNA, 22 bp, Homo sapiens
tctaagctagtggctcatgtga

SEQ ID NO: 8125319 - DNA, 22 bp, Homo sapiens
tctaagcctcagaccacgctgc

SEQ ID NO: 8125320 - DNA, 22 bp, Homo sapiens
tctaagcctgtgtcctctgcag

SEQ ID NO: 8125321 - DNA, 22 bp, Homo sapiens
tctaatctacaaaaggaaattc

SEQ ID NO: 8125322 - DNA, 22 bp, Homo sapiens
ccacttcatcagtgctccattt

SEQ ID NO: 8125323 - DNA, 22 bp, Homo sapiens
ccacttcatcagtgctccattt

SEQ ID NO: 8125324 - DNA, 22 bp, Homo sapiens
ccactgtgcccagcctcatggg

SEQ ID NO: 8125325 - DNA, 22 bp, Homo sapiens
tctaagccgcaagcctatctgt

SEQ ID NO: 8125326 - DNA, 22 bp, Homo sapiens
ccactgtcttttccaggctgaa

SEQ ID NO: 8125327 - DNA, 22 bp, Homo sapiens
ccactgtatcttccttgaattt

SEQ ID NO: 8125328 - DNA, 22 bp, Homo sapiens
ccactgtattttggaagcagat

SEQ ID NO: 8125329 - DNA, 22 bp, Homo sapiens
ccactgtagagatttgaatgcc

SEQ ID NO: 8125330 - DNA, 21 bp, Homo sapiens
ccactgtagactcattctgag

SEQ ID NO: 8125331 - DNA, 22 bp, Homo sapiens
ccactgtagttatgatgaagtt

SEQ ID NO: 8125332 - DNA, 22 bp, Homo sapiens
ccactgtatagccactgccggt

SEQ ID NO: 8125333 - DNA, 22 bp, Homo sapiens
ccactgtaaccattatcaccat

SEQ ID NO: 8125334 - DNA, 22 bp, Homo sapiens
ccactgggggctgctcccaggt

SEQ ID NO: 8125335 - DNA, 22 bp, Homo sapiens
tcctgggcttcacagactctgt

SEQ ID NO: 8125336 - DNA, 22 bp, Homo sapiens
tcctgggcttgctcctccagct

SEQ ID NO: 8125337 - DNA, 22 bp, Homo sapiens
tccttggggacgctgacatcgt

SEQ ID NO: 8125338 - DNA, 22 bp, Homo sapiens
tccttcctgctctaacattcag

SEQ ID NO: 8125339 - DNA, 20 bp, Homo sapiens
tcctaataacctgaagaaat

SEQ ID NO: 8125340 - DNA, 20 bp, Homo sapiens
tcctactcttttaatatgtg

SEQ ID NO: 8125341 - DNA, 22 bp, Homo sapiens
tcctagaacagcccacctggaa

SEQ ID NO: 8125342 - DNA, 22 bp, Homo sapiens
tcctagaactccaggacagtcc

SEQ ID NO: 8125343 - DNA, 22 bp, Homo sapiens
ccaaggccacaaacagcctggc

SEQ ID NO: 8125344 - DNA, 22 bp, Homo sapiens
tcctggcacccttgggttggag

SEQ ID NO: 8125345 - DNA, 22 bp, Homo sapiens
tcctggcagagagcatgaggcc

SEQ ID NO: 8125346 - DNA, 22 bp, Homo sapiens
tcctggcagaaatggggctgtg

SEQ ID NO: 8125347 - DNA, 22 bp, Homo sapiens
ccaagggaaaccgagaggctgg

SEQ ID NO: 8125348 - DNA, 18 bp, Homo sapiens
tcctggcagtcagagagg

SEQ ID NO: 8125349 - DNA, 22 bp, Homo sapiens
ccacactccccgcaggcgtagg

SEQ ID NO: 8125350 - DNA, 17 bp, Homo sapiens
ccacaccctttccttcc

SEQ ID NO: 8125351 - DNA, 22 bp, Homo sapiens
ccacactgcctgttatctccca

SEQ ID NO: 8125352 - DNA, 22 bp, Homo sapiens
tcctggcagcccgcaggtgctg

SEQ ID NO: 8125353 - DNA, 21 bp, Homo sapiens
tcctggcaggcccaggaccct

SEQ ID NO: 8125354 - DNA, 22 bp, Homo sapiens
tcctggcagggtggcagcgggt

SEQ ID NO: 8125355 - DNA, 22 bp, Homo sapiens
tcctggcaggtcagcaggagca

SEQ ID NO: 8125356 - DNA, 22 bp, Homo sapiens
tcctggcaggtctgagaggtct

SEQ ID NO: 8125357 - DNA, 22 bp, Homo sapiens
tcctggcagtaatttgatgttg

SEQ ID NO: 8125358 - DNA, 22 bp, Homo sapiens
tcctggcaggtgtattggctgt

SEQ ID NO: 8125359 - DNA, 22 bp, Homo sapiens
tcctgggctgtgtgccactctg

SEQ ID NO: 8125360 - DNA, 22 bp, Homo sapiens
ttgtacaacgttttaaatttga

SEQ ID NO: 8125361 - DNA, 22 bp, Homo sapiens
ctccagattccgtttattcagg

SEQ ID NO: 8125362 - DNA, 22 bp, Homo sapiens
ttctttcttagcaatctatggt

SEQ ID NO: 8125363 - DNA, 23 bp, Homo sapiens
ttgaaaggtagctggcagctaga

SEQ ID NO: 8125364 - DNA, 22 bp, Homo sapiens
ttcttttcccaatattttgctg

SEQ ID NO: 8125365 - DNA, 22 bp, Homo sapiens
ttcttttcctgtggctcatcca

SEQ ID NO: 8125366 - DNA, 22 bp, Homo sapiens
ttgaaatactgcattgttcagt

SEQ ID NO: 8125367 - DNA, 22 bp, Homo sapiens
ttgaaagtccttcttgagttac

SEQ ID NO: 8125368 - DNA, 22 bp, Homo sapiens
ttgaaagtagaatgtatgtgga

SEQ ID NO: 8125369 - DNA, 22 bp, Homo sapiens
ttgaaagttaggatttagctgg

SEQ ID NO: 8125370 - DNA, 22 bp, Homo sapiens
ttgaaagtttatggagtctgca

SEQ ID NO: 8125371 - DNA, 22 bp, Homo sapiens
ctcccactcctggctcaccaca

SEQ ID NO: 8125372 - DNA, 22 bp, Homo sapiens
ctcccactcctggctcaccaca

SEQ ID NO: 8125373 - DNA, 22 bp, Homo sapiens
ctcccagaaaattctcagacaa

SEQ ID NO: 8125374 - DNA, 22 bp, Homo sapiens
ctcccagaaaattctcagacaa

SEQ ID NO: 8125375 - DNA, 22 bp, Homo sapiens
ctcccagacatgtgcctccttg

SEQ ID NO: 8125376 - DNA, 22 bp, Homo sapiens
ctcccaagataaataaggcagt

SEQ ID NO: 8125377 - DNA, 22 bp, Homo sapiens
ctcccagccttcgccagtctga

SEQ ID NO: 8125378 - DNA, 22 bp, Homo sapiens
ctcccagacatgtgcctccttg

SEQ ID NO: 8125379 - DNA, 22 bp, Homo sapiens
ctcccagagaccaagctgagaa

SEQ ID NO: 8125380 - DNA, 22 bp, Homo sapiens
tttaatatccagtggatacaaa

SEQ ID NO: 8125381 - DNA, 22 bp, Homo sapiens
tttaagttccttttcaacaact

SEQ ID NO: 8125382 - DNA, 22 bp, Homo sapiens
ctcccctccttaggtcttctag

SEQ ID NO: 8125383 - DNA, 22 bp, Homo sapiens
ctccccttcttgccagatcctt

SEQ ID NO: 8125384 - DNA, 22 bp, Homo sapiens
ctccccttccgccagctcttga

SEQ ID NO: 8125385 - DNA, 19 bp, Homo sapiens
tttagacattgtctggtat

SEQ ID NO: 8125386 - DNA, 22 bp, Homo sapiens
ctccccatggcaacagttatgg

SEQ ID NO: 8125387 - DNA, 17 bp, Homo sapiens
ctcctggcagcctcagg

SEQ ID NO: 8125388 - DNA, 22 bp, Homo sapiens
ctcctggccacgttcttgctgg

SEQ ID NO: 8125389 - DNA, 22 bp, Homo sapiens
ctcctccagtgggtccctcagg

SEQ ID NO: 8125390 - DNA, 20 bp, Homo sapiens
tttcctaagtggtttgctga

SEQ ID NO: 8125391 - DNA, 22 bp, Homo sapiens
tttcctcacacagaagatcttg

SEQ ID NO: 8125392 - DNA, 22 bp, Homo sapiens
tttcctcaactgtcaaatgggg

SEQ ID NO: 8125393 - DNA, 22 bp, Homo sapiens
tttcctcactcatgtcatcagt

SEQ ID NO: 8125394 - DNA, 22 bp, Homo sapiens
ctctccaggctgggacaggacc

SEQ ID NO: 8125395 - DNA, 22 bp, Homo sapiens
ctctccaggagctcagagtcta

SEQ ID NO: 8125396 - DNA, 22 bp, Homo sapiens
ctctccaggagctcagagtcta

SEQ ID NO: 8125397 - DNA, 22 bp, Homo sapiens
ctctccagggaagcagtgtact

SEQ ID NO: 8125398 - DNA, 22 bp, Homo sapiens
ctctccaggggtagatgccttc

SEQ ID NO: 8125399 - DNA, 22 bp, Homo sapiens
ctctccagtcatattctcagtc

SEQ ID NO: 8125400 - DNA, 22 bp, Homo sapiens
ctctcctggggagcacacacac

SEQ ID NO: 8125401 - DNA, 22 bp, Homo sapiens
ctctcctggtgtggaggacagg

SEQ ID NO: 8125402 - DNA, 22 bp, Homo sapiens
ctctcctggtgtggaggacagg

SEQ ID NO: 8125403 - DNA, 20 bp, Homo sapiens
ctctctctccattcccaggg

SEQ ID NO: 8125404 - DNA, 22 bp, Homo sapiens
tttccttgcctcctgtccttct

SEQ ID NO: 8125405 - DNA, 22 bp, Homo sapiens
ctctgttgtcagtggaagcagc

SEQ ID NO: 8125406 - DNA, 22 bp, Homo sapiens
ctcttcaaaagtctaatcctta

SEQ ID NO: 8125407 - DNA, 22 bp, Homo sapiens
tttgtacactgtctactatgaa

SEQ ID NO: 8125408 - DNA, 22 bp, Homo sapiens
ttttaagaactgttctgtgctt

SEQ ID NO: 8125409 - DNA, 22 bp, Homo sapiens
ttttagaatcaggttgtctggg

SEQ ID NO: 8125410 - DNA, 22 bp, Homo sapiens
ttttaagttaatataattgagg

SEQ ID NO: 8125411 - DNA, 22 bp, Homo sapiens
ttttaagatgctagtatttcag

SEQ ID NO: 8125412 - DNA, 22 bp, Homo sapiens
ctctggaaaaccactagcagga

SEQ ID NO: 8125413 - DNA, 22 bp, Homo sapiens
ctctggaaaattgtgtgggggt

SEQ ID NO: 8125414 - DNA, 22 bp, Homo sapiens
ctctggaaatggccatagtcat

SEQ ID NO: 8125415 - DNA, 22 bp, Homo sapiens
tttgctcttgctgcttggggca

SEQ ID NO: 8125416 - DNA, 22 bp, Homo sapiens
tttgggaaggcagacatcccac

SEQ ID NO: 8125417 - DNA, 19 bp, Homo sapiens
tttgggaagcccagagtgt

SEQ ID NO: 8125418 - DNA, 22 bp, Homo sapiens
tttgggaaatagtagaaaatgt

SEQ ID NO: 8125419 - DNA, 22 bp, Homo sapiens
tttgggaaataaacctagagga

SEQ ID NO: 8125420 - DNA, 22 bp, Homo sapiens
tttgggaaatattgtgttcaag

SEQ ID NO: 8125421 - DNA, 20 bp, Homo sapiens
tttgggaaatgcaggtttca

SEQ ID NO: 8125422 - DNA, 22 bp, Homo sapiens
tttgggaaccagaagttcaaaa

SEQ ID NO: 8125423 - DNA, 22 bp, Homo sapiens
tttgggaacaatgaggatctga

SEQ ID NO: 8125424 - DNA, 22 bp, Homo sapiens
ctctggaatgtttacatgccct

SEQ ID NO: 8125425 - DNA, 22 bp, Homo sapiens
ctctggaatgggtgtttctaac

SEQ ID NO: 8125426 - DNA, 22 bp, Homo sapiens
ctctggaagaatacacttagaa

SEQ ID NO: 8125427 - DNA, 22 bp, Homo sapiens
ctctggaagtgatggcaggtca

SEQ ID NO: 8125428 - DNA, 20 bp, Homo sapiens
ctctggaagagtttaaatgg

SEQ ID NO: 8125429 - DNA, 22 bp, Homo sapiens
ctctggaagatgacctgggtaa

SEQ ID NO: 8125430 - DNA, 22 bp, Homo sapiens
ctctgcagaggcccaaggctga

SEQ ID NO: 8125431 - DNA, 19 bp, Homo sapiens
ctctgccatttgctgcctg

SEQ ID NO: 8125432 - DNA, 22 bp, Homo sapiens
ctctgccatcttggagctcaag

SEQ ID NO: 8125433 - DNA, 22 bp, Homo sapiens
tttgcaaagtgcttgcagagta

SEQ ID NO: 8125434 - DNA, 19 bp, Homo sapiens
ctctgcctccctcctgggt

SEQ ID NO: 8125435 - DNA, 22 bp, Homo sapiens
ctctgcccgcggatgccacgtc

SEQ ID NO: 8125436 - DNA, 22 bp, Homo sapiens
ctctgcccgtgcctttcccagt

SEQ ID NO: 8125437 - DNA, 22 bp, Homo sapiens
ctctgcccagtgcccacaggag

SEQ ID NO: 8125438 - DNA, 22 bp, Homo sapiens
ctctgcccagtgcccacaggag

SEQ ID NO: 8125439 - DNA, 21 bp, Homo sapiens
ctctgcccagggcctcctgcc

SEQ ID NO: 8125440 - DNA, 21 bp, Homo sapiens
ctctgcccagggcctcctgcc

SEQ ID NO: 8125441 - DNA, 21 bp, Homo sapiens
ctctgcccagggcctcctgcc

SEQ ID NO: 8125442 - DNA, 22 bp, Homo sapiens
ctgcacagagcagggcagacac

SEQ ID NO: 8125443 - DNA, 21 bp, Homo sapiens
ctgcaaatacctagttatctg

SEQ ID NO: 8125444 - DNA, 22 bp, Homo sapiens
ctgcacagtggacagtgaagat

SEQ ID NO: 8125445 - DNA, 22 bp, Homo sapiens
ctgaggcatgttacaggacata

SEQ ID NO: 8125446 - DNA, 22 bp, Homo sapiens
ctgcacagtgttggaagctgcc

SEQ ID NO: 8125447 - DNA, 22 bp, Homo sapiens
ctgcaccatctggagcacctcc

SEQ ID NO: 8125448 - DNA, 22 bp, Homo sapiens
ctgcagggatgtgaggcccgtt

SEQ ID NO: 8125449 - DNA, 22 bp, Homo sapiens
ctgcagggcccgcctgagccct

SEQ ID NO: 8125450 - DNA, 22 bp, Homo sapiens
ctgacagcgagagagttgcccc

SEQ ID NO: 8125451 - DNA, 22 bp, Homo sapiens
ctgacagctgaattgcttgcat

SEQ ID NO: 8125452 - DNA, 22 bp, Homo sapiens
ctgacagggtagacagagggca

SEQ ID NO: 8125453 - DNA, 20 bp, Homo sapiens
ctgaccagcagcctgtctcc

SEQ ID NO: 8125454 - DNA, 22 bp, Homo sapiens
ctgaggcagagggcagaccaga

SEQ ID NO: 8125455 - DNA, 19 bp, Homo sapiens
ctgagcctcagtttcctag

SEQ ID NO: 8125456 - DNA, 22 bp, Homo sapiens
ctgactccttaccatatgcttt

SEQ ID NO: 8125457 - DNA, 22 bp, Homo sapiens
ctgactccctccccaaagctgg

SEQ ID NO: 8125458 - DNA, 22 bp, Homo sapiens
tggggcagctccatctattcca

SEQ ID NO: 8125459 - DNA, 22 bp, Homo sapiens
tggggcagcagacctttcttgg

SEQ ID NO: 8125460 - DNA, 22 bp, Homo sapiens
tgggggaagagcttgttaaagt

SEQ ID NO: 8125461 - DNA, 22 bp, Homo sapiens
tgggggaaattcagccagatat

SEQ ID NO: 8125462 - DNA, 22 bp, Homo sapiens
cctgggcaatatagtgaggccc

SEQ ID NO: 8125463 - DNA, 22 bp, Homo sapiens
cctgggcaacatagggagaccc

SEQ ID NO: 8125464 - DNA, 22 bp, Homo sapiens
cctgggcaaattatgttactca

SEQ ID NO: 8125465 - DNA, 22 bp, Homo sapiens
cctgggcaaatgccagagacaa

SEQ ID NO: 8125466 - DNA, 22 bp, Homo sapiens
cctgggcaacatagtgagacct

SEQ ID NO: 8125467 - DNA, 22 bp, Homo sapiens
cctgggcaacatagtgagaccc

SEQ ID NO: 8125468 - DNA, 22 bp, Homo sapiens
tgttcatctggcaggcatagcc

SEQ ID NO: 8125469 - DNA, 22 bp, Homo sapiens
tgttcagtttgctatcataatc

SEQ ID NO: 8125470 - DNA, 22 bp, Homo sapiens
cctggtggcgaatggtggtagg

SEQ ID NO: 8125471 - DNA, 22 bp, Homo sapiens
cctgggctgggcgtctcatggg

SEQ ID NO: 8125472 - DNA, 22 bp, Homo sapiens
cctgggctggagtacagcagtg

SEQ ID NO: 8125473 - DNA, 22 bp, Homo sapiens
tgttacaaggaagaatgtaggt

SEQ ID NO: 8125474 - DNA, 18 bp, Homo sapiens
cctgtctggggtccccac

SEQ ID NO: 8125475 - DNA, 22 bp, Homo sapiens
cctgtctgggcttgagtattta

SEQ ID NO: 8125476 - DNA, 22 bp, Homo sapiens
cctgtctggccttccacggggg

SEQ ID NO: 8125477 - DNA, 22 bp, Homo sapiens
cctgtctgtcctttgcattctt

SEQ ID NO: 8125478 - DNA, 22 bp, Homo sapiens
cctgtctgcatgatccctgcca

SEQ ID NO: 8125479 - DNA, 22 bp, Homo sapiens
cctgtctgcatgagtgagcata

SEQ ID NO: 8125480 - DNA, 22 bp, Homo sapiens
cctgtctgcaaggggtggatcc

SEQ ID NO: 8125481 - DNA, 20 bp, Homo sapiens
cctgtctgcaatggaggtca

SEQ ID NO: 8125482 - DNA, 22 bp, Homo sapiens
cctgtcagccccacttctgcct

SEQ ID NO: 8125483 - DNA, 22 bp, Homo sapiens
cctgtgggtcacatgggtgact

SEQ ID NO: 8125484 - DNA, 22 bp, Homo sapiens
ttaaagtaatctgtgtgaattt

SEQ ID NO: 8125485 - DNA, 22 bp, Homo sapiens
ttagaaaacataagtggtaaag

SEQ ID NO: 8125486 - DNA, 23 bp, Homo sapiens
ttagacaatcctcaaaaggtaat

SEQ ID NO: 8125487 - DNA, 22 bp, Homo sapiens
ttagaatctttagagtctcact

SEQ ID NO: 8125488 - DNA, 23 bp, Homo sapiens
ttacttttgcaccaacctaatat

SEQ ID NO: 8125489 - DNA, 23 bp, Homo sapiens
ttacttttgcaccaacctaatat

SEQ ID NO: 8125490 - DNA, 22 bp, Homo sapiens
ccttctcagccccagctcccgc

SEQ ID NO: 8125491 - DNA, 22 bp, Homo sapiens
cctgtgtgctgatgacgacaga

SEQ ID NO: 8125492 - DNA, 22 bp, Homo sapiens
ccttcctggagcccatgcagat

SEQ ID NO: 8125493 - DNA, 19 bp, Homo sapiens
ccttccccttcagcctctg

SEQ ID NO: 8125494 - DNA, 22 bp, Homo sapiens
ccttccctaaagcgtcgcttag

SEQ ID NO: 8125495 - DNA, 17 bp, Homo sapiens
ccttcctcatctccttc

SEQ ID NO: 8125496 - DNA, 17 bp, Homo sapiens
ccttcctcatctccttc

SEQ ID NO: 8125497 - DNA, 22 bp, Homo sapiens
ttccaggacttcatggctctga

SEQ ID NO: 8125498 - DNA, 22 bp, Homo sapiens
ctacagagaactcagctgccct

SEQ ID NO: 8125499 - DNA, 22 bp, Homo sapiens
ctacttgttcactgtaggtcgc

SEQ ID NO: 8125500 - DNA, 22 bp, Homo sapiens
ctacttagagacatgctaacat

SEQ ID NO: 8125501 - DNA, 22 bp, Homo sapiens
ttctctggagagtatcttctta

SEQ ID NO: 8125502 - DNA, 21 bp, Homo sapiens
ctaccctcactcccattcctc

SEQ ID NO: 8125503 - DNA, 22 bp, Homo sapiens
ctactctcccatgattctctgt

SEQ ID NO: 8125504 - DNA, 22 bp, Homo sapiens
ctattaaacactactgtgcact

SEQ ID NO: 8125505 - DNA, 22 bp, Homo sapiens
ctcacagatgttctcctttagg

SEQ ID NO: 8125506 - DNA, 22 bp, Homo sapiens
ctcacagatgtcctggcacttc

SEQ ID NO: 8125507 - DNA, 22 bp, Homo sapiens
ctcacagatatttgcttcaggt

SEQ ID NO: 8125508 - DNA, 22 bp, Homo sapiens
ctcacagatgatgtctatgtgg

SEQ ID NO: 8125509 - DNA, 22 bp, Homo sapiens
ctcacagatctgtgcctgaacc

SEQ ID NO: 8125510 - DNA, 22 bp, Homo sapiens
ctcacactgtgccaaatccttt

SEQ ID NO: 8125511 - DNA, 22 bp, Homo sapiens
ctcacacttcccaccctcctgg

SEQ ID NO: 8125512 - DNA, 22 bp, Homo sapiens
ctcacagagcctctgtgtcttc

SEQ ID NO: 8125513 - DNA, 22 bp, Homo sapiens
ctcacaccagcttacaagactt

SEQ ID NO: 8125514 - DNA, 22 bp, Homo sapiens
ctcaagtaattagcaacaaata

SEQ ID NO: 8125515 - DNA, 22 bp, Homo sapiens
ctattatttcctcatctataaa

SEQ ID NO: 8125516 - DNA, 22 bp, Homo sapiens
ctattagctgaataatgcattg

SEQ ID NO: 8125517 - DNA, 22 bp, Homo sapiens
ttcatctggaatttatgttata

SEQ ID NO: 8125518 - DNA, 22 bp, Homo sapiens
ttcatctgcttcttgattttgc

SEQ ID NO: 8125519 - DNA, 22 bp, Homo sapiens
cggtggagtgctcagctgaacc

SEQ ID NO: 8125520 - DNA, 22 bp, Homo sapiens
cggtcaggtgcagcgttggcac

SEQ ID NO: 8125521 - DNA, 22 bp, Homo sapiens
ctaaataatccctctggtctta

SEQ ID NO: 8125522 - DNA, 22 bp, Homo sapiens
ctaaagtgccaggaatacaggt

SEQ ID NO: 8125523 - DNA, 22 bp, Homo sapiens
ctaaagaagctagcaatctata

SEQ ID NO: 8125524 - DNA, 22 bp, Homo sapiens
ttcacaccaggtatttatattt

SEQ ID NO: 8125525 - DNA, 22 bp, Homo sapiens
ttcagatgattagaatagtatt

SEQ ID NO: 8125526 - DNA, 22 bp, Homo sapiens
ttcagggagagcgggacgggtg

SEQ ID NO: 8125527 - DNA, 22 bp, Homo sapiens
ttcagggactttgatgtatcag

SEQ ID NO: 8125528 - DNA, 22 bp, Homo sapiens
cctttctacagatgcctcttgc

SEQ ID NO: 8125529 - DNA, 22 bp, Homo sapiens
cctttctaagatactgcaactt

SEQ ID NO: 8125530 - DNA, 22 bp, Homo sapiens
cctttctacagatgcctcttgc

SEQ ID NO: 8125531 - DNA, 22 bp, Homo sapiens
cctttctctttgctgatcatgt

SEQ ID NO: 8125532 - DNA, 22 bp, Homo sapiens
ttaggaggtctatggacatcct

SEQ ID NO: 8125533 - DNA, 22 bp, Homo sapiens
ttaggaatgagatttctagtga

SEQ ID NO: 8125534 - DNA, 22 bp, Homo sapiens
cgcatccagggcgcaggatctg

SEQ ID NO: 8125535 - DNA, 22 bp, Homo sapiens
cgccaggcttggtagctcatgc

SEQ ID NO: 8125536 - DNA, 22 bp, Homo sapiens
cgcattatccgtccagcagact

SEQ ID NO: 8125537 - DNA, 22 bp, Homo sapiens
cgcccagctgaaatctccaggc

SEQ ID NO: 8125538 - DNA, 22 bp, Homo sapiens
ttcaagtctgcccagagtcagc

SEQ ID NO: 8125539 - DNA, 22 bp, Homo sapiens
ctggcctgtgggctgtctccgg

SEQ ID NO: 8125540 - DNA, 22 bp, Homo sapiens
ctggctcacctccgctccagca

SEQ ID NO: 8125541 - DNA, 22 bp, Homo sapiens
ctggctcaggaaagttgctgct

SEQ ID NO: 8125542 - DNA, 22 bp, Homo sapiens
ctggccctatgagcctcctgat

SEQ ID NO: 8125543 - DNA, 22 bp, Homo sapiens
ctggccctcggagtccagctgc

SEQ ID NO: 8125544 - DNA, 22 bp, Homo sapiens
ctggctcattttagcatcaggt

SEQ ID NO: 8125545 - DNA, 23 bp, Homo sapiens
ctggctcatcctggttgcagtgg

SEQ ID NO: 8125546 - DNA, 22 bp, Homo sapiens
ctggctcatagagcagctccaa

SEQ ID NO: 8125547 - DNA, 22 bp, Homo sapiens
ctggccagctgacagcagggct

SEQ ID NO: 8125548 - DNA, 20 bp, Homo sapiens
ctggcaggagcgagtctacc

SEQ ID NO: 8125549 - DNA, 22 bp, Homo sapiens
ctggcaggagcattcacagagg

SEQ ID NO: 8125550 - DNA, 22 bp, Homo sapiens
ctggcaggcggaggttgcagtg

SEQ ID NO: 8125551 - DNA, 22 bp, Homo sapiens
ctggcaggcagacttctgcaag

SEQ ID NO: 8125552 - DNA, 22 bp, Homo sapiens
ctggcaggcggcagagcccagg

SEQ ID NO: 8125553 - DNA, 18 bp, Homo sapiens
ctgccacttaatgtggtg

SEQ ID NO: 8125554 - DNA, 22 bp, Homo sapiens
ctgcatccatgttgctgcaaag

SEQ ID NO: 8125555 - DNA, 22 bp, Homo sapiens
ctgcatccatctcctagcacag

SEQ ID NO: 8125556 - DNA, 22 bp, Homo sapiens
ctgccacaagctggccctgtgt

SEQ ID NO: 8125557 - DNA, 22 bp, Homo sapiens
ctgccagctcaaagcgcagcta

SEQ ID NO: 8125558 - DNA, 22 bp, Homo sapiens
ctggcaggaaggcatttagaca

SEQ ID NO: 8125559 - DNA, 22 bp, Homo sapiens
ctggcagcttcctttgcatctg

SEQ ID NO: 8125560 - DNA, 22 bp, Homo sapiens
ctggcagcttcaggacactcgg

SEQ ID NO: 8125561 - DNA, 22 bp, Homo sapiens
ctggcagcccaacctagagtct

SEQ ID NO: 8125562 - DNA, 22 bp, Homo sapiens
ctgggctgctgtccactagggt

SEQ ID NO: 8125563 - DNA, 22 bp, Homo sapiens
ctgggctgcagcgggagcgacg

SEQ ID NO: 8125564 - DNA, 22 bp, Homo sapiens
ctgggctctaggaaccattcct

SEQ ID NO: 8125565 - DNA, 22 bp, Homo sapiens
ctggggctgcggtggaggagcc

SEQ ID NO: 8125566 - DNA, 22 bp, Homo sapiens
ctggggctgcggacgggagccc

SEQ ID NO: 8125567 - DNA, 22 bp, Homo sapiens
ctggggccagtgaggaggcttt

SEQ ID NO: 8125568 - DNA, 22 bp, Homo sapiens
ctggggcccgagccttgggcca

SEQ ID NO: 8125569 - DNA, 22 bp, Homo sapiens
ctggggctcactccagccctgg

SEQ ID NO: 8125570 - DNA, 22 bp, Homo sapiens
ctgggcagtttattcagttctg

SEQ ID NO: 8125571 - DNA, 22 bp, Homo sapiens
ctgggcagtttattcagttctg

SEQ ID NO: 8125572 - DNA, 22 bp, Homo sapiens
ctgggcagttttacatcattgc

SEQ ID NO: 8125573 - DNA, 22 bp, Homo sapiens
ctgtgccatcctagggctgctg

SEQ ID NO: 8125574 - DNA, 22 bp, Homo sapiens
ctgtgcagtggggctctgggtt

SEQ ID NO: 8125575 - DNA, 22 bp, Homo sapiens
ctgtgcatggccatcagtgccc

SEQ ID NO: 8125576 - DNA, 22 bp, Homo sapiens
ctgtgccacctgagggactcta

SEQ ID NO: 8125577 - DNA, 22 bp, Homo sapiens
ctgtgccagcctgtcccaggag

SEQ ID NO: 8125578 - DNA, 22 bp, Homo sapiens
ctgtgcagtggcagcgtgtggg

SEQ ID NO: 8125579 - DNA, 22 bp, Homo sapiens
ctgtcctgcccaccctgcaggg

SEQ ID NO: 8125580 - DNA, 22 bp, Homo sapiens
ctgggtgctgtgggctcagagg

SEQ ID NO: 8125581 - DNA, 22 bp, Homo sapiens
ctgtcctctgtcctcagcagga

SEQ ID NO: 8125582 - DNA, 22 bp, Homo sapiens
ctgtcctctgtcctcagcagga

SEQ ID NO: 8125583 - DNA, 22 bp, Homo sapiens
ctgtggctctgcagtcccaaca

SEQ ID NO: 8125584 - DNA, 22 bp, Homo sapiens
ctgtgtctaatcaggtcagtca

SEQ ID NO: 8125585 - DNA, 22 bp, Homo sapiens
ctgtgtacccacgtgggcaccc

SEQ ID NO: 8125586 - DNA, 22 bp, Homo sapiens
ctgtggctgtctctttcccatg

SEQ ID NO: 8125587 - DNA, 22 bp, Homo sapiens
ctgttctgaactgcctgcatgc

SEQ ID NO: 8125588 - DNA, 22 bp, Homo sapiens
cttattttaagtcagtttgggt

SEQ ID NO: 8125589 - DNA, 22 bp, Homo sapiens
cttattttgctgatgacccagg

SEQ ID NO: 8125590 - DNA, 22 bp, Homo sapiens
ctgttgttcatcatctgtcatt

SEQ ID NO: 8125591 - DNA, 22 bp, Homo sapiens
ctgttgtttgctagtgtactct

SEQ ID NO: 8125592 - DNA, 22 bp, Homo sapiens
ctgttgtccctgggagctcagc

SEQ ID NO: 8125593 - DNA, 22 bp, Homo sapiens
cttccctttttatgtcttcagc

SEQ ID NO: 8125594 - DNA, 22 bp, Homo sapiens
cttcctctcttgcccataagag

SEQ ID NO: 8125595 - DNA, 22 bp, Homo sapiens
cttcctctgcctcccgtgctca

SEQ ID NO: 8125596 - DNA, 22 bp, Homo sapiens
cttcctgaacaatgccatcaat

SEQ ID NO: 8125597 - DNA, 22 bp, Homo sapiens
cttcctgaaggatggcagcctc

SEQ ID NO: 8125598 - DNA, 22 bp, Homo sapiens
cttcctgaggtgctgagcacag

SEQ ID NO: 8125599 - DNA, 22 bp, Homo sapiens
cttcagctgcagttatgtttag

SEQ ID NO: 8125600 - DNA, 22 bp, Homo sapiens
cttgcagcatccggtcctctct

SEQ ID NO: 8125601 - DNA, 22 bp, Homo sapiens
cttgacattcttaataatttta

SEQ ID NO: 8125602 - DNA, 22 bp, Homo sapiens
cttcctgggccctgcttaagca

SEQ ID NO: 8125603 - DNA, 22 bp, Homo sapiens
cttcctgggtcagcctggaggt

SEQ ID NO: 8125604 - DNA, 22 bp, Homo sapiens
cttcctggccattgccatggca

SEQ ID NO: 8125605 - DNA, 22 bp, Homo sapiens
cttcctgcccacttcctgctgg

SEQ ID NO: 8125606 - DNA, 22 bp, Homo sapiens
cttgtcagccaattgtggattt

SEQ ID NO: 8125607 - DNA, 20 bp, Homo sapiens
cttgcccagggtctcctgcc

SEQ ID NO: 8125608 - DNA, 22 bp, Homo sapiens
cttgccaggatcagagtcacag

SEQ ID NO: 8125609 - DNA, 22 bp, Homo sapiens
cttgtagaattgaaatggtctc

SEQ ID NO: 8125610 - DNA, 18 bp, Homo sapiens
gacaggtgggtgagacca

SEQ ID NO: 8125611 - DNA, 22 bp, Homo sapiens
gacagggtggctgatagggctc

SEQ ID NO: 8125612 - DNA, 22 bp, Homo sapiens
gacccagggtttctgcacaggg

SEQ ID NO: 8125613 - DNA, 22 bp, Homo sapiens
gacagtagtaaagctaggacca

SEQ ID NO: 8125614 - DNA, 17 bp, Homo sapiens
gacaggctcagtgacga

SEQ ID NO: 8125615 - DNA, 23 bp, Homo sapiens
gacagggctgacttggcagctgc

SEQ ID NO: 8125616 - DNA, 22 bp, Homo sapiens
gacagggctgtgggaggagcag

SEQ ID NO: 8125617 - DNA, 21 bp, Homo sapiens
gacaggggaagaagcaaggag

SEQ ID NO: 8125618 - DNA, 22 bp, Homo sapiens
gacaggggtccctctgggctgt

SEQ ID NO: 8125619 - DNA, 22 bp, Homo sapiens
gacaggctttgagtcccagaac

SEQ ID NO: 8125620 - DNA, 22 bp, Homo sapiens
gacaggcttcctaagtgccaga

SEQ ID NO: 8125621 - DNA, 17 bp, Homo sapiens
gacaggctcagtgacga

SEQ ID NO: 8125622 - DNA, 22 bp, Homo sapiens
gacaggcttcatcctcagagtt

SEQ ID NO: 8125623 - DNA, 22 bp, Homo sapiens
gacaacaggcagacgtcagaaa

SEQ ID NO: 8125624 - DNA, 22 bp, Homo sapiens
gaatatgttctggaagttcttg

SEQ ID NO: 8125625 - DNA, 22 bp, Homo sapiens
gaatatgaccttatttggagat

SEQ ID NO: 8125626 - DNA, 22 bp, Homo sapiens
gaatatgagtgtccctgaggtc

SEQ ID NO: 8125627 - DNA, 22 bp, Homo sapiens
gacaagacacctctctccatcc

SEQ ID NO: 8125628 - DNA, 17 bp, Homo sapiens
gacaagacagaattcat

SEQ ID NO: 8125629 - DNA, 22 bp, Homo sapiens
gacaagacagcttgcagacaac

SEQ ID NO: 8125630 - DNA, 22 bp, Homo sapiens
gacaagacatgtgatgacatca

SEQ ID NO: 8125631 - DNA, 22 bp, Homo sapiens
gacaagactatgtagaaagtat

SEQ ID NO: 8125632 - DNA, 22 bp, Homo sapiens
gacaagacattggtaaagatat

SEQ ID NO: 8125633 - DNA, 22 bp, Homo sapiens
gacaagactggtttatttaagg

SEQ ID NO: 8125634 - DNA, 22 bp, Homo sapiens
gaatacattggaaatcagaata

SEQ ID NO: 8125635 - DNA, 22 bp, Homo sapiens
gaatacatgattaaagtttgat

SEQ ID NO: 8125636 - DNA, 22 bp, Homo sapiens
gaatacattggaaatcagaata

SEQ ID NO: 8125637 - DNA, 23 bp, Homo sapiens
gaatagttttagaaattggagaa

SEQ ID NO: 8125638 - DNA, 22 bp, Homo sapiens
gaatatattggtgaaaatagtt

SEQ ID NO: 8125639 - DNA, 22 bp, Homo sapiens
gaatatattggtgaaaatagtt

SEQ ID NO: 8125640 - DNA, 22 bp, Homo sapiens
gaagttgatagagtacatgatt

SEQ ID NO: 8125641 - DNA, 22 bp, Homo sapiens
gaatacatgatacatgaactgc

SEQ ID NO: 8125642 - DNA, 22 bp, Homo sapiens
gaatacatccagagcagggctg

SEQ ID NO: 8125643 - DNA, 22 bp, Homo sapiens
gaataacattggaaccctgaag

SEQ ID NO: 8125644 - DNA, 22 bp, Homo sapiens
gaataacattttttcctttaca

SEQ ID NO: 8125645 - DNA, 22 bp, Homo sapiens
gaataacagcaagtttgcaggc

SEQ ID NO: 8125646 - DNA, 22 bp, Homo sapiens
gaataacattggaaccctgaag

SEQ ID NO: 8125647 - DNA, 22 bp, Homo sapiens
gaaatatttctcttgagcccct

SEQ ID NO: 8125648 - DNA, 22 bp, Homo sapiens
ctttcataattcagcacattga

SEQ ID NO: 8125649 - DNA, 22 bp, Homo sapiens
ctttccaactctagtgaaattt

SEQ ID NO: 8125650 - DNA, 22 bp, Homo sapiens
ctttcattcttagatattagtg

SEQ ID NO: 8125651 - DNA, 22 bp, Homo sapiens
gaaatgcatggatcttggcaga

SEQ ID NO: 8125652 - DNA, 22 bp, Homo sapiens
gaacagtgaactgatttgtaaa

SEQ ID NO: 8125653 - DNA, 22 bp, Homo sapiens
gaacagtgccagcacacaataa

SEQ ID NO: 8125654 - DNA, 17 bp, Homo sapiens
gaacagtgtaagacact

SEQ ID NO: 8125655 - DNA, 22 bp, Homo sapiens
gaacagggttgggtgagagagg

SEQ ID NO: 8125656 - DNA, 22 bp, Homo sapiens
gaacagggttgggtgagagagg

SEQ ID NO: 8125657 - DNA, 21 bp, Homo sapiens
gaacaggaaaagctggcttca

SEQ ID NO: 8125658 - DNA, 22 bp, Homo sapiens
gaacaggaacatattggctctc

SEQ ID NO: 8125659 - DNA, 22 bp, Homo sapiens
gaagatattctctaaatacttt

SEQ ID NO: 8125660 - DNA, 22 bp, Homo sapiens
gaagatacctcaattctttgaa

SEQ ID NO: 8125661 - DNA, 22 bp, Homo sapiens
gaagccagattatcacaagcca

SEQ ID NO: 8125662 - DNA, 22 bp, Homo sapiens
gaagccagcagtggagaaagga

SEQ ID NO: 8125663 - DNA, 22 bp, Homo sapiens
gaagccagccttgtctgcctct

SEQ ID NO: 8125664 - DNA, 22 bp, Homo sapiens
gaagccaggggcctgacaggca

SEQ ID NO: 8125665 - DNA, 22 bp, Homo sapiens
gaagccagtgtttgaagaattt

SEQ ID NO: 8125666 - DNA, 22 bp, Homo sapiens
gaagccagtactgtgctctgca

SEQ ID NO: 8125667 - DNA, 22 bp, Homo sapiens
gaagcccagcaaactgtgatca

SEQ ID NO: 8125668 - DNA, 22 bp, Homo sapiens
gaagcccaagcttcacagctat

SEQ ID NO: 8125669 - DNA, 22 bp, Homo sapiens
gaagcccagggcgtggccgggc

SEQ ID NO: 8125670 - DNA, 22 bp, Homo sapiens
gaagacatgtttttaatatgta

SEQ ID NO: 8125671 - DNA, 22 bp, Homo sapiens
gaacatttggcatgagaatttg

SEQ ID NO: 8125672 - DNA, 22 bp, Homo sapiens
gaagaggatgacaggagccggt

SEQ ID NO: 8125673 - DNA, 22 bp, Homo sapiens
gaagaggatgacaggagccggt

SEQ ID NO: 8125674 - DNA, 22 bp, Homo sapiens
gaagagaagcatcaataggtaa

SEQ ID NO: 8125675 - DNA, 22 bp, Homo sapiens
gaagagaaaggcaaggagtttt

SEQ ID NO: 8125676 - DNA, 22 bp, Homo sapiens
gaagagctccaaaaacagtgag

SEQ ID NO: 8125677 - DNA, 22 bp, Homo sapiens
gagctgaaatatgaagccaatt

SEQ ID NO: 8125678 - DNA, 19 bp, Homo sapiens
gagctgagagtagcactgg

SEQ ID NO: 8125679 - DNA, 22 bp, Homo sapiens
gagcgggaggaacggctcgggc

SEQ ID NO: 8125680 - DNA, 22 bp, Homo sapiens
gagccctttccactgccctctg

SEQ ID NO: 8125681 - DNA, 22 bp, Homo sapiens
gagccctgttcaggcctcctca

SEQ ID NO: 8125682 - DNA, 22 bp, Homo sapiens
gagcggaggcttggaggccagc

SEQ ID NO: 8125683 - DNA, 22 bp, Homo sapiens
gaggcagaagttgcagtgagca

SEQ ID NO: 8125684 - DNA, 22 bp, Homo sapiens
gaggcagaggaaggtggtctct

SEQ ID NO: 8125685 - DNA, 22 bp, Homo sapiens
gaggccaggaagcccaagatca

SEQ ID NO: 8125686 - DNA, 22 bp, Homo sapiens
gaggaaaatgcaacaggaatgc

SEQ ID NO: 8125687 - DNA, 22 bp, Homo sapiens
gaggaaaatattcagggaggtt

SEQ ID NO: 8125688 - DNA, 20 bp, Homo sapiens
gaggaaaagctgccaggcct

SEQ ID NO: 8125689 - DNA, 22 bp, Homo sapiens
gaggaaaataacaactaagggc

SEQ ID NO: 8125690 - DNA, 19 bp, Homo sapiens
gaggaggaaaactagtgta

SEQ ID NO: 8125691 - DNA, 22 bp, Homo sapiens
gaggaggaagttctctgtaggc

SEQ ID NO: 8125692 - DNA, 22 bp, Homo sapiens
gaggaggaggaagtggaaccca

SEQ ID NO: 8125693 - DNA, 22 bp, Homo sapiens
gagatgtttagatgtttgtcca

SEQ ID NO: 8125694 - DNA, 22 bp, Homo sapiens
gagccacagaaggaaattgggg

SEQ ID NO: 8125695 - DNA, 22 bp, Homo sapiens
gagccaccttcaactcaggaat

SEQ ID NO: 8125696 - DNA, 22 bp, Homo sapiens
gagagggatactgagttttggt

SEQ ID NO: 8125697 - DNA, 22 bp, Homo sapiens
gagagggagccagccaggaacc

SEQ ID NO: 8125698 - DNA, 22 bp, Homo sapiens
gagatgagtgggggatctctca

SEQ ID NO: 8125699 - DNA, 22 bp, Homo sapiens
gagaggcatggaacagattctt

SEQ ID NO: 8125700 - DNA, 22 bp, Homo sapiens
gagaatgggaatgaaagtagca

SEQ ID NO: 8125701 - DNA, 22 bp, Homo sapiens
gagaattttctagtagtttcat

SEQ ID NO: 8125702 - DNA, 22 bp, Homo sapiens
gagaatttgctggcttcattgt

SEQ ID NO: 8125703 - DNA, 22 bp, Homo sapiens
gagaaggctggtcttaagtcga

SEQ ID NO: 8125704 - DNA, 22 bp, Homo sapiens
gagaaggctgatccttggagtt

SEQ ID NO: 8125705 - DNA, 22 bp, Homo sapiens
gacctcatgatccacctgcctt

SEQ ID NO: 8125706 - DNA, 22 bp, Homo sapiens
gagaaggactacacatctggcc

SEQ ID NO: 8125707 - DNA, 22 bp, Homo sapiens
gagaaggactacggaaaacaga

SEQ ID NO: 8125708 - DNA, 22 bp, Homo sapiens
gagaaggactacggaaaacaga

SEQ ID NO: 8125709 - DNA, 22 bp, Homo sapiens
gagaaggagtagctgacctggg

SEQ ID NO: 8125710 - DNA, 22 bp, Homo sapiens
gtgagagaaattggagggaatg

SEQ ID NO: 8125711 - DNA, 22 bp, Homo sapiens
gtgagagaatttgagttaaatt

SEQ ID NO: 8125712 - DNA, 23 bp, Homo sapiens
gtgagcagcccactaggaatgcc

SEQ ID NO: 8125713 - DNA, 22 bp, Homo sapiens
gtgagacatcttgggaagtgat

SEQ ID NO: 8125714 - DNA, 22 bp, Homo sapiens
gtgagcaggataggggctccct

SEQ ID NO: 8125715 - DNA, 21 bp, Homo sapiens
gtgcacagtcctgcacacagg

SEQ ID NO: 8125716 - DNA, 23 bp, Homo sapiens
gtgcacagtcaagcccagcttag

SEQ ID NO: 8125717 - DNA, 22 bp, Homo sapiens
gtgcacaggtgggaaaatgagt

SEQ ID NO: 8125718 - DNA, 22 bp, Homo sapiens
gtgcacagatttaattttattc

SEQ ID NO: 8125719 - DNA, 22 bp, Homo sapiens
gtgcacagagcccagggccgcg

SEQ ID NO: 8125720 - DNA, 22 bp, Homo sapiens
gtgcacagaagcagaagctaga

SEQ ID NO: 8125721 - DNA, 22 bp, Homo sapiens
gtgcacagattcagaggttttg

SEQ ID NO: 8125722 - DNA, 22 bp, Homo sapiens
gtgcaccagtcacatgggcaga

SEQ ID NO: 8125723 - DNA, 22 bp, Homo sapiens
gtgcataaatagcagagctgtg

SEQ ID NO: 8125724 - DNA, 22 bp, Homo sapiens
gtgcagaggtcacaaaagtgaa

SEQ ID NO: 8125725 - DNA, 20 bp, Homo sapiens
gtgcaggttccccttgcact

SEQ ID NO: 8125726 - DNA, 22 bp, Homo sapiens
gtgcagggtagcgacggcagga

SEQ ID NO: 8125727 - DNA, 22 bp, Homo sapiens
gtgcagtgaccctggagagctg

SEQ ID NO: 8125728 - DNA, 22 bp, Homo sapiens
gtctgctggcacgtcacagata

SEQ ID NO: 8125729 - DNA, 22 bp, Homo sapiens
gtctgctgtgccttggggaaaa

SEQ ID NO: 8125730 - DNA, 22 bp, Homo sapiens
gtctggaggaaaaggttaaatg

SEQ ID NO: 8125731 - DNA, 22 bp, Homo sapiens
gtctggagcctgggtccctgct

SEQ ID NO: 8125732 - DNA, 22 bp, Homo sapiens
gtctggaggaggaagaaggcac

SEQ ID NO: 8125733 - DNA, 22 bp, Homo sapiens
gtctggaggagggctctgcggc

SEQ ID NO: 8125734 - DNA, 22 bp, Homo sapiens
gtctggaggcactttctcatga

SEQ ID NO: 8125735 - DNA, 22 bp, Homo sapiens
gtctgccctggggcatcagttt

SEQ ID NO: 8125736 - DNA, 22 bp, Homo sapiens
gtctgcccgcctgcaaagtgtt

SEQ ID NO: 8125737 - DNA, 20 bp, Homo sapiens
gtctgcccaggccaccacgg

SEQ ID NO: 8125738 - DNA, 22 bp, Homo sapiens
gtgaagatctgagccctcaggt

SEQ ID NO: 8125739 - DNA, 22 bp, Homo sapiens
gtgaagatgcctcaggtgaccc

SEQ ID NO: 8125740 - DNA, 22 bp, Homo sapiens
gtgaagcagggaaggaaaggat

SEQ ID NO: 8125741 - DNA, 22 bp, Homo sapiens
gtgaaggactagcatggagggc

SEQ ID NO: 8125742 - DNA, 22 bp, Homo sapiens
gtgaccatcatctcagctagtt

SEQ ID NO: 8125743 - DNA, 22 bp, Homo sapiens
gtgaacagttcattttatcatg

SEQ ID NO: 8125744 - DNA, 17 bp, Homo sapiens
gtctggagtggccttca

SEQ ID NO: 8125745 - DNA, 22 bp, Homo sapiens
gtctggagtggggcctgagaat

SEQ ID NO: 8125746 - DNA, 22 bp, Homo sapiens
gtctggagtaccataaaaagga

SEQ ID NO: 8125747 - DNA, 18 bp, Homo sapiens
gtctggaggtcaggagct

SEQ ID NO: 8125748 - DNA, 22 bp, Homo sapiens
gtctggaggggagatttgggtt

SEQ ID NO: 8125749 - DNA, 22 bp, Homo sapiens
gtctggagggtgggtagagacc

SEQ ID NO: 8125750 - DNA, 22 bp, Homo sapiens
gtctggagggaagagatgtcag

SEQ ID NO: 8125751 - DNA, 22 bp, Homo sapiens
gtctggaggcccgtcagcccta

SEQ ID NO: 8125752 - DNA, 22 bp, Homo sapiens
gtccactctagggcagctctcg

SEQ ID NO: 8125753 - DNA, 22 bp, Homo sapiens
gtccactctctgccgtgcctgt

SEQ ID NO: 8125754 - DNA, 22 bp, Homo sapiens
gtccactcactcttagtcactc

SEQ ID NO: 8125755 - DNA, 22 bp, Homo sapiens
gtccactcccagtgcctgaggc

SEQ ID NO: 8125756 - DNA, 19 bp, Homo sapiens
gtccactccactcggtctc

SEQ ID NO: 8125757 - DNA, 22 bp, Homo sapiens
gtccaagagtcaagaagggggc

SEQ ID NO: 8125758 - DNA, 22 bp, Homo sapiens
gtccaagagtcaagaagggggc

SEQ ID NO: 8125759 - DNA, 22 bp, Homo sapiens
gtccaagagggagctacagagc

SEQ ID NO: 8125760 - DNA, 22 bp, Homo sapiens
gtccctctgtgtccctgcagtc

SEQ ID NO: 8125761 - DNA, 22 bp, Homo sapiens
gtccccttggtaaccttcagct

SEQ ID NO: 8125762 - DNA, 22 bp, Homo sapiens
gtcctgggaaggaagccaggga

SEQ ID NO: 8125763 - DNA, 17 bp, Homo sapiens
gtcctgggaggagagag

SEQ ID NO: 8125764 - DNA, 22 bp, Homo sapiens
gtattcacatggtggtagattg

SEQ ID NO: 8125765 - DNA, 22 bp, Homo sapiens
gtattcacctaaatgtagtttg

SEQ ID NO: 8125766 - DNA, 21 bp, Homo sapiens
gtattctttatgaagtgaaaa

SEQ ID NO: 8125767 - DNA, 22 bp, Homo sapiens
gtatttaattccattaagttag

SEQ ID NO: 8125768 - DNA, 22 bp, Homo sapiens
gtagaaatggtgtgtttcttct

SEQ ID NO: 8125769 - DNA, 22 bp, Homo sapiens
gtagaaattccatttactttga

SEQ ID NO: 8125770 - DNA, 22 bp, Homo sapiens
gtagaaatgtaaccaggagata

SEQ ID NO: 8125771 - DNA, 22 bp, Homo sapiens
ggtttctagcagagtctcttta

SEQ ID NO: 8125772 - DNA, 22 bp, Homo sapiens
gggtggaggtgggttttgagat

SEQ ID NO: 8125773 - DNA, 22 bp, Homo sapiens
gggtggaggagaacaggcccca

SEQ ID NO: 8125774 - DNA, 22 bp, Homo sapiens
gggtggagtagaaagatgaatt

SEQ ID NO: 8125775 - DNA, 22 bp, Homo sapiens
gggtggagtgtgaaatctggct

SEQ ID NO: 8125776 - DNA, 22 bp, Homo sapiens
gggtggagcttggacaccagta

SEQ ID NO: 8125777 - DNA, 22 bp, Homo sapiens
gggtggagccagttgactctgt

SEQ ID NO: 8125778 - DNA, 22 bp, Homo sapiens
gggtggagcctgagaatttgca

SEQ ID NO: 8125779 - DNA, 22 bp, Homo sapiens
ggggtgggcgtgcagggacacc

SEQ ID NO: 8125780 - DNA, 22 bp, Homo sapiens
ggggtgtgagtagagctgggga

SEQ ID NO: 8125781 - DNA, 22 bp, Homo sapiens
ggggctgggatttgaacccagg

SEQ ID NO: 8125782 - DNA, 22 bp, Homo sapiens
ggggctctggagaaaggccagt

SEQ ID NO: 8125783 - DNA, 22 bp, Homo sapiens
ggggctcagttcggacagcctg

SEQ ID NO: 8125784 - DNA, 22 bp, Homo sapiens
ggggccgaccgcggttcaggcc

SEQ ID NO: 8125785 - DNA, 22 bp, Homo sapiens
ggggaagaggcgtgatggatcc

SEQ ID NO: 8125786 - DNA, 22 bp, Homo sapiens
ggggaagaggcgtgatggatcc

SEQ ID NO: 8125787 - DNA, 22 bp, Homo sapiens
gggcttggctggggccaccaga

SEQ ID NO: 8125788 - DNA, 22 bp, Homo sapiens
gggctgcatcagcaggacccgg

SEQ ID NO: 8125789 - DNA, 22 bp, Homo sapiens
gggctgagtgtcccaggccgaa

SEQ ID NO: 8125790 - DNA, 22 bp, Homo sapiens
gggctgagggccaattcctact

SEQ ID NO: 8125791 - DNA, 22 bp, Homo sapiens
gggctgagttcctgcctcactc

SEQ ID NO: 8125792 - DNA, 22 bp, Homo sapiens
gggctgagctgttctgagttta

SEQ ID NO: 8125793 - DNA, 22 bp, Homo sapiens
gggctgaggaacatattttgtt

SEQ ID NO: 8125794 - DNA, 22 bp, Homo sapiens
gggctgaggctaccactggtct

SEQ ID NO: 8125795 - DNA, 22 bp, Homo sapiens
gggctgagccacagcttttgtt

SEQ ID NO: 8125796 - DNA, 22 bp, Homo sapiens
gggctgagctaagctgggttga

SEQ ID NO: 8125797 - DNA, 22 bp, Homo sapiens
gggctgagccatttgaaccttg

SEQ ID NO: 8125798 - DNA, 22 bp, Homo sapiens
gggctgagattggtgccctgtc

SEQ ID NO: 8125799 - DNA, 22 bp, Homo sapiens
gggctgagcacatactgacagc

SEQ ID NO: 8125800 - DNA, 22 bp, Homo sapiens
gggctgagagctggaatctgag

SEQ ID NO: 8125801 - DNA, 22 bp, Homo sapiens
gggctgagagtgactgttctgt

SEQ ID NO: 8125802 - DNA, 22 bp, Homo sapiens
ggtctggaataaggtccaggaa

SEQ ID NO: 8125803 - DNA, 22 bp, Homo sapiens
ggtctggaatggagtaggggtg

SEQ ID NO: 8125804 - DNA, 23 bp, Homo sapiens
ggtctggaattcgcggagttaac

SEQ ID NO: 8125805 - DNA, 22 bp, Homo sapiens
ggtctggaccctcctggagtgg

SEQ ID NO: 8125806 - DNA, 22 bp, Homo sapiens
ggtctggagctaatcttgttgg

SEQ ID NO: 8125807 - DNA, 22 bp, Homo sapiens
ggtctggaccatggacgccggg

SEQ ID NO: 8125808 - DNA, 22 bp, Homo sapiens
ggtctggacagaatgtgacact

SEQ ID NO: 8125809 - DNA, 22 bp, Homo sapiens
ggtctcttcaggagcttgagcg

SEQ ID NO: 8125810 - DNA, 22 bp, Homo sapiens
ggtctggataattccagtacct

SEQ ID NO: 8125811 - DNA, 22 bp, Homo sapiens
ggtctggatattcaccagggcc

SEQ ID NO: 8125812 - DNA, 22 bp, Homo sapiens
ggtctggatgctgaggttccca

SEQ ID NO: 8125813 - DNA, 22 bp, Homo sapiens
ggtctggatttctgcttctttc

SEQ ID NO: 8125814 - DNA, 22 bp, Homo sapiens
ggtctggattttatctactgta

SEQ ID NO: 8125815 - DNA, 22 bp, Homo sapiens
ggtctggagtaggatgatggct

SEQ ID NO: 8125816 - DNA, 22 bp, Homo sapiens
ggtctggagcttggctaaggga

SEQ ID NO: 8125817 - DNA, 22 bp, Homo sapiens
ggtctggagtagatgagtcatg

SEQ ID NO: 8125818 - DNA, 16 bp, Homo sapiens
ggtctggaggatgtct

SEQ ID NO: 8125819 - DNA, 22 bp, Homo sapiens
ggtctggattttgaacaaaatt

SEQ ID NO: 8125820 - DNA, 19 bp, Homo sapiens
ggtgtgtgctggggcctgt

SEQ ID NO: 8125821 - DNA, 22 bp, Homo sapiens
ggtgtgtggttttgatacagtc

SEQ ID NO: 8125822 - DNA, 22 bp, Homo sapiens
ggtgtggatcatctgaggtcag

SEQ ID NO: 8125823 - DNA, 22 bp, Homo sapiens
ggtcacgtgaccgcacctgcct

SEQ ID NO: 8125824 - DNA, 20 bp, Homo sapiens
gggtggagttgcggtctgtg

SEQ ID NO: 8125825 - DNA, 22 bp, Homo sapiens
ggtcagcagtgcagggcagagc

SEQ ID NO: 8125826 - DNA, 22 bp, Homo sapiens
ggtctcctgggttgaccagctg

SEQ ID NO: 8125827 - DNA, 22 bp, Homo sapiens
ggtctctgacttagagatggat

SEQ ID NO: 8125828 - DNA, 22 bp, Homo sapiens
ggctgggctccgggagcatgcg

SEQ ID NO: 8125829 - DNA, 22 bp, Homo sapiens
ggctgggctccgggagcatgcg

SEQ ID NO: 8125830 - DNA, 22 bp, Homo sapiens
ggcttctgagtgctctgctgtt

SEQ ID NO: 8125831 - DNA, 22 bp, Homo sapiens
ggcttctgaaactgtattgaga

SEQ ID NO: 8125832 - DNA, 22 bp, Homo sapiens
ggcttctcccttcttctgattg

SEQ ID NO: 8125833 - DNA, 22 bp, Homo sapiens
ggctgagcaattttgatgacat

SEQ ID NO: 8125834 - DNA, 22 bp, Homo sapiens
ggctgaaggatgaaagctgcag

SEQ ID NO: 8125835 - DNA, 22 bp, Homo sapiens
ggctcttgttcgtaccatggct

SEQ ID NO: 8125836 - DNA, 22 bp, Homo sapiens
ggctgaagtgtagtggctcact

SEQ ID NO: 8125837 - DNA, 22 bp, Homo sapiens
ggctgagactagagtgaggcat

SEQ ID NO: 8125838 - DNA, 22 bp, Homo sapiens
ggctccaggaacctcctctcct

SEQ ID NO: 8125839 - DNA, 22 bp, Homo sapiens
ggctccagccctggctcttcac

SEQ ID NO: 8125840 - DNA, 22 bp, Homo sapiens
ggctccagaaatcatagagcag

SEQ ID NO: 8125841 - DNA, 22 bp, Homo sapiens
ggcgggaggctgaggagttggt

SEQ ID NO: 8125842 - DNA, 22 bp, Homo sapiens
gggacaggctgagacttgagct

SEQ ID NO: 8125843 - DNA, 22 bp, Homo sapiens
gggacaggctgagacttgagct

SEQ ID NO: 8125844 - DNA, 22 bp, Homo sapiens
gggacaggcaaaggtatgcttc

SEQ ID NO: 8125845 - DNA, 22 bp, Homo sapiens
gggacaggcccctcgctagctt

SEQ ID NO: 8125846 - DNA, 22 bp, Homo sapiens
gggagaagtggaaatctcatta

SEQ ID NO: 8125847 - DNA, 22 bp, Homo sapiens
gggagaagtggaaatctcatta

SEQ ID NO: 8125848 - DNA, 22 bp, Homo sapiens
gggacagccatgtgcagatgcc

SEQ ID NO: 8125849 - DNA, 22 bp, Homo sapiens
gggacagcagaaagaaggcaag

SEQ ID NO: 8125850 - DNA, 22 bp, Homo sapiens
gggacaggcaaaggtatgcttc

SEQ ID NO: 8125851 - DNA, 22 bp, Homo sapiens
gggagaggttacccgagcaact

SEQ ID NO: 8125852 - DNA, 22 bp, Homo sapiens
gggagagaattattgccagacc

SEQ ID NO: 8125853 - DNA, 22 bp, Homo sapiens
gggagagagaaaacgtggcgca

SEQ ID NO: 8125854 - DNA, 22 bp, Homo sapiens
gggagacacgctgcaggcataa

SEQ ID NO: 8125855 - DNA, 22 bp, Homo sapiens
gggagatgaatcagaagtgatc

SEQ ID NO: 8125856 - DNA, 22 bp, Homo sapiens
gggagaggttacccgagcaact

SEQ ID NO: 8125857 - DNA, 22 bp, Homo sapiens
gggagaggttacccgagcaact

SEQ ID NO: 8125858 - DNA, 22 bp, Homo sapiens
gggcaggatgcagtttcagaga

SEQ ID NO: 8125859 - DNA, 22 bp, Homo sapiens
gggcaggagagaacagtcatgg

SEQ ID NO: 8125860 - DNA, 22 bp, Homo sapiens
gggcaggaggctaattctgcat

SEQ ID NO: 8125861 - DNA, 22 bp, Homo sapiens
gggcaagcacagcgagcgtgcg

SEQ ID NO: 8125862 - DNA, 22 bp, Homo sapiens
gggcaagcacagcgagcgtgcg

SEQ ID NO: 8125863 - DNA, 22 bp, Homo sapiens
gggaggaaatgtgcagcgaatt

SEQ ID NO: 8125864 - DNA, 22 bp, Homo sapiens
gggaggaaggcttgggtgagta

SEQ ID NO: 8125865 - DNA, 22 bp, Homo sapiens
gggaggaaggcttgggtgagta

SEQ ID NO: 8125866 - DNA, 22 bp, Homo sapiens
gggaggaaggcttgggtgagta

SEQ ID NO: 8125867 - DNA, 22 bp, Homo sapiens
gggaggaaatgtgcagcgaatt

SEQ ID NO: 8125868 - DNA, 22 bp, Homo sapiens
gggatggggagctggaaagggg

SEQ ID NO: 8125869 - DNA, 22 bp, Homo sapiens
gggaggagctgagtgtgtgtgc

SEQ ID NO: 8125870 - DNA, 22 bp, Homo sapiens
ggagtaggccccgggagagagt

SEQ ID NO: 8125871 - DNA, 22 bp, Homo sapiens
ggagtcaccaagtaggagtctt

SEQ ID NO: 8125872 - DNA, 22 bp, Homo sapiens
ggagtgagtactggagtagctg

SEQ ID NO: 8125873 - DNA, 22 bp, Homo sapiens
ggcaaaggaaaacgtctcagct

SEQ ID NO: 8125874 - DNA, 22 bp, Homo sapiens
ggcaagaggtccaagaggtctc

SEQ ID NO: 8125875 - DNA, 22 bp, Homo sapiens
ggcaggcagaggctgagacagg

SEQ ID NO: 8125876 - DNA, 20 bp, Homo sapiens
ggcagagggcctgggagaag

SEQ ID NO: 8125877 - DNA, 20 bp, Homo sapiens
ggcagagggcctgggagaag

SEQ ID NO: 8125878 - DNA, 22 bp, Homo sapiens
ggcagaggtagctggaaccagg

SEQ ID NO: 8125879 - DNA, 22 bp, Homo sapiens
ggcagaggtagctggaaccagg

SEQ ID NO: 8125880 - DNA, 22 bp, Homo sapiens
ggcagaggagctggaaacatgg

SEQ ID NO: 8125881 - DNA, 22 bp, Homo sapiens
ggcagaggagctggaaacatgg

SEQ ID NO: 8125882 - DNA, 22 bp, Homo sapiens
ggcagaggaagctggaagtggg

SEQ ID NO: 8125883 - DNA, 20 bp, Homo sapiens
ggcaccaggctaggattgga

SEQ ID NO: 8125884 - DNA, 22 bp, Homo sapiens
ggcaccaggctgggcataggcc

SEQ ID NO: 8125885 - DNA, 23 bp, Homo sapiens
ggcaccaggccatggagcgggag

SEQ ID NO: 8125886 - DNA, 22 bp, Homo sapiens
ggcacagctgatgcagacacac

SEQ ID NO: 8125887 - DNA, 17 bp, Homo sapiens
ggcaccagacggagagt

SEQ ID NO: 8125888 - DNA, 22 bp, Homo sapiens
ggcacagcgactaccatcgaaa

SEQ ID NO: 8125889 - DNA, 22 bp, Homo sapiens
ggccttgggtataggtgggtat

SEQ ID NO: 8125890 - DNA, 22 bp, Homo sapiens
ggccttggtgccatggccagtt

SEQ ID NO: 8125891 - DNA, 22 bp, Homo sapiens
ggccttggtaatgggggactgt

SEQ ID NO: 8125892 - DNA, 22 bp, Homo sapiens
ggccttggtaaagggatgcatg

SEQ ID NO: 8125893 - DNA, 22 bp, Homo sapiens
ggccttttgtgtccttgcccgt

SEQ ID NO: 8125894 - DNA, 22 bp, Homo sapiens
ggccttggttccaaagcaggca

SEQ ID NO: 8125895 - DNA, 23 bp, Homo sapiens
ggcctctgtgttctgcccacatg

SEQ ID NO: 8125896 - DNA, 22 bp, Homo sapiens
ggcctctgtttggagccaggat

SEQ ID NO: 8125897 - DNA, 22 bp, Homo sapiens
ggcagtgaacagaaatgcagaa

SEQ ID NO: 8125898 - DNA, 22 bp, Homo sapiens
ggcagtgaacagaaatgcagaa

SEQ ID NO: 8125899 - DNA, 22 bp, Homo sapiens
ggcagtgaatctgagagcctgg

SEQ ID NO: 8125900 - DNA, 22 bp, Homo sapiens
ggcagtgaatgaaacagaggct

SEQ ID NO: 8125901 - DNA, 22 bp, Homo sapiens
ggccagtggctctgtgcttggg

SEQ ID NO: 8125902 - DNA, 22 bp, Homo sapiens
ggccatgagcagccctgtggga

SEQ ID NO: 8125903 - DNA, 22 bp, Homo sapiens
ggccatgagaatgtgcaggtcc

SEQ ID NO: 8125904 - DNA, 22 bp, Homo sapiens
ggccacaacttgctcctagccc

SEQ ID NO: 8125905 - DNA, 22 bp, Homo sapiens
gcagaggatcaggctctggaaa

SEQ ID NO: 8125906 - DNA, 21 bp, Homo sapiens
gcagaggcacggcaccaaggg

SEQ ID NO: 8125907 - DNA, 22 bp, Homo sapiens
gcagagcaggaaggaagtcagg

SEQ ID NO: 8125908 - DNA, 22 bp, Homo sapiens
gcagaggtgagaagggcctccc

SEQ ID NO: 8125909 - DNA, 20 bp, Homo sapiens
gcagagtgtgagagggtgaa

SEQ ID NO: 8125910 - DNA, 22 bp, Homo sapiens
gcagaggggaagctgaggaatt

SEQ ID NO: 8125911 - DNA, 22 bp, Homo sapiens
gcagagggtcctgtgccagcag

SEQ ID NO: 8125912 - DNA, 22 bp, Homo sapiens
gcagagggtcctgtgccagcag

SEQ ID NO: 8125913 - DNA, 22 bp, Homo sapiens
gcagagggggtacttcggccct

SEQ ID NO: 8125914 - DNA, 22 bp, Homo sapiens
gcagagaaagttttgtcctcag

SEQ ID NO: 8125915 - DNA, 22 bp, Homo sapiens
gcagagcaccctgcagtggtat

SEQ ID NO: 8125916 - DNA, 19 bp, Homo sapiens
gcagacaggtccagagagg

SEQ ID NO: 8125917 - DNA, 22 bp, Homo sapiens
gcaaataaatgctcactgctgt

SEQ ID NO: 8125918 - DNA, 22 bp, Homo sapiens
gcaaagtgaaatggggcagaga

SEQ ID NO: 8125919 - DNA, 20 bp, Homo sapiens
gaggcccagagaggtgaagc

SEQ ID NO: 8125920 - DNA, 22 bp, Homo sapiens
gcacactcctggatcctagaga

SEQ ID NO: 8125921 - DNA, 22 bp, Homo sapiens
gcacaccctctcaccagcactg

SEQ ID NO: 8125922 - DNA, 22 bp, Homo sapiens
gcacagggctgccaggcggctt

SEQ ID NO: 8125923 - DNA, 21 bp, Homo sapiens
gcagatgggaagagacgaggc

SEQ ID NO: 8125924 - DNA, 18 bp, Homo sapiens
gcagcccctcttccttcc

SEQ ID NO: 8125925 - DNA, 22 bp, Homo sapiens
gcagcccaggagcaggcgaccc

SEQ ID NO: 8125926 - DNA, 22 bp, Homo sapiens
gcagcccaggctcgctcactgc

SEQ ID NO: 8125927 - DNA, 22 bp, Homo sapiens
gcagcccaggtctctctcactc

SEQ ID NO: 8125928 - DNA, 22 bp, Homo sapiens
gcagatggtgggggaggagtac

SEQ ID NO: 8125929 - DNA, 22 bp, Homo sapiens
gcaggacaaaatttccagggtg

SEQ ID NO: 8125930 - DNA, 22 bp, Homo sapiens
gcaggaagatgagctcaggtaa

SEQ ID NO: 8125931 - DNA, 22 bp, Homo sapiens
gcaggaagccttaccaagccca

SEQ ID NO: 8125932 - DNA, 22 bp, Homo sapiens
gcaggaagaggctcgaagcccc

SEQ ID NO: 8125933 - DNA, 22 bp, Homo sapiens
gcaggaagaggctcgaagcccc

SEQ ID NO: 8125934 - DNA, 20 bp, Homo sapiens
gcagcctcaacaggcacagc

SEQ ID NO: 8125935 - DNA, 22 bp, Homo sapiens
gcaggcagatcacctgtcagga

SEQ ID NO: 8125936 - DNA, 22 bp, Homo sapiens
gcaggcagaggtggaggagaca

SEQ ID NO: 8125937 - DNA, 22 bp, Homo sapiens
gcaggcagaggtggaggagaca

SEQ ID NO: 8125938 - DNA, 22 bp, Homo sapiens
gccccaagggagcccagcacac

SEQ ID NO: 8125939 - DNA, 22 bp, Homo sapiens
gccccacagcctgcggtctcag

SEQ ID NO: 8125940 - DNA, 22 bp, Homo sapiens
gcccatgggcctgaggccctag

SEQ ID NO: 8125941 - DNA, 22 bp, Homo sapiens
gcccatggcttccctaggcaca

SEQ ID NO: 8125942 - DNA, 22 bp, Homo sapiens
gcccagctgtctggcagggatg

SEQ ID NO: 8125943 - DNA, 22 bp, Homo sapiens
gcccagctggcttccagcacat

SEQ ID NO: 8125944 - DNA, 22 bp, Homo sapiens
gccaggtcacctcactcatcca

SEQ ID NO: 8125945 - DNA, 22 bp, Homo sapiens
gcccagccctgaggtcacagct

SEQ ID NO: 8125946 - DNA, 22 bp, Homo sapiens
gcctctgggctctgcccctggc

SEQ ID NO: 8125947 - DNA, 22 bp, Homo sapiens
gcctcctgagtagctgggattg

SEQ ID NO: 8125948 - DNA, 22 bp, Homo sapiens
gcctcctgacttacactgagct

SEQ ID NO: 8125949 - DNA, 22 bp, Homo sapiens
gcctcctgcccagatgagtgat

SEQ ID NO: 8125950 - DNA, 22 bp, Homo sapiens
gcctcctgcccagatgagtgat

SEQ ID NO: 8125951 - DNA, 22 bp, Homo sapiens
gccctgtgtgatcacatgaaca

SEQ ID NO: 8125952 - DNA, 22 bp, Homo sapiens
gcctcccttggtgtctcccggg

SEQ ID NO: 8125953 - DNA, 22 bp, Homo sapiens
gcctccggagtcacagtgtctt

SEQ ID NO: 8125954 - DNA, 22 bp, Homo sapiens
gcctccggagttgcagtgtctt

SEQ ID NO: 8125955 - DNA, 22 bp, Homo sapiens
gcctcctgaagtgctgggatta

SEQ ID NO: 8125956 - DNA, 22 bp, Homo sapiens
gcctcctaccacaccctcagtc

SEQ ID NO: 8125957 - DNA, 22 bp, Homo sapiens
gcctcctagagctccagggact

SEQ ID NO: 8125958 - DNA, 22 bp, Homo sapiens
gcctcctatggggccatcgcag

SEQ ID NO: 8125959 - DNA, 22 bp, Homo sapiens
gcctcctcacaatgtacccacg

SEQ ID NO: 8125960 - DNA, 22 bp, Homo sapiens
gccccagctctgccacaactag

SEQ ID NO: 8125961 - DNA, 22 bp, Homo sapiens
gccctggcctcctggaacaggc

SEQ ID NO: 8125962 - DNA, 22 bp, Homo sapiens
gccctggccttcatctcagaca

SEQ ID NO: 8125963 - DNA, 22 bp, Homo sapiens
gccaccagggggtgcaaggtcc

SEQ ID NO: 8125964 - DNA, 22 bp, Homo sapiens
gccaccagggggctccagtgag

SEQ ID NO: 8125965 - DNA, 22 bp, Homo sapiens
gccaccaggagcccagtccaaa

SEQ ID NO: 8125966 - DNA, 22 bp, Homo sapiens
gccaccagcagaaaaggggcca

SEQ ID NO: 8125967 - DNA, 22 bp, Homo sapiens
gcagtgggaaggttggcacatg

SEQ ID NO: 8125968 - DNA, 22 bp, Homo sapiens
gcagtgattggatcagagatgg

SEQ ID NO: 8125969 - DNA, 22 bp, Homo sapiens
gcagtggaagcctctttaagca

SEQ ID NO: 8125970 - DNA, 22 bp, Homo sapiens
gcagtgaagccagatctgaaat

SEQ ID NO: 8125971 - DNA, 22 bp, Homo sapiens
gcagtggcatgatgtgggctca

SEQ ID NO: 8125972 - DNA, 22 bp, Homo sapiens
gcagtggcagagacagcaccaa

SEQ ID NO: 8125973 - DNA, 22 bp, Homo sapiens
gcagtggcaccgctggctctgg

SEQ ID NO: 8125974 - DNA, 17 bp, Homo sapiens
gcagtggaggggtagtt

SEQ ID NO: 8125975 - DNA, 23 bp, Homo sapiens
gcagtggaatgtctctgtttgga

SEQ ID NO: 8125976 - DNA, 22 bp, Homo sapiens
gcagtggatggccagcaggggc

SEQ ID NO: 8125977 - DNA, 22 bp, Homo sapiens
gcagtggatccaatggtatctt

SEQ ID NO: 8125978 - DNA, 17 bp, Homo sapiens
gccagggagaggaagcc

SEQ ID NO: 8125979 - DNA, 22 bp, Homo sapiens
gccagggctcgcggtccctcgt

SEQ ID NO: 8125980 - DNA, 22 bp, Homo sapiens
gccagcctgtgggggctctgtg

SEQ ID NO: 8125981 - DNA, 22 bp, Homo sapiens
gccaccatgtattgacttggcc

SEQ ID NO: 8125982 - DNA, 23 bp, Homo sapiens
gccagccttgctctcctgcagcc

SEQ ID NO: 8125983 - DNA, 22 bp, Homo sapiens
ggaatgagctcggagcagaagg

SEQ ID NO: 8125984 - DNA, 22 bp, Homo sapiens
ggaatgtgcgtactcagtgtca

SEQ ID NO: 8125985 - DNA, 22 bp, Homo sapiens
ggaattggtttcaagggaaagt

SEQ ID NO: 8125986 - DNA, 22 bp, Homo sapiens
ggaattggtttcaagggaaagt

SEQ ID NO: 8125987 - DNA, 22 bp, Homo sapiens
ggacacagctgcagccacaccc

SEQ ID NO: 8125988 - DNA, 22 bp, Homo sapiens
ggaagcagcctgaagccaaggg

SEQ ID NO: 8125989 - DNA, 22 bp, Homo sapiens
ggaagagggaaccacgactgta

SEQ ID NO: 8125990 - DNA, 22 bp, Homo sapiens
ggaagaggctggtagtgcccgt

SEQ ID NO: 8125991 - DNA, 22 bp, Homo sapiens
ggaagagtaacaggaggtggaa

SEQ ID NO: 8125992 - DNA, 22 bp, Homo sapiens
ggaagaggaggagccaggcttt

SEQ ID NO: 8125993 - DNA, 22 bp, Homo sapiens
ggaagaggaggagccaggcttt

SEQ ID NO: 8125994 - DNA, 22 bp, Homo sapiens
ggaagaggctctcattgagggc

SEQ ID NO: 8125995 - DNA, 22 bp, Homo sapiens
ggaagaggctgagccaggtccc

SEQ ID NO: 8125996 - DNA, 23 bp, Homo sapiens
ggacacaggccttgtctgcgcct

SEQ ID NO: 8125997 - DNA, 22 bp, Homo sapiens
ggacacagtggaagacagcttg

SEQ ID NO: 8125998 - DNA, 22 bp, Homo sapiens
ggacagggtaagtactagtgtg

SEQ ID NO: 8125999 - DNA, 22 bp, Homo sapiens
ggacagggttggggcatataaa

SEQ ID NO: 8126000 - DNA, 19 bp, Homo sapiens
ggacatcactctaagcctt

SEQ ID NO: 8126001 - DNA, 19 bp, Homo sapiens
ggaccaggtcctgggcagc

SEQ ID NO: 8126002 - DNA, 22 bp, Homo sapiens
ggagacagggttgaaccacgca

SEQ ID NO: 8126003 - DNA, 22 bp, Homo sapiens
ggagacagtatggcttgtagct

SEQ ID NO: 8126004 - DNA, 22 bp, Homo sapiens
ggagactgatctgagtgataac

SEQ ID NO: 8126005 - DNA, 22 bp, Homo sapiens
ggagacagtggtagggcctaag

SEQ ID NO: 8126006 - DNA, 22 bp, Homo sapiens
ggagacagtgacttagagactg

SEQ ID NO: 8126007 - DNA, 22 bp, Homo sapiens
ggagacagtgacttagagactg

SEQ ID NO: 8126008 - DNA, 22 bp, Homo sapiens
ggagagaaattgaggtagcaag

SEQ ID NO: 8126009 - DNA, 22 bp, Homo sapiens
ggagcagggaattacagcgcag

SEQ ID NO: 8126010 - DNA, 22 bp, Homo sapiens
gctgggcttctcaatgctgcct

SEQ ID NO: 8126011 - DNA, 22 bp, Homo sapiens
gctgtgctatatctctgagtgt

SEQ ID NO: 8126012 - DNA, 19 bp, Homo sapiens
gctgtgggacagcagggtg

SEQ ID NO: 8126013 - DNA, 22 bp, Homo sapiens
gctgtggtccctctgtcctcat

SEQ ID NO: 8126014 - DNA, 22 bp, Homo sapiens
gcttgatgatacctaggagatg

SEQ ID NO: 8126015 - DNA, 22 bp, Homo sapiens
gctggagacctcagagaaccca

SEQ ID NO: 8126016 - DNA, 22 bp, Homo sapiens
gctggcttttgaagtctagcta

SEQ ID NO: 8126017 - DNA, 22 bp, Homo sapiens
gctggctttgtggtctctcctc

SEQ ID NO: 8126018 - DNA, 21 bp, Homo sapiens
gctggctttattctgcgtttg

SEQ ID NO: 8126019 - DNA, 17 bp, Homo sapiens
gctggcttctccttgct

SEQ ID NO: 8126020 - DNA, 22 bp, Homo sapiens
gctggcttccctacctgcacct

SEQ ID NO: 8126021 - DNA, 22 bp, Homo sapiens
gctgagagtccaggaaaacatc

SEQ ID NO: 8126022 - DNA, 22 bp, Homo sapiens
gctgagagtgagcactggatat

SEQ ID NO: 8126023 - DNA, 17 bp, Homo sapiens
gctgagaggcagcacag

SEQ ID NO: 8126024 - DNA, 22 bp, Homo sapiens
gctgagagcacatagaaggggc

SEQ ID NO: 8126025 - DNA, 22 bp, Homo sapiens
gctgagagcaaagcatgtctag

SEQ ID NO: 8126026 - DNA, 22 bp, Homo sapiens
gctgagagatcaaggcaggatt

SEQ ID NO: 8126027 - DNA, 22 bp, Homo sapiens
gctgagactggcagcaggaagt

SEQ ID NO: 8126028 - DNA, 22 bp, Homo sapiens
gctgacacttagaagtgccctg

SEQ ID NO: 8126029 - DNA, 22 bp, Homo sapiens
gctgagggaggctgaactgagt

SEQ ID NO: 8126030 - DNA, 22 bp, Homo sapiens
gctgagagtgggtgcagtgctt

SEQ ID NO: 8126031 - DNA, 22 bp, Homo sapiens
gctctgggattaccagccttag

SEQ ID NO: 8126032 - DNA, 22 bp, Homo sapiens
gctcctccaatatggactcctc

SEQ ID NO: 8126033 - DNA, 21 bp, Homo sapiens
gctgctcgagatccagtgctt

SEQ ID NO: 8126034 - DNA, 22 bp, Homo sapiens
gctgctgtgccccatctgcaga

SEQ ID NO: 8126035 - DNA, 22 bp, Homo sapiens
gctgctgttatgatgttacttt

SEQ ID NO: 8126036 - DNA, 22 bp, Homo sapiens
gctgctgtgttggccactgctt

SEQ ID NO: 8126037 - DNA, 22 bp, Homo sapiens
gctgagggcatgtgtggcgact

SEQ ID NO: 8126038 - DNA, 22 bp, Homo sapiens
gctgagggccgcatagggtcat

SEQ ID NO: 8126039 - DNA, 22 bp, Homo sapiens
gctgcccagggtggagccggct

SEQ ID NO: 8126040 - DNA, 22 bp, Homo sapiens
gctgcccagcaggccccagggg

SEQ ID NO: 8126041 - DNA, 22 bp, Homo sapiens
gctgcctcactccagcccaata

SEQ ID NO: 8126042 - DNA, 22 bp, Homo sapiens
gctgcctcaggcacctcctggc

SEQ ID NO: 8126043 - DNA, 22 bp, Homo sapiens
gctgccctgtggtagagggtgg

SEQ ID NO: 8126044 - DNA, 22 bp, Homo sapiens
gctgccctgtctgcagcaggac

SEQ ID NO: 8126045 - DNA, 22 bp, Homo sapiens
gctcagagggaacaaggggctg

SEQ ID NO: 8126046 - DNA, 22 bp, Homo sapiens
gctcagaggccactgttggaaa

SEQ ID NO: 8126047 - DNA, 22 bp, Homo sapiens
gctcagagtggcctggctaggg

SEQ ID NO: 8126048 - DNA, 21 bp, Homo sapiens
gctcagagtattgcactgttt

SEQ ID NO: 8126049 - DNA, 23 bp, Homo sapiens
gctcagaggtttttctctggatg

SEQ ID NO: 8126050 - DNA, 22 bp, Homo sapiens
gctcagaggttgttcttgggtt

SEQ ID NO: 8126051 - DNA, 19 bp, Homo sapiens
gctcagagggccctgtgct

SEQ ID NO: 8126052 - DNA, 21 bp, Homo sapiens
gctcagcaaaggtgaggtgca

SEQ ID NO: 8126053 - DNA, 22 bp, Homo sapiens
gctcagagttaattggatgggt

SEQ ID NO: 8126054 - DNA, 22 bp, Homo sapiens
gctccagggacccaagagaaaa

SEQ ID NO: 8126055 - DNA, 22 bp, Homo sapiens
gctccagggtggatgacaattc

SEQ ID NO: 8126056 - DNA, 22 bp, Homo sapiens
gctccagggtcagctcagaact

SEQ ID NO: 8126057 - DNA, 22 bp, Homo sapiens
gctcccagaaccaaggctgggg

SEQ ID NO: 8126058 - DNA, 22 bp, Homo sapiens
gctccaggtgtcccaggtaaaa

SEQ ID NO: 8126059 - DNA, 22 bp, Homo sapiens
gctccaggtgaatcctctcacc

SEQ ID NO: 8126060 - DNA, 20 bp, Homo sapiens
gctccaggtcagagaggacg

SEQ ID NO: 8126061 - DNA, 22 bp, Homo sapiens
gctccctgctccttcaccgacc

SEQ ID NO: 8126062 - DNA, 22 bp, Homo sapiens
gctccctggtagccatgctctc

SEQ ID NO: 8126063 - DNA, 22 bp, Homo sapiens
gctccctggtattgctgccact

SEQ ID NO: 8126064 - DNA, 17 bp, Homo sapiens
gctccctgaggacagct

SEQ ID NO: 8126065 - DNA, 22 bp, Homo sapiens
gctccctgcatttcccaccctt

SEQ ID NO: 8126066 - DNA, 22 bp, Homo sapiens
gctacagagctctgtgaagaga

SEQ ID NO: 8126067 - DNA, 22 bp, Homo sapiens
gcgggtggaacggctccacgtg

SEQ ID NO: 8126068 - DNA, 22 bp, Homo sapiens
gccttggccttcctaggcctga

SEQ ID NO: 8126069 - DNA, 22 bp, Homo sapiens
gcctctggggcagctgagtcat

SEQ ID NO: 8126070 - DNA, 22 bp, Homo sapiens
taggacagtttactttggttac

SEQ ID NO: 8126071 - DNA, 22 bp, Homo sapiens
taggacagtagctggtgcacag

SEQ ID NO: 8126072 - DNA, 22 bp, Homo sapiens
taggacagttatgggttttatt

SEQ ID NO: 8126073 - DNA, 22 bp, Homo sapiens
taggacagtggagataaccaga

SEQ ID NO: 8126074 - DNA, 22 bp, Homo sapiens
taggacaggtgaggggctgtgg

SEQ ID NO: 8126075 - DNA, 22 bp, Homo sapiens
taggatatggtagaaatcattc

SEQ ID NO: 8126076 - DNA, 22 bp, Homo sapiens
taggagtgcataaaactatatt

SEQ ID NO: 8126077 - DNA, 21 bp, Homo sapiens
taggcaatttgttgtcatagc

SEQ ID NO: 8126078 - DNA, 22 bp, Homo sapiens
taggcaatattagactttgtct

SEQ ID NO: 8126079 - DNA, 22 bp, Homo sapiens
tagggaggctacttcttgtagg

SEQ ID NO: 8126080 - DNA, 22 bp, Homo sapiens
tagggaggctacttcttgtagg

SEQ ID NO: 8126081 - DNA, 22 bp, Homo sapiens
tagggaggagggttttcaaatc

SEQ ID NO: 8126082 - DNA, 22 bp, Homo sapiens
tagctctagcactggataatcc

SEQ ID NO: 8126083 - DNA, 22 bp, Homo sapiens
tagcctatcttcactaagagca

SEQ ID NO: 8126084 - DNA, 22 bp, Homo sapiens
tagcctatagtttctgctaaga

SEQ ID NO: 8126085 - DNA, 22 bp, Homo sapiens
tagccccagctactcggaagct

SEQ ID NO: 8126086 - DNA, 22 bp, Homo sapiens
tagcccctgcctttgaacctgg

SEQ ID NO: 8126087 - DNA, 22 bp, Homo sapiens
tagccctgtccttggcctgtgc

SEQ ID NO: 8126088 - DNA, 19 bp, Homo sapiens
tagccctggccatcatgag

SEQ ID NO: 8126089 - DNA, 22 bp, Homo sapiens
tagagggttattaggacagaag

SEQ ID NO: 8126090 - DNA, 22 bp, Homo sapiens
tagcagaagttccaatgcatat

SEQ ID NO: 8126091 - DNA, 22 bp, Homo sapiens
tagcagaagaacaacatgatct

SEQ ID NO: 8126092 - DNA, 22 bp, Homo sapiens
tagaggtgttgttgatatagaa

SEQ ID NO: 8126093 - DNA, 22 bp, Homo sapiens
tagcagaggaaaagagaacatt

SEQ ID NO: 8126094 - DNA, 22 bp, Homo sapiens
tagcagagcgggtgcgaggcgg

SEQ ID NO: 8126095 - DNA, 22 bp, Homo sapiens
tagaaagaaattcagattggct

SEQ ID NO: 8126096 - DNA, 22 bp, Homo sapiens
tagaaacccatgtttattcagt

SEQ ID NO: 8126097 - DNA, 22 bp, Homo sapiens
tacttttagcctatttgattct

SEQ ID NO: 8126098 - DNA, 22 bp, Homo sapiens
tagaaaggatattgagatgaat

SEQ ID NO: 8126099 - DNA, 22 bp, Homo sapiens
tagaaataaatctgcagctggg

SEQ ID NO: 8126100 - DNA, 22 bp, Homo sapiens
tagaaagtggttgagagtttag

SEQ ID NO: 8126101 - DNA, 22 bp, Homo sapiens
tagaaatgcccagattctgcta

SEQ ID NO: 8126102 - DNA, 22 bp, Homo sapiens
tagaatgagaaagtgtagcagg

SEQ ID NO: 8126103 - DNA, 22 bp, Homo sapiens
tagaaatggagaacagattaat

SEQ ID NO: 8126104 - DNA, 22 bp, Homo sapiens
tagaatgtggaggtaacagact

SEQ ID NO: 8126105 - DNA, 22 bp, Homo sapiens
tagaatgtgcctggaatacagt

SEQ ID NO: 8126106 - DNA, 23 bp, Homo sapiens
tagaatgtcattcaatgatatgg

SEQ ID NO: 8126107 - DNA, 22 bp, Homo sapiens
tagaatgtgcaaatgtgcacac

SEQ ID NO: 8126108 - DNA, 22 bp, Homo sapiens
tagaatgttaagaatatgtata

SEQ ID NO: 8126109 - DNA, 22 bp, Homo sapiens
tagacaaactgatacttggcga

SEQ ID NO: 8126110 - DNA, 22 bp, Homo sapiens
tagacaatatttgaaagtagtg

SEQ ID NO: 8126111 - DNA, 22 bp, Homo sapiens
tagacaaaagggggcagatatg

SEQ ID NO: 8126112 - DNA, 22 bp, Homo sapiens
tagaattttctgctttgatagt

SEQ ID NO: 8126113 - DNA, 22 bp, Homo sapiens
tagagggaaggaagaatggatt

SEQ ID NO: 8126114 - DNA, 22 bp, Homo sapiens
tagacactgtatgagctgggtg

SEQ ID NO: 8126115 - DNA, 22 bp, Homo sapiens
tatagcaattcagaatacatgt

SEQ ID NO: 8126116 - DNA, 22 bp, Homo sapiens
tatacacatgtgtgtattcata

SEQ ID NO: 8126117 - DNA, 22 bp, Homo sapiens
tatacacattacagtttcagga

SEQ ID NO: 8126118 - DNA, 22 bp, Homo sapiens
tatacacacctccaaagcagga

SEQ ID NO: 8126119 - DNA, 22 bp, Homo sapiens
tataacaggaagtattcaaaca

SEQ ID NO: 8126120 - DNA, 22 bp, Homo sapiens
tataattagtaaatggcagatt

SEQ ID NO: 8126121 - DNA, 22 bp, Homo sapiens
taggtgcagtggctcatgcctg

SEQ ID NO: 8126122 - DNA, 22 bp, Homo sapiens
taggtgtctgctcttatttaac

SEQ ID NO: 8126123 - DNA, 22 bp, Homo sapiens
taggggtgaggccaggcatcag

SEQ ID NO: 8126124 - DNA, 22 bp, Homo sapiens
taggggtgggatccaggaatta

SEQ ID NO: 8126125 - DNA, 22 bp, Homo sapiens
taggggtgggatccaggaatta

SEQ ID NO: 8126126 - DNA, 22 bp, Homo sapiens
taggggtggagctaagagtccc

SEQ ID NO: 8126127 - DNA, 22 bp, Homo sapiens
taggggtggagctaagagtccc

SEQ ID NO: 8126128 - DNA, 22 bp, Homo sapiens
taggggtgtttcgagagaggtt

SEQ ID NO: 8126129 - DNA, 22 bp, Homo sapiens
taggggtgtttcgagagaggtt

SEQ ID NO: 8126130 - DNA, 22 bp, Homo sapiens
tatctacagttaatatgtcatc

SEQ ID NO: 8126131 - DNA, 22 bp, Homo sapiens
tatccggagactttttaaattg

SEQ ID NO: 8126132 - DNA, 22 bp, Homo sapiens
tatctaaaggatttaatttagt

SEQ ID NO: 8126133 - DNA, 20 bp, Homo sapiens
tatctaaatgcttacattac

SEQ ID NO: 8126134 - DNA, 22 bp, Homo sapiens
tatagcaattcagaatacatgt

SEQ ID NO: 8126135 - DNA, 22 bp, Homo sapiens
tataggaaatttatctcctggg

SEQ ID NO: 8126136 - DNA, 22 bp, Homo sapiens
tataggaaataggtcttctgtg

SEQ ID NO: 8126137 - DNA, 22 bp, Homo sapiens
tataggtgaataaatgagttta

SEQ ID NO: 8126138 - DNA, 22 bp, Homo sapiens
tatagtatacttaaagtctatt

SEQ ID NO: 8126139 - DNA, 22 bp, Homo sapiens
tatccaaagtttctcagaaact

SEQ ID NO: 8126140 - DNA, 22 bp, Homo sapiens
tatatattcttaagtagtgtag

SEQ ID NO: 8126141 - DNA, 22 bp, Homo sapiens
tatgtacaatttgttgtatgtc

SEQ ID NO: 8126142 - DNA, 22 bp, Homo sapiens
tatgtacaatcagcagttcata

SEQ ID NO: 8126143 - DNA, 22 bp, Homo sapiens
tatgtacaagcacacatgtgac

SEQ ID NO: 8126144 - DNA, 22 bp, Homo sapiens
tatgtacagggatagaacttga

SEQ ID NO: 8126145 - DNA, 22 bp, Homo sapiens
tatgtacacttaagtttgagaa

SEQ ID NO: 8126146 - DNA, 22 bp, Homo sapiens
tatgtacacggtggctctgaag

SEQ ID NO: 8126147 - DNA, 22 bp, Homo sapiens
tatgtacaccggggaaggtggg

SEQ ID NO: 8126148 - DNA, 22 bp, Homo sapiens
tatgtacacatacacttgtaat

SEQ ID NO: 8126149 - DNA, 22 bp, Homo sapiens
tatgtcctgctactctctcatg

SEQ ID NO: 8126150 - DNA, 22 bp, Homo sapiens
tatgtacagtccttaacttaaa

SEQ ID NO: 8126151 - DNA, 22 bp, Homo sapiens
tatgtgatagagttactttata

SEQ ID NO: 8126152 - DNA, 22 bp, Homo sapiens
tatttaatttgctcattgtgat

SEQ ID NO: 8126153 - DNA, 22 bp, Homo sapiens
tatttataatctgccaaagaga

SEQ ID NO: 8126154 - DNA, 22 bp, Homo sapiens
tatttataccaggtgatcggag

SEQ ID NO: 8126155 - DNA, 22 bp, Homo sapiens
tatttataatctgccaaagaga

SEQ ID NO: 8126156 - DNA, 22 bp, Homo sapiens
tatttatattctgccttctgct

SEQ ID NO: 8126157 - DNA, 22 bp, Homo sapiens
tattcttactctcgactgcatt

SEQ ID NO: 8126158 - DNA, 22 bp, Homo sapiens
tattgaaattcttcatgtcctc

SEQ ID NO: 8126159 - DNA, 22 bp, Homo sapiens
taagggttcagaatgcagtggt

SEQ ID NO: 8126160 - DNA, 22 bp, Homo sapiens
taagggggcacttactctcagg

SEQ ID NO: 8126161 - DNA, 22 bp, Homo sapiens
taagggggaagatcatatttta

SEQ ID NO: 8126162 - DNA, 22 bp, Homo sapiens
taagggggaactcagttcagaa

SEQ ID NO: 8126163 - DNA, 17 bp, Homo sapiens
taagggggaaacggagc

SEQ ID NO: 8126164 - DNA, 22 bp, Homo sapiens
taaggcagtgagaagaaacagg

SEQ ID NO: 8126165 - DNA, 22 bp, Homo sapiens
taaggcaggactggatagctat

SEQ ID NO: 8126166 - DNA, 22 bp, Homo sapiens
taagtgagccctcagagtatgg

SEQ ID NO: 8126167 - DNA, 22 bp, Homo sapiens
taagtactaatattagtaactc

SEQ ID NO: 8126168 - DNA, 22 bp, Homo sapiens
taagtaatttgtgcagagatac

SEQ ID NO: 8126169 - DNA, 22 bp, Homo sapiens
taataatagcagtagctgccac

SEQ ID NO: 8126170 - DNA, 22 bp, Homo sapiens
taatacatcattcatctaagga

SEQ ID NO: 8126171 - DNA, 22 bp, Homo sapiens
taattacaggtccaaaacaatc

SEQ ID NO: 8126172 - DNA, 22 bp, Homo sapiens
taattacagaggtttgccagtt

SEQ ID NO: 8126173 - DNA, 22 bp, Homo sapiens
taattacaaagcaagcacaggg

SEQ ID NO: 8126174 - DNA, 22 bp, Homo sapiens
taattataacagttacatctta

SEQ ID NO: 8126175 - DNA, 22 bp, Homo sapiens
taatactgactaaagatatcaa

SEQ ID NO: 8126176 - DNA, 22 bp, Homo sapiens
tacaaagatggaaggttatgtt

SEQ ID NO: 8126177 - DNA, 22 bp, Homo sapiens
tacaaagatagtgttagagtaa

SEQ ID NO: 8126178 - DNA, 22 bp, Homo sapiens
tacaaagtaatgtataatatcg

SEQ ID NO: 8126179 - DNA, 22 bp, Homo sapiens
tacaaagtgctttagaaatgaa

SEQ ID NO: 8126180 - DNA, 22 bp, Homo sapiens
tacagaaagacctctcgggaaa

SEQ ID NO: 8126181 - DNA, 22 bp, Homo sapiens
tacagaaagggatgattgatct

SEQ ID NO: 8126182 - DNA, 22 bp, Homo sapiens
tacagaaacagcgtggttagaa

SEQ ID NO: 8126183 - DNA, 20 bp, Homo sapiens
tacagaaacaggacttttgg

SEQ ID NO: 8126184 - DNA, 22 bp, Homo sapiens
tacagaaaaactggcattgaag

SEQ ID NO: 8126185 - DNA, 22 bp, Homo sapiens
tacagaaaaacttggaggcttt

SEQ ID NO: 8126186 - DNA, 22 bp, Homo sapiens
tacagaaaaacatctggagccg

SEQ ID NO: 8126187 - DNA, 22 bp, Homo sapiens
tacagatatagagatttataga

SEQ ID NO: 8126188 - DNA, 22 bp, Homo sapiens
tacagatatagagatttataga

SEQ ID NO: 8126189 - DNA, 22 bp, Homo sapiens
tacagatatagagatttataga

SEQ ID NO: 8126190 - DNA, 22 bp, Homo sapiens
tacagataggaggaatctgaaa

SEQ ID NO: 8126191 - DNA, 22 bp, Homo sapiens
tacagatacagatctagataca

SEQ ID NO: 8126192 - DNA, 22 bp, Homo sapiens
tacagatacagatctagataca

SEQ ID NO: 8126193 - DNA, 22 bp, Homo sapiens
tacagataaattttaagtagaa

SEQ ID NO: 8126194 - DNA, 22 bp, Homo sapiens
tacagataactgaatgcagact

SEQ ID NO: 8126195 - DNA, 22 bp, Homo sapiens
tacagaagtaaataccaaaagc

SEQ ID NO: 8126196 - DNA, 22 bp, Homo sapiens
tacagaataaagcgtgaagctt

SEQ ID NO: 8126197 - DNA, 22 bp, Homo sapiens
tacagagtatttttaatatggt

SEQ ID NO: 8126198 - DNA, 22 bp, Homo sapiens
tacagagtggttgtccaactct

SEQ ID NO: 8126199 - DNA, 22 bp, Homo sapiens
tacagaactgaagtagtgaaaa

SEQ ID NO: 8126200 - DNA, 22 bp, Homo sapiens
tacagaagctgagacactgaga

SEQ ID NO: 8126201 - DNA, 22 bp, Homo sapiens
tacagaaattgccaccagctct

SEQ ID NO: 8126202 - DNA, 22 bp, Homo sapiens
tacagaaatacagtcaggccta

SEQ ID NO: 8126203 - DNA, 22 bp, Homo sapiens
tacagaaatactggggggttct

SEQ ID NO: 8126204 - DNA, 22 bp, Homo sapiens
tacagaaatcacatcgctttga

SEQ ID NO: 8126205 - DNA, 22 bp, Homo sapiens
tacatatagacagttactctag

SEQ ID NO: 8126206 - DNA, 22 bp, Homo sapiens
tacattgaaagtcatttaatcc

SEQ ID NO: 8126207 - DNA, 22 bp, Homo sapiens
tacattctggaaaggcacagac

SEQ ID NO: 8126208 - DNA, 22 bp, Homo sapiens
tacattgaactatgagttcagt

SEQ ID NO: 8126209 - DNA, 22 bp, Homo sapiens
tacaggctgaactcaatgatga

SEQ ID NO: 8126210 - DNA, 19 bp, Homo sapiens
tacaggatcctcatacagt

SEQ ID NO: 8126211 - DNA, 22 bp, Homo sapiens
tacatagagggtaatagcatca

SEQ ID NO: 8126212 - DNA, 22 bp, Homo sapiens
tacatagcaaggaaatgacaga

SEQ ID NO: 8126213 - DNA, 22 bp, Homo sapiens
gttaagaagctagagatgaaca

SEQ ID NO: 8126214 - DNA, 22 bp, Homo sapiens
gtgtgcctcccattagggtgta

SEQ ID NO: 8126215 - DNA, 22 bp, Homo sapiens
gtgctctcctggctgccctgac

SEQ ID NO: 8126216 - DNA, 22 bp, Homo sapiens
gtgctctccagccccacgtgga

SEQ ID NO: 8126217 - DNA, 18 bp, Homo sapiens
gtgtgcagttgcaggggt

SEQ ID NO: 8126218 - DNA, 22 bp, Homo sapiens
gtgtgccaccagtcaaggtgaa

SEQ ID NO: 8126219 - DNA, 22 bp, Homo sapiens
gttgcagacggggtgcactgaa

SEQ ID NO: 8126220 - DNA, 23 bp, Homo sapiens
gttgcctttgcatcttcatccat

SEQ ID NO: 8126221 - DNA, 18 bp, Homo sapiens
gtttcatgcatgtgaaac

SEQ ID NO: 8126222 - DNA, 22 bp, Homo sapiens
gttgtacaattgtttcacatgc

SEQ ID NO: 8126223 - DNA, 22 bp, Homo sapiens
taaaatttgtccctgagtgttg

SEQ ID NO: 8126224 - DNA, 22 bp, Homo sapiens
taaaatgatctctcatgttctt

SEQ ID NO: 8126225 - DNA, 22 bp, Homo sapiens
gttttgaatactactagaactt

SEQ ID NO: 8126226 - DNA, 22 bp, Homo sapiens
gttttgcttctcatgttaagtg

SEQ ID NO: 8126227 - DNA, 22 bp, Homo sapiens
taaattgatcgtttgggatgaa

SEQ ID NO: 8126228 - DNA, 23 bp, Homo sapiens
taaatttcttgattcttatgtga

SEQ ID NO: 8126229 - DNA, 22 bp, Homo sapiens
taaagtatattttttctcaata

SEQ ID NO: 8126230 - DNA, 22 bp, Homo sapiens
taaagtgctggatttgagtaaa

SEQ ID NO: 8126231 - DNA, 23 bp, Homo sapiens
taaagtgctgatggtgagggagc

SEQ ID NO: 8126232 - DNA, 22 bp, Homo sapiens
taaagtgctggatttgagtaaa

SEQ ID NO: 8126233 - DNA, 22 bp, Homo sapiens
taaagtgctgggattataggcc

SEQ ID NO: 8126234 - DNA, 22 bp, Homo sapiens
taaagtgcctcaggtcctgggt

SEQ ID NO: 8126235 - DNA, 22 bp, Homo sapiens
taaagtgcgacccagtccccag

SEQ ID NO: 8126236 - DNA, 22 bp, Homo sapiens
taaagtgctcataaaaatggat

SEQ ID NO: 8126237 - DNA, 22 bp, Homo sapiens
taaagtgcttatgataaccaag

SEQ ID NO: 8126238 - DNA, 22 bp, Homo sapiens
taaagtgcttcctaacccagag

SEQ ID NO: 8126239 - DNA, 22 bp, Homo sapiens
tcccacaggtggagcttgcagt

SEQ ID NO: 8126240 - DNA, 22 bp, Homo sapiens
tcccacagtctcacaatgcata

SEQ ID NO: 8126241 - DNA, 22 bp, Homo sapiens
tcccacagcttcgtgcttcccc

SEQ ID NO: 8126242 - DNA, 22 bp, Homo sapiens
tcccatcactagcatctgcacc

SEQ ID NO: 8126243 - DNA, 22 bp, Homo sapiens
tcccatcaatgtctgcagaaga

SEQ ID NO: 8126244 - DNA, 22 bp, Homo sapiens
tcccatcaggtttaggtgggag

SEQ ID NO: 8126245 - DNA, 19 bp, Homo sapiens
tcccatcaggaactggctt

SEQ ID NO: 8126246 - DNA, 22 bp, Homo sapiens
tcccatcactctggaatgggta

SEQ ID NO: 8126247 - DNA, 22 bp, Homo sapiens
tcccatcactagcatctgcacc

SEQ ID NO: 8126248 - DNA, 22 bp, Homo sapiens
tcccattgccatagataggaca

SEQ ID NO: 8126249 - DNA, 22 bp, Homo sapiens
tcccattctgccaaggacattg

SEQ ID NO: 8126250 - DNA, 22 bp, Homo sapiens
tcccatcaatgtctgcagaaga

SEQ ID NO: 8126251 - DNA, 22 bp, Homo sapiens
tccccaggaaattctgattctt

SEQ ID NO: 8126252 - DNA, 22 bp, Homo sapiens
tccccactcaccactggccaaa

SEQ ID NO: 8126253 - DNA, 22 bp, Homo sapiens
tccccacctacacactgctcct

SEQ ID NO: 8126254 - DNA, 22 bp, Homo sapiens
tccccaggggcatctctctgct

SEQ ID NO: 8126255 - DNA, 22 bp, Homo sapiens
tccccaggagcaatgattcagt

SEQ ID NO: 8126256 - DNA, 22 bp, Homo sapiens
tccatgccaggcagtcgatgca

SEQ ID NO: 8126257 - DNA, 22 bp, Homo sapiens
tcccaagcaatgagtcagggcc

SEQ ID NO: 8126258 - DNA, 22 bp, Homo sapiens
tcccacacagcccgctcaccgg

SEQ ID NO: 8126259 - DNA, 22 bp, Homo sapiens
tcccaagtgtcttggaccaggg

SEQ ID NO: 8126260 - DNA, 22 bp, Homo sapiens
tccatccatgtaggaagatggt

SEQ ID NO: 8126261 - DNA, 20 bp, Homo sapiens
tccatgagttagagactata

SEQ ID NO: 8126262 - DNA, 22 bp, Homo sapiens
tccaggctgcagtcttgccctc

SEQ ID NO: 8126263 - DNA, 22 bp, Homo sapiens
tccaggctggaaatgtcaaact

SEQ ID NO: 8126264 - DNA, 22 bp, Homo sapiens
tccaggctggaaatgtcaaact

SEQ ID NO: 8126265 - DNA, 22 bp, Homo sapiens
tccaggctgccacagtgcaacg

SEQ ID NO: 8126266 - DNA, 20 bp, Homo sapiens
tccagggccctggctcctct

SEQ ID NO: 8126267 - DNA, 22 bp, Homo sapiens
tccatcaccatttctgcgagct

SEQ ID NO: 8126268 - DNA, 22 bp, Homo sapiens
tccaggcatcccccaggacaga

SEQ ID NO: 8126269 - DNA, 22 bp, Homo sapiens
tccaggctaggtttacaggaca

SEQ ID NO: 8126270 - DNA, 22 bp, Homo sapiens
tccaggctcagcacttgctact

SEQ ID NO: 8126271 - DNA, 22 bp, Homo sapiens
tccaggctctaggctgctctcc

SEQ ID NO: 8126272 - DNA, 22 bp, Homo sapiens
tccaggctctcaggtgtcagca

SEQ ID NO: 8126273 - DNA, 19 bp, Homo sapiens
tccaggctgagagtcagct

SEQ ID NO: 8126274 - DNA, 22 bp, Homo sapiens
tccaggctgatccatgaagaat

SEQ ID NO: 8126275 - DNA, 22 bp, Homo sapiens
tccaggctgatccatgaagaat

SEQ ID NO: 8126276 - DNA, 21 bp, Homo sapiens
tccaggctgatgatgtcaact

SEQ ID NO: 8126277 - DNA, 22 bp, Homo sapiens
tccaggctgcaaggccacaggg

SEQ ID NO: 8126278 - DNA, 23 bp, Homo sapiens
tccaggctgaaggagcagatttt

SEQ ID NO: 8126279 - DNA, 22 bp, Homo sapiens
tccaggctctcaggtgtcagca

SEQ ID NO: 8126280 - DNA, 22 bp, Homo sapiens
tccaggctgacgcagctattta

SEQ ID NO: 8126281 - DNA, 22 bp, Homo sapiens
tccaggagtgtgtgctaatggg

SEQ ID NO: 8126282 - DNA, 20 bp, Homo sapiens
tccaggcagctcagagtgtc

SEQ ID NO: 8126283 - DNA, 18 bp, Homo sapiens
tccagctctgccacttac

SEQ ID NO: 8126284 - DNA, 22 bp, Homo sapiens
tccagctctgcttcacagtctc

SEQ ID NO: 8126285 - DNA, 22 bp, Homo sapiens
tccagcttgcctggtcttttgg

SEQ ID NO: 8126286 - DNA, 22 bp, Homo sapiens
tccagcttgacaaatgatttta

SEQ ID NO: 8126287 - DNA, 22 bp, Homo sapiens
tccagcttataggtagatttaa

SEQ ID NO: 8126288 - DNA, 22 bp, Homo sapiens
tccagcttttaccaaatgagca

SEQ ID NO: 8126289 - DNA, 22 bp, Homo sapiens
tccagctttgagattttatgga

SEQ ID NO: 8126290 - DNA, 22 bp, Homo sapiens
tccagctcccactctcactgct

SEQ ID NO: 8126291 - DNA, 20 bp, Homo sapiens
tccagctccgtgttcttcct

SEQ ID NO: 8126292 - DNA, 17 bp, Homo sapiens
tccagctcctcattgtt

SEQ ID NO: 8126293 - DNA, 22 bp, Homo sapiens
tccagagctgggtctgtgctca

SEQ ID NO: 8126294 - DNA, 23 bp, Homo sapiens
tccagagctcatgctctcaacca

SEQ ID NO: 8126295 - DNA, 19 bp, Homo sapiens
tccagaactgccctggcct

SEQ ID NO: 8126296 - DNA, 22 bp, Homo sapiens
tcattgaagtgactgaaagatt

SEQ ID NO: 8126297 - DNA, 22 bp, Homo sapiens
tcattgaatgagatgcaataga

SEQ ID NO: 8126298 - DNA, 22 bp, Homo sapiens
tccagagcaggtgtctacacag

SEQ ID NO: 8126299 - DNA, 22 bp, Homo sapiens
tccagagcctttccacccactt

SEQ ID NO: 8126300 - DNA, 22 bp, Homo sapiens
tcaagtcttcacgtgatatctc

SEQ ID NO: 8126301 - DNA, 22 bp, Homo sapiens
tcaataatggcaggataaattt

SEQ ID NO: 8126302 - DNA, 22 bp, Homo sapiens
tcaagtagaactataatgatgt

SEQ ID NO: 8126303 - DNA, 22 bp, Homo sapiens
tcaagtccaggaaagcacagtc

SEQ ID NO: 8126304 - DNA, 22 bp, Homo sapiens
tcaagtatttatttctgctggc

SEQ ID NO: 8126305 - DNA, 22 bp, Homo sapiens
tatttcttgagactcgtcttcc

SEQ ID NO: 8126306 - DNA, 22 bp, Homo sapiens
tatttcttcgggattcaagcta

SEQ ID NO: 8126307 - DNA, 22 bp, Homo sapiens
tcaagaatttggataagaaatg

SEQ ID NO: 8126308 - DNA, 22 bp, Homo sapiens
tcaagaatttttaatgtgactg

SEQ ID NO: 8126309 - DNA, 20 bp, Homo sapiens
tcaagacagacatggagttt

SEQ ID NO: 8126310 - DNA, 22 bp, Homo sapiens
tatttcttgagtggtcagtttc

SEQ ID NO: 8126311 - DNA, 18 bp, Homo sapiens
tcaagacatcatgaaata

SEQ ID NO: 8126312 - DNA, 22 bp, Homo sapiens
tcaagacatattaaatgtgcga

SEQ ID NO: 8126313 - DNA, 22 bp, Homo sapiens
tcaagacatcactgtgcatttt

SEQ ID NO: 8126314 - DNA, 22 bp, Homo sapiens
tcaagacagtgtgatactggcc

SEQ ID NO: 8126315 - DNA, 22 bp, Homo sapiens
tcaagacagatgggtaacttgg

SEQ ID NO: 8126316 - DNA, 20 bp, Homo sapiens
tcaagacagacatggagttt

SEQ ID NO: 8126317 - DNA, 21 bp, Homo sapiens
tcaagacagcatatttaagaa

SEQ ID NO: 8126318 - DNA, 22 bp, Homo sapiens
tcaagacagggtttaaggttga

SEQ ID NO: 8126319 - DNA, 22 bp, Homo sapiens
tcacagaacacaaatgccactt

SEQ ID NO: 8126320 - DNA, 22 bp, Homo sapiens
tcacaaaagcttttgaatttgg

SEQ ID NO: 8126321 - DNA, 22 bp, Homo sapiens
tcacaagggccctgcagtccac

SEQ ID NO: 8126322 - DNA, 22 bp, Homo sapiens
tcacagctccagactgcaactc

SEQ ID NO: 8126323 - DNA, 22 bp, Homo sapiens
tcacaggataaggtggcatcac

SEQ ID NO: 8126324 - DNA, 22 bp, Homo sapiens
tcacagaagttgaatttgcatg

SEQ ID NO: 8126325 - DNA, 22 bp, Homo sapiens
tcacaggcctggggcagagggc

SEQ ID NO: 8126326 - DNA, 22 bp, Homo sapiens
tcacaggctggtctccgaggac

SEQ ID NO: 8126327 - DNA, 22 bp, Homo sapiens
tcaccaggattcctatcagtag

SEQ ID NO: 8126328 - DNA, 22 bp, Homo sapiens
tcaccaggattgggctgtaggc

SEQ ID NO: 8126329 - DNA, 22 bp, Homo sapiens
tcaccaggcaactatgtactcc

SEQ ID NO: 8126330 - DNA, 22 bp, Homo sapiens
tcaccaggctagagtgcagtgg

SEQ ID NO: 8126331 - DNA, 22 bp, Homo sapiens
tcaccaataataacttgagaat

SEQ ID NO: 8126332 - DNA, 22 bp, Homo sapiens
tcaccactgaacagacctttgg

SEQ ID NO: 8126333 - DNA, 22 bp, Homo sapiens
tcacagtataacctcatatagg

SEQ ID NO: 8126334 - DNA, 22 bp, Homo sapiens
tcacattttatctgagattgac

SEQ ID NO: 8126335 - DNA, 22 bp, Homo sapiens
tcacattttctactactgtacg

SEQ ID NO: 8126336 - DNA, 22 bp, Homo sapiens
tcactctgacttggcctccaac

SEQ ID NO: 8126337 - DNA, 19 bp, Homo sapiens
tcacttctgttagcatgga

SEQ ID NO: 8126338 - DNA, 22 bp, Homo sapiens
tcacttcttcccttgcacatat

SEQ ID NO: 8126339 - DNA, 22 bp, Homo sapiens
tcactgatgcttatgaaagtgt

SEQ ID NO: 8126340 - DNA, 22 bp, Homo sapiens
tcactgacgtggggctacttga

SEQ ID NO: 8126341 - DNA, 22 bp, Homo sapiens
tcactctgttttactcactgtt

SEQ ID NO: 8126342 - DNA, 22 bp, Homo sapiens
tcactctgttttactcactgtt

SEQ ID NO: 8126343 - DNA, 22 bp, Homo sapiens
tcactctgttttactcactgtt

SEQ ID NO: 8126344 - DNA, 17 bp, Homo sapiens
tcagaccctgtgtcagg

SEQ ID NO: 8126345 - DNA, 20 bp, Homo sapiens
tcagacccggggaagggagc

SEQ ID NO: 8126346 - DNA, 22 bp, Homo sapiens
tcagagaagctgccaggcgagc

SEQ ID NO: 8126347 - DNA, 22 bp, Homo sapiens
tcagagaagacatcattgtgaa

SEQ ID NO: 8126348 - DNA, 20 bp, Homo sapiens
tcagagaaggagctttcctg

SEQ ID NO: 8126349 - DNA, 20 bp, Homo sapiens
tcagagaaggagctttcctg

SEQ ID NO: 8126350 - DNA, 22 bp, Homo sapiens
tcactttttgatatcattctgc

SEQ ID NO: 8126351 - DNA, 22 bp, Homo sapiens
tcagaggaactggactaaagcc

SEQ ID NO: 8126352 - DNA, 22 bp, Homo sapiens
tcagaggaagcatcaagttctc

SEQ ID NO: 8126353 - DNA, 22 bp, Homo sapiens
tcagaggaaagggaacatagtc

SEQ ID NO: 8126354 - DNA, 22 bp, Homo sapiens
tcagaggaaacaatctttagta

SEQ ID NO: 8126355 - DNA, 22 bp, Homo sapiens
tcagaggaaaggtcagatggct

SEQ ID NO: 8126356 - DNA, 22 bp, Homo sapiens
tcagaggaacactgtttcatgc

SEQ ID NO: 8126357 - DNA, 22 bp, Homo sapiens
tcagcacaggtcttgcaaaaca

SEQ ID NO: 8126358 - DNA, 22 bp, Homo sapiens
tcagagcttatctcttgctgga

SEQ ID NO: 8126359 - DNA, 22 bp, Homo sapiens
tcagagctaaggggagagcaaa

SEQ ID NO: 8126360 - DNA, 23 bp, Homo sapiens
tcagagaggccccctgcagagat

SEQ ID NO: 8126361 - DNA, 23 bp, Homo sapiens
tcagagaggccccctgcagagat

SEQ ID NO: 8126362 - DNA, 21 bp, Homo sapiens
tcatatttctcttgctattgt

SEQ ID NO: 8126363 - DNA, 21 bp, Homo sapiens
tcatatttctcttgctattgt

SEQ ID NO: 8126364 - DNA, 22 bp, Homo sapiens
tcatgctgaggggattttaaat

SEQ ID NO: 8126365 - DNA, 22 bp, Homo sapiens
tcatgctggcccagaatggagg

SEQ ID NO: 8126366 - DNA, 22 bp, Homo sapiens
tcatgctgagtcctggctttgt

SEQ ID NO: 8126367 - DNA, 22 bp, Homo sapiens
tcattatcttggctcatttctg

SEQ ID NO: 8126368 - DNA, 18 bp, Homo sapiens
tcattattgtttctggag

SEQ ID NO: 8126369 - DNA, 22 bp, Homo sapiens
tcatggaatagagcagtggcaa

SEQ ID NO: 8126370 - DNA, 22 bp, Homo sapiens
tcatgctgggtactatggctgc

SEQ ID NO: 8126371 - DNA, 22 bp, Homo sapiens
tcagtgtccggagcctgagtgc

SEQ ID NO: 8126372 - DNA, 22 bp, Homo sapiens
tcagtgtctcatatgaggtttc

SEQ ID NO: 8126373 - DNA, 22 bp, Homo sapiens
tcagtgaagtaatggtgagaga

SEQ ID NO: 8126374 - DNA, 20 bp, Homo sapiens
tcagtgattatctctgagtg

SEQ ID NO: 8126375 - DNA, 22 bp, Homo sapiens
tcagtgatttctggggtgaggg

SEQ ID NO: 8126376 - DNA, 22 bp, Homo sapiens
tcagtgcaatcaaggtatgttt

SEQ ID NO: 8126377 - DNA, 18 bp, Homo sapiens
tcaggctgggcctccttc

SEQ ID NO: 8126378 - DNA, 18 bp, Homo sapiens
tcaggctgggcctccttc

SEQ ID NO: 8126379 - DNA, 22 bp, Homo sapiens
tcaggctgggagacaatcactg

SEQ ID NO: 8126380 - DNA, 22 bp, Homo sapiens
tcaggctgggctcctctcccca

SEQ ID NO: 8126381 - DNA, 22 bp, Homo sapiens
tcaggctggggtgctaaggtgt

SEQ ID NO: 8126382 - DNA, 22 bp, Homo sapiens
tcaggctgaggtcatctgcatc

SEQ ID NO: 8126383 - DNA, 22 bp, Homo sapiens
tcaggctgctggccagcaggct

SEQ ID NO: 8126384 - DNA, 22 bp, Homo sapiens
tcaggctgataggaggaactga

SEQ ID NO: 8126385 - DNA, 21 bp, Homo sapiens
tcaggctgatgtcgatgttag

SEQ ID NO: 8126386 - DNA, 18 bp, Homo sapiens
tcaggctggaagtttgcc

SEQ ID NO: 8126387 - DNA, 22 bp, Homo sapiens
tcaggctgctttcatgcttaga

SEQ ID NO: 8126388 - DNA, 22 bp, Homo sapiens
tcaggctgctgtactgtgaatg

SEQ ID NO: 8126389 - DNA, 22 bp, Homo sapiens
tcaggctggagtgcagtggcgc

SEQ ID NO: 8126390 - DNA, 22 bp, Homo sapiens
tcaggctggaatgcagtggggc

SEQ ID NO: 8126391 - DNA, 18 bp, Homo sapiens
tcaggagtttgtggatgg

SEQ ID NO: 8126392 - DNA, 22 bp, Homo sapiens
tcaggcctgcaggcttcctgga

SEQ ID NO: 8126393 - DNA, 22 bp, Homo sapiens
tcagctctgcaaggtcacctcc

SEQ ID NO: 8126394 - DNA, 22 bp, Homo sapiens
tcaggagtactggtgtctacag

SEQ ID NO: 8126395 - DNA, 22 bp, Homo sapiens
tcagccttgtggccctgctcca

SEQ ID NO: 8126396 - DNA, 22 bp, Homo sapiens
tcagctctacacacacctgtgt

SEQ ID NO: 8126397 - DNA, 22 bp, Homo sapiens
tcagcactttgaagcagaagga

SEQ ID NO: 8126398 - DNA, 22 bp, Homo sapiens
tcagcctgcgtcatggtgacac

SEQ ID NO: 8126399 - DNA, 22 bp, Homo sapiens
tcagcctgctccaagtgctgcc

SEQ ID NO: 8126400 - DNA, 20 bp, Homo sapiens
tttgatttcacaaggccagt

SEQ ID NO: 8126401 - DNA, 22 bp, Homo sapiens
tttgatttactggatattctca

SEQ ID NO: 8126402 - DNA, 22 bp, Homo sapiens
tttgcaaataaataagtgctcg

SEQ ID NO: 8126403 - DNA, 22 bp, Homo sapiens
tttgcaaataccatgaaacttg

SEQ ID NO: 8126404 - DNA, 22 bp, Homo sapiens
tttgcaaatacagaggtcttgc

SEQ ID NO: 8126405 - DNA, 22 bp, Homo sapiens
tttgcaaatatgtgtttctatt

SEQ ID NO: 8126406 - DNA, 22 bp, Homo sapiens
tttgcaaatgaagctctgagga

SEQ ID NO: 8126407 - DNA, 22 bp, Homo sapiens
tttgcaaattagccaccctgtt

SEQ ID NO: 8126408 - DNA, 22 bp, Homo sapiens
tttgcaaatgctctgcagagct

SEQ ID NO: 8126409 - DNA, 22 bp, Homo sapiens
tttgcaaatttcgtctcctcag

SEQ ID NO: 8126410 - DNA, 22 bp, Homo sapiens
tttggaacaagacaaaacatta

SEQ ID NO: 8126411 - DNA, 22 bp, Homo sapiens
tttggaagggaaccaaaacatg

SEQ ID NO: 8126412 - DNA, 22 bp, Homo sapiens
tttggaagatagttcggcagtt

SEQ ID NO: 8126413 - DNA, 22 bp, Homo sapiens
tttggaagtaaatgagtgtttt

SEQ ID NO: 8126414 - DNA, 22 bp, Homo sapiens
ttttagaagttcacttgggttt

SEQ ID NO: 8126415 - DNA, 22 bp, Homo sapiens
ttttatatggcacattggttgg

SEQ ID NO: 8126416 - DNA, 22 bp, Homo sapiens
ttttatatggcacattggttgg

SEQ ID NO: 8126417 - DNA, 22 bp, Homo sapiens
ttttatagctgaatagtattcc

SEQ ID NO: 8126418 - DNA, 22 bp, Homo sapiens
ttttagaagttcatgtgggatt

SEQ ID NO: 8126419 - DNA, 22 bp, Homo sapiens
ttttatcaatcattaagacatt

SEQ ID NO: 8126420 - DNA, 22 bp, Homo sapiens
ttttatcaatcattaagacatt

SEQ ID NO: 8126421 - DNA, 22 bp, Homo sapiens
ttttatattgagtgagagttcc

SEQ ID NO: 8126422 - DNA, 22 bp, Homo sapiens
ttttatattgagtgagagttcc

SEQ ID NO: 8126423 - DNA, 20 bp, Homo sapiens
ttttatatgtagggtatatg

SEQ ID NO: 8126424 - DNA, 20 bp, Homo sapiens
ttttatatgtagggtatatg

SEQ ID NO: 8126425 - DNA, 18 bp, Homo sapiens
tttgttgggttgccttta

SEQ ID NO: 8126426 - DNA, 22 bp, Homo sapiens
tttttgggtccaggctgtatct

SEQ ID NO: 8126427 - DNA, 22 bp, Homo sapiens
ttttcttctacctgctgtccaa

SEQ ID NO: 8126428 - DNA, 22 bp, Homo sapiens
ttttctattaactcattttgca

SEQ ID NO: 8126429 - DNA, 22 bp, Homo sapiens
tttctttatcatagcatctttg

SEQ ID NO: 8126430 - DNA, 21 bp, Homo sapiens
tttcttcactttgccccatgt

SEQ ID NO: 8126431 - DNA, 22 bp, Homo sapiens
tttctctttcaatctgcagtac

SEQ ID NO: 8126432 - DNA, 22 bp, Homo sapiens
tttctctgtgggctttatgcat

SEQ ID NO: 8126433 - DNA, 22 bp, Homo sapiens
tttctgctcgctctcaatcagg

SEQ ID NO: 8126434 - DNA, 22 bp, Homo sapiens
tttctgacttttatatgcatat

SEQ ID NO: 8126435 - DNA, 22 bp, Homo sapiens
tttctcagtaatgtcctggaat

SEQ ID NO: 8126436 - DNA, 22 bp, Homo sapiens
tttctcatttagagtggcaggg

SEQ ID NO: 8126437 - DNA, 22 bp, Homo sapiens
tttctcatggaacatagctcct

SEQ ID NO: 8126438 - DNA, 22 bp, Homo sapiens
tttctaagtaagattaacttct

SEQ ID NO: 8126439 - DNA, 22 bp, Homo sapiens
tttccttctcagggagcttcaa

SEQ ID NO: 8126440 - DNA, 22 bp, Homo sapiens
tttcattgtctacatatgacat

SEQ ID NO: 8126441 - DNA, 22 bp, Homo sapiens
tttcagatgtgtgtctctgaag

SEQ ID NO: 8126442 - DNA, 22 bp, Homo sapiens
tttcaaagacagccatatttgt

SEQ ID NO: 8126443 - DNA, 22 bp, Homo sapiens
tttcaaagaccattaactatca

SEQ ID NO: 8126444 - DNA, 22 bp, Homo sapiens
tttcaaagcaactgaaaaggaa

SEQ ID NO: 8126445 - DNA, 22 bp, Homo sapiens
tttcaaaggaggctgagaggat

SEQ ID NO: 8126446 - DNA, 22 bp, Homo sapiens
tttcaaagagaggcagaaggaa

SEQ ID NO: 8126447 - DNA, 20 bp, Homo sapiens
tttcaaaggcacctatgaag

SEQ ID NO: 8126448 - DNA, 22 bp, Homo sapiens
ttggttttagttcttgctcatg

SEQ ID NO: 8126449 - DNA, 22 bp, Homo sapiens
ttggttttatcttaagattctt

SEQ ID NO: 8126450 - DNA, 22 bp, Homo sapiens
ttggttttctaatgtattaagg

SEQ ID NO: 8126451 - DNA, 22 bp, Homo sapiens
ttggttttcaggggcaggataa

SEQ ID NO: 8126452 - DNA, 22 bp, Homo sapiens
ttgtctaatgagctccacttca

SEQ ID NO: 8126453 - DNA, 22 bp, Homo sapiens
ttggttttctcagctggaccat

SEQ ID NO: 8126454 - DNA, 22 bp, Homo sapiens
ttggttttctatcctctgcaat

SEQ ID NO: 8126455 - DNA, 22 bp, Homo sapiens
ttggttttcatagctccactct

SEQ ID NO: 8126456 - DNA, 21 bp, Homo sapiens
ttggttttctgagtctgtaca

SEQ ID NO: 8126457 - DNA, 22 bp, Homo sapiens
ttggttttgggatgtacaaagg

SEQ ID NO: 8126458 - DNA, 22 bp, Homo sapiens
ttggttttgaaatagcttattg

SEQ ID NO: 8126459 - DNA, 22 bp, Homo sapiens
ttgtctggtcaaatcacttgta

SEQ ID NO: 8126460 - DNA, 22 bp, Homo sapiens
ttgtgaatagtgccgctataaa

SEQ ID NO: 8126461 - DNA, 22 bp, Homo sapiens
ttgtgaatagtgccgcaataaa

SEQ ID NO: 8126462 - DNA, 22 bp, Homo sapiens
ttggggtgttcagggtacttct

SEQ ID NO: 8126463 - DNA, 22 bp, Homo sapiens
ttggggtgttggatggagcaag

SEQ ID NO: 8126464 - DNA, 23 bp, Homo sapiens
ttgcaaatttcagttagttcatg

SEQ ID NO: 8126465 - DNA, 22 bp, Homo sapiens
ttgcaaattcatggatctgaat

SEQ ID NO: 8126466 - DNA, 22 bp, Homo sapiens
ttgcaaattattttagtccctt

SEQ ID NO: 8126467 - DNA, 22 bp, Homo sapiens
ttgcaaattgcaagagttggat

SEQ ID NO: 8126468 - DNA, 22 bp, Homo sapiens
ttgcaaattccaatccaatatt

SEQ ID NO: 8126469 - DNA, 22 bp, Homo sapiens
ttgcaattaacatatgtcaact

SEQ ID NO: 8126470 - DNA, 22 bp, Homo sapiens
ttgcaagaggtgattttattga

SEQ ID NO: 8126471 - DNA, 22 bp, Homo sapiens
ttgtgaatggtgccgcaataaa

SEQ ID NO: 8126472 - DNA, 19 bp, Homo sapiens
ttgtgtgtcagtcagagtt

SEQ ID NO: 8126473 - DNA, 22 bp, Homo sapiens
ttgtgtgtgagccttcaccaca

SEQ ID NO: 8126474 - DNA, 22 bp, Homo sapiens
ttgtgtgtcttcttcactgccc

SEQ ID NO: 8126475 - DNA, 22 bp, Homo sapiens
ttgtttccattgcagactgtgt

SEQ ID NO: 8126476 - DNA, 22 bp, Homo sapiens
ttgttaaaaatagatttccagg

SEQ ID NO: 8126477 - DNA, 22 bp, Homo sapiens
ttgttttcacagctttgcccgg

SEQ ID NO: 8126478 - DNA, 22 bp, Homo sapiens
ttgttttaagccagtctgccta

SEQ ID NO: 8126479 - DNA, 22 bp, Homo sapiens
tttaatgtttgagtcagtatat

SEQ ID NO: 8126480 - DNA, 22 bp, Homo sapiens
tttaatgttaaatttgtagatg

SEQ ID NO: 8126481 - DNA, 22 bp, Homo sapiens
tttaatgttaaatttgtagatg

SEQ ID NO: 8126482 - DNA, 22 bp, Homo sapiens
tttaaaatttagacctctccac

SEQ ID NO: 8126483 - DNA, 22 bp, Homo sapiens
tttagaaattgcagagtgggtg

SEQ ID NO: 8126484 - DNA, 22 bp, Homo sapiens
tttaccatacatcaaaatattt

SEQ ID NO: 8126485 - DNA, 22 bp, Homo sapiens
tttacgaaaagtgactaatagg

SEQ ID NO: 8126486 - DNA, 22 bp, Homo sapiens
tttaccatcctcttttagaatt

SEQ ID NO: 8126487 - DNA, 22 bp, Homo sapiens
tttaccatctgccacagatatg

SEQ ID NO: 8126488 - DNA, 22 bp, Homo sapiens
tttaccattattaaaattaagt

SEQ ID NO: 8126489 - DNA, 22 bp, Homo sapiens
tttactaagcccagttatatgc

SEQ ID NO: 8126490 - DNA, 22 bp, Homo sapiens
tttattatgtacaggcactata

SEQ ID NO: 8126491 - DNA, 22 bp, Homo sapiens
tttattatgatggacaccttcg

SEQ ID NO: 8126492 - DNA, 22 bp, Homo sapiens
tttcaaactgcccagcacacct

SEQ ID NO: 8126493 - DNA, 22 bp, Homo sapiens
tttatttgaatcaggggagaat

SEQ ID NO: 8126494 - DNA, 22 bp, Homo sapiens
tttatttgtcttgccatttagt

SEQ ID NO: 8126495 - DNA, 22 bp, Homo sapiens
ttccctggctcttctacatcgt

SEQ ID NO: 8126496 - DNA, 22 bp, Homo sapiens
ttcctagggcagagccgctggg

SEQ ID NO: 8126497 - DNA, 22 bp, Homo sapiens
ttcctcacactcccccattcga

SEQ ID NO: 8126498 - DNA, 20 bp, Homo sapiens
ttcctcacaagtccctcggc

SEQ ID NO: 8126499 - DNA, 22 bp, Homo sapiens
ttcctctgtagttgctgatgaa

SEQ ID NO: 8126500 - DNA, 22 bp, Homo sapiens
ttcctctgtatgctttgctgct

SEQ ID NO: 8126501 - DNA, 22 bp, Homo sapiens
ttcctcatctgtgcacctcact

SEQ ID NO: 8126502 - DNA, 22 bp, Homo sapiens
ttcctcatctgtgcacctcact

SEQ ID NO: 8126503 - DNA, 22 bp, Homo sapiens
ttcctcatctgtgcacctcact

SEQ ID NO: 8126504 - DNA, 22 bp, Homo sapiens
ttcctcatggggttccttcaga

SEQ ID NO: 8126505 - DNA, 22 bp, Homo sapiens
ttcctcagggcggatgggcagg

SEQ ID NO: 8126506 - DNA, 22 bp, Homo sapiens
ttcctcagctgtttgggctcat

SEQ ID NO: 8126507 - DNA, 22 bp, Homo sapiens
ttcctgttcaggaaagttgtgt

SEQ ID NO: 8126508 - DNA, 22 bp, Homo sapiens
ttccttctattcagctccaaga

SEQ ID NO: 8126509 - DNA, 22 bp, Homo sapiens
ttccttctccagaacttctagg

SEQ ID NO: 8126510 - DNA, 22 bp, Homo sapiens
ttctacaatatgaataatgaag

SEQ ID NO: 8126511 - DNA, 22 bp, Homo sapiens
ttctaggggggatcttggtcca

SEQ ID NO: 8126512 - DNA, 22 bp, Homo sapiens
ttctagggttcgagtataatcc

SEQ ID NO: 8126513 - DNA, 22 bp, Homo sapiens
ttctagggatggtaggtacaaa

SEQ ID NO: 8126514 - DNA, 22 bp, Homo sapiens
ttctagggatctgctgctgttt

SEQ ID NO: 8126515 - DNA, 22 bp, Homo sapiens
ttcaacaacttggttcaaatgg

SEQ ID NO: 8126516 - DNA, 23 bp, Homo sapiens
ttcaaagcttaagctctttccac

SEQ ID NO: 8126517 - DNA, 22 bp, Homo sapiens
ttcaactaatgtttattttatg

SEQ ID NO: 8126518 - DNA, 22 bp, Homo sapiens
ttcaatgtttcttatcaagttg

SEQ ID NO: 8126519 - DNA, 22 bp, Homo sapiens
ttcaatgcatatagatatagaa

SEQ ID NO: 8126520 - DNA, 22 bp, Homo sapiens
ttcatgcttttaccgctgttaa

SEQ ID NO: 8126521 - DNA, 22 bp, Homo sapiens
ttcatgctcctgccctttttgg

SEQ ID NO: 8126522 - DNA, 22 bp, Homo sapiens
ttcagtgcttacaggtttcttt

SEQ ID NO: 8126523 - DNA, 22 bp, Homo sapiens
ttccaatttgtggtgagttaat

SEQ ID NO: 8126524 - DNA, 22 bp, Homo sapiens
ttcatgtaccgtgtaccaggca

SEQ ID NO: 8126525 - DNA, 22 bp, Homo sapiens
ttcatgtaggctgcaatgcaca

SEQ ID NO: 8126526 - DNA, 19 bp, Homo sapiens
ttcacattggaagaagtag

SEQ ID NO: 8126527 - DNA, 22 bp, Homo sapiens
ttcacattgaaggtgctttctt

SEQ ID NO: 8126528 - DNA, 22 bp, Homo sapiens
ttcacattccgcggctattttc

SEQ ID NO: 8126529 - DNA, 22 bp, Homo sapiens
ttcacattataatcagttctgc

SEQ ID NO: 8126530 - DNA, 22 bp, Homo sapiens
ttcagtagggccctcacacagt

SEQ ID NO: 8126531 - DNA, 22 bp, Homo sapiens
ttcaggagaattccaagaagta

SEQ ID NO: 8126532 - DNA, 22 bp, Homo sapiens
ttcaggaggtgagcaagaaggg

SEQ ID NO: 8126533 - DNA, 22 bp, Homo sapiens
ttcttgctcaatgtctgtttaa

SEQ ID NO: 8126534 - DNA, 18 bp, Homo sapiens
ttctttaattcagtttga

SEQ ID NO: 8126535 - DNA, 22 bp, Homo sapiens
ttctttatcagttactcatagg

SEQ ID NO: 8126536 - DNA, 22 bp, Homo sapiens
ttcttacatattttcatatggt

SEQ ID NO: 8126537 - DNA, 22 bp, Homo sapiens
ttcttacagagtttacagagcc

SEQ ID NO: 8126538 - DNA, 22 bp, Homo sapiens
ttcttacagatttggtgaatga

SEQ ID NO: 8126539 - DNA, 22 bp, Homo sapiens
ttctgtttataatttgcagttg

SEQ ID NO: 8126540 - DNA, 22 bp, Homo sapiens
ttctgttttagaaataagtagt

SEQ ID NO: 8126541 - DNA, 22 bp, Homo sapiens
ttcttacaagtattccaggtcc

SEQ ID NO: 8126542 - DNA, 22 bp, Homo sapiens
ttctgaaggctcctcaggaaag

SEQ ID NO: 8126543 - DNA, 22 bp, Homo sapiens
ttctataaatgaatgtgtatat

SEQ ID NO: 8126544 - DNA, 22 bp, Homo sapiens
ttctataagactcatatttctt

SEQ ID NO: 8126545 - DNA, 22 bp, Homo sapiens
ttctgagagctgaagaaatgtt

SEQ ID NO: 8126546 - DNA, 22 bp, Homo sapiens
ttctgagatgaggaggaaaaag

SEQ ID NO: 8126547 - DNA, 22 bp, Homo sapiens
ttctgagagttgtagtgtatcc

SEQ ID NO: 8126548 - DNA, 22 bp, Homo sapiens
ttctgaatttctgtgtatctta

SEQ ID NO: 8126549 - DNA, 22 bp, Homo sapiens
ttctggaaagaaggctaaggtc

SEQ ID NO: 8126550 - DNA, 22 bp, Homo sapiens
ttctggaaaccctcagccagtg

SEQ ID NO: 8126551 - DNA, 19 bp, Homo sapiens
ttctggaaacccaggtaat

SEQ ID NO: 8126552 - DNA, 22 bp, Homo sapiens
ttctggaaaagaaagttaagat

SEQ ID NO: 8126553 - DNA, 22 bp, Homo sapiens
ttctggaaagcatttgaggccc

SEQ ID NO: 8126554 - DNA, 22 bp, Homo sapiens
ttctggaaagatttgcgtgtaa

SEQ ID NO: 8126555 - DNA, 20 bp, Homo sapiens
ttctgcttgcaaatatcaag

SEQ ID NO: 8126556 - DNA, 22 bp, Homo sapiens
ttctgagattgttaggcactaa

SEQ ID NO: 8126557 - DNA, 22 bp, Homo sapiens
ttctgctggtaactatgtttca

SEQ ID NO: 8126558 - DNA, 21 bp, Homo sapiens
ttctgctgtgccatgcctctg

SEQ ID NO: 8126559 - DNA, 22 bp, Homo sapiens
ttctgctctaatgtacaccagc

SEQ ID NO: 8126560 - DNA, 22 bp, Homo sapiens
ttctgctgaagtcactgggagc

SEQ ID NO: 8126561 - DNA, 22 bp, Homo sapiens
ttgaggagtgtttagggtgagg

SEQ ID NO: 8126562 - DNA, 22 bp, Homo sapiens
ttgagatattcagttccattga

SEQ ID NO: 8126563 - DNA, 22 bp, Homo sapiens
ttgaagattattctattaaaag

SEQ ID NO: 8126564 - DNA, 22 bp, Homo sapiens
ttctttatgttaatgaatctat

SEQ ID NO: 8126565 - DNA, 22 bp, Homo sapiens
ttctttcccagaagatatgttt

SEQ ID NO: 8126566 - DNA, 23 bp, Homo sapiens
ttgcaaagggcaaaggtcatgtg

SEQ ID NO: 8126567 - DNA, 22 bp, Homo sapiens
ttgcaaagagataatcctaggc

SEQ ID NO: 8126568 - DNA, 22 bp, Homo sapiens
ttgcaaataaacaagtatacat

SEQ ID NO: 8126569 - DNA, 23 bp, Homo sapiens
ttgatttagctgggattgcatgc

SEQ ID NO: 8126570 - DNA, 22 bp, Homo sapiens
ttgatttatagaatgttcaagc

SEQ ID NO: 8126571 - DNA, 22 bp, Homo sapiens
ttgatttatagaatgttcaagc

SEQ ID NO: 8126572 - DNA, 22 bp, Homo sapiens
ttgcaaatgaccattgccacat

SEQ ID NO: 8126573 - DNA, 22 bp, Homo sapiens
ttgcaaatgtgaataattacac

SEQ ID NO: 8126574 - DNA, 22 bp, Homo sapiens
ttgcaaattatataagggatgc

SEQ ID NO: 8126575 - DNA, 22 bp, Homo sapiens
ttgcaaattaaagaggatagca

SEQ ID NO: 8126576 - DNA, 22 bp, Homo sapiens
ttgcaaatgttatactgccagt

SEQ ID NO: 8126577 - DNA, 22 bp, Homo sapiens
ttgcaaatgtttcataacagta

SEQ ID NO: 8126578 - DNA, 22 bp, Homo sapiens
ttgcaaatgtggttagggcttt

SEQ ID NO: 8126579 - DNA, 22 bp, Homo sapiens
ttgcaaatgtgagtttagactg

SEQ ID NO: 8126580 - DNA, 22 bp, Homo sapiens
ttgcaaatattgtttacctttc

SEQ ID NO: 8126581 - DNA, 22 bp, Homo sapiens
ttgcaaatctttgccagaaggc

SEQ ID NO: 8126582 - DNA, 22 bp, Homo sapiens
ttgcaaatcagaagtatagatt

SEQ ID NO: 8126583 - DNA, 22 bp, Homo sapiens
ttgcaaataaacaagtatacat

SEQ ID NO: 8126584 - DNA, 22 bp, Homo sapiens
ttgcaaataatagcctgaaact

SEQ ID NO: 8126585 - DNA, 20 bp, Homo sapiens
ttgcaaatatctattgattg

SEQ ID NO: 8126586 - DNA, 22 bp, Homo sapiens
ttgattactatgtgttgaaagc

SEQ ID NO: 8126587 - DNA, 22 bp, Homo sapiens
ttgatgtacagaattgttcaca

SEQ ID NO: 8126588 - DNA, 22 bp, Homo sapiens
ttgatcttggactttccagcct

SEQ ID NO: 8126589 - DNA, 22 bp, Homo sapiens
ttgatgtaaagtgattcatggg

SEQ ID NO: 8126590 - DNA, 22 bp, Homo sapiens
ttgatccctggaaattgaaatg

SEQ ID NO: 8126591 - DNA, 22 bp, Homo sapiens
ttaagaaggtactcaaagatct

SEQ ID NO: 8126592 - DNA, 22 bp, Homo sapiens
ttaacagaggacacatcaaact

SEQ ID NO: 8126593 - DNA, 22 bp, Homo sapiens
ttaagtaagaccttatgtcttg

SEQ ID NO: 8126594 - DNA, 22 bp, Homo sapiens
ttaagtgtcataatttccaaga

SEQ ID NO: 8126595 - DNA, 22 bp, Homo sapiens
ttaattatgagaaagggaaaag

SEQ ID NO: 8126596 - DNA, 22 bp, Homo sapiens
tgttttcttcctaattgctcat

SEQ ID NO: 8126597 - DNA, 22 bp, Homo sapiens
tgtttttaaataatgatagaaa

SEQ ID NO: 8126598 - DNA, 22 bp, Homo sapiens
ttaaatattttcagcagggtca

SEQ ID NO: 8126599 - DNA, 22 bp, Homo sapiens
ttaaatattatgttgtctgcaa

SEQ ID NO: 8126600 - DNA, 22 bp, Homo sapiens
ttaaatattatgttgtctgcaa

SEQ ID NO: 8126601 - DNA, 22 bp, Homo sapiens
ttaacacatatttatcaattgc

SEQ ID NO: 8126602 - DNA, 22 bp, Homo sapiens
ttaacaatagagtttcttcagg

SEQ ID NO: 8126603 - DNA, 22 bp, Homo sapiens
ttaacaatagagtttcttcagg

SEQ ID NO: 8126604 - DNA, 22 bp, Homo sapiens
ttaaatgacttttattattctc

SEQ ID NO: 8126605 - DNA, 22 bp, Homo sapiens
ttaaatattttcagcagggtca

SEQ ID NO: 8126606 - DNA, 22 bp, Homo sapiens
ttaaatgctcacataaaggtag

SEQ ID NO: 8126607 - DNA, 22 bp, Homo sapiens
ttaaatgatgcatatcatttag

SEQ ID NO: 8126608 - DNA, 22 bp, Homo sapiens
ttaaatgaggctgatgtagatt

SEQ ID NO: 8126609 - DNA, 22 bp, Homo sapiens
ttaaatgaggctgatgtagatt

SEQ ID NO: 8126610 - DNA, 22 bp, Homo sapiens
ttaaatgagatgttcagatatt

SEQ ID NO: 8126611 - DNA, 22 bp, Homo sapiens
ttacacagatggttagtagagg

SEQ ID NO: 8126612 - DNA, 22 bp, Homo sapiens
ttacaaagaaaattaggcattt

SEQ ID NO: 8126613 - DNA, 22 bp, Homo sapiens
ttacacaacatctgtattatta

SEQ ID NO: 8126614 - DNA, 22 bp, Homo sapiens
ttacatattgtctattgttcaa

SEQ ID NO: 8126615 - DNA, 22 bp, Homo sapiens
ttacagtacagaaaataacaga

SEQ ID NO: 8126616 - DNA, 19 bp, Homo sapiens
ttacaggttgacatcaatt

SEQ ID NO: 8126617 - DNA, 22 bp, Homo sapiens
ttacaggttgtgtattcagtga

SEQ ID NO: 8126618 - DNA, 22 bp, Homo sapiens
ttacaggtgggaaaactaagct

SEQ ID NO: 8126619 - DNA, 22 bp, Homo sapiens
ttacaggtctgtgtcatcatct

SEQ ID NO: 8126620 - DNA, 22 bp, Homo sapiens
ttactttgatgatcaatgagcg

SEQ ID NO: 8126621 - DNA, 22 bp, Homo sapiens
ttactttgggtcctgcttataa

SEQ ID NO: 8126622 - DNA, 18 bp, Homo sapiens
ttactttgtatagcctag

SEQ ID NO: 8126623 - DNA, 22 bp, Homo sapiens
ttactttgctttctcattacag

SEQ ID NO: 8126624 - DNA, 22 bp, Homo sapiens
ttagacatcaagaagccaatgt

SEQ ID NO: 8126625 - DNA, 21 bp, Homo sapiens
ttagaagctaatgcagctggt

SEQ ID NO: 8126626 - DNA, 22 bp, Homo sapiens
ttacttgacataaatgagttta

SEQ ID NO: 8126627 - DNA, 22 bp, Homo sapiens
ttacttgaaatgtgataagaga

SEQ ID NO: 8126628 - DNA, 22 bp, Homo sapiens
ttacttgatgtatgatgagtag

SEQ ID NO: 8126629 - DNA, 22 bp, Homo sapiens
ttacttgatgatgtataaagtc

SEQ ID NO: 8126630 - DNA, 22 bp, Homo sapiens
ttacttgaaaggaaattaaggt

SEQ ID NO: 8126631 - DNA, 22 bp, Homo sapiens
ttactagcaggattcagattct

SEQ ID NO: 8126632 - DNA, 22 bp, Homo sapiens
ttactcagtctcccatacattg

SEQ ID NO: 8126633 - DNA, 20 bp, Homo sapiens
ttactcagttcctgccatgc

SEQ ID NO: 8126634 - DNA, 22 bp, Homo sapiens
tgttcagaacaaaggtaaatga

SEQ ID NO: 8126635 - DNA, 22 bp, Homo sapiens
tgttcccattttctgcataatc

SEQ ID NO: 8126636 - DNA, 22 bp, Homo sapiens
tgtgtttgaggcatgttgcaga

SEQ ID NO: 8126637 - DNA, 22 bp, Homo sapiens
tgtgttgttttaagctgctgca

SEQ ID NO: 8126638 - DNA, 22 bp, Homo sapiens
tgtgttattgccactgaagacc

SEQ ID NO: 8126639 - DNA, 22 bp, Homo sapiens
tgttctcttttcctgctgagcc

SEQ ID NO: 8126640 - DNA, 22 bp, Homo sapiens
tgttctctaagaaaagaagcat

SEQ ID NO: 8126641 - DNA, 22 bp, Homo sapiens
tgtttacaaggagaatttgagg

SEQ ID NO: 8126642 - DNA, 22 bp, Homo sapiens
tgtttacaaggagtttatattg

SEQ ID NO: 8126643 - DNA, 22 bp, Homo sapiens
tgtttacacttcaaggttaagg

SEQ ID NO: 8126644 - DNA, 22 bp, Homo sapiens
tgtttacatgcataagcttaag

SEQ ID NO: 8126645 - DNA, 22 bp, Homo sapiens
tgtttcctaagtgtctctgaag

SEQ ID NO: 8126646 - DNA, 18 bp, Homo sapiens
tgtttcctcctggaggct

SEQ ID NO: 8126647 - DNA, 22 bp, Homo sapiens
tgtttgaaaagtggagatttat

SEQ ID NO: 8126648 - DNA, 22 bp, Homo sapiens
tgtgtgattccacttatatggg

SEQ ID NO: 8126649 - DNA, 22 bp, Homo sapiens
tgtgtgattgcacttatatgag

SEQ ID NO: 8126650 - DNA, 20 bp, Homo sapiens
tgtgtcttcctttctttatg

SEQ ID NO: 8126651 - DNA, 20 bp, Homo sapiens
tgtgtcaggccctgattaaa

SEQ ID NO: 8126652 - DNA, 22 bp, Homo sapiens
tgtgtcaggccttatcggtggc

SEQ ID NO: 8126653 - DNA, 19 bp, Homo sapiens
tgtggtctctgttctcagg

SEQ ID NO: 8126654 - DNA, 22 bp, Homo sapiens
tgtggccagaggtactatttta

SEQ ID NO: 8126655 - DNA, 22 bp, Homo sapiens
tgtggccatggtcagaatattg

SEQ ID NO: 8126656 - DNA, 22 bp, Homo sapiens
tgtggccagcaggtggctgtgt

SEQ ID NO: 8126657 - DNA, 22 bp, Homo sapiens
tgtggccagccacaggcatggt

SEQ ID NO: 8126658 - DNA, 20 bp, Homo sapiens
tgtggccagctctctactgg

SEQ ID NO: 8126659 - DNA, 22 bp, Homo sapiens
tgtggcagaaccagaattcaaa

SEQ ID NO: 8126660 - DNA, 22 bp, Homo sapiens
tgtggcacttgcaaatattttg

SEQ ID NO: 8126661 - DNA, 22 bp, Homo sapiens
tccccaggtcctgtcggctcct

SEQ ID NO: 8126662 - DNA, 22 bp, Homo sapiens
tgtggacagagcagaaggtcat

SEQ ID NO: 8126663 - DNA, 22 bp, Homo sapiens
tcccctctttctggaaacacaa

SEQ ID NO: 8126664 - DNA, 22 bp, Homo sapiens
tcccctctggttgacccaggag

SEQ ID NO: 8126665 - DNA, 22 bp, Homo sapiens
tcccctctggaggctgcagggg

SEQ ID NO: 8126666 - DNA, 22 bp, Homo sapiens
tcccctctctgcgctcccaggt

SEQ ID NO: 8126667 - DNA, 22 bp, Homo sapiens
tgtggacatagaagcatgtgga

SEQ ID NO: 8126668 - DNA, 22 bp, Homo sapiens
gccaagaaatgcccctcacaga

SEQ ID NO: 8126669 - DNA, 22 bp, Homo sapiens
attgtctgaatccaaagctctg

SEQ ID NO: 8126670 - DNA, 22 bp, Homo sapiens
attgtctctttcaataacttgt

SEQ ID NO: 8126671 - DNA, 22 bp, Homo sapiens
attgtcattggcttctatgtct

SEQ ID NO: 8126672 - DNA, 22 bp, Homo sapiens
attgtcattccagtcattgtta

SEQ ID NO: 8126673 - DNA, 22 bp, Homo sapiens
gcatattttcacaagctcttgg

SEQ ID NO: 8126674 - DNA, 22 bp, Homo sapiens
gcaggcctgcccagcaggatgg

SEQ ID NO: 8126675 - DNA, 22 bp, Homo sapiens
gcaggcctgcccagcaggatgg

SEQ ID NO: 8126676 - DNA, 22 bp, Homo sapiens
gcaggcctgtaatgaagggaca

SEQ ID NO: 8126677 - DNA, 22 bp, Homo sapiens
gcaggcctgtcttgctcgccct

SEQ ID NO: 8126678 - DNA, 22 bp, Homo sapiens
attgatatattatttctaactg

SEQ ID NO: 8126679 - DNA, 22 bp, Homo sapiens
gcagctgcgaagaagtctatct

SEQ ID NO: 8126680 - DNA, 22 bp, Homo sapiens
attctttagccagcaggtatat

SEQ ID NO: 8126681 - DNA, 19 bp, Homo sapiens
attcttcagcagtgagacc

SEQ ID NO: 8126682 - DNA, 22 bp, Homo sapiens
attcacattttatttcactgga

SEQ ID NO: 8126683 - DNA, 22 bp, Homo sapiens
attcacattgagcttcactgtg

SEQ ID NO: 8126684 - DNA, 22 bp, Homo sapiens
attcagttgtaatctttgttag

SEQ ID NO: 8126685 - DNA, 22 bp, Homo sapiens
attcagttctgctggttctgct

SEQ ID NO: 8126686 - DNA, 22 bp, Homo sapiens
attactgaggcaaagtagtttt

SEQ ID NO: 8126687 - DNA, 22 bp, Homo sapiens
gatatttaactctcacaggtcc

SEQ ID NO: 8126688 - DNA, 22 bp, Homo sapiens
attaggcagtgccattgtacgg

SEQ ID NO: 8126689 - DNA, 22 bp, Homo sapiens
gcccacagttaatgggggctct

SEQ ID NO: 8126690 - DNA, 21 bp, Homo sapiens
gcccacagtgaggaggatccc

SEQ ID NO: 8126691 - DNA, 22 bp, Homo sapiens
atttctgatagtaaaggtcttt

SEQ ID NO: 8126692 - DNA, 22 bp, Homo sapiens
atttctgatacccggtcaccct

SEQ ID NO: 8126693 - DNA, 17 bp, Homo sapiens
gcccccagaaatctcag

SEQ ID NO: 8126694 - DNA, 22 bp, Homo sapiens
gcccccacaggcgggctcgggt

SEQ ID NO: 8126695 - DNA, 22 bp, Homo sapiens
gcccccaggctctggagaacct

SEQ ID NO: 8126696 - DNA, 22 bp, Homo sapiens
gcccccagctctcaagctcaaa

SEQ ID NO: 8126697 - DNA, 22 bp, Homo sapiens
gcccccaggcactacatgtgaa

SEQ ID NO: 8126698 - DNA, 22 bp, Homo sapiens
gcccccagaagggccacagatt

SEQ ID NO: 8126699 - DNA, 22 bp, Homo sapiens
gcctcacagactgactgaaagc

SEQ ID NO: 8126700 - DNA, 22 bp, Homo sapiens
gcctgaatctgatgaatgatct

SEQ ID NO: 8126701 - DNA, 20 bp, Homo sapiens
gcctgaatgcttaactggag

SEQ ID NO: 8126702 - DNA, 22 bp, Homo sapiens
attttgctgtggtacattagga

SEQ ID NO: 8126703 - DNA, 22 bp, Homo sapiens
attttgctttatgtaaatatgt

SEQ ID NO: 8126704 - DNA, 22 bp, Homo sapiens
attttgtttcctttggagtaga

SEQ ID NO: 8126705 - DNA, 22 bp, Homo sapiens
caaaagcagttctatctgagtt

SEQ ID NO: 8126706 - DNA, 22 bp, Homo sapiens
caaagcagtattggattcttta

SEQ ID NO: 8126707 - DNA, 22 bp, Homo sapiens
caaagcagtgatccttaaagga

SEQ ID NO: 8126708 - DNA, 20 bp, Homo sapiens
caaagcagtaggataaaaat

SEQ ID NO: 8126709 - DNA, 18 bp, Homo sapiens
caaagcaggtgacagtgt

SEQ ID NO: 8126710 - DNA, 22 bp, Homo sapiens
caaagcaggaagctcctgacag

SEQ ID NO: 8126711 - DNA, 22 bp, Homo sapiens
caaagcagagaactgtctcatt

SEQ ID NO: 8126712 - DNA, 22 bp, Homo sapiens
caaagcagagccagagcttgtc

SEQ ID NO: 8126713 - DNA, 22 bp, Homo sapiens
caaagcagcctgcagtgtggac

SEQ ID NO: 8126714 - DNA, 22 bp, Homo sapiens
caaagcaggaagaatattgaaa

SEQ ID NO: 8126715 - DNA, 22 bp, Homo sapiens
caaaggaaatactaatctggaa

SEQ ID NO: 8126716 - DNA, 22 bp, Homo sapiens
caaagctataaattcagacaga

SEQ ID NO: 8126717 - DNA, 21 bp, Homo sapiens
caaaggactgtagctcactga

SEQ ID NO: 8126718 - DNA, 22 bp, Homo sapiens
caaatagaactcacagacaaga

SEQ ID NO: 8126719 - DNA, 22 bp, Homo sapiens
gctctttctgtccgcagggcct

SEQ ID NO: 8126720 - DNA, 22 bp, Homo sapiens
gctgacaggctctgtgtatgct

SEQ ID NO: 8126721 - DNA, 22 bp, Homo sapiens
atgaacagtacaaagcacagac

SEQ ID NO: 8126722 - DNA, 22 bp, Homo sapiens
atgaacagtatgcaacatgatt

SEQ ID NO: 8126723 - DNA, 22 bp, Homo sapiens
atgaacagtatgcaacatgatt

SEQ ID NO: 8126724 - DNA, 22 bp, Homo sapiens
ctttctgaaagacattttaact

SEQ ID NO: 8126725 - DNA, 22 bp, Homo sapiens
ctttctgaagtttaagttctaa

SEQ ID NO: 8126726 - DNA, 22 bp, Homo sapiens
ctttctgaggagacgggctttg

SEQ ID NO: 8126727 - DNA, 22 bp, Homo sapiens
ctttctgagtccaacccctgat

SEQ ID NO: 8126728 - DNA, 22 bp, Homo sapiens
ctttctgatccctgcaaccctc

SEQ ID NO: 8126729 - DNA, 22 bp, Homo sapiens
ctttctgaagtttaagttctaa

SEQ ID NO: 8126730 - DNA, 22 bp, Homo sapiens
ctttctgatccctgcaaccctc

SEQ ID NO: 8126731 - DNA, 22 bp, Homo sapiens
ctttctgattttaagctctaat

SEQ ID NO: 8126732 - DNA, 22 bp, Homo sapiens
atgatcagcagttttcagtgtt

SEQ ID NO: 8126733 - DNA, 22 bp, Homo sapiens
atgatattttagtaaagtgata

SEQ ID NO: 8126734 - DNA, 22 bp, Homo sapiens
atgatattttagtaaagtgata

SEQ ID NO: 8126735 - DNA, 22 bp, Homo sapiens
atgatgaattttaaaagcacca

SEQ ID NO: 8126736 - DNA, 22 bp, Homo sapiens
atgatgaaattttctatcatgt

SEQ ID NO: 8126737 - DNA, 22 bp, Homo sapiens
gaaatttattatctacatcatt

SEQ ID NO: 8126738 - DNA, 22 bp, Homo sapiens
atgatcagggcagaagcagaag

SEQ ID NO: 8126739 - DNA, 22 bp, Homo sapiens
gaaaggtttggcttttcagtag

SEQ ID NO: 8126740 - DNA, 22 bp, Homo sapiens
gaaacatttgttgagtacttgc

SEQ ID NO: 8126741 - DNA, 22 bp, Homo sapiens
atgacagatgctgtggggaggt

SEQ ID NO: 8126742 - DNA, 21 bp, Homo sapiens
atgacagatgctgcagatcgt

SEQ ID NO: 8126743 - DNA, 22 bp, Homo sapiens
gaaagcagtatttagttctgtt

SEQ ID NO: 8126744 - DNA, 22 bp, Homo sapiens
gaacaatagtggtaacaaagcc

SEQ ID NO: 8126745 - DNA, 22 bp, Homo sapiens
atgcacagatccccaggaccct

SEQ ID NO: 8126746 - DNA, 22 bp, Homo sapiens
atgcacagctgaacactctaaa

SEQ ID NO: 8126747 - DNA, 22 bp, Homo sapiens
gaaggctgtggctggtctcagt

SEQ ID NO: 8126748 - DNA, 22 bp, Homo sapiens
gaatattttcagtacagatggt

SEQ ID NO: 8126749 - DNA, 22 bp, Homo sapiens
atgcacaggtgctgatgcacgc

SEQ ID NO: 8126750 - DNA, 22 bp, Homo sapiens
atgcacaggaccacacataatg

SEQ ID NO: 8126751 - DNA, 22 bp, Homo sapiens
atgctattccagaatgtaaatt

SEQ ID NO: 8126752 - DNA, 22 bp, Homo sapiens
gactggagtcaatgagcagcac

SEQ ID NO: 8126753 - DNA, 22 bp, Homo sapiens
gacggagctggttgctgcggct

SEQ ID NO: 8126754 - DNA, 22 bp, Homo sapiens
gacgggtgtatgctcccagcca

SEQ ID NO: 8126755 - DNA, 22 bp, Homo sapiens
gacggggcagccagctggtggc

SEQ ID NO: 8126756 - DNA, 22 bp, Homo sapiens
gagggcgcttcagagagatgaa

SEQ ID NO: 8126757 - DNA, 22 bp, Homo sapiens
atgtgacagtgtttgacagatg

SEQ ID NO: 8126758 - DNA, 22 bp, Homo sapiens
atgtagagtagaatagtacaac

SEQ ID NO: 8126759 - DNA, 22 bp, Homo sapiens
atgttggagtcgtaaggcatgg

SEQ ID NO: 8126760 - DNA, 22 bp, Homo sapiens
atgttggactaggctcttaatt

SEQ ID NO: 8126761 - DNA, 22 bp, Homo sapiens
atgttgtacattctatgggttt

SEQ ID NO: 8126762 - DNA, 22 bp, Homo sapiens
atgttgtattatgttattgtct

SEQ ID NO: 8126763 - DNA, 22 bp, Homo sapiens
gataatttaagtcttgggggct

SEQ ID NO: 8126764 - DNA, 22 bp, Homo sapiens
gataatttctccatctcaaggt

SEQ ID NO: 8126765 - DNA, 22 bp, Homo sapiens
gataatttgatacctcaatcag

SEQ ID NO: 8126766 - DNA, 22 bp, Homo sapiens
gataattttggttccaggttgg

SEQ ID NO: 8126767 - DNA, 22 bp, Homo sapiens
gataattttagtctgaaaattg

SEQ ID NO: 8126768 - DNA, 22 bp, Homo sapiens
gatatcagagacttggctacca

SEQ ID NO: 8126769 - DNA, 22 bp, Homo sapiens
gaggtggccaagcgaggaaggg

SEQ ID NO: 8126770 - DNA, 22 bp, Homo sapiens
gaggtggcactgtgaggagcac

SEQ ID NO: 8126771 - DNA, 22 bp, Homo sapiens
atggttatgcaaacatgatgca

SEQ ID NO: 8126772 - DNA, 22 bp, Homo sapiens
gaggcagcctcagtggacctcg

SEQ ID NO: 8126773 - DNA, 22 bp, Homo sapiens
gaggagaaatttggggacctga

SEQ ID NO: 8126774 - DNA, 22 bp, Homo sapiens
atgggcaggcctctcatttctg

SEQ ID NO: 8126775 - DNA, 18 bp, Homo sapiens
atgggcaggtaagatcca

SEQ ID NO: 8126776 - DNA, 22 bp, Homo sapiens
atgggcagggcagtgtataaga

SEQ ID NO: 8126777 - DNA, 22 bp, Homo sapiens
atggcttttgatgctaagccaa

SEQ ID NO: 8126778 - DNA, 22 bp, Homo sapiens
gagagagaggtgctgccaggca

SEQ ID NO: 8126779 - DNA, 22 bp, Homo sapiens
gagagagagctaatattaagct

SEQ ID NO: 8126780 - DNA, 22 bp, Homo sapiens
gagagagacatgtaaacgcggt

SEQ ID NO: 8126781 - DNA, 22 bp, Homo sapiens
gagagagaagtgggtgtcacct

SEQ ID NO: 8126782 - DNA, 22 bp, Homo sapiens
gagagagaaggcctgtgggtgt

SEQ ID NO: 8126783 - DNA, 22 bp, Homo sapiens
gagagagctctgtgcctgggat

SEQ ID NO: 8126784 - DNA, 23 bp, Homo sapiens
gagagagattgctaaaccactcc

SEQ ID NO: 8126785 - DNA, 22 bp, Homo sapiens
gagagataggttgcaggaagct

SEQ ID NO: 8126786 - DNA, 22 bp, Homo sapiens
cacagaggctcaaagccaggtg

SEQ ID NO: 8126787 - DNA, 22 bp, Homo sapiens
cacagagaaaatgttggtgctt

SEQ ID NO: 8126788 - DNA, 20 bp, Homo sapiens
cacagactgtatgggcacca

SEQ ID NO: 8126789 - DNA, 22 bp, Homo sapiens
ggactgggcatgggtgctctgc

SEQ ID NO: 8126790 - DNA, 22 bp, Homo sapiens
cacagagaccccttctggggcc

SEQ ID NO: 8126791 - DNA, 22 bp, Homo sapiens
ggaagggcctcgggcgtgggac

SEQ ID NO: 8126792 - DNA, 22 bp, Homo sapiens
cacagaagtttcatagtctcga

SEQ ID NO: 8126793 - DNA, 22 bp, Homo sapiens
cacagaagtgtgtataactctt

SEQ ID NO: 8126794 - DNA, 22 bp, Homo sapiens
ggaagggcaataaaatctcagg

SEQ ID NO: 8126795 - DNA, 22 bp, Homo sapiens
cacacagctagtgacaggagaa

SEQ ID NO: 8126796 - DNA, 18 bp, Homo sapiens
caatgttttagatctcta

SEQ ID NO: 8126797 - DNA, 22 bp, Homo sapiens
caatgtttgttagagctctaga

SEQ ID NO: 8126798 - DNA, 22 bp, Homo sapiens
caatgtttgtgatctactgact

SEQ ID NO: 8126799 - DNA, 22 bp, Homo sapiens
cacacagatggtaagggaggga

SEQ ID NO: 8126800 - DNA, 22 bp, Homo sapiens
cacacagacagctctctgaaga

SEQ ID NO: 8126801 - DNA, 22 bp, Homo sapiens
cacacagatggtaagggaggga

SEQ ID NO: 8126802 - DNA, 22 bp, Homo sapiens
ggaggcagaatagagtgtgggt

SEQ ID NO: 8126803 - DNA, 22 bp, Homo sapiens
cacagaggtgatagtggtcaag

SEQ ID NO: 8126804 - DNA, 22 bp, Homo sapiens
cacagatgaagtaaacaactct

SEQ ID NO: 8126805 - DNA, 19 bp, Homo sapiens
cacagatgattgacacata

SEQ ID NO: 8126806 - DNA, 22 bp, Homo sapiens
cacagatacctagtgaaacata

SEQ ID NO: 8126807 - DNA, 19 bp, Homo sapiens
ggagccgccgcccttcatt

SEQ ID NO: 8126808 - DNA, 22 bp, Homo sapiens
caaggtgccatgctgggcgggg

SEQ ID NO: 8126809 - DNA, 22 bp, Homo sapiens
caatgtcaaggagaccaaaacg

SEQ ID NO: 8126810 - DNA, 22 bp, Homo sapiens
caatgtcagaattacagttgat

SEQ ID NO: 8126811 - DNA, 22 bp, Homo sapiens
caatgtcatttcactgggctta

SEQ ID NO: 8126812 - DNA, 22 bp, Homo sapiens
caatgtcatgattttccattag

SEQ ID NO: 8126813 - DNA, 22 bp, Homo sapiens
caatgtcagtcaagcagcaaat

SEQ ID NO: 8126814 - DNA, 22 bp, Homo sapiens
caatgtcagagaagctcatatc

SEQ ID NO: 8126815 - DNA, 22 bp, Homo sapiens
caatgtttactggggacccaga

SEQ ID NO: 8126816 - DNA, 22 bp, Homo sapiens
caatgtttgagtaggagcataa

SEQ ID NO: 8126817 - DNA, 22 bp, Homo sapiens
caatgtttcttgtaaccagtga

SEQ ID NO: 8126818 - DNA, 22 bp, Homo sapiens
gctttcttcatactcaagcatc

SEQ ID NO: 8126819 - DNA, 22 bp, Homo sapiens
gctttctggtttgtgctacagg

SEQ ID NO: 8126820 - DNA, 17 bp, Homo sapiens
gcttgggctgcctgttg

SEQ ID NO: 8126821 - DNA, 22 bp, Homo sapiens
caagccagctcctgccacagag

SEQ ID NO: 8126822 - DNA, 22 bp, Homo sapiens
gctggaggaggaagtgtgaggg

SEQ ID NO: 8126823 - DNA, 22 bp, Homo sapiens
gctggaggatggactggaagaa

SEQ ID NO: 8126824 - DNA, 22 bp, Homo sapiens
ggcctgtgggaggacagctggg

SEQ ID NO: 8126825 - DNA, 22 bp, Homo sapiens
ggctcaggggccaggcctgtcc

SEQ ID NO: 8126826 - DNA, 19 bp, Homo sapiens
ggctcagggcgctgccgcc

SEQ ID NO: 8126827 - DNA, 22 bp, Homo sapiens
ggctcaggctggagtgcagtgg

SEQ ID NO: 8126828 - DNA, 22 bp, Homo sapiens
ggctctggtgccctggctccca

SEQ ID NO: 8126829 - DNA, 20 bp, Homo sapiens
ggctctggaatctggtgggc

SEQ ID NO: 8126830 - DNA, 22 bp, Homo sapiens
ggctctggtcagtgaggggcct

SEQ ID NO: 8126831 - DNA, 22 bp, Homo sapiens
ggctccagggtacccctggatg

SEQ ID NO: 8126832 - DNA, 22 bp, Homo sapiens
ggctcaggttgggtcacatgac

SEQ ID NO: 8126833 - DNA, 22 bp, Homo sapiens
ggctcaggttaccagtccctcc

SEQ ID NO: 8126834 - DNA, 22 bp, Homo sapiens
ggctgccctgggaggcaagggt

SEQ ID NO: 8126835 - DNA, 22 bp, Homo sapiens
ggctgccctcgtctactgccca

SEQ ID NO: 8126836 - DNA, 22 bp, Homo sapiens
ggctgccccagtgctcatggct

SEQ ID NO: 8126837 - DNA, 20 bp, Homo sapiens
ggctgcccactccagagtac

SEQ ID NO: 8126838 - DNA, 22 bp, Homo sapiens
cagaaaaggaagagctatgtaa

SEQ ID NO: 8126839 - DNA, 22 bp, Homo sapiens
cagaaagctctttcaatcttgc

SEQ ID NO: 8126840 - DNA, 18 bp, Homo sapiens
cagaaagttatttactct

SEQ ID NO: 8126841 - DNA, 22 bp, Homo sapiens
ggctgtccttggccaaggcact

SEQ ID NO: 8126842 - DNA, 20 bp, Homo sapiens
ggctgtcccgcggctgccgg

SEQ ID NO: 8126843 - DNA, 22 bp, Homo sapiens
ggctgtccacctaccatgccgg

SEQ ID NO: 8126844 - DNA, 22 bp, Homo sapiens
ggcaggtgcacctgagccatct

SEQ ID NO: 8126845 - DNA, 22 bp, Homo sapiens
ggcaggtgcccagagagcacga

SEQ ID NO: 8126846 - DNA, 22 bp, Homo sapiens
ggcaggtgccagttggcttggg

SEQ ID NO: 8126847 - DNA, 21 bp, Homo sapiens
ggccctggttacgcctcctct

SEQ ID NO: 8126848 - DNA, 22 bp, Homo sapiens
ggccctgtccccttcagttttg

SEQ ID NO: 8126849 - DNA, 22 bp, Homo sapiens
ggccctgtccctggccgtctgt

SEQ ID NO: 8126850 - DNA, 22 bp, Homo sapiens
ggccctgtcctggctgtctccg

SEQ ID NO: 8126851 - DNA, 22 bp, Homo sapiens
ggcccttgcagcaggcgctggc

SEQ ID NO: 8126852 - DNA, 22 bp, Homo sapiens
ggcccttcctgctctcttagct

SEQ ID NO: 8126853 - DNA, 22 bp, Homo sapiens
ggccctgttccacgtggggtgt

SEQ ID NO: 8126854 - DNA, 22 bp, Homo sapiens
ggccactgacctacatctgggg

SEQ ID NO: 8126855 - DNA, 23 bp, Homo sapiens
ggccactgaattttctgcatctt

SEQ ID NO: 8126856 - DNA, 22 bp, Homo sapiens
ggccactgctctccagcctggg

SEQ ID NO: 8126857 - DNA, 22 bp, Homo sapiens
ggccggggcctgctcgcctgtg

SEQ ID NO: 8126858 - DNA, 22 bp, Homo sapiens
ggccgctgcgcctccaaccgag

SEQ ID NO: 8126859 - DNA, 20 bp, Homo sapiens
ggccggggagctctccaggg

SEQ ID NO: 8126860 - DNA, 19 bp, Homo sapiens
ggccgcggcccgcagtggg

SEQ ID NO: 8126861 - DNA, 22 bp, Homo sapiens
cacgcacgctgggtggaggcgc

SEQ ID NO: 8126862 - DNA, 22 bp, Homo sapiens
cacatttaggttcctatagcca

SEQ ID NO: 8126863 - DNA, 22 bp, Homo sapiens
cacatttacttttatcccttgg

SEQ ID NO: 8126864 - DNA, 22 bp, Homo sapiens
cacagttttatcttatactgat

SEQ ID NO: 8126865 - DNA, 19 bp, Homo sapiens
cacatacagaaaagagtaa

SEQ ID NO: 8126866 - DNA, 22 bp, Homo sapiens
cacagttttgtcttggtttcca

SEQ ID NO: 8126867 - DNA, 22 bp, Homo sapiens
cacagttttgcccagggcttct

SEQ ID NO: 8126868 - DNA, 22 bp, Homo sapiens
cacataataaatgttcctgatg

SEQ ID NO: 8126869 - DNA, 20 bp, Homo sapiens
cagcaggaaaagtgcctcag

SEQ ID NO: 8126870 - DNA, 22 bp, Homo sapiens
cagcagctggtgagacacagcc

SEQ ID NO: 8126871 - DNA, 22 bp, Homo sapiens
cagcaggcggcccgcgggcccg

SEQ ID NO: 8126872 - DNA, 22 bp, Homo sapiens
gtcatgcatgggctctgaagaa

SEQ ID NO: 8126873 - DNA, 22 bp, Homo sapiens
gtcatgcagacagggttgtttt

SEQ ID NO: 8126874 - DNA, 22 bp, Homo sapiens
gtcatgaaattctagagcttga

SEQ ID NO: 8126875 - DNA, 22 bp, Homo sapiens
gtcataatataaaaactgactt

SEQ ID NO: 8126876 - DNA, 22 bp, Homo sapiens
gtcataaagcttgttgcattta

SEQ ID NO: 8126877 - DNA, 22 bp, Homo sapiens
gtctgttacctccaagaccatt

SEQ ID NO: 8126878 - DNA, 22 bp, Homo sapiens
cagccaggtatgggcgtgcggg

SEQ ID NO: 8126879 - DNA, 22 bp, Homo sapiens
cagccccttcctggcatctgga

SEQ ID NO: 8126880 - DNA, 22 bp, Homo sapiens
gtcccaggctccatggcagcca

SEQ ID NO: 8126881 - DNA, 22 bp, Homo sapiens
gtcccaggcttatgtggagctt

SEQ ID NO: 8126882 - DNA, 22 bp, Homo sapiens
gtccctggggaatcagctggag

SEQ ID NO: 8126883 - DNA, 22 bp, Homo sapiens
gtccctggtctaccgtggcttc

SEQ ID NO: 8126884 - DNA, 22 bp, Homo sapiens
gtccctgggggtttaggactca

SEQ ID NO: 8126885 - DNA, 20 bp, Homo sapiens
gtgcccagttggtgacagac

SEQ ID NO: 8126886 - DNA, 22 bp, Homo sapiens
cagcctgcaggaggccgtcagc

SEQ ID NO: 8126887 - DNA, 22 bp, Homo sapiens
cagccctgcttccccgctagtt

SEQ ID NO: 8126888 - DNA, 23 bp, Homo sapiens
cagccctggagatgtgggaggca

SEQ ID NO: 8126889 - DNA, 20 bp, Homo sapiens
cagcctccactcactcagct

SEQ ID NO: 8126890 - DNA, 22 bp, Homo sapiens
cagccctgcagagggcgctcct

SEQ ID NO: 8126891 - DNA, 17 bp, Homo sapiens
cagccctgccgttccca

SEQ ID NO: 8126892 - DNA, 22 bp, Homo sapiens
cagccctgccatggagcctcct

SEQ ID NO: 8126893 - DNA, 22 bp, Homo sapiens
cagctattctctgaaatgaata

SEQ ID NO: 8126894 - DNA, 22 bp, Homo sapiens
cagctacagttccactgagcat

SEQ ID NO: 8126895 - DNA, 22 bp, Homo sapiens
cagctacaggacgggcatctgc

SEQ ID NO: 8126896 - DNA, 22 bp, Homo sapiens
cagctacaggacctgatgcacc

SEQ ID NO: 8126897 - DNA, 22 bp, Homo sapiens
cagctacacaccagaactatta

SEQ ID NO: 8126898 - DNA, 22 bp, Homo sapiens
cagccttcaaggcttagctcag

SEQ ID NO: 8126899 - DNA, 22 bp, Homo sapiens
cagcctggcctgggactgctga

SEQ ID NO: 8126900 - DNA, 22 bp, Homo sapiens
cagcctgggctccagagtccct

SEQ ID NO: 8126901 - DNA, 22 bp, Homo sapiens
cagagacagcctgggagggaca

SEQ ID NO: 8126902 - DNA, 22 bp, Homo sapiens
cagagacagcctgggagggaca

SEQ ID NO: 8126903 - DNA, 22 bp, Homo sapiens
gggcagcattctgtgggcaggt

SEQ ID NO: 8126904 - DNA, 22 bp, Homo sapiens
gggcagcatcaggaggggcttt

SEQ ID NO: 8126905 - DNA, 22 bp, Homo sapiens
gggcagtgggaccaggcaccag

SEQ ID NO: 8126906 - DNA, 22 bp, Homo sapiens
gggcagtggctcacgcctgtaa

SEQ ID NO: 8126907 - DNA, 19 bp, Homo sapiens
gggcagtggcactagggag

SEQ ID NO: 8126908 - DNA, 22 bp, Homo sapiens
gggcagtgggtggctgcagcct

SEQ ID NO: 8126909 - DNA, 22 bp, Homo sapiens
cagagacaggatctcgaagact

SEQ ID NO: 8126910 - DNA, 22 bp, Homo sapiens
cagagacagggcagggagtgtg

SEQ ID NO: 8126911 - DNA, 22 bp, Homo sapiens
gggcagagaaatggacagttgg

SEQ ID NO: 8126912 - DNA, 22 bp, Homo sapiens
cagaccccgagtttgcagagtt

SEQ ID NO: 8126913 - DNA, 23 bp, Homo sapiens
cagagctggctcagagctgcctg

SEQ ID NO: 8126914 - DNA, 22 bp, Homo sapiens
cagaggagttcagtacacagcc

SEQ ID NO: 8126915 - DNA, 22 bp, Homo sapiens
cagaggatatactatctggaaa

SEQ ID NO: 8126916 - DNA, 22 bp, Homo sapiens
gggccagagcacagaggatgtt

SEQ ID NO: 8126917 - DNA, 22 bp, Homo sapiens
gggccagcctactgctagaccc

SEQ ID NO: 8126918 - DNA, 22 bp, Homo sapiens
gggctctgtgttctagctctcg

SEQ ID NO: 8126919 - DNA, 22 bp, Homo sapiens
gggccactcctggctgctgagt

SEQ ID NO: 8126920 - DNA, 22 bp, Homo sapiens
gggccactgggtcctgctggcc

SEQ ID NO: 8126921 - DNA, 22 bp, Homo sapiens
gggccactcagattgtcccctt

SEQ ID NO: 8126922 - DNA, 22 bp, Homo sapiens
gggcagtgtcgaggtctggtcc

SEQ ID NO: 8126923 - DNA, 22 bp, Homo sapiens
gggcagtgtcggggcccaggga

SEQ ID NO: 8126924 - DNA, 22 bp, Homo sapiens
gggcagtgtctggcccccaggc

SEQ ID NO: 8126925 - DNA, 22 bp, Homo sapiens
gggctgacaccacccaggcgca

SEQ ID NO: 8126926 - DNA, 22 bp, Homo sapiens
gggctgacatatttggtgctct

SEQ ID NO: 8126927 - DNA, 22 bp, Homo sapiens
ggtgctgatttgttgctgagat

SEQ ID NO: 8126928 - DNA, 22 bp, Homo sapiens
ggtgctgctgctgaacccagct

SEQ ID NO: 8126929 - DNA, 22 bp, Homo sapiens
ggtgctgactctgtcgtgagca

SEQ ID NO: 8126930 - DNA, 22 bp, Homo sapiens
cagcacattgatcagagacgct

SEQ ID NO: 8126931 - DNA, 22 bp, Homo sapiens
cagcacatggatggagttagga

SEQ ID NO: 8126932 - DNA, 22 bp, Homo sapiens
cagcacatctccaagaatttct

SEQ ID NO: 8126933 - DNA, 22 bp, Homo sapiens
cagcacatctgattatatgact

SEQ ID NO: 8126934 - DNA, 22 bp, Homo sapiens
cagcacataatcagtgattgtg

SEQ ID NO: 8126935 - DNA, 22 bp, Homo sapiens
cagcacatagtaggtattcact

SEQ ID NO: 8126936 - DNA, 22 bp, Homo sapiens
cagcacatagtaggtattcact

SEQ ID NO: 8126937 - DNA, 22 bp, Homo sapiens
ggtctgcgatggcaagggtctt

SEQ ID NO: 8126938 - DNA, 22 bp, Homo sapiens
cgggcccgagcacggcacccac

SEQ ID NO: 8126939 - DNA, 22 bp, Homo sapiens
cgggccgttaggaaggtggggc

SEQ ID NO: 8126940 - DNA, 22 bp, Homo sapiens
cgggcagcggcgtggccatggt

SEQ ID NO: 8126941 - DNA, 22 bp, Homo sapiens
cgggcagattgggaaggttcat

SEQ ID NO: 8126942 - DNA, 22 bp, Homo sapiens
cgggcagatcacacagggcttg

SEQ ID NO: 8126943 - DNA, 22 bp, Homo sapiens
cggctcagctagcttggcccca

SEQ ID NO: 8126944 - DNA, 18 bp, Homo sapiens
cgggcgggcgcctggccc

SEQ ID NO: 8126945 - DNA, 22 bp, Homo sapiens
cgggctgctctggaccgacagc

SEQ ID NO: 8126946 - DNA, 20 bp, Homo sapiens
ctaagaggaggactaggttt

SEQ ID NO: 8126947 - DNA, 22 bp, Homo sapiens
ctaagaggaagtactctgttat

SEQ ID NO: 8126948 - DNA, 22 bp, Homo sapiens
ctaagcaagaatgagtgcaaca

SEQ ID NO: 8126949 - DNA, 19 bp, Homo sapiens
cgcaggcttcgggtcgctc

SEQ ID NO: 8126950 - DNA, 20 bp, Homo sapiens
cggctcagcctctccctccc

SEQ ID NO: 8126951 - DNA, 22 bp, Homo sapiens
agtatttcctggcttatctgct

SEQ ID NO: 8126952 - DNA, 22 bp, Homo sapiens
agtatgttgacttattcttgga

SEQ ID NO: 8126953 - DNA, 22 bp, Homo sapiens
ctagaatctgggatttctgact

SEQ ID NO: 8126954 - DNA, 22 bp, Homo sapiens
cctgtcatttttatcaatgtct

SEQ ID NO: 8126955 - DNA, 20 bp, Homo sapiens
cctgtcatcccagcattttg

SEQ ID NO: 8126956 - DNA, 22 bp, Homo sapiens
cctgtgcatccggtggtcattg

SEQ ID NO: 8126957 - DNA, 18 bp, Homo sapiens
cctgtgacagaggcatca

SEQ ID NO: 8126958 - DNA, 22 bp, Homo sapiens
aggtgggcaatgaggcctgagt

SEQ ID NO: 8126959 - DNA, 22 bp, Homo sapiens
aggtgggcacacctcccttctc

SEQ ID NO: 8126960 - DNA, 22 bp, Homo sapiens
aggtggggccaaatgctacagt

SEQ ID NO: 8126961 - DNA, 22 bp, Homo sapiens
aggtggggaggagtgtctcttt

SEQ ID NO: 8126962 - DNA, 22 bp, Homo sapiens
cctggtgcccccaagccagctg

SEQ ID NO: 8126963 - DNA, 22 bp, Homo sapiens
cctgtcagctgatggctatgta

SEQ ID NO: 8126964 - DNA, 22 bp, Homo sapiens
cctgggcttgcatctgtgctgg

SEQ ID NO: 8126965 - DNA, 22 bp, Homo sapiens
cctgggctcaggcttgggcagc

SEQ ID NO: 8126966 - DNA, 22 bp, Homo sapiens
cctggaggtggaggttgcagtg

SEQ ID NO: 8126967 - DNA, 21 bp, Homo sapiens
aggtcccaggtttgggcagca

SEQ ID NO: 8126968 - DNA, 22 bp, Homo sapiens
cctgccagctgtgggccagcct

SEQ ID NO: 8126969 - DNA, 22 bp, Homo sapiens
aggtagggctaggctgcgtctg

SEQ ID NO: 8126970 - DNA, 23 bp, Homo sapiens
cctgcagctgccacgccctgctc

SEQ ID NO: 8126971 - DNA, 22 bp, Homo sapiens
ctcctcacacccactgcaacca

SEQ ID NO: 8126972 - DNA, 21 bp, Homo sapiens
ctccggagtgagctgtgggta

SEQ ID NO: 8126973 - DNA, 22 bp, Homo sapiens
ctccggaggggcgctcatgctt

SEQ ID NO: 8126974 - DNA, 22 bp, Homo sapiens
ctcctacataacccagcgaact

SEQ ID NO: 8126975 - DNA, 22 bp, Homo sapiens
ctccggccgcggtgcccagcgc

SEQ ID NO: 8126976 - DNA, 22 bp, Homo sapiens
ctcctcagaagagggtaacaca

SEQ ID NO: 8126977 - DNA, 22 bp, Homo sapiens
ctcctcagaacagccttggctg

SEQ ID NO: 8126978 - DNA, 22 bp, Homo sapiens
ctcctgggtcattgccagcaaa

SEQ ID NO: 8126979 - DNA, 22 bp, Homo sapiens
ctcctgggggacagcggcaggg

SEQ ID NO: 8126980 - DNA, 22 bp, Homo sapiens
ctcatgcattctttttgtgtgt

SEQ ID NO: 8126981 - DNA, 22 bp, Homo sapiens
agtcctcccttggggccacctt

SEQ ID NO: 8126982 - DNA, 23 bp, Homo sapiens
agtcttcattgtatttccagacc

SEQ ID NO: 8126983 - DNA, 22 bp, Homo sapiens
ctccagcctcatctcctggctg

SEQ ID NO: 8126984 - DNA, 22 bp, Homo sapiens
ctctcatgtagtatctgtatgg

SEQ ID NO: 8126985 - DNA, 22 bp, Homo sapiens
ctctcatgcaaaatttagttct

SEQ ID NO: 8126986 - DNA, 22 bp, Homo sapiens
ctctgcctgccactgttcaggc

SEQ ID NO: 8126987 - DNA, 22 bp, Homo sapiens
ctctgcatcaggcattatggat

SEQ ID NO: 8126988 - DNA, 22 bp, Homo sapiens
ctctgcctgtgtcgccaccaca

SEQ ID NO: 8126989 - DNA, 22 bp, Homo sapiens
ctctgcctgtctcatcctgcaa

SEQ ID NO: 8126990 - DNA, 22 bp, Homo sapiens
ctctgcgccaccctcgcctgct

SEQ ID NO: 8126991 - DNA, 22 bp, Homo sapiens
ctctgctcaccagccatgtgat

SEQ ID NO: 8126992 - DNA, 22 bp, Homo sapiens
ctctggcttctaccttgcagtt

SEQ ID NO: 8126993 - DNA, 22 bp, Homo sapiens
ctctggggtggaggaggctgac

SEQ ID NO: 8126994 - DNA, 22 bp, Homo sapiens
ctctggggttaagcttccatgg

SEQ ID NO: 8126995 - DNA, 22 bp, Homo sapiens
ctctggggtgcttcgacacttc

SEQ ID NO: 8126996 - DNA, 22 bp, Homo sapiens
ctgaaatattttaatctcagga

SEQ ID NO: 8126997 - DNA, 22 bp, Homo sapiens
ctgaaatatatactgggaaaaa

SEQ ID NO: 8126998 - DNA, 22 bp, Homo sapiens
ctgaaatatagatgtgaacagt

SEQ ID NO: 8126999 - DNA, 23 bp, Homo sapiens
ctgaaataccagaaaatcagtgt

SEQ ID NO: 8127000 - DNA, 22 bp, Homo sapiens
ctgagaaacaatgaattgtgat

SEQ ID NO: 8127001 - DNA, 22 bp, Homo sapiens
ctgagcagcacagggcgccagg

SEQ ID NO: 8127002 - DNA, 22 bp, Homo sapiens
ctgagcagcaacccagagcctc

SEQ ID NO: 8127003 - DNA, 22 bp, Homo sapiens
ctgagcagcaacccagagcctc

SEQ ID NO: 8127004 - DNA, 22 bp, Homo sapiens
ctgagcagcaattgctggccca

SEQ ID NO: 8127005 - DNA, 19 bp, Homo sapiens
ctgagcagagggaggaact

SEQ ID NO: 8127006 - DNA, 22 bp, Homo sapiens
ctgagcagaggtcaagatactt

SEQ ID NO: 8127007 - DNA, 22 bp, Homo sapiens
ctgagcagatgaccagccccag

SEQ ID NO: 8127008 - DNA, 22 bp, Homo sapiens
ctgaattagatgaaaaaggctc

SEQ ID NO: 8127009 - DNA, 20 bp, Homo sapiens
ctgacagaaaatatttcatc

SEQ ID NO: 8127010 - DNA, 22 bp, Homo sapiens
ctgacagaatcattaagaccat

SEQ ID NO: 8127011 - DNA, 22 bp, Homo sapiens
ctgaaattattgtttaatcaaa

SEQ ID NO: 8127012 - DNA, 22 bp, Homo sapiens
ctgaaattccatttcagccaca

SEQ ID NO: 8127013 - DNA, 22 bp, Homo sapiens
ctgcctctcaggtccctgagat

SEQ ID NO: 8127014 - DNA, 22 bp, Homo sapiens
ctgcctctattcactgaggcag

SEQ ID NO: 8127015 - DNA, 22 bp, Homo sapiens
ctgccctgtttggacagcccgg

SEQ ID NO: 8127016 - DNA, 22 bp, Homo sapiens
ataaatgcctcagaatcatccc

SEQ ID NO: 8127017 - DNA, 22 bp, Homo sapiens
ataaatgattcagcaggaaata

SEQ ID NO: 8127018 - DNA, 23 bp, Homo sapiens
ctgcagagaactgagggacagcc

SEQ ID NO: 8127019 - DNA, 22 bp, Homo sapiens
ctgcagagagtgccgggcagcc

SEQ ID NO: 8127020 - DNA, 20 bp, Homo sapiens
ctgcagggtgagtgggcgat

SEQ ID NO: 8127021 - DNA, 20 bp, Homo sapiens
ctgcagggttagaggctcca

SEQ ID NO: 8127022 - DNA, 22 bp, Homo sapiens
agttatttaaaatgattgtcct

SEQ ID NO: 8127023 - DNA, 22 bp, Homo sapiens
ctgaggagcagctggcccgcta

SEQ ID NO: 8127024 - DNA, 22 bp, Homo sapiens
ctgaggagaggtggcctgtgtt

SEQ ID NO: 8127025 - DNA, 22 bp, Homo sapiens
ctgatcattgttgttgctgtaa

SEQ ID NO: 8127026 - DNA, 22 bp, Homo sapiens
agttatttactcctttgtctct

SEQ ID NO: 8127027 - DNA, 22 bp, Homo sapiens
atacagtggctgtgagctgggc

SEQ ID NO: 8127028 - DNA, 22 bp, Homo sapiens
ctgctgcaggatgggcactctg

SEQ ID NO: 8127029 - DNA, 22 bp, Homo sapiens
ctgctgcagatgacagacccaa

SEQ ID NO: 8127030 - DNA, 22 bp, Homo sapiens
ctggagaagaggtagtatgtag

SEQ ID NO: 8127031 - DNA, 22 bp, Homo sapiens
ctggagaattctatgaaatatt

SEQ ID NO: 8127032 - DNA, 22 bp, Homo sapiens
atagcaatcagtgtatttgaaa

SEQ ID NO: 8127033 - DNA, 22 bp, Homo sapiens
atagcaatgatcaagacagaca

SEQ ID NO: 8127034 - DNA, 19 bp, Homo sapiens
ctggctgcaatgccagggt

SEQ ID NO: 8127035 - DNA, 22 bp, Homo sapiens
ctggctgcagctccgaggaaga

SEQ ID NO: 8127036 - DNA, 22 bp, Homo sapiens
atagcaaaaggcaccagagtga

SEQ ID NO: 8127037 - DNA, 22 bp, Homo sapiens
ctggcccatggtgagctctggg

SEQ ID NO: 8127038 - DNA, 22 bp, Homo sapiens
atagatttgaatttaagacttg

SEQ ID NO: 8127039 - DNA, 22 bp, Homo sapiens
atccagtctgtctaccttctca

SEQ ID NO: 8127040 - DNA, 22 bp, Homo sapiens
atccagtcccacacatgctctg

SEQ ID NO: 8127041 - DNA, 22 bp, Homo sapiens
ctgtgtgtcctcggacgagttt

SEQ ID NO: 8127042 - DNA, 22 bp, Homo sapiens
ctgtgtgtcatttgtcaatcct

SEQ ID NO: 8127043 - DNA, 21 bp, Homo sapiens
ctgtgggaccaagcactggga

SEQ ID NO: 8127044 - DNA, 22 bp, Homo sapiens
ctgtgggagaagggctttttct

SEQ ID NO: 8127045 - DNA, 22 bp, Homo sapiens
ctgtggccttggaccagcatct

SEQ ID NO: 8127046 - DNA, 22 bp, Homo sapiens
cttcctctatgttcaggtagaa

SEQ ID NO: 8127047 - DNA, 22 bp, Homo sapiens
cttcctcctccatctcgaaggc

SEQ ID NO: 8127048 - DNA, 22 bp, Homo sapiens
atctgaaaagctttaatgagct

SEQ ID NO: 8127049 - DNA, 23 bp, Homo sapiens
atctgaaaagcatttgcagtttg

SEQ ID NO: 8127050 - DNA, 22 bp, Homo sapiens
atctgaaactctgacattgtct

SEQ ID NO: 8127051 - DNA, 21 bp, Homo sapiens
atctgaaatgtcaaagcagat

SEQ ID NO: 8127052 - DNA, 22 bp, Homo sapiens
cttcttatctgaaagtaatatt

SEQ ID NO: 8127053 - DNA, 21 bp, Homo sapiens
atcagaaaatgtaatggagca

SEQ ID NO: 8127054 - DNA, 22 bp, Homo sapiens
atcaaatcattgcattaatgtt

SEQ ID NO: 8127055 - DNA, 22 bp, Homo sapiens
ctgggctcacctgtggctggca

SEQ ID NO: 8127056 - DNA, 22 bp, Homo sapiens
atattacataaacatgagtgaa

SEQ ID NO: 8127057 - DNA, 22 bp, Homo sapiens
atattactctgatttagtaaat

SEQ ID NO: 8127058 - DNA, 22 bp, Homo sapiens
atattacttcctggtataaaat

SEQ ID NO: 8127059 - DNA, 22 bp, Homo sapiens
atattataagttatttcaagtt

SEQ ID NO: 8127060 - DNA, 22 bp, Homo sapiens
atatgctaattagagggcatta

SEQ ID NO: 8127061 - DNA, 22 bp, Homo sapiens
atattatggccccatctaagct

SEQ ID NO: 8127062 - DNA, 22 bp, Homo sapiens
atattcttgaagggagattata

SEQ ID NO: 8127063 - DNA, 22 bp, Homo sapiens
catctcctttggtctacttcca

SEQ ID NO: 8127064 - DNA, 20 bp, Homo sapiens
catctcctgcctccatgttc

SEQ ID NO: 8127065 - DNA, 23 bp, Homo sapiens
aggaggcctgaaactgaggctga

SEQ ID NO: 8127066 - DNA, 22 bp, Homo sapiens
aggaggctctcaggtcctcccc

SEQ ID NO: 8127067 - DNA, 22 bp, Homo sapiens
catgaggatccaggtgacaggc

SEQ ID NO: 8127068 - DNA, 22 bp, Homo sapiens
catgagactgccttttcaaacc

SEQ ID NO: 8127069 - DNA, 22 bp, Homo sapiens
catgagaatgaagaagacttaa

SEQ ID NO: 8127070 - DNA, 22 bp, Homo sapiens
aggatggggtctgcagcctggt

SEQ ID NO: 8127071 - DNA, 22 bp, Homo sapiens
cataacattattttctgaagat

SEQ ID NO: 8127072 - DNA, 22 bp, Homo sapiens
aggaggccgctgatgggctccc

SEQ ID NO: 8127073 - DNA, 22 bp, Homo sapiens
aggagccagcgttcctcaggat

SEQ ID NO: 8127074 - DNA, 22 bp, Homo sapiens
cagtgtgggtttgggaggagta

SEQ ID NO: 8127075 - DNA, 22 bp, Homo sapiens
cagtatttgttccctatcaatg

SEQ ID NO: 8127076 - DNA, 22 bp, Homo sapiens
cattgcactctggctggaacgg

SEQ ID NO: 8127077 - DNA, 22 bp, Homo sapiens
catttcaaacagttacagctgc

SEQ ID NO: 8127078 - DNA, 22 bp, Homo sapiens
catttctgattacagaatacta

SEQ ID NO: 8127079 - DNA, 22 bp, Homo sapiens
catttctgcagaattgctcttc

SEQ ID NO: 8127080 - DNA, 22 bp, Homo sapiens
catttcaatacagtttgtaaat

SEQ ID NO: 8127081 - DNA, 22 bp, Homo sapiens
ccacagagacagagcccagggt

SEQ ID NO: 8127082 - DNA, 22 bp, Homo sapiens
catttctgtgacacttccatct

SEQ ID NO: 8127083 - DNA, 22 bp, Homo sapiens
catttctgttctcttcctgtac

SEQ ID NO: 8127084 - DNA, 22 bp, Homo sapiens
catttctgtcacgttcttttat

SEQ ID NO: 8127085 - DNA, 22 bp, Homo sapiens
catttctgggagacatgctaga

SEQ ID NO: 8127086 - DNA, 22 bp, Homo sapiens
catttctgtacatgttttggtg

SEQ ID NO: 8127087 - DNA, 23 bp, Homo sapiens
catttctgggagatttataaaat

SEQ ID NO: 8127088 - DNA, 22 bp, Homo sapiens
ccacagtttgccagccaggaat

SEQ ID NO: 8127089 - DNA, 22 bp, Homo sapiens
ccacagtttgccaacacctact

SEQ ID NO: 8127090 - DNA, 22 bp, Homo sapiens
ccacagtttcttcatctataaa

SEQ ID NO: 8127091 - DNA, 22 bp, Homo sapiens
ccacagttgctgaaatcgctta

SEQ ID NO: 8127092 - DNA, 21 bp, Homo sapiens
ccacagttctggcaagggctg

SEQ ID NO: 8127093 - DNA, 22 bp, Homo sapiens
ccacagtttaggaagtcactct

SEQ ID NO: 8127094 - DNA, 22 bp, Homo sapiens
ccacagttattcatttgtgaca

SEQ ID NO: 8127095 - DNA, 23 bp, Homo sapiens
ccacagttcatcgttcactcacc

SEQ ID NO: 8127096 - DNA, 22 bp, Homo sapiens
ccacagttcatgcactggggct

SEQ ID NO: 8127097 - DNA, 21 bp, Homo sapiens
caggctctgctagaggagcct

SEQ ID NO: 8127098 - DNA, 22 bp, Homo sapiens
agcttctagcccatccagcagg

SEQ ID NO: 8127099 - DNA, 22 bp, Homo sapiens
caggcccagtgatcagggctct

SEQ ID NO: 8127100 - DNA, 22 bp, Homo sapiens
caggcccatctgctcccaggct

SEQ ID NO: 8127101 - DNA, 22 bp, Homo sapiens
caggcagcgctcgtggcctggc

SEQ ID NO: 8127102 - DNA, 22 bp, Homo sapiens
caggcagggagctggaaaggat

SEQ ID NO: 8127103 - DNA, 22 bp, Homo sapiens
caggagcagagggtggtcagca

SEQ ID NO: 8127104 - DNA, 22 bp, Homo sapiens
caggatgggatgtagtgggccc

SEQ ID NO: 8127105 - DNA, 22 bp, Homo sapiens
caggacagagcccagactgtgt

SEQ ID NO: 8127106 - DNA, 22 bp, Homo sapiens
cagctgggtttagtggggtgtg

SEQ ID NO: 8127107 - DNA, 22 bp, Homo sapiens
aggaagagcattcacatggtag

SEQ ID NO: 8127108 - DNA, 22 bp, Homo sapiens
aggaagagctggaccagaggac

SEQ ID NO: 8127109 - DNA, 21 bp, Homo sapiens
aggaaaggccagcacgtaggg

SEQ ID NO: 8127110 - DNA, 22 bp, Homo sapiens
cagggctggctgtggcaatctc

SEQ ID NO: 8127111 - DNA, 22 bp, Homo sapiens
agctttggaaatcaatgtaaaa

SEQ ID NO: 8127112 - DNA, 22 bp, Homo sapiens
aggacagagcctgtgcagaccg

SEQ ID NO: 8127113 - DNA, 22 bp, Homo sapiens
aggacagagccctagtttcata

SEQ ID NO: 8127114 - DNA, 22 bp, Homo sapiens
aggacaagctaaaggacttcct

SEQ ID NO: 8127115 - DNA, 22 bp, Homo sapiens
aggacacttaggttattcaact

SEQ ID NO: 8127116 - DNA, 22 bp, Homo sapiens
aggacagaatctatattcagtt

SEQ ID NO: 8127117 - DNA, 22 bp, Homo sapiens
caggtgggattttgctgcttga

SEQ ID NO: 8127118 - DNA, 22 bp, Homo sapiens
cagtatttgttacagcattagc

SEQ ID NO: 8127119 - DNA, 22 bp, Homo sapiens
cagtatttggaatatagctaag

SEQ ID NO: 8127120 - DNA, 22 bp, Homo sapiens
cagtatttcctcttcttaactt

SEQ ID NO: 8127121 - DNA, 22 bp, Homo sapiens
agggaaataatctattctgagg

SEQ ID NO: 8127122 - DNA, 22 bp, Homo sapiens
agggacagttacatcatcagac

SEQ ID NO: 8127123 - DNA, 22 bp, Homo sapiens
ccctgaggcaaaggctagagtt

SEQ ID NO: 8127124 - DNA, 23 bp, Homo sapiens
agggccaggtgcggaaacagctc

SEQ ID NO: 8127125 - DNA, 22 bp, Homo sapiens
ccctgaggatagggcaggaccc

SEQ ID NO: 8127126 - DNA, 22 bp, Homo sapiens
cccctggggatcagctggaatt

SEQ ID NO: 8127127 - DNA, 21 bp, Homo sapiens
cccctgggagccctgtcagta

SEQ ID NO: 8127128 - DNA, 22 bp, Homo sapiens
cccctgggtccaggcttctctg

SEQ ID NO: 8127129 - DNA, 22 bp, Homo sapiens
agggcagactaggatggaagtg

SEQ ID NO: 8127130 - DNA, 22 bp, Homo sapiens
agggcagaccacgtgcaaggat

SEQ ID NO: 8127131 - DNA, 22 bp, Homo sapiens
agggcagaaatcgattacacct

SEQ ID NO: 8127132 - DNA, 22 bp, Homo sapiens
agggcagaaatattgatactgt

SEQ ID NO: 8127133 - DNA, 22 bp, Homo sapiens
agggcagaagtacagacactta

SEQ ID NO: 8127134 - DNA, 22 bp, Homo sapiens
cccctgccatagtcaaatctaa

SEQ ID NO: 8127135 - DNA, 22 bp, Homo sapiens
cccctgccagctatccctgaac

SEQ ID NO: 8127136 - DNA, 22 bp, Homo sapiens
agggcagaaaccaccttgatgg

SEQ ID NO: 8127137 - DNA, 18 bp, Homo sapiens
aggggcagcttgtgtgga

SEQ ID NO: 8127138 - DNA, 22 bp, Homo sapiens
aggggcctggttggcctctgtt

SEQ ID NO: 8127139 - DNA, 22 bp, Homo sapiens
aggggcggcctgcctgaagcag

SEQ ID NO: 8127140 - DNA, 22 bp, Homo sapiens
aggggctcaaagtgtgcaggga

SEQ ID NO: 8127141 - DNA, 22 bp, Homo sapiens
aggggctcaagcagtgtggtct

SEQ ID NO: 8127142 - DNA, 22 bp, Homo sapiens
aggggctcagttactttggcag

SEQ ID NO: 8127143 - DNA, 22 bp, Homo sapiens
aggggctcctttgtgctgcgtc

SEQ ID NO: 8127144 - DNA, 22 bp, Homo sapiens
aggggctgactggaaagtgcca

SEQ ID NO: 8127145 - DNA, 22 bp, Homo sapiens
aggggctctgagtgggccagga

SEQ ID NO: 8127146 - DNA, 22 bp, Homo sapiens
agggggtgatcaaggtgcggcg

SEQ ID NO: 8127147 - DNA, 22 bp, Homo sapiens
aggggtagagattgctggtgta

SEQ ID NO: 8127148 - DNA, 22 bp, Homo sapiens
agggggagacatgtgtgtgttt

SEQ ID NO: 8127149 - DNA, 22 bp, Homo sapiens
cctcagggtctctcacagcacc

SEQ ID NO: 8127150 - DNA, 22 bp, Homo sapiens
agggctttgatgtccatgagga

SEQ ID NO: 8127151 - DNA, 22 bp, Homo sapiens
agggctttgcaatgcacagtgg

SEQ ID NO: 8127152 - DNA, 22 bp, Homo sapiens
agggcttttgcaatccaagtct

SEQ ID NO: 8127153 - DNA, 22 bp, Homo sapiens
agggctttggccccctgctgca

SEQ ID NO: 8127154 - DNA, 22 bp, Homo sapiens
agggctttgtttaggtgaccac

SEQ ID NO: 8127155 - DNA, 22 bp, Homo sapiens
agggctttgtggcagtcactat

SEQ ID NO: 8127156 - DNA, 19 bp, Homo sapiens
agggctttgtgtgctgctc

SEQ ID NO: 8127157 - DNA, 22 bp, Homo sapiens
cctacagttatattcttgattg

SEQ ID NO: 8127158 - DNA, 22 bp, Homo sapiens
agggcctgtccgctcccgcccg

SEQ ID NO: 8127159 - DNA, 21 bp, Homo sapiens
agggcctgtgctctccaggtc

SEQ ID NO: 8127160 - DNA, 22 bp, Homo sapiens
cccactcctggagctagggctc

SEQ ID NO: 8127161 - DNA, 18 bp, Homo sapiens
cccacggtgctgtagggc

SEQ ID NO: 8127162 - DNA, 22 bp, Homo sapiens
ccattttctgcagctgccgcgg

SEQ ID NO: 8127163 - DNA, 18 bp, Homo sapiens
cccacacagcagtagctc

SEQ ID NO: 8127164 - DNA, 22 bp, Homo sapiens
cccacacacatttatgatagga

SEQ ID NO: 8127165 - DNA, 22 bp, Homo sapiens
aggctgccatagggaactgcat

SEQ ID NO: 8127166 - DNA, 19 bp, Homo sapiens
aggctgcccagtctctgcc

SEQ ID NO: 8127167 - DNA, 22 bp, Homo sapiens
aggctgccctgccgccagtggg

SEQ ID NO: 8127168 - DNA, 22 bp, Homo sapiens
aggctgccagaagccttcagga

SEQ ID NO: 8127169 - DNA, 22 bp, Homo sapiens
aggctcagcccaaggtggagag

SEQ ID NO: 8127170 - DNA, 22 bp, Homo sapiens
aggctcagcccctgggaggaga

SEQ ID NO: 8127171 - DNA, 22 bp, Homo sapiens
aggctctgggaacagacgggtg

SEQ ID NO: 8127172 - DNA, 20 bp, Homo sapiens
aggctcagatacccagggaa

SEQ ID NO: 8127173 - DNA, 22 bp, Homo sapiens
ccaggtggtgaaagtgggccct

SEQ ID NO: 8127174 - DNA, 20 bp, Homo sapiens
ccaggtggtgcctggagagg

SEQ ID NO: 8127175 - DNA, 22 bp, Homo sapiens
ccaggtgtttggcctgcatgat

SEQ ID NO: 8127176 - DNA, 19 bp, Homo sapiens
aggctctgtaggagagggc

SEQ ID NO: 8127177 - DNA, 22 bp, Homo sapiens
ccagggcacgttgggacagtac

SEQ ID NO: 8127178 - DNA, 22 bp, Homo sapiens
ccagggcagaaaaagagggaat

SEQ ID NO: 8127179 - DNA, 22 bp, Homo sapiens
ccagccagctggttggacgcct

SEQ ID NO: 8127180 - DNA, 22 bp, Homo sapiens
ccagcaggcagtcatatccttt

SEQ ID NO: 8127181 - DNA, 22 bp, Homo sapiens
ccagccagatgataagctctat

SEQ ID NO: 8127182 - DNA, 22 bp, Homo sapiens
aggccctgacctgggagatcta

SEQ ID NO: 8127183 - DNA, 22 bp, Homo sapiens
aggccctgcccagagctcctcg

SEQ ID NO: 8127184 - DNA, 22 bp, Homo sapiens
aggccctgcggaaatgatcatt

SEQ ID NO: 8127185 - DNA, 22 bp, Homo sapiens
aggccctgcccagtgccacaag

SEQ ID NO: 8127186 - DNA, 23 bp, Homo sapiens
aggccctgcctgtccctcttttt

SEQ ID NO: 8127187 - DNA, 22 bp, Homo sapiens
ccagaggatgctggtcagcctc

SEQ ID NO: 8127188 - DNA, 22 bp, Homo sapiens
aggctcagaggtgagcatctgc

SEQ ID NO: 8127189 - DNA, 20 bp, Homo sapiens
aggctcagagcagtagtaca

SEQ ID NO: 8127190 - DNA, 16 bp, Homo sapiens
aggctcagaggctgga

SEQ ID NO: 8127191 - DNA, 22 bp, Homo sapiens
aggctcagagatgagtaagcac

SEQ ID NO: 8127192 - DNA, 21 bp, Homo sapiens
aggctcagagagaaactcttg

SEQ ID NO: 8127193 - DNA, 21 bp, Homo sapiens
aggccctggaggtcagagaaa

SEQ ID NO: 8127194 - DNA, 22 bp, Homo sapiens
aggccctgctgaggcctccctc

SEQ ID NO: 8127195 - DNA, 22 bp, Homo sapiens
aggccctgctttccagagctca

SEQ ID NO: 8127196 - DNA, 22 bp, Homo sapiens
aggccctggacactcaagccgg

SEQ ID NO: 8127197 - DNA, 22 bp, Homo sapiens
agggaggcattagctactgcga

SEQ ID NO: 8127198 - DNA, 22 bp, Homo sapiens
agggaggcaggaaagttgtctg

SEQ ID NO: 8127199 - DNA, 20 bp, Homo sapiens
accagagatagcaatagtgc

SEQ ID NO: 8127200 - DNA, 22 bp, Homo sapiens
accagagaaaacacagcaggct

SEQ ID NO: 8127201 - DNA, 22 bp, Homo sapiens
agggccagcagcttggccaacc

SEQ ID NO: 8127202 - DNA, 22 bp, Homo sapiens
agggccagcccataatgccaaa

SEQ ID NO: 8127203 - DNA, 22 bp, Homo sapiens
agggccagcactcctggcagga

SEQ ID NO: 8127204 - DNA, 22 bp, Homo sapiens
agggccagtgggttgaaaggca

SEQ ID NO: 8127205 - DNA, 22 bp, Homo sapiens
agggccagtaccaggtgggtgg

SEQ ID NO: 8127206 - DNA, 22 bp, Homo sapiens
agggccagtaaatgtttcctca

SEQ ID NO: 8127207 - DNA, 22 bp, Homo sapiens
agggctcaatggtgggcatgta

SEQ ID NO: 8127208 - DNA, 22 bp, Homo sapiens
agggccagttcagaggacatgg

SEQ ID NO: 8127209 - DNA, 22 bp, Homo sapiens
acctcagaggccagggatctag

SEQ ID NO: 8127210 - DNA, 22 bp, Homo sapiens
acctcatctggtttgtaaggca

SEQ ID NO: 8127211 - DNA, 22 bp, Homo sapiens
aggggcctcgcaggaccgctcc

SEQ ID NO: 8127212 - DNA, 22 bp, Homo sapiens
aggggccacctgtggcaccctg

SEQ ID NO: 8127213 - DNA, 22 bp, Homo sapiens
aggggccaccaccaaggaaggt

SEQ ID NO: 8127214 - DNA, 22 bp, Homo sapiens
aggggccattgttctgcccgct

SEQ ID NO: 8127215 - DNA, 22 bp, Homo sapiens
aggggccatgtaagtgtatcac

SEQ ID NO: 8127216 - DNA, 22 bp, Homo sapiens
aggggtggagagtgttgccagt

SEQ ID NO: 8127217 - DNA, 23 bp, Homo sapiens
aggggtggtcagtacccgcagtg

SEQ ID NO: 8127218 - DNA, 22 bp, Homo sapiens
agggctcagtaaacggtggatt

SEQ ID NO: 8127219 - DNA, 22 bp, Homo sapiens
aggggcaggtgctgcacttaga

SEQ ID NO: 8127220 - DNA, 22 bp, Homo sapiens
aggggcagttccaagttttgtg

SEQ ID NO: 8127221 - DNA, 22 bp, Homo sapiens
agggctttgagaatagtggaac

SEQ ID NO: 8127222 - DNA, 22 bp, Homo sapiens
agggctttgatggcattctcat

SEQ ID NO: 8127223 - DNA, 22 bp, Homo sapiens
aggctctggcaacagctggtgt

SEQ ID NO: 8127224 - DNA, 22 bp, Homo sapiens
aggctctggagttagccaggca

SEQ ID NO: 8127225 - DNA, 22 bp, Homo sapiens
acatttctcaggtaagtcattt

SEQ ID NO: 8127226 - DNA, 22 bp, Homo sapiens
aggctggctggggatgcgtctt

SEQ ID NO: 8127227 - DNA, 22 bp, Homo sapiens
accactggctcaggagctggga

SEQ ID NO: 8127228 - DNA, 22 bp, Homo sapiens
aggctcagggacggggcccctt

SEQ ID NO: 8127229 - DNA, 22 bp, Homo sapiens
aggctcaggaggagctgccgga

SEQ ID NO: 8127230 - DNA, 22 bp, Homo sapiens
aggctcaggcaggaatggcgga

SEQ ID NO: 8127231 - DNA, 20 bp, Homo sapiens
aggctcagctgagctcttgg

SEQ ID NO: 8127232 - DNA, 22 bp, Homo sapiens
aggctcagctggtggtgatcgc

SEQ ID NO: 8127233 - DNA, 22 bp, Homo sapiens
aggctctgacccatgggaccca

SEQ ID NO: 8127234 - DNA, 22 bp, Homo sapiens
aggctctggagtgtggtgctgg

SEQ ID NO: 8127235 - DNA, 22 bp, Homo sapiens
acagtgttacttgatagtgtat

SEQ ID NO: 8127236 - DNA, 20 bp, Homo sapiens
acagtgttagttatcatctc

SEQ ID NO: 8127237 - DNA, 22 bp, Homo sapiens
acagtggagaaggcatgaggct

SEQ ID NO: 8127238 - DNA, 21 bp, Homo sapiens
acagtgagaaataaatggaaa

SEQ ID NO: 8127239 - DNA, 22 bp, Homo sapiens
acagtgagatccaagggcaggc

SEQ ID NO: 8127240 - DNA, 17 bp, Homo sapiens
aggaggccctggcgttt

SEQ ID NO: 8127241 - DNA, 22 bp, Homo sapiens
acatctgaggagaccagcctct

SEQ ID NO: 8127242 - DNA, 22 bp, Homo sapiens
acatctgttcaaatatgcattt

SEQ ID NO: 8127243 - DNA, 22 bp, Homo sapiens
acaggctcgtgcgcgcacgtgt

SEQ ID NO: 8127244 - DNA, 22 bp, Homo sapiens
aggaaaggtagcgtgccagcag

SEQ ID NO: 8127245 - DNA, 22 bp, Homo sapiens
aggacaggattgagctgaactg

SEQ ID NO: 8127246 - DNA, 22 bp, Homo sapiens
aggacagtgtggaagagggtgc

SEQ ID NO: 8127247 - DNA, 22 bp, Homo sapiens
acaggacatgtaccaggtggtc

SEQ ID NO: 8127248 - DNA, 22 bp, Homo sapiens
acaggacatggcttctgtgacg

SEQ ID NO: 8127249 - DNA, 22 bp, Homo sapiens
acaggacaggtaggattcgcag

SEQ ID NO: 8127250 - DNA, 22 bp, Homo sapiens
acaggacaatttataatgggca

SEQ ID NO: 8127251 - DNA, 22 bp, Homo sapiens
atagttctagacctatagttct

SEQ ID NO: 8127252 - DNA, 22 bp, Homo sapiens
atagctaccatgttggacagta

SEQ ID NO: 8127253 - DNA, 22 bp, Homo sapiens
atagctactgatgacacacaca

SEQ ID NO: 8127254 - DNA, 22 bp, Homo sapiens
atagctgttgccaatttccatg

SEQ ID NO: 8127255 - DNA, 22 bp, Homo sapiens
atacaagttgtgataatgtaaa

SEQ ID NO: 8127256 - DNA, 22 bp, Homo sapiens
agttcagcaaataaaacatagt

SEQ ID NO: 8127257 - DNA, 20 bp, Homo sapiens
agttcacaggccaaatttct

SEQ ID NO: 8127258 - DNA, 22 bp, Homo sapiens
agttgcagacgcagagatgttg

SEQ ID NO: 8127259 - DNA, 22 bp, Homo sapiens
agaaagaacgcacttgtgctgc

SEQ ID NO: 8127260 - DNA, 19 bp, Homo sapiens
atatagcattattcaattt

SEQ ID NO: 8127261 - DNA, 22 bp, Homo sapiens
agaaagaacgttggttatctta

SEQ ID NO: 8127262 - DNA, 22 bp, Homo sapiens
agaaatcaatatctatatgttg

SEQ ID NO: 8127263 - DNA, 20 bp, Homo sapiens
agaaatcagaccacacacta

SEQ ID NO: 8127264 - DNA, 22 bp, Homo sapiens
atattaattatttacacatgag

SEQ ID NO: 8127265 - DNA, 22 bp, Homo sapiens
atcaagagtattgacaagacca

SEQ ID NO: 8127266 - DNA, 22 bp, Homo sapiens
atctgcttgttgcatgtctgtt

SEQ ID NO: 8127267 - DNA, 22 bp, Homo sapiens
agaagccaaatgccagtgacct

SEQ ID NO: 8127268 - DNA, 22 bp, Homo sapiens
agaagcattatttaattttact

SEQ ID NO: 8127269 - DNA, 22 bp, Homo sapiens
agaagccaaaggggccagatat

SEQ ID NO: 8127270 - DNA, 20 bp, Homo sapiens
aggtgtccacgtggcagggt

SEQ ID NO: 8127271 - DNA, 22 bp, Homo sapiens
aggtggagaagagatgggcagt

SEQ ID NO: 8127272 - DNA, 22 bp, Homo sapiens
aggtggggttcagtctcagccg

SEQ ID NO: 8127273 - DNA, 22 bp, Homo sapiens
aggtggggaaaccagcgatccc

SEQ ID NO: 8127274 - DNA, 22 bp, Homo sapiens
agggtgcagggacaggtgtgca

SEQ ID NO: 8127275 - DNA, 22 bp, Homo sapiens
agggtcagttctgtgaggtgtt

SEQ ID NO: 8127276 - DNA, 21 bp, Homo sapiens
aggtgcaggcctcaagcccca

SEQ ID NO: 8127277 - DNA, 19 bp, Homo sapiens
aggtgcaggtcacagggga

SEQ ID NO: 8127278 - DNA, 22 bp, Homo sapiens
aggtgcaggagctgtgcaggga

SEQ ID NO: 8127279 - DNA, 22 bp, Homo sapiens
agggtgcatgtttgcaagagtg

SEQ ID NO: 8127280 - DNA, 22 bp, Homo sapiens
agtcagtgaatctgaaggctaa

SEQ ID NO: 8127281 - DNA, 22 bp, Homo sapiens
agtgattttatcaatttactca

SEQ ID NO: 8127282 - DNA, 22 bp, Homo sapiens
agtgagagtattaatgtgaact

SEQ ID NO: 8127283 - DNA, 22 bp, Homo sapiens
agtgaattagcctatttgtaaa

SEQ ID NO: 8127284 - DNA, 22 bp, Homo sapiens
agtgagcaagacttcgttgtcc

SEQ ID NO: 8127285 - DNA, 22 bp, Homo sapiens
actggggctgatgcgttcgtgt

SEQ ID NO: 8127286 - DNA, 22 bp, Homo sapiens
actggggcctcctccatgctct

SEQ ID NO: 8127287 - DNA, 22 bp, Homo sapiens
actggggcaggaaagtatgctg

SEQ ID NO: 8127288 - DNA, 22 bp, Homo sapiens
actggggcagtgggcagtggtt

SEQ ID NO: 8127289 - DNA, 19 bp, Homo sapiens
agttatttctaaatttacc

SEQ ID NO: 8127290 - DNA, 22 bp, Homo sapiens
agtgtgggttttatggagccct

SEQ ID NO: 8127291 - DNA, 22 bp, Homo sapiens
agtgtgtgaccttttaatttaa

SEQ ID NO: 8127292 - DNA, 22 bp, Homo sapiens
cagctggcatacctgggcccgg

SEQ ID NO: 8127293 - DNA, 23 bp, Homo sapiens
agctctggcgttggggaggtagt

SEQ ID NO: 8127294 - DNA, 22 bp, Homo sapiens
agctctggagccggaggatttc

SEQ ID NO: 8127295 - DNA, 22 bp, Homo sapiens
agctctggcactggcgcgggat

SEQ ID NO: 8127296 - DNA, 22 bp, Homo sapiens
agctctggaagccctggtagtt

SEQ ID NO: 8127297 - DNA, 22 bp, Homo sapiens
cagcgagagacaaagagctgtg

SEQ ID NO: 8127298 - DNA, 22 bp, Homo sapiens
cagcggggcctgtgctggggag

SEQ ID NO: 8127299 - DNA, 22 bp, Homo sapiens
cagccctgggtccctgccctgg

SEQ ID NO: 8127300 - DNA, 22 bp, Homo sapiens
cagcctcctgggacactcaccg

SEQ ID NO: 8127301 - DNA, 22 bp, Homo sapiens
cagcctctaagcacagcctctc

SEQ ID NO: 8127302 - DNA, 22 bp, Homo sapiens
cagcactttagcggaggcatca

SEQ ID NO: 8127303 - DNA, 22 bp, Homo sapiens
cagcatcaccaacttgagcaat

SEQ ID NO: 8127304 - DNA, 22 bp, Homo sapiens
cagcatcaccaacttgagcaat

SEQ ID NO: 8127305 - DNA, 22 bp, Homo sapiens
agccctctctttagagatctga

SEQ ID NO: 8127306 - DNA, 22 bp, Homo sapiens
cagagtgataaatatagaaatt

SEQ ID NO: 8127307 - DNA, 22 bp, Homo sapiens
cagagtgattatggaggattgc

SEQ ID NO: 8127308 - DNA, 22 bp, Homo sapiens
cagagtgaaataggggatcaag

SEQ ID NO: 8127309 - DNA, 22 bp, Homo sapiens
cagagtgaaaactgagctcaaa

SEQ ID NO: 8127310 - DNA, 20 bp, Homo sapiens
cagaggagtacatatgttca

SEQ ID NO: 8127311 - DNA, 22 bp, Homo sapiens
cagaggagtgggccgttatggt

SEQ ID NO: 8127312 - DNA, 22 bp, Homo sapiens
cagaggagaattgcgggatcat

SEQ ID NO: 8127313 - DNA, 18 bp, Homo sapiens
cagaggagagacattcag

SEQ ID NO: 8127314 - DNA, 22 bp, Homo sapiens
cagaggaggcggtatacactgc

SEQ ID NO: 8127315 - DNA, 22 bp, Homo sapiens
cagaggaggccaccgcataggc

SEQ ID NO: 8127316 - DNA, 17 bp, Homo sapiens
cagaggagctttggggg

SEQ ID NO: 8127317 - DNA, 22 bp, Homo sapiens
agcccttagtacatttctcaag

SEQ ID NO: 8127318 - DNA, 22 bp, Homo sapiens
agccgctgtctcttgggccgcg

SEQ ID NO: 8127319 - DNA, 22 bp, Homo sapiens
agcctattccaggatgagctca

SEQ ID NO: 8127320 - DNA, 22 bp, Homo sapiens
agcctgagtgcttaggactgtt

SEQ ID NO: 8127321 - DNA, 22 bp, Homo sapiens
cagagccaggtctaggagtctc

SEQ ID NO: 8127322 - DNA, 22 bp, Homo sapiens
cagagccagtcagtcagaaact

SEQ ID NO: 8127323 - DNA, 22 bp, Homo sapiens
cagagcagtaaatctggggcac

SEQ ID NO: 8127324 - DNA, 22 bp, Homo sapiens
agccaggccttttctcaaggtt

SEQ ID NO: 8127325 - DNA, 20 bp, Homo sapiens
agcaattgtgaacttattca

SEQ ID NO: 8127326 - DNA, 22 bp, Homo sapiens
agcaattggaatttagacaaga

SEQ ID NO: 8127327 - DNA, 22 bp, Homo sapiens
caagggagttgctgcatgcagg

SEQ ID NO: 8127328 - DNA, 22 bp, Homo sapiens
caatgtttttccttccttaata

SEQ ID NO: 8127329 - DNA, 22 bp, Homo sapiens
caattactggtccacagaaatt

SEQ ID NO: 8127330 - DNA, 22 bp, Homo sapiens
caatgttttgttgaatgaatag

SEQ ID NO: 8127331 - DNA, 22 bp, Homo sapiens
cacagaacaccaaagaaccttc

SEQ ID NO: 8127332 - DNA, 22 bp, Homo sapiens
cacagaacatccttagctcatg

SEQ ID NO: 8127333 - DNA, 22 bp, Homo sapiens
cacacatgtgagcagagaggcg

SEQ ID NO: 8127334 - DNA, 22 bp, Homo sapiens
cacactgttgaggacgagatgt

SEQ ID NO: 8127335 - DNA, 22 bp, Homo sapiens
caatttctggaactaattctga

SEQ ID NO: 8127336 - DNA, 23 bp, Homo sapiens
cacatggattaaatgagaccaca

SEQ ID NO: 8127337 - DNA, 22 bp, Homo sapiens
agcaggcctcatgcaccagcta

SEQ ID NO: 8127338 - DNA, 19 bp, Homo sapiens
agcaggccaggcaggtggc

SEQ ID NO: 8127339 - DNA, 18 bp, Homo sapiens
agcaggcgttgcctggga

SEQ ID NO: 8127340 - DNA, 22 bp, Homo sapiens
cactaaaactacattggaaaca

SEQ ID NO: 8127341 - DNA, 22 bp, Homo sapiens
cacattgtaggtctcagctctt

SEQ ID NO: 8127342 - DNA, 22 bp, Homo sapiens
cacgttttatgacagaagaagc

SEQ ID NO: 8127343 - DNA, 22 bp, Homo sapiens
cactgcactccatcctgggaaa

SEQ ID NO: 8127344 - DNA, 22 bp, Homo sapiens
agcatttgaaaactatttaatt

SEQ ID NO: 8127345 - DNA, 22 bp, Homo sapiens
cactgcactccagcccgggcaa

SEQ ID NO: 8127346 - DNA, 22 bp, Homo sapiens
cactggggaaaacaggcttctt

SEQ ID NO: 8127347 - DNA, 22 bp, Homo sapiens
cactggggtgggcctggtagag

SEQ ID NO: 8127348 - DNA, 22 bp, Homo sapiens
cactgggcgtgtcctgggtgag

SEQ ID NO: 8127349 - DNA, 22 bp, Homo sapiens
agccaaaggcaccagagacact

SEQ ID NO: 8127350 - DNA, 22 bp, Homo sapiens
agagaaaagccatcccagccaa

SEQ ID NO: 8127351 - DNA, 22 bp, Homo sapiens
agagaacagcattgcagctttg

SEQ ID NO: 8127352 - DNA, 22 bp, Homo sapiens
agagaacaaattaaaggtggtt

SEQ ID NO: 8127353 - DNA, 22 bp, Homo sapiens
agagaacaaattaaaggtggtt

SEQ ID NO: 8127354 - DNA, 22 bp, Homo sapiens
atgctaaaaacttgatcattat

SEQ ID NO: 8127355 - DNA, 22 bp, Homo sapiens
atgctgagattcacctgaatgt

SEQ ID NO: 8127356 - DNA, 22 bp, Homo sapiens
atgccacataattacaaataga

SEQ ID NO: 8127357 - DNA, 22 bp, Homo sapiens
atgactgttatgggactggaac

SEQ ID NO: 8127358 - DNA, 22 bp, Homo sapiens
atgaccagccgagataaacaga

SEQ ID NO: 8127359 - DNA, 22 bp, Homo sapiens
atgagaaaattgaggcccatag

SEQ ID NO: 8127360 - DNA, 19 bp, Homo sapiens
atgaggaactgaggctcag

SEQ ID NO: 8127361 - DNA, 22 bp, Homo sapiens
atgaggaggccagtaagagcct

SEQ ID NO: 8127362 - DNA, 22 bp, Homo sapiens
atgaggagctgttttaactgct

SEQ ID NO: 8127363 - DNA, 22 bp, Homo sapiens
atgcaaattaacatatagtaga

SEQ ID NO: 8127364 - DNA, 22 bp, Homo sapiens
atgcaaatgtcaccacttctaa

SEQ ID NO: 8127365 - DNA, 22 bp, Homo sapiens
atgattttctgataaagaactg

SEQ ID NO: 8127366 - DNA, 20 bp, Homo sapiens
atgattcatgatgatgtctc

SEQ ID NO: 8127367 - DNA, 22 bp, Homo sapiens
atgattgaaaatgacattgcca

SEQ ID NO: 8127368 - DNA, 22 bp, Homo sapiens
atgattgaccatctgctgggct

SEQ ID NO: 8127369 - DNA, 17 bp, Homo sapiens
atgtatattaactctga

SEQ ID NO: 8127370 - DNA, 18 bp, Homo sapiens
agagatgggagttggaaa

SEQ ID NO: 8127371 - DNA, 22 bp, Homo sapiens
atgtatatgaagctagtatttt

SEQ ID NO: 8127372 - DNA, 22 bp, Homo sapiens
atgtagttgaagtgctataaag

SEQ ID NO: 8127373 - DNA, 22 bp, Homo sapiens
atgtacatagcatcatctagga

SEQ ID NO: 8127374 - DNA, 22 bp, Homo sapiens
agagagaagcaatcagtggcca

SEQ ID NO: 8127375 - DNA, 17 bp, Homo sapiens
agagagaaaagggccat

SEQ ID NO: 8127376 - DNA, 22 bp, Homo sapiens
atggacagctgacactcacatt

SEQ ID NO: 8127377 - DNA, 22 bp, Homo sapiens
atggacagagctgagctccacc

SEQ ID NO: 8127378 - DNA, 22 bp, Homo sapiens
agagaacagtgttttgaaggag

SEQ ID NO: 8127379 - DNA, 22 bp, Homo sapiens
agagaacattagcaaaaacagc

SEQ ID NO: 8127380 - DNA, 22 bp, Homo sapiens
atgggcagtgtattggaaggaa

SEQ ID NO: 8127381 - DNA, 22 bp, Homo sapiens
atgggcagtaacagtggcagtc

SEQ ID NO: 8127382 - DNA, 16 bp, Homo sapiens
atgggcagtgaggaag

SEQ ID NO: 8127383 - DNA, 22 bp, Homo sapiens
atgggcagttaggaggccagga

SEQ ID NO: 8127384 - DNA, 21 bp, Homo sapiens
atgttcactgggtcaattaga

SEQ ID NO: 8127385 - DNA, 22 bp, Homo sapiens
atgttctaatccctgctatgta

SEQ ID NO: 8127386 - DNA, 22 bp, Homo sapiens
agagcgagtctggggctcggat

SEQ ID NO: 8127387 - DNA, 22 bp, Homo sapiens
atgtgagtgtatacttacgtgt

SEQ ID NO: 8127388 - DNA, 18 bp, Homo sapiens
agagatggtgtagagttt

SEQ ID NO: 8127389 - DNA, 22 bp, Homo sapiens
atgtgcaacttcagcagaaagg

SEQ ID NO: 8127390 - DNA, 22 bp, Homo sapiens
atgtgcaaagtaaagtaatttt

SEQ ID NO: 8127391 - DNA, 22 bp, Homo sapiens
atgttacagaaagcaaagatga

SEQ ID NO: 8127392 - DNA, 22 bp, Homo sapiens
agatgtttgtaaacacactgct

SEQ ID NO: 8127393 - DNA, 22 bp, Homo sapiens
agattctaccagagctagtttg

SEQ ID NO: 8127394 - DNA, 22 bp, Homo sapiens
agatttagtggtggaattttgg

SEQ ID NO: 8127395 - DNA, 22 bp, Homo sapiens
agatttcaatgtgagcattagt

SEQ ID NO: 8127396 - DNA, 22 bp, Homo sapiens
agatttatgtggtcacactcag

SEQ ID NO: 8127397 - DNA, 22 bp, Homo sapiens
atttctgataaacgtaagctgc

SEQ ID NO: 8127398 - DNA, 22 bp, Homo sapiens
atttcttttcaagagggtgctt

SEQ ID NO: 8127399 - DNA, 22 bp, Homo sapiens
agatgagaatttttagagtgct

SEQ ID NO: 8127400 - DNA, 22 bp, Homo sapiens
atttgaaatcccttctactgta

SEQ ID NO: 8127401 - DNA, 22 bp, Homo sapiens
atttgaaatctgggttactctg

SEQ ID NO: 8127402 - DNA, 22 bp, Homo sapiens
attttgttgatggtggagtagc

SEQ ID NO: 8127403 - DNA, 22 bp, Homo sapiens
attttgttgaggtaattgtcaa

SEQ ID NO: 8127404 - DNA, 22 bp, Homo sapiens
caaagtttaaagtagatttcag

SEQ ID NO: 8127405 - DNA, 22 bp, Homo sapiens
caaagtggctggccgggagatc

SEQ ID NO: 8127406 - DNA, 22 bp, Homo sapiens
caaagtgggtgccctgatgctc

SEQ ID NO: 8127407 - DNA, 22 bp, Homo sapiens
caaagttttagtaaacatatat

SEQ ID NO: 8127408 - DNA, 22 bp, Homo sapiens
caaataattactatcctcactt

SEQ ID NO: 8127409 - DNA, 22 bp, Homo sapiens
attgtgtggtgaatgatcagct

SEQ ID NO: 8127410 - DNA, 22 bp, Homo sapiens
attgaaatacataaaattgcca

SEQ ID NO: 8127411 - DNA, 22 bp, Homo sapiens
attgagaagaaaatctaatata

SEQ ID NO: 8127412 - DNA, 22 bp, Homo sapiens
attgagaagaaaatctaatata

SEQ ID NO: 8127413 - DNA, 22 bp, Homo sapiens
attgaaaaattcacaattctgg

SEQ ID NO: 8127414 - DNA, 22 bp, Homo sapiens
attgaaaataaggccagaaaca

SEQ ID NO: 8127415 - DNA, 22 bp, Homo sapiens
attgagaatatgatttagtata

SEQ ID NO: 8127416 - DNA, 22 bp, Homo sapiens
attgagaatattgtgacagtgt

SEQ ID NO: 8127417 - DNA, 22 bp, Homo sapiens
attgagaatccatttgagatga

SEQ ID NO: 8127418 - DNA, 22 bp, Homo sapiens
attgagagtgtatagctgatct

SEQ ID NO: 8127419 - DNA, 23 bp, Homo sapiens
attgagcaagcttttgcctaagt

SEQ ID NO: 8127420 - DNA, 22 bp, Homo sapiens
attgagcacaaacgttactaga

SEQ ID NO: 8127421 - DNA, 22 bp, Homo sapiens
attgagcagcttctctgccatc

SEQ ID NO: 8127422 - DNA, 22 bp, Homo sapiens
attgagcacctactttgtgcca

SEQ ID NO: 8127423 - DNA, 19 bp, Homo sapiens
attgagcattacaaataga

SEQ ID NO: 8127424 - DNA, 22 bp, Homo sapiens
attgtataacagcatgtatttt

SEQ ID NO: 8127425 - DNA, 22 bp, Homo sapiens
agaggaaatggataaagggtga

SEQ ID NO: 8127426 - DNA, 22 bp, Homo sapiens
attctctgaagtcaatggaaat

SEQ ID NO: 8127427 - DNA, 22 bp, Homo sapiens
attctctgaagtctttcagggc

SEQ ID NO: 8127428 - DNA, 22 bp, Homo sapiens
attctctgtctttttgaaaaca

SEQ ID NO: 8127429 - DNA, 22 bp, Homo sapiens
attgaaaaatgactattgctta

SEQ ID NO: 8127430 - DNA, 22 bp, Homo sapiens
attctaattagttctacatgtt

SEQ ID NO: 8127431 - DNA, 22 bp, Homo sapiens
actcttggtcagaacaattcag

SEQ ID NO: 8127432 - DNA, 22 bp, Homo sapiens
actctttaacagactttgatct

SEQ ID NO: 8127433 - DNA, 22 bp, Homo sapiens
actgaaaatgaattagaaacag

SEQ ID NO: 8127434 - DNA, 22 bp, Homo sapiens
actgaaaaagacatcttggtaa

SEQ ID NO: 8127435 - DNA, 22 bp, Homo sapiens
actgaaaaagtatgattcactg

SEQ ID NO: 8127436 - DNA, 19 bp, Homo sapiens
actcttttccttttgaatc

SEQ ID NO: 8127437 - DNA, 18 bp, Homo sapiens
actctttctgcccacagg

SEQ ID NO: 8127438 - DNA, 22 bp, Homo sapiens
actgtaattggattgtctgact

SEQ ID NO: 8127439 - DNA, 22 bp, Homo sapiens
actgtaattatctgaacgtgca

SEQ ID NO: 8127440 - DNA, 22 bp, Homo sapiens
actgtaatattttaagatgtct

SEQ ID NO: 8127441 - DNA, 22 bp, Homo sapiens
actgtacacacttctctgtctt

SEQ ID NO: 8127442 - DNA, 19 bp, Homo sapiens
aatagcaggagcagttccc

SEQ ID NO: 8127443 - DNA, 22 bp, Homo sapiens
aatagcacacttgtgagcatta

SEQ ID NO: 8127444 - DNA, 22 bp, Homo sapiens
actgggaggcatctggagctga

SEQ ID NO: 8127445 - DNA, 22 bp, Homo sapiens
actggctgagtttatgttcaca

SEQ ID NO: 8127446 - DNA, 22 bp, Homo sapiens
aatgaactggatcagggtttct

SEQ ID NO: 8127447 - DNA, 22 bp, Homo sapiens
aatgaacttcagtgatttctgg

SEQ ID NO: 8127448 - DNA, 22 bp, Homo sapiens
agaacaattgccccaaagcttg

SEQ ID NO: 8127449 - DNA, 22 bp, Homo sapiens
aatgcctggcgattagtgtagc

SEQ ID NO: 8127450 - DNA, 22 bp, Homo sapiens
aatgcctaagtaattattttga

SEQ ID NO: 8127451 - DNA, 22 bp, Homo sapiens
aatgcatgtttcctctcagcag

SEQ ID NO: 8127452 - DNA, 22 bp, Homo sapiens
aatgcataccatgtcatctttg

SEQ ID NO: 8127453 - DNA, 22 bp, Homo sapiens
agaaagggatgaggtagctgct

SEQ ID NO: 8127454 - DNA, 22 bp, Homo sapiens
aatctacatgcaatatttttag

SEQ ID NO: 8127455 - DNA, 22 bp, Homo sapiens
aaggacagaaacagattgctgg

SEQ ID NO: 8127456 - DNA, 22 bp, Homo sapiens
aaggacagagagccattccaga

SEQ ID NO: 8127457 - DNA, 18 bp, Homo sapiens
aaggcacaggagaacatt

SEQ ID NO: 8127458 - DNA, 22 bp, Homo sapiens
aaggcacagccacttgatcatc

SEQ ID NO: 8127459 - DNA, 22 bp, Homo sapiens
aaggcacagaggcagggcactt

SEQ ID NO: 8127460 - DNA, 22 bp, Homo sapiens
aaggcacaacacaagagggtga

SEQ ID NO: 8127461 - DNA, 22 bp, Homo sapiens
aaggcaatggcaagagaaagca

SEQ ID NO: 8127462 - DNA, 22 bp, Homo sapiens
aaggcaatgttagcaacataat

SEQ ID NO: 8127463 - DNA, 21 bp, Homo sapiens
acatgcatagagagatttctg

SEQ ID NO: 8127464 - DNA, 22 bp, Homo sapiens
acatgcatggggtaatggtatt

SEQ ID NO: 8127465 - DNA, 22 bp, Homo sapiens
acatgcatggacatgtatatat

SEQ ID NO: 8127466 - DNA, 22 bp, Homo sapiens
aagtatatttagctgagcttgt

SEQ ID NO: 8127467 - DNA, 22 bp, Homo sapiens
acccagggcttaaggcggtgca

SEQ ID NO: 8127468 - DNA, 22 bp, Homo sapiens
acccagggctcaagcgtaggca

SEQ ID NO: 8127469 - DNA, 22 bp, Homo sapiens
aagggtggtgtaggagatcaaa

SEQ ID NO: 8127470 - DNA, 22 bp, Homo sapiens
aagggtgggcaccgccaggtca

SEQ ID NO: 8127471 - DNA, 22 bp, Homo sapiens
aagggtgggccctggcagccat

SEQ ID NO: 8127472 - DNA, 22 bp, Homo sapiens
acagaaggacttgagaaagaca

SEQ ID NO: 8127473 - DNA, 22 bp, Homo sapiens
acagaaggcggggacaaggcgg

SEQ ID NO: 8127474 - DNA, 22 bp, Homo sapiens
acagaagtgttgaagttttcat

SEQ ID NO: 8127475 - DNA, 22 bp, Homo sapiens
acagaagtgtctttttcattca

SEQ ID NO: 8127476 - DNA, 22 bp, Homo sapiens
acagagggtgtggaggaagacg

SEQ ID NO: 8127477 - DNA, 22 bp, Homo sapiens
acagagggtctgggcacaggac

SEQ ID NO: 8127478 - DNA, 19 bp, Homo sapiens
acagagggcaactgagaaa

SEQ ID NO: 8127479 - DNA, 22 bp, Homo sapiens
agcgggcaccctttgagggttt

SEQ ID NO: 8127480 - DNA, 22 bp, Homo sapiens
agcgggctcaagtggccagcag

SEQ ID NO: 8127481 - DNA, 22 bp, Homo sapiens
agcgtgggtccaaggctctggt

SEQ ID NO: 8127482 - DNA, 17 bp, Homo sapiens
acagcaggcccggaggg

SEQ ID NO: 8127483 - DNA, 22 bp, Homo sapiens
acagcaggttattgttatggca

SEQ ID NO: 8127484 - DNA, 22 bp, Homo sapiens
acagcagagtggagatgagcac

SEQ ID NO: 8127485 - DNA, 22 bp, Homo sapiens
acagcagagtgtgagatagcca

SEQ ID NO: 8127486 - DNA, 22 bp, Homo sapiens
acagatagatttgagggaggct

SEQ ID NO: 8127487 - DNA, 16 bp, Homo sapiens
acacagttttaaggca

SEQ ID NO: 8127488 - DNA, 22 bp, Homo sapiens
acacagtttttcagacagagat

SEQ ID NO: 8127489 - DNA, 22 bp, Homo sapiens
acacagttctcttcttgtaact

SEQ ID NO: 8127490 - DNA, 22 bp, Homo sapiens
acacagttcttagcaggtgtct

SEQ ID NO: 8127491 - DNA, 22 bp, Homo sapiens
acacagttcgttgttttctact

SEQ ID NO: 8127492 - DNA, 22 bp, Homo sapiens
acacagttcgtgcttttctatt

SEQ ID NO: 8127493 - DNA, 22 bp, Homo sapiens
acacagttcatgcatgaggtct

SEQ ID NO: 8127494 - DNA, 22 bp, Homo sapiens
acacagtttaaacgattagtac

SEQ ID NO: 8127495 - DNA, 22 bp, Homo sapiens
acacagttggtggctcagtctg

SEQ ID NO: 8127496 - DNA, 22 bp, Homo sapiens
acacagtttatggtattctgtt

SEQ ID NO: 8127497 - DNA, 22 bp, Homo sapiens
acacagttgattgtcactcagg

SEQ ID NO: 8127498 - DNA, 22 bp, Homo sapiens
acacagttctttcactgttggt

SEQ ID NO: 8127499 - DNA, 22 bp, Homo sapiens
acacaagaataatgatgaaggt

SEQ ID NO: 8127500 - DNA, 22 bp, Homo sapiens
acacagggcggaaagcatgaga

SEQ ID NO: 8127501 - DNA, 22 bp, Homo sapiens
acacagttcaggatcaaatagc

SEQ ID NO: 8127502 - DNA, 22 bp, Homo sapiens
acactgtgtgacttctgagact

SEQ ID NO: 8127503 - DNA, 22 bp, Homo sapiens
agccagctgtgggctcaggcgg

SEQ ID NO: 8127504 - DNA, 22 bp, Homo sapiens
agccagctgtgtggtcaggcaa

SEQ ID NO: 8127505 - DNA, 22 bp, Homo sapiens
agccagctggtgggtcagctgg

SEQ ID NO: 8127506 - DNA, 22 bp, Homo sapiens
aatttggacttgggtgctagag

SEQ ID NO: 8127507 - DNA, 22 bp, Homo sapiens
aatttctgctgagcactgggcc

SEQ ID NO: 8127508 - DNA, 22 bp, Homo sapiens
aatttctgtatgaatagagaaa

SEQ ID NO: 8127509 - DNA, 22 bp, Homo sapiens
acaacagtagcctttacaaggc

SEQ ID NO: 8127510 - DNA, 22 bp, Homo sapiens
acaaagtgctgacattacaggc

SEQ ID NO: 8127511 - DNA, 22 bp, Homo sapiens
acaataatgtattgccaaaagt

SEQ ID NO: 8127512 - DNA, 22 bp, Homo sapiens
acaatactcatgctctttttct

SEQ ID NO: 8127513 - DNA, 22 bp, Homo sapiens
acaatactattttcagtatcct

SEQ ID NO: 8127514 - DNA, 21 bp, Homo sapiens
acaatactatttgggggaagt

SEQ ID NO: 8127515 - DNA, 22 bp, Homo sapiens
acaatactagccaaggttatta

SEQ ID NO: 8127516 - DNA, 22 bp, Homo sapiens
acaatacttaccaatgtttttg

SEQ ID NO: 8127517 - DNA, 19 bp, Homo sapiens
acaatagaaaagtcttttg

SEQ ID NO: 8127518 - DNA, 22 bp, Homo sapiens
acaacagtgtggtggaaggagc

SEQ ID NO: 8127519 - DNA, 22 bp, Homo sapiens
acaacattatacatagaaagct

SEQ ID NO: 8127520 - DNA, 22 bp, Homo sapiens
acaacattcttaaatacactga

SEQ ID NO: 8127521 - DNA, 22 bp, Homo sapiens
acaacattatacatagaaagct

SEQ ID NO: 8127522 - DNA, 22 bp, Homo sapiens
agcacacaggacttgattcatg

SEQ ID NO: 8127523 - DNA, 22 bp, Homo sapiens
agcacacagtattagccattgt

SEQ ID NO: 8127524 - DNA, 22 bp, Homo sapiens
agcacagaatgaggtggaagtg

SEQ ID NO: 8127525 - DNA, 22 bp, Homo sapiens
agcacactggcattgggaagct

SEQ ID NO: 8127526 - DNA, 22 bp, Homo sapiens
agaggaggtggtgatgctttaa

SEQ ID NO: 8127527 - DNA, 22 bp, Homo sapiens
agaggaggtggtgatgctttaa

SEQ ID NO: 8127528 - DNA, 22 bp, Homo sapiens
agaggacaaaatgagaagtgct

SEQ ID NO: 8127529 - DNA, 22 bp, Homo sapiens
agaggaggtccttttctgatgt

SEQ ID NO: 8127530 - DNA, 22 bp, Homo sapiens
agaggatgttctaggcactcat

SEQ ID NO: 8127531 - DNA, 21 bp, Homo sapiens
agaggaagtgattggtctggc

SEQ ID NO: 8127532 - DNA, 22 bp, Homo sapiens
agaggaagtaatcaggacctgc

SEQ ID NO: 8127533 - DNA, 22 bp, Homo sapiens
aattccaacagacaaagttaga

SEQ ID NO: 8127534 - DNA, 21 bp, Homo sapiens
agagaagggactcttccagtc

SEQ ID NO: 8127535 - DNA, 22 bp, Homo sapiens
agagaaggcatagaacttgagt

SEQ ID NO: 8127536 - DNA, 22 bp, Homo sapiens
agagaagggaagggattcaccc

SEQ ID NO: 8127537 - DNA, 22 bp, Homo sapiens
aatgtgtagcatttaatgcagt

SEQ ID NO: 8127538 - DNA, 20 bp, Homo sapiens
aaatgatgggaataatctat

SEQ ID NO: 8127539 - DNA, 20 bp, Homo sapiens
aaatgcttttgacacatatt

SEQ ID NO: 8127540 - DNA, 22 bp, Homo sapiens
aaatgcttattagtgtcacaaa

SEQ ID NO: 8127541 - DNA, 22 bp, Homo sapiens
aaatcacagggtctctaagtat

SEQ ID NO: 8127542 - DNA, 23 bp, Homo sapiens
aaatattcttttttagtaagtgc

SEQ ID NO: 8127543 - DNA, 22 bp, Homo sapiens
aaatgatgattaaaatgaggta

SEQ ID NO: 8127544 - DNA, 22 bp, Homo sapiens
aagagagaagtctctctggttc

SEQ ID NO: 8127545 - DNA, 22 bp, Homo sapiens
aagagagacaataggtagcatt

SEQ ID NO: 8127546 - DNA, 22 bp, Homo sapiens
aagagagagtgcgctcacagaa

SEQ ID NO: 8127547 - DNA, 22 bp, Homo sapiens
aagagagagtgcgctcacagaa

SEQ ID NO: 8127548 - DNA, 22 bp, Homo sapiens
aagagagagcattcttctgtta

SEQ ID NO: 8127549 - DNA, 22 bp, Homo sapiens
aagagagagcattcttctgtta

SEQ ID NO: 8127550 - DNA, 22 bp, Homo sapiens
aagagagaccatgggggacagg

SEQ ID NO: 8127551 - DNA, 22 bp, Homo sapiens
aagagtttgtcagatctgcacg

SEQ ID NO: 8127552 - DNA, 22 bp, Homo sapiens
aagaagcaggtcacagacaggg

SEQ ID NO: 8127553 - DNA, 22 bp, Homo sapiens
aagaagcatggctgtagattcc

SEQ ID NO: 8127554 - DNA, 22 bp, Homo sapiens
aagaagcattctttcattggtt

SEQ ID NO: 8127555 - DNA, 22 bp, Homo sapiens
aagagagaagtctctctggttc

SEQ ID NO: 8127556 - DNA, 22 bp, Homo sapiens
aagagagaactcccttcgccag

SEQ ID NO: 8127557 - DNA, 22 bp, Homo sapiens
aaattcagatggctttcttttc

SEQ ID NO: 8127558 - DNA, 22 bp, Homo sapiens
aaattagatatgtgtgagactc

SEQ ID NO: 8127559 - DNA, 22 bp, Homo sapiens
aaattccattttgtgactattc

SEQ ID NO: 8127560 - DNA, 22 bp, Homo sapiens
aaattgtcagaattcagaaagt

SEQ ID NO: 8127561 - DNA, 22 bp, Homo sapiens
aaattgtataatgttccagctg

SEQ ID NO: 8127562 - DNA, 22 bp, Homo sapiens
aaagcattgtttcaagattaac

SEQ ID NO: 8127563 - DNA, 22 bp, Homo sapiens
aaagcatttcatgtctagaaag

SEQ ID NO: 8127564 - DNA, 19 bp, Homo sapiens
aaagcagtgcatcctcttt

SEQ ID NO: 8127565 - DNA, 21 bp, Homo sapiens
aaagcatcacgaacatttggg

SEQ ID NO: 8127566 - DNA, 22 bp, Homo sapiens
aaagcatcagatctgacacttc

SEQ ID NO: 8127567 - DNA, 22 bp, Homo sapiens
aacatgaaacccaaacagaata

SEQ ID NO: 8127568 - DNA, 22 bp, Homo sapiens
aacatgatgacaaaggtatatt

SEQ ID NO: 8127569 - DNA, 22 bp, Homo sapiens
aacttgaaaacctcatgaattg

SEQ ID NO: 8127570 - DNA, 22 bp, Homo sapiens
aacttgaagttgcagaaagtac

SEQ ID NO: 8127571 - DNA, 22 bp, Homo sapiens
aaaatgcaaacctacctacata

SEQ ID NO: 8127572 - DNA, 22 bp, Homo sapiens
aaagcagcagaatctctcaggg

SEQ ID NO: 8127573 - DNA, 21 bp, Homo sapiens
aaaatgtagacttttccctga

SEQ ID NO: 8127574 - DNA, 22 bp, Homo sapiens
aaagcagggaaatctatttgca

SEQ ID NO: 8127575 - DNA, 22 bp, Homo sapiens
aaaattgtaggaactgaatcaa

SEQ ID NO: 8127576 - DNA, 22 bp, Homo sapiens
aaagcagggtccaaggagatgt

SEQ ID NO: 8127577 - DNA, 22 bp, Homo sapiens
aaaagcagtaaatgtatgacct

SEQ ID NO: 8127578 - DNA, 22 bp, Homo sapiens
aaaagcaggtactcagcttggg

SEQ ID NO: 8127579 - DNA, 22 bp, Homo sapiens
aaaagcagtttatagtcagttg

SEQ ID NO: 8127580 - DNA, 22 bp, Homo sapiens
aaaagcatctcaaaggagcttc

SEQ ID NO: 8127581 - DNA, 22 bp, Homo sapiens
aaaagcagagactctggagcta

SEQ ID NO: 8127582 - DNA, 22 bp, Homo sapiens
aaaagcagaccacgctttgtgg

SEQ ID NO: 8127583 - DNA, 22 bp, Homo sapiens
aaaagagcttggttgattttgc

SEQ ID NO: 8127584 - DNA, 22 bp, Homo sapiens
aaagacagatggcaaggatgat

SEQ ID NO: 8127585 - DNA, 22 bp, Homo sapiens
aaagacagtggattcaaaatcc

SEQ ID NO: 8127586 - DNA, 22 bp, Homo sapiens
aaatgtgagttatagcaataga

SEQ ID NO: 8127587 - DNA, 22 bp, Homo sapiens
aaatggtgctactaggagtcag

SEQ ID NO: 8127588 - DNA, 22 bp, Homo sapiens
aaatggtggctcttttaaattg

SEQ ID NO: 8127589 - DNA, 22 bp, Homo sapiens
aaatggtgttgtatttagtctc

SEQ ID NO: 8127590 - DNA, 22 bp, Homo sapiens
aaatggtgtttctaatgctaga

SEQ ID NO: 8127591 - DNA, 22 bp, Homo sapiens
aaacttagtagagttcatatta

SEQ ID NO: 8127592 - DNA, 22 bp, Homo sapiens
aaatgacagttctctctgagta

SEQ ID NO: 8127593 - DNA, 22 bp, Homo sapiens
aaactgtttccctccataacct

SEQ ID NO: 8127594 - DNA, 22 bp, Homo sapiens
aaactgttcctttttcagcaac

SEQ ID NO: 8127595 - DNA, 22 bp, Homo sapiens
aaatgacactcattcagtgtca

SEQ ID NO: 8127596 - DNA, 22 bp, Homo sapiens
aaatgacactaggctttttgca

SEQ ID NO: 8127597 - DNA, 22 bp, Homo sapiens
aaatgacaataaaagtccatgc

SEQ ID NO: 8127598 - DNA, 22 bp, Homo sapiens
aaagttttattcaagcattagt

SEQ ID NO: 8127599 - DNA, 22 bp, Homo sapiens
acacagcaacttgcagtatgga

SEQ ID NO: 8127600 - DNA, 22 bp, Homo sapiens
acacagcaacttgcagtatgga

SEQ ID NO: 8127601 - DNA, 17 bp, Homo sapiens
acacagacaggcagaca

SEQ ID NO: 8127602 - DNA, 20 bp, Homo sapiens
acacagactcagcttggatg

SEQ ID NO: 8127603 - DNA, 22 bp, Homo sapiens
acaatgtgacctgacagtgtta

SEQ ID NO: 8127604 - DNA, 22 bp, Homo sapiens
acaatatagtccatgagcatgc

SEQ ID NO: 8127605 - DNA, 17 bp, Homo sapiens
aagaatcattagagaag

SEQ ID NO: 8127606 - DNA, 22 bp, Homo sapiens
aagaatcatctgaactttgagg

SEQ ID NO: 8127607 - DNA, 22 bp, Homo sapiens
aagaatcattgtaaagttctgt

SEQ ID NO: 8127608 - DNA, 22 bp, Homo sapiens
aagaacatgttaaaagattcac

SEQ ID NO: 8127609 - DNA, 22 bp, Homo sapiens
aatgtacaataagacaaagagg

SEQ ID NO: 8127610 - DNA, 19 bp, Homo sapiens
aagaagcaataagctgtga

SEQ ID NO: 8127611 - DNA, 21 bp, Homo sapiens
aagaagcaatttattggaagg

SEQ ID NO: 8127612 - DNA, 22 bp, Homo sapiens
aagcataaaacgttacaacatg

SEQ ID NO: 8127613 - DNA, 22 bp, Homo sapiens
acagagcacagtcgggatggga

SEQ ID NO: 8127614 - DNA, 22 bp, Homo sapiens
aagcagggagaaatttttcttc

SEQ ID NO: 8127615 - DNA, 22 bp, Homo sapiens
acacttgttaagaagaggatat

SEQ ID NO: 8127616 - DNA, 22 bp, Homo sapiens
acagacctgggcacagaaagga

SEQ ID NO: 8127617 - DNA, 22 bp, Homo sapiens
acagagatgaataatacaggtg

SEQ ID NO: 8127618 - DNA, 22 bp, Homo sapiens
acagagatgtggatgagggatt

SEQ ID NO: 8127619 - DNA, 22 bp, Homo sapiens
acagagatggcacagagaaggt

SEQ ID NO: 8127620 - DNA, 22 bp, Homo sapiens
acagagatgaattagacagggt

SEQ ID NO: 8127621 - DNA, 18 bp, Homo sapiens
acagaaatagctgtgcct

SEQ ID NO: 8127622 - DNA, 22 bp, Homo sapiens
acagacatttaataaatgctga

SEQ ID NO: 8127623 - DNA, 21 bp, Homo sapiens
aatgatgaaagatgacagagt

SEQ ID NO: 8127624 - DNA, 22 bp, Homo sapiens
aatgatgacaggataaagaaca

SEQ ID NO: 8127625 - DNA, 22 bp, Homo sapiens
aatgaaatgtagcttatccata

SEQ ID NO: 8127626 - DNA, 22 bp, Homo sapiens
aatgcacatgttgtaataaata

SEQ ID NO: 8127627 - DNA, 22 bp, Homo sapiens
aatgcacatatatgtgtataca

SEQ ID NO: 8127628 - DNA, 22 bp, Homo sapiens
aatctgaagggagatacatgta

SEQ ID NO: 8127629 - DNA, 22 bp, Homo sapiens
aatctcatgagcttcttgtccc

SEQ ID NO: 8127630 - DNA, 22 bp, Homo sapiens
aataatgtaggatgataaatga

SEQ ID NO: 8127631 - DNA, 22 bp, Homo sapiens
aataatgagcttgtctaattgt

SEQ ID NO: 8127632 - DNA, 22 bp, Homo sapiens
aacagtttatcaagtttttaca

SEQ ID NO: 8127633 - DNA, 22 bp, Homo sapiens
aacagtttatgagatatgctat

SEQ ID NO: 8127634 - DNA, 22 bp, Homo sapiens
aacagtttatgataaattctta

SEQ ID NO: 8127635 - DNA, 22 bp, Homo sapiens
aatatttctccttcgttatagc

SEQ ID NO: 8127636 - DNA, 22 bp, Homo sapiens
aatatttcgttgcgtggctaga

SEQ ID NO: 8127637 - DNA, 22 bp, Homo sapiens
aatatttcaaaaggaaacacag

SEQ ID NO: 8127638 - DNA, 22 bp, Homo sapiens
aatatttctgcagaatggtttt

SEQ ID NO: 8127639 - DNA, 22 bp, Homo sapiens
aatatttctgtagctatgttct

SEQ ID NO: 8127640 - DNA, 22 bp, Homo sapiens
aacagtgcttcattcacacatt

SEQ ID NO: 8127641 - DNA, 23 bp, Homo sapiens
aaggtgtcattgatgggattcta

SEQ ID NO: 8127642 - DNA, 22 bp, Homo sapiens
aaggccaggtccctgcagtgca

SEQ ID NO: 8127643 - DNA, 22 bp, Homo sapiens
aaggagggttcccaggtcctgg

SEQ ID NO: 8127644 - DNA, 16 bp, Homo sapiens
aaggagggaagagaat

SEQ ID NO: 8127645 - DNA, 22 bp, Homo sapiens
aaggagggaaagcagtgcttct

SEQ ID NO: 8127646 - DNA, 22 bp, Homo sapiens
tcagcaggcacggacaggctgc

SEQ ID NO: 8127647 - DNA, 22 bp, Homo sapiens
tcagcaggcacaccaaaaactg

SEQ ID NO: 8127648 - DNA, 22 bp, Homo sapiens
tcagcagaaaggcactagatga

SEQ ID NO: 8127649 - DNA, 22 bp, Homo sapiens
tcagctctaagttttatgcaaa

SEQ ID NO: 8127650 - DNA, 22 bp, Homo sapiens
tcagctctcacagatctcaacc

SEQ ID NO: 8127651 - DNA, 22 bp, Homo sapiens
tcagctcggcctaggcccacgg

SEQ ID NO: 8127652 - DNA, 22 bp, Homo sapiens
tcagctccacagctcctctgcc

SEQ ID NO: 8127653 - DNA, 22 bp, Homo sapiens
tcaggcctgcaaggagagtccc

SEQ ID NO: 8127654 - DNA, 22 bp, Homo sapiens
tcaggccacttcacaggtgatt

SEQ ID NO: 8127655 - DNA, 22 bp, Homo sapiens
tcaggccacggctcactgagac

SEQ ID NO: 8127656 - DNA, 22 bp, Homo sapiens
tcaggcattcccatgcataaga

SEQ ID NO: 8127657 - DNA, 22 bp, Homo sapiens
tcaggccaaggtagacatgact

SEQ ID NO: 8127658 - DNA, 22 bp, Homo sapiens
tcaggccaaagaaacagcatga

SEQ ID NO: 8127659 - DNA, 22 bp, Homo sapiens
tcaggtggccaaatgggagcgc

SEQ ID NO: 8127660 - DNA, 17 bp, Homo sapiens
tcagtctctgtcctgga

SEQ ID NO: 8127661 - DNA, 20 bp, Homo sapiens
tcatggaatctcactctagt

SEQ ID NO: 8127662 - DNA, 22 bp, Homo sapiens
tcatggaagaaaggtttgtttc

SEQ ID NO: 8127663 - DNA, 22 bp, Homo sapiens
tcatggaagaggtattttttgt

SEQ ID NO: 8127664 - DNA, 22 bp, Homo sapiens
tcatggcagtttaataagtggt

SEQ ID NO: 8127665 - DNA, 22 bp, Homo sapiens
tcattatttgctttagttatgt

SEQ ID NO: 8127666 - DNA, 22 bp, Homo sapiens
tcatgctatttcgaatgtaata

SEQ ID NO: 8127667 - DNA, 21 bp, Homo sapiens
tcatgcatgagtttatatata

SEQ ID NO: 8127668 - DNA, 21 bp, Homo sapiens
tcatatttctcttgctattgt

SEQ ID NO: 8127669 - DNA, 21 bp, Homo sapiens
tcatatttctcttgctattgt

SEQ ID NO: 8127670 - DNA, 22 bp, Homo sapiens
tcatatttaggcctttaattca

SEQ ID NO: 8127671 - DNA, 23 bp, Homo sapiens
tcagagaggccccctgcagagat

SEQ ID NO: 8127672 - DNA, 22 bp, Homo sapiens
tcagagaggcaatactgtttaa

SEQ ID NO: 8127673 - DNA, 23 bp, Homo sapiens
tcagagaggccccctgcagagat

SEQ ID NO: 8127674 - DNA, 22 bp, Homo sapiens
tcagagaggttaaatatcttgt

SEQ ID NO: 8127675 - DNA, 22 bp, Homo sapiens
tcagagaggttggtgataagaa

SEQ ID NO: 8127676 - DNA, 22 bp, Homo sapiens
tcagaggaaaggtcagatggct

SEQ ID NO: 8127677 - DNA, 22 bp, Homo sapiens
tcactctttatcttttatgtct

SEQ ID NO: 8127678 - DNA, 22 bp, Homo sapiens
tcactgaaagaatgacattatg

SEQ ID NO: 8127679 - DNA, 19 bp, Homo sapiens
tcactgaggctttgttggc

SEQ ID NO: 8127680 - DNA, 22 bp, Homo sapiens
tcactgaaggaagacactgtca

SEQ ID NO: 8127681 - DNA, 19 bp, Homo sapiens
tcacttgaagttcagaaat

SEQ ID NO: 8127682 - DNA, 22 bp, Homo sapiens
tcactgttaataaatagcaaag

SEQ ID NO: 8127683 - DNA, 22 bp, Homo sapiens
tcactttaatgatttgtagaat

SEQ ID NO: 8127684 - DNA, 22 bp, Homo sapiens
tcactttgacagagaaatgaat

SEQ ID NO: 8127685 - DNA, 22 bp, Homo sapiens
tcactagtcatcatatattttt

SEQ ID NO: 8127686 - DNA, 22 bp, Homo sapiens
tcactactgacagagatgtgta

SEQ ID NO: 8127687 - DNA, 22 bp, Homo sapiens
tcactctgacttggcctccaac

SEQ ID NO: 8127688 - DNA, 22 bp, Homo sapiens
tcacattttcatattctctgag

SEQ ID NO: 8127689 - DNA, 22 bp, Homo sapiens
tcacagtagccatttcatgagt

SEQ ID NO: 8127690 - DNA, 23 bp, Homo sapiens
tcaccagaaggggtcaataaaga

SEQ ID NO: 8127691 - DNA, 22 bp, Homo sapiens
tcaccagatctctctgtaatgg

SEQ ID NO: 8127692 - DNA, 22 bp, Homo sapiens
tcacaggctctccaccatgagg

SEQ ID NO: 8127693 - DNA, 22 bp, Homo sapiens
tcacaggctctagggattaaga

SEQ ID NO: 8127694 - DNA, 22 bp, Homo sapiens
tcacaagtttctcttgcatgcg

SEQ ID NO: 8127695 - DNA, 20 bp, Homo sapiens
tcacacatggtaagctatga

SEQ ID NO: 8127696 - DNA, 22 bp, Homo sapiens
tcaagataagtcagtatatcaa

SEQ ID NO: 8127697 - DNA, 22 bp, Homo sapiens
tcaagataccaccattatatgt

SEQ ID NO: 8127698 - DNA, 22 bp, Homo sapiens
tcaagctgcatcagtgcagtga

SEQ ID NO: 8127699 - DNA, 22 bp, Homo sapiens
tatttcttcgggattcaagcta

SEQ ID NO: 8127700 - DNA, 22 bp, Homo sapiens
tatttctgtttatttgtacatc

SEQ ID NO: 8127701 - DNA, 22 bp, Homo sapiens
tatttctggctttgagggtgat

SEQ ID NO: 8127702 - DNA, 22 bp, Homo sapiens
tatttctgtcagccagatatgg

SEQ ID NO: 8127703 - DNA, 22 bp, Homo sapiens
tatttctgtatgcataaaagga

SEQ ID NO: 8127704 - DNA, 22 bp, Homo sapiens
tatttctgtaactcagggtctg

SEQ ID NO: 8127705 - DNA, 22 bp, Homo sapiens
tatttctgaggcccaggaagtg

SEQ ID NO: 8127706 - DNA, 22 bp, Homo sapiens
tatttctgggagttcagaaatt

SEQ ID NO: 8127707 - DNA, 22 bp, Homo sapiens
tatttctgattgctcatgaggc

SEQ ID NO: 8127708 - DNA, 20 bp, Homo sapiens
tatttctgggcaaccattta

SEQ ID NO: 8127709 - DNA, 20 bp, Homo sapiens
tatttctgggcaaccattta

SEQ ID NO: 8127710 - DNA, 22 bp, Homo sapiens
tccagctccacagcctccctgt

SEQ ID NO: 8127711 - DNA, 22 bp, Homo sapiens
tccagctcatctgtctccatta

SEQ ID NO: 8127712 - DNA, 22 bp, Homo sapiens
tccagcctttctactcactgag

SEQ ID NO: 8127713 - DNA, 21 bp, Homo sapiens
tccagctcctgccactcctta

SEQ ID NO: 8127714 - DNA, 22 bp, Homo sapiens
tccagctcctgagttcactgct

SEQ ID NO: 8127715 - DNA, 22 bp, Homo sapiens
tccaggctctaggctgctctcc

SEQ ID NO: 8127716 - DNA, 22 bp, Homo sapiens
tccaggccaatgtagcaggccc

SEQ ID NO: 8127717 - DNA, 22 bp, Homo sapiens
tccaggccacatggatggcgat

SEQ ID NO: 8127718 - DNA, 22 bp, Homo sapiens
tccaggctgcagtcttgccctc

SEQ ID NO: 8127719 - DNA, 20 bp, Homo sapiens
tccatgagttagagactata

SEQ ID NO: 8127720 - DNA, 22 bp, Homo sapiens
tccatgagggacactggatgct

SEQ ID NO: 8127721 - DNA, 22 bp, Homo sapiens
tccatgaggcagggaggctggc

SEQ ID NO: 8127722 - DNA, 22 bp, Homo sapiens
tccatgagtttgaggaaaagag

SEQ ID NO: 8127723 - DNA, 22 bp, Homo sapiens
tccatgagctagctttccaaag

SEQ ID NO: 8127724 - DNA, 23 bp, Homo sapiens
tccatgagatgtgggcttctagt

SEQ ID NO: 8127725 - DNA, 22 bp, Homo sapiens
tccatgaggaccaaattcgtag

SEQ ID NO: 8127726 - DNA, 22 bp, Homo sapiens
tccatgagctagggattcatca

SEQ ID NO: 8127727 - DNA, 22 bp, Homo sapiens
tccatgagaacccttggagata

SEQ ID NO: 8127728 - DNA, 17 bp, Homo sapiens
tccatgagacatgaaga

SEQ ID NO: 8127729 - DNA, 22 bp, Homo sapiens
tccatgagacagatactgtaag

SEQ ID NO: 8127730 - DNA, 22 bp, Homo sapiens
tccatgagaggtaactttacaa

SEQ ID NO: 8127731 - DNA, 22 bp, Homo sapiens
tcccacacttgaaacaaggctg

SEQ ID NO: 8127732 - DNA, 22 bp, Homo sapiens
taaattaaagattggagaagga

SEQ ID NO: 8127733 - DNA, 20 bp, Homo sapiens
taaattagccttgaagatta

SEQ ID NO: 8127734 - DNA, 22 bp, Homo sapiens
taaattgtggccatttgtgttt

SEQ ID NO: 8127735 - DNA, 22 bp, Homo sapiens
taaattcagtgagtaatttctg

SEQ ID NO: 8127736 - DNA, 22 bp, Homo sapiens
taactgaacatctcaaatcaag

SEQ ID NO: 8127737 - DNA, 22 bp, Homo sapiens
gttttgcttctcatgttaagtg

SEQ ID NO: 8127738 - DNA, 21 bp, Homo sapiens
gttttgctggtatctggggat

SEQ ID NO: 8127739 - DNA, 22 bp, Homo sapiens
gttttgctgactcccacaggaa

SEQ ID NO: 8127740 - DNA, 22 bp, Homo sapiens
gttttgctcatttggtccaagg

SEQ ID NO: 8127741 - DNA, 18 bp, Homo sapiens
gttttgtggctagtagtg

SEQ ID NO: 8127742 - DNA, 22 bp, Homo sapiens
gtttcccaaattgttcacaggg

SEQ ID NO: 8127743 - DNA, 22 bp, Homo sapiens
taaaatgtgtttctgtatggtt

SEQ ID NO: 8127744 - DNA, 22 bp, Homo sapiens
taaaatgtagcttctaggctgg

SEQ ID NO: 8127745 - DNA, 22 bp, Homo sapiens
gtttttattgtgtaaatgtggg

SEQ ID NO: 8127746 - DNA, 19 bp, Homo sapiens
gttttgtttgcagaactta

SEQ ID NO: 8127747 - DNA, 22 bp, Homo sapiens
gttttgttttgagtcaactcca

SEQ ID NO: 8127748 - DNA, 22 bp, Homo sapiens
taaacaagctgtctgatattct

SEQ ID NO: 8127749 - DNA, 22 bp, Homo sapiens
gtttcattcggcagctcataag

SEQ ID NO: 8127750 - DNA, 22 bp, Homo sapiens
gttgctcaggcaggagtacagt

SEQ ID NO: 8127751 - DNA, 22 bp, Homo sapiens
gttgggaagtgtagctccacct

SEQ ID NO: 8127752 - DNA, 22 bp, Homo sapiens
gttgggaaggtgaacatgatgc

SEQ ID NO: 8127753 - DNA, 22 bp, Homo sapiens
gttcagagtgggaatgatcact

SEQ ID NO: 8127754 - DNA, 22 bp, Homo sapiens
gtgctctccagccccacgtgga

SEQ ID NO: 8127755 - DNA, 22 bp, Homo sapiens
gtgctcctggccacatgaagct

SEQ ID NO: 8127756 - DNA, 22 bp, Homo sapiens
gtgctcctcacagtgtggccct

SEQ ID NO: 8127757 - DNA, 22 bp, Homo sapiens
gtgctcagggcctggctgggga

SEQ ID NO: 8127758 - DNA, 22 bp, Homo sapiens
gtgctcaggttcccatgagtgc

SEQ ID NO: 8127759 - DNA, 22 bp, Homo sapiens
gtgctcaggggcaatcctggga

SEQ ID NO: 8127760 - DNA, 22 bp, Homo sapiens
gtgctcagcccggatgagatca

SEQ ID NO: 8127761 - DNA, 22 bp, Homo sapiens
gtgctccaacattagtgtgctt

SEQ ID NO: 8127762 - DNA, 22 bp, Homo sapiens
gtgctccaggataggctgacct

SEQ ID NO: 8127763 - DNA, 22 bp, Homo sapiens
gtgtggcttgggtgaggcgcct

SEQ ID NO: 8127764 - DNA, 22 bp, Homo sapiens
gtgtgggaaggctaggatgctg

SEQ ID NO: 8127765 - DNA, 22 bp, Homo sapiens
gttaagtaccagattgtctgaa

SEQ ID NO: 8127766 - DNA, 22 bp, Homo sapiens
gttaagtaaactatgatttatc

SEQ ID NO: 8127767 - DNA, 22 bp, Homo sapiens
gttaatttagtagagtccagat

SEQ ID NO: 8127768 - DNA, 22 bp, Homo sapiens
tacatagcaaggaaatgacaga

SEQ ID NO: 8127769 - DNA, 22 bp, Homo sapiens
tacagaagctgagacactgaga

SEQ ID NO: 8127770 - DNA, 22 bp, Homo sapiens
tacagcaatgcctgaaatagta

SEQ ID NO: 8127771 - DNA, 22 bp, Homo sapiens
tacaaatcagatcatgagttta

SEQ ID NO: 8127772 - DNA, 22 bp, Homo sapiens
tacaaagaggtaattgcatata

SEQ ID NO: 8127773 - DNA, 22 bp, Homo sapiens
taattatagccgctattttgct

SEQ ID NO: 8127774 - DNA, 22 bp, Homo sapiens
taatactgctgtgcttgagttg

SEQ ID NO: 8127775 - DNA, 22 bp, Homo sapiens
taatactgatgtctgagcccca

SEQ ID NO: 8127776 - DNA, 19 bp, Homo sapiens
taatactggctgtagctgg

SEQ ID NO: 8127777 - DNA, 22 bp, Homo sapiens
taatactgggaaatacttgggt

SEQ ID NO: 8127778 - DNA, 23 bp, Homo sapiens
taatactgcttcagaggcttaga

SEQ ID NO: 8127779 - DNA, 22 bp, Homo sapiens
taatactgtatactgcaaattt

SEQ ID NO: 8127780 - DNA, 22 bp, Homo sapiens
taatactgtaacttggtgggtc

SEQ ID NO: 8127781 - DNA, 22 bp, Homo sapiens
taatactgtgcttcattttcct

SEQ ID NO: 8127782 - DNA, 22 bp, Homo sapiens
taatgtttccagtctatgatgg

SEQ ID NO: 8127783 - DNA, 22 bp, Homo sapiens
taatgtttagaagcagacagct

SEQ ID NO: 8127784 - DNA, 22 bp, Homo sapiens
taatggtgcagtgggtgtaact

SEQ ID NO: 8127785 - DNA, 22 bp, Homo sapiens
taatggtgcttctgtgagataa

SEQ ID NO: 8127786 - DNA, 22 bp, Homo sapiens
taatggtgtttttctgtaattt

SEQ ID NO: 8127787 - DNA, 21 bp, Homo sapiens
taatggtgatggttatgttct

SEQ ID NO: 8127788 - DNA, 22 bp, Homo sapiens
taatgtttttctcaacattgct

SEQ ID NO: 8127789 - DNA, 22 bp, Homo sapiens
taatgtttgggaaggtgctttg

SEQ ID NO: 8127790 - DNA, 22 bp, Homo sapiens
taatgtttccagtctatgatgg

SEQ ID NO: 8127791 - DNA, 22 bp, Homo sapiens
taatgtttgagatgttggattt

SEQ ID NO: 8127792 - DNA, 22 bp, Homo sapiens
taatactgaaagggaaatgtcc

SEQ ID NO: 8127793 - DNA, 22 bp, Homo sapiens
taatactgaaaggagtatcagc

SEQ ID NO: 8127794 - DNA, 22 bp, Homo sapiens
taatactgagccaccaggtagg

SEQ ID NO: 8127795 - DNA, 22 bp, Homo sapiens
taatactgactaaagatatcaa

SEQ ID NO: 8127796 - DNA, 21 bp, Homo sapiens
taatactgaaagtgacatctg

SEQ ID NO: 8127797 - DNA, 22 bp, Homo sapiens
taatactgaaggtaaaatttct

SEQ ID NO: 8127798 - DNA, 22 bp, Homo sapiens
taagtgcaatgttttacttaaa

SEQ ID NO: 8127799 - DNA, 17 bp, Homo sapiens
taagtgattatctcata

SEQ ID NO: 8127800 - DNA, 22 bp, Homo sapiens
taaggcaaaggggaagttatca

SEQ ID NO: 8127801 - DNA, 22 bp, Homo sapiens
taagggctgacttggaactgtc

SEQ ID NO: 8127802 - DNA, 22 bp, Homo sapiens
tattgaaatccattacgttctt

SEQ ID NO: 8127803 - DNA, 22 bp, Homo sapiens
tattctcagcaacacacatgga

SEQ ID NO: 8127804 - DNA, 22 bp, Homo sapiens
tattctcagtgctataagtaga

SEQ ID NO: 8127805 - DNA, 22 bp, Homo sapiens
tattcttaattgctgagctgaa

SEQ ID NO: 8127806 - DNA, 22 bp, Homo sapiens
tattctgatttcaagtgagagt

SEQ ID NO: 8127807 - DNA, 22 bp, Homo sapiens
tatttatcgagtgtctactatg

SEQ ID NO: 8127808 - DNA, 21 bp, Homo sapiens
tatttatctcaggctatcttt

SEQ ID NO: 8127809 - DNA, 22 bp, Homo sapiens
tatttaatttgctcattgtgat

SEQ ID NO: 8127810 - DNA, 22 bp, Homo sapiens
tattgacatttttatagcttga

SEQ ID NO: 8127811 - DNA, 22 bp, Homo sapiens
tatttctcttcaaaattgatgt

SEQ ID NO: 8127812 - DNA, 22 bp, Homo sapiens
tatttctgaatccaaaaggtca

SEQ ID NO: 8127813 - DNA, 22 bp, Homo sapiens
tatttctgagaaccaacttacc

SEQ ID NO: 8127814 - DNA, 22 bp, Homo sapiens
tatgtgagtctaattgtgtagt

SEQ ID NO: 8127815 - DNA, 22 bp, Homo sapiens
tattacatccacttttattgca

SEQ ID NO: 8127816 - DNA, 22 bp, Homo sapiens
tattactaccatctgctactat

SEQ ID NO: 8127817 - DNA, 22 bp, Homo sapiens
tatgtacagtccttaacttaaa

SEQ ID NO: 8127818 - DNA, 22 bp, Homo sapiens
tatgtacacatacacttgtaat

SEQ ID NO: 8127819 - DNA, 22 bp, Homo sapiens
tatgtacaagcacacatgtgac

SEQ ID NO: 8127820 - DNA, 22 bp, Homo sapiens
tatccaggaggaactcattttg

SEQ ID NO: 8127821 - DNA, 22 bp, Homo sapiens
tatctacagttaatatgtcatc

SEQ ID NO: 8127822 - DNA, 21 bp, Homo sapiens
tatctacagtgtccattcagt

SEQ ID NO: 8127823 - DNA, 21 bp, Homo sapiens
tatctactggtgtctttcaga

SEQ ID NO: 8127824 - DNA, 23 bp, Homo sapiens
tatctactttgcaattcagtacc

SEQ ID NO: 8127825 - DNA, 22 bp, Homo sapiens
tataatttatcatgtcacagtt

SEQ ID NO: 8127826 - DNA, 22 bp, Homo sapiens
tataacaggaagtattcaaaca

SEQ ID NO: 8127827 - DNA, 22 bp, Homo sapiens
tatacaatggctgaatcatcca

SEQ ID NO: 8127828 - DNA, 22 bp, Homo sapiens
tataatttttctgtggccagtt

SEQ ID NO: 8127829 - DNA, 22 bp, Homo sapiens
tataattttagaagagatggaa

SEQ ID NO: 8127830 - DNA, 22 bp, Homo sapiens
tataattttaagtggtaaatta

SEQ ID NO: 8127831 - DNA, 22 bp, Homo sapiens
tataatttggggaaagtggtgt

SEQ ID NO: 8127832 - DNA, 20 bp, Homo sapiens
tagaaatcttataaaagact

SEQ ID NO: 8127833 - DNA, 22 bp, Homo sapiens
tagaaaggaagctacttagggg

SEQ ID NO: 8127834 - DNA, 22 bp, Homo sapiens
tagagtaaatagtatgagaaag

SEQ ID NO: 8127835 - DNA, 20 bp, Homo sapiens
taggcaattagtagataaca

SEQ ID NO: 8127836 - DNA, 22 bp, Homo sapiens
taggagggttagagggaaatat

SEQ ID NO: 8127837 - DNA, 22 bp, Homo sapiens
taggaaaccaatcttttgggag

SEQ ID NO: 8127838 - DNA, 22 bp, Homo sapiens
taggacagtggagataaccaga

SEQ ID NO: 8127839 - DNA, 22 bp, Homo sapiens
taggacagtagctggtgcacag

SEQ ID NO: 8127840 - DNA, 22 bp, Homo sapiens
taggacaggtgaggggctgtgg

SEQ ID NO: 8127841 - DNA, 22 bp, Homo sapiens
taggacagtttactttggttac

SEQ ID NO: 8127842 - DNA, 22 bp, Homo sapiens
taggagggccctgaaaatggca

SEQ ID NO: 8127843 - DNA, 22 bp, Homo sapiens
taggagggggaacaaggcatac

SEQ ID NO: 8127844 - DNA, 22 bp, Homo sapiens
tagctttgtgaagtttacagac

SEQ ID NO: 8127845 - DNA, 22 bp, Homo sapiens
tagctttgaagttatttaacag

SEQ ID NO: 8127846 - DNA, 22 bp, Homo sapiens
tagctttgcaaaggaagtttta

SEQ ID NO: 8127847 - DNA, 22 bp, Homo sapiens
tagctttgctggcaagcatgtc

SEQ ID NO: 8127848 - DNA, 22 bp, Homo sapiens
gcgggtggatcatgaggtcagg

SEQ ID NO: 8127849 - DNA, 22 bp, Homo sapiens
gcgggttgaagggcgcatcgaa

SEQ ID NO: 8127850 - DNA, 22 bp, Homo sapiens
gcgggtggtgtccctgctcctc

SEQ ID NO: 8127851 - DNA, 22 bp, Homo sapiens
gcgggtggaacggctccacgtg

SEQ ID NO: 8127852 - DNA, 22 bp, Homo sapiens
gcggggggcagcagtcgctcag

SEQ ID NO: 8127853 - DNA, 22 bp, Homo sapiens
gcgtgggctggactgggatgaa

SEQ ID NO: 8127854 - DNA, 22 bp, Homo sapiens
gcgtggggcagcccagggcttc

SEQ ID NO: 8127855 - DNA, 18 bp, Homo sapiens
gcgtggagcgggctcggt

SEQ ID NO: 8127856 - DNA, 23 bp, Homo sapiens
gcgtccggcctctctcgctcccg

SEQ ID NO: 8127857 - DNA, 22 bp, Homo sapiens
gcggtgggggaaaggagcggtt

SEQ ID NO: 8127858 - DNA, 22 bp, Homo sapiens
gcgtctcaaggcccccaggcca

SEQ ID NO: 8127859 - DNA, 22 bp, Homo sapiens
gcggtggggaaaggaggtgctg

SEQ ID NO: 8127860 - DNA, 23 bp, Homo sapiens
gctcagatgccctaggaggtggc

SEQ ID NO: 8127861 - DNA, 22 bp, Homo sapiens
gctcagccgaacttcagagcag

SEQ ID NO: 8127862 - DNA, 22 bp, Homo sapiens
gctcagcgtggacctggagctt

SEQ ID NO: 8127863 - DNA, 23 bp, Homo sapiens
gctcagcctcagcaggcccagga

SEQ ID NO: 8127864 - DNA, 19 bp, Homo sapiens
gctcagagtccccctgcgg

SEQ ID NO: 8127865 - DNA, 22 bp, Homo sapiens
gctactgtgaaggagtctttct

SEQ ID NO: 8127866 - DNA, 19 bp, Homo sapiens
gctactgaggcccaggacc

SEQ ID NO: 8127867 - DNA, 22 bp, Homo sapiens
gctgccctgtctgcagcaggac

SEQ ID NO: 8127868 - DNA, 22 bp, Homo sapiens
gctgccctacccgaggcactct

SEQ ID NO: 8127869 - DNA, 22 bp, Homo sapiens
gctgccccccggactcggcggg

SEQ ID NO: 8127870 - DNA, 22 bp, Homo sapiens
gctgccccagctgggggctgga

SEQ ID NO: 8127871 - DNA, 22 bp, Homo sapiens
gctgcctgtcctgaggagtccg

SEQ ID NO: 8127872 - DNA, 22 bp, Homo sapiens
gctgccctgtggtccagcaggt

SEQ ID NO: 8127873 - DNA, 22 bp, Homo sapiens
gctgcccagcaggccccagggg

SEQ ID NO: 8127874 - DNA, 22 bp, Homo sapiens
gctgcccaggagaggtggggct

SEQ ID NO: 8127875 - DNA, 22 bp, Homo sapiens
gctgcccagtgtgctcatgcag

SEQ ID NO: 8127876 - DNA, 22 bp, Homo sapiens
gctgcccagttctgctgctgcc

SEQ ID NO: 8127877 - DNA, 22 bp, Homo sapiens
gctgcccaattacagggccgtg

SEQ ID NO: 8127878 - DNA, 22 bp, Homo sapiens
gctgcttcctttcctgctgacc

SEQ ID NO: 8127879 - DNA, 22 bp, Homo sapiens
gctgcttcagggacgtgccagc

SEQ ID NO: 8127880 - DNA, 19 bp, Homo sapiens
gctgctcctggctgaccac

SEQ ID NO: 8127881 - DNA, 22 bp, Homo sapiens
gctgctccagtgttctgtctag

SEQ ID NO: 8127882 - DNA, 22 bp, Homo sapiens
gctgctccagctgtgctgcaga

SEQ ID NO: 8127883 - DNA, 22 bp, Homo sapiens
gctgctcctgagtcccgcgcgc

SEQ ID NO: 8127884 - DNA, 22 bp, Homo sapiens
gctgctccgtctgagctctggt

SEQ ID NO: 8127885 - DNA, 22 bp, Homo sapiens
gctgctccgcagagtgtgtgtg

SEQ ID NO: 8127886 - DNA, 22 bp, Homo sapiens
gctgcctgtggcccttctgggt

SEQ ID NO: 8127887 - DNA, 22 bp, Homo sapiens
gctcctccaatatggactcctc

SEQ ID NO: 8127888 - DNA, 22 bp, Homo sapiens
gctcctccctgtgcagacccag

SEQ ID NO: 8127889 - DNA, 22 bp, Homo sapiens
gctccggcttggtgtgcagggt

SEQ ID NO: 8127890 - DNA, 22 bp, Homo sapiens
gctccgggggttccagatcatc

SEQ ID NO: 8127891 - DNA, 22 bp, Homo sapiens
gctctgggaactgactgccttc

SEQ ID NO: 8127892 - DNA, 22 bp, Homo sapiens
gctctgggccatcctggccggg

SEQ ID NO: 8127893 - DNA, 22 bp, Homo sapiens
gctctggggatgcttctgccgt

SEQ ID NO: 8127894 - DNA, 22 bp, Homo sapiens
gctctgggctgccctctggaca

SEQ ID NO: 8127895 - DNA, 22 bp, Homo sapiens
gctgagaatcaagatggagagg

SEQ ID NO: 8127896 - DNA, 22 bp, Homo sapiens
gctgagaggcagccagaccctc

SEQ ID NO: 8127897 - DNA, 22 bp, Homo sapiens
gctgtgtatcagatgccacggg

SEQ ID NO: 8127898 - DNA, 22 bp, Homo sapiens
gcttctgtggtgcatctttgct

SEQ ID NO: 8127899 - DNA, 22 bp, Homo sapiens
gctgtggcggcagcagctggtg

SEQ ID NO: 8127900 - DNA, 22 bp, Homo sapiens
gctgtgggccacacggctgagt

SEQ ID NO: 8127901 - DNA, 22 bp, Homo sapiens
gctgtgggtgctggctccaccc

SEQ ID NO: 8127902 - DNA, 22 bp, Homo sapiens
gctggggcctgaacagtcagct

SEQ ID NO: 8127903 - DNA, 19 bp, Homo sapiens
gctggggcctgaccagaca

SEQ ID NO: 8127904 - DNA, 22 bp, Homo sapiens
gctggggcctctgtgaggttaa

SEQ ID NO: 8127905 - DNA, 22 bp, Homo sapiens
gctggggaggcagcagagaaca

SEQ ID NO: 8127906 - DNA, 22 bp, Homo sapiens
ggagcagggaattacagcgcag

SEQ ID NO: 8127907 - DNA, 22 bp, Homo sapiens
ggagcaggcagggccgtgtctg

SEQ ID NO: 8127908 - DNA, 22 bp, Homo sapiens
ggagagagacctccatgcccag

SEQ ID NO: 8127909 - DNA, 22 bp, Homo sapiens
ggagagagacctccatgcccag

SEQ ID NO: 8127910 - DNA, 22 bp, Homo sapiens
ggagagagagctcattagctgc

SEQ ID NO: 8127911 - DNA, 22 bp, Homo sapiens
ggagagaaattgaggtagcaag

SEQ ID NO: 8127912 - DNA, 22 bp, Homo sapiens
ggagagaaattgaggtagcaag

SEQ ID NO: 8127913 - DNA, 22 bp, Homo sapiens
ggagagaactgacctgaaagga

SEQ ID NO: 8127914 - DNA, 22 bp, Homo sapiens
ggagagaattcagcttaagatt

SEQ ID NO: 8127915 - DNA, 22 bp, Homo sapiens
ggagacagtgacttagagactg

SEQ ID NO: 8127916 - DNA, 22 bp, Homo sapiens
ggacagggtaagtactagtgtg

SEQ ID NO: 8127917 - DNA, 22 bp, Homo sapiens
ggacagtgtgggccatctcact

SEQ ID NO: 8127918 - DNA, 22 bp, Homo sapiens
ggacagtgcgagacacagtaac

SEQ ID NO: 8127919 - DNA, 22 bp, Homo sapiens
ggaagagtgcaggtttgtttca

SEQ ID NO: 8127920 - DNA, 22 bp, Homo sapiens
ggaagagggaaccacgactgta

SEQ ID NO: 8127921 - DNA, 22 bp, Homo sapiens
gccagctgaaatttcagttctg

SEQ ID NO: 8127922 - DNA, 22 bp, Homo sapiens
gccagggctcgcggtccctcgt

SEQ ID NO: 8127923 - DNA, 22 bp, Homo sapiens
gcaggggagtggcaggcccgga

SEQ ID NO: 8127924 - DNA, 22 bp, Homo sapiens
gcaggggagtggatgatggatt

SEQ ID NO: 8127925 - DNA, 22 bp, Homo sapiens
gccctggatgctcatggcatca

SEQ ID NO: 8127926 - DNA, 22 bp, Homo sapiens
gccctggatgtacaggcatgtt

SEQ ID NO: 8127927 - DNA, 22 bp, Homo sapiens
gccctgggattgggtggaggct

SEQ ID NO: 8127928 - DNA, 22 bp, Homo sapiens
gccctgggcaaggttctggcca

SEQ ID NO: 8127929 - DNA, 22 bp, Homo sapiens
gccctggagagggatatggcat

SEQ ID NO: 8127930 - DNA, 22 bp, Homo sapiens
gccccagacataagtagggggt

SEQ ID NO: 8127931 - DNA, 22 bp, Homo sapiens
gcccagcccctgggtggacgtg

SEQ ID NO: 8127932 - DNA, 22 bp, Homo sapiens
gccagggtgtgcagggacagga

SEQ ID NO: 8127933 - DNA, 22 bp, Homo sapiens
gccccactttcctaggcagtat

SEQ ID NO: 8127934 - DNA, 22 bp, Homo sapiens
gccccactgtggaacctaagtc

SEQ ID NO: 8127935 - DNA, 22 bp, Homo sapiens
gcaggcagaggtggaggagaca

SEQ ID NO: 8127936 - DNA, 22 bp, Homo sapiens
gcaggcagatcacctgtcagga

SEQ ID NO: 8127937 - DNA, 21 bp, Homo sapiens
gcagggacaaagcttcaggag

SEQ ID NO: 8127938 - DNA, 22 bp, Homo sapiens
gcaggcaggtggcatcttgtga

SEQ ID NO: 8127939 - DNA, 22 bp, Homo sapiens
gcagggaccaaaagaggcagta

SEQ ID NO: 8127940 - DNA, 22 bp, Homo sapiens
gcagggacaactgtgcacctga

SEQ ID NO: 8127941 - DNA, 18 bp, Homo sapiens
gcagggacacagggtcac

SEQ ID NO: 8127942 - DNA, 22 bp, Homo sapiens
gcagggacatcttcagatcact

SEQ ID NO: 8127943 - DNA, 20 bp, Homo sapiens
gcagcctcaacaggcacagc

SEQ ID NO: 8127944 - DNA, 22 bp, Homo sapiens
gcagcctcaaactccccagctc

SEQ ID NO: 8127945 - DNA, 22 bp, Homo sapiens
gcagccctttctgggcagggga

SEQ ID NO: 8127946 - DNA, 22 bp, Homo sapiens
gcagcccttcaggtgaggggca

SEQ ID NO: 8127947 - DNA, 22 bp, Homo sapiens
gcagcctctgatgatggccgta

SEQ ID NO: 8127948 - DNA, 22 bp, Homo sapiens
gcaggaatctaacccaaggaga

SEQ ID NO: 8127949 - DNA, 22 bp, Homo sapiens
gcagatgggagccccaggggag

SEQ ID NO: 8127950 - DNA, 23 bp, Homo sapiens
gcagatggccccagagtgctgcc

SEQ ID NO: 8127951 - DNA, 22 bp, Homo sapiens
gcagatggatgtggacggcgcc

SEQ ID NO: 8127952 - DNA, 22 bp, Homo sapiens
gcacacagaacatttggatcct

SEQ ID NO: 8127953 - DNA, 22 bp, Homo sapiens
gcacacagtagggattcaatga

SEQ ID NO: 8127954 - DNA, 22 bp, Homo sapiens
gcacacatatatatgagcatgt

SEQ ID NO: 8127955 - DNA, 20 bp, Homo sapiens
gcacacatagaaatgcatat

SEQ ID NO: 8127956 - DNA, 22 bp, Homo sapiens
gcacacatgcatgtgtgcatcc

SEQ ID NO: 8127957 - DNA, 22 bp, Homo sapiens
gcaaagaaatgtcagtgagagg

SEQ ID NO: 8127958 - DNA, 22 bp, Homo sapiens
gcaaagcagaaccctctctatc

SEQ ID NO: 8127959 - DNA, 22 bp, Homo sapiens
gcaaagcaagctgtcagcctca

SEQ ID NO: 8127960 - DNA, 22 bp, Homo sapiens
gcacagttctctcagtctccag

SEQ ID NO: 8127961 - DNA, 22 bp, Homo sapiens
gcacagttgagacttcacagct

SEQ ID NO: 8127962 - DNA, 22 bp, Homo sapiens
gcacagttgacaatgattaaga

SEQ ID NO: 8127963 - DNA, 22 bp, Homo sapiens
gcacagttaaagggtcatgtga

SEQ ID NO: 8127964 - DNA, 20 bp, Homo sapiens
gcacagtttgggaaccatgg

SEQ ID NO: 8127965 - DNA, 22 bp, Homo sapiens
gcacagttgatttatgctggtg

SEQ ID NO: 8127966 - DNA, 22 bp, Homo sapiens
gcacagttgtgacaaccatcgc

SEQ ID NO: 8127967 - DNA, 22 bp, Homo sapiens
gcacagttgccattagccacat

SEQ ID NO: 8127968 - DNA, 22 bp, Homo sapiens
gcacatgagctgctgggatggg

SEQ ID NO: 8127969 - DNA, 22 bp, Homo sapiens
gcagaggtcctagccaggagtc

SEQ ID NO: 8127970 - DNA, 19 bp, Homo sapiens
gcagagtggggtggagggt

SEQ ID NO: 8127971 - DNA, 22 bp, Homo sapiens
gcagaggaggacccaggaatta

SEQ ID NO: 8127972 - DNA, 22 bp, Homo sapiens
gcagaggagtgattatgccgtg

SEQ ID NO: 8127973 - DNA, 22 bp, Homo sapiens
gcagaggatcaggctctggaaa

SEQ ID NO: 8127974 - DNA, 22 bp, Homo sapiens
gcagaggatcaggctctggaaa

SEQ ID NO: 8127975 - DNA, 22 bp, Homo sapiens
gcagaggatagcatatgaacct

SEQ ID NO: 8127976 - DNA, 22 bp, Homo sapiens
ggccacacagatgactgctttc

SEQ ID NO: 8127977 - DNA, 22 bp, Homo sapiens
ggccacacggagaggctggtct

SEQ ID NO: 8127978 - DNA, 22 bp, Homo sapiens
ggccacactctggtagaggtga

SEQ ID NO: 8127979 - DNA, 20 bp, Homo sapiens
ggcatgggtggggctcccag

SEQ ID NO: 8127980 - DNA, 22 bp, Homo sapiens
ggccatgcctggtctggcacca

SEQ ID NO: 8127981 - DNA, 22 bp, Homo sapiens
ggccatgccaggctgcctggga

SEQ ID NO: 8127982 - DNA, 22 bp, Homo sapiens
ggccagtctgggccacggtcgg

SEQ ID NO: 8127983 - DNA, 19 bp, Homo sapiens
ggccaggctgactgtggtc

SEQ ID NO: 8127984 - DNA, 22 bp, Homo sapiens
ggccagggcctggggactgtcc

SEQ ID NO: 8127985 - DNA, 22 bp, Homo sapiens
ggcatgggccgaggtgcctcct

SEQ ID NO: 8127986 - DNA, 22 bp, Homo sapiens
ggcaggtggattttctactcta

SEQ ID NO: 8127987 - DNA, 22 bp, Homo sapiens
ggcaggtggcactgctgctccc

SEQ ID NO: 8127988 - DNA, 22 bp, Homo sapiens
ggcaggtgggaaccctccccac

SEQ ID NO: 8127989 - DNA, 22 bp, Homo sapiens
ggcctctgtttggagccaggat

SEQ ID NO: 8127990 - DNA, 22 bp, Homo sapiens
ggcctctggttcgtggtgacct

SEQ ID NO: 8127991 - DNA, 22 bp, Homo sapiens
ggcctcagaggaggtgtgagtc

SEQ ID NO: 8127992 - DNA, 22 bp, Homo sapiens
ggcctcagagaaggctgtgcgg

SEQ ID NO: 8127993 - DNA, 21 bp, Homo sapiens
ggcctcagccacctggctctg

SEQ ID NO: 8127994 - DNA, 18 bp, Homo sapiens
ggcctcagcctggccgga

SEQ ID NO: 8127995 - DNA, 22 bp, Homo sapiens
ggccatgctcgtggctggactg

SEQ ID NO: 8127996 - DNA, 22 bp, Homo sapiens
ggccatgctgttgcctgctggt

SEQ ID NO: 8127997 - DNA, 22 bp, Homo sapiens
ggcacagccctctctgtggaca

SEQ ID NO: 8127998 - DNA, 22 bp, Homo sapiens
ggcacatttataagtggacata

SEQ ID NO: 8127999 - DNA, 22 bp, Homo sapiens
ggcagaggaagctggaagtggg

SEQ ID NO: 8128000 - DNA, 22 bp, Homo sapiens
ggcagaggaaggatgaattcac

SEQ ID NO: 8128001 - DNA, 22 bp, Homo sapiens
ggcagaggagctggaaacatgg

SEQ ID NO: 8128002 - DNA, 20 bp, Homo sapiens
ggcagagggcctgggagaag

SEQ ID NO: 8128003 - DNA, 22 bp, Homo sapiens
ggcaggcactgtgctaggcgct

SEQ ID NO: 8128004 - DNA, 22 bp, Homo sapiens
ggcaggaggtgagtggcgggtg

SEQ ID NO: 8128005 - DNA, 22 bp, Homo sapiens
ggagtctgagcttgtgtcctgg

SEQ ID NO: 8128006 - DNA, 19 bp, Homo sapiens
ggagccagctgtggaaggc

SEQ ID NO: 8128007 - DNA, 23 bp, Homo sapiens
ggagccagcctgtggggagcggg

SEQ ID NO: 8128008 - DNA, 22 bp, Homo sapiens
ggagccagaggctgctgctgtg

SEQ ID NO: 8128009 - DNA, 22 bp, Homo sapiens
ggagccagagtctgcagtgtaa

SEQ ID NO: 8128010 - DNA, 22 bp, Homo sapiens
ggagccagagcactggggagcc

SEQ ID NO: 8128011 - DNA, 22 bp, Homo sapiens
gggatggggagctggaaagggg

SEQ ID NO: 8128012 - DNA, 22 bp, Homo sapiens
gggcacagcccagtggggtccc

SEQ ID NO: 8128013 - DNA, 22 bp, Homo sapiens
gggattgaattgggggatcaca

SEQ ID NO: 8128014 - DNA, 22 bp, Homo sapiens
gggcaggagagggccacctgga

SEQ ID NO: 8128015 - DNA, 19 bp, Homo sapiens
gggcatgctggctctagag

SEQ ID NO: 8128016 - DNA, 22 bp, Homo sapiens
gggagctgtaagggacaggtag

SEQ ID NO: 8128017 - DNA, 22 bp, Homo sapiens
gggagagcgggaggtgccacag

SEQ ID NO: 8128018 - DNA, 22 bp, Homo sapiens
gggagagcgcgctagggccgag

SEQ ID NO: 8128019 - DNA, 19 bp, Homo sapiens
gggagagccaggctcaccc

SEQ ID NO: 8128020 - DNA, 22 bp, Homo sapiens
gggacattgtcaatggtggtag

SEQ ID NO: 8128021 - DNA, 22 bp, Homo sapiens
gggacaggcccctcgctagctt

SEQ ID NO: 8128022 - DNA, 22 bp, Homo sapiens
gggacatctttctagtcagggt

SEQ ID NO: 8128023 - DNA, 22 bp, Homo sapiens
ggcgggaggctgaggagttggt

SEQ ID NO: 8128024 - DNA, 22 bp, Homo sapiens
ggcgggcagatgcggacacgcg

SEQ ID NO: 8128025 - DNA, 22 bp, Homo sapiens
ggcggggcctcgcgaacggcct

SEQ ID NO: 8128026 - DNA, 21 bp, Homo sapiens
ggcggcgcagagctgcggctc

SEQ ID NO: 8128027 - DNA, 22 bp, Homo sapiens
ggcggccgccttcggccacggc

SEQ ID NO: 8128028 - DNA, 22 bp, Homo sapiens
ggcgggacggggcgtgcacaga

SEQ ID NO: 8128029 - DNA, 22 bp, Homo sapiens
ggctccagatgtcccctggcaa

SEQ ID NO: 8128030 - DNA, 22 bp, Homo sapiens
ggctctgctgcacccttggctc

SEQ ID NO: 8128031 - DNA, 22 bp, Homo sapiens
ggctctgctgcaagtcttcctc

SEQ ID NO: 8128032 - DNA, 22 bp, Homo sapiens
ggctctgctcacagcccgcagc

SEQ ID NO: 8128033 - DNA, 22 bp, Homo sapiens
ggctctgctcctggtgccagtg

SEQ ID NO: 8128034 - DNA, 22 bp, Homo sapiens
ggctccaggagatgctgggcag

SEQ ID NO: 8128035 - DNA, 22 bp, Homo sapiens
ggctctggcaaggggaggctac

SEQ ID NO: 8128036 - DNA, 22 bp, Homo sapiens
ggctctggagacatgtggagag

SEQ ID NO: 8128037 - DNA, 22 bp, Homo sapiens
ggctctgggaaatggtcttcct

SEQ ID NO: 8128038 - DNA, 22 bp, Homo sapiens
ggctgctgagttggccaggaga

SEQ ID NO: 8128039 - DNA, 22 bp, Homo sapiens
ggctgctgagtcacgacagtga

SEQ ID NO: 8128040 - DNA, 22 bp, Homo sapiens
ggctgctggccagcctaggagt

SEQ ID NO: 8128041 - DNA, 22 bp, Homo sapiens
ggctgctggcattgaggtaggt

SEQ ID NO: 8128042 - DNA, 22 bp, Homo sapiens
ggctgctggagttgggtctctc

SEQ ID NO: 8128043 - DNA, 22 bp, Homo sapiens
ggctgggaggccgtgctgacct

SEQ ID NO: 8128044 - DNA, 22 bp, Homo sapiens
ggctgggcaaacaagactcttc

SEQ ID NO: 8128045 - DNA, 21 bp, Homo sapiens
ggctgctgggagagctgcgtg

SEQ ID NO: 8128046 - DNA, 21 bp, Homo sapiens
ggctgctgggagagctgcgtg

SEQ ID NO: 8128047 - DNA, 22 bp, Homo sapiens
ggctgggccgcggctacccaga

SEQ ID NO: 8128048 - DNA, 22 bp, Homo sapiens
ggctgggcctctccctcagctg

SEQ ID NO: 8128049 - DNA, 21 bp, Homo sapiens
ggctgggcaggacccacccct

SEQ ID NO: 8128050 - DNA, 22 bp, Homo sapiens
ggctgggccagggcctgtggac

SEQ ID NO: 8128051 - DNA, 22 bp, Homo sapiens
ggtctctgagtgaggacctggg

SEQ ID NO: 8128052 - DNA, 22 bp, Homo sapiens
ggtctctgcagctcccggcccc

SEQ ID NO: 8128053 - DNA, 22 bp, Homo sapiens
ggtctctgtcactgagtggccc

SEQ ID NO: 8128054 - DNA, 22 bp, Homo sapiens
ggtcgctgagctagcatctgca

SEQ ID NO: 8128055 - DNA, 22 bp, Homo sapiens
ggtcgggcactctccagggctg

SEQ ID NO: 8128056 - DNA, 20 bp, Homo sapiens
gggtggagttgcggtctgtg

SEQ ID NO: 8128057 - DNA, 21 bp, Homo sapiens
gggtggccgcatgggtgcgtg

SEQ ID NO: 8128058 - DNA, 22 bp, Homo sapiens
gggtggctaggtatcccccatt

SEQ ID NO: 8128059 - DNA, 22 bp, Homo sapiens
gggtggccttcatagctcaggg

SEQ ID NO: 8128060 - DNA, 22 bp, Homo sapiens
ggtagggcaaagtagggcacct

SEQ ID NO: 8128061 - DNA, 22 bp, Homo sapiens
ggtcagagctggagagataggg

SEQ ID NO: 8128062 - DNA, 22 bp, Homo sapiens
ggtcagagccgttagcattcag

SEQ ID NO: 8128063 - DNA, 22 bp, Homo sapiens
ggtcagagaaaagtagggtgtt

SEQ ID NO: 8128064 - DNA, 22 bp, Homo sapiens
ggtgtgggaactacaggttttt

SEQ ID NO: 8128065 - DNA, 22 bp, Homo sapiens
ggtgtgggtccttgtgcttgct

SEQ ID NO: 8128066 - DNA, 19 bp, Homo sapiens
ggtggctctccctcaggga

SEQ ID NO: 8128067 - DNA, 17 bp, Homo sapiens
ggtggctcgggcgcggc

SEQ ID NO: 8128068 - DNA, 22 bp, Homo sapiens
ggtgtccttcgtccgctggcat

SEQ ID NO: 8128069 - DNA, 20 bp, Homo sapiens
ggtgtgttggttcagcatgg

SEQ ID NO: 8128070 - DNA, 20 bp, Homo sapiens
ggtggccgtagcgggcggcg

SEQ ID NO: 8128071 - DNA, 22 bp, Homo sapiens
ggtctctttgcttcagctacag

SEQ ID NO: 8128072 - DNA, 22 bp, Homo sapiens
ggtctctgtttggggctggcaa

SEQ ID NO: 8128073 - DNA, 22 bp, Homo sapiens
ggtggctcagtgtcaggccctg

SEQ ID NO: 8128074 - DNA, 19 bp, Homo sapiens
ggtggctcagggcccagcc

SEQ ID NO: 8128075 - DNA, 22 bp, Homo sapiens
ggtggcctcgccgcggctctgc

SEQ ID NO: 8128076 - DNA, 22 bp, Homo sapiens
gggctgagagctggaatctgag

SEQ ID NO: 8128077 - DNA, 22 bp, Homo sapiens
gggcatgtaggaatccatggag

SEQ ID NO: 8128078 - DNA, 22 bp, Homo sapiens
gggcatgtctctaggctggcta

SEQ ID NO: 8128079 - DNA, 22 bp, Homo sapiens
gggctgagtgtcccaggccgaa

SEQ ID NO: 8128080 - DNA, 22 bp, Homo sapiens
gggctgaggctaccactggtct

SEQ ID NO: 8128081 - DNA, 22 bp, Homo sapiens
gggctgcacgtattctgctcac

SEQ ID NO: 8128082 - DNA, 22 bp, Homo sapiens
gggctgccaagcctgcctgcct

SEQ ID NO: 8128083 - DNA, 22 bp, Homo sapiens
gggctgcctgagcatctcctcc

SEQ ID NO: 8128084 - DNA, 22 bp, Homo sapiens
gggctgccttttaattcttccc

SEQ ID NO: 8128085 - DNA, 22 bp, Homo sapiens
gggctgcctttcttctgggagc

SEQ ID NO: 8128086 - DNA, 22 bp, Homo sapiens
gggctgctgctgccagcgacac

SEQ ID NO: 8128087 - DNA, 22 bp, Homo sapiens
gggcttgctaagaagagcgcat

SEQ ID NO: 8128088 - DNA, 22 bp, Homo sapiens
ggggaagaggcgtgatggatcc

SEQ ID NO: 8128089 - DNA, 22 bp, Homo sapiens
ggggcggggctctgagaagcat

SEQ ID NO: 8128090 - DNA, 22 bp, Homo sapiens
ggggctcagttcggacagcctg

SEQ ID NO: 8128091 - DNA, 22 bp, Homo sapiens
ggggctctgcctctcccacgcc

SEQ ID NO: 8128092 - DNA, 22 bp, Homo sapiens
ggggctctcaggtctccccaaa

SEQ ID NO: 8128093 - DNA, 22 bp, Homo sapiens
ggggctgaacctggaggtggtc

SEQ ID NO: 8128094 - DNA, 20 bp, Homo sapiens
ggggctgcatgcagagaaga

SEQ ID NO: 8128095 - DNA, 22 bp, Homo sapiens
ggggctgctcccacccctgagg

SEQ ID NO: 8128096 - DNA, 22 bp, Homo sapiens
ggggctgcttcacctttttacg

SEQ ID NO: 8128097 - DNA, 22 bp, Homo sapiens
ggggctgctcgccgcgcgtttc

SEQ ID NO: 8128098 - DNA, 22 bp, Homo sapiens
ggggctgctggtatttccagtt

SEQ ID NO: 8128099 - DNA, 22 bp, Homo sapiens
ggggtgtgtctgacaatggtat

SEQ ID NO: 8128100 - DNA, 22 bp, Homo sapiens
ggggtgggcgtgcagggacacc

SEQ ID NO: 8128101 - DNA, 22 bp, Homo sapiens
ggggtggggttactcattgtgc

SEQ ID NO: 8128102 - DNA, 22 bp, Homo sapiens
gggtggaggagaacaggcccca

SEQ ID NO: 8128103 - DNA, 22 bp, Homo sapiens
gggtggagtagaaagatgaatt

SEQ ID NO: 8128104 - DNA, 22 bp, Homo sapiens
gggtaggctgctcctggggccc

SEQ ID NO: 8128105 - DNA, 22 bp, Homo sapiens
gggtaggcagtgcgtcctgcct

SEQ ID NO: 8128106 - DNA, 22 bp, Homo sapiens
gggtaggccagaagggcctgga

SEQ ID NO: 8128107 - DNA, 22 bp, Homo sapiens
gggtaggctctgcaggctgggt

SEQ ID NO: 8128108 - DNA, 22 bp, Homo sapiens
ggtttgcatgtgatgttgggca

SEQ ID NO: 8128109 - DNA, 22 bp, Homo sapiens
gtatttaattccattaagttag

SEQ ID NO: 8128110 - DNA, 22 bp, Homo sapiens
gtattcttgagtggcaactagg

SEQ ID NO: 8128111 - DNA, 22 bp, Homo sapiens
gtcctgggcatgcagggctttc

SEQ ID NO: 8128112 - DNA, 22 bp, Homo sapiens
gtcctgggaggggctggtcctg

SEQ ID NO: 8128113 - DNA, 22 bp, Homo sapiens
gtcctgggcccaggggctgcct

SEQ ID NO: 8128114 - DNA, 22 bp, Homo sapiens
gtcctgggaaggaagccaggga

SEQ ID NO: 8128115 - DNA, 22 bp, Homo sapiens
gtccctgcatctgcaggccatg

SEQ ID NO: 8128116 - DNA, 22 bp, Homo sapiens
gtccctggaaaagagctggtga

SEQ ID NO: 8128117 - DNA, 22 bp, Homo sapiens
gtcattttgctgcatatttaga

SEQ ID NO: 8128118 - DNA, 23 bp, Homo sapiens
gtatttcagcattctcagttaaa

SEQ ID NO: 8128119 - DNA, 22 bp, Homo sapiens
gtgaacaggagaaagtgatgga

SEQ ID NO: 8128120 - DNA, 19 bp, Homo sapiens
gtgaacaaggagaatggga

SEQ ID NO: 8128121 - DNA, 22 bp, Homo sapiens
gtgaacaaggagactacaactt

SEQ ID NO: 8128122 - DNA, 22 bp, Homo sapiens
gtgaaattgtatttggcattga

SEQ ID NO: 8128123 - DNA, 22 bp, Homo sapiens
gtcctgggcctgctgaggctga

SEQ ID NO: 8128124 - DNA, 22 bp, Homo sapiens
gtcctgggcggagggctgctgt

SEQ ID NO: 8128125 - DNA, 20 bp, Homo sapiens
gtgcagaggcagcctgtggg

SEQ ID NO: 8128126 - DNA, 22 bp, Homo sapiens
gtgcagagcaagggctgagggc

SEQ ID NO: 8128127 - DNA, 22 bp, Homo sapiens
gtgcagaggacgtggcggcctc

SEQ ID NO: 8128128 - DNA, 22 bp, Homo sapiens
gtgcattgtaggatgttatgca

SEQ ID NO: 8128129 - DNA, 22 bp, Homo sapiens
gtgccacatggtccatgtatca

SEQ ID NO: 8128130 - DNA, 22 bp, Homo sapiens
gtgcagagaaggagcagtagtt

SEQ ID NO: 8128131 - DNA, 22 bp, Homo sapiens
gtgcagagaggtggagggactt

SEQ ID NO: 8128132 - DNA, 22 bp, Homo sapiens
gtgcacagagcccagggccgcg

SEQ ID NO: 8128133 - DNA, 22 bp, Homo sapiens
gtgagcagggcaggactgggga

SEQ ID NO: 8128134 - DNA, 23 bp, Homo sapiens
gtgcacagtcaagcccagcttag

SEQ ID NO: 8128135 - DNA, 21 bp, Homo sapiens
gtgcacagtcctgcacacagg

SEQ ID NO: 8128136 - DNA, 22 bp, Homo sapiens
gtgagacacccaagagtcagat

SEQ ID NO: 8128137 - DNA, 22 bp, Homo sapiens
gtgactctcaaaagtgcagtct

SEQ ID NO: 8128138 - DNA, 22 bp, Homo sapiens
gtgagaaatggaacttcatacg

SEQ ID NO: 8128139 - DNA, 22 bp, Homo sapiens
gagaattagggcgtaattcaga

SEQ ID NO: 8128140 - DNA, 22 bp, Homo sapiens
gagacaaagcttcctgtgggta

SEQ ID NO: 8128141 - DNA, 22 bp, Homo sapiens
gagacacaaacacatttagagg

SEQ ID NO: 8128142 - DNA, 22 bp, Homo sapiens
gagccacagcaacctcaaagga

SEQ ID NO: 8128143 - DNA, 22 bp, Homo sapiens
gagccagccgcaagagctgtga

SEQ ID NO: 8128144 - DNA, 22 bp, Homo sapiens
gagccagcagccggcaccacca

SEQ ID NO: 8128145 - DNA, 22 bp, Homo sapiens
gagccagattttatgcaagaca

SEQ ID NO: 8128146 - DNA, 22 bp, Homo sapiens
gagccaggtcgggccgcggcga

SEQ ID NO: 8128147 - DNA, 22 bp, Homo sapiens
gagatggaaaactgctggtagt

SEQ ID NO: 8128148 - DNA, 22 bp, Homo sapiens
gagatggaatctgtgtggaggg

SEQ ID NO: 8128149 - DNA, 18 bp, Homo sapiens
gagcagcaggatcaagaa

SEQ ID NO: 8128150 - DNA, 19 bp, Homo sapiens
gaggaggaaaactagtgta

SEQ ID NO: 8128151 - DNA, 22 bp, Homo sapiens
gaggaggcagcctatcccttag

SEQ ID NO: 8128152 - DNA, 22 bp, Homo sapiens
gaggaggccagtggaaggaagc

SEQ ID NO: 8128153 - DNA, 22 bp, Homo sapiens
gaggaggctaagtgggctctgg

SEQ ID NO: 8128154 - DNA, 22 bp, Homo sapiens
gaggagcttgtgagaagatgtc

SEQ ID NO: 8128155 - DNA, 22 bp, Homo sapiens
gaggagcttgtgagaagatgtc

SEQ ID NO: 8128156 - DNA, 22 bp, Homo sapiens
gaggagcttcagaggaatctta

SEQ ID NO: 8128157 - DNA, 19 bp, Homo sapiens
gaggagctatcggagacag

SEQ ID NO: 8128158 - DNA, 22 bp, Homo sapiens
gaggagctgtctttgtgatctt

SEQ ID NO: 8128159 - DNA, 22 bp, Homo sapiens
gaggcactctcgacaagggtgg

SEQ ID NO: 8128160 - DNA, 22 bp, Homo sapiens
gaggcacatgactcaccaatgg

SEQ ID NO: 8128161 - DNA, 22 bp, Homo sapiens
gaggcacatcacttggtgcatt

SEQ ID NO: 8128162 - DNA, 22 bp, Homo sapiens
gaggcacaatacatgtctcaag

SEQ ID NO: 8128163 - DNA, 22 bp, Homo sapiens
gaggcaatgggctatagcattg

SEQ ID NO: 8128164 - DNA, 22 bp, Homo sapiens
gagccctgttcaggcctcctca

SEQ ID NO: 8128165 - DNA, 22 bp, Homo sapiens
gagcctcctcctggtgtgccga

SEQ ID NO: 8128166 - DNA, 22 bp, Homo sapiens
gagcgggggctgccgggatttg

SEQ ID NO: 8128167 - DNA, 22 bp, Homo sapiens
gagctctgtgtagcctgagggt

SEQ ID NO: 8128168 - DNA, 22 bp, Homo sapiens
gagctctgttctcgtcctgctg

SEQ ID NO: 8128169 - DNA, 22 bp, Homo sapiens
gaagaggatgacaggagccggt

SEQ ID NO: 8128170 - DNA, 22 bp, Homo sapiens
gaagaggactgtggcatcctag

SEQ ID NO: 8128171 - DNA, 22 bp, Homo sapiens
gaaccatttctgaatagtttgt

SEQ ID NO: 8128172 - DNA, 22 bp, Homo sapiens
gaaccattgttgaaaagaatag

SEQ ID NO: 8128173 - DNA, 22 bp, Homo sapiens
gaagatttgttgtaatttttag

SEQ ID NO: 8128174 - DNA, 22 bp, Homo sapiens
gaacagggttgggtgagagagg

SEQ ID NO: 8128175 - DNA, 22 bp, Homo sapiens
gaacagtgccagcacacaataa

SEQ ID NO: 8128176 - DNA, 22 bp, Homo sapiens
gaaatgctacacttgttaatga

SEQ ID NO: 8128177 - DNA, 22 bp, Homo sapiens
gaaatcaaacccttttctgata

SEQ ID NO: 8128178 - DNA, 22 bp, Homo sapiens
gaaatcaaacccttttctgata

SEQ ID NO: 8128179 - DNA, 22 bp, Homo sapiens
ctttcacagtcctgactgagcg

SEQ ID NO: 8128180 - DNA, 22 bp, Homo sapiens
ctttcacaagatttgagatgct

SEQ ID NO: 8128181 - DNA, 22 bp, Homo sapiens
gaatactgacactcaggtggga

SEQ ID NO: 8128182 - DNA, 22 bp, Homo sapiens
gaatactgatgctcagccccct

SEQ ID NO: 8128183 - DNA, 18 bp, Homo sapiens
gaatactgagagcacaaa

SEQ ID NO: 8128184 - DNA, 22 bp, Homo sapiens
gaatactggaaaactcatttta

SEQ ID NO: 8128185 - DNA, 22 bp, Homo sapiens
gacaactgtcagtatattgtta

SEQ ID NO: 8128186 - DNA, 22 bp, Homo sapiens
gacaggcttcatcctcagagtt

SEQ ID NO: 8128187 - DNA, 22 bp, Homo sapiens
gacaggctttctcaggatgagc

SEQ ID NO: 8128188 - DNA, 22 bp, Homo sapiens
gacagggctgtgggaggagcag

SEQ ID NO: 8128189 - DNA, 22 bp, Homo sapiens
gacacagacagttagaggtaat

SEQ ID NO: 8128190 - DNA, 22 bp, Homo sapiens
gacacactgtttggactagggt

SEQ ID NO: 8128191 - DNA, 22 bp, Homo sapiens
cttgtagaattgaaatggtctc

SEQ ID NO: 8128192 - DNA, 22 bp, Homo sapiens
cttgcccgcgaagaagctagga

SEQ ID NO: 8128193 - DNA, 22 bp, Homo sapiens
cttgaccgattctagtggacat

SEQ ID NO: 8128194 - DNA, 22 bp, Homo sapiens
cttgaccgaatatgatcacttc

SEQ ID NO: 8128195 - DNA, 22 bp, Homo sapiens
cttgacagtcccaggaaaatag

SEQ ID NO: 8128196 - DNA, 22 bp, Homo sapiens
cttgacagaaggttttatccta

SEQ ID NO: 8128197 - DNA, 22 bp, Homo sapiens
cttgatctacatagtgaaaccc

SEQ ID NO: 8128198 - DNA, 22 bp, Homo sapiens
cttcagctgcagttatgtttag

SEQ ID NO: 8128199 - DNA, 22 bp, Homo sapiens
cttcagctacctctgatgcaag

SEQ ID NO: 8128200 - DNA, 22 bp, Homo sapiens
cttcctctgtgtcctgggcttg

SEQ ID NO: 8128201 - DNA, 22 bp, Homo sapiens
cttcctctgtgtcctgggcttc

SEQ ID NO: 8128202 - DNA, 22 bp, Homo sapiens
cttcctctgtgtcctgggcttg

SEQ ID NO: 8128203 - DNA, 22 bp, Homo sapiens
cttcctctgtggccagagtgta

SEQ ID NO: 8128204 - DNA, 22 bp, Homo sapiens
cttcctctgtgtcctgggcttc

SEQ ID NO: 8128205 - DNA, 22 bp, Homo sapiens
cttcctctgaggcttctgagtc

SEQ ID NO: 8128206 - DNA, 22 bp, Homo sapiens
ctgttgtctatataagtttttc

SEQ ID NO: 8128207 - DNA, 22 bp, Homo sapiens
ctgttgtagctgcgctgcttca

SEQ ID NO: 8128208 - DNA, 22 bp, Homo sapiens
ctgttctgaccagtgcagggat

SEQ ID NO: 8128209 - DNA, 22 bp, Homo sapiens
ctgtggctgcgtaggtctggca

SEQ ID NO: 8128210 - DNA, 20 bp, Homo sapiens
ctgtgtagtgctcaggtaag

SEQ ID NO: 8128211 - DNA, 22 bp, Homo sapiens
ctgtggctctcagaggctgctg

SEQ ID NO: 8128212 - DNA, 22 bp, Homo sapiens
ctgggtgccacgggcaccctgg

SEQ ID NO: 8128213 - DNA, 22 bp, Homo sapiens
ctgggtgacagagtgagatggt

SEQ ID NO: 8128214 - DNA, 22 bp, Homo sapiens
ctgggtgattcctgtccaggca

SEQ ID NO: 8128215 - DNA, 22 bp, Homo sapiens
ctgggtgagttgatgaaggaga

SEQ ID NO: 8128216 - DNA, 22 bp, Homo sapiens
ctgtcctgcagttgggggcagg

SEQ ID NO: 8128217 - DNA, 22 bp, Homo sapiens
ctgtgcattgttgagtgtttag

SEQ ID NO: 8128218 - DNA, 22 bp, Homo sapiens
ctgtgcattgtcttgtctgtag

SEQ ID NO: 8128219 - DNA, 22 bp, Homo sapiens
ctgggcagttttacatcattgc

SEQ ID NO: 8128220 - DNA, 22 bp, Homo sapiens
ctgggcagtttattcagttctg

SEQ ID NO: 8128221 - DNA, 22 bp, Homo sapiens
ctgggcaggagaggtggttgga

SEQ ID NO: 8128222 - DNA, 22 bp, Homo sapiens
ctgggccacaagcctgtgtgat

SEQ ID NO: 8128223 - DNA, 22 bp, Homo sapiens
ctgggccactccagatgcccac

SEQ ID NO: 8128224 - DNA, 22 bp, Homo sapiens
ctgggaggcagaggttgtagtg

SEQ ID NO: 8128225 - DNA, 22 bp, Homo sapiens
ctgggaggcagaggttgcagtg

SEQ ID NO: 8128226 - DNA, 22 bp, Homo sapiens
ctgggaggcagaggttgcagtg

SEQ ID NO: 8128227 - DNA, 22 bp, Homo sapiens
ctgggaggcactattcaggagg

SEQ ID NO: 8128228 - DNA, 22 bp, Homo sapiens
ctgggaggcccacgttgggaag

SEQ ID NO: 8128229 - DNA, 22 bp, Homo sapiens
ctgggcagctgtgcaaacaata

SEQ ID NO: 8128230 - DNA, 22 bp, Homo sapiens
ctgggaggcaccgcgtcgtgct

SEQ ID NO: 8128231 - DNA, 22 bp, Homo sapiens
ctgggaggattcattgaggtga

SEQ ID NO: 8128232 - DNA, 22 bp, Homo sapiens
ctggggccctgggtctgccctc

SEQ ID NO: 8128233 - DNA, 22 bp, Homo sapiens
ctggggcccgagccttgggcca

SEQ ID NO: 8128234 - DNA, 22 bp, Homo sapiens
ctggggctcactttggtcaggc

SEQ ID NO: 8128235 - DNA, 23 bp, Homo sapiens
ctggggctcattgcagtagccat

SEQ ID NO: 8128236 - DNA, 22 bp, Homo sapiens
ctggggccagtgaggaggcttt

SEQ ID NO: 8128237 - DNA, 22 bp, Homo sapiens
ctggggcccatcgagggctgag

SEQ ID NO: 8128238 - DNA, 22 bp, Homo sapiens
ctggggccacaacggcgcacgc

SEQ ID NO: 8128239 - DNA, 22 bp, Homo sapiens
ctggggcattgggagaggcctg

SEQ ID NO: 8128240 - DNA, 22 bp, Homo sapiens
ctggggctgcggacgggagccc

SEQ ID NO: 8128241 - DNA, 22 bp, Homo sapiens
ctggggctgcagcgatcttcat

SEQ ID NO: 8128242 - DNA, 22 bp, Homo sapiens
ctgggccagaccttgtggtctt

SEQ ID NO: 8128243 - DNA, 19 bp, Homo sapiens
ctgggccagagctgtcctc

SEQ ID NO: 8128244 - DNA, 22 bp, Homo sapiens
ctgccagccaggccaggtaggc

SEQ ID NO: 8128245 - DNA, 22 bp, Homo sapiens
ctgccagctcaaagcgcagcta

SEQ ID NO: 8128246 - DNA, 22 bp, Homo sapiens
ctgccagctcaccggctcagac

SEQ ID NO: 8128247 - DNA, 22 bp, Homo sapiens
ctgccagcagaggccagcgctg

SEQ ID NO: 8128248 - DNA, 22 bp, Homo sapiens
ctgccacaggggagcaggcaga

SEQ ID NO: 8128249 - DNA, 22 bp, Homo sapiens
ctgccagaaggttcctgctgca

SEQ ID NO: 8128250 - DNA, 22 bp, Homo sapiens
ctggcaggctctctggtcggtt

SEQ ID NO: 8128251 - DNA, 22 bp, Homo sapiens
ctggcaggatctaaccagggaa

SEQ ID NO: 8128252 - DNA, 22 bp, Homo sapiens
ctggctcatagagcagctccaa

SEQ ID NO: 8128253 - DNA, 22 bp, Homo sapiens
ctggctgcaggaaggagtgggc

SEQ ID NO: 8128254 - DNA, 22 bp, Homo sapiens
ctggctgcaggatgaggctgcc

SEQ ID NO: 8128255 - DNA, 22 bp, Homo sapiens
ctggctgcagtagcaagagact

SEQ ID NO: 8128256 - DNA, 22 bp, Homo sapiens
ctggctgcctggagtgagggag

SEQ ID NO: 8128257 - DNA, 22 bp, Homo sapiens
ctggctcacctccgctccagca

SEQ ID NO: 8128258 - DNA, 18 bp, Homo sapiens
cgccctgctataaatgac

SEQ ID NO: 8128259 - DNA, 19 bp, Homo sapiens
ttcacaattatgaaattag

SEQ ID NO: 8128260 - DNA, 22 bp, Homo sapiens
ttcaatatcattgtttagtctc

SEQ ID NO: 8128261 - DNA, 23 bp, Homo sapiens
cgcccagcctcagtgacctgggc

SEQ ID NO: 8128262 - DNA, 22 bp, Homo sapiens
cctttctctttgctgatcatgt

SEQ ID NO: 8128263 - DNA, 22 bp, Homo sapiens
ttcaggctatagaccaatttgg

SEQ ID NO: 8128264 - DNA, 22 bp, Homo sapiens
cggggctggcacaggtgaccac

SEQ ID NO: 8128265 - DNA, 22 bp, Homo sapiens
cggggctgtagcacagctgagc

SEQ ID NO: 8128266 - DNA, 22 bp, Homo sapiens
ttcagcaaaatatctcagatag

SEQ ID NO: 8128267 - DNA, 22 bp, Homo sapiens
ttcaggagtgtcaggagtgcct

SEQ ID NO: 8128268 - DNA, 22 bp, Homo sapiens
ttcagcaaacacgatgcttgtt

SEQ ID NO: 8128269 - DNA, 22 bp, Homo sapiens
ttcacagaattgtcttgactgg

SEQ ID NO: 8128270 - DNA, 22 bp, Homo sapiens
ttcatgaatgttccatgtgagt

SEQ ID NO: 8128271 - DNA, 22 bp, Homo sapiens
ttcatgaaagtgtatcttgtgg

SEQ ID NO: 8128272 - DNA, 22 bp, Homo sapiens
ttcatgaaacttaactgttggg

SEQ ID NO: 8128273 - DNA, 22 bp, Homo sapiens
ctatttttctgtaccctaattt

SEQ ID NO: 8128274 - DNA, 22 bp, Homo sapiens
ctattatttcctcatctataaa

SEQ ID NO: 8128275 - DNA, 22 bp, Homo sapiens
ctattattatcctaatttctgt

SEQ ID NO: 8128276 - DNA, 22 bp, Homo sapiens
ctcacagagctcatactgggag

SEQ ID NO: 8128277 - DNA, 22 bp, Homo sapiens
ctcacagatatttgcttcaggt

SEQ ID NO: 8128278 - DNA, 22 bp, Homo sapiens
ctcacaggcatctcatcaggct

SEQ ID NO: 8128279 - DNA, 22 bp, Homo sapiens
ctattacagggaagccttggga

SEQ ID NO: 8128280 - DNA, 22 bp, Homo sapiens
ctagcaggtcaaaccagctgat

SEQ ID NO: 8128281 - DNA, 22 bp, Homo sapiens
ttctctggcggtgtgttttcct

SEQ ID NO: 8128282 - DNA, 22 bp, Homo sapiens
ctagatttctagttcattatcc

SEQ ID NO: 8128283 - DNA, 22 bp, Homo sapiens
ctagcaattaggtttataaggc

SEQ ID NO: 8128284 - DNA, 21 bp, Homo sapiens
ctactgtgagacacaaagtgc

SEQ ID NO: 8128285 - DNA, 22 bp, Homo sapiens
ctacagagtatctaaagaggta

SEQ ID NO: 8128286 - DNA, 19 bp, Homo sapiens
ccttcctccccagggccat

SEQ ID NO: 8128287 - DNA, 22 bp, Homo sapiens
cctgggctgtacctgtgcgcgg

SEQ ID NO: 8128288 - DNA, 22 bp, Homo sapiens
tgttacaggaaatagaattacc

SEQ ID NO: 8128289 - DNA, 22 bp, Homo sapiens
tgtgtctgaacatgctttgtaa

SEQ ID NO: 8128290 - DNA, 23 bp, Homo sapiens
tgtgtctgaggatatatgtgcat

SEQ ID NO: 8128291 - DNA, 19 bp, Homo sapiens
cctgggagtcagctgaagg

SEQ ID NO: 8128292 - DNA, 22 bp, Homo sapiens
cctgggaggtggatgttgcggt

SEQ ID NO: 8128293 - DNA, 22 bp, Homo sapiens
cctgggaggtggaggttgcagt

SEQ ID NO: 8128294 - DNA, 22 bp, Homo sapiens
tggggcagcagacctttcttgg

SEQ ID NO: 8128295 - DNA, 22 bp, Homo sapiens
tggggcagctccatctattcca

SEQ ID NO: 8128296 - DNA, 22 bp, Homo sapiens
tggggcagccacatagacaaca

SEQ ID NO: 8128297 - DNA, 22 bp, Homo sapiens
tggggcagggatgggaaactat

SEQ ID NO: 8128298 - DNA, 22 bp, Homo sapiens
tggggcagtggcttttcaccct

SEQ ID NO: 8128299 - DNA, 22 bp, Homo sapiens
tggggctgtggattctcacgaa

SEQ ID NO: 8128300 - DNA, 22 bp, Homo sapiens
tggggctgtgagactacaggat

SEQ ID NO: 8128301 - DNA, 22 bp, Homo sapiens
tggggccaagaaggtctcatgt

SEQ ID NO: 8128302 - DNA, 22 bp, Homo sapiens
tggggcagttaataaacattct

SEQ ID NO: 8128303 - DNA, 23 bp, Homo sapiens
tggggccaagtgaggaagggtct

SEQ ID NO: 8128304 - DNA, 22 bp, Homo sapiens
tggggccacacatctctttcta

SEQ ID NO: 8128305 - DNA, 22 bp, Homo sapiens
ctgacagatgctgctggcagta

SEQ ID NO: 8128306 - DNA, 22 bp, Homo sapiens
ctgacagattagatgtgcatat

SEQ ID NO: 8128307 - DNA, 22 bp, Homo sapiens
ctgacagatctggatctgaact

SEQ ID NO: 8128308 - DNA, 22 bp, Homo sapiens
ctgacagatacttatgacataa

SEQ ID NO: 8128309 - DNA, 22 bp, Homo sapiens
ctgcagggcccgcctgagccct

SEQ ID NO: 8128310 - DNA, 22 bp, Homo sapiens
ctgcagggcttaccttgctctg

SEQ ID NO: 8128311 - DNA, 19 bp, Homo sapiens
ctgcagggatgtgcagagt

SEQ ID NO: 8128312 - DNA, 22 bp, Homo sapiens
ctgcagggcagaagggcataga

SEQ ID NO: 8128313 - DNA, 22 bp, Homo sapiens
ctgcagggagaggggacagcct

SEQ ID NO: 8128314 - DNA, 22 bp, Homo sapiens
ctgaggccagaacccgaccctg

SEQ ID NO: 8128315 - DNA, 21 bp, Homo sapiens
ctctgcccagggcctcctgcc

SEQ ID NO: 8128316 - DNA, 22 bp, Homo sapiens
tttcctttatgacatcaccact

SEQ ID NO: 8128317 - DNA, 22 bp, Homo sapiens
tttgggaaataaacctagagga

SEQ ID NO: 8128318 - DNA, 19 bp, Homo sapiens
tttgggaagcccagagtgt

SEQ ID NO: 8128319 - DNA, 23 bp, Homo sapiens
tttgggaagggagagagtaagca

SEQ ID NO: 8128320 - DNA, 22 bp, Homo sapiens
tttgggaagtgggagcaaggtg

SEQ ID NO: 8128321 - DNA, 22 bp, Homo sapiens
tttgggaataattgcacagatt

SEQ ID NO: 8128322 - DNA, 22 bp, Homo sapiens
tttgggaagtttaaaataagta

SEQ ID NO: 8128323 - DNA, 22 bp, Homo sapiens
ctctgctttttaaaaggagtcc

SEQ ID NO: 8128324 - DNA, 19 bp, Homo sapiens
ttttaagtcctctctattc

SEQ ID NO: 8128325 - DNA, 22 bp, Homo sapiens
ttttaagtgcaatctgaatgcg

SEQ ID NO: 8128326 - DNA, 19 bp, Homo sapiens
ttttaagtgccctttcttc

SEQ ID NO: 8128327 - DNA, 22 bp, Homo sapiens
ttttaatactgctattgtagga

SEQ ID NO: 8128328 - DNA, 22 bp, Homo sapiens
ttttaagttggattgctaagta

SEQ ID NO: 8128329 - DNA, 22 bp, Homo sapiens
ttttaagatgctagtatttcag

SEQ ID NO: 8128330 - DNA, 22 bp, Homo sapiens
ttttagttactgcagtagcaaa

SEQ ID NO: 8128331 - DNA, 22 bp, Homo sapiens
ctctttaactcccattctgtcc

SEQ ID NO: 8128332 - DNA, 22 bp, Homo sapiens
ctctttagtggtgatgatgcta

SEQ ID NO: 8128333 - DNA, 22 bp, Homo sapiens
tttcctcacacagaagatcttg

SEQ ID NO: 8128334 - DNA, 22 bp, Homo sapiens
tttcacataaatattatgccta

SEQ ID NO: 8128335 - DNA, 22 bp, Homo sapiens
tttcacagttagcatgaggact

SEQ ID NO: 8128336 - DNA, 22 bp, Homo sapiens
tttcacagtcaatttggagtca

SEQ ID NO: 8128337 - DNA, 22 bp, Homo sapiens
tttcacaaagcatagcacttta

SEQ ID NO: 8128338 - DNA, 21 bp, Homo sapiens
tttcacaaaagtatgtgacaa

SEQ ID NO: 8128339 - DNA, 22 bp, Homo sapiens
tttcacaaactgaggagacaat

SEQ ID NO: 8128340 - DNA, 22 bp, Homo sapiens
tttcacaaactcagggtgtgtg

SEQ ID NO: 8128341 - DNA, 18 bp, Homo sapiens
ctcctccacagcccctgc

SEQ ID NO: 8128342 - DNA, 22 bp, Homo sapiens
ctcccgtgccactggctcctgc

SEQ ID NO: 8128343 - DNA, 22 bp, Homo sapiens
tttagtagtgacagattctggg

SEQ ID NO: 8128344 - DNA, 22 bp, Homo sapiens
tttaacagatgctatgtctacc

SEQ ID NO: 8128345 - DNA, 22 bp, Homo sapiens
ctcccaggcacagggaggagcc

SEQ ID NO: 8128346 - DNA, 22 bp, Homo sapiens
ctcccaggcagggctgcccact

SEQ ID NO: 8128347 - DNA, 22 bp, Homo sapiens
ctcccaggactcagaggagaag

SEQ ID NO: 8128348 - DNA, 22 bp, Homo sapiens
ttgtcttattttatcataagca

SEQ ID NO: 8128349 - DNA, 22 bp, Homo sapiens
ttgtcttaaatggatggacaat

SEQ ID NO: 8128350 - DNA, 19 bp, Homo sapiens
ttgtcttagctgcataaga

SEQ ID NO: 8128351 - DNA, 22 bp, Homo sapiens
ctccagccagagtgcctctgtt

SEQ ID NO: 8128352 - DNA, 22 bp, Homo sapiens
ctccagcctcatctcctggctg

SEQ ID NO: 8128353 - DNA, 20 bp, Homo sapiens
ctccagcccctgccctggtc

SEQ ID NO: 8128354 - DNA, 22 bp, Homo sapiens
ttgtgtaattagcaaacaaatc

SEQ ID NO: 8128355 - DNA, 22 bp, Homo sapiens
ttgtgtaaaacctgtgatcttt

SEQ ID NO: 8128356 - DNA, 22 bp, Homo sapiens
ttgaaagtctctgcatgtagga

SEQ ID NO: 8128357 - DNA, 22 bp, Homo sapiens
ctcatttacctttgcaatcaag

SEQ ID NO: 8128358 - DNA, 22 bp, Homo sapiens
ttctttcttagcaatctatggt

SEQ ID NO: 8128359 - DNA, 22 bp, Homo sapiens
ttcttttaatttctgtctgcag

SEQ ID NO: 8128360 - DNA, 22 bp, Homo sapiens
ttcttttacattaagatttcag

SEQ ID NO: 8128361 - DNA, 22 bp, Homo sapiens
ttgtacaacgttttaaatttga

SEQ ID NO: 8128362 - DNA, 22 bp, Homo sapiens
ttgtaattaatggcagcaatta

SEQ ID NO: 8128363 - DNA, 22 bp, Homo sapiens
tcctgggcttaagtgatcctcc

SEQ ID NO: 8128364 - DNA, 22 bp, Homo sapiens
ccacactgaccagctgtgagac

SEQ ID NO: 8128365 - DNA, 22 bp, Homo sapiens
ccacactgaacctcagtgtctt

SEQ ID NO: 8128366 - DNA, 22 bp, Homo sapiens
ccacactttgagatgactagga

SEQ ID NO: 8128367 - DNA, 19 bp, Homo sapiens
ccacacagtgtgcaattta

SEQ ID NO: 8128368 - DNA, 19 bp, Homo sapiens
tccttccccccagcacaga

SEQ ID NO: 8128369 - DNA, 23 bp, Homo sapiens
tcctttaatgctggaatggctag

SEQ ID NO: 8128370 - DNA, 19 bp, Homo sapiens
tcctggggaggggcatggc

SEQ ID NO: 8128371 - DNA, 22 bp, Homo sapiens
tcctgggcttagtggctaggtc

SEQ ID NO: 8128372 - DNA, 22 bp, Homo sapiens
ccactgtctgcaggcctcagca

SEQ ID NO: 8128373 - DNA, 22 bp, Homo sapiens
ccactgtcagaggggctgtgcc

SEQ ID NO: 8128374 - DNA, 22 bp, Homo sapiens
ccactgtcttttccaggctgaa

SEQ ID NO: 8128375 - DNA, 22 bp, Homo sapiens
catgggccagagctcctctggg

SEQ ID NO: 8128376 - DNA, 22 bp, Homo sapiens
catgggcccgtgagaggcaggg

SEQ ID NO: 8128377 - DNA, 22 bp, Homo sapiens
catgggaggtctgcaaggtgct

SEQ ID NO: 8128378 - DNA, 17 bp, Homo sapiens
tccaggagaggcaatgg

SEQ ID NO: 8128379 - DNA, 22 bp, Homo sapiens
cattacatttcaaaatgtttcc

SEQ ID NO: 8128380 - DNA, 22 bp, Homo sapiens
cattagcaatcataaaccttta

SEQ ID NO: 8128381 - DNA, 22 bp, Homo sapiens
cattgttaattggtatcttaca

SEQ ID NO: 8128382 - DNA, 22 bp, Homo sapiens
cattgttgctgcttcaagatat

SEQ ID NO: 8128383 - DNA, 22 bp, Homo sapiens
cattgttgaacacctgctggat

SEQ ID NO: 8128384 - DNA, 22 bp, Homo sapiens
cattgttggtaatgctcagagg

SEQ ID NO: 8128385 - DNA, 22 bp, Homo sapiens
cattgttggcagagggacagag

SEQ ID NO: 8128386 - DNA, 22 bp, Homo sapiens
cattgttgtgagatcaagcagt

SEQ ID NO: 8128387 - DNA, 22 bp, Homo sapiens
cattgttggtcattgtcggttg

SEQ ID NO: 8128388 - DNA, 22 bp, Homo sapiens
cattgttgttaaacatagtaat

SEQ ID NO: 8128389 - DNA, 22 bp, Homo sapiens
tccctggggtatcgctgaggca

SEQ ID NO: 8128390 - DNA, 22 bp, Homo sapiens
tccctggggtaacattagaggg

SEQ ID NO: 8128391 - DNA, 20 bp, Homo sapiens
tccctggggccctacttcct

SEQ ID NO: 8128392 - DNA, 18 bp, Homo sapiens
tccctggggctgccaccc

SEQ ID NO: 8128393 - DNA, 22 bp, Homo sapiens
tccctgggtcattctctggcac

SEQ ID NO: 8128394 - DNA, 22 bp, Homo sapiens
tccctggggttcctccagccac

SEQ ID NO: 8128395 - DNA, 22 bp, Homo sapiens
tccctgggtcctgcttgctctc

SEQ ID NO: 8128396 - DNA, 22 bp, Homo sapiens
tccctgggttcccgtggaagtg

SEQ ID NO: 8128397 - DNA, 22 bp, Homo sapiens
tccctgggttacctttcaaggt

SEQ ID NO: 8128398 - DNA, 22 bp, Homo sapiens
tcagaggagcaaaagaggggat

SEQ ID NO: 8128399 - DNA, 22 bp, Homo sapiens
tcagaggatcatgtccctactc

SEQ ID NO: 8128400 - DNA, 22 bp, Homo sapiens
cagtttttcaaaattacatgat

SEQ ID NO: 8128401 - DNA, 22 bp, Homo sapiens
tcaatatttttatgagcataga

SEQ ID NO: 8128402 - DNA, 21 bp, Homo sapiens
tcagagagtcacagtgaactg

SEQ ID NO: 8128403 - DNA, 22 bp, Homo sapiens
tcagagagtcctggtcatttgc

SEQ ID NO: 8128404 - DNA, 21 bp, Homo sapiens
tcagagagtcacagtgaactg

SEQ ID NO: 8128405 - DNA, 22 bp, Homo sapiens
tcagagaggttggtgataagaa

SEQ ID NO: 8128406 - DNA, 22 bp, Homo sapiens
cagttgcctactacatggcagg

SEQ ID NO: 8128407 - DNA, 22 bp, Homo sapiens
cagttgcactagccacatttca

SEQ ID NO: 8128408 - DNA, 22 bp, Homo sapiens
cagttgcagctgtgacattgcg

SEQ ID NO: 8128409 - DNA, 22 bp, Homo sapiens
tcagagagttagtgtcttagct

SEQ ID NO: 8128410 - DNA, 22 bp, Homo sapiens
tcagagagttagtgtcttagct

SEQ ID NO: 8128411 - DNA, 22 bp, Homo sapiens
tcagagagttacacaaattgtt

SEQ ID NO: 8128412 - DNA, 22 bp, Homo sapiens
tcagagagtgcaaaatatagct

SEQ ID NO: 8128413 - DNA, 22 bp, Homo sapiens
tcagagagttttcactagggtg

SEQ ID NO: 8128414 - DNA, 22 bp, Homo sapiens
tcagagagttggaaagaattaa

SEQ ID NO: 8128415 - DNA, 22 bp, Homo sapiens
cataattttccatggtttgcta

SEQ ID NO: 8128416 - DNA, 22 bp, Homo sapiens
cataatttgtggtagtggggga

SEQ ID NO: 8128417 - DNA, 22 bp, Homo sapiens
cataatttctgtatcagcacca

SEQ ID NO: 8128418 - DNA, 22 bp, Homo sapiens
cataatttgatatgcttgatgg

SEQ ID NO: 8128419 - DNA, 18 bp, Homo sapiens
cataattttctttcttta

SEQ ID NO: 8128420 - DNA, 18 bp, Homo sapiens
cataattttctttcttta

SEQ ID NO: 8128421 - DNA, 22 bp, Homo sapiens
cataatttcccaagagattgaa

SEQ ID NO: 8128422 - DNA, 22 bp, Homo sapiens
cataatttcactgtcgtatggc

SEQ ID NO: 8128423 - DNA, 22 bp, Homo sapiens
cataatttctaccagggccata

SEQ ID NO: 8128424 - DNA, 22 bp, Homo sapiens
tcaggcctagaacacagcagat

SEQ ID NO: 8128425 - DNA, 22 bp, Homo sapiens
catagaaatcaggtgagaatct

SEQ ID NO: 8128426 - DNA, 22 bp, Homo sapiens
catggcaggaaggacatgcact

SEQ ID NO: 8128427 - DNA, 22 bp, Homo sapiens
catgaaggctgccagcaggcat

SEQ ID NO: 8128428 - DNA, 22 bp, Homo sapiens
catgcagtttctctatgcgtag

SEQ ID NO: 8128429 - DNA, 22 bp, Homo sapiens
catctgtaggtgacacatgagt

SEQ ID NO: 8128430 - DNA, 22 bp, Homo sapiens
catctgatgggaatataagagc

SEQ ID NO: 8128431 - DNA, 22 bp, Homo sapiens
catctgaagagctttgcaagag

SEQ ID NO: 8128432 - DNA, 22 bp, Homo sapiens
catgaaattgctcctttggtgc

SEQ ID NO: 8128433 - DNA, 22 bp, Homo sapiens
catgaacatttgtttacatctg

SEQ ID NO: 8128434 - DNA, 22 bp, Homo sapiens
catgaacatttgtttacatctg

SEQ ID NO: 8128435 - DNA, 22 bp, Homo sapiens
catgaacaccaggcatgaacaa

SEQ ID NO: 8128436 - DNA, 22 bp, Homo sapiens
catgaacaatttgctcactgat

SEQ ID NO: 8128437 - DNA, 22 bp, Homo sapiens
tcagtgctgagtagcgtgcacc

SEQ ID NO: 8128438 - DNA, 22 bp, Homo sapiens
catctcacttccctgcagcatc

SEQ ID NO: 8128439 - DNA, 22 bp, Homo sapiens
catctcactgaggggtttacaa

SEQ ID NO: 8128440 - DNA, 22 bp, Homo sapiens
catctcacagcaaactgctgaa

SEQ ID NO: 8128441 - DNA, 21 bp, Homo sapiens
catctcagtgggttggtggat

SEQ ID NO: 8128442 - DNA, 22 bp, Homo sapiens
tatttgaagattcttctgatgt

SEQ ID NO: 8128443 - DNA, 22 bp, Homo sapiens
cagtatttttaagctgctttgt

SEQ ID NO: 8128444 - DNA, 21 bp, Homo sapiens
cagtattttaagcagtgagtt

SEQ ID NO: 8128445 - DNA, 22 bp, Homo sapiens
tcaaaacactattacctttaat

SEQ ID NO: 8128446 - DNA, 22 bp, Homo sapiens
tcaatagataaagctacataaa

SEQ ID NO: 8128447 - DNA, 22 bp, Homo sapiens
tcaagcaagttgcatattgcta

SEQ ID NO: 8128448 - DNA, 23 bp, Homo sapiens
tcaagcaataattggtaatagtg

SEQ ID NO: 8128449 - DNA, 22 bp, Homo sapiens
tcaagcaagtgtttggtgtaaa

SEQ ID NO: 8128450 - DNA, 22 bp, Homo sapiens
caggtgctctgctgcaggtaag

SEQ ID NO: 8128451 - DNA, 22 bp, Homo sapiens
caggtggcattgtcccgccagc

SEQ ID NO: 8128452 - DNA, 22 bp, Homo sapiens
caggtggcatgactgcctacaa

SEQ ID NO: 8128453 - DNA, 22 bp, Homo sapiens
caggtggggggcttccgagcct

SEQ ID NO: 8128454 - DNA, 18 bp, Homo sapiens
caggtgggtctcctgccc

SEQ ID NO: 8128455 - DNA, 22 bp, Homo sapiens
caggtgggtacatcacagagac

SEQ ID NO: 8128456 - DNA, 22 bp, Homo sapiens
cagggccagttctcgcagcagt

SEQ ID NO: 8128457 - DNA, 22 bp, Homo sapiens
caggggtggctgcagcagaggt

SEQ ID NO: 8128458 - DNA, 22 bp, Homo sapiens
caggggtgtttttggccaggag

SEQ ID NO: 8128459 - DNA, 22 bp, Homo sapiens
caggggctgtttgcctcaggcc

SEQ ID NO: 8128460 - DNA, 20 bp, Homo sapiens
cagggctctgggcctggcct

SEQ ID NO: 8128461 - DNA, 22 bp, Homo sapiens
caggctgggactgacccctgct

SEQ ID NO: 8128462 - DNA, 22 bp, Homo sapiens
caggctgggaacgccacccgct

SEQ ID NO: 8128463 - DNA, 22 bp, Homo sapiens
caggctgggaacgccacccgct

SEQ ID NO: 8128464 - DNA, 22 bp, Homo sapiens
caggctggcaatgcgtcaagca

SEQ ID NO: 8128465 - DNA, 22 bp, Homo sapiens
caggctggagttcagtggtgtg

SEQ ID NO: 8128466 - DNA, 22 bp, Homo sapiens
caggctggagttcagtggtgtg

SEQ ID NO: 8128467 - DNA, 22 bp, Homo sapiens
caggctgccgtgaagcaggcct

SEQ ID NO: 8128468 - DNA, 22 bp, Homo sapiens
caggctggagtgcagtggtgcc

SEQ ID NO: 8128469 - DNA, 22 bp, Homo sapiens
tactgtggttactgctattaga

SEQ ID NO: 8128470 - DNA, 22 bp, Homo sapiens
tactgtggtaacattttaaatt

SEQ ID NO: 8128471 - DNA, 22 bp, Homo sapiens
caggctgcagcagcagtggccc

SEQ ID NO: 8128472 - DNA, 22 bp, Homo sapiens
caggcgggcaggtgcggcccct

SEQ ID NO: 8128473 - DNA, 22 bp, Homo sapiens
caggcgctgtggctcccacctg

SEQ ID NO: 8128474 - DNA, 18 bp, Homo sapiens
caggcctttgagacagaa

SEQ ID NO: 8128475 - DNA, 22 bp, Homo sapiens
caggcccagcccagcccttcga

SEQ ID NO: 8128476 - DNA, 22 bp, Homo sapiens
caggcctctccttagtctggca

SEQ ID NO: 8128477 - DNA, 22 bp, Homo sapiens
caggcctgaccctgagcttcac

SEQ ID NO: 8128478 - DNA, 22 bp, Homo sapiens
caggcctcttccatgcagcagc

SEQ ID NO: 8128479 - DNA, 22 bp, Homo sapiens
tacattgctcattatattgctt

SEQ ID NO: 8128480 - DNA, 22 bp, Homo sapiens
tacattgctttctaatacatct

SEQ ID NO: 8128481 - DNA, 22 bp, Homo sapiens
tacattgctagaaatgtatttt

SEQ ID NO: 8128482 - DNA, 22 bp, Homo sapiens
taatgtcagtgacctggtttaa

SEQ ID NO: 8128483 - DNA, 22 bp, Homo sapiens
taatgtcaaggtgatagatttg

SEQ ID NO: 8128484 - DNA, 22 bp, Homo sapiens
taatgtcagcatagtttatttt

SEQ ID NO: 8128485 - DNA, 22 bp, Homo sapiens
taatgtcaaggtcattctagag

SEQ ID NO: 8128486 - DNA, 20 bp, Homo sapiens
taatgtcaaagtcacaaggt

SEQ ID NO: 8128487 - DNA, 22 bp, Homo sapiens
caggccagttttgatttaagcc

SEQ ID NO: 8128488 - DNA, 22 bp, Homo sapiens
caggccagtgtgcttcccaggc

SEQ ID NO: 8128489 - DNA, 19 bp, Homo sapiens
caggccagtgtcagggggc

SEQ ID NO: 8128490 - DNA, 22 bp, Homo sapiens
caggccagggttgagaagagaa

SEQ ID NO: 8128491 - DNA, 22 bp, Homo sapiens
caggccaggtgctctagaatca

SEQ ID NO: 8128492 - DNA, 22 bp, Homo sapiens
caggccagtgggaaatagggat

SEQ ID NO: 8128493 - DNA, 22 bp, Homo sapiens
caggccaggtggcaggcaaaac

SEQ ID NO: 8128494 - DNA, 22 bp, Homo sapiens
caggccagagcgcgtggttggg

SEQ ID NO: 8128495 - DNA, 22 bp, Homo sapiens
caggccagggagaatatgaagc

SEQ ID NO: 8128496 - DNA, 22 bp, Homo sapiens
tacaaaccaaggaacagtgatc

SEQ ID NO: 8128497 - DNA, 22 bp, Homo sapiens
tacaaaccagcagaataggtcc

SEQ ID NO: 8128498 - DNA, 22 bp, Homo sapiens
taagtattggcctatagctaga

SEQ ID NO: 8128499 - DNA, 22 bp, Homo sapiens
taagtgaaataagtcagataca

SEQ ID NO: 8128500 - DNA, 19 bp, Homo sapiens
tgagaaggcagtggggagc

SEQ ID NO: 8128501 - DNA, 22 bp, Homo sapiens
tgagaaggcctgtgtgacaggg

SEQ ID NO: 8128502 - DNA, 22 bp, Homo sapiens
ccaggggctctcagggtgtgtg

SEQ ID NO: 8128503 - DNA, 19 bp, Homo sapiens
ccaggtggaactgaggtag

SEQ ID NO: 8128504 - DNA, 22 bp, Homo sapiens
ccaggtggaaggtctgtgctct

SEQ ID NO: 8128505 - DNA, 22 bp, Homo sapiens
ccaggggctggtgctgagctgg

SEQ ID NO: 8128506 - DNA, 21 bp, Homo sapiens
ccaggctggccatggtattga

SEQ ID NO: 8128507 - DNA, 22 bp, Homo sapiens
ccaggctggattttgcagttca

SEQ ID NO: 8128508 - DNA, 20 bp, Homo sapiens
ccaggctggcaaatgggggc

SEQ ID NO: 8128509 - DNA, 22 bp, Homo sapiens
ccaggctggagtgtagtcgcat

SEQ ID NO: 8128510 - DNA, 22 bp, Homo sapiens
ccaggctggagtgtagtcgcat

SEQ ID NO: 8128511 - DNA, 22 bp, Homo sapiens
ccaggctggattttgcagttca

SEQ ID NO: 8128512 - DNA, 22 bp, Homo sapiens
ccaggctggagtgcagtagtgt

SEQ ID NO: 8128513 - DNA, 22 bp, Homo sapiens
ccaggctggagtgcagtagtgt

SEQ ID NO: 8128514 - DNA, 22 bp, Homo sapiens
ccaggctggagtgcagtggcac

SEQ ID NO: 8128515 - DNA, 22 bp, Homo sapiens
ccaggctggagtgcagtggcac

SEQ ID NO: 8128516 - DNA, 22 bp, Homo sapiens
tgaatgcaagtcacacatttct

SEQ ID NO: 8128517 - DNA, 20 bp, Homo sapiens
tgacaactctgagaacgttc

SEQ ID NO: 8128518 - DNA, 22 bp, Homo sapiens
tgacaactttacaaaattcttc

SEQ ID NO: 8128519 - DNA, 22 bp, Homo sapiens
tgacaatgacatggacagtgat

SEQ ID NO: 8128520 - DNA, 22 bp, Homo sapiens
tgacaatagcgatttatcttgc

SEQ ID NO: 8128521 - DNA, 22 bp, Homo sapiens
tgagaaaaggttgagatgataa

SEQ ID NO: 8128522 - DNA, 22 bp, Homo sapiens
tgagaaaagtacatggagaagc

SEQ ID NO: 8128523 - DNA, 22 bp, Homo sapiens
ccaggggaaacagggagcactc

SEQ ID NO: 8128524 - DNA, 21 bp, Homo sapiens
ccaggggcaaattgtcgtttc

SEQ ID NO: 8128525 - DNA, 22 bp, Homo sapiens
tgacagttaaggtatacattca

SEQ ID NO: 8128526 - DNA, 22 bp, Homo sapiens
tgcacacattctatggggctga

SEQ ID NO: 8128527 - DNA, 22 bp, Homo sapiens
tgcaaatagcctatatttatag

SEQ ID NO: 8128528 - DNA, 23 bp, Homo sapiens
tgattttaaaaagtaagttatca

SEQ ID NO: 8128529 - DNA, 21 bp, Homo sapiens
ccattgagaccatggaggagt

SEQ ID NO: 8128530 - DNA, 20 bp, Homo sapiens
tgagggctaaccagactctg

SEQ ID NO: 8128531 - DNA, 22 bp, Homo sapiens
tgagggctccccgctgctgtgt

SEQ ID NO: 8128532 - DNA, 22 bp, Homo sapiens
tgagggctgcttccagagctag

SEQ ID NO: 8128533 - DNA, 22 bp, Homo sapiens
ccagtctcttccctcctgccag

SEQ ID NO: 8128534 - DNA, 22 bp, Homo sapiens
ccatggcctcgctctacgtggg

SEQ ID NO: 8128535 - DNA, 22 bp, Homo sapiens
ccaggacagggagacgggagcc

SEQ ID NO: 8128536 - DNA, 22 bp, Homo sapiens
ccaggaccacacgacaggagag

SEQ ID NO: 8128537 - DNA, 22 bp, Homo sapiens
tctgcttctgtgaaggcagtct

SEQ ID NO: 8128538 - DNA, 23 bp, Homo sapiens
tctgcttctgtattttttcccat

SEQ ID NO: 8128539 - DNA, 22 bp, Homo sapiens
tctgcttctcctacttcatggg

SEQ ID NO: 8128540 - DNA, 22 bp, Homo sapiens
ccagagagaaatggatttgagt

SEQ ID NO: 8128541 - DNA, 22 bp, Homo sapiens
ccagagagaaaatggagggcca

SEQ ID NO: 8128542 - DNA, 22 bp, Homo sapiens
ccagctgctatcatgccatttc

SEQ ID NO: 8128543 - DNA, 22 bp, Homo sapiens
ccagctgctgtgaggaccacag

SEQ ID NO: 8128544 - DNA, 22 bp, Homo sapiens
ccaggccattcccagagttgct

SEQ ID NO: 8128545 - DNA, 22 bp, Homo sapiens
ccaggccagggctgcagcgagc

SEQ ID NO: 8128546 - DNA, 22 bp, Homo sapiens
ccaggccaggagagcgaggttt

SEQ ID NO: 8128547 - DNA, 21 bp, Homo sapiens
ccaggccaggcctacggggat

SEQ ID NO: 8128548 - DNA, 18 bp, Homo sapiens
ccaggccatgaacctctg

SEQ ID NO: 8128549 - DNA, 19 bp, Homo sapiens
ccaggccatcccagttccc

SEQ ID NO: 8128550 - DNA, 22 bp, Homo sapiens
ccaggccagtgtttggtccagg

SEQ ID NO: 8128551 - DNA, 22 bp, Homo sapiens
ccaggcctggaccatgccaggg

SEQ ID NO: 8128552 - DNA, 22 bp, Homo sapiens
ccaggctgaatatgttccaggg

SEQ ID NO: 8128553 - DNA, 22 bp, Homo sapiens
ccaggctggagtgcaatggtgc

SEQ ID NO: 8128554 - DNA, 22 bp, Homo sapiens
ccaggctggagtgcaatggcgt

SEQ ID NO: 8128555 - DNA, 22 bp, Homo sapiens
ccaggctgctgttggtgtccgc

SEQ ID NO: 8128556 - DNA, 22 bp, Homo sapiens
ccaggctgagcatgattggagc

SEQ ID NO: 8128557 - DNA, 22 bp, Homo sapiens
ccaggctgaatatgttccaggg

SEQ ID NO: 8128558 - DNA, 22 bp, Homo sapiens
ccaggccagcctggagcatggc

SEQ ID NO: 8128559 - DNA, 22 bp, Homo sapiens
ccaggccagcgctggctggagg

SEQ ID NO: 8128560 - DNA, 22 bp, Homo sapiens
ccaggccagcaggcacacctgc

SEQ ID NO: 8128561 - DNA, 22 bp, Homo sapiens
ccaggccagagtgcagtggcac

SEQ ID NO: 8128562 - DNA, 22 bp, Homo sapiens
ccaggccagagtgcagtggcac

SEQ ID NO: 8128563 - DNA, 22 bp, Homo sapiens
tcttcagagatgtaacatatgg

SEQ ID NO: 8128564 - DNA, 22 bp, Homo sapiens
tcttcagacttccggaaacgtg

SEQ ID NO: 8128565 - DNA, 22 bp, Homo sapiens
tcttcagaggagctgaatatat

SEQ ID NO: 8128566 - DNA, 22 bp, Homo sapiens
tcttcagaaaattatcacttgt

SEQ ID NO: 8128567 - DNA, 22 bp, Homo sapiens
tcttcagaagatcacatcagtg

SEQ ID NO: 8128568 - DNA, 22 bp, Homo sapiens
tcttcagagtgagcagtgtcat

SEQ ID NO: 8128569 - DNA, 22 bp, Homo sapiens
tcttagaatgtcaactgatgtt

SEQ ID NO: 8128570 - DNA, 22 bp, Homo sapiens
tggctctgtcactgtgagctat

SEQ ID NO: 8128571 - DNA, 20 bp, Homo sapiens
cctctgccccggggctgcta

SEQ ID NO: 8128572 - DNA, 18 bp, Homo sapiens
cctctgccatagccagca

SEQ ID NO: 8128573 - DNA, 20 bp, Homo sapiens
cctctgcctttctagtctga

SEQ ID NO: 8128574 - DNA, 21 bp, Homo sapiens
cctctgctcgggcatgcgttt

SEQ ID NO: 8128575 - DNA, 19 bp, Homo sapiens
cctctgcgctgtcctgctc

SEQ ID NO: 8128576 - DNA, 22 bp, Homo sapiens
cctctgctgctgttgagcaccg

SEQ ID NO: 8128577 - DNA, 22 bp, Homo sapiens
tgggaaggacgtgtcagtggca

SEQ ID NO: 8128578 - DNA, 22 bp, Homo sapiens
cctcttcctcaccatctacaac

SEQ ID NO: 8128579 - DNA, 22 bp, Homo sapiens
tgggcccttatgaagctcaaga

SEQ ID NO: 8128580 - DNA, 22 bp, Homo sapiens
tgggccctggtggccatgcctc

SEQ ID NO: 8128581 - DNA, 18 bp, Homo sapiens
tgggctgcctggcctctg

SEQ ID NO: 8128582 - DNA, 22 bp, Homo sapiens
tgggctgcggataggcctcgga

SEQ ID NO: 8128583 - DNA, 22 bp, Homo sapiens
tgggctgctgtctgcacatgct

SEQ ID NO: 8128584 - DNA, 22 bp, Homo sapiens
tgggctgctgagaatgagagag

SEQ ID NO: 8128585 - DNA, 22 bp, Homo sapiens
tgggctgctgcggtgctcttgg

SEQ ID NO: 8128586 - DNA, 22 bp, Homo sapiens
tgggcccgcagctgctgctcca

SEQ ID NO: 8128587 - DNA, 23 bp, Homo sapiens
tgggccctggagtcgccagtctg

SEQ ID NO: 8128588 - DNA, 21 bp, Homo sapiens
tgggcccagttcccgctgggc

SEQ ID NO: 8128589 - DNA, 22 bp, Homo sapiens
tgggcccaagagagtctccaac

SEQ ID NO: 8128590 - DNA, 22 bp, Homo sapiens
tgggctgcttctcaaatgtctc

SEQ ID NO: 8128591 - DNA, 22 bp, Homo sapiens
tgggctgcttctattggtggtc

SEQ ID NO: 8128592 - DNA, 22 bp, Homo sapiens
tgggctgcttcctcagctgaga

SEQ ID NO: 8128593 - DNA, 22 bp, Homo sapiens
tgggctgctgttacaggggctg

SEQ ID NO: 8128594 - DNA, 22 bp, Homo sapiens
cctgagctccagtagcagccag

SEQ ID NO: 8128595 - DNA, 17 bp, Homo sapiens
cctcttcctctcagctg

SEQ ID NO: 8128596 - DNA, 17 bp, Homo sapiens
cctcttcctctcagctg

SEQ ID NO: 8128597 - DNA, 23 bp, Homo sapiens
tgggagtgttgggatctctgctc

SEQ ID NO: 8128598 - DNA, 22 bp, Homo sapiens
cctcaggcttcgtcttccaccc

SEQ ID NO: 8128599 - DNA, 22 bp, Homo sapiens
cctcagggaatgggaggctggg

SEQ ID NO: 8128600 - DNA, 22 bp, Homo sapiens
cctcaggctgggctgcccctgg

SEQ ID NO: 8128601 - DNA, 22 bp, Homo sapiens
cctcaggctagctactgtccct

SEQ ID NO: 8128602 - DNA, 22 bp, Homo sapiens
tggcccagagcactgctgggca

SEQ ID NO: 8128603 - DNA, 19 bp, Homo sapiens
tggcccagatggtcctggg

SEQ ID NO: 8128604 - DNA, 22 bp, Homo sapiens
tggctctggtgcgggctcctgc

SEQ ID NO: 8128605 - DNA, 22 bp, Homo sapiens
cctcatgctgcatctctgaggt

SEQ ID NO: 8128606 - DNA, 21 bp, Homo sapiens
cctcatcaaactttcacttgc

SEQ ID NO: 8128607 - DNA, 22 bp, Homo sapiens
cctcagttttctcatctgtaaa

SEQ ID NO: 8128608 - DNA, 22 bp, Homo sapiens
cctcagtgagtgtttccttctt

SEQ ID NO: 8128609 - DNA, 19 bp, Homo sapiens
tggcagaggacaaggactt

SEQ ID NO: 8128610 - DNA, 22 bp, Homo sapiens
cccagggtccctgctctctgtg

SEQ ID NO: 8128611 - DNA, 22 bp, Homo sapiens
cccagggttgcctgcctctgct

SEQ ID NO: 8128612 - DNA, 22 bp, Homo sapiens
tgcctgtgttgattactttgtc

SEQ ID NO: 8128613 - DNA, 22 bp, Homo sapiens
tgcctgttaagggtgtagatat

SEQ ID NO: 8128614 - DNA, 22 bp, Homo sapiens
tgcctgtgtggggtctgccgcc

SEQ ID NO: 8128615 - DNA, 22 bp, Homo sapiens
tgcctgtgtggtctgcgcatta

SEQ ID NO: 8128616 - DNA, 22 bp, Homo sapiens
tgcctgtgtgaccacgggcaag

SEQ ID NO: 8128617 - DNA, 22 bp, Homo sapiens
tgcccagcctaaacttggcaag

SEQ ID NO: 8128618 - DNA, 20 bp, Homo sapiens
tgccagtgtgtcaatttata

SEQ ID NO: 8128619 - DNA, 22 bp, Homo sapiens
tgccagtgtagtagctggttta

SEQ ID NO: 8128620 - DNA, 22 bp, Homo sapiens
tgccagtgggtgtgcagagact

SEQ ID NO: 8128621 - DNA, 22 bp, Homo sapiens
tgccagtgtctgctatctgaga

SEQ ID NO: 8128622 - DNA, 22 bp, Homo sapiens
tgccagtgtgagtggagttctt

SEQ ID NO: 8128623 - DNA, 22 bp, Homo sapiens
tgccagtgcttgtgtctgagca

SEQ ID NO: 8128624 - DNA, 22 bp, Homo sapiens
tgcacagagcaggcaccagcgg

SEQ ID NO: 8128625 - DNA, 22 bp, Homo sapiens
tgcacagagagatgagacacgt

SEQ ID NO: 8128626 - DNA, 22 bp, Homo sapiens
tgcacagacatacacatatatg

SEQ ID NO: 8128627 - DNA, 22 bp, Homo sapiens
tgctgtgttctcctgactcacc

SEQ ID NO: 8128628 - DNA, 22 bp, Homo sapiens
tgctgtgttcaccaatatgtgt

SEQ ID NO: 8128629 - DNA, 22 bp, Homo sapiens
tgctgtgtaaaaggtgattgaa

SEQ ID NO: 8128630 - DNA, 22 bp, Homo sapiens
tggaatgtgttctattttacag

SEQ ID NO: 8128631 - DNA, 22 bp, Homo sapiens
tggaatgtcagctacaagaggg

SEQ ID NO: 8128632 - DNA, 22 bp, Homo sapiens
tggaatgtgaacatacaaggta

SEQ ID NO: 8128633 - DNA, 22 bp, Homo sapiens
ccctgacccaaaactgtcagaa

SEQ ID NO: 8128634 - DNA, 22 bp, Homo sapiens
ccctgaccatcccgcactgact

SEQ ID NO: 8128635 - DNA, 22 bp, Homo sapiens
tggagcaggacggggagtggta

SEQ ID NO: 8128636 - DNA, 22 bp, Homo sapiens
tgctggagcccaggcggccttt

SEQ ID NO: 8128637 - DNA, 22 bp, Homo sapiens
ccccacagtccgtgaggagcca

SEQ ID NO: 8128638 - DNA, 22 bp, Homo sapiens
ccccacagccgccagcagggag

SEQ ID NO: 8128639 - DNA, 22 bp, Homo sapiens
ccccacagcttgtggagagaat

SEQ ID NO: 8128640 - DNA, 22 bp, Homo sapiens
cccgagcgggccctggggtgac

SEQ ID NO: 8128641 - DNA, 22 bp, Homo sapiens
tgtggactggcgggacgcaatg

SEQ ID NO: 8128642 - DNA, 22 bp, Homo sapiens
tgtggactgaaagaaccggcag

SEQ ID NO: 8128643 - DNA, 22 bp, Homo sapiens
tgtggactctgagatccggaga

SEQ ID NO: 8128644 - DNA, 22 bp, Homo sapiens
tgtggactctggagtcagacag

SEQ ID NO: 8128645 - DNA, 22 bp, Homo sapiens
tgtggactgtgctgccacagtg

SEQ ID NO: 8128646 - DNA, 21 bp, Homo sapiens
tgtggcagatgttgggaggca

SEQ ID NO: 8128647 - DNA, 22 bp, Homo sapiens
tgtggcagaggaggcagcgtcc

SEQ ID NO: 8128648 - DNA, 18 bp, Homo sapiens
tgtggcaggggtgggaga

SEQ ID NO: 8128649 - DNA, 22 bp, Homo sapiens
tgtggcagtaaaattgggcaac

SEQ ID NO: 8128650 - DNA, 22 bp, Homo sapiens
tgtggtatcaccatccactagt

SEQ ID NO: 8128651 - DNA, 19 bp, Homo sapiens
tgtgtgcaaatggaagcca

SEQ ID NO: 8128652 - DNA, 22 bp, Homo sapiens
tgtttgaaactttgatcactaa

SEQ ID NO: 8128653 - DNA, 22 bp, Homo sapiens
tgtttgaaagcacctacatttt

SEQ ID NO: 8128654 - DNA, 22 bp, Homo sapiens
tgtttgcaaccccttgtgagaa

SEQ ID NO: 8128655 - DNA, 22 bp, Homo sapiens
tgttctaagtgttttgttcatg

SEQ ID NO: 8128656 - DNA, 22 bp, Homo sapiens
tgtttaataattctatgatagt

SEQ ID NO: 8128657 - DNA, 22 bp, Homo sapiens
tgtgttatctatctcgatgctt

SEQ ID NO: 8128658 - DNA, 22 bp, Homo sapiens
tgtgtgcagacagatattactt

SEQ ID NO: 8128659 - DNA, 22 bp, Homo sapiens
tgtgtgcatacacacggtaaca

SEQ ID NO: 8128660 - DNA, 22 bp, Homo sapiens
tgtgtgcaggcactgtgccaga

SEQ ID NO: 8128661 - DNA, 20 bp, Homo sapiens
tgtgtgcatctgtatgtatt

SEQ ID NO: 8128662 - DNA, 22 bp, Homo sapiens
tgtgtgcagcggcaggtgaagt

SEQ ID NO: 8128663 - DNA, 22 bp, Homo sapiens
tgtgtgcacttaatgcaatcat

SEQ ID NO: 8128664 - DNA, 22 bp, Homo sapiens
tgtgtgcagacagatattactt

SEQ ID NO: 8128665 - DNA, 22 bp, Homo sapiens
tgtgtgcacatgatttgaaatg

SEQ ID NO: 8128666 - DNA, 22 bp, Homo sapiens
tgtgttgttttaagctgctgca

SEQ ID NO: 8128667 - DNA, 21 bp, Homo sapiens
tgtgtttgagactatgtttcc

SEQ ID NO: 8128668 - DNA, 22 bp, Homo sapiens
tgttcaaatcttttgcttattt

SEQ ID NO: 8128669 - DNA, 22 bp, Homo sapiens
tgttcaaatcttttgcttattt

SEQ ID NO: 8128670 - DNA, 22 bp, Homo sapiens
tgttcaaatgatcttcttaaat

SEQ ID NO: 8128671 - DNA, 22 bp, Homo sapiens
tgttaaaaatgcagattcctat

SEQ ID NO: 8128672 - DNA, 21 bp, Homo sapiens
tgttatgtgcttcaagaagtg

SEQ ID NO: 8128673 - DNA, 22 bp, Homo sapiens
ttacttgatttgaaaatcatag

SEQ ID NO: 8128674 - DNA, 20 bp, Homo sapiens
ttagaagggccagatgaagg

SEQ ID NO: 8128675 - DNA, 22 bp, Homo sapiens
ttagagagaaccatcaggatct

SEQ ID NO: 8128676 - DNA, 22 bp, Homo sapiens
ttacatattgtctattgttcaa

SEQ ID NO: 8128677 - DNA, 22 bp, Homo sapiens
ttacatcattgagacatacata

SEQ ID NO: 8128678 - DNA, 22 bp, Homo sapiens
ttaattttctcatctgtgaaat

SEQ ID NO: 8128679 - DNA, 22 bp, Homo sapiens
ttaatttttatgtatagtgtgt

SEQ ID NO: 8128680 - DNA, 22 bp, Homo sapiens
ttacactaagctacttctatat

SEQ ID NO: 8128681 - DNA, 22 bp, Homo sapiens
ttaaatgatgcatatcatttag

SEQ ID NO: 8128682 - DNA, 22 bp, Homo sapiens
ttaaatgatgcatatcatttag

SEQ ID NO: 8128683 - DNA, 22 bp, Homo sapiens
ttaaatggggatgagtagatgg

SEQ ID NO: 8128684 - DNA, 22 bp, Homo sapiens
ttaaatctgttctcatgtctgt

SEQ ID NO: 8128685 - DNA, 22 bp, Homo sapiens
ttaaatgaacgagatatgcaac

SEQ ID NO: 8128686 - DNA, 22 bp, Homo sapiens
ttaaatgtttaatctaacttga

SEQ ID NO: 8128687 - DNA, 22 bp, Homo sapiens
ttaaagcatcctgtcagtctgt

SEQ ID NO: 8128688 - DNA, 17 bp, Homo sapiens
tgttttctgctaccttt

SEQ ID NO: 8128689 - DNA, 22 bp, Homo sapiens
tgttttctgattctcgtgtggt

SEQ ID NO: 8128690 - DNA, 22 bp, Homo sapiens
tgttttgttcactgcattgtcc

SEQ ID NO: 8128691 - DNA, 22 bp, Homo sapiens
tgttttgtctaatctaaattct

SEQ ID NO: 8128692 - DNA, 22 bp, Homo sapiens
tgttttgtgcacttctatagca

SEQ ID NO: 8128693 - DNA, 22 bp, Homo sapiens
tgttttgtagctaatagctatt

SEQ ID NO: 8128694 - DNA, 22 bp, Homo sapiens
ttaattctgcctttcatgtaac

SEQ ID NO: 8128695 - DNA, 22 bp, Homo sapiens
ttaagttttaaagctagagtct

SEQ ID NO: 8128696 - DNA, 22 bp, Homo sapiens
ttaagtaagaccttatgtcttg

SEQ ID NO: 8128697 - DNA, 22 bp, Homo sapiens
ttaagtcacttatctaaagaca

SEQ ID NO: 8128698 - DNA, 22 bp, Homo sapiens
ttaagtcacttatctaaagaca

SEQ ID NO: 8128699 - DNA, 22 bp, Homo sapiens
ttaaggcaactgggtccaagat

SEQ ID NO: 8128700 - DNA, 22 bp, Homo sapiens
ttaacacttgaactctacatgt

SEQ ID NO: 8128701 - DNA, 22 bp, Homo sapiens
ttaacttgtcagaaaatacagt

SEQ ID NO: 8128702 - DNA, 22 bp, Homo sapiens
ttgattaaaatgagacatcatt

SEQ ID NO: 8128703 - DNA, 22 bp, Homo sapiens
ttgattctacttaaaacatatg

SEQ ID NO: 8128704 - DNA, 22 bp, Homo sapiens
ttgattttaaaatagtgacact

SEQ ID NO: 8128705 - DNA, 22 bp, Homo sapiens
ttgaagagcaccagcattttga

SEQ ID NO: 8128706 - DNA, 22 bp, Homo sapiens
ttgaagagacgatttttccacc

SEQ ID NO: 8128707 - DNA, 23 bp, Homo sapiens
ttgagcatttgtggatactgaaa

SEQ ID NO: 8128708 - DNA, 22 bp, Homo sapiens
ttgagcatttgttttgaaagag

SEQ ID NO: 8128709 - DNA, 21 bp, Homo sapiens
ttgagcatgtactttgtgctt

SEQ ID NO: 8128710 - DNA, 21 bp, Homo sapiens
ttgagcatgtaccctttgcct

SEQ ID NO: 8128711 - DNA, 22 bp, Homo sapiens
ttgagcatgtaactacacaggg

SEQ ID NO: 8128712 - DNA, 22 bp, Homo sapiens
ttgagcatcaattaagtgagtt

SEQ ID NO: 8128713 - DNA, 22 bp, Homo sapiens
ttgagcatcttatagaaagagc

SEQ ID NO: 8128714 - DNA, 22 bp, Homo sapiens
ttgagcatctgaggattttcct

SEQ ID NO: 8128715 - DNA, 22 bp, Homo sapiens
ttgagcatatgcatttccaatt

SEQ ID NO: 8128716 - DNA, 18 bp, Homo sapiens
ttctgcggtgacagatat

SEQ ID NO: 8128717 - DNA, 20 bp, Homo sapiens
ttctgcttgcaaatatcaag

SEQ ID NO: 8128718 - DNA, 22 bp, Homo sapiens
ttctgcttttctctgtctgagt

SEQ ID NO: 8128719 - DNA, 22 bp, Homo sapiens
ttctgctttcagttcttctggg

SEQ ID NO: 8128720 - DNA, 22 bp, Homo sapiens
ttctgctttggttccatggatg

SEQ ID NO: 8128721 - DNA, 22 bp, Homo sapiens
ttctgaatttctgtgtatctta

SEQ ID NO: 8128722 - DNA, 22 bp, Homo sapiens
ttctgagaaggctgtggacaca

SEQ ID NO: 8128723 - DNA, 20 bp, Homo sapiens
ttctatacatatcactgaaa

SEQ ID NO: 8128724 - DNA, 22 bp, Homo sapiens
ttctagttactcttaaatgctg

SEQ ID NO: 8128725 - DNA, 21 bp, Homo sapiens
ttctgggttgttaatctgaac

SEQ ID NO: 8128726 - DNA, 18 bp, Homo sapiens
ttctgggtgttatgttta

SEQ ID NO: 8128727 - DNA, 22 bp, Homo sapiens
ttctgggtggccagtatttaga

SEQ ID NO: 8128728 - DNA, 22 bp, Homo sapiens
ttcttgaatagggattgataaa

SEQ ID NO: 8128729 - DNA, 22 bp, Homo sapiens
ttcttgaaaatagccatgtaca

SEQ ID NO: 8128730 - DNA, 22 bp, Homo sapiens
ttcaggagctggctgcgaagga

SEQ ID NO: 8128731 - DNA, 22 bp, Homo sapiens
ttcaggagctagggatgtgaaa

SEQ ID NO: 8128732 - DNA, 22 bp, Homo sapiens
ttcacattccgcggctattttc

SEQ ID NO: 8128733 - DNA, 22 bp, Homo sapiens
ttcacagtggctaagttctgca

SEQ ID NO: 8128734 - DNA, 21 bp, Homo sapiens
ttcacagtggataactttctg

SEQ ID NO: 8128735 - DNA, 22 bp, Homo sapiens
ttcacagtgctgcacctggctt

SEQ ID NO: 8128736 - DNA, 22 bp, Homo sapiens
ttcacagtggccctctctgagt

SEQ ID NO: 8128737 - DNA, 22 bp, Homo sapiens
ttcacagtggctgacaggctgg

SEQ ID NO: 8128738 - DNA, 22 bp, Homo sapiens
ttcacagtggctgtgccatttg

SEQ ID NO: 8128739 - DNA, 20 bp, Homo sapiens
ttcatgggagcaaagaggcc

SEQ ID NO: 8128740 - DNA, 22 bp, Homo sapiens
ttcatcatcagaactgttcact

SEQ ID NO: 8128741 - DNA, 22 bp, Homo sapiens
ttcatggagttgagaaggctaa

SEQ ID NO: 8128742 - DNA, 18 bp, Homo sapiens
ttcatcatgactctgtgg

SEQ ID NO: 8128743 - DNA, 22 bp, Homo sapiens
ttcacagtaatgtgcccaggta

SEQ ID NO: 8128744 - DNA, 22 bp, Homo sapiens
ttcacagtaagtaggatagttg

SEQ ID NO: 8128745 - DNA, 22 bp, Homo sapiens
ttcacagtaacagggggatatg

SEQ ID NO: 8128746 - DNA, 22 bp, Homo sapiens
ttcacagtataggtttccagcg

SEQ ID NO: 8128747 - DNA, 22 bp, Homo sapiens
ttcacagtcacccttctccatg

SEQ ID NO: 8128748 - DNA, 22 bp, Homo sapiens
ttcacagtgagctatgtcttgt

SEQ ID NO: 8128749 - DNA, 22 bp, Homo sapiens
ttcacagtctatcttggttttt

SEQ ID NO: 8128750 - DNA, 22 bp, Homo sapiens
ttcacagtgccagggggcaggc

SEQ ID NO: 8128751 - DNA, 22 bp, Homo sapiens
ttcacagtgctcacagttcagt

SEQ ID NO: 8128752 - DNA, 22 bp, Homo sapiens
ttcacaatagctggcatcatct

SEQ ID NO: 8128753 - DNA, 22 bp, Homo sapiens
ttcaacaattaagtatcagcct

SEQ ID NO: 8128754 - DNA, 22 bp, Homo sapiens
ttagagttgagtttctatgaga

SEQ ID NO: 8128755 - DNA, 22 bp, Homo sapiens
ttcaacaagtcttttttcactg

SEQ ID NO: 8128756 - DNA, 21 bp, Homo sapiens
ttcaacaaagggaataagttt

SEQ ID NO: 8128757 - DNA, 22 bp, Homo sapiens
ttctagaaccatgacttcaggg

SEQ ID NO: 8128758 - DNA, 22 bp, Homo sapiens
ttctacaatatgaataatgaag

SEQ ID NO: 8128759 - DNA, 22 bp, Homo sapiens
ttctagaaactggagcaaacag

SEQ ID NO: 8128760 - DNA, 22 bp, Homo sapiens
ttctagaaacacatgcaaacag

SEQ ID NO: 8128761 - DNA, 22 bp, Homo sapiens
ttctaatacacggtatgacttt

SEQ ID NO: 8128762 - DNA, 22 bp, Homo sapiens
ttctaatagctgcctatgtatt

SEQ ID NO: 8128763 - DNA, 22 bp, Homo sapiens
ttccttctattcagctccaaga

SEQ ID NO: 8128764 - DNA, 22 bp, Homo sapiens
ttcctgaatataaagacactag

SEQ ID NO: 8128765 - DNA, 20 bp, Homo sapiens
ttccagagatctgcatttta

SEQ ID NO: 8128766 - DNA, 20 bp, Homo sapiens
ttccacatctttgcacatgc

SEQ ID NO: 8128767 - DNA, 22 bp, Homo sapiens
ttccacacttaaggaatatgat

SEQ ID NO: 8128768 - DNA, 22 bp, Homo sapiens
ttccacactttcacacgaggtc

SEQ ID NO: 8128769 - DNA, 22 bp, Homo sapiens
tttatttgtcttgccatttagt

SEQ ID NO: 8128770 - DNA, 22 bp, Homo sapiens
tttcaaacatagatctgaatat

SEQ ID NO: 8128771 - DNA, 22 bp, Homo sapiens
tttatataacagagactgctat

SEQ ID NO: 8128772 - DNA, 23 bp, Homo sapiens
tttatagcagcatgatttatagt

SEQ ID NO: 8128773 - DNA, 23 bp, Homo sapiens
tttatagcagcatgatttataat

SEQ ID NO: 8128774 - DNA, 22 bp, Homo sapiens
tttatagtcgtctcagtaataa

SEQ ID NO: 8128775 - DNA, 22 bp, Homo sapiens
tttatagatgtctgtattataa

SEQ ID NO: 8128776 - DNA, 22 bp, Homo sapiens
tttatacttcataatgtctatt

SEQ ID NO: 8128777 - DNA, 22 bp, Homo sapiens
tttagtttgatgttctactcct

SEQ ID NO: 8128778 - DNA, 22 bp, Homo sapiens
tttacgtgaaggtgttatgtgt

SEQ ID NO: 8128779 - DNA, 22 bp, Homo sapiens
tttacaaggcagaactgattaa

SEQ ID NO: 8128780 - DNA, 22 bp, Homo sapiens
ttgttttagtaggtacactgag

SEQ ID NO: 8128781 - DNA, 17 bp, Homo sapiens
ttgtttgttcttgcccc

SEQ ID NO: 8128782 - DNA, 22 bp, Homo sapiens
ttgtttgtgctatttaatgtag

SEQ ID NO: 8128783 - DNA, 22 bp, Homo sapiens
ttgttttattctgcaatttccc

SEQ ID NO: 8128784 - DNA, 22 bp, Homo sapiens
ttgttaaaaatagatttccagg

SEQ ID NO: 8128785 - DNA, 22 bp, Homo sapiens
ttgtttcattttggctaaactg

SEQ ID NO: 8128786 - DNA, 20 bp, Homo sapiens
ttgtttaaaggtgaagaggc

SEQ ID NO: 8128787 - DNA, 22 bp, Homo sapiens
ttgtttaaagaacttctgactt

SEQ ID NO: 8128788 - DNA, 22 bp, Homo sapiens
ttgtgtgtgagccttcaccaca

SEQ ID NO: 8128789 - DNA, 22 bp, Homo sapiens
ttgtgtgtcttcttcactgccc

SEQ ID NO: 8128790 - DNA, 19 bp, Homo sapiens
ttgtgtgtcagtcagagtt

SEQ ID NO: 8128791 - DNA, 19 bp, Homo sapiens
ttgtgactggctctgcata

SEQ ID NO: 8128792 - DNA, 22 bp, Homo sapiens
ttgtgttgcatcttattcttct

SEQ ID NO: 8128793 - DNA, 22 bp, Homo sapiens
ttgtgtgtgtaactttatgaga

SEQ ID NO: 8128794 - DNA, 22 bp, Homo sapiens
ttgtgtgtttgtagaaaatcca

SEQ ID NO: 8128795 - DNA, 22 bp, Homo sapiens
ttgcaagaaataatcgaataga

SEQ ID NO: 8128796 - DNA, 22 bp, Homo sapiens
ttggtgaattgagaccatttgt

SEQ ID NO: 8128797 - DNA, 22 bp, Homo sapiens
ttgtctaatgagctccacttca

SEQ ID NO: 8128798 - DNA, 22 bp, Homo sapiens
ttgtctaaggaggtagaggact

SEQ ID NO: 8128799 - DNA, 22 bp, Homo sapiens
ttggttcagtaggcatgcctgg

SEQ ID NO: 8128800 - DNA, 22 bp, Homo sapiens
tttcaaagagttgtaaattact

SEQ ID NO: 8128801 - DNA, 22 bp, Homo sapiens
tttcaaagacagccatatttgt

SEQ ID NO: 8128802 - DNA, 22 bp, Homo sapiens
tttcaaactttactcttgaatc

SEQ ID NO: 8128803 - DNA, 22 bp, Homo sapiens
tttcaaagaccattaactatca

SEQ ID NO: 8128804 - DNA, 22 bp, Homo sapiens
tttcagagttggggaaaagcag

SEQ ID NO: 8128805 - DNA, 22 bp, Homo sapiens
tttcagggaagtgttgaaaagg

SEQ ID NO: 8128806 - DNA, 22 bp, Homo sapiens
tttcagtcttattttgttgata

SEQ ID NO: 8128807 - DNA, 22 bp, Homo sapiens
tttcattgtcatctatcttaga

SEQ ID NO: 8128808 - DNA, 22 bp, Homo sapiens
tttcattttggttatgccataa

SEQ ID NO: 8128809 - DNA, 22 bp, Homo sapiens
tttcctcttcttcccatgtcat

SEQ ID NO: 8128810 - DNA, 22 bp, Homo sapiens
tttcctcttcgattaagtttgg

SEQ ID NO: 8128811 - DNA, 22 bp, Homo sapiens
tttcctcttccgagggggaggc

SEQ ID NO: 8128812 - DNA, 22 bp, Homo sapiens
tttcctctgggccctgccaccc

SEQ ID NO: 8128813 - DNA, 22 bp, Homo sapiens
tttcctctgtcatgacagctga

SEQ ID NO: 8128814 - DNA, 22 bp, Homo sapiens
tttcctcttatacagtgtttat

SEQ ID NO: 8128815 - DNA, 22 bp, Homo sapiens
tttcctctttgtaccttgacta

SEQ ID NO: 8128816 - DNA, 22 bp, Homo sapiens
tttctactcatcctttggagaa

SEQ ID NO: 8128817 - DNA, 22 bp, Homo sapiens
tttctcatagtcatgcctctta

SEQ ID NO: 8128818 - DNA, 22 bp, Homo sapiens
tttctcatggacccttcatgat

SEQ ID NO: 8128819 - DNA, 22 bp, Homo sapiens
tttctcagggaggagtcaagcc

SEQ ID NO: 8128820 - DNA, 21 bp, Homo sapiens
tttctcataaaatactcatta

SEQ ID NO: 8128821 - DNA, 22 bp, Homo sapiens
tttctagacatttctatgtaca

SEQ ID NO: 8128822 - DNA, 22 bp, Homo sapiens
tttctgcatcttgaaacagagc

SEQ ID NO: 8128823 - DNA, 22 bp, Homo sapiens
tttctgcatttacaaaatgagg

SEQ ID NO: 8128824 - DNA, 23 bp, Homo sapiens
tttctgaagttgagatggacttt

SEQ ID NO: 8128825 - DNA, 22 bp, Homo sapiens
tttctgaattcctaggatgttg

SEQ ID NO: 8128826 - DNA, 22 bp, Homo sapiens
tttctgtaattaaaagggcagg

SEQ ID NO: 8128827 - DNA, 22 bp, Homo sapiens
tttctccttgtgtctcctttga

SEQ ID NO: 8128828 - DNA, 22 bp, Homo sapiens
tttctgaaaactgaagtagtgc

SEQ ID NO: 8128829 - DNA, 22 bp, Homo sapiens
tttctgaaaactgaagtagtgc

SEQ ID NO: 8128830 - DNA, 21 bp, Homo sapiens
tttctgaaggcaacatctatc

SEQ ID NO: 8128831 - DNA, 22 bp, Homo sapiens
tttctgaagggcagcagactct

SEQ ID NO: 8128832 - DNA, 22 bp, Homo sapiens
tttctgaagatacagctttgct

SEQ ID NO: 8128833 - DNA, 22 bp, Homo sapiens
tttcttccccaagtgaatttta

SEQ ID NO: 8128834 - DNA, 22 bp, Homo sapiens
tttcttgtttcatggtgtctca

SEQ ID NO: 8128835 - DNA, 22 bp, Homo sapiens
tttcttgtctttagtatctggc

SEQ ID NO: 8128836 - DNA, 22 bp, Homo sapiens
tttcttcctggattcctacttc

SEQ ID NO: 8128837 - DNA, 22 bp, Homo sapiens
ttttctttaatctggtggggtg

SEQ ID NO: 8128838 - DNA, 22 bp, Homo sapiens
ttttctaacatctagtaatttg

SEQ ID NO: 8128839 - DNA, 22 bp, Homo sapiens
ttttgaagaagatgggaattta

SEQ ID NO: 8128840 - DNA, 22 bp, Homo sapiens
ttttttgtcttgaagaaatggt

SEQ ID NO: 8128841 - DNA, 22 bp, Homo sapiens
tttttgctgataagcagaattc

SEQ ID NO: 8128842 - DNA, 22 bp, Homo sapiens
tttttgctaatccccagccact

SEQ ID NO: 8128843 - DNA, 22 bp, Homo sapiens
tttttgctccacaactttgaag

SEQ ID NO: 8128844 - DNA, 23 bp, Homo sapiens
ttttttgtcttgctaggctgccc

SEQ ID NO: 8128845 - DNA, 22 bp, Homo sapiens
tttgttgttagagtatgtgaaa

SEQ ID NO: 8128846 - DNA, 22 bp, Homo sapiens
tttgttgtgataatggtctgca

SEQ ID NO: 8128847 - DNA, 22 bp, Homo sapiens
tttgttgtcatcagtgatgagt

SEQ ID NO: 8128848 - DNA, 22 bp, Homo sapiens
tttgttctgaagcaagtaggga

SEQ ID NO: 8128849 - DNA, 22 bp, Homo sapiens
ttttatcagcagggataacaag

SEQ ID NO: 8128850 - DNA, 22 bp, Homo sapiens
ttttagtttggatttctaaagc

SEQ ID NO: 8128851 - DNA, 22 bp, Homo sapiens
ttttataaagagagtcagttgg

SEQ ID NO: 8128852 - DNA, 22 bp, Homo sapiens
ttttatagctgaatagtattcc

SEQ ID NO: 8128853 - DNA, 22 bp, Homo sapiens
tttgttttgaactagctcagaa

SEQ ID NO: 8128854 - DNA, 22 bp, Homo sapiens
tttgtttctgcaatacctatag

SEQ ID NO: 8128855 - DNA, 22 bp, Homo sapiens
tttgtttagatggtaaatcagt

SEQ ID NO: 8128856 - DNA, 22 bp, Homo sapiens
tttggactgcatgatgatctgg

SEQ ID NO: 8128857 - DNA, 22 bp, Homo sapiens
tttggactcaatggtttgctgc

SEQ ID NO: 8128858 - DNA, 22 bp, Homo sapiens
tttggactatctgtgtggcttt

SEQ ID NO: 8128859 - DNA, 22 bp, Homo sapiens
tttggactactgggaccttgtg

SEQ ID NO: 8128860 - DNA, 22 bp, Homo sapiens
tttggaagggaaagaaagtact

SEQ ID NO: 8128861 - DNA, 22 bp, Homo sapiens
tttggaacccagcccatcggaa

SEQ ID NO: 8128862 - DNA, 23 bp, Homo sapiens
tttggacttgtgactcttctcct

SEQ ID NO: 8128863 - DNA, 20 bp, Homo sapiens
tttggagagaaagaagtagt

SEQ ID NO: 8128864 - DNA, 22 bp, Homo sapiens
tttggagatggagagagggcat

SEQ ID NO: 8128865 - DNA, 22 bp, Homo sapiens
tttggcacttggcagttgagtt

SEQ ID NO: 8128866 - DNA, 22 bp, Homo sapiens
tttggcaccaaaggagaagatc

SEQ ID NO: 8128867 - DNA, 22 bp, Homo sapiens
tttgcagaagaaaacatgaaca

SEQ ID NO: 8128868 - DNA, 22 bp, Homo sapiens
tttgcacagatgggatacagca

SEQ ID NO: 8128869 - DNA, 22 bp, Homo sapiens
cactattttctcttcagatggc

SEQ ID NO: 8128870 - DNA, 22 bp, Homo sapiens
cactcagaggtttgattgctca

SEQ ID NO: 8128871 - DNA, 21 bp, Homo sapiens
cactatttatatatgccagct

SEQ ID NO: 8128872 - DNA, 22 bp, Homo sapiens
cactatttcctggattttgacg

SEQ ID NO: 8128873 - DNA, 22 bp, Homo sapiens
ggccaggctgccctgggagcag

SEQ ID NO: 8128874 - DNA, 22 bp, Homo sapiens
ggccaggctggtctcagacttc

SEQ ID NO: 8128875 - DNA, 22 bp, Homo sapiens
cacctgcctgctagagcctgac

SEQ ID NO: 8128876 - DNA, 22 bp, Homo sapiens
caccaggctgaaccagagggga

SEQ ID NO: 8128877 - DNA, 22 bp, Homo sapiens
cactgggagagctggacttggg

SEQ ID NO: 8128878 - DNA, 22 bp, Homo sapiens
cactgcactccagcctgggtga

SEQ ID NO: 8128879 - DNA, 22 bp, Homo sapiens
cactgcactccagcctgggaga

SEQ ID NO: 8128880 - DNA, 22 bp, Homo sapiens
cactgcactccagcctgggtca

SEQ ID NO: 8128881 - DNA, 22 bp, Homo sapiens
ggctctgctggtaagatgcctc

SEQ ID NO: 8128882 - DNA, 22 bp, Homo sapiens
ggctctgctggattgaggccag

SEQ ID NO: 8128883 - DNA, 22 bp, Homo sapiens
ggctctgcttcagaaggctcat

SEQ ID NO: 8128884 - DNA, 22 bp, Homo sapiens
ggctctgcttcctggaattgtg

SEQ ID NO: 8128885 - DNA, 22 bp, Homo sapiens
ggctctgcttgaggccagcctg

SEQ ID NO: 8128886 - DNA, 22 bp, Homo sapiens
cactgggatttggggtgtctta

SEQ ID NO: 8128887 - DNA, 22 bp, Homo sapiens
cactgtggagcaaatttattta

SEQ ID NO: 8128888 - DNA, 20 bp, Homo sapiens
ggctctgcttgtgagcagcc

SEQ ID NO: 8128889 - DNA, 17 bp, Homo sapiens
ggctgctgtgctggtgc

SEQ ID NO: 8128890 - DNA, 22 bp, Homo sapiens
cacatgcaggagccaatgtaca

SEQ ID NO: 8128891 - DNA, 22 bp, Homo sapiens
ggcagagtggagtgcggcctcc

SEQ ID NO: 8128892 - DNA, 22 bp, Homo sapiens
ggcagagtgctctgggcagggg

SEQ ID NO: 8128893 - DNA, 22 bp, Homo sapiens
ggagagcctccacggcttctgt

SEQ ID NO: 8128894 - DNA, 22 bp, Homo sapiens
cacaggaggttaggaagtggtc

SEQ ID NO: 8128895 - DNA, 22 bp, Homo sapiens
cacagtgcaatcggccacaaat

SEQ ID NO: 8128896 - DNA, 22 bp, Homo sapiens
cacagtgcactaagctccgggg

SEQ ID NO: 8128897 - DNA, 19 bp, Homo sapiens
cacagtgcagccatttctc

SEQ ID NO: 8128898 - DNA, 22 bp, Homo sapiens
ggagagaggagcccactgctgt

SEQ ID NO: 8128899 - DNA, 21 bp, Homo sapiens
cacacagtgatctatccacat

SEQ ID NO: 8128900 - DNA, 22 bp, Homo sapiens
ggacatggagctccatggaggc

SEQ ID NO: 8128901 - DNA, 17 bp, Homo sapiens
cacaactgaaaccacta

SEQ ID NO: 8128902 - DNA, 22 bp, Homo sapiens
cacaactgccagccaggaaagg

SEQ ID NO: 8128903 - DNA, 22 bp, Homo sapiens
ggaagctgaatccagagacagg

SEQ ID NO: 8128904 - DNA, 22 bp, Homo sapiens
caatatataggaacaacttagg

SEQ ID NO: 8128905 - DNA, 22 bp, Homo sapiens
caatatataggaacaacttagg

SEQ ID NO: 8128906 - DNA, 22 bp, Homo sapiens
caatagaaaactcaatacttaa

SEQ ID NO: 8128907 - DNA, 22 bp, Homo sapiens
caatagaaggcacagataggta

SEQ ID NO: 8128908 - DNA, 22 bp, Homo sapiens
caatactgcatctttgcccttt

SEQ ID NO: 8128909 - DNA, 22 bp, Homo sapiens
caatactgggcaggagagtaca

SEQ ID NO: 8128910 - DNA, 22 bp, Homo sapiens
caattctgaggcctgctttgtt

SEQ ID NO: 8128911 - DNA, 22 bp, Homo sapiens
caatcactgggatattggtgtg

SEQ ID NO: 8128912 - DNA, 22 bp, Homo sapiens
caatcactgacctgcagatgca

SEQ ID NO: 8128913 - DNA, 22 bp, Homo sapiens
caatgttttgttgaatgaatag

SEQ ID NO: 8128914 - DNA, 22 bp, Homo sapiens
caatgttttcaactgacaagta

SEQ ID NO: 8128915 - DNA, 22 bp, Homo sapiens
caagaataaaatacatgttgat

SEQ ID NO: 8128916 - DNA, 22 bp, Homo sapiens
gctggggagcaagagtagtgag

SEQ ID NO: 8128917 - DNA, 22 bp, Homo sapiens
gctgccctgtccggctctcctg

SEQ ID NO: 8128918 - DNA, 22 bp, Homo sapiens
caaattttgtgtgttctctagt

SEQ ID NO: 8128919 - DNA, 22 bp, Homo sapiens
caactactggtgctcaggaaat

SEQ ID NO: 8128920 - DNA, 22 bp, Homo sapiens
gctgcctgcacagagctgcttt

SEQ ID NO: 8128921 - DNA, 22 bp, Homo sapiens
caagaaactttattctgccata

SEQ ID NO: 8128922 - DNA, 22 bp, Homo sapiens
gctctggaacctgccaggatgc

SEQ ID NO: 8128923 - DNA, 23 bp, Homo sapiens
gctctggagctgggcctggcagg

SEQ ID NO: 8128924 - DNA, 18 bp, Homo sapiens
gctgccctagctcccctc

SEQ ID NO: 8128925 - DNA, 22 bp, Homo sapiens
gctgccctccagttcccacagt

SEQ ID NO: 8128926 - DNA, 22 bp, Homo sapiens
gctgccctctctggccccacac

SEQ ID NO: 8128927 - DNA, 22 bp, Homo sapiens
gctgccctcccagggcaagctt

SEQ ID NO: 8128928 - DNA, 22 bp, Homo sapiens
gctgccctctgtgacccggccc

SEQ ID NO: 8128929 - DNA, 22 bp, Homo sapiens
gctgccctgactccagcagcct

SEQ ID NO: 8128930 - DNA, 22 bp, Homo sapiens
gggtaaatctcttttcatggct

SEQ ID NO: 8128931 - DNA, 22 bp, Homo sapiens
ggggcgactgtatcttggggca

SEQ ID NO: 8128932 - DNA, 22 bp, Homo sapiens
ggggcctgtagagcttcaggga

SEQ ID NO: 8128933 - DNA, 23 bp, Homo sapiens
ggggcctgcaccggtctgcgcgg

SEQ ID NO: 8128934 - DNA, 22 bp, Homo sapiens
ggggcagcctccaggaaagctg

SEQ ID NO: 8128935 - DNA, 22 bp, Homo sapiens
ggggcagatggaacagagcaca

SEQ ID NO: 8128936 - DNA, 22 bp, Homo sapiens
ggggcagagtctggactgttgt

SEQ ID NO: 8128937 - DNA, 22 bp, Homo sapiens
ggggcagagcatagctccaatt

SEQ ID NO: 8128938 - DNA, 21 bp, Homo sapiens
ggggcagagctaggccctgca

SEQ ID NO: 8128939 - DNA, 22 bp, Homo sapiens
ggggcagagtagctggggtgtg

SEQ ID NO: 8128940 - DNA, 22 bp, Homo sapiens
ggggcagagagaaggaagcttg

SEQ ID NO: 8128941 - DNA, 22 bp, Homo sapiens
ggggcagaagtagtgcccctga

SEQ ID NO: 8128942 - DNA, 22 bp, Homo sapiens
ggggcagagaataaaaacctaa

SEQ ID NO: 8128943 - DNA, 22 bp, Homo sapiens
gggctgtgcctcaggtggggtc

SEQ ID NO: 8128944 - DNA, 22 bp, Homo sapiens
gggctgtgagagtggggctgct

SEQ ID NO: 8128945 - DNA, 22 bp, Homo sapiens
gggctggaggaccggcctcgga

SEQ ID NO: 8128946 - DNA, 22 bp, Homo sapiens
gggttcctggctcctgtgtggt

SEQ ID NO: 8128947 - DNA, 22 bp, Homo sapiens
cagatgagggctggaggtgagc

SEQ ID NO: 8128948 - DNA, 22 bp, Homo sapiens
cagatgaagtaggtgacgagca

SEQ ID NO: 8128949 - DNA, 22 bp, Homo sapiens
cagatgaccgtcttccagccag

SEQ ID NO: 8128950 - DNA, 22 bp, Homo sapiens
ggtatttatatgtctgaagctg

SEQ ID NO: 8128951 - DNA, 22 bp, Homo sapiens
ggtatttatagtggtgcttagt

SEQ ID NO: 8128952 - DNA, 22 bp, Homo sapiens
ggtcctgcattgccagcaagct

SEQ ID NO: 8128953 - DNA, 22 bp, Homo sapiens
cagatgcagcaaaatgacaggc

SEQ ID NO: 8128954 - DNA, 23 bp, Homo sapiens
cagatgaggttggcagcatggtc

SEQ ID NO: 8128955 - DNA, 22 bp, Homo sapiens
ggtccctggttccctctgagct

SEQ ID NO: 8128956 - DNA, 22 bp, Homo sapiens
ggtcctgcgtctggctcgcccg

SEQ ID NO: 8128957 - DNA, 22 bp, Homo sapiens
ggtcctgctggctcagctgagc

SEQ ID NO: 8128958 - DNA, 22 bp, Homo sapiens
cagacaaagcggaaactgttta

SEQ ID NO: 8128959 - DNA, 22 bp, Homo sapiens
gggaggcacgaggcgcgcagtg

SEQ ID NO: 8128960 - DNA, 22 bp, Homo sapiens
gggaggcagtgctggaggctgg

SEQ ID NO: 8128961 - DNA, 21 bp, Homo sapiens
gggagctggaaactgggtgac

SEQ ID NO: 8128962 - DNA, 22 bp, Homo sapiens
cagagacacttaacaggaatgg

SEQ ID NO: 8128963 - DNA, 22 bp, Homo sapiens
cagagacagaaaatggatctag

SEQ ID NO: 8128964 - DNA, 22 bp, Homo sapiens
cagagacacttaacaggaatgg

SEQ ID NO: 8128965 - DNA, 22 bp, Homo sapiens
cagagacaacctggtagagaaa

SEQ ID NO: 8128966 - DNA, 22 bp, Homo sapiens
cagacttgaaagagactcagtt

SEQ ID NO: 8128967 - DNA, 22 bp, Homo sapiens
cagagcagaaacctgggtgatt

SEQ ID NO: 8128968 - DNA, 20 bp, Homo sapiens
cagagccaagagcagcatct

SEQ ID NO: 8128969 - DNA, 22 bp, Homo sapiens
cagagcagtggagagtaggtct

SEQ ID NO: 8128970 - DNA, 20 bp, Homo sapiens
cagagcagtgcccaggcggc

SEQ ID NO: 8128971 - DNA, 17 bp, Homo sapiens
gggcagggactcctggg

SEQ ID NO: 8128972 - DNA, 22 bp, Homo sapiens
gggcaggtactgggtggtgagc

SEQ ID NO: 8128973 - DNA, 22 bp, Homo sapiens
gggcaggtacaagatgcttctt

SEQ ID NO: 8128974 - DNA, 22 bp, Homo sapiens
gggcaggggtcagtggccccaa

SEQ ID NO: 8128975 - DNA, 20 bp, Homo sapiens
cagccctccagtggaggcag

SEQ ID NO: 8128976 - DNA, 22 bp, Homo sapiens
cagccctggcccaggtgcctta

SEQ ID NO: 8128977 - DNA, 21 bp, Homo sapiens
gtcacacaggcctggagctga

SEQ ID NO: 8128978 - DNA, 22 bp, Homo sapiens
gtcacagaggctgccagggttg

SEQ ID NO: 8128979 - DNA, 22 bp, Homo sapiens
gtcagcaattcaagagctctta

SEQ ID NO: 8128980 - DNA, 22 bp, Homo sapiens
gtcagcaagatgaatcagcagg

SEQ ID NO: 8128981 - DNA, 22 bp, Homo sapiens
gtcagcaaaaaatttatgtgag

SEQ ID NO: 8128982 - DNA, 22 bp, Homo sapiens
gtcagcaatagttagtttacaa

SEQ ID NO: 8128983 - DNA, 22 bp, Homo sapiens
gtcagcaaggtgcaagcggctg

SEQ ID NO: 8128984 - DNA, 22 bp, Homo sapiens
gtcagcaaggaaaatgtgtcac

SEQ ID NO: 8128985 - DNA, 22 bp, Homo sapiens
cagccagctggtgcggcagagc

SEQ ID NO: 8128986 - DNA, 22 bp, Homo sapiens
atctttctctgcactatacaat

SEQ ID NO: 8128987 - DNA, 22 bp, Homo sapiens
atctttcactttttgtggatga

SEQ ID NO: 8128988 - DNA, 22 bp, Homo sapiens
atcttggattggagaaagaagt

SEQ ID NO: 8128989 - DNA, 22 bp, Homo sapiens
atgaatttttctaagcttttgt

SEQ ID NO: 8128990 - DNA, 22 bp, Homo sapiens
atgacacaagagcagaagccat

SEQ ID NO: 8128991 - DNA, 22 bp, Homo sapiens
atgacacataaaacaaggactg

SEQ ID NO: 8128992 - DNA, 22 bp, Homo sapiens
atgacagacagaagggattttt

SEQ ID NO: 8128993 - DNA, 22 bp, Homo sapiens
atgacagaaggcctccctgaca

SEQ ID NO: 8128994 - DNA, 23 bp, Homo sapiens
atgacactcctgtgcgcaccctg

SEQ ID NO: 8128995 - DNA, 22 bp, Homo sapiens
ctttggaaaagcataccaagga

SEQ ID NO: 8128996 - DNA, 22 bp, Homo sapiens
ctttgcattttgcccaactgtg

SEQ ID NO: 8128997 - DNA, 22 bp, Homo sapiens
atgacagatagtcttcatttgc

SEQ ID NO: 8128998 - DNA, 19 bp, Homo sapiens
atgacagagttgataagtg

SEQ ID NO: 8128999 - DNA, 22 bp, Homo sapiens
atgacagaggattgtaaagagg

SEQ ID NO: 8129000 - DNA, 22 bp, Homo sapiens
atgacagaccctctaaagacaa

SEQ ID NO: 8129001 - DNA, 22 bp, Homo sapiens
atgacagaggagtgcaggtgat

SEQ ID NO: 8129002 - DNA, 22 bp, Homo sapiens
atgagagacaggaacgagctgg

SEQ ID NO: 8129003 - DNA, 22 bp, Homo sapiens
atgagcatccagaacagtgcct

SEQ ID NO: 8129004 - DNA, 22 bp, Homo sapiens
atgagcatatgggaggagtact

SEQ ID NO: 8129005 - DNA, 23 bp, Homo sapiens
atgagcatttttaatttctgtgg

SEQ ID NO: 8129006 - DNA, 22 bp, Homo sapiens
atgagcatgtgactcaaaccaa

SEQ ID NO: 8129007 - DNA, 22 bp, Homo sapiens
atgagcatctgagccagtgact

SEQ ID NO: 8129008 - DNA, 22 bp, Homo sapiens
atgagcatctgacatttaaaac

SEQ ID NO: 8129009 - DNA, 22 bp, Homo sapiens
atgagctagaaaaccatgtgga

SEQ ID NO: 8129010 - DNA, 22 bp, Homo sapiens
gaagagagcagcaaactggagt

SEQ ID NO: 8129011 - DNA, 22 bp, Homo sapiens
gaaggagggagcggcgcggatt

SEQ ID NO: 8129012 - DNA, 22 bp, Homo sapiens
gaagcagcaagtataggacagg

SEQ ID NO: 8129013 - DNA, 22 bp, Homo sapiens
gaagcagcaaatctgcagtatc

SEQ ID NO: 8129014 - DNA, 22 bp, Homo sapiens
gaagccttgaactgcaaacccc

SEQ ID NO: 8129015 - DNA, 22 bp, Homo sapiens
atgctaaactatgatcattttc

SEQ ID NO: 8129016 - DNA, 16 bp, Homo sapiens
atgctgctattagagg

SEQ ID NO: 8129017 - DNA, 22 bp, Homo sapiens
atgctctgggcttttgaagtgg

SEQ ID NO: 8129018 - DNA, 22 bp, Homo sapiens
atgctacatagatacaaaaatg

SEQ ID NO: 8129019 - DNA, 22 bp, Homo sapiens
atgctactcattaagtttgtca

SEQ ID NO: 8129020 - DNA, 19 bp, Homo sapiens
gaagtcattctgaaattct

SEQ ID NO: 8129021 - DNA, 22 bp, Homo sapiens
atgtgagtgctatgatagacag

SEQ ID NO: 8129022 - DNA, 22 bp, Homo sapiens
atgtcataaatatactgttcct

SEQ ID NO: 8129023 - DNA, 22 bp, Homo sapiens
atgtcagaagctggatgacagc

SEQ ID NO: 8129024 - DNA, 22 bp, Homo sapiens
atgtcagagcttccacaatagt

SEQ ID NO: 8129025 - DNA, 22 bp, Homo sapiens
atgtggaatgaacaaaggaggc

SEQ ID NO: 8129026 - DNA, 22 bp, Homo sapiens
atgtgcttggaaaagcagtggt

SEQ ID NO: 8129027 - DNA, 22 bp, Homo sapiens
atgggcagcagctgtcattttc

SEQ ID NO: 8129028 - DNA, 22 bp, Homo sapiens
atgggcagagtggggacaggaa

SEQ ID NO: 8129029 - DNA, 22 bp, Homo sapiens
atgggcagcagctgccattcat

SEQ ID NO: 8129030 - DNA, 22 bp, Homo sapiens
atgggcaggcactggctctcag

SEQ ID NO: 8129031 - DNA, 22 bp, Homo sapiens
gaggagctgggtcagggagaca

SEQ ID NO: 8129032 - DNA, 22 bp, Homo sapiens
atgggcaggcaaggtggcgagt

SEQ ID NO: 8129033 - DNA, 22 bp, Homo sapiens
atgggcagctgcagcagtggtg

SEQ ID NO: 8129034 - DNA, 22 bp, Homo sapiens
gaggagggctttgttgatgtta

SEQ ID NO: 8129035 - DNA, 22 bp, Homo sapiens
gaggagggcctggtgtcccttc

SEQ ID NO: 8129036 - DNA, 22 bp, Homo sapiens
gaggagggcagttcctctttta

SEQ ID NO: 8129037 - DNA, 22 bp, Homo sapiens
gaggagggagctggaagctctt

SEQ ID NO: 8129038 - DNA, 22 bp, Homo sapiens
gaggaggggcacttgtctccta

SEQ ID NO: 8129039 - DNA, 22 bp, Homo sapiens
gaggaggggacagtacttgtgc

SEQ ID NO: 8129040 - DNA, 22 bp, Homo sapiens
gaggcacagtgtttggtcagtg

SEQ ID NO: 8129041 - DNA, 23 bp, Homo sapiens
atgtatttaaatttcagtgatga

SEQ ID NO: 8129042 - DNA, 21 bp, Homo sapiens
atgggcagaggcagagaggct

SEQ ID NO: 8129043 - DNA, 17 bp, Homo sapiens
gagcccgttatcgggga

SEQ ID NO: 8129044 - DNA, 22 bp, Homo sapiens
gagcccgagcgcgtacccggcg

SEQ ID NO: 8129045 - DNA, 22 bp, Homo sapiens
atgggcagagctggtgggaggc

SEQ ID NO: 8129046 - DNA, 22 bp, Homo sapiens
atgggcagacagggagctcacg

SEQ ID NO: 8129047 - DNA, 22 bp, Homo sapiens
gagaaggggtgatgtgggtaat

SEQ ID NO: 8129048 - DNA, 22 bp, Homo sapiens
atgctgtttgcttttagtctgc

SEQ ID NO: 8129049 - DNA, 23 bp, Homo sapiens
gagaacagccacagagagctgtg

SEQ ID NO: 8129050 - DNA, 22 bp, Homo sapiens
atgctgtctctgctatccaaag

SEQ ID NO: 8129051 - DNA, 22 bp, Homo sapiens
atggataatgtctctgtttccc

SEQ ID NO: 8129052 - DNA, 22 bp, Homo sapiens
gagacaggcagctagtgggtca

SEQ ID NO: 8129053 - DNA, 22 bp, Homo sapiens
gagaatcatttacagaatgatt

SEQ ID NO: 8129054 - DNA, 22 bp, Homo sapiens
gccagctgctcgcgtagggtag

SEQ ID NO: 8129055 - DNA, 22 bp, Homo sapiens
gccagctgccctctgctggtcc

SEQ ID NO: 8129056 - DNA, 22 bp, Homo sapiens
gccagctgcatctcctgggctg

SEQ ID NO: 8129057 - DNA, 21 bp, Homo sapiens
gccagctgcagggcttccttg

SEQ ID NO: 8129058 - DNA, 20 bp, Homo sapiens
gcatggcatgtagtgaagtg

SEQ ID NO: 8129059 - DNA, 22 bp, Homo sapiens
gccagatattcagaggtgaaag

SEQ ID NO: 8129060 - DNA, 22 bp, Homo sapiens
attgtactcacaaaacatgagt

SEQ ID NO: 8129061 - DNA, 22 bp, Homo sapiens
atttattaagcatctgctatgt

SEQ ID NO: 8129062 - DNA, 22 bp, Homo sapiens
gccatcatatcccctgtgacct

SEQ ID NO: 8129063 - DNA, 22 bp, Homo sapiens
atttatcatcagaccttttaaa

SEQ ID NO: 8129064 - DNA, 22 bp, Homo sapiens
atttatcaacatgtaccattgg

SEQ ID NO: 8129065 - DNA, 22 bp, Homo sapiens
gccctgtcctcctgactgagtg

SEQ ID NO: 8129066 - DNA, 22 bp, Homo sapiens
gccctggggaaggtgtctccaa

SEQ ID NO: 8129067 - DNA, 22 bp, Homo sapiens
gccctgcctgccggtgtgggtc

SEQ ID NO: 8129068 - DNA, 22 bp, Homo sapiens
gccctgggctccctgctccaca

SEQ ID NO: 8129069 - DNA, 22 bp, Homo sapiens
gccatgcctgtgtctccaggcc

SEQ ID NO: 8129070 - DNA, 20 bp, Homo sapiens
gccatgaggggaggtgactg

SEQ ID NO: 8129071 - DNA, 23 bp, Homo sapiens
gccatgagttccctttcacttgt

SEQ ID NO: 8129072 - DNA, 22 bp, Homo sapiens
gccatgagtaaactggaaagcc

SEQ ID NO: 8129073 - DNA, 22 bp, Homo sapiens
gccatgaggctccgagaagtca

SEQ ID NO: 8129074 - DNA, 22 bp, Homo sapiens
gccatgagaagaaatgaagggc

SEQ ID NO: 8129075 - DNA, 22 bp, Homo sapiens
gccatgaggaactgtaagacaa

SEQ ID NO: 8129076 - DNA, 22 bp, Homo sapiens
gccatgagatgttttatttgca

SEQ ID NO: 8129077 - DNA, 22 bp, Homo sapiens
atttcaagtgttgagctcataa

SEQ ID NO: 8129078 - DNA, 22 bp, Homo sapiens
atttgtcagtggaagtgattca

SEQ ID NO: 8129079 - DNA, 22 bp, Homo sapiens
atttgtcaacaggcatttaggt

SEQ ID NO: 8129080 - DNA, 21 bp, Homo sapiens
attttcattaattcagtgtgg

SEQ ID NO: 8129081 - DNA, 22 bp, Homo sapiens
attttgataatcatgttagaga

SEQ ID NO: 8129082 - DNA, 22 bp, Homo sapiens
attttgctggtctgaattactt

SEQ ID NO: 8129083 - DNA, 22 bp, Homo sapiens
attttgctgctatgccttgcaa

SEQ ID NO: 8129084 - DNA, 22 bp, Homo sapiens
attttgctacagttggtggaaa

SEQ ID NO: 8129085 - DNA, 22 bp, Homo sapiens
attttgatgctatctaatgaat

SEQ ID NO: 8129086 - DNA, 22 bp, Homo sapiens
caaaagatacttgcatctaact

SEQ ID NO: 8129087 - DNA, 22 bp, Homo sapiens
gctcccagggcagcgcagaaga

SEQ ID NO: 8129088 - DNA, 20 bp, Homo sapiens
caaagacatgctaggggtgg

SEQ ID NO: 8129089 - DNA, 22 bp, Homo sapiens
gctctgctgtcttcttgcaggc

SEQ ID NO: 8129090 - DNA, 22 bp, Homo sapiens
gctctgctgtggaatcctctcc

SEQ ID NO: 8129091 - DNA, 22 bp, Homo sapiens
caaagacacgggaaacaacgtt

SEQ ID NO: 8129092 - DNA, 22 bp, Homo sapiens
gcatggagaagtgggaacaggt

SEQ ID NO: 8129093 - DNA, 22 bp, Homo sapiens
gcatcattttcttcttcctgca

SEQ ID NO: 8129094 - DNA, 20 bp, Homo sapiens
gcaggcagggaatgggggtg

SEQ ID NO: 8129095 - DNA, 22 bp, Homo sapiens
attcttttaaatggcagtagta

SEQ ID NO: 8129096 - DNA, 22 bp, Homo sapiens
attcttttgtcctagcttgata

SEQ ID NO: 8129097 - DNA, 22 bp, Homo sapiens
attcttttcccaactgctttaa

SEQ ID NO: 8129098 - DNA, 22 bp, Homo sapiens
gcaggcaggaaggactaagtaa

SEQ ID NO: 8129099 - DNA, 22 bp, Homo sapiens
attctgaagttgcaggagaagc

SEQ ID NO: 8129100 - DNA, 22 bp, Homo sapiens
attctgatcattcaagatgtca

SEQ ID NO: 8129101 - DNA, 19 bp, Homo sapiens
attcatttttgccttctaa

SEQ ID NO: 8129102 - DNA, 22 bp, Homo sapiens
attcacaaatgctgccccattc

SEQ ID NO: 8129103 - DNA, 21 bp, Homo sapiens
gagtgggctgagatggggctg

SEQ ID NO: 8129104 - DNA, 22 bp, Homo sapiens
atgttatgtctgggaaggggta

SEQ ID NO: 8129105 - DNA, 22 bp, Homo sapiens
atgttattaaagtacagattct

SEQ ID NO: 8129106 - DNA, 22 bp, Homo sapiens
gcagagaaggattgaaaccaga

SEQ ID NO: 8129107 - DNA, 22 bp, Homo sapiens
gcagagaccccgcagtgaggcc

SEQ ID NO: 8129108 - DNA, 22 bp, Homo sapiens
gcagagaggaatgaagccatcc

SEQ ID NO: 8129109 - DNA, 22 bp, Homo sapiens
gcagagagttgggctgcgccag

SEQ ID NO: 8129110 - DNA, 22 bp, Homo sapiens
gcagagaggatattattgtcca

SEQ ID NO: 8129111 - DNA, 22 bp, Homo sapiens
gcaccagggtgctgtgttctgg

SEQ ID NO: 8129112 - DNA, 22 bp, Homo sapiens
gcacacagattaggaaacagaa

SEQ ID NO: 8129113 - DNA, 22 bp, Homo sapiens
gcacacagaattgattcactgt

SEQ ID NO: 8129114 - DNA, 22 bp, Homo sapiens
aggtctggtgagagcaggtgct

SEQ ID NO: 8129115 - DNA, 22 bp, Homo sapiens
cctgggtgtcatgggcagctgg

SEQ ID NO: 8129116 - DNA, 22 bp, Homo sapiens
aggtggagttaagtgtgaactg

SEQ ID NO: 8129117 - DNA, 22 bp, Homo sapiens
aggtggagtgtgcagggagagc

SEQ ID NO: 8129118 - DNA, 22 bp, Homo sapiens
aggtgctgtttgtcagcagttt

SEQ ID NO: 8129119 - DNA, 22 bp, Homo sapiens
cctgggcaggccggacgctggg

SEQ ID NO: 8129120 - DNA, 22 bp, Homo sapiens
agggtggcagttactggagcaa

SEQ ID NO: 8129121 - DNA, 22 bp, Homo sapiens
agggtggccatgagggagagat

SEQ ID NO: 8129122 - DNA, 21 bp, Homo sapiens
agggtggctctgggtcagaac

SEQ ID NO: 8129123 - DNA, 22 bp, Homo sapiens
aggggctgtggaaaccaactct

SEQ ID NO: 8129124 - DNA, 19 bp, Homo sapiens
agggtggcaaaggagggtg

SEQ ID NO: 8129125 - DNA, 22 bp, Homo sapiens
cctggagcactctccctggctg

SEQ ID NO: 8129126 - DNA, 19 bp, Homo sapiens
aggtgtgggggctgcagac

SEQ ID NO: 8129127 - DNA, 17 bp, Homo sapiens
aggtgtggtcaagggag

SEQ ID NO: 8129128 - DNA, 22 bp, Homo sapiens
aggtgtgggaaacgggtgacct

SEQ ID NO: 8129129 - DNA, 22 bp, Homo sapiens
aggtgtggcttgaagtctctat

SEQ ID NO: 8129130 - DNA, 22 bp, Homo sapiens
cctggtgaatgttcatggactg

SEQ ID NO: 8129131 - DNA, 22 bp, Homo sapiens
agtaatgacaatttttatctgt

SEQ ID NO: 8129132 - DNA, 21 bp, Homo sapiens
aggtttatttcaacttcagga

SEQ ID NO: 8129133 - DNA, 22 bp, Homo sapiens
agtcagaatctgcattttaacc

SEQ ID NO: 8129134 - DNA, 22 bp, Homo sapiens
agtcagaattcgatcccaggtc

SEQ ID NO: 8129135 - DNA, 22 bp, Homo sapiens
cgcgctctccttctggcaccca

SEQ ID NO: 8129136 - DNA, 22 bp, Homo sapiens
cgcgctgcagacagcggaggcc

SEQ ID NO: 8129137 - DNA, 22 bp, Homo sapiens
cgcgggcctccagacccagtat

SEQ ID NO: 8129138 - DNA, 22 bp, Homo sapiens
cgcgggcccctgcgctccgggc

SEQ ID NO: 8129139 - DNA, 22 bp, Homo sapiens
cgcggctctgcgggccgctgag

SEQ ID NO: 8129140 - DNA, 22 bp, Homo sapiens
cgcggaggaggtcaggaggtga

SEQ ID NO: 8129141 - DNA, 22 bp, Homo sapiens
cgcgggggtcctcaggcaggcg

SEQ ID NO: 8129142 - DNA, 22 bp, Homo sapiens
cgtgatatttgtggtggatgaa

SEQ ID NO: 8129143 - DNA, 22 bp, Homo sapiens
cgcggtggcggcctccagcgcc

SEQ ID NO: 8129144 - DNA, 19 bp, Homo sapiens
cgtggagctggcaggcagg

SEQ ID NO: 8129145 - DNA, 22 bp, Homo sapiens
ctaaactagcagttctgcaaca

SEQ ID NO: 8129146 - DNA, 22 bp, Homo sapiens
ctaaacatgtagcttttgtggt

SEQ ID NO: 8129147 - DNA, 22 bp, Homo sapiens
ctaaacatgcaagagcttctgg

SEQ ID NO: 8129148 - DNA, 22 bp, Homo sapiens
agtgcaggccccaggccaggcc

SEQ ID NO: 8129149 - DNA, 22 bp, Homo sapiens
agtgggcagcccaggaggtctt

SEQ ID NO: 8129150 - DNA, 22 bp, Homo sapiens
agtgggcaggcagggtgcgcag

SEQ ID NO: 8129151 - DNA, 22 bp, Homo sapiens
agtgggctggtggcagggagaa

SEQ ID NO: 8129152 - DNA, 22 bp, Homo sapiens
agtgggctggtggcagggagaa

SEQ ID NO: 8129153 - DNA, 22 bp, Homo sapiens
agtgggcttactgagggagtgt

SEQ ID NO: 8129154 - DNA, 22 bp, Homo sapiens
agtgggcttactgagggagtgt

SEQ ID NO: 8129155 - DNA, 22 bp, Homo sapiens
agtgggcttttttccgttccat

SEQ ID NO: 8129156 - DNA, 22 bp, Homo sapiens
agtgggcccttgtcacactgat

SEQ ID NO: 8129157 - DNA, 22 bp, Homo sapiens
agtgggcatgatctggtgtctg

SEQ ID NO: 8129158 - DNA, 22 bp, Homo sapiens
agtgggcccgagccagtggtct

SEQ ID NO: 8129159 - DNA, 22 bp, Homo sapiens
ctctgagaggctgccctgccat

SEQ ID NO: 8129160 - DNA, 22 bp, Homo sapiens
ctctgtttttcaatagttcttg

SEQ ID NO: 8129161 - DNA, 22 bp, Homo sapiens
ctctgtttggcgctgctccttc

SEQ ID NO: 8129162 - DNA, 22 bp, Homo sapiens
ctgaagcagggagtgatgaagt

SEQ ID NO: 8129163 - DNA, 22 bp, Homo sapiens
ctgagaaagtgagggttaaaca

SEQ ID NO: 8129164 - DNA, 18 bp, Homo sapiens
agtgtgtgccctttcagg

SEQ ID NO: 8129165 - DNA, 20 bp, Homo sapiens
agtgtgttcctcttactgtg

SEQ ID NO: 8129166 - DNA, 22 bp, Homo sapiens
agtgtgtgtttgggcggtttat

SEQ ID NO: 8129167 - DNA, 22 bp, Homo sapiens
agtgtgtttaggctgcgggttg

SEQ ID NO: 8129168 - DNA, 22 bp, Homo sapiens
agtgtgttgtaggctcaaatgg

SEQ ID NO: 8129169 - DNA, 22 bp, Homo sapiens
agtgtgtttggagcgagggagg

SEQ ID NO: 8129170 - DNA, 21 bp, Homo sapiens
agtgtgttcttggcattacct

SEQ ID NO: 8129171 - DNA, 22 bp, Homo sapiens
agtgtgttctcaatgaaaagaa

SEQ ID NO: 8129172 - DNA, 22 bp, Homo sapiens
agtgtgttctggtctaccttgg

SEQ ID NO: 8129173 - DNA, 18 bp, Homo sapiens
agtcatttacttttgtga

SEQ ID NO: 8129174 - DNA, 22 bp, Homo sapiens
agtcattttgccagtcttcagg

SEQ ID NO: 8129175 - DNA, 22 bp, Homo sapiens
agtctgtgtgaatgtgggcttt

SEQ ID NO: 8129176 - DNA, 22 bp, Homo sapiens
ctcctcctggacacaggctgtg

SEQ ID NO: 8129177 - DNA, 22 bp, Homo sapiens
ctcaggcagttgtttgcatagt

SEQ ID NO: 8129178 - DNA, 22 bp, Homo sapiens
agtgacaggggaggcaggtgtg

SEQ ID NO: 8129179 - DNA, 22 bp, Homo sapiens
agtgatttgcagtatttactaa

SEQ ID NO: 8129180 - DNA, 22 bp, Homo sapiens
agtgatttgactcttttattgt

SEQ ID NO: 8129181 - DNA, 22 bp, Homo sapiens
cttcagcagcctcttgcataaa

SEQ ID NO: 8129182 - DNA, 22 bp, Homo sapiens
cttcagcagatgtgctagagat

SEQ ID NO: 8129183 - DNA, 22 bp, Homo sapiens
ctgtttctccacactcttccca

SEQ ID NO: 8129184 - DNA, 22 bp, Homo sapiens
cttcagaatgggactgtgtttg

SEQ ID NO: 8129185 - DNA, 22 bp, Homo sapiens
atctgcatttgaacaagctcct

SEQ ID NO: 8129186 - DNA, 22 bp, Homo sapiens
atctcatcagatctgtataagc

SEQ ID NO: 8129187 - DNA, 22 bp, Homo sapiens
atctccagctggctgtgataaa

SEQ ID NO: 8129188 - DNA, 21 bp, Homo sapiens
atcagggatgggttggacacc

SEQ ID NO: 8129189 - DNA, 22 bp, Homo sapiens
atcaggaagtctgccacaaggc

SEQ ID NO: 8129190 - DNA, 22 bp, Homo sapiens
atcattcatcttattgccagtc

SEQ ID NO: 8129191 - DNA, 22 bp, Homo sapiens
atcattcagtctctgggacagt

SEQ ID NO: 8129192 - DNA, 23 bp, Homo sapiens
ctgttatgtaaatatgtttagtg

SEQ ID NO: 8129193 - DNA, 22 bp, Homo sapiens
ctgttatgcatggtcattgcct

SEQ ID NO: 8129194 - DNA, 22 bp, Homo sapiens
atagtatttccagaaatagtct

SEQ ID NO: 8129195 - DNA, 22 bp, Homo sapiens
atatattttttgagacagagtc

SEQ ID NO: 8129196 - DNA, 22 bp, Homo sapiens
atatattttgcggtcacgtggc

SEQ ID NO: 8129197 - DNA, 22 bp, Homo sapiens
atatcacagctctttcattgct

SEQ ID NO: 8129198 - DNA, 22 bp, Homo sapiens
atatcacagtagttgtttagtt

SEQ ID NO: 8129199 - DNA, 22 bp, Homo sapiens
atatcacaaacaagtctgtact

SEQ ID NO: 8129200 - DNA, 22 bp, Homo sapiens
ctgggcagtttacattcctacc

SEQ ID NO: 8129201 - DNA, 22 bp, Homo sapiens
ctgggcagttcgctttcgtttt

SEQ ID NO: 8129202 - DNA, 22 bp, Homo sapiens
ctgggccagtctcggccgctct

SEQ ID NO: 8129203 - DNA, 22 bp, Homo sapiens
ctggtgggagcagcaggcagct

SEQ ID NO: 8129204 - DNA, 22 bp, Homo sapiens
ctggggaggcagggctgcccct

SEQ ID NO: 8129205 - DNA, 20 bp, Homo sapiens
ctggggaggaggatgtgttc

SEQ ID NO: 8129206 - DNA, 22 bp, Homo sapiens
ctgtaatgaactctttgtcagt

SEQ ID NO: 8129207 - DNA, 22 bp, Homo sapiens
atattttcactgaaccaaagta

SEQ ID NO: 8129208 - DNA, 22 bp, Homo sapiens
atattttccgaacttgaggtag

SEQ ID NO: 8129209 - DNA, 22 bp, Homo sapiens
ctgtatgttccgttttgtcact

SEQ ID NO: 8129210 - DNA, 22 bp, Homo sapiens
agttttcaatatatgatagtga

SEQ ID NO: 8129211 - DNA, 22 bp, Homo sapiens
ctgatattcttgaaatcatggt

SEQ ID NO: 8129212 - DNA, 22 bp, Homo sapiens
ctgataatacagcagtttgtct

SEQ ID NO: 8129213 - DNA, 21 bp, Homo sapiens
ctgataattgttaaattattt

SEQ ID NO: 8129214 - DNA, 22 bp, Homo sapiens
ctgataatttcaaaaatcttca

SEQ ID NO: 8129215 - DNA, 22 bp, Homo sapiens
ctgatagacaatcaccatggga

SEQ ID NO: 8129216 - DNA, 22 bp, Homo sapiens
ctgccctgacctgcctcagagt

SEQ ID NO: 8129217 - DNA, 22 bp, Homo sapiens
ctgccctctagggatgcactgg

SEQ ID NO: 8129218 - DNA, 22 bp, Homo sapiens
ctgcccgtccctttgctctcgc

SEQ ID NO: 8129219 - DNA, 22 bp, Homo sapiens
agttttcacactcaccaaaagg

SEQ ID NO: 8129220 - DNA, 22 bp, Homo sapiens
ctgcctgctgcctgtggagggt

SEQ ID NO: 8129221 - DNA, 22 bp, Homo sapiens
ctgcctgcttttctgggagccg

SEQ ID NO: 8129222 - DNA, 22 bp, Homo sapiens
ctgcctgcttctgagccagagg

SEQ ID NO: 8129223 - DNA, 23 bp, Homo sapiens
ctgcctgctggggagacagatct

SEQ ID NO: 8129224 - DNA, 22 bp, Homo sapiens
ctgccctgtggctctgagtcat

SEQ ID NO: 8129225 - DNA, 22 bp, Homo sapiens
atagtacacatcctacaatgtt

SEQ ID NO: 8129226 - DNA, 22 bp, Homo sapiens
ctggccagtgactgctcacccg

SEQ ID NO: 8129227 - DNA, 22 bp, Homo sapiens
ctggccaggcttgggacagaca

SEQ ID NO: 8129228 - DNA, 22 bp, Homo sapiens
ataatttacaactgcttttaat

SEQ ID NO: 8129229 - DNA, 22 bp, Homo sapiens
ataattatctcagacacttgtt

SEQ ID NO: 8129230 - DNA, 22 bp, Homo sapiens
ataatgtttcagtactgtctgt

SEQ ID NO: 8129231 - DNA, 22 bp, Homo sapiens
ctggaaagttcaagataaagct

SEQ ID NO: 8129232 - DNA, 19 bp, Homo sapiens
ctggaaagttggcagtgag

SEQ ID NO: 8129233 - DNA, 22 bp, Homo sapiens
atacatgactcacacattctgc

SEQ ID NO: 8129234 - DNA, 22 bp, Homo sapiens
aggctgcctggctgtgagtgaa

SEQ ID NO: 8129235 - DNA, 22 bp, Homo sapiens
aggctgcctcgtgagctcgctg

SEQ ID NO: 8129236 - DNA, 22 bp, Homo sapiens
aggctgcctctgcaggatccct

SEQ ID NO: 8129237 - DNA, 22 bp, Homo sapiens
aggctgcctcttttgagagggt

SEQ ID NO: 8129238 - DNA, 19 bp, Homo sapiens
aggctgcctcaccctccct

SEQ ID NO: 8129239 - DNA, 22 bp, Homo sapiens
cccactgtctgttcccagggcc

SEQ ID NO: 8129240 - DNA, 22 bp, Homo sapiens
aggctctgtgcagcctgcatct

SEQ ID NO: 8129241 - DNA, 22 bp, Homo sapiens
aggctgaggtgtgctgtgatcg

SEQ ID NO: 8129242 - DNA, 22 bp, Homo sapiens
aggctcagtcccggcccgcgcc

SEQ ID NO: 8129243 - DNA, 22 bp, Homo sapiens
aggctcagtatagctggcaagt

SEQ ID NO: 8129244 - DNA, 22 bp, Homo sapiens
aggctcagtctgttcatgcact

SEQ ID NO: 8129245 - DNA, 22 bp, Homo sapiens
aggctcagcctgggcctagagc

SEQ ID NO: 8129246 - DNA, 22 bp, Homo sapiens
aggctcaggtctcaggtctggc

SEQ ID NO: 8129247 - DNA, 22 bp, Homo sapiens
aggctcagttctgtggtgagcc

SEQ ID NO: 8129248 - DNA, 22 bp, Homo sapiens
aggctcagttcacgtcaacttt

SEQ ID NO: 8129249 - DNA, 22 bp, Homo sapiens
aggctcagttcacgtcaacttt

SEQ ID NO: 8129250 - DNA, 22 bp, Homo sapiens
ccagggtgagtgtcatgggtta

SEQ ID NO: 8129251 - DNA, 22 bp, Homo sapiens
ccaggacaagtgtggccatggc

SEQ ID NO: 8129252 - DNA, 22 bp, Homo sapiens
aggccctgggcagttctgtagc

SEQ ID NO: 8129253 - DNA, 22 bp, Homo sapiens
aggccctggggtctgttaaatt

SEQ ID NO: 8129254 - DNA, 18 bp, Homo sapiens
aggccctggcctcgaaca

SEQ ID NO: 8129255 - DNA, 22 bp, Homo sapiens
aggccctggcctgactcaatgt

SEQ ID NO: 8129256 - DNA, 22 bp, Homo sapiens
aggccctggctgggtttcttta

SEQ ID NO: 8129257 - DNA, 22 bp, Homo sapiens
aggccctgggagcagagatgca

SEQ ID NO: 8129258 - DNA, 22 bp, Homo sapiens
aggccctggcactgcctgggag

SEQ ID NO: 8129259 - DNA, 22 bp, Homo sapiens
aggccctggcccccagagattc

SEQ ID NO: 8129260 - DNA, 22 bp, Homo sapiens
ccagcctcatcgcctgcctgtc

SEQ ID NO: 8129261 - DNA, 22 bp, Homo sapiens
ccagcctcatcatattcctgct

SEQ ID NO: 8129262 - DNA, 22 bp, Homo sapiens
ccagcctccatgtagatagctg

SEQ ID NO: 8129263 - DNA, 19 bp, Homo sapiens
ccagctggcctgggacctc

SEQ ID NO: 8129264 - DNA, 22 bp, Homo sapiens
aggcccagcccgtcctcgtgct

SEQ ID NO: 8129265 - DNA, 22 bp, Homo sapiens
aggcaggggagctggaagggta

SEQ ID NO: 8129266 - DNA, 22 bp, Homo sapiens
ccagagagggcgccacctggag

SEQ ID NO: 8129267 - DNA, 17 bp, Homo sapiens
ccagagagtagttagga

SEQ ID NO: 8129268 - DNA, 22 bp, Homo sapiens
ccagagagtatcatggagagta

SEQ ID NO: 8129269 - DNA, 22 bp, Homo sapiens
ccagagagtcgatgggggacac

SEQ ID NO: 8129270 - DNA, 22 bp, Homo sapiens
ccagagaggggaagggcttgcc

SEQ ID NO: 8129271 - DNA, 22 bp, Homo sapiens
ccagagaggtagcttaccctct

SEQ ID NO: 8129272 - DNA, 22 bp, Homo sapiens
ccagagagtaggaggcattatt

SEQ ID NO: 8129273 - DNA, 22 bp, Homo sapiens
ccagagagtaaacattttccgg

SEQ ID NO: 8129274 - DNA, 20 bp, Homo sapiens
ccagagagtaggttagtgat

SEQ ID NO: 8129275 - DNA, 22 bp, Homo sapiens
aggccagacagctagaaacagg

SEQ ID NO: 8129276 - DNA, 22 bp, Homo sapiens
aggccagaacagctctgcacca

SEQ ID NO: 8129277 - DNA, 22 bp, Homo sapiens
aggccagaagtcaaaaactcta

SEQ ID NO: 8129278 - DNA, 22 bp, Homo sapiens
aggccagaagccagaaatgctt

SEQ ID NO: 8129279 - DNA, 22 bp, Homo sapiens
agggcagagatctgagtgggca

SEQ ID NO: 8129280 - DNA, 22 bp, Homo sapiens
agggcagagattaattaagaca

SEQ ID NO: 8129281 - DNA, 22 bp, Homo sapiens
agggcagagcactgaattggga

SEQ ID NO: 8129282 - DNA, 22 bp, Homo sapiens
agggcagagaaatgtagttgag

SEQ ID NO: 8129283 - DNA, 22 bp, Homo sapiens
agggcagagacatgcttcctga

SEQ ID NO: 8129284 - DNA, 22 bp, Homo sapiens
agggcagagagatgaatgggat

SEQ ID NO: 8129285 - DNA, 20 bp, Homo sapiens
agggcagagggattacaggc

SEQ ID NO: 8129286 - DNA, 22 bp, Homo sapiens
agggcagagctgtctaaatggc

SEQ ID NO: 8129287 - DNA, 22 bp, Homo sapiens
agggcagaggcggacacggaag

SEQ ID NO: 8129288 - DNA, 20 bp, Homo sapiens
ccctggactcctgagcaaac

SEQ ID NO: 8129289 - DNA, 22 bp, Homo sapiens
ccctggacggggaatatgactt

SEQ ID NO: 8129290 - DNA, 22 bp, Homo sapiens
ccctggaggaccccaatgtggc

SEQ ID NO: 8129291 - DNA, 22 bp, Homo sapiens
agggatggatcttggccctgga

SEQ ID NO: 8129292 - DNA, 22 bp, Homo sapiens
ccctctgcctctgagtaggaca

SEQ ID NO: 8129293 - DNA, 22 bp, Homo sapiens
ccctctgcaggctggacctgcc

SEQ ID NO: 8129294 - DNA, 22 bp, Homo sapiens
ccctctgctcaggtgcataggc

SEQ ID NO: 8129295 - DNA, 18 bp, Homo sapiens
agggatctagatggagtc

SEQ ID NO: 8129296 - DNA, 22 bp, Homo sapiens
agggatggaagctcgtctgcaa

SEQ ID NO: 8129297 - DNA, 22 bp, Homo sapiens
aggcttctctgcaagatgttaa

SEQ ID NO: 8129298 - DNA, 22 bp, Homo sapiens
aggctggctgagctgcagcctg

SEQ ID NO: 8129299 - DNA, 22 bp, Homo sapiens
agggccagaatccctcagtcta

SEQ ID NO: 8129300 - DNA, 22 bp, Homo sapiens
ccctggaggctggaggcagtag

SEQ ID NO: 8129301 - DNA, 22 bp, Homo sapiens
ccgagagcaggtggccgctggt

SEQ ID NO: 8129302 - DNA, 22 bp, Homo sapiens
ccgagcccggagaggagctctt

SEQ ID NO: 8129303 - DNA, 22 bp, Homo sapiens
ccgaggctggcctcagggctgt

SEQ ID NO: 8129304 - DNA, 22 bp, Homo sapiens
ccgaggctggagtgcagtggcg

SEQ ID NO: 8129305 - DNA, 22 bp, Homo sapiens
agggccctctggcaggccaggc

SEQ ID NO: 8129306 - DNA, 22 bp, Homo sapiens
agggccctgagttgcagccctg

SEQ ID NO: 8129307 - DNA, 22 bp, Homo sapiens
agggcccttacgcaggcccttc

SEQ ID NO: 8129308 - DNA, 22 bp, Homo sapiens
agggctaggaatggaactggag

SEQ ID NO: 8129309 - DNA, 22 bp, Homo sapiens
agggctctggggtggcagagat

SEQ ID NO: 8129310 - DNA, 22 bp, Homo sapiens
agggctctgtccccagaggccc

SEQ ID NO: 8129311 - DNA, 22 bp, Homo sapiens
agggctctgttggggtcagcac

SEQ ID NO: 8129312 - DNA, 18 bp, Homo sapiens
agggctctctgctgggtt

SEQ ID NO: 8129313 - DNA, 22 bp, Homo sapiens
aggggctgggacagagccaagc

SEQ ID NO: 8129314 - DNA, 22 bp, Homo sapiens
aggggctggcttatctgagagt

SEQ ID NO: 8129315 - DNA, 22 bp, Homo sapiens
aggggctgcctggcttggcact

SEQ ID NO: 8129316 - DNA, 22 bp, Homo sapiens
aggggctgctgggtccgcccct

SEQ ID NO: 8129317 - DNA, 22 bp, Homo sapiens
aggggctggagttcgaggttac

SEQ ID NO: 8129318 - DNA, 22 bp, Homo sapiens
agggctgcaggcaagatatggc

SEQ ID NO: 8129319 - DNA, 22 bp, Homo sapiens
agggctgcaccggggcttcgcg

SEQ ID NO: 8129320 - DNA, 19 bp, Homo sapiens
cctctgccagcccgcctct

SEQ ID NO: 8129321 - DNA, 22 bp, Homo sapiens
cctctgggcaggtagcagcagc

SEQ ID NO: 8129322 - DNA, 16 bp, Homo sapiens
cctctgggcctgcaag

SEQ ID NO: 8129323 - DNA, 22 bp, Homo sapiens
agggctgcaatgggagataact

SEQ ID NO: 8129324 - DNA, 22 bp, Homo sapiens
cagctctggtccagggagggca

SEQ ID NO: 8129325 - DNA, 22 bp, Homo sapiens
cagctctgggtgacaggagggc

SEQ ID NO: 8129326 - DNA, 22 bp, Homo sapiens
cagctctgtaaattccttcatc

SEQ ID NO: 8129327 - DNA, 22 bp, Homo sapiens
agctgctgcgcctcaccctggc

SEQ ID NO: 8129328 - DNA, 22 bp, Homo sapiens
caggcacactgtctacactgag

SEQ ID NO: 8129329 - DNA, 22 bp, Homo sapiens
caggccagaggctgttgttgcg

SEQ ID NO: 8129330 - DNA, 22 bp, Homo sapiens
caggccagcagggcctccgtgg

SEQ ID NO: 8129331 - DNA, 22 bp, Homo sapiens
caggccagagtccaactccaga

SEQ ID NO: 8129332 - DNA, 20 bp, Homo sapiens
caggccagaggtttgatggc

SEQ ID NO: 8129333 - DNA, 22 bp, Homo sapiens
caggccagcttcctgacatcct

SEQ ID NO: 8129334 - DNA, 22 bp, Homo sapiens
caggccagcggcccgcgcgttc

SEQ ID NO: 8129335 - DNA, 22 bp, Homo sapiens
caggccagcggcccgcgcgttc

SEQ ID NO: 8129336 - DNA, 22 bp, Homo sapiens
caggccagcgtccagaacaagc

SEQ ID NO: 8129337 - DNA, 22 bp, Homo sapiens
caggccaggctgcatttgcccc

SEQ ID NO: 8129338 - DNA, 22 bp, Homo sapiens
agctgggctgggctgagctgag

SEQ ID NO: 8129339 - DNA, 22 bp, Homo sapiens
caggggctgtgggcggagcctc

SEQ ID NO: 8129340 - DNA, 22 bp, Homo sapiens
caggggctctgggtgatgtgag

SEQ ID NO: 8129341 - DNA, 22 bp, Homo sapiens
caggggctccctgggtgccagt

SEQ ID NO: 8129342 - DNA, 22 bp, Homo sapiens
caggggctgaaatgttggggtt

SEQ ID NO: 8129343 - DNA, 22 bp, Homo sapiens
cagggcctccccggcagtcttt

SEQ ID NO: 8129344 - DNA, 22 bp, Homo sapiens
cagggcctctcctccaggaact

SEQ ID NO: 8129345 - DNA, 18 bp, Homo sapiens
agctggggcctctggtcc

SEQ ID NO: 8129346 - DNA, 22 bp, Homo sapiens
agctggggcatttatccactaa

SEQ ID NO: 8129347 - DNA, 22 bp, Homo sapiens
agctgggcttggccaggtcgct

SEQ ID NO: 8129348 - DNA, 22 bp, Homo sapiens
caggctgcggtcggctctggtc

SEQ ID NO: 8129349 - DNA, 22 bp, Homo sapiens
caggctggacattagatacata

SEQ ID NO: 8129350 - DNA, 22 bp, Homo sapiens
caggctggagtacaattgtgtg

SEQ ID NO: 8129351 - DNA, 22 bp, Homo sapiens
caggctggagtgcagtggtgcc

SEQ ID NO: 8129352 - DNA, 22 bp, Homo sapiens
caggctggagtgcagttgtgca

SEQ ID NO: 8129353 - DNA, 22 bp, Homo sapiens
caggctggagtgcagttgtgca

SEQ ID NO: 8129354 - DNA, 22 bp, Homo sapiens
caggctggagtgcagtgtcgcc

SEQ ID NO: 8129355 - DNA, 22 bp, Homo sapiens
cagggagctctgggccggactc

SEQ ID NO: 8129356 - DNA, 22 bp, Homo sapiens
catattctttaagcaatgctct

SEQ ID NO: 8129357 - DNA, 22 bp, Homo sapiens
aggacccaagcacagttcctgg

SEQ ID NO: 8129358 - DNA, 22 bp, Homo sapiens
aggaccagtatgagagcatctg

SEQ ID NO: 8129359 - DNA, 22 bp, Homo sapiens
caggtgggagccacagcgtaca

SEQ ID NO: 8129360 - DNA, 22 bp, Homo sapiens
aggacattcatttcaaggagga

SEQ ID NO: 8129361 - DNA, 22 bp, Homo sapiens
cagtggccaacttcctgcctct

SEQ ID NO: 8129362 - DNA, 18 bp, Homo sapiens
aggactcctgggagttgg

SEQ ID NO: 8129363 - DNA, 22 bp, Homo sapiens
aggactcctgctgggaatggct

SEQ ID NO: 8129364 - DNA, 22 bp, Homo sapiens
aggactccatgtgtcctggaga

SEQ ID NO: 8129365 - DNA, 22 bp, Homo sapiens
cagtgctcccgctgccgctgtg

SEQ ID NO: 8129366 - DNA, 22 bp, Homo sapiens
cagtgcctgggacccggctgtg

SEQ ID NO: 8129367 - DNA, 22 bp, Homo sapiens
cagtgcctggatagcaacatga

SEQ ID NO: 8129368 - DNA, 20 bp, Homo sapiens
aggaggggatagaatcaaag

SEQ ID NO: 8129369 - DNA, 22 bp, Homo sapiens
catgcgggttccaggctgcact

SEQ ID NO: 8129370 - DNA, 16 bp, Homo sapiens
aggaggggaattagga

SEQ ID NO: 8129371 - DNA, 21 bp, Homo sapiens
aggagggcacaaggccaggaa

SEQ ID NO: 8129372 - DNA, 22 bp, Homo sapiens
catggatatattgtacagtagc

SEQ ID NO: 8129373 - DNA, 22 bp, Homo sapiens
catggatatattgtacagtagc

SEQ ID NO: 8129374 - DNA, 22 bp, Homo sapiens
catggatagatgaatgcttaaa

SEQ ID NO: 8129375 - DNA, 22 bp, Homo sapiens
catggacatatgagacctttcc

SEQ ID NO: 8129376 - DNA, 22 bp, Homo sapiens
catggaatgtgagttgtttagt

SEQ ID NO: 8129377 - DNA, 22 bp, Homo sapiens
catggacaacctccattcgagt

SEQ ID NO: 8129378 - DNA, 22 bp, Homo sapiens
catggacagtgggacagtgtgt

SEQ ID NO: 8129379 - DNA, 22 bp, Homo sapiens
catgggggctgaggctgctgta

SEQ ID NO: 8129380 - DNA, 22 bp, Homo sapiens
catggggatgaggctgagactt

SEQ ID NO: 8129381 - DNA, 23 bp, Homo sapiens
catggggagcagtgctcctgacc

SEQ ID NO: 8129382 - DNA, 22 bp, Homo sapiens
ccaagccgcggctcctcctgcg

SEQ ID NO: 8129383 - DNA, 22 bp, Homo sapiens
ccaaggtgggcagatcacgagg

SEQ ID NO: 8129384 - DNA, 18 bp, Homo sapiens
aggcaggctggagtgact

SEQ ID NO: 8129385 - DNA, 22 bp, Homo sapiens
ccaatactctttctccctgtgt

SEQ ID NO: 8129386 - DNA, 22 bp, Homo sapiens
ccaatactgttgattcatagtg

SEQ ID NO: 8129387 - DNA, 22 bp, Homo sapiens
ccaatactgaacttaaaagtat

SEQ ID NO: 8129388 - DNA, 22 bp, Homo sapiens
ccaatacttagattaaaatagt

SEQ ID NO: 8129389 - DNA, 22 bp, Homo sapiens
acatagagcattggatatggga

SEQ ID NO: 8129390 - DNA, 20 bp, Homo sapiens
acatagctatagaaagtcga

SEQ ID NO: 8129391 - DNA, 22 bp, Homo sapiens
acatagctcagcataatcgtgg

SEQ ID NO: 8129392 - DNA, 22 bp, Homo sapiens
acatagctcagtatcacttact

SEQ ID NO: 8129393 - DNA, 21 bp, Homo sapiens
aggcagctggaaggcctggct

SEQ ID NO: 8129394 - DNA, 21 bp, Homo sapiens
acagtttattagagtaagtgc

SEQ ID NO: 8129395 - DNA, 22 bp, Homo sapiens
acagtttgagaaccactagcct

SEQ ID NO: 8129396 - DNA, 22 bp, Homo sapiens
acagtttaggatgagagaacac

SEQ ID NO: 8129397 - DNA, 22 bp, Homo sapiens
acagtcaggaatttgtaaaacg

SEQ ID NO: 8129398 - DNA, 22 bp, Homo sapiens
aggagcactgagccagcatggg

SEQ ID NO: 8129399 - DNA, 22 bp, Homo sapiens
aggagcagaactgttgtggagg

SEQ ID NO: 8129400 - DNA, 22 bp, Homo sapiens
acagtaaacaatgcagcaaatt

SEQ ID NO: 8129401 - DNA, 22 bp, Homo sapiens
aggacacagctcttcagtaaga

SEQ ID NO: 8129402 - DNA, 22 bp, Homo sapiens
aggacacactgttctcacgtaa

SEQ ID NO: 8129403 - DNA, 21 bp, Homo sapiens
acagggcttcagggagggtta

SEQ ID NO: 8129404 - DNA, 23 bp, Homo sapiens
acaggaggggacaggtggccgtg

SEQ ID NO: 8129405 - DNA, 22 bp, Homo sapiens
acaggagaaatctggtcaaaag

SEQ ID NO: 8129406 - DNA, 22 bp, Homo sapiens
acagctgggaactcacacagca

SEQ ID NO: 8129407 - DNA, 17 bp, Homo sapiens
agctgacatcaaaactt

SEQ ID NO: 8129408 - DNA, 22 bp, Homo sapiens
agctctgggtcacggctgccga

SEQ ID NO: 8129409 - DNA, 22 bp, Homo sapiens
agctctggggtggagcccagga

SEQ ID NO: 8129410 - DNA, 19 bp, Homo sapiens
acatgttttgcagaacagc

SEQ ID NO: 8129411 - DNA, 22 bp, Homo sapiens
acatgctcattaaatattagct

SEQ ID NO: 8129412 - DNA, 22 bp, Homo sapiens
acatttggacaatagtagacaa

SEQ ID NO: 8129413 - DNA, 22 bp, Homo sapiens
acatttggcaagaaagagaaac

SEQ ID NO: 8129414 - DNA, 22 bp, Homo sapiens
acatttggtaacacttgagcat

SEQ ID NO: 8129415 - DNA, 22 bp, Homo sapiens
acatttctttctattcagtagc

SEQ ID NO: 8129416 - DNA, 22 bp, Homo sapiens
aggctgagctggtagtgagtac

SEQ ID NO: 8129417 - DNA, 22 bp, Homo sapiens
acattgcaataataattctctt

SEQ ID NO: 8129418 - DNA, 22 bp, Homo sapiens
acatttctaatttaatgtaaca

SEQ ID NO: 8129419 - DNA, 22 bp, Homo sapiens
acatttctagttgttcatctcc

SEQ ID NO: 8129420 - DNA, 21 bp, Homo sapiens
agggcagattagctgtaagag

SEQ ID NO: 8129421 - DNA, 22 bp, Homo sapiens
agggcagatggaacttccccga

SEQ ID NO: 8129422 - DNA, 22 bp, Homo sapiens
accagctagggtagcacatctc

SEQ ID NO: 8129423 - DNA, 22 bp, Homo sapiens
agggctgcccagtgtgagagct

SEQ ID NO: 8129424 - DNA, 22 bp, Homo sapiens
agggctgccatttctggcccaa

SEQ ID NO: 8129425 - DNA, 19 bp, Homo sapiens
accaggcctcagaggccct

SEQ ID NO: 8129426 - DNA, 22 bp, Homo sapiens
agggggcccttgcaggtgagcg

SEQ ID NO: 8129427 - DNA, 22 bp, Homo sapiens
agggggcaggagagacctgctg

SEQ ID NO: 8129428 - DNA, 22 bp, Homo sapiens
agggggagtttcagttagaaag

SEQ ID NO: 8129429 - DNA, 22 bp, Homo sapiens
agggggagcttggctactcctg

SEQ ID NO: 8129430 - DNA, 22 bp, Homo sapiens
agggggaggctgtgctgcgtct

SEQ ID NO: 8129431 - DNA, 22 bp, Homo sapiens
agggctgccccagtccagccgg

SEQ ID NO: 8129432 - DNA, 22 bp, Homo sapiens
agggctgctaccttaatcagtt

SEQ ID NO: 8129433 - DNA, 22 bp, Homo sapiens
agggctgcctgctctgcattga

SEQ ID NO: 8129434 - DNA, 22 bp, Homo sapiens
agggctgcctgactccagagcc

SEQ ID NO: 8129435 - DNA, 22 bp, Homo sapiens
agggctgctatgttgattcaga

SEQ ID NO: 8129436 - DNA, 22 bp, Homo sapiens
agggctgctcctccttcaggcc

SEQ ID NO: 8129437 - DNA, 19 bp, Homo sapiens
agggctgctctggcctggg

SEQ ID NO: 8129438 - DNA, 20 bp, Homo sapiens
actctgtaggtaatgagact

SEQ ID NO: 8129439 - DNA, 22 bp, Homo sapiens
agtgcaattttgctttcccaat

SEQ ID NO: 8129440 - DNA, 22 bp, Homo sapiens
agtgcatagggggatgcacagc

SEQ ID NO: 8129441 - DNA, 22 bp, Homo sapiens
actgaggacagtgaggagggct

SEQ ID NO: 8129442 - DNA, 22 bp, Homo sapiens
agtggcagtggaaagcacacgg

SEQ ID NO: 8129443 - DNA, 22 bp, Homo sapiens
agtgtactgctgcggccgggac

SEQ ID NO: 8129444 - DNA, 22 bp, Homo sapiens
actggaaaaccactgaaatgag

SEQ ID NO: 8129445 - DNA, 22 bp, Homo sapiens
actggaaaggctctgaatggga

SEQ ID NO: 8129446 - DNA, 22 bp, Homo sapiens
acggcgggagggtcactggcca

SEQ ID NO: 8129447 - DNA, 22 bp, Homo sapiens
actagacatcgagctacagagt

SEQ ID NO: 8129448 - DNA, 22 bp, Homo sapiens
agtatttcttcatatgattact

SEQ ID NO: 8129449 - DNA, 22 bp, Homo sapiens
actagtctgcattacaaaatag

SEQ ID NO: 8129450 - DNA, 22 bp, Homo sapiens
acctggagtcatttgaggagta

SEQ ID NO: 8129451 - DNA, 19 bp, Homo sapiens
acctggcctcttgagcaag

SEQ ID NO: 8129452 - DNA, 22 bp, Homo sapiens
acctcccttgctaaagactgtg

SEQ ID NO: 8129453 - DNA, 22 bp, Homo sapiens
acctgaatttgaaatgtttatt

SEQ ID NO: 8129454 - DNA, 22 bp, Homo sapiens
acctgaattttaatccttgctc

SEQ ID NO: 8129455 - DNA, 22 bp, Homo sapiens
acctgaattttggatgagctgt

SEQ ID NO: 8129456 - DNA, 22 bp, Homo sapiens
acctgaattgtcatatcttatt

SEQ ID NO: 8129457 - DNA, 22 bp, Homo sapiens
acctgaattgatttgacctgta

SEQ ID NO: 8129458 - DNA, 22 bp, Homo sapiens
acctgaatccaaactcaacaat

SEQ ID NO: 8129459 - DNA, 22 bp, Homo sapiens
acctgaatccccagggccttcc

SEQ ID NO: 8129460 - DNA, 22 bp, Homo sapiens
actttctcaggaattcacagac

SEQ ID NO: 8129461 - DNA, 22 bp, Homo sapiens
atatttcagctttacttaggaa

SEQ ID NO: 8129462 - DNA, 22 bp, Homo sapiens
atatttcacgtaggttgttttc

SEQ ID NO: 8129463 - DNA, 21 bp, Homo sapiens
atatttctcataaggttatgg

SEQ ID NO: 8129464 - DNA, 22 bp, Homo sapiens
atatttcatggggttccatact

SEQ ID NO: 8129465 - DNA, 22 bp, Homo sapiens
atatttcatggggttccatact

SEQ ID NO: 8129466 - DNA, 22 bp, Homo sapiens
atattcctgacttaatttttga

SEQ ID NO: 8129467 - DNA, 22 bp, Homo sapiens
atattctagccaaagtgtgagc

SEQ ID NO: 8129468 - DNA, 22 bp, Homo sapiens
agaaagtgaacgtgttcagttt

SEQ ID NO: 8129469 - DNA, 22 bp, Homo sapiens
agaaagtgaccttgaaaactgg

SEQ ID NO: 8129470 - DNA, 22 bp, Homo sapiens
agaaagttatcacaaaattgag

SEQ ID NO: 8129471 - DNA, 22 bp, Homo sapiens
agaaagggctattttgaggtag

SEQ ID NO: 8129472 - DNA, 22 bp, Homo sapiens
agaaagggttctctgaggtgct

SEQ ID NO: 8129473 - DNA, 20 bp, Homo sapiens
agaacactggtgtattgtga

SEQ ID NO: 8129474 - DNA, 22 bp, Homo sapiens
agaacactgggaagttactaac

SEQ ID NO: 8129475 - DNA, 22 bp, Homo sapiens
agaaattaggaaagtaacactt

SEQ ID NO: 8129476 - DNA, 22 bp, Homo sapiens
agaacacttttaaatggcttgt

SEQ ID NO: 8129477 - DNA, 22 bp, Homo sapiens
agaacactgtaaagtcattgaa

SEQ ID NO: 8129478 - DNA, 22 bp, Homo sapiens
agaacacttgctcctgattctc

SEQ ID NO: 8129479 - DNA, 18 bp, Homo sapiens
agaacacttggttagatc

SEQ ID NO: 8129480 - DNA, 22 bp, Homo sapiens
agaacagatgtgggcagacctg

SEQ ID NO: 8129481 - DNA, 22 bp, Homo sapiens
agaacactgctagtataatcac

SEQ ID NO: 8129482 - DNA, 22 bp, Homo sapiens
atctaaaatgtggttagttggt

SEQ ID NO: 8129483 - DNA, 22 bp, Homo sapiens
atctaaagtgtcataagtagct

SEQ ID NO: 8129484 - DNA, 22 bp, Homo sapiens
atctcacatcctcagtagtgca

SEQ ID NO: 8129485 - DNA, 22 bp, Homo sapiens
atctcacactgggtttgagggt

SEQ ID NO: 8129486 - DNA, 22 bp, Homo sapiens
atctaagctcacaggcttgttg

SEQ ID NO: 8129487 - DNA, 22 bp, Homo sapiens
atctaattttcactcatttgct

SEQ ID NO: 8129488 - DNA, 22 bp, Homo sapiens
atctatttctgctaataacaat

SEQ ID NO: 8129489 - DNA, 20 bp, Homo sapiens
atcggcttgcctggaaacaa

SEQ ID NO: 8129490 - DNA, 22 bp, Homo sapiens
actttagtctgtttcattatct

SEQ ID NO: 8129491 - DNA, 22 bp, Homo sapiens
actttatcaggaatcacacagc

SEQ ID NO: 8129492 - DNA, 22 bp, Homo sapiens
acttaatcattctctctgcttt

SEQ ID NO: 8129493 - DNA, 22 bp, Homo sapiens
actgggaatggagcctgggcct

SEQ ID NO: 8129494 - DNA, 22 bp, Homo sapiens
ataatcctgctttttcactatt

SEQ ID NO: 8129495 - DNA, 22 bp, Homo sapiens
ataatcttgtatttcctaaagt

SEQ ID NO: 8129496 - DNA, 22 bp, Homo sapiens
agcagggggccacagtcacagc

SEQ ID NO: 8129497 - DNA, 22 bp, Homo sapiens
agcaggggctcctccacagcca

SEQ ID NO: 8129498 - DNA, 22 bp, Homo sapiens
agcagggctttgtctctgtgaa

SEQ ID NO: 8129499 - DNA, 22 bp, Homo sapiens
cactgcacttcagcctgggtga

SEQ ID NO: 8129500 - DNA, 22 bp, Homo sapiens
cacctgaagatttagagattga

SEQ ID NO: 8129501 - DNA, 22 bp, Homo sapiens
cacctgaatggaactttgaacc

SEQ ID NO: 8129502 - DNA, 22 bp, Homo sapiens
agcatacaccctaaactgctta

SEQ ID NO: 8129503 - DNA, 22 bp, Homo sapiens
agcatacagtaggtgctcagtt

SEQ ID NO: 8129504 - DNA, 22 bp, Homo sapiens
cactgcttccattgttcacctg

SEQ ID NO: 8129505 - DNA, 22 bp, Homo sapiens
agcaggcaggaggctactaagg

SEQ ID NO: 8129506 - DNA, 22 bp, Homo sapiens
cacagtttggttttgctgtaat

SEQ ID NO: 8129507 - DNA, 22 bp, Homo sapiens
cacagtttatgatctcagtgaa

SEQ ID NO: 8129508 - DNA, 22 bp, Homo sapiens
cacagttgtttgttcataagaa

SEQ ID NO: 8129509 - DNA, 22 bp, Homo sapiens
cacagtttctataggtcagaat

SEQ ID NO: 8129510 - DNA, 22 bp, Homo sapiens
cacagtttcaataattattctt

SEQ ID NO: 8129511 - DNA, 22 bp, Homo sapiens
cacagtttctgaacactttgca

SEQ ID NO: 8129512 - DNA, 22 bp, Homo sapiens
cacagtttgcataggaaaaaca

SEQ ID NO: 8129513 - DNA, 22 bp, Homo sapiens
cacagtttgggtctccggggca

SEQ ID NO: 8129514 - DNA, 22 bp, Homo sapiens
cacagtttggtatagaagtgat

SEQ ID NO: 8129515 - DNA, 22 bp, Homo sapiens
cacacactgttaatgtaggagt

SEQ ID NO: 8129516 - DNA, 22 bp, Homo sapiens
cacacactcttcctggcaccta

SEQ ID NO: 8129517 - DNA, 22 bp, Homo sapiens
agcaggcaagcgtgagttctct

SEQ ID NO: 8129518 - DNA, 22 bp, Homo sapiens
agcacaggtgaaacagtcaggt

SEQ ID NO: 8129519 - DNA, 20 bp, Homo sapiens
agcacattaaacatactcct

SEQ ID NO: 8129520 - DNA, 22 bp, Homo sapiens
caaattaatgtgtctcaaaata

SEQ ID NO: 8129521 - DNA, 22 bp, Homo sapiens
agcacattagtatctaagaaca

SEQ ID NO: 8129522 - DNA, 22 bp, Homo sapiens
agcacattaagtgagttcatgt

SEQ ID NO: 8129523 - DNA, 22 bp, Homo sapiens
agcacatttaagtatgaaatat

SEQ ID NO: 8129524 - DNA, 22 bp, Homo sapiens
agcacattgatttattttggag

SEQ ID NO: 8129525 - DNA, 22 bp, Homo sapiens
agcacattcttgccttaacctc

SEQ ID NO: 8129526 - DNA, 22 bp, Homo sapiens
agcacattctgccttgctttgc

SEQ ID NO: 8129527 - DNA, 22 bp, Homo sapiens
agcacattcccacctgtacttc

SEQ ID NO: 8129528 - DNA, 22 bp, Homo sapiens
agcacattttatttaagaaaat

SEQ ID NO: 8129529 - DNA, 22 bp, Homo sapiens
agcacattttctcaaagctcat

SEQ ID NO: 8129530 - DNA, 22 bp, Homo sapiens
caatttttgtacttatagtact

SEQ ID NO: 8129531 - DNA, 22 bp, Homo sapiens
agcagcaggaggccattgtctt

SEQ ID NO: 8129532 - DNA, 22 bp, Homo sapiens
caagagagatgcagctcactca

SEQ ID NO: 8129533 - DNA, 22 bp, Homo sapiens
agcctctggtcctccctcagct

SEQ ID NO: 8129534 - DNA, 22 bp, Homo sapiens
agcctctgcacttcttacaggt

SEQ ID NO: 8129535 - DNA, 22 bp, Homo sapiens
agcctctgatggctcccaagga

SEQ ID NO: 8129536 - DNA, 22 bp, Homo sapiens
agcctctgctggccctggcact

SEQ ID NO: 8129537 - DNA, 22 bp, Homo sapiens
cagaggtgcatacaggtcatta

SEQ ID NO: 8129538 - DNA, 22 bp, Homo sapiens
agcctcttccagctcctttcta

SEQ ID NO: 8129539 - DNA, 22 bp, Homo sapiens
cagcagtttcctatggttcagc

SEQ ID NO: 8129540 - DNA, 22 bp, Homo sapiens
cagccctgcacgctgcctccgc

SEQ ID NO: 8129541 - DNA, 22 bp, Homo sapiens
cagccctgagaaggaggatctc

SEQ ID NO: 8129542 - DNA, 22 bp, Homo sapiens
cagcatcaacattctcagctct

SEQ ID NO: 8129543 - DNA, 21 bp, Homo sapiens
agctcagcaagatggaggctc

SEQ ID NO: 8129544 - DNA, 21 bp, Homo sapiens
agctcagccgggcacagtggc

SEQ ID NO: 8129545 - DNA, 22 bp, Homo sapiens
agctcagcttcctctccatgct

SEQ ID NO: 8129546 - DNA, 22 bp, Homo sapiens
cagctcaggaaggaaggccggc

SEQ ID NO: 8129547 - DNA, 19 bp, Homo sapiens
cagctcaggactcagcccc

SEQ ID NO: 8129548 - DNA, 22 bp, Homo sapiens
cagacaggtagggacagaacat

SEQ ID NO: 8129549 - DNA, 22 bp, Homo sapiens
cagacaggttgcaaaacttcaa

SEQ ID NO: 8129550 - DNA, 22 bp, Homo sapiens
cagacaggttgcaaaacttcaa

SEQ ID NO: 8129551 - DNA, 22 bp, Homo sapiens
cagagggaaaaggggagtaata

SEQ ID NO: 8129552 - DNA, 22 bp, Homo sapiens
cagagggacagtatgatgaaag

SEQ ID NO: 8129553 - DNA, 22 bp, Homo sapiens
cagagggacagtatgatgaaag

SEQ ID NO: 8129554 - DNA, 22 bp, Homo sapiens
agcccagagacaatgctcagta

SEQ ID NO: 8129555 - DNA, 22 bp, Homo sapiens
agcccagaaatgaaaggatgat

SEQ ID NO: 8129556 - DNA, 22 bp, Homo sapiens
agcccagagggtagcagaagaa

SEQ ID NO: 8129557 - DNA, 22 bp, Homo sapiens
agagatgacatgagggacttaa

SEQ ID NO: 8129558 - DNA, 22 bp, Homo sapiens
agagatggccttaggtgggaat

SEQ ID NO: 8129559 - DNA, 22 bp, Homo sapiens
atgtcaaatcagttttatcaga

SEQ ID NO: 8129560 - DNA, 22 bp, Homo sapiens
agagacagggttttgtcgtgtt

SEQ ID NO: 8129561 - DNA, 22 bp, Homo sapiens
agagaccaagggaatagtctca

SEQ ID NO: 8129562 - DNA, 21 bp, Homo sapiens
agagacagagaaagtaacatt

SEQ ID NO: 8129563 - DNA, 22 bp, Homo sapiens
agagatgaaaagtggagactgg

SEQ ID NO: 8129564 - DNA, 22 bp, Homo sapiens
atggctattttagagatcaagg

SEQ ID NO: 8129565 - DNA, 22 bp, Homo sapiens
atggctatttagagttaagcat

SEQ ID NO: 8129566 - DNA, 22 bp, Homo sapiens
atggccagcaagttcagaattt

SEQ ID NO: 8129567 - DNA, 22 bp, Homo sapiens
atggccagggtggcactgtggt

SEQ ID NO: 8129568 - DNA, 22 bp, Homo sapiens
agaccacagtcaggctcctggt

SEQ ID NO: 8129569 - DNA, 22 bp, Homo sapiens
agacaaaccttgttttatgatg

SEQ ID NO: 8129570 - DNA, 22 bp, Homo sapiens
atgaacaataatcatgtctatg

SEQ ID NO: 8129571 - DNA, 22 bp, Homo sapiens
atgaacaataaaatagatcaca

SEQ ID NO: 8129572 - DNA, 22 bp, Homo sapiens
atgaacaatctggcaagaactt

SEQ ID NO: 8129573 - DNA, 22 bp, Homo sapiens
atgaacaatgactacatattga

SEQ ID NO: 8129574 - DNA, 22 bp, Homo sapiens
agacaaaggattaatgatgatg

SEQ ID NO: 8129575 - DNA, 22 bp, Homo sapiens
agacaaaggattaatgatgatg

SEQ ID NO: 8129576 - DNA, 22 bp, Homo sapiens
atgaacaaaaacaaggcctgtt

SEQ ID NO: 8129577 - DNA, 22 bp, Homo sapiens
atgaacaacttgaagctccatg

SEQ ID NO: 8129578 - DNA, 22 bp, Homo sapiens
atgaaatttgctgctaagttcc

SEQ ID NO: 8129579 - DNA, 22 bp, Homo sapiens
atgaacaagagagggaagattc

SEQ ID NO: 8129580 - DNA, 22 bp, Homo sapiens
atgaacaagtatttgcatgagc

SEQ ID NO: 8129581 - DNA, 22 bp, Homo sapiens
atgaaatttgaccaattattta

SEQ ID NO: 8129582 - DNA, 22 bp, Homo sapiens
atgaaatttgaccaattattta

SEQ ID NO: 8129583 - DNA, 22 bp, Homo sapiens
atgaaattgatcttgaactttt

SEQ ID NO: 8129584 - DNA, 22 bp, Homo sapiens
atgaaattgatcttgaactttt

SEQ ID NO: 8129585 - DNA, 20 bp, Homo sapiens
atgaaattcctgttttctga

SEQ ID NO: 8129586 - DNA, 22 bp, Homo sapiens
atctcagaaagtttaatttttc

SEQ ID NO: 8129587 - DNA, 22 bp, Homo sapiens
atctcagacatgttgtccatga

SEQ ID NO: 8129588 - DNA, 22 bp, Homo sapiens
agaagtggtgtgtggccgagct

SEQ ID NO: 8129589 - DNA, 22 bp, Homo sapiens
agaagttatccaccttagatgc

SEQ ID NO: 8129590 - DNA, 22 bp, Homo sapiens
agaagttatccaccttagatgc

SEQ ID NO: 8129591 - DNA, 22 bp, Homo sapiens
atgacaaattcagaccatagca

SEQ ID NO: 8129592 - DNA, 22 bp, Homo sapiens
atgcacatgaggcaagcaaaat

SEQ ID NO: 8129593 - DNA, 22 bp, Homo sapiens
atgcactgttggatatatttgt

SEQ ID NO: 8129594 - DNA, 22 bp, Homo sapiens
agacagcagggagcaggattca

SEQ ID NO: 8129595 - DNA, 22 bp, Homo sapiens
agacagcagggagcaggattca

SEQ ID NO: 8129596 - DNA, 22 bp, Homo sapiens
agacagcatgatacatgatgct

SEQ ID NO: 8129597 - DNA, 22 bp, Homo sapiens
agacagctccaagtgtctctgt

SEQ ID NO: 8129598 - DNA, 20 bp, Homo sapiens
agacaggagcccccattcag

SEQ ID NO: 8129599 - DNA, 22 bp, Homo sapiens
agacaggagagggaactgccgg

SEQ ID NO: 8129600 - DNA, 23 bp, Homo sapiens
agacagcttagagtttgcctctc

SEQ ID NO: 8129601 - DNA, 22 bp, Homo sapiens
agacagctgggagtgtccttct

SEQ ID NO: 8129602 - DNA, 21 bp, Homo sapiens
atgtttacactgactactgtg

SEQ ID NO: 8129603 - DNA, 22 bp, Homo sapiens
agaggacaaaatgagaagtgct

SEQ ID NO: 8129604 - DNA, 22 bp, Homo sapiens
agaggaggctctgggatcgtcc

SEQ ID NO: 8129605 - DNA, 22 bp, Homo sapiens
agaggaggccaggcccacacct

SEQ ID NO: 8129606 - DNA, 22 bp, Homo sapiens
agaggaggcagcttaactcagt

SEQ ID NO: 8129607 - DNA, 22 bp, Homo sapiens
agaggaggatttgtaaaggtct

SEQ ID NO: 8129608 - DNA, 22 bp, Homo sapiens
agaggaggaagagctttaaaat

SEQ ID NO: 8129609 - DNA, 20 bp, Homo sapiens
agaggaggattattttattc

SEQ ID NO: 8129610 - DNA, 22 bp, Homo sapiens
agaggagaatccgtttccttgc

SEQ ID NO: 8129611 - DNA, 22 bp, Homo sapiens
agaggactgttggtcttagaaa

SEQ ID NO: 8129612 - DNA, 22 bp, Homo sapiens
agaggagctgggaggccctcgt

SEQ ID NO: 8129613 - DNA, 22 bp, Homo sapiens
attgcatatgcagcacatcagg

SEQ ID NO: 8129614 - DNA, 18 bp, Homo sapiens
agagggaatcagttggat

SEQ ID NO: 8129615 - DNA, 22 bp, Homo sapiens
agagggaaatccaggagtgctt

SEQ ID NO: 8129616 - DNA, 22 bp, Homo sapiens
agagggagaaaagaatcagttg

SEQ ID NO: 8129617 - DNA, 22 bp, Homo sapiens
agaggcctgtgtgctccagtgg

SEQ ID NO: 8129618 - DNA, 22 bp, Homo sapiens
attcatttgctattgtgtatgg

SEQ ID NO: 8129619 - DNA, 22 bp, Homo sapiens
attcatttagagggattaagca

SEQ ID NO: 8129620 - DNA, 22 bp, Homo sapiens
agaggcctttctgttgagtgaa

SEQ ID NO: 8129621 - DNA, 22 bp, Homo sapiens
agaggtcttaagatctagactg

SEQ ID NO: 8129622 - DNA, 22 bp, Homo sapiens
attgccacctgttgctatggag

SEQ ID NO: 8129623 - DNA, 22 bp, Homo sapiens
attgccaactgcattacagtcc

SEQ ID NO: 8129624 - DNA, 19 bp, Homo sapiens
attgccacattgggtcagg

SEQ ID NO: 8129625 - DNA, 22 bp, Homo sapiens
attgctcagcacaagcagcaga

SEQ ID NO: 8129626 - DNA, 22 bp, Homo sapiens
attgctacttcctcaggaaaac

SEQ ID NO: 8129627 - DNA, 22 bp, Homo sapiens
attgctaggaacaggttgcacc

SEQ ID NO: 8129628 - DNA, 20 bp, Homo sapiens
agatacagtttaattactct

SEQ ID NO: 8129629 - DNA, 22 bp, Homo sapiens
atttcacaggccagtggtgggg

SEQ ID NO: 8129630 - DNA, 22 bp, Homo sapiens
atttcacattaatttgatgctc

SEQ ID NO: 8129631 - DNA, 22 bp, Homo sapiens
atttcacagcgtggttgactgc

SEQ ID NO: 8129632 - DNA, 22 bp, Homo sapiens
atttcacagctgctgttcaggt

SEQ ID NO: 8129633 - DNA, 22 bp, Homo sapiens
atttctcattttgcttcaaagg

SEQ ID NO: 8129634 - DNA, 22 bp, Homo sapiens
atttctcatgtacaaaaacact

SEQ ID NO: 8129635 - DNA, 18 bp, Homo sapiens
agctctggggagatgggc

SEQ ID NO: 8129636 - DNA, 22 bp, Homo sapiens
agctctgggggaaagtctgctc

SEQ ID NO: 8129637 - DNA, 22 bp, Homo sapiens
agctatttctcttattatatcc

SEQ ID NO: 8129638 - DNA, 22 bp, Homo sapiens
acagcaaaggacgaacactctg

SEQ ID NO: 8129639 - DNA, 22 bp, Homo sapiens
agctatgctgcagttgtggagt

SEQ ID NO: 8129640 - DNA, 22 bp, Homo sapiens
acagcaatctgagagacatagt

SEQ ID NO: 8129641 - DNA, 22 bp, Homo sapiens
acagcaatcaatatggcattct

SEQ ID NO: 8129642 - DNA, 23 bp, Homo sapiens
acagcaagaggaccagatgtgag

SEQ ID NO: 8129643 - DNA, 22 bp, Homo sapiens
acagagagggagtgataaatcc

SEQ ID NO: 8129644 - DNA, 22 bp, Homo sapiens
acagagaggtaaaatatatagt

SEQ ID NO: 8129645 - DNA, 22 bp, Homo sapiens
acagagcaggtccagaagtgcc

SEQ ID NO: 8129646 - DNA, 22 bp, Homo sapiens
acagagcatataaagtgctttg

SEQ ID NO: 8129647 - DNA, 22 bp, Homo sapiens
agcccccaggagtctccacgcc

SEQ ID NO: 8129648 - DNA, 22 bp, Homo sapiens
agcccccaggatgcaaaatgac

SEQ ID NO: 8129649 - DNA, 22 bp, Homo sapiens
agcccccagtctaaactgttgg

SEQ ID NO: 8129650 - DNA, 19 bp, Homo sapiens
agcccccagacagcaggcc

SEQ ID NO: 8129651 - DNA, 19 bp, Homo sapiens
acagagtgatgaggataga

SEQ ID NO: 8129652 - DNA, 22 bp, Homo sapiens
acagagtggagttcagtaaata

SEQ ID NO: 8129653 - DNA, 22 bp, Homo sapiens
acacatatatttgcatatacac

SEQ ID NO: 8129654 - DNA, 22 bp, Homo sapiens
agcagggcagttaaagggtcct

SEQ ID NO: 8129655 - DNA, 22 bp, Homo sapiens
agcagggcatgaataagggttt

SEQ ID NO: 8129656 - DNA, 22 bp, Homo sapiens
acactgcagatgtaatttgagt

SEQ ID NO: 8129657 - DNA, 22 bp, Homo sapiens
acacatttgggctcctacataa

SEQ ID NO: 8129658 - DNA, 23 bp, Homo sapiens
acacatttttcccgttctgaggt

SEQ ID NO: 8129659 - DNA, 22 bp, Homo sapiens
acactgtgcatgcatatacaca

SEQ ID NO: 8129660 - DNA, 22 bp, Homo sapiens
acagaacaagacctgcttattg

SEQ ID NO: 8129661 - DNA, 22 bp, Homo sapiens
acagaaattgctaatagctcat

SEQ ID NO: 8129662 - DNA, 23 bp, Homo sapiens
agacactgtaaagaattgcagtt

SEQ ID NO: 8129663 - DNA, 22 bp, Homo sapiens
agacagcagaaactagagcact

SEQ ID NO: 8129664 - DNA, 19 bp, Homo sapiens
agacagagctcagtgggtt

SEQ ID NO: 8129665 - DNA, 22 bp, Homo sapiens
agaaggtggctactcagtcatc

SEQ ID NO: 8129666 - DNA, 23 bp, Homo sapiens
agaaggtgggcctgctgagttat

SEQ ID NO: 8129667 - DNA, 22 bp, Homo sapiens
aatgtcatgagcctgctcttgt

SEQ ID NO: 8129668 - DNA, 22 bp, Homo sapiens
aatgtcaattaccagaacagaa

SEQ ID NO: 8129669 - DNA, 22 bp, Homo sapiens
aatgtcaatctcagagaacaca

SEQ ID NO: 8129670 - DNA, 22 bp, Homo sapiens
aatgtcattggtaaagattagg

SEQ ID NO: 8129671 - DNA, 22 bp, Homo sapiens
aatgtcatttaaagacaaagaa

SEQ ID NO: 8129672 - DNA, 22 bp, Homo sapiens
aatgttctgcaactgttttcat

SEQ ID NO: 8129673 - DNA, 22 bp, Homo sapiens
aatgttcaaacagatcacttag

SEQ ID NO: 8129674 - DNA, 19 bp, Homo sapiens
aatgtttaagagaaaaagg

SEQ ID NO: 8129675 - DNA, 22 bp, Homo sapiens
aatgttgttctctgcaaacaca

SEQ ID NO: 8129676 - DNA, 22 bp, Homo sapiens
aatgttgtatggtgccttcaga

SEQ ID NO: 8129677 - DNA, 22 bp, Homo sapiens
aatgtttcaattaagtctttta

SEQ ID NO: 8129678 - DNA, 22 bp, Homo sapiens
aatgtttgagcatctacatgct

SEQ ID NO: 8129679 - DNA, 22 bp, Homo sapiens
aatgtttgaccaaaaaactgca

SEQ ID NO: 8129680 - DNA, 22 bp, Homo sapiens
aatgtttgcatctattcacatg

SEQ ID NO: 8129681 - DNA, 22 bp, Homo sapiens
aattaggcaaattaatttctct

SEQ ID NO: 8129682 - DNA, 22 bp, Homo sapiens
aattatatgttaatcttcaatt

SEQ ID NO: 8129683 - DNA, 23 bp, Homo sapiens
aatttagtttgagacattagcct

SEQ ID NO: 8129684 - DNA, 22 bp, Homo sapiens
aatttagtccttacagtgcaga

SEQ ID NO: 8129685 - DNA, 22 bp, Homo sapiens
aatttagtgtaaagctactgga

SEQ ID NO: 8129686 - DNA, 22 bp, Homo sapiens
acaaatgattatcacagaggag

SEQ ID NO: 8129687 - DNA, 22 bp, Homo sapiens
acaaatgactatttggtacagg

SEQ ID NO: 8129688 - DNA, 22 bp, Homo sapiens
aattttattagaaggcaagggg

SEQ ID NO: 8129689 - DNA, 22 bp, Homo sapiens
aattttattaactggatgtagc

SEQ ID NO: 8129690 - DNA, 22 bp, Homo sapiens
agcaagcagaattctgtcctct

SEQ ID NO: 8129691 - DNA, 22 bp, Homo sapiens
agcacaggtaatacagagtaac

SEQ ID NO: 8129692 - DNA, 22 bp, Homo sapiens
acaatgttttgaaacatctagg

SEQ ID NO: 8129693 - DNA, 22 bp, Homo sapiens
agatggggcagaatggagccat

SEQ ID NO: 8129694 - DNA, 22 bp, Homo sapiens
aaggcatggcagggtttacaca

SEQ ID NO: 8129695 - DNA, 22 bp, Homo sapiens
acatgtgtctaagaatgaaaga

SEQ ID NO: 8129696 - DNA, 22 bp, Homo sapiens
accatgagttatttgacaggcc

SEQ ID NO: 8129697 - DNA, 22 bp, Homo sapiens
accatgaggaaatacatttgtg

SEQ ID NO: 8129698 - DNA, 22 bp, Homo sapiens
aaggtggggtcctgtcatctga

SEQ ID NO: 8129699 - DNA, 22 bp, Homo sapiens
aaggtcttaagaactgctacat

SEQ ID NO: 8129700 - DNA, 22 bp, Homo sapiens
acagtagagtaaaagggagcct

SEQ ID NO: 8129701 - DNA, 22 bp, Homo sapiens
acagttgttttccagatatgtt

SEQ ID NO: 8129702 - DNA, 23 bp, Homo sapiens
acagggctgtccagggctaggtc

SEQ ID NO: 8129703 - DNA, 22 bp, Homo sapiens
aatgagaaaacacagaggaggt

SEQ ID NO: 8129704 - DNA, 19 bp, Homo sapiens
aatgactgagtacattgtc

SEQ ID NO: 8129705 - DNA, 22 bp, Homo sapiens
aatgaccagcgcctgcagaggg

SEQ ID NO: 8129706 - DNA, 22 bp, Homo sapiens
aatgaactggagaacaatgacc

SEQ ID NO: 8129707 - DNA, 22 bp, Homo sapiens
aatgaacagtgggtgaggtacc

SEQ ID NO: 8129708 - DNA, 22 bp, Homo sapiens
aatgaacatataaagagatctt

SEQ ID NO: 8129709 - DNA, 22 bp, Homo sapiens
aatgaacatataaagagatctt

SEQ ID NO: 8129710 - DNA, 22 bp, Homo sapiens
agaaaacataggagacaggaaa

SEQ ID NO: 8129711 - DNA, 22 bp, Homo sapiens
aatgaacaagaaagactttgag

SEQ ID NO: 8129712 - DNA, 22 bp, Homo sapiens
aatgaacaagagagagaacttt

SEQ ID NO: 8129713 - DNA, 22 bp, Homo sapiens
aatgaacaagagagagaacttt

SEQ ID NO: 8129714 - DNA, 22 bp, Homo sapiens
aatgaacaagaaagactttgag

SEQ ID NO: 8129715 - DNA, 22 bp, Homo sapiens
aatgaacacagccctctacttt

SEQ ID NO: 8129716 - DNA, 22 bp, Homo sapiens
acttgttgccctcctgaaaatt

SEQ ID NO: 8129717 - DNA, 22 bp, Homo sapiens
aatcataattgtatacattcat

SEQ ID NO: 8129718 - DNA, 22 bp, Homo sapiens
acttgagaaaccaagtagaaag

SEQ ID NO: 8129719 - DNA, 22 bp, Homo sapiens
acttgagagaatcggaggagtc

SEQ ID NO: 8129720 - DNA, 22 bp, Homo sapiens
aatatatgagggagctatttga

SEQ ID NO: 8129721 - DNA, 19 bp, Homo sapiens
acttgaaagcagagagttt

SEQ ID NO: 8129722 - DNA, 22 bp, Homo sapiens
acttgaataggtgtcaaggcca

SEQ ID NO: 8129723 - DNA, 22 bp, Homo sapiens
acttgaaacatctttaaatgta

SEQ ID NO: 8129724 - DNA, 22 bp, Homo sapiens
acttgaaaccctgagatgataa

SEQ ID NO: 8129725 - DNA, 22 bp, Homo sapiens
aagtgttttctccccaccaggc

SEQ ID NO: 8129726 - DNA, 22 bp, Homo sapiens
aagttactttacctctttagct

SEQ ID NO: 8129727 - DNA, 22 bp, Homo sapiens
aagtttatgttggtaagatatc

SEQ ID NO: 8129728 - DNA, 22 bp, Homo sapiens
aataatgttgacgatagtctta

SEQ ID NO: 8129729 - DNA, 22 bp, Homo sapiens
aataatgtttatttgtattctc

SEQ ID NO: 8129730 - DNA, 22 bp, Homo sapiens
aataatttccagccaactggaa

SEQ ID NO: 8129731 - DNA, 22 bp, Homo sapiens
aataattgtcaactatgctaca

SEQ ID NO: 8129732 - DNA, 22 bp, Homo sapiens
aataattttagctcagagttgt

SEQ ID NO: 8129733 - DNA, 22 bp, Homo sapiens
aataattttgagagcctggaaa

SEQ ID NO: 8129734 - DNA, 23 bp, Homo sapiens
aacagccacactgctgagattca

SEQ ID NO: 8129735 - DNA, 22 bp, Homo sapiens
aacaaatgtaaaatgcagatgc

SEQ ID NO: 8129736 - DNA, 22 bp, Homo sapiens
aacaaatggaacacaaatcttt

SEQ ID NO: 8129737 - DNA, 22 bp, Homo sapiens
aaatgttttgctcccatgtggt

SEQ ID NO: 8129738 - DNA, 22 bp, Homo sapiens
aaatgtttctacttgtgagcat

SEQ ID NO: 8129739 - DNA, 22 bp, Homo sapiens
aaatgtttctacttgtgagcat

SEQ ID NO: 8129740 - DNA, 22 bp, Homo sapiens
aaatgtttaagtgtaggagcaa

SEQ ID NO: 8129741 - DNA, 22 bp, Homo sapiens
aaatgttaggttgtactgagtc

SEQ ID NO: 8129742 - DNA, 22 bp, Homo sapiens
aaatgtgttcctttgctacaga

SEQ ID NO: 8129743 - DNA, 22 bp, Homo sapiens
aaatgtctatctggcatattcc

SEQ ID NO: 8129744 - DNA, 22 bp, Homo sapiens
aaatgtgtgcacaaagacagct

SEQ ID NO: 8129745 - DNA, 22 bp, Homo sapiens
aaatgtgtatatgaaacatgat

SEQ ID NO: 8129746 - DNA, 22 bp, Homo sapiens
aacaaagtcgttgcctagaaga

SEQ ID NO: 8129747 - DNA, 22 bp, Homo sapiens
aacaaactcaaatggaagagtg

SEQ ID NO: 8129748 - DNA, 22 bp, Homo sapiens
aacaaacctgggtggagaaagg

SEQ ID NO: 8129749 - DNA, 22 bp, Homo sapiens
aacaaaccttccctatacgtct

SEQ ID NO: 8129750 - DNA, 22 bp, Homo sapiens
aaattctatgtcaatgtttatt

SEQ ID NO: 8129751 - DNA, 20 bp, Homo sapiens
aacagggcagaagcggagac

SEQ ID NO: 8129752 - DNA, 22 bp, Homo sapiens
aacatgctctggattgctgtga

SEQ ID NO: 8129753 - DNA, 22 bp, Homo sapiens
aacatgctctgtttcttggatg

SEQ ID NO: 8129754 - DNA, 22 bp, Homo sapiens
aacatgctcttcctggctagtc

SEQ ID NO: 8129755 - DNA, 22 bp, Homo sapiens
aacatgcttgcttagaatcagc

SEQ ID NO: 8129756 - DNA, 22 bp, Homo sapiens
aaccaaagaaaactgtggtgag

SEQ ID NO: 8129757 - DNA, 21 bp, Homo sapiens
aacatttcaggatccaaattg

SEQ ID NO: 8129758 - DNA, 22 bp, Homo sapiens
aactgtttaccatacacagtga

SEQ ID NO: 8129759 - DNA, 22 bp, Homo sapiens
aacttaaacccactcatgtaga

SEQ ID NO: 8129760 - DNA, 22 bp, Homo sapiens
aatgatatgcaaattatcatca

SEQ ID NO: 8129761 - DNA, 21 bp, Homo sapiens
aactgctggtcttttctgtct

SEQ ID NO: 8129762 - DNA, 22 bp, Homo sapiens
aactgctggggaggccaaactc

SEQ ID NO: 8129763 - DNA, 22 bp, Homo sapiens
aactgcataatatatcatgcag

SEQ ID NO: 8129764 - DNA, 19 bp, Homo sapiens
acacagggctagagttaca

SEQ ID NO: 8129765 - DNA, 22 bp, Homo sapiens
acacaggggaaagtggagctga

SEQ ID NO: 8129766 - DNA, 22 bp, Homo sapiens
acacagggtctagagttaggcc

SEQ ID NO: 8129767 - DNA, 22 bp, Homo sapiens
acacaggggctcggctgggtgc

SEQ ID NO: 8129768 - DNA, 18 bp, Homo sapiens
aagaggctgttctgtggg

SEQ ID NO: 8129769 - DNA, 22 bp, Homo sapiens
aagcagcattcagtgaaatgtg

SEQ ID NO: 8129770 - DNA, 22 bp, Homo sapiens
aagcagcatcctgggcagacct

SEQ ID NO: 8129771 - DNA, 22 bp, Homo sapiens
acagagtacattcagagactat

SEQ ID NO: 8129772 - DNA, 22 bp, Homo sapiens
aagcattgtaagcagaagatgc

SEQ ID NO: 8129773 - DNA, 22 bp, Homo sapiens
aagcatttatagataagaattt

SEQ ID NO: 8129774 - DNA, 22 bp, Homo sapiens
aagcatttcaatataatattca

SEQ ID NO: 8129775 - DNA, 22 bp, Homo sapiens
aagcatgtactcaagcaaatgt

SEQ ID NO: 8129776 - DNA, 22 bp, Homo sapiens
aagcatggtttctgacgtcatg

SEQ ID NO: 8129777 - DNA, 22 bp, Homo sapiens
aagcatttcaggtagagatatt

SEQ ID NO: 8129778 - DNA, 22 bp, Homo sapiens
aatgttttcccagtgcagacga

SEQ ID NO: 8129779 - DNA, 22 bp, Homo sapiens
aatgttttctgactgctaactt

SEQ ID NO: 8129780 - DNA, 22 bp, Homo sapiens
aagaagcactttcctacatgtt

SEQ ID NO: 8129781 - DNA, 22 bp, Homo sapiens
aagaaatggcttcatctgagta

SEQ ID NO: 8129782 - DNA, 22 bp, Homo sapiens
aatgttttaaaagagattgaga

SEQ ID NO: 8129783 - DNA, 22 bp, Homo sapiens
aagacaggaaaagctccaggcc

SEQ ID NO: 8129784 - DNA, 22 bp, Homo sapiens
aagacactaagctttcaggata

SEQ ID NO: 8129785 - DNA, 22 bp, Homo sapiens
aattgttgtacagaataaatga

SEQ ID NO: 8129786 - DNA, 22 bp, Homo sapiens
aattgttgggtattcctgtgac

SEQ ID NO: 8129787 - DNA, 20 bp, Homo sapiens
aattgttgactccccagaga

SEQ ID NO: 8129788 - DNA, 22 bp, Homo sapiens
aattgttgagcataaattatcg

SEQ ID NO: 8129789 - DNA, 22 bp, Homo sapiens
aattgttgggccctaccccaga

SEQ ID NO: 8129790 - DNA, 22 bp, Homo sapiens
aattgtcttgaaagcaacactt

SEQ ID NO: 8129791 - DNA, 22 bp, Homo sapiens
aagaagcagagctgtgggtgtt

SEQ ID NO: 8129792 - DNA, 22 bp, Homo sapiens
aagaagcactttcctacatgtt

SEQ ID NO: 8129793 - DNA, 20 bp, Homo sapiens
acaaagactggaaaagcaag

SEQ ID NO: 8129794 - DNA, 22 bp, Homo sapiens
aagagagaacacagcttgggca

SEQ ID NO: 8129795 - DNA, 22 bp, Homo sapiens
aagagaggacatggtgaacctg

SEQ ID NO: 8129796 - DNA, 17 bp, Homo sapiens
aagagaggctgagctgg

SEQ ID NO: 8129797 - DNA, 17 bp, Homo sapiens
aagagaggctgagctgg

SEQ ID NO: 8129798 - DNA, 22 bp, Homo sapiens
aagagaggggttgcatggaaat

SEQ ID NO: 8129799 - DNA, 22 bp, Homo sapiens
acaaggacgtcacttccacggt

SEQ ID NO: 8129800 - DNA, 22 bp, Homo sapiens
aaagaggaaccaagagcacgtg

SEQ ID NO: 8129801 - DNA, 22 bp, Homo sapiens
aaagaggatggagtagtcagct

SEQ ID NO: 8129802 - DNA, 22 bp, Homo sapiens
aaagagttgaaaactaacagtg

SEQ ID NO: 8129803 - DNA, 22 bp, Homo sapiens
aaagagttctgtttgagctgaa

SEQ ID NO: 8129804 - DNA, 22 bp, Homo sapiens
aaattaagagtaactctgtaga

SEQ ID NO: 8129805 - DNA, 22 bp, Homo sapiens
aaagagttgttgtataacagga

SEQ ID NO: 8129806 - DNA, 22 bp, Homo sapiens
aaattactttacactttcatct

SEQ ID NO: 8129807 - DNA, 22 bp, Homo sapiens
aaattaagggtgagaagagttg

SEQ ID NO: 8129808 - DNA, 21 bp, Homo sapiens
aaactgaccttgcctgagaca

SEQ ID NO: 8129809 - DNA, 22 bp, Homo sapiens
aaacagtgactggtacataata

SEQ ID NO: 8129810 - DNA, 22 bp, Homo sapiens
aaagttacagtaattcagtgta

SEQ ID NO: 8129811 - DNA, 22 bp, Homo sapiens
aaaagagagttgccagtctgta

SEQ ID NO: 8129812 - DNA, 22 bp, Homo sapiens
aaacaagcaagcacataatttt

SEQ ID NO: 8129813 - DNA, 22 bp, Homo sapiens
aaaaatcacttttataggcagc

SEQ ID NO: 8129814 - DNA, 21 bp, Homo sapiens
aaacagagctgagtaatagat

SEQ ID NO: 8129815 - DNA, 22 bp, Homo sapiens
aaaagacatatgtgggcattct

SEQ ID NO: 8129816 - DNA, 22 bp, Homo sapiens
aaaagacaggtgtctgcggccc

SEQ ID NO: 8129817 - DNA, 22 bp, Homo sapiens
aaaagacatctatttcaggcag

SEQ ID NO: 8129818 - DNA, 20 bp, Homo sapiens
aaaaacagtaatgctgaaga

SEQ ID NO: 8129819 - DNA, 22 bp, Homo sapiens
aaaatgaagcaaaggcattcag

SEQ ID NO: 8129820 - DNA, 22 bp, Homo sapiens
aaatgcatcagctcataagaga

SEQ ID NO: 8129821 - DNA, 22 bp, Homo sapiens
aaatgcatatcaaagacttgaa

SEQ ID NO: 8129822 - DNA, 22 bp, Homo sapiens
aaatcctaagcagaggaattta

SEQ ID NO: 8129823 - DNA, 22 bp, Homo sapiens
aaatccattctgttttaaaagt

SEQ ID NO: 8129824 - DNA, 22 bp, Homo sapiens
aaatcctaaaagtttgacttaa

SEQ ID NO: 8129825 - DNA, 22 bp, Homo sapiens
aaatcctaatgacaagtttagt

SEQ ID NO: 8129826 - DNA, 22 bp, Homo sapiens
aaatcctaataatgcactagtg

SEQ ID NO: 8129827 - DNA, 19 bp, Homo sapiens
aaatcctgaggttcaaaag

SEQ ID NO: 8129828 - DNA, 22 bp, Homo sapiens
aaatcctaccaagaaattccct

SEQ ID NO: 8129829 - DNA, 22 bp, Homo sapiens
aaatgtcaaagacgtgtttttg

SEQ ID NO: 8129830 - DNA, 22 bp, Homo sapiens
aagcatgcagactacccctagg

SEQ ID NO: 8129831 - DNA, 21 bp, Homo sapiens
aaataaggatagatggtttgg

SEQ ID NO: 8129832 - DNA, 22 bp, Homo sapiens
aaataattatagcgagtctatc

SEQ ID NO: 8129833 - DNA, 22 bp, Homo sapiens
aaatccatcaaatcttctagaa

SEQ ID NO: 8129834 - DNA, 22 bp, Homo sapiens
aaatccagtttgtcatttccca

SEQ ID NO: 8129835 - DNA, 22 bp, Homo sapiens
aaatactgtagataatagagtt

SEQ ID NO: 8129836 - DNA, 22 bp, Homo sapiens
aaatactgtagataatagagtt

SEQ ID NO: 8129837 - DNA, 22 bp, Homo sapiens
aaataattgagttggtcaatat

SEQ ID NO: 8129838 - DNA, 22 bp, Homo sapiens
aaatagatttctctgggtttgt

SEQ ID NO: 8129839 - DNA, 22 bp, Homo sapiens
aacagcagaaactgcaagctac

SEQ ID NO: 8129840 - DNA, 22 bp, Homo sapiens
aacagcaatagcactattcatt

SEQ ID NO: 8129841 - DNA, 22 bp, Homo sapiens
aaaggttttcatcacagcaaga

SEQ ID NO: 8129842 - DNA, 22 bp, Homo sapiens
aaaggtttccgagctttaattt

SEQ ID NO: 8129843 - DNA, 22 bp, Homo sapiens
aaagtgcagtaacttgcccaag

SEQ ID NO: 8129844 - DNA, 22 bp, Homo sapiens
aaagtcacatagcatcacttct

SEQ ID NO: 8129845 - DNA, 22 bp, Homo sapiens
aaagtagcttagttgatatttc

SEQ ID NO: 8129846 - DNA, 22 bp, Homo sapiens
ggcctctggtcaagacaagcat

SEQ ID NO: 8129847 - DNA, 22 bp, Homo sapiens
ggcctctggggtcctgagccca

SEQ ID NO: 8129848 - DNA, 22 bp, Homo sapiens
ggcctctcttgggacagctgtc

SEQ ID NO: 8129849 - DNA, 22 bp, Homo sapiens
ggcctctctgagagcagacgtt

SEQ ID NO: 8129850 - DNA, 21 bp, Homo sapiens
ggcctcccggaccgcagcgcc

SEQ ID NO: 8129851 - DNA, 22 bp, Homo sapiens
ggcctctgccccagccacacct

SEQ ID NO: 8129852 - DNA, 22 bp, Homo sapiens
ggcctctgcctcatctgggcac

SEQ ID NO: 8129853 - DNA, 19 bp, Homo sapiens
ggcctctgcaggccgcccc

SEQ ID NO: 8129854 - DNA, 22 bp, Homo sapiens
ggcctctgcaactggctgtggc

SEQ ID NO: 8129855 - DNA, 22 bp, Homo sapiens
ggctcagcaatgatgagcccct

SEQ ID NO: 8129856 - DNA, 22 bp, Homo sapiens
ggctcactgcaacttccgcctc

SEQ ID NO: 8129857 - DNA, 22 bp, Homo sapiens
ggctctgcctgcccagcagcac

SEQ ID NO: 8129858 - DNA, 22 bp, Homo sapiens
ggctctgcctgcctgagtgtcc

SEQ ID NO: 8129859 - DNA, 22 bp, Homo sapiens
ggctctgcctctgaccctctgg

SEQ ID NO: 8129860 - DNA, 22 bp, Homo sapiens
ggctctgcccgcggctgcccac

SEQ ID NO: 8129861 - DNA, 22 bp, Homo sapiens
ggctctgccatttcctagctgc

SEQ ID NO: 8129862 - DNA, 22 bp, Homo sapiens
ggctctgcccaggtggacagca

SEQ ID NO: 8129863 - DNA, 20 bp, Homo sapiens
ggctctgccccaccccgtcc

SEQ ID NO: 8129864 - DNA, 22 bp, Homo sapiens
ggctctgcatgcaggttgtcag

SEQ ID NO: 8129865 - DNA, 22 bp, Homo sapiens
ggctctgcatgtgagtgggtgg

SEQ ID NO: 8129866 - DNA, 22 bp, Homo sapiens
ggctctgcagtgacttgagggg

SEQ ID NO: 8129867 - DNA, 22 bp, Homo sapiens
ggctctgcagagggcccagctt

SEQ ID NO: 8129868 - DNA, 22 bp, Homo sapiens
ggctctgcactcagagtcattc

SEQ ID NO: 8129869 - DNA, 21 bp, Homo sapiens
ggccagctgcatatgtcactg

SEQ ID NO: 8129870 - DNA, 22 bp, Homo sapiens
ggccagctgctcagtgtctctg

SEQ ID NO: 8129871 - DNA, 22 bp, Homo sapiens
ggccagctgccaccagccctat

SEQ ID NO: 8129872 - DNA, 22 bp, Homo sapiens
ggccagctggagttccgggtgg

SEQ ID NO: 8129873 - DNA, 20 bp, Homo sapiens
ggccagctggaggcgccggg

SEQ ID NO: 8129874 - DNA, 22 bp, Homo sapiens
ggcccaggctggagtgcagtgg

SEQ ID NO: 8129875 - DNA, 22 bp, Homo sapiens
ggcccagctgtgcttccagccc

SEQ ID NO: 8129876 - DNA, 22 bp, Homo sapiens
ggcccagctgggcggggacacg

SEQ ID NO: 8129877 - DNA, 22 bp, Homo sapiens
ggcccatgcatcctgtgcagcc

SEQ ID NO: 8129878 - DNA, 22 bp, Homo sapiens
ggcccaggctggagtgcggtgg

SEQ ID NO: 8129879 - DNA, 22 bp, Homo sapiens
ggcagtggaggaccctgtgtct

SEQ ID NO: 8129880 - DNA, 22 bp, Homo sapiens
ggcagtgcccggtgcctcctct

SEQ ID NO: 8129881 - DNA, 22 bp, Homo sapiens
ggcagtgcaaggcagcctggat

SEQ ID NO: 8129882 - DNA, 20 bp, Homo sapiens
ggcagcgggttcgggcgcag

SEQ ID NO: 8129883 - DNA, 22 bp, Homo sapiens
ggcagctagagctctttaaagt

SEQ ID NO: 8129884 - DNA, 22 bp, Homo sapiens
ggcaggcttgatatggggggac

SEQ ID NO: 8129885 - DNA, 21 bp, Homo sapiens
ggcagcctctgtggaagggga

SEQ ID NO: 8129886 - DNA, 22 bp, Homo sapiens
ggcagccctttctggccagctc

SEQ ID NO: 8129887 - DNA, 22 bp, Homo sapiens
ggcacctggtaagtgctcagta

SEQ ID NO: 8129888 - DNA, 22 bp, Homo sapiens
ggaggaggtgggttaagttgta

SEQ ID NO: 8129889 - DNA, 22 bp, Homo sapiens
ggaggaggggtttacattggaa

SEQ ID NO: 8129890 - DNA, 22 bp, Homo sapiens
ggaggaggggtgactgaatgct

SEQ ID NO: 8129891 - DNA, 22 bp, Homo sapiens
ggcagatgttgcagtgagcaga

SEQ ID NO: 8129892 - DNA, 22 bp, Homo sapiens
ggcacgtgcctaaggagcaggc

SEQ ID NO: 8129893 - DNA, 22 bp, Homo sapiens
gggcagagagctggaactcctt

SEQ ID NO: 8129894 - DNA, 20 bp, Homo sapiens
gggcagagccagccagtccc

SEQ ID NO: 8129895 - DNA, 22 bp, Homo sapiens
gggcagagactcagaaacagaa

SEQ ID NO: 8129896 - DNA, 22 bp, Homo sapiens
gggcagaggctctggcccatcc

SEQ ID NO: 8129897 - DNA, 21 bp, Homo sapiens
gggcagaggggcctcctgggt

SEQ ID NO: 8129898 - DNA, 15 bp, Homo sapiens
gggcaggtctggggc

SEQ ID NO: 8129899 - DNA, 22 bp, Homo sapiens
gggcaggtgacctcttgtcctg

SEQ ID NO: 8129900 - DNA, 22 bp, Homo sapiens
gggcaggtgattttggctccat

SEQ ID NO: 8129901 - DNA, 22 bp, Homo sapiens
gggcaggtctgggtcagcctga

SEQ ID NO: 8129902 - DNA, 22 bp, Homo sapiens
gggcaggtgccagctccctgtc

SEQ ID NO: 8129903 - DNA, 22 bp, Homo sapiens
gggagctctccctgaggcctgg

SEQ ID NO: 8129904 - DNA, 22 bp, Homo sapiens
gggagcgggactgcgcaggctt

SEQ ID NO: 8129905 - DNA, 22 bp, Homo sapiens
gggccctggggcctgatttgca

SEQ ID NO: 8129906 - DNA, 22 bp, Homo sapiens
gggccctgtgatttcttgagga

SEQ ID NO: 8129907 - DNA, 22 bp, Homo sapiens
gggccggagctgggtcccgcgc

SEQ ID NO: 8129908 - DNA, 22 bp, Homo sapiens
gggccctgatctgtgagcgcag

SEQ ID NO: 8129909 - DNA, 22 bp, Homo sapiens
gggccctgccccgtggctctga

SEQ ID NO: 8129910 - DNA, 22 bp, Homo sapiens
gggccctggggatgtggacgcg

SEQ ID NO: 8129911 - DNA, 22 bp, Homo sapiens
gggccctgggattcagagcaag

SEQ ID NO: 8129912 - DNA, 22 bp, Homo sapiens
gggccctgcctaaggaacacac

SEQ ID NO: 8129913 - DNA, 22 bp, Homo sapiens
gggcccagtaccctctgccaag

SEQ ID NO: 8129914 - DNA, 22 bp, Homo sapiens
gggcaggtgtttccaaggtgag

SEQ ID NO: 8129915 - DNA, 22 bp, Homo sapiens
gggccccttgctgctctgctgg

SEQ ID NO: 8129916 - DNA, 22 bp, Homo sapiens
gggccccttgtatctctggctc

SEQ ID NO: 8129917 - DNA, 22 bp, Homo sapiens
gggcaggtgtgcagagctgttg

SEQ ID NO: 8129918 - DNA, 22 bp, Homo sapiens
gggcaggtggagggcccagcca

SEQ ID NO: 8129919 - DNA, 22 bp, Homo sapiens
gggcaggtgcccagggccagag

SEQ ID NO: 8129920 - DNA, 22 bp, Homo sapiens
gggcaggtggcagggtctctgg

SEQ ID NO: 8129921 - DNA, 23 bp, Homo sapiens
gggctcagatttcattctgtgcc

SEQ ID NO: 8129922 - DNA, 22 bp, Homo sapiens
gggctcagccccattgaaccag

SEQ ID NO: 8129923 - DNA, 22 bp, Homo sapiens
gggctcagaggagtggcctggg

SEQ ID NO: 8129924 - DNA, 22 bp, Homo sapiens
gggctcagacatccctcctgga

SEQ ID NO: 8129925 - DNA, 21 bp, Homo sapiens
gggctcagcgctcggctcctc

SEQ ID NO: 8129926 - DNA, 22 bp, Homo sapiens
gggctcagctgggcgtgctggt

SEQ ID NO: 8129927 - DNA, 22 bp, Homo sapiens
gggctcagttctgcttcatgct

SEQ ID NO: 8129928 - DNA, 22 bp, Homo sapiens
gggctctgaatcccaggtctgc

SEQ ID NO: 8129929 - DNA, 22 bp, Homo sapiens
gggctctggatggagcctgcag

SEQ ID NO: 8129930 - DNA, 22 bp, Homo sapiens
gggctctggaaatgggagctcc

SEQ ID NO: 8129931 - DNA, 22 bp, Homo sapiens
ggctgtggggccgggtacagtg

SEQ ID NO: 8129932 - DNA, 22 bp, Homo sapiens
ggctgtggacactgagctcaga

SEQ ID NO: 8129933 - DNA, 22 bp, Homo sapiens
ggctgtgcgtcatccggctgca

SEQ ID NO: 8129934 - DNA, 22 bp, Homo sapiens
ggctgtgcgggcagccgtggga

SEQ ID NO: 8129935 - DNA, 22 bp, Homo sapiens
gggaaggcaggattctctggtg

SEQ ID NO: 8129936 - DNA, 22 bp, Homo sapiens
gggaaggcaccatggtgttcca

SEQ ID NO: 8129937 - DNA, 22 bp, Homo sapiens
gggaaggcagtgtctggttgaa

SEQ ID NO: 8129938 - DNA, 22 bp, Homo sapiens
gggaaggcatacctgagggaga

SEQ ID NO: 8129939 - DNA, 23 bp, Homo sapiens
gggagccaggacctcgcgcccca

SEQ ID NO: 8129940 - DNA, 22 bp, Homo sapiens
ggctggagacaacgtcctgccc

SEQ ID NO: 8129941 - DNA, 17 bp, Homo sapiens
ggctggagcagctcccc

SEQ ID NO: 8129942 - DNA, 22 bp, Homo sapiens
ggctctgcggcgtgtgcgcagg

SEQ ID NO: 8129943 - DNA, 22 bp, Homo sapiens
ggctctgcgcctgcggggactt

SEQ ID NO: 8129944 - DNA, 22 bp, Homo sapiens
ggctctgcgcggtaaagtgact

SEQ ID NO: 8129945 - DNA, 22 bp, Homo sapiens
ggctgccagtgagtgcagaccg

SEQ ID NO: 8129946 - DNA, 22 bp, Homo sapiens
ggctgcagttgtgtgaaggccg

SEQ ID NO: 8129947 - DNA, 22 bp, Homo sapiens
gtcctctgtagggctgggccac

SEQ ID NO: 8129948 - DNA, 22 bp, Homo sapiens
gtcagaaaacttccctttgagt

SEQ ID NO: 8129949 - DNA, 22 bp, Homo sapiens
gtatttttcagttaggagctta

SEQ ID NO: 8129950 - DNA, 22 bp, Homo sapiens
gtatttttagtagagtcggggt

SEQ ID NO: 8129951 - DNA, 22 bp, Homo sapiens
gtatttttaggtaaggaaagta

SEQ ID NO: 8129952 - DNA, 22 bp, Homo sapiens
gtatttttcattccaagtgaga

SEQ ID NO: 8129953 - DNA, 22 bp, Homo sapiens
gtacaaattaggaagctttgtg

SEQ ID NO: 8129954 - DNA, 22 bp, Homo sapiens
gtctatatattgcttgaataat

SEQ ID NO: 8129955 - DNA, 22 bp, Homo sapiens
gtctatgatattttgttatagc

SEQ ID NO: 8129956 - DNA, 22 bp, Homo sapiens
gtctaattcctgctcttactca

SEQ ID NO: 8129957 - DNA, 22 bp, Homo sapiens
gtgaaaaatcatcatgacttga

SEQ ID NO: 8129958 - DNA, 22 bp, Homo sapiens
gtgaaaaatgatttgttaactg

SEQ ID NO: 8129959 - DNA, 22 bp, Homo sapiens
gtgagcataacaacagagttta

SEQ ID NO: 8129960 - DNA, 22 bp, Homo sapiens
gtgagcatagtaccaggtagta

SEQ ID NO: 8129961 - DNA, 22 bp, Homo sapiens
gtgagcatcaaaaacgtgtatg

SEQ ID NO: 8129962 - DNA, 22 bp, Homo sapiens
gtgagcatatatgtaatcgttt

SEQ ID NO: 8129963 - DNA, 22 bp, Homo sapiens
gtgagcatcccttaccggaagt

SEQ ID NO: 8129964 - DNA, 22 bp, Homo sapiens
gtgagcatgccgtccaagtcac

SEQ ID NO: 8129965 - DNA, 22 bp, Homo sapiens
gtgagcatcttggcagatatga

SEQ ID NO: 8129966 - DNA, 22 bp, Homo sapiens
gtgagcatgtagtaatctggag

SEQ ID NO: 8129967 - DNA, 22 bp, Homo sapiens
gtgagctgggtgaatggtaggg

SEQ ID NO: 8129968 - DNA, 17 bp, Homo sapiens
gtgagctgagtcaggac

SEQ ID NO: 8129969 - DNA, 22 bp, Homo sapiens
gtgagccgagtatagttcatag

SEQ ID NO: 8129970 - DNA, 22 bp, Homo sapiens
gtgaggagctctttgactcacg

SEQ ID NO: 8129971 - DNA, 22 bp, Homo sapiens
gtgctggaccctggaaggtggt

SEQ ID NO: 8129972 - DNA, 22 bp, Homo sapiens
gtgctgccagacagtgagaggg

SEQ ID NO: 8129973 - DNA, 22 bp, Homo sapiens
gtgctgccggcatagcagtgaa

SEQ ID NO: 8129974 - DNA, 22 bp, Homo sapiens
gtgctgcctgccagcttctggg

SEQ ID NO: 8129975 - DNA, 22 bp, Homo sapiens
gtgcaggcaaaagggccaggcc

SEQ ID NO: 8129976 - DNA, 22 bp, Homo sapiens
ggtgggcaggcgaggcccaggt

SEQ ID NO: 8129977 - DNA, 19 bp, Homo sapiens
ggtggcagaacgtgggtcc

SEQ ID NO: 8129978 - DNA, 22 bp, Homo sapiens
ggtggagctggaccaggagagg

SEQ ID NO: 8129979 - DNA, 22 bp, Homo sapiens
ggtggagcgcagggtgctggcg

SEQ ID NO: 8129980 - DNA, 22 bp, Homo sapiens
ggtggagctatacgggatggct

SEQ ID NO: 8129981 - DNA, 22 bp, Homo sapiens
ggtggggcctgctccagcggcc

SEQ ID NO: 8129982 - DNA, 22 bp, Homo sapiens
ggtggggccctggcactggtat

SEQ ID NO: 8129983 - DNA, 19 bp, Homo sapiens
ggtgggtgacctccccacc

SEQ ID NO: 8129984 - DNA, 22 bp, Homo sapiens
ggtgggtgagccctgggagctg

SEQ ID NO: 8129985 - DNA, 22 bp, Homo sapiens
ggtgggtgcagggggcttctta

SEQ ID NO: 8129986 - DNA, 22 bp, Homo sapiens
ggtgggccaggaaggccgccag

SEQ ID NO: 8129987 - DNA, 22 bp, Homo sapiens
ggtgggcaggtcactctgcctc

SEQ ID NO: 8129988 - DNA, 22 bp, Homo sapiens
ggtgggcgactgagaggggttt

SEQ ID NO: 8129989 - DNA, 22 bp, Homo sapiens
ggttgttgtgaaggtgaagaga

SEQ ID NO: 8129990 - DNA, 21 bp, Homo sapiens
ggttaaaagacacatctgttt

SEQ ID NO: 8129991 - DNA, 22 bp, Homo sapiens
ggttaaaactgatattatgggt

SEQ ID NO: 8129992 - DNA, 22 bp, Homo sapiens
ggttaaaaataatttacttggc

SEQ ID NO: 8129993 - DNA, 23 bp, Homo sapiens
ggtggtgctcatatctcaggcct

SEQ ID NO: 8129994 - DNA, 23 bp, Homo sapiens
gggtttccttctggctcctcctt

SEQ ID NO: 8129995 - DNA, 22 bp, Homo sapiens
gggttgggactgtcatctggag

SEQ ID NO: 8129996 - DNA, 22 bp, Homo sapiens
gggtggtgtattagagctgcag

SEQ ID NO: 8129997 - DNA, 18 bp, Homo sapiens
gggtggtgtgctcttcgc

SEQ ID NO: 8129998 - DNA, 22 bp, Homo sapiens
ggtccctgaagatgcctgagga

SEQ ID NO: 8129999 - DNA, 22 bp, Homo sapiens
ggtgagaggcagtgctgtggaa

SEQ ID NO: 8130000 - DNA, 21 bp, Homo sapiens
ggtgctcctccatgctgctct

SEQ ID NO: 8130001 - DNA, 21 bp, Homo sapiens
ggtgctcgctgatgaggagtg

SEQ ID NO: 8130002 - DNA, 22 bp, Homo sapiens
ggtgaggctggcttgccttctt

SEQ ID NO: 8130003 - DNA, 18 bp, Homo sapiens
ggtgaggcggcggccagc

SEQ ID NO: 8130004 - DNA, 22 bp, Homo sapiens
ggtgaggcaggtggctgctgag

SEQ ID NO: 8130005 - DNA, 22 bp, Homo sapiens
gggtgaggagctgccagtcatg

SEQ ID NO: 8130006 - DNA, 22 bp, Homo sapiens
gggtgagggatgagccttcttc

SEQ ID NO: 8130007 - DNA, 18 bp, Homo sapiens
gggtgcaggcactgactg

SEQ ID NO: 8130008 - DNA, 23 bp, Homo sapiens
gggtgctgcctgtagtcatgctg

SEQ ID NO: 8130009 - DNA, 18 bp, Homo sapiens
gggtgctggggccccttg

SEQ ID NO: 8130010 - DNA, 21 bp, Homo sapiens
gggtgctgtggtcatgcagga

SEQ ID NO: 8130011 - DNA, 22 bp, Homo sapiens
gggtggagccagttgactctgt

SEQ ID NO: 8130012 - DNA, 21 bp, Homo sapiens
gggtggggttccagccttttc

SEQ ID NO: 8130013 - DNA, 22 bp, Homo sapiens
gggtggtctggcaggctggaaa

SEQ ID NO: 8130014 - DNA, 22 bp, Homo sapiens
gggtggtcatctgaaggtctgg

SEQ ID NO: 8130015 - DNA, 22 bp, Homo sapiens
gggtggtggccagcagtgggca

SEQ ID NO: 8130016 - DNA, 22 bp, Homo sapiens
ggggcccagggcagcagtgcag

SEQ ID NO: 8130017 - DNA, 22 bp, Homo sapiens
ggggcccagcacccctcctcgc

SEQ ID NO: 8130018 - DNA, 19 bp, Homo sapiens
ggggcccggggtctgcgag

SEQ ID NO: 8130019 - DNA, 22 bp, Homo sapiens
ggggcccgggcactggccgtca

SEQ ID NO: 8130020 - DNA, 22 bp, Homo sapiens
ggggcccttgtggctgcaggcc

SEQ ID NO: 8130021 - DNA, 22 bp, Homo sapiens
ggggtagggcgattgctgcttt

SEQ ID NO: 8130022 - DNA, 22 bp, Homo sapiens
ggggccagcttcgcgtgctctt

SEQ ID NO: 8130023 - DNA, 22 bp, Homo sapiens
ggggccaggtccagcttccaaa

SEQ ID NO: 8130024 - DNA, 22 bp, Homo sapiens
ggggccagtaggagtgatgtac

SEQ ID NO: 8130025 - DNA, 22 bp, Homo sapiens
ggggccagatatcactaaggtt

SEQ ID NO: 8130026 - DNA, 22 bp, Homo sapiens
ggggtgctgaagatgtcatggt

SEQ ID NO: 8130027 - DNA, 22 bp, Homo sapiens
ggggtgagttagcgtcggcttg

SEQ ID NO: 8130028 - DNA, 22 bp, Homo sapiens
ggggtggattcctacaggtcca

SEQ ID NO: 8130029 - DNA, 22 bp, Homo sapiens
ggggtggatttcaggcggtgtc

SEQ ID NO: 8130030 - DNA, 22 bp, Homo sapiens
ggggtggctggcacctcctggt

SEQ ID NO: 8130031 - DNA, 22 bp, Homo sapiens
ggggtgggagtgccatccttga

SEQ ID NO: 8130032 - DNA, 19 bp, Homo sapiens
ggggtggctggggctccag

SEQ ID NO: 8130033 - DNA, 22 bp, Homo sapiens
ggggaggacctttccaaggctt

SEQ ID NO: 8130034 - DNA, 22 bp, Homo sapiens
ggggaggcaagatgaagtgagg

SEQ ID NO: 8130035 - DNA, 22 bp, Homo sapiens
ggggaggccagtggaccgtccc

SEQ ID NO: 8130036 - DNA, 22 bp, Homo sapiens
ggggcagggaggttatcgccga

SEQ ID NO: 8130037 - DNA, 20 bp, Homo sapiens
ggggcaggtttttatggcta

SEQ ID NO: 8130038 - DNA, 22 bp, Homo sapiens
ggggcagtgaggtggcagcccg

SEQ ID NO: 8130039 - DNA, 22 bp, Homo sapiens
ggggcatcagaaccctgtggga

SEQ ID NO: 8130040 - DNA, 22 bp, Homo sapiens
ggggccagagaggacccaggtg

SEQ ID NO: 8130041 - DNA, 22 bp, Homo sapiens
ggggcaggaggtgttctctttt

SEQ ID NO: 8130042 - DNA, 22 bp, Homo sapiens
ggggatctaggcttatgagggc

SEQ ID NO: 8130043 - DNA, 22 bp, Homo sapiens
ggggaggctgatgtgggcaaag

SEQ ID NO: 8130044 - DNA, 22 bp, Homo sapiens
ggggagtgttttcatgggcttg

SEQ ID NO: 8130045 - DNA, 22 bp, Homo sapiens
gggctctgggatgctcttagag

SEQ ID NO: 8130046 - DNA, 18 bp, Homo sapiens
gggctctggcatctgggt

SEQ ID NO: 8130047 - DNA, 19 bp, Homo sapiens
gggctctggcctcagtggg

SEQ ID NO: 8130048 - DNA, 16 bp, Homo sapiens
gggctgggggattctg

SEQ ID NO: 8130049 - DNA, 22 bp, Homo sapiens
gggcttcagttctgaccatctt

SEQ ID NO: 8130050 - DNA, 22 bp, Homo sapiens
gctcatattcaactatcttcac

SEQ ID NO: 8130051 - DNA, 22 bp, Homo sapiens
gctcagggagagagggcagccg

SEQ ID NO: 8130052 - DNA, 20 bp, Homo sapiens
gctcagggcctgggtctgga

SEQ ID NO: 8130053 - DNA, 22 bp, Homo sapiens
gctcagggcctggctgcggact

SEQ ID NO: 8130054 - DNA, 22 bp, Homo sapiens
gctcagggaactttttgcaggc

SEQ ID NO: 8130055 - DNA, 22 bp, Homo sapiens
gctccctcccaccagcctgcag

SEQ ID NO: 8130056 - DNA, 19 bp, Homo sapiens
gctctccctctcagttgag

SEQ ID NO: 8130057 - DNA, 22 bp, Homo sapiens
gctctgggtagccactgcctgg

SEQ ID NO: 8130058 - DNA, 22 bp, Homo sapiens
gctggagctgcagcctgggcct

SEQ ID NO: 8130059 - DNA, 22 bp, Homo sapiens
gctggaggggtaataggatggg

SEQ ID NO: 8130060 - DNA, 22 bp, Homo sapiens
gctgctgcttgaaggctcggag

SEQ ID NO: 8130061 - DNA, 22 bp, Homo sapiens
gctggaggtggtgagaaaaggt

SEQ ID NO: 8130062 - DNA, 22 bp, Homo sapiens
gctctgtggcattcatgggcag

SEQ ID NO: 8130063 - DNA, 22 bp, Homo sapiens
gctgcctcccagagccctgcag

SEQ ID NO: 8130064 - DNA, 22 bp, Homo sapiens
gctgcaggctctgcaggaattg

SEQ ID NO: 8130065 - DNA, 22 bp, Homo sapiens
gctgcaggcggccgtggtggcg

SEQ ID NO: 8130066 - DNA, 22 bp, Homo sapiens
gctgcaggcgcctgcggtctct

SEQ ID NO: 8130067 - DNA, 22 bp, Homo sapiens
gctgcaggctgtggcaggggag

SEQ ID NO: 8130068 - DNA, 22 bp, Homo sapiens
gctgcagggagctggaaggctc

SEQ ID NO: 8130069 - DNA, 22 bp, Homo sapiens
gctgcagggctctcacaggggg

SEQ ID NO: 8130070 - DNA, 23 bp, Homo sapiens
gctgtctgtcatctctgcgggag

SEQ ID NO: 8130071 - DNA, 22 bp, Homo sapiens
gctgtcccgctgacttccagct

SEQ ID NO: 8130072 - DNA, 22 bp, Homo sapiens
gctgtccctttcacaaggtttt

SEQ ID NO: 8130073 - DNA, 23 bp, Homo sapiens
gctgtccccatgctccatccctg

SEQ ID NO: 8130074 - DNA, 20 bp, Homo sapiens
gctgtcccaggccaaagggc

SEQ ID NO: 8130075 - DNA, 22 bp, Homo sapiens
gcttggggtcatgaggctgctg

SEQ ID NO: 8130076 - DNA, 22 bp, Homo sapiens
gcttgttgaattgcattttcca

SEQ ID NO: 8130077 - DNA, 22 bp, Homo sapiens
gcttttattgtctttacgacga

SEQ ID NO: 8130078 - DNA, 22 bp, Homo sapiens
ggagctgcatttagggagcctt

SEQ ID NO: 8130079 - DNA, 22 bp, Homo sapiens
ggaggaggggcgctttgtctat

SEQ ID NO: 8130080 - DNA, 22 bp, Homo sapiens
ggaggaggcggcagaagttcct

SEQ ID NO: 8130081 - DNA, 17 bp, Homo sapiens
ggagccaggagcccacc

SEQ ID NO: 8130082 - DNA, 22 bp, Homo sapiens
ggagccaggcatatcggggcac

SEQ ID NO: 8130083 - DNA, 22 bp, Homo sapiens
ggaaggctttgaggggtgctgg

SEQ ID NO: 8130084 - DNA, 22 bp, Homo sapiens
ggaaggcagtgaaggggctgat

SEQ ID NO: 8130085 - DNA, 19 bp, Homo sapiens
ggaaggcagaggggctgtg

SEQ ID NO: 8130086 - DNA, 22 bp, Homo sapiens
ggacagggctcttggcactcct

SEQ ID NO: 8130087 - DNA, 22 bp, Homo sapiens
ggacaggctgcatctgagcatg

SEQ ID NO: 8130088 - DNA, 22 bp, Homo sapiens
ggacaggccctctggtcagctt

SEQ ID NO: 8130089 - DNA, 22 bp, Homo sapiens
ggacaggcccggggagcctgga

SEQ ID NO: 8130090 - DNA, 22 bp, Homo sapiens
ggacaggcaggtgatttccaga

SEQ ID NO: 8130091 - DNA, 22 bp, Homo sapiens
ggacaggccatatggaatacat

SEQ ID NO: 8130092 - DNA, 22 bp, Homo sapiens
ggacaggcgcagggccaaggaa

SEQ ID NO: 8130093 - DNA, 22 bp, Homo sapiens
ggacaggccgcctcggtggggg

SEQ ID NO: 8130094 - DNA, 22 bp, Homo sapiens
ggagaaaattgatgaagttggc

SEQ ID NO: 8130095 - DNA, 22 bp, Homo sapiens
ggactgtctactaacaagaagc

SEQ ID NO: 8130096 - DNA, 22 bp, Homo sapiens
ggactgggtaggagcccagggc

SEQ ID NO: 8130097 - DNA, 17 bp, Homo sapiens
gcagttaaattaagatg

SEQ ID NO: 8130098 - DNA, 21 bp, Homo sapiens
gcagttaatagcagagcacac

SEQ ID NO: 8130099 - DNA, 22 bp, Homo sapiens
gcagttgctcttgaggcacttt

SEQ ID NO: 8130100 - DNA, 22 bp, Homo sapiens
gccagctgaggccgtgcaggct

SEQ ID NO: 8130101 - DNA, 22 bp, Homo sapiens
gccagctgtaggtggtgggttg

SEQ ID NO: 8130102 - DNA, 23 bp, Homo sapiens
gccaggctccggtctgtggccac

SEQ ID NO: 8130103 - DNA, 22 bp, Homo sapiens
gccaggctaagaaaggtgtgat

SEQ ID NO: 8130104 - DNA, 22 bp, Homo sapiens
gcctggagaggaagccggtgga

SEQ ID NO: 8130105 - DNA, 22 bp, Homo sapiens
gcctggagtgcagtggcgtgat

SEQ ID NO: 8130106 - DNA, 22 bp, Homo sapiens
gccctagccatcctgtgctctg

SEQ ID NO: 8130107 - DNA, 22 bp, Homo sapiens
gccctacctcagtccagatctg

SEQ ID NO: 8130108 - DNA, 22 bp, Homo sapiens
gcccgtgtgcagagtgggagct

SEQ ID NO: 8130109 - DNA, 22 bp, Homo sapiens
gccctaggcttttgtgactgcc

SEQ ID NO: 8130110 - DNA, 21 bp, Homo sapiens
gccctaggctacctggagcgc

SEQ ID NO: 8130111 - DNA, 22 bp, Homo sapiens
gccctagcgccagctcagcacc

SEQ ID NO: 8130112 - DNA, 22 bp, Homo sapiens
gcccacacaccagctcaggagg

SEQ ID NO: 8130113 - DNA, 17 bp, Homo sapiens
gccctgcctgctgccct

SEQ ID NO: 8130114 - DNA, 22 bp, Homo sapiens
gccctgcctgtctgctgggagg

SEQ ID NO: 8130115 - DNA, 22 bp, Homo sapiens
gccctgcgccgtcccgctggtg

SEQ ID NO: 8130116 - DNA, 22 bp, Homo sapiens
gccctgctctggtctctgcccg

SEQ ID NO: 8130117 - DNA, 22 bp, Homo sapiens
gccctgctcttttgcccaccca

SEQ ID NO: 8130118 - DNA, 22 bp, Homo sapiens
gccctgctgcgcagcacgcatg

SEQ ID NO: 8130119 - DNA, 23 bp, Homo sapiens
gccctgctgggacctcctgctac

SEQ ID NO: 8130120 - DNA, 22 bp, Homo sapiens
gcctcaggtgcatctctcattc

SEQ ID NO: 8130121 - DNA, 22 bp, Homo sapiens
gccctgcttctggcatgcagaa

SEQ ID NO: 8130122 - DNA, 22 bp, Homo sapiens
gcctcagggggagaggccagct

SEQ ID NO: 8130123 - DNA, 22 bp, Homo sapiens
gcagctggctcagagaggtggg

SEQ ID NO: 8130124 - DNA, 19 bp, Homo sapiens
gcagggtgttgactgtccc

SEQ ID NO: 8130125 - DNA, 22 bp, Homo sapiens
gcagggccagggctcaggctgt

SEQ ID NO: 8130126 - DNA, 22 bp, Homo sapiens
gcagggtgtgtctcatacagtt

SEQ ID NO: 8130127 - DNA, 22 bp, Homo sapiens
gcagggccagtgcagagaggaa

SEQ ID NO: 8130128 - DNA, 19 bp, Homo sapiens
gcagggtggcagagctctt

SEQ ID NO: 8130129 - DNA, 22 bp, Homo sapiens
gcagggccaggtacaagaagca

SEQ ID NO: 8130130 - DNA, 23 bp, Homo sapiens
gcagctggttagaagggaaggag

SEQ ID NO: 8130131 - DNA, 22 bp, Homo sapiens
gcaggccattcaggagatgtgc

SEQ ID NO: 8130132 - DNA, 22 bp, Homo sapiens
gcaggccagctgtgcagatggg

SEQ ID NO: 8130133 - DNA, 22 bp, Homo sapiens
gcaggccaagccctcgcagaga

SEQ ID NO: 8130134 - DNA, 22 bp, Homo sapiens
gcaggcctcccctgctggagct

SEQ ID NO: 8130135 - DNA, 22 bp, Homo sapiens
gcacagactttgattgcagtca

SEQ ID NO: 8130136 - DNA, 22 bp, Homo sapiens
gcacagacagaatccctactcc

SEQ ID NO: 8130137 - DNA, 22 bp, Homo sapiens
gcaatactgagattattgtact

SEQ ID NO: 8130138 - DNA, 22 bp, Homo sapiens
gcaatactaagtgacttttggg

SEQ ID NO: 8130139 - DNA, 22 bp, Homo sapiens
gcaatactcaacacttttgctt

SEQ ID NO: 8130140 - DNA, 22 bp, Homo sapiens
gcacagagaggctgtgagcgcc

SEQ ID NO: 8130141 - DNA, 22 bp, Homo sapiens
gcacagagtgggtgagatgtgg

SEQ ID NO: 8130142 - DNA, 22 bp, Homo sapiens
gcacattgcttgcccattgtaa

SEQ ID NO: 8130143 - DNA, 22 bp, Homo sapiens
gcacattgttactcttactgtg

SEQ ID NO: 8130144 - DNA, 22 bp, Homo sapiens
gcaataaagtagcagctcatca

SEQ ID NO: 8130145 - DNA, 22 bp, Homo sapiens
gcaataaaatgtaatgattggg

SEQ ID NO: 8130146 - DNA, 19 bp, Homo sapiens
gagtattttccaacttggt

SEQ ID NO: 8130147 - DNA, 22 bp, Homo sapiens
gcagaggtgtgggaggggccac

SEQ ID NO: 8130148 - DNA, 22 bp, Homo sapiens
gcagacagggctacagaggtac

SEQ ID NO: 8130149 - DNA, 22 bp, Homo sapiens
gcagaggtgtgggaggggccac

SEQ ID NO: 8130150 - DNA, 22 bp, Homo sapiens
gcagagtgggagcccagggctg

SEQ ID NO: 8130151 - DNA, 22 bp, Homo sapiens
gcagcaaacttccacaagtaga

SEQ ID NO: 8130152 - DNA, 22 bp, Homo sapiens
gcagagtgagccgaggctgctc

SEQ ID NO: 8130153 - DNA, 22 bp, Homo sapiens
gcacatttctcaaagaattgtc

SEQ ID NO: 8130154 - DNA, 22 bp, Homo sapiens
gcacatttgccactgagctcct

SEQ ID NO: 8130155 - DNA, 22 bp, Homo sapiens
gcagaaggatccgcaggtgcaa

SEQ ID NO: 8130156 - DNA, 22 bp, Homo sapiens
gcagaaggcctcttggttaata

SEQ ID NO: 8130157 - DNA, 22 bp, Homo sapiens
tccaggctacttggattcctgg

SEQ ID NO: 8130158 - DNA, 18 bp, Homo sapiens
tccaggcctgaagtgtcc

SEQ ID NO: 8130159 - DNA, 22 bp, Homo sapiens
tcccagcctggaccctgccagt

SEQ ID NO: 8130160 - DNA, 22 bp, Homo sapiens
tcccagccttccagtctggttt

SEQ ID NO: 8130161 - DNA, 22 bp, Homo sapiens
tcccagccttccttgtggtgaa

SEQ ID NO: 8130162 - DNA, 22 bp, Homo sapiens
tcccagccggtgcctgggtccc

SEQ ID NO: 8130163 - DNA, 22 bp, Homo sapiens
tccatggagtttttatttggta

SEQ ID NO: 8130164 - DNA, 22 bp, Homo sapiens
tccattctttttacctctcaga

SEQ ID NO: 8130165 - DNA, 22 bp, Homo sapiens
tcccaagagctactcaatggaa

SEQ ID NO: 8130166 - DNA, 22 bp, Homo sapiens
tccctgccctgccttcatggtt

SEQ ID NO: 8130167 - DNA, 22 bp, Homo sapiens
tcccaggctggggccaggtgac

SEQ ID NO: 8130168 - DNA, 22 bp, Homo sapiens
tccctcagagggcaagcgcaga

SEQ ID NO: 8130169 - DNA, 22 bp, Homo sapiens
tcctcaaagttgtataaatatt

SEQ ID NO: 8130170 - DNA, 22 bp, Homo sapiens
tcctcacaagcaagcacaggta

SEQ ID NO: 8130171 - DNA, 22 bp, Homo sapiens
tcctcacacccataccactgac

SEQ ID NO: 8130172 - DNA, 22 bp, Homo sapiens
tccctgggactcagacatggaa

SEQ ID NO: 8130173 - DNA, 15 bp, Homo sapiens
tccctgggagatggt

SEQ ID NO: 8130174 - DNA, 22 bp, Homo sapiens
tccctgggagatgatgatgagg

SEQ ID NO: 8130175 - DNA, 22 bp, Homo sapiens
tccctgggacggccttttggag

SEQ ID NO: 8130176 - DNA, 22 bp, Homo sapiens
tccctgggaccggcagctcaca

SEQ ID NO: 8130177 - DNA, 22 bp, Homo sapiens
tccggtgctgaaggcccaggtg

SEQ ID NO: 8130178 - DNA, 18 bp, Homo sapiens
tccctgggatataattac

SEQ ID NO: 8130179 - DNA, 16 bp, Homo sapiens
tccctgggagtggtgg

SEQ ID NO: 8130180 - DNA, 22 bp, Homo sapiens
tccctgggaattaatatttgga

SEQ ID NO: 8130181 - DNA, 22 bp, Homo sapiens
tccctgggaacaaaggatgaga

SEQ ID NO: 8130182 - DNA, 22 bp, Homo sapiens
tccctgggaaatgtcagtttca

SEQ ID NO: 8130183 - DNA, 22 bp, Homo sapiens
tccctgcctcctggcagtgcca

SEQ ID NO: 8130184 - DNA, 22 bp, Homo sapiens
tcctctggggtcagggcactac

SEQ ID NO: 8130185 - DNA, 22 bp, Homo sapiens
tcctctttaaatgcttttatct

SEQ ID NO: 8130186 - DNA, 22 bp, Homo sapiens
tcctgaaattctggttgtcact

SEQ ID NO: 8130187 - DNA, 22 bp, Homo sapiens
tcctgcagagccgccctcaggt

SEQ ID NO: 8130188 - DNA, 22 bp, Homo sapiens
tcctgcagctgaagctcatgtg

SEQ ID NO: 8130189 - DNA, 22 bp, Homo sapiens
tcagatgttgaaaaggaaaagt

SEQ ID NO: 8130190 - DNA, 22 bp, Homo sapiens
tcagaatgtgcagaggaacagt

SEQ ID NO: 8130191 - DNA, 22 bp, Homo sapiens
tcagagtgggagaatgtgccaa

SEQ ID NO: 8130192 - DNA, 22 bp, Homo sapiens
tcagagtgcagggagtagcagc

SEQ ID NO: 8130193 - DNA, 22 bp, Homo sapiens
tcagagtgtggtgagatgtgca

SEQ ID NO: 8130194 - DNA, 22 bp, Homo sapiens
tcagcaaaggaccagcacaggc

SEQ ID NO: 8130195 - DNA, 17 bp, Homo sapiens
tcagcaaagacaaagga

SEQ ID NO: 8130196 - DNA, 21 bp, Homo sapiens
tcagcaaaataagcaaatgga

SEQ ID NO: 8130197 - DNA, 22 bp, Homo sapiens
tcagcaaatacttattgagcgc

SEQ ID NO: 8130198 - DNA, 22 bp, Homo sapiens
tcagcaggcccatcctccaggc

SEQ ID NO: 8130199 - DNA, 22 bp, Homo sapiens
tcagcaggctctggttgaccat

SEQ ID NO: 8130200 - DNA, 22 bp, Homo sapiens
tcagcaggcggttccttgtggg

SEQ ID NO: 8130201 - DNA, 17 bp, Homo sapiens
tcagcaggggccaagct

SEQ ID NO: 8130202 - DNA, 22 bp, Homo sapiens
tcagcagtgtagtttatcattc

SEQ ID NO: 8130203 - DNA, 22 bp, Homo sapiens
tcagcagggctgggagctgtga

SEQ ID NO: 8130204 - DNA, 22 bp, Homo sapiens
tcaggagacaaagggtgcggag

SEQ ID NO: 8130205 - DNA, 22 bp, Homo sapiens
tcagctctgcctgtggaggcac

SEQ ID NO: 8130206 - DNA, 20 bp, Homo sapiens
tcagcatgctcctcagacat

SEQ ID NO: 8130207 - DNA, 22 bp, Homo sapiens
tcagcattttttgggtgtaact

SEQ ID NO: 8130208 - DNA, 22 bp, Homo sapiens
tcactgcaacctccacctcctg

SEQ ID NO: 8130209 - DNA, 22 bp, Homo sapiens
tcacattttagtaccatgattt

SEQ ID NO: 8130210 - DNA, 22 bp, Homo sapiens
tcacatttgtgttttattagag

SEQ ID NO: 8130211 - DNA, 22 bp, Homo sapiens
tcacatttgtgttttattagag

SEQ ID NO: 8130212 - DNA, 22 bp, Homo sapiens
tcacatttggagaaagcctgcc

SEQ ID NO: 8130213 - DNA, 22 bp, Homo sapiens
tcacatttgcaattgcattgtt

SEQ ID NO: 8130214 - DNA, 22 bp, Homo sapiens
tcacattttatatctctggttt

SEQ ID NO: 8130215 - DNA, 22 bp, Homo sapiens
tcacattttatctattttaagt

SEQ ID NO: 8130216 - DNA, 22 bp, Homo sapiens
tcactgcaacctccacctcccg

SEQ ID NO: 8130217 - DNA, 20 bp, Homo sapiens
tcagaacagtagaggagcta

SEQ ID NO: 8130218 - DNA, 22 bp, Homo sapiens
tcagaacagctctcagatatcc

SEQ ID NO: 8130219 - DNA, 22 bp, Homo sapiens
tcagaacagcagggtgtggctg

SEQ ID NO: 8130220 - DNA, 22 bp, Homo sapiens
tcagaacaggactggctgccat

SEQ ID NO: 8130221 - DNA, 22 bp, Homo sapiens
tcagaacagaagctggctataa

SEQ ID NO: 8130222 - DNA, 22 bp, Homo sapiens
tcagaacagcacagggtgattt

SEQ ID NO: 8130223 - DNA, 22 bp, Homo sapiens
tcagaacagaagaaggaacacg

SEQ ID NO: 8130224 - DNA, 22 bp, Homo sapiens
tcaacagtggcaaagaggcacg

SEQ ID NO: 8130225 - DNA, 22 bp, Homo sapiens
tcaacatacatacatggtcagg

SEQ ID NO: 8130226 - DNA, 22 bp, Homo sapiens
tcaacaataggatatagcaggt

SEQ ID NO: 8130227 - DNA, 22 bp, Homo sapiens
tcacagtgacttacagagattg

SEQ ID NO: 8130228 - DNA, 22 bp, Homo sapiens
tcacatttctcagcactgatga

SEQ ID NO: 8130229 - DNA, 22 bp, Homo sapiens
tcacatttctgattataccaaa

SEQ ID NO: 8130230 - DNA, 22 bp, Homo sapiens
tcacatttgataatgcccattg

SEQ ID NO: 8130231 - DNA, 22 bp, Homo sapiens
tcacatgctactgagccagacc

SEQ ID NO: 8130232 - DNA, 22 bp, Homo sapiens
tcacatgctgtgggatctgtat

SEQ ID NO: 8130233 - DNA, 22 bp, Homo sapiens
tcacattgccattagttcagtt

SEQ ID NO: 8130234 - DNA, 22 bp, Homo sapiens
tcacattgtaggatagcagaga

SEQ ID NO: 8130235 - DNA, 22 bp, Homo sapiens
tcacattgttatgtaaatgttt

SEQ ID NO: 8130236 - DNA, 22 bp, Homo sapiens
tcacattgtaggtcatttgcaa

SEQ ID NO: 8130237 - DNA, 22 bp, Homo sapiens
tcacattggaccttcctgacaa

SEQ ID NO: 8130238 - DNA, 22 bp, Homo sapiens
tcacattgctcccatagtggat

SEQ ID NO: 8130239 - DNA, 22 bp, Homo sapiens
tcacattgccgtctgtgcactt

SEQ ID NO: 8130240 - DNA, 22 bp, Homo sapiens
tcacattgttcttagtttacct

SEQ ID NO: 8130241 - DNA, 23 bp, Homo sapiens
tcacatttaacccctcagacctc

SEQ ID NO: 8130242 - DNA, 22 bp, Homo sapiens
tcacagttttagctgttaaata

SEQ ID NO: 8130243 - DNA, 22 bp, Homo sapiens
tcacagttttaagtgtgatcca

SEQ ID NO: 8130244 - DNA, 22 bp, Homo sapiens
tcacagttttagaaaatagata

SEQ ID NO: 8130245 - DNA, 22 bp, Homo sapiens
tcacagtttcttttctgataaa

SEQ ID NO: 8130246 - DNA, 22 bp, Homo sapiens
tcacagtttccataggtcagca

SEQ ID NO: 8130247 - DNA, 23 bp, Homo sapiens
tcataaatattagcacagtagga

SEQ ID NO: 8130248 - DNA, 22 bp, Homo sapiens
tcagtatgatgagagggaaatt

SEQ ID NO: 8130249 - DNA, 22 bp, Homo sapiens
tcagtctcctttcctctagaca

SEQ ID NO: 8130250 - DNA, 22 bp, Homo sapiens
tcagtctccatctgcttgtctt

SEQ ID NO: 8130251 - DNA, 23 bp, Homo sapiens
tcatctgtaacagcctatgaaat

SEQ ID NO: 8130252 - DNA, 17 bp, Homo sapiens
tcaggctgggtgcagtg

SEQ ID NO: 8130253 - DNA, 22 bp, Homo sapiens
tcaggagagagttgggtaggct

SEQ ID NO: 8130254 - DNA, 22 bp, Homo sapiens
tcatttgtaccattttttaaga

SEQ ID NO: 8130255 - DNA, 19 bp, Homo sapiens
tccaaagaagttcacattt

SEQ ID NO: 8130256 - DNA, 22 bp, Homo sapiens
tccaaggtcagcgagagtcact

SEQ ID NO: 8130257 - DNA, 20 bp, Homo sapiens
tccaatgtaggataaatgtg

SEQ ID NO: 8130258 - DNA, 22 bp, Homo sapiens
tccaagaagagcctttctcctc

SEQ ID NO: 8130259 - DNA, 22 bp, Homo sapiens
tcatttcaatgatactactaag

SEQ ID NO: 8130260 - DNA, 22 bp, Homo sapiens
tcatttcagccatttttaaatg

SEQ ID NO: 8130261 - DNA, 22 bp, Homo sapiens
tcatttcagatgcatttagaat

SEQ ID NO: 8130262 - DNA, 22 bp, Homo sapiens
tcatttcagatgcatttagaat

SEQ ID NO: 8130263 - DNA, 23 bp, Homo sapiens
tcatttcaggttgcatggtacca

SEQ ID NO: 8130264 - DNA, 22 bp, Homo sapiens
tcatttcagtggcacagaagat

SEQ ID NO: 8130265 - DNA, 22 bp, Homo sapiens
tcatttcagttgttccctggtt

SEQ ID NO: 8130266 - DNA, 22 bp, Homo sapiens
tcatttcagttcagaggccttt

SEQ ID NO: 8130267 - DNA, 22 bp, Homo sapiens
gtttatcacaataaataattct

SEQ ID NO: 8130268 - DNA, 22 bp, Homo sapiens
gtttatcattattattagcaac

SEQ ID NO: 8130269 - DNA, 22 bp, Homo sapiens
gttgaaatgagggattaatcag

SEQ ID NO: 8130270 - DNA, 22 bp, Homo sapiens
gttgacagtgaccctgaaagca

SEQ ID NO: 8130271 - DNA, 22 bp, Homo sapiens
gttgacaggaaggcgttcccag

SEQ ID NO: 8130272 - DNA, 22 bp, Homo sapiens
gttgacagaattgtgtggctgg

SEQ ID NO: 8130273 - DNA, 22 bp, Homo sapiens
gttgacagctggtgagctgcta

SEQ ID NO: 8130274 - DNA, 22 bp, Homo sapiens
gttgacagagcgcctttgaatt

SEQ ID NO: 8130275 - DNA, 22 bp, Homo sapiens
gttgacagaaaaataacatagc

SEQ ID NO: 8130276 - DNA, 22 bp, Homo sapiens
gttgaaatttgtgataatttag

SEQ ID NO: 8130277 - DNA, 22 bp, Homo sapiens
gttgaaaatacagattcctagg

SEQ ID NO: 8130278 - DNA, 22 bp, Homo sapiens
gttcttttggtagagtgtgcat

SEQ ID NO: 8130279 - DNA, 22 bp, Homo sapiens
gtttcttttgtgatcaccaacc

SEQ ID NO: 8130280 - DNA, 22 bp, Homo sapiens
gtttcacagtctgcagaatttt

SEQ ID NO: 8130281 - DNA, 22 bp, Homo sapiens
gtttcacacatcctgcacatag

SEQ ID NO: 8130282 - DNA, 22 bp, Homo sapiens
gtttgtgtaacatgatgatgat

SEQ ID NO: 8130283 - DNA, 22 bp, Homo sapiens
gtttgcattccaatttagggga

SEQ ID NO: 8130284 - DNA, 21 bp, Homo sapiens
gtttgcatgaacaagtcagcc

SEQ ID NO: 8130285 - DNA, 22 bp, Homo sapiens
gtttgcatatttgcacaggaat

SEQ ID NO: 8130286 - DNA, 22 bp, Homo sapiens
gtttgcataaagtggatgcagg

SEQ ID NO: 8130287 - DNA, 22 bp, Homo sapiens
gttatgatggccctttcctggt

SEQ ID NO: 8130288 - DNA, 22 bp, Homo sapiens
gttattgtccatttatttagca

SEQ ID NO: 8130289 - DNA, 22 bp, Homo sapiens
gttattgtccagcacagttggg

SEQ ID NO: 8130290 - DNA, 21 bp, Homo sapiens
gtgctgggacacagccaggct

SEQ ID NO: 8130291 - DNA, 22 bp, Homo sapiens
taaagacatggtgtaggtgaac

SEQ ID NO: 8130292 - DNA, 17 bp, Homo sapiens
taaagatcagccatgta

SEQ ID NO: 8130293 - DNA, 22 bp, Homo sapiens
taaagacataggatcagggaga

SEQ ID NO: 8130294 - DNA, 20 bp, Homo sapiens
taaagacataagctactatc

SEQ ID NO: 8130295 - DNA, 22 bp, Homo sapiens
taaagacatgcaaagtctaatt

SEQ ID NO: 8130296 - DNA, 23 bp, Homo sapiens
taaagacagccttcaggattctg

SEQ ID NO: 8130297 - DNA, 22 bp, Homo sapiens
taaagacagatggaccagccat

SEQ ID NO: 8130298 - DNA, 22 bp, Homo sapiens
taaatgttactttcctttcaca

SEQ ID NO: 8130299 - DNA, 22 bp, Homo sapiens
taaatgttatgcccatcatcca

SEQ ID NO: 8130300 - DNA, 22 bp, Homo sapiens
taaatgtttagtcttatttggg

SEQ ID NO: 8130301 - DNA, 22 bp, Homo sapiens
taaatgttttgtgggttgagtt

SEQ ID NO: 8130302 - DNA, 22 bp, Homo sapiens
taaatgttggcattggaggccg

SEQ ID NO: 8130303 - DNA, 22 bp, Homo sapiens
taaatgttgtaagtacatctaa

SEQ ID NO: 8130304 - DNA, 22 bp, Homo sapiens
taagaggatatttggccagaag

SEQ ID NO: 8130305 - DNA, 21 bp, Homo sapiens
taagagcctaacacagaaagg

SEQ ID NO: 8130306 - DNA, 22 bp, Homo sapiens
tacaacattgtgttgcttcata

SEQ ID NO: 8130307 - DNA, 22 bp, Homo sapiens
taatttcaaatttcttagcgtg

SEQ ID NO: 8130308 - DNA, 23 bp, Homo sapiens
taattcacatatacattgcttca

SEQ ID NO: 8130309 - DNA, 22 bp, Homo sapiens
taattgaactaacatgcaaaca

SEQ ID NO: 8130310 - DNA, 22 bp, Homo sapiens
taattgcagggtgtcagaatac

SEQ ID NO: 8130311 - DNA, 23 bp, Homo sapiens
taattgcttgagttagtaataca

SEQ ID NO: 8130312 - DNA, 22 bp, Homo sapiens
taccaagagttcttgcctgttt

SEQ ID NO: 8130313 - DNA, 22 bp, Homo sapiens
tacagagatgtgaaaagctcta

SEQ ID NO: 8130314 - DNA, 22 bp, Homo sapiens
tacagagatgccgaagagtgaa

SEQ ID NO: 8130315 - DNA, 22 bp, Homo sapiens
tacagagatttattgctaaggc

SEQ ID NO: 8130316 - DNA, 22 bp, Homo sapiens
tacagagagtacagcatccaca

SEQ ID NO: 8130317 - DNA, 22 bp, Homo sapiens
tacagagatactctagatcaaa

SEQ ID NO: 8130318 - DNA, 22 bp, Homo sapiens
tactctgccactaggagttctg

SEQ ID NO: 8130319 - DNA, 22 bp, Homo sapiens
taccatttctacatatcttgtc

SEQ ID NO: 8130320 - DNA, 22 bp, Homo sapiens
taccaattctattttggattga

SEQ ID NO: 8130321 - DNA, 22 bp, Homo sapiens
taccagggaacagggatattaa

SEQ ID NO: 8130322 - DNA, 22 bp, Homo sapiens
tagttttttcaacaaatggtgc

SEQ ID NO: 8130323 - DNA, 22 bp, Homo sapiens
tagttacttttgctcttcatta

SEQ ID NO: 8130324 - DNA, 22 bp, Homo sapiens
tagttattgcctaggagcagct

SEQ ID NO: 8130325 - DNA, 22 bp, Homo sapiens
tagtctctatgagtgaatcaca

SEQ ID NO: 8130326 - DNA, 22 bp, Homo sapiens
taggggctcagaacatgtcctt

SEQ ID NO: 8130327 - DNA, 22 bp, Homo sapiens
taggggcagaagcggcggtcca

SEQ ID NO: 8130328 - DNA, 22 bp, Homo sapiens
tagtgctatagaagtgcttgcg

SEQ ID NO: 8130329 - DNA, 22 bp, Homo sapiens
tagggctttgctcatcctaggt

SEQ ID NO: 8130330 - DNA, 22 bp, Homo sapiens
tagggcagccacccaggctgct

SEQ ID NO: 8130331 - DNA, 22 bp, Homo sapiens
tagggcagccttatagctccca

SEQ ID NO: 8130332 - DNA, 22 bp, Homo sapiens
tagggcagattcggtggagttt

SEQ ID NO: 8130333 - DNA, 22 bp, Homo sapiens
tagctgggagtgtctgatgggt

SEQ ID NO: 8130334 - DNA, 22 bp, Homo sapiens
tagctgggactactggccctgc

SEQ ID NO: 8130335 - DNA, 22 bp, Homo sapiens
tagctgacgctaaataaatgtt

SEQ ID NO: 8130336 - DNA, 22 bp, Homo sapiens
tagcaacatggttatcacatta

SEQ ID NO: 8130337 - DNA, 21 bp, Homo sapiens
tagaagcacataggttcaaag

SEQ ID NO: 8130338 - DNA, 20 bp, Homo sapiens
tagagagatatgggggttcc

SEQ ID NO: 8130339 - DNA, 20 bp, Homo sapiens
tagagagaggatattaaagt

SEQ ID NO: 8130340 - DNA, 22 bp, Homo sapiens
tagagagagctgtggtggctct

SEQ ID NO: 8130341 - DNA, 22 bp, Homo sapiens
tagagagagatatatacacaca

SEQ ID NO: 8130342 - DNA, 23 bp, Homo sapiens
tattacaattggtcttattaaga

SEQ ID NO: 8130343 - DNA, 22 bp, Homo sapiens
tattacaaattataatgggaga

SEQ ID NO: 8130344 - DNA, 22 bp, Homo sapiens
tattgtcaagaagtttatagtg

SEQ ID NO: 8130345 - DNA, 22 bp, Homo sapiens
tattgtcacgtcttaattctag

SEQ ID NO: 8130346 - DNA, 22 bp, Homo sapiens
tattgtctgtttgaatgactat

SEQ ID NO: 8130347 - DNA, 22 bp, Homo sapiens
tatttaagatgtgtcataaaga

SEQ ID NO: 8130348 - DNA, 22 bp, Homo sapiens
tattgttgttgtgagggggatg

SEQ ID NO: 8130349 - DNA, 22 bp, Homo sapiens
tatttggacaccaagtagaagt

SEQ ID NO: 8130350 - DNA, 22 bp, Homo sapiens
tattttctggggagagtgaacc

SEQ ID NO: 8130351 - DNA, 22 bp, Homo sapiens
tatttaattagtgattgtagag

SEQ ID NO: 8130352 - DNA, 22 bp, Homo sapiens
tatttgcaggacatagatatgg

SEQ ID NO: 8130353 - DNA, 22 bp, Homo sapiens
tatttgcaggcttttgtcatgg

SEQ ID NO: 8130354 - DNA, 22 bp, Homo sapiens
tattttgtatttatgcaagaaa

SEQ ID NO: 8130355 - DNA, 22 bp, Homo sapiens
tcaaagatagatgttgagaaat

SEQ ID NO: 8130356 - DNA, 22 bp, Homo sapiens
tcaaagaacatcatctgaaatg

SEQ ID NO: 8130357 - DNA, 22 bp, Homo sapiens
tcaaactggcagacttctactt

SEQ ID NO: 8130358 - DNA, 22 bp, Homo sapiens
tcaaataccagcaatttcatgt

SEQ ID NO: 8130359 - DNA, 21 bp, Homo sapiens
tcaaatcaggtatcactattg

SEQ ID NO: 8130360 - DNA, 22 bp, Homo sapiens
tcaaatcccagctcagcctctc

SEQ ID NO: 8130361 - DNA, 22 bp, Homo sapiens
tatcacaggtgtgatttacatt

SEQ ID NO: 8130362 - DNA, 22 bp, Homo sapiens
tatcacttgcgttttggcagag

SEQ ID NO: 8130363 - DNA, 22 bp, Homo sapiens
tatcacaggtgtgatttacatt

SEQ ID NO: 8130364 - DNA, 23 bp, Homo sapiens
tatctttttcaatgttggaaata

SEQ ID NO: 8130365 - DNA, 18 bp, Homo sapiens
tatcttttccagtggtat

SEQ ID NO: 8130366 - DNA, 22 bp, Homo sapiens
tatcttttgagttctcaagatg

SEQ ID NO: 8130367 - DNA, 22 bp, Homo sapiens
tatcatttagagtatttcttca

SEQ ID NO: 8130368 - DNA, 22 bp, Homo sapiens
tatcattttactgtgacatttt

SEQ ID NO: 8130369 - DNA, 22 bp, Homo sapiens
tatgaaatgatggggaaaatag

SEQ ID NO: 8130370 - DNA, 22 bp, Homo sapiens
tatgaaatttaaacacagatca

SEQ ID NO: 8130371 - DNA, 22 bp, Homo sapiens
tatgaaatttaaacacagatca

SEQ ID NO: 8130372 - DNA, 22 bp, Homo sapiens
tatgtagtacttagtgcataca

SEQ ID NO: 8130373 - DNA, 22 bp, Homo sapiens
tatgtttgttatcacaactagg

SEQ ID NO: 8130374 - DNA, 21 bp, Homo sapiens
tattaatatgtctaagctgat

SEQ ID NO: 8130375 - DNA, 22 bp, Homo sapiens
tatggaatggctattttctagg

SEQ ID NO: 8130376 - DNA, 22 bp, Homo sapiens
tatggaaataattagacaagtg

SEQ ID NO: 8130377 - DNA, 22 bp, Homo sapiens
gagaggagacttatccagattg

SEQ ID NO: 8130378 - DNA, 22 bp, Homo sapiens
gagaggagaagcctgcgcttca

SEQ ID NO: 8130379 - DNA, 22 bp, Homo sapiens
gagaggagtagacactttggtt

SEQ ID NO: 8130380 - DNA, 22 bp, Homo sapiens
gagaggagtaggctgatggtgc

SEQ ID NO: 8130381 - DNA, 22 bp, Homo sapiens
gagaggaggtggctatgacagc

SEQ ID NO: 8130382 - DNA, 18 bp, Homo sapiens
gagaggagccagaatttt

SEQ ID NO: 8130383 - DNA, 22 bp, Homo sapiens
gagagacagcacacagtgtggg

SEQ ID NO: 8130384 - DNA, 22 bp, Homo sapiens
gagagacagcagaacgtgcagc

SEQ ID NO: 8130385 - DNA, 22 bp, Homo sapiens
gagagagaaccccgtgcccttc

SEQ ID NO: 8130386 - DNA, 22 bp, Homo sapiens
gagagagaaaatgactccggac

SEQ ID NO: 8130387 - DNA, 22 bp, Homo sapiens
gagagccatggtggagatgggg

SEQ ID NO: 8130388 - DNA, 22 bp, Homo sapiens
gagagccagcagtaaagacatt

SEQ ID NO: 8130389 - DNA, 22 bp, Homo sapiens
gagaagcaggtttagcagacaa

SEQ ID NO: 8130390 - DNA, 22 bp, Homo sapiens
gagaagcaggtttagcagacaa

SEQ ID NO: 8130391 - DNA, 22 bp, Homo sapiens
gagaagcaatcagcagccaccc

SEQ ID NO: 8130392 - DNA, 22 bp, Homo sapiens
gagaagaacttgggcaaagtca

SEQ ID NO: 8130393 - DNA, 22 bp, Homo sapiens
gagaacttgaacttttcctctg

SEQ ID NO: 8130394 - DNA, 22 bp, Homo sapiens
gagaaagggaacttacagagtg

SEQ ID NO: 8130395 - DNA, 22 bp, Homo sapiens
gagaaagggaacttacagagtg

SEQ ID NO: 8130396 - DNA, 22 bp, Homo sapiens
gagcaggaaggccagaagggtc

SEQ ID NO: 8130397 - DNA, 22 bp, Homo sapiens
gagcaggaactgaaaatgagac

SEQ ID NO: 8130398 - DNA, 23 bp, Homo sapiens
gagcagagcgggcgggggtcctg

SEQ ID NO: 8130399 - DNA, 22 bp, Homo sapiens
gagcacatgtggagagtctggg

SEQ ID NO: 8130400 - DNA, 22 bp, Homo sapiens
gagcacatgagaggaaatcaaa

SEQ ID NO: 8130401 - DNA, 22 bp, Homo sapiens
gagcaccctacctgccactgag

SEQ ID NO: 8130402 - DNA, 22 bp, Homo sapiens
gagcacagtaaagcagtgtcac

SEQ ID NO: 8130403 - DNA, 22 bp, Homo sapiens
gagcacgttgaagcgcactgtc

SEQ ID NO: 8130404 - DNA, 22 bp, Homo sapiens
gagcaatagcaccaattaactc

SEQ ID NO: 8130405 - DNA, 22 bp, Homo sapiens
gagaggagttactatttccgag

SEQ ID NO: 8130406 - DNA, 22 bp, Homo sapiens
gagaggagtccctatcacagtt

SEQ ID NO: 8130407 - DNA, 22 bp, Homo sapiens
gagaggagtccctatcacagtt

SEQ ID NO: 8130408 - DNA, 22 bp, Homo sapiens
gagcaacacattgaatgaggat

SEQ ID NO: 8130409 - DNA, 22 bp, Homo sapiens
gacagcctcatgaggagcaaaa

SEQ ID NO: 8130410 - DNA, 22 bp, Homo sapiens
gacatcatagggtgggaggaaa

SEQ ID NO: 8130411 - DNA, 22 bp, Homo sapiens
gacatgcatattcactcttctt

SEQ ID NO: 8130412 - DNA, 22 bp, Homo sapiens
gacctggcatattcattggcac

SEQ ID NO: 8130413 - DNA, 22 bp, Homo sapiens
gacctggggtggaaggaaggca

SEQ ID NO: 8130414 - DNA, 22 bp, Homo sapiens
gaccttgtaaattttcactcca

SEQ ID NO: 8130415 - DNA, 21 bp, Homo sapiens
gacaaacatttcatagcttta

SEQ ID NO: 8130416 - DNA, 22 bp, Homo sapiens
gacaaaagtgttttgaacaagg

SEQ ID NO: 8130417 - DNA, 22 bp, Homo sapiens
gaatgctaagcatgtgggagtt

SEQ ID NO: 8130418 - DNA, 22 bp, Homo sapiens
gaatgtttgactaaaggtagct

SEQ ID NO: 8130419 - DNA, 19 bp, Homo sapiens
gaatgtttgtattcagcgc

SEQ ID NO: 8130420 - DNA, 22 bp, Homo sapiens
gaattacaaagtgagacaagct

SEQ ID NO: 8130421 - DNA, 22 bp, Homo sapiens
gaatttaaggaccaagcatttt

SEQ ID NO: 8130422 - DNA, 22 bp, Homo sapiens
gaatgtttttcattggtgactc

SEQ ID NO: 8130423 - DNA, 22 bp, Homo sapiens
gaatgtttttaggaatgttatg

SEQ ID NO: 8130424 - DNA, 22 bp, Homo sapiens
gaatgtttttcaaacctgtggc

SEQ ID NO: 8130425 - DNA, 22 bp, Homo sapiens
gaatgtttttataagtgttaca

SEQ ID NO: 8130426 - DNA, 22 bp, Homo sapiens
gaatgtttgtgcagagtcatct

SEQ ID NO: 8130427 - DNA, 22 bp, Homo sapiens
gaggtctgggcttgggcctggt

SEQ ID NO: 8130428 - DNA, 22 bp, Homo sapiens
gaggtctgggatggggcctgaa

SEQ ID NO: 8130429 - DNA, 22 bp, Homo sapiens
gagggtgggtttcttgcacgtc

SEQ ID NO: 8130430 - DNA, 22 bp, Homo sapiens
gagggtgggccagatatgaggg

SEQ ID NO: 8130431 - DNA, 20 bp, Homo sapiens
gagggtgggacttcctaggc

SEQ ID NO: 8130432 - DNA, 22 bp, Homo sapiens
gagggtgggctcctatctgggt

SEQ ID NO: 8130433 - DNA, 22 bp, Homo sapiens
gagggtgggctttgttcctcca

SEQ ID NO: 8130434 - DNA, 22 bp, Homo sapiens
gagggtgggtacaccagccctc

SEQ ID NO: 8130435 - DNA, 22 bp, Homo sapiens
gagggtggggaatagactgcta

SEQ ID NO: 8130436 - DNA, 22 bp, Homo sapiens
gagggtggcctttagagcccat

SEQ ID NO: 8130437 - DNA, 22 bp, Homo sapiens
gagggtggctcctccctgggcc

SEQ ID NO: 8130438 - DNA, 22 bp, Homo sapiens
gagggtggagctccagaatctg

SEQ ID NO: 8130439 - DNA, 22 bp, Homo sapiens
gagggtggaagagctgctgaga

SEQ ID NO: 8130440 - DNA, 22 bp, Homo sapiens
gagggtgcagctgggccccacg

SEQ ID NO: 8130441 - DNA, 22 bp, Homo sapiens
gagggtggaaagggtgtacctg

SEQ ID NO: 8130442 - DNA, 22 bp, Homo sapiens
gaggtgctgctgtacttcttgc

SEQ ID NO: 8130443 - DNA, 22 bp, Homo sapiens
gaggtggctgcttgctgggaaa

SEQ ID NO: 8130444 - DNA, 22 bp, Homo sapiens
gaggtggctgggagtagggaat

SEQ ID NO: 8130445 - DNA, 22 bp, Homo sapiens
gaggcctgggttggaggtgcat

SEQ ID NO: 8130446 - DNA, 22 bp, Homo sapiens
gaggctggttctgaagtactgt

SEQ ID NO: 8130447 - DNA, 22 bp, Homo sapiens
gaggctggtggttagttccatt

SEQ ID NO: 8130448 - DNA, 22 bp, Homo sapiens
gaggctggtaggaaaggaaaca

SEQ ID NO: 8130449 - DNA, 22 bp, Homo sapiens
gaggcgggcagatcacctgagg

SEQ ID NO: 8130450 - DNA, 22 bp, Homo sapiens
gaggcgcagcccggaggagaca

SEQ ID NO: 8130451 - DNA, 22 bp, Homo sapiens
gaggcggccagcgaggccgcaa

SEQ ID NO: 8130452 - DNA, 22 bp, Homo sapiens
gaggctcaaacctggacagagc

SEQ ID NO: 8130453 - DNA, 22 bp, Homo sapiens
gagggccacgttcagggctctc

SEQ ID NO: 8130454 - DNA, 22 bp, Homo sapiens
gagggccaggcggagacaggcg

SEQ ID NO: 8130455 - DNA, 22 bp, Homo sapiens
gagggccctggctggctccagc

SEQ ID NO: 8130456 - DNA, 22 bp, Homo sapiens
gaggagagaacattcctccata

SEQ ID NO: 8130457 - DNA, 22 bp, Homo sapiens
gaggagactgacagcagattct

SEQ ID NO: 8130458 - DNA, 21 bp, Homo sapiens
gaggactgcacactctgattg

SEQ ID NO: 8130459 - DNA, 17 bp, Homo sapiens
gaggacagggaagtagg

SEQ ID NO: 8130460 - DNA, 22 bp, Homo sapiens
gaggacagtgtgatctgccagc

SEQ ID NO: 8130461 - DNA, 22 bp, Homo sapiens
gaggacgggcttcatggggcct

SEQ ID NO: 8130462 - DNA, 22 bp, Homo sapiens
gaggaggttccgggtggagaag

SEQ ID NO: 8130463 - DNA, 22 bp, Homo sapiens
gaggagagaagctaacggtgct

SEQ ID NO: 8130464 - DNA, 22 bp, Homo sapiens
gaggagtgccagccgtggagtc

SEQ ID NO: 8130465 - DNA, 22 bp, Homo sapiens
gaggccagaatgagtctctggg

SEQ ID NO: 8130466 - DNA, 22 bp, Homo sapiens
gaggccagaagtgcctcgggct

SEQ ID NO: 8130467 - DNA, 22 bp, Homo sapiens
gagctcagcccaaagagcagtg

SEQ ID NO: 8130468 - DNA, 22 bp, Homo sapiens
gagctcagcaaaggtctgtgtg

SEQ ID NO: 8130469 - DNA, 22 bp, Homo sapiens
gagctcagtgtagtcatggctt

SEQ ID NO: 8130470 - DNA, 23 bp, Homo sapiens
gagctcaggtagggctcgcccgc

SEQ ID NO: 8130471 - DNA, 22 bp, Homo sapiens
gagcaggacgtgggaatgggaa

SEQ ID NO: 8130472 - DNA, 22 bp, Homo sapiens
gagcaggcattctagtggctga

SEQ ID NO: 8130473 - DNA, 22 bp, Homo sapiens
gagcaggcaactctgcagtgcc

SEQ ID NO: 8130474 - DNA, 22 bp, Homo sapiens
gagctcagaggattctggggag

SEQ ID NO: 8130475 - DNA, 22 bp, Homo sapiens
gagcaggcctggggtgaggcct

SEQ ID NO: 8130476 - DNA, 22 bp, Homo sapiens
gaggacaggagactcactgttt

SEQ ID NO: 8130477 - DNA, 22 bp, Homo sapiens
gagctgggattcatctatgtct

SEQ ID NO: 8130478 - DNA, 22 bp, Homo sapiens
cttggacttccaggaagtattt

SEQ ID NO: 8130479 - DNA, 22 bp, Homo sapiens
cttggactggacccgaggaatg

SEQ ID NO: 8130480 - DNA, 22 bp, Homo sapiens
cttcttctctacatcctttgat

SEQ ID NO: 8130481 - DNA, 22 bp, Homo sapiens
ctttctctgtgtttcacatgct

SEQ ID NO: 8130482 - DNA, 22 bp, Homo sapiens
ctttctcttcactgtcatgatc

SEQ ID NO: 8130483 - DNA, 22 bp, Homo sapiens
ctttgcataatgaatgatcata

SEQ ID NO: 8130484 - DNA, 22 bp, Homo sapiens
ctttgcatgtggtagaaggttc

SEQ ID NO: 8130485 - DNA, 22 bp, Homo sapiens
ctttgcattctcagcacagagc

SEQ ID NO: 8130486 - DNA, 22 bp, Homo sapiens
ctttggaacaagaagaaatggc

SEQ ID NO: 8130487 - DNA, 22 bp, Homo sapiens
ctttgcatacaatttttagaaa

SEQ ID NO: 8130488 - DNA, 21 bp, Homo sapiens
ctttgcatacagatgccaatt

SEQ ID NO: 8130489 - DNA, 22 bp, Homo sapiens
ctttgcatgggtctgaaggctt

SEQ ID NO: 8130490 - DNA, 21 bp, Homo sapiens
ctttgcatctatatgttctca

SEQ ID NO: 8130491 - DNA, 21 bp, Homo sapiens
ctttgcatctatatgttctca

SEQ ID NO: 8130492 - DNA, 22 bp, Homo sapiens
ctttctctgtgtttcacatgct

SEQ ID NO: 8130493 - DNA, 22 bp, Homo sapiens
cttccctcctggattccagact

SEQ ID NO: 8130494 - DNA, 20 bp, Homo sapiens
cttcttcagcctatgcttca

SEQ ID NO: 8130495 - DNA, 22 bp, Homo sapiens
ctgttaaagatagttaagcttc

SEQ ID NO: 8130496 - DNA, 22 bp, Homo sapiens
ctgttaaaatgtggtcttaaaa

SEQ ID NO: 8130497 - DNA, 20 bp, Homo sapiens
ctgttaaaaggtatgaattc

SEQ ID NO: 8130498 - DNA, 22 bp, Homo sapiens
gaagaactttagggcagaattt

SEQ ID NO: 8130499 - DNA, 22 bp, Homo sapiens
gaacttgttgtaagaaaatatg

SEQ ID NO: 8130500 - DNA, 22 bp, Homo sapiens
gaaattaagcaggggtctgtgg

SEQ ID NO: 8130501 - DNA, 22 bp, Homo sapiens
gaaatgttttacaaggcatact

SEQ ID NO: 8130502 - DNA, 22 bp, Homo sapiens
gaaatgtttgggaggagtcaac

SEQ ID NO: 8130503 - DNA, 23 bp, Homo sapiens
gaaatgtttcttgattaatccta

SEQ ID NO: 8130504 - DNA, 22 bp, Homo sapiens
gaaatgtttccttttgtatgct

SEQ ID NO: 8130505 - DNA, 22 bp, Homo sapiens
gaaattaaccacctttggcttt

SEQ ID NO: 8130506 - DNA, 22 bp, Homo sapiens
gaaatgttggacacttgaaatt

SEQ ID NO: 8130507 - DNA, 22 bp, Homo sapiens
gaaatgttgtctctgcagcaat

SEQ ID NO: 8130508 - DNA, 22 bp, Homo sapiens
gaaatgttgtcctgtctcttga

SEQ ID NO: 8130509 - DNA, 22 bp, Homo sapiens
gaaatgttatgagatatgtact

SEQ ID NO: 8130510 - DNA, 22 bp, Homo sapiens
gaaatgttcctgatccctgatt

SEQ ID NO: 8130511 - DNA, 22 bp, Homo sapiens
gaaagacatagttgcaagatgg

SEQ ID NO: 8130512 - DNA, 22 bp, Homo sapiens
gaaatgtctttgacaagagagg

SEQ ID NO: 8130513 - DNA, 22 bp, Homo sapiens
ctttttgttgtataagcccttt

SEQ ID NO: 8130514 - DNA, 22 bp, Homo sapiens
gaaagaatgctatagtgacttc

SEQ ID NO: 8130515 - DNA, 22 bp, Homo sapiens
gaaagaatgctgggagccatct

SEQ ID NO: 8130516 - DNA, 22 bp, Homo sapiens
gaaagaatcaactatgtctctg

SEQ ID NO: 8130517 - DNA, 22 bp, Homo sapiens
ctttggaggtcatagccaagag

SEQ ID NO: 8130518 - DNA, 22 bp, Homo sapiens
ctttggaagtaaagtcagcagg

SEQ ID NO: 8130519 - DNA, 22 bp, Homo sapiens
cttttgttctacagctggggaa

SEQ ID NO: 8130520 - DNA, 22 bp, Homo sapiens
ctttttgtctctgtcctgatga

SEQ ID NO: 8130521 - DNA, 22 bp, Homo sapiens
ctgggagtgtccctctggtaat

SEQ ID NO: 8130522 - DNA, 22 bp, Homo sapiens
ctgggcccacgagggctctggg

SEQ ID NO: 8130523 - DNA, 22 bp, Homo sapiens
ctgggcccacaagtggaatcgt

SEQ ID NO: 8130524 - DNA, 22 bp, Homo sapiens
ctgggccagatccagcctcaca

SEQ ID NO: 8130525 - DNA, 22 bp, Homo sapiens
ctgggatggctccgctgctgct

SEQ ID NO: 8130526 - DNA, 22 bp, Homo sapiens
ctgggagtcaccaggagcaagg

SEQ ID NO: 8130527 - DNA, 22 bp, Homo sapiens
ctgggaggcggaggttgcagtg

SEQ ID NO: 8130528 - DNA, 22 bp, Homo sapiens
ctgggctcaaatcctggccctg

SEQ ID NO: 8130529 - DNA, 22 bp, Homo sapiens
ctgggcccaggcggctctcgga

SEQ ID NO: 8130530 - DNA, 22 bp, Homo sapiens
ctgggtggctgtccagccagcc

SEQ ID NO: 8130531 - DNA, 22 bp, Homo sapiens
ctggggtggtgcaggcctcatg

SEQ ID NO: 8130532 - DNA, 22 bp, Homo sapiens
ctggggtggaggagctcccctg

SEQ ID NO: 8130533 - DNA, 22 bp, Homo sapiens
ctgggggtgagcagcagcgacg

SEQ ID NO: 8130534 - DNA, 22 bp, Homo sapiens
ctgggggtcgcgcctctgggca

SEQ ID NO: 8130535 - DNA, 22 bp, Homo sapiens
ctggggctggtgaggcaggctc

SEQ ID NO: 8130536 - DNA, 22 bp, Homo sapiens
ctgggggccttacggaactcca

SEQ ID NO: 8130537 - DNA, 20 bp, Homo sapiens
ctgggctcggtggccctggc

SEQ ID NO: 8130538 - DNA, 23 bp, Homo sapiens
ctgtgtgtgccgagggtggccac

SEQ ID NO: 8130539 - DNA, 22 bp, Homo sapiens
ctgtgtgtgagaagcaggttga

SEQ ID NO: 8130540 - DNA, 22 bp, Homo sapiens
ctgtgtgtgctacaggcttcca

SEQ ID NO: 8130541 - DNA, 22 bp, Homo sapiens
ctgtgtgtgtctgcagcatact

SEQ ID NO: 8130542 - DNA, 22 bp, Homo sapiens
ctgtgtgtttatatcatttcct

SEQ ID NO: 8130543 - DNA, 22 bp, Homo sapiens
ctgtggggccaaattctcctct

SEQ ID NO: 8130544 - DNA, 22 bp, Homo sapiens
ctgtgggctgaaagtgctcccg

SEQ ID NO: 8130545 - DNA, 22 bp, Homo sapiens
ctgtgtgtgaacacagcccagc

SEQ ID NO: 8130546 - DNA, 22 bp, Homo sapiens
ctgtgggcgcctgtcagcctca

SEQ ID NO: 8130547 - DNA, 22 bp, Homo sapiens
ctgtgggcatttgagtgtgggt

SEQ ID NO: 8130548 - DNA, 22 bp, Homo sapiens
ctgtgggcctagtctggcctag

SEQ ID NO: 8130549 - DNA, 20 bp, Homo sapiens
ctgtggcatcttgaaggagg

SEQ ID NO: 8130550 - DNA, 22 bp, Homo sapiens
ctgtggatttacttgagaagct

SEQ ID NO: 8130551 - DNA, 22 bp, Homo sapiens
ctgtgaatttaaagcacacatc

SEQ ID NO: 8130552 - DNA, 22 bp, Homo sapiens
ctggttttccaatgttttgact

SEQ ID NO: 8130553 - DNA, 21 bp, Homo sapiens
ctgtcatgcaaccattctcca

SEQ ID NO: 8130554 - DNA, 22 bp, Homo sapiens
ctgtcatggtttgaatgctcgc

SEQ ID NO: 8130555 - DNA, 22 bp, Homo sapiens
ctgtcatggtcagattgtcatc

SEQ ID NO: 8130556 - DNA, 22 bp, Homo sapiens
ctatacatcccaatttcagaga

SEQ ID NO: 8130557 - DNA, 22 bp, Homo sapiens
ctataattatgctcaaaatgta

SEQ ID NO: 8130558 - DNA, 22 bp, Homo sapiens
ctcagagagggcaccagggcca

SEQ ID NO: 8130559 - DNA, 22 bp, Homo sapiens
ctcagagatatagtccctgctt

SEQ ID NO: 8130560 - DNA, 22 bp, Homo sapiens
ctagaaatattttacagtcaag

SEQ ID NO: 8130561 - DNA, 22 bp, Homo sapiens
ctagaaatacaggcacgtgcca

SEQ ID NO: 8130562 - DNA, 17 bp, Homo sapiens
ctagagagaaagagcta

SEQ ID NO: 8130563 - DNA, 22 bp, Homo sapiens
cgtgtctgggatagcagaagta

SEQ ID NO: 8130564 - DNA, 22 bp, Homo sapiens
cgtgtgttgaaagatgtacatc

SEQ ID NO: 8130565 - DNA, 22 bp, Homo sapiens
ttctggaagccccagagtcaga

SEQ ID NO: 8130566 - DNA, 22 bp, Homo sapiens
ttctggaagctgggcagcaccc

SEQ ID NO: 8130567 - DNA, 22 bp, Homo sapiens
ctccagagtcacactgcctggg

SEQ ID NO: 8130568 - DNA, 22 bp, Homo sapiens
ctccagagggtcagactctgag

SEQ ID NO: 8130569 - DNA, 22 bp, Homo sapiens
ttgcatcagaattacttggagg

SEQ ID NO: 8130570 - DNA, 22 bp, Homo sapiens
ttgcatcaggtagacaactata

SEQ ID NO: 8130571 - DNA, 22 bp, Homo sapiens
ttgcatgcaaggcctccgtggc

SEQ ID NO: 8130572 - DNA, 22 bp, Homo sapiens
ctcagggcagtatggctgagag

SEQ ID NO: 8130573 - DNA, 22 bp, Homo sapiens
ctcagggctggaaagccaggaa

SEQ ID NO: 8130574 - DNA, 22 bp, Homo sapiens
ctcagggtgagaaattgatcca

SEQ ID NO: 8130575 - DNA, 22 bp, Homo sapiens
ctcagggtaatgaaagacgaat

SEQ ID NO: 8130576 - DNA, 22 bp, Homo sapiens
cggcagagcttcctgctcagcg

SEQ ID NO: 8130577 - DNA, 22 bp, Homo sapiens
cggcagagtgtgtgcgtgcatg

SEQ ID NO: 8130578 - DNA, 22 bp, Homo sapiens
cggcagagccctgagtcagcct

SEQ ID NO: 8130579 - DNA, 22 bp, Homo sapiens
cggggcagagggtcttctccag

SEQ ID NO: 8130580 - DNA, 22 bp, Homo sapiens
cggggcagaaagttgtcttttg

SEQ ID NO: 8130581 - DNA, 22 bp, Homo sapiens
cggggagggcagaggctccctc

SEQ ID NO: 8130582 - DNA, 23 bp, Homo sapiens
cggggccagggtcaggaccggtc

SEQ ID NO: 8130583 - DNA, 22 bp, Homo sapiens
cggggcaggagtccctgtagag

SEQ ID NO: 8130584 - DNA, 22 bp, Homo sapiens
cgggaggaaaggcgaggctctg

SEQ ID NO: 8130585 - DNA, 22 bp, Homo sapiens
cggggaggcttcggattaaagc

SEQ ID NO: 8130586 - DNA, 22 bp, Homo sapiens
cggggcctaccgctgcgtggcc

SEQ ID NO: 8130587 - DNA, 22 bp, Homo sapiens
cggggcgagcagacggcggcaa

SEQ ID NO: 8130588 - DNA, 22 bp, Homo sapiens
cggggctgaggcaacgcggaga

SEQ ID NO: 8130589 - DNA, 22 bp, Homo sapiens
cggggctgacagcaggtgtgct

SEQ ID NO: 8130590 - DNA, 22 bp, Homo sapiens
cggggctgctcgtcctcctgtg

SEQ ID NO: 8130591 - DNA, 22 bp, Homo sapiens
cgtggggacccacgtgcagcac

SEQ ID NO: 8130592 - DNA, 22 bp, Homo sapiens
cgtgggagtggtgggtgctcag

SEQ ID NO: 8130593 - DNA, 22 bp, Homo sapiens
cgtgggaggaaaaatgggcttc

SEQ ID NO: 8130594 - DNA, 22 bp, Homo sapiens
ttcaaagtcctgtcaggtagcc

SEQ ID NO: 8130595 - DNA, 22 bp, Homo sapiens
ttatttcatgtaaaatttatgt

SEQ ID NO: 8130596 - DNA, 22 bp, Homo sapiens
ttatttcatataatgttatcaa

SEQ ID NO: 8130597 - DNA, 20 bp, Homo sapiens
cgctcctgttcccggtccca

SEQ ID NO: 8130598 - DNA, 22 bp, Homo sapiens
ttatttattgtgtacctactgt

SEQ ID NO: 8130599 - DNA, 22 bp, Homo sapiens
ttatttatgttaacagtcgaga

SEQ ID NO: 8130600 - DNA, 20 bp, Homo sapiens
ttatttcagttgctagattg

SEQ ID NO: 8130601 - DNA, 22 bp, Homo sapiens
cctttttcagcttctagaggct

SEQ ID NO: 8130602 - DNA, 22 bp, Homo sapiens
ccttttcttgccactgactcgg

SEQ ID NO: 8130603 - DNA, 22 bp, Homo sapiens
ttatatttctggtagccttcag

SEQ ID NO: 8130604 - DNA, 22 bp, Homo sapiens
ccttgaaatgagaaaaagttgg

SEQ ID NO: 8130605 - DNA, 23 bp, Homo sapiens
ccttcagaagaagtaacaggggc

SEQ ID NO: 8130606 - DNA, 22 bp, Homo sapiens
ccttcagacctagacaggaatc

SEQ ID NO: 8130607 - DNA, 22 bp, Homo sapiens
ccttcagaggtgtagattgcgt

SEQ ID NO: 8130608 - DNA, 20 bp, Homo sapiens
ccttcagaacttacatagta

SEQ ID NO: 8130609 - DNA, 22 bp, Homo sapiens
ttagcaattgattctcataagc

SEQ ID NO: 8130610 - DNA, 22 bp, Homo sapiens
ccttacctgattgctggcatcc

SEQ ID NO: 8130611 - DNA, 22 bp, Homo sapiens
ttaagaggagatcatactggag

SEQ ID NO: 8130612 - DNA, 22 bp, Homo sapiens
tgtcaataactggagtcattat

SEQ ID NO: 8130613 - DNA, 22 bp, Homo sapiens
tgtcaatatgtaataactgaat

SEQ ID NO: 8130614 - DNA, 21 bp, Homo sapiens
tgtcagagcttgtaggacatt

SEQ ID NO: 8130615 - DNA, 20 bp, Homo sapiens
tgtcagcaattaggagaaaa

SEQ ID NO: 8130616 - DNA, 22 bp, Homo sapiens
tttgaaagacagaatatttttg

SEQ ID NO: 8130617 - DNA, 22 bp, Homo sapiens
tttgaaaattagacacaggcta

SEQ ID NO: 8130618 - DNA, 22 bp, Homo sapiens
tttgaaaatttaagtgctacac

SEQ ID NO: 8130619 - DNA, 22 bp, Homo sapiens
tttgaaaacttaatttggtcgt

SEQ ID NO: 8130620 - DNA, 22 bp, Homo sapiens
tttgaaaagaaccatcgcctta

SEQ ID NO: 8130621 - DNA, 21 bp, Homo sapiens
tttgaatagaaatagtgctta

SEQ ID NO: 8130622 - DNA, 22 bp, Homo sapiens
ctctgcagagcctccagcccag

SEQ ID NO: 8130623 - DNA, 19 bp, Homo sapiens
tttgaaagagttttattgg

SEQ ID NO: 8130624 - DNA, 19 bp, Homo sapiens
ctctggcctctggatgctg

SEQ ID NO: 8130625 - DNA, 22 bp, Homo sapiens
ctctggcctgcttcctcaggta

SEQ ID NO: 8130626 - DNA, 22 bp, Homo sapiens
ctctggcctggggcctgctccc

SEQ ID NO: 8130627 - DNA, 22 bp, Homo sapiens
ctctggccccagtggccccttg

SEQ ID NO: 8130628 - DNA, 22 bp, Homo sapiens
ctctggccagagcctgcgggaa

SEQ ID NO: 8130629 - DNA, 22 bp, Homo sapiens
tttggaatgtagtttaatcatc

SEQ ID NO: 8130630 - DNA, 21 bp, Homo sapiens
ttttgctgttttagaatgaga

SEQ ID NO: 8130631 - DNA, 22 bp, Homo sapiens
ttttgctgttatatgctattat

SEQ ID NO: 8130632 - DNA, 22 bp, Homo sapiens
ttttgctggtttatctctatta

SEQ ID NO: 8130633 - DNA, 22 bp, Homo sapiens
ctctggttgagtgagaaccaag

SEQ ID NO: 8130634 - DNA, 22 bp, Homo sapiens
ctctggtttatttcttggaaag

SEQ ID NO: 8130635 - DNA, 22 bp, Homo sapiens
tttcattatacagcttcataaa

SEQ ID NO: 8130636 - DNA, 22 bp, Homo sapiens
tttccacagctgtataaaataa

SEQ ID NO: 8130637 - DNA, 22 bp, Homo sapiens
tttccacatcaccatgaggtga

SEQ ID NO: 8130638 - DNA, 22 bp, Homo sapiens
ctctgaaagagtttagtattat

SEQ ID NO: 8130639 - DNA, 22 bp, Homo sapiens
ctctgaaagttagagaaaatag

SEQ ID NO: 8130640 - DNA, 22 bp, Homo sapiens
ctctgaaactcctgcaccttct

SEQ ID NO: 8130641 - DNA, 22 bp, Homo sapiens
tttctacatgtcaatccaaacc

SEQ ID NO: 8130642 - DNA, 18 bp, Homo sapiens
tttatgagctgtgggacc

SEQ ID NO: 8130643 - DNA, 22 bp, Homo sapiens
ctccaggcccacggccgcggcc

SEQ ID NO: 8130644 - DNA, 22 bp, Homo sapiens
tttatgcagcgtttcaccaccc

SEQ ID NO: 8130645 - DNA, 22 bp, Homo sapiens
tttcagaatatcgattcagtga

SEQ ID NO: 8130646 - DNA, 22 bp, Homo sapiens
ctccttcccctactcagcatcc

SEQ ID NO: 8130647 - DNA, 22 bp, Homo sapiens
tttcagaaattgttattattct

SEQ ID NO: 8130648 - DNA, 22 bp, Homo sapiens
tttcagaaattatattagatgc

SEQ ID NO: 8130649 - DNA, 22 bp, Homo sapiens
tttcacatagaaagtgatttac

SEQ ID NO: 8130650 - DNA, 22 bp, Homo sapiens
ctgcaggacagggccggaggcc

SEQ ID NO: 8130651 - DNA, 22 bp, Homo sapiens
ctgcagcctcaacctcctgagc

SEQ ID NO: 8130652 - DNA, 22 bp, Homo sapiens
ctgcagcctaggtgcagctggg

SEQ ID NO: 8130653 - DNA, 22 bp, Homo sapiens
ctgcaggagtgaaagcaggcct

SEQ ID NO: 8130654 - DNA, 22 bp, Homo sapiens
ctgcaggaggatcctgagagtg

SEQ ID NO: 8130655 - DNA, 22 bp, Homo sapiens
ctgcccacacctgagctgggcc

SEQ ID NO: 8130656 - DNA, 22 bp, Homo sapiens
ctgcccagattttaccacctgc

SEQ ID NO: 8130657 - DNA, 20 bp, Homo sapiens
ctgcccagccactgagggat

SEQ ID NO: 8130658 - DNA, 22 bp, Homo sapiens
ctgcccagtttgggagcctttc

SEQ ID NO: 8130659 - DNA, 22 bp, Homo sapiens
ctgcccaggctgaaggaacatc

SEQ ID NO: 8130660 - DNA, 22 bp, Homo sapiens
ctgaggcctggccccaccacag

SEQ ID NO: 8130661 - DNA, 22 bp, Homo sapiens
ctgagcatttgtgcagcttctc

SEQ ID NO: 8130662 - DNA, 22 bp, Homo sapiens
ctgagcatttgcctttttaaca

SEQ ID NO: 8130663 - DNA, 22 bp, Homo sapiens
ctgagcatttgccggagcgtca

SEQ ID NO: 8130664 - DNA, 22 bp, Homo sapiens
ctgagcattatcttggattttg

SEQ ID NO: 8130665 - DNA, 22 bp, Homo sapiens
ctgagcatggccggtccatggt

SEQ ID NO: 8130666 - DNA, 22 bp, Homo sapiens
ctgagcatgctacatgcagcac

SEQ ID NO: 8130667 - DNA, 22 bp, Homo sapiens
ctgagcatgctcctcttttcca

SEQ ID NO: 8130668 - DNA, 22 bp, Homo sapiens
ctgagcatccagcaggtactgc

SEQ ID NO: 8130669 - DNA, 17 bp, Homo sapiens
ctgagcatccgtgctct

SEQ ID NO: 8130670 - DNA, 22 bp, Homo sapiens
ctgagcatcatggcagaatctt

SEQ ID NO: 8130671 - DNA, 22 bp, Homo sapiens
ctcttcctagtgtgcagcgtgg

SEQ ID NO: 8130672 - DNA, 22 bp, Homo sapiens
ctcttcctacagtctgctatgc

SEQ ID NO: 8130673 - DNA, 22 bp, Homo sapiens
ctgagcagtgctttgcagtggg

SEQ ID NO: 8130674 - DNA, 22 bp, Homo sapiens
ctgagcagtctagccaggtgtt

SEQ ID NO: 8130675 - DNA, 19 bp, Homo sapiens
ctgagcaggcaggtaggat

SEQ ID NO: 8130676 - DNA, 22 bp, Homo sapiens
ctgagcaggcggtggagcggct

SEQ ID NO: 8130677 - DNA, 22 bp, Homo sapiens
ctgagcaggcggtggagcggct

SEQ ID NO: 8130678 - DNA, 22 bp, Homo sapiens
ctgagcaggacagtgggagacc

SEQ ID NO: 8130679 - DNA, 19 bp, Homo sapiens
ctgagcagcggcagcactt

SEQ ID NO: 8130680 - DNA, 22 bp, Homo sapiens
ctgagcagcgtggggagctggc

SEQ ID NO: 8130681 - DNA, 22 bp, Homo sapiens
ctgagcagcgtggggagctggc

SEQ ID NO: 8130682 - DNA, 22 bp, Homo sapiens
ctgagcagctccctgagtggtc

SEQ ID NO: 8130683 - DNA, 19 bp, Homo sapiens
ctgagcagcggcagcactt

SEQ ID NO: 8130684 - DNA, 22 bp, Homo sapiens
ctgagcagaccatggcagaggt

SEQ ID NO: 8130685 - DNA, 22 bp, Homo sapiens
ctgagcagaagggtgcacgtgc

SEQ ID NO: 8130686 - DNA, 22 bp, Homo sapiens
ctggagccggcgagccccagcc

SEQ ID NO: 8130687 - DNA, 22 bp, Homo sapiens
ctggaaagtgtctccatcctgg

SEQ ID NO: 8130688 - DNA, 22 bp, Homo sapiens
ctggaaagtgcatgtaatgagg

SEQ ID NO: 8130689 - DNA, 22 bp, Homo sapiens
ctggaaagtgcttttctgagag

SEQ ID NO: 8130690 - DNA, 22 bp, Homo sapiens
ctggaaagtgctgagacaattg

SEQ ID NO: 8130691 - DNA, 22 bp, Homo sapiens
ctggaaagtcaggtcagaaact

SEQ ID NO: 8130692 - DNA, 22 bp, Homo sapiens
ctggaaagtgaggagagttcca

SEQ ID NO: 8130693 - DNA, 22 bp, Homo sapiens
ctggaaggagaaggaggctgtg

SEQ ID NO: 8130694 - DNA, 22 bp, Homo sapiens
ctggagaaacatcaggcatagg

SEQ ID NO: 8130695 - DNA, 22 bp, Homo sapiens
ctggagaaaatccatgtgtatg

SEQ ID NO: 8130696 - DNA, 22 bp, Homo sapiens
ctgctgtcaaaaatcactccat

SEQ ID NO: 8130697 - DNA, 19 bp, Homo sapiens
ctgctgggtgctgagggag

SEQ ID NO: 8130698 - DNA, 22 bp, Homo sapiens
ctgctgggtctatgcaagtgga

SEQ ID NO: 8130699 - DNA, 21 bp, Homo sapiens
ctgctctgacagtgaggccag

SEQ ID NO: 8130700 - DNA, 22 bp, Homo sapiens
ctgctctgtttcttagctgggt

SEQ ID NO: 8130701 - DNA, 18 bp, Homo sapiens
ctgcctgttgctgagagg

SEQ ID NO: 8130702 - DNA, 22 bp, Homo sapiens
ctgcctgttcctgatcattcta

SEQ ID NO: 8130703 - DNA, 19 bp, Homo sapiens
ctgcctgttatggagagaa

SEQ ID NO: 8130704 - DNA, 22 bp, Homo sapiens
ctgcctgtgtgtgcctgcagaa

SEQ ID NO: 8130705 - DNA, 22 bp, Homo sapiens
ctgcctgtgggtacaagtggaa

SEQ ID NO: 8130706 - DNA, 22 bp, Homo sapiens
ctgcctgtggacaccctggagg

SEQ ID NO: 8130707 - DNA, 21 bp, Homo sapiens
tggctctgaaagagtgctgca

SEQ ID NO: 8130708 - DNA, 22 bp, Homo sapiens
tgggccagaagtatgcatgttt

SEQ ID NO: 8130709 - DNA, 22 bp, Homo sapiens
tgggccagaggcatggagctat

SEQ ID NO: 8130710 - DNA, 22 bp, Homo sapiens
cctgaggcttaatctgtcccaa

SEQ ID NO: 8130711 - DNA, 22 bp, Homo sapiens
cctgcaccacaaggcttcagag

SEQ ID NO: 8130712 - DNA, 22 bp, Homo sapiens
cctgccaggagctggtgctgca

SEQ ID NO: 8130713 - DNA, 22 bp, Homo sapiens
cctgcaccaggcccagcatggt

SEQ ID NO: 8130714 - DNA, 21 bp, Homo sapiens
tgggggagaattggttgcttt

SEQ ID NO: 8130715 - DNA, 22 bp, Homo sapiens
tgggggtggttcttgcctccag

SEQ ID NO: 8130716 - DNA, 22 bp, Homo sapiens
tgggggtgtcctggtgcacaca

SEQ ID NO: 8130717 - DNA, 22 bp, Homo sapiens
tgggggtgtgccagggacctcc

SEQ ID NO: 8130718 - DNA, 22 bp, Homo sapiens
tgggtcagagcagacctctgga

SEQ ID NO: 8130719 - DNA, 22 bp, Homo sapiens
tgggtcagacagccagtgggcc

SEQ ID NO: 8130720 - DNA, 22 bp, Homo sapiens
tgggtcagaggacctcgtggcc

SEQ ID NO: 8130721 - DNA, 22 bp, Homo sapiens
cctggagctcactgggagccgg

SEQ ID NO: 8130722 - DNA, 22 bp, Homo sapiens
cctggagggcgccgcacagtcc

SEQ ID NO: 8130723 - DNA, 18 bp, Homo sapiens
cctggaggtcttcggggt

SEQ ID NO: 8130724 - DNA, 22 bp, Homo sapiens
cctggaggcggaggttgcagtg

SEQ ID NO: 8130725 - DNA, 22 bp, Homo sapiens
cctggaggctctgggagggcag

SEQ ID NO: 8130726 - DNA, 18 bp, Homo sapiens
cctggagctccacagcaa

SEQ ID NO: 8130727 - DNA, 22 bp, Homo sapiens
cctggagcttggtcacgctgcg

SEQ ID NO: 8130728 - DNA, 22 bp, Homo sapiens
ccgtccccagccacctgctgat

SEQ ID NO: 8130729 - DNA, 22 bp, Homo sapiens
ccgtctgcagcctccaggagtt

SEQ ID NO: 8130730 - DNA, 22 bp, Homo sapiens
ccgtcccctctgaccttgctga

SEQ ID NO: 8130731 - DNA, 22 bp, Homo sapiens
ccggggacttaaagtgaaggaa

SEQ ID NO: 8130732 - DNA, 22 bp, Homo sapiens
ccgggtggggactccaggtttc

SEQ ID NO: 8130733 - DNA, 22 bp, Homo sapiens
ccgggccgccccgcgtttctta

SEQ ID NO: 8130734 - DNA, 22 bp, Homo sapiens
ccgggccccacggtgacctcag

SEQ ID NO: 8130735 - DNA, 22 bp, Homo sapiens
ccgggcgggggctctcgtcacc

SEQ ID NO: 8130736 - DNA, 20 bp, Homo sapiens
cctcacagggcagagagggg

SEQ ID NO: 8130737 - DNA, 20 bp, Homo sapiens
cctcacagggcagagagggg

SEQ ID NO: 8130738 - DNA, 17 bp, Homo sapiens
cctcacagggaccagac

SEQ ID NO: 8130739 - DNA, 17 bp, Homo sapiens
cctcacagggaccagac

SEQ ID NO: 8130740 - DNA, 22 bp, Homo sapiens
cctcacagcttgggcaaacggc

SEQ ID NO: 8130741 - DNA, 22 bp, Homo sapiens
cctcacagcctcatgcccagcc

SEQ ID NO: 8130742 - DNA, 22 bp, Homo sapiens
cctcacagggccaggcccctca

SEQ ID NO: 8130743 - DNA, 22 bp, Homo sapiens
cctcacagcccttggcccagga

SEQ ID NO: 8130744 - DNA, 22 bp, Homo sapiens
cctcacagagcccagatgtcta

SEQ ID NO: 8130745 - DNA, 22 bp, Homo sapiens
cctcacagaggggcagccatct

SEQ ID NO: 8130746 - DNA, 22 bp, Homo sapiens
ccgcggggtcatggctgggccg

SEQ ID NO: 8130747 - DNA, 22 bp, Homo sapiens
ccgccgtgtcgacaggccctgg

SEQ ID NO: 8130748 - DNA, 22 bp, Homo sapiens
ccctgtgagcggctggatgcct

SEQ ID NO: 8130749 - DNA, 22 bp, Homo sapiens
tggctcagcgcggcctggtctt

SEQ ID NO: 8130750 - DNA, 22 bp, Homo sapiens
cctccccatgacccggtgctgg

SEQ ID NO: 8130751 - DNA, 22 bp, Homo sapiens
tggctcagccagccctaggaac

SEQ ID NO: 8130752 - DNA, 22 bp, Homo sapiens
tggctcagccattcgtgttgcc

SEQ ID NO: 8130753 - DNA, 22 bp, Homo sapiens
tggctcagcctggccctttcat

SEQ ID NO: 8130754 - DNA, 22 bp, Homo sapiens
cctcagccttggccccaggcag

SEQ ID NO: 8130755 - DNA, 22 bp, Homo sapiens
cctcagcccctgaatggagaga

SEQ ID NO: 8130756 - DNA, 22 bp, Homo sapiens
cctcactgaagaggtgacattt

SEQ ID NO: 8130757 - DNA, 22 bp, Homo sapiens
tggccctgcttatgtctctctt

SEQ ID NO: 8130758 - DNA, 22 bp, Homo sapiens
tggaagaatgtttgccttataa

SEQ ID NO: 8130759 - DNA, 22 bp, Homo sapiens
tgcctcataacactcctggagt

SEQ ID NO: 8130760 - DNA, 22 bp, Homo sapiens
tgcctcagtttcatctgcagaa

SEQ ID NO: 8130761 - DNA, 22 bp, Homo sapiens
tgcctcagtttctccatatgaa

SEQ ID NO: 8130762 - DNA, 21 bp, Homo sapiens
tgctttctaaaaatactattg

SEQ ID NO: 8130763 - DNA, 19 bp, Homo sapiens
tggaggggtttgaatgtgg

SEQ ID NO: 8130764 - DNA, 22 bp, Homo sapiens
tggaggggcaatggagcgcgga

SEQ ID NO: 8130765 - DNA, 22 bp, Homo sapiens
ccctggagctagtctgagcaga

SEQ ID NO: 8130766 - DNA, 22 bp, Homo sapiens
ccctgctcttctgactcaagct

SEQ ID NO: 8130767 - DNA, 22 bp, Homo sapiens
tggaggccagaggtactgggac

SEQ ID NO: 8130768 - DNA, 22 bp, Homo sapiens
tggacagtgcagatacagaatg

SEQ ID NO: 8130769 - DNA, 22 bp, Homo sapiens
ccctgcctctgaagctgctcag

SEQ ID NO: 8130770 - DNA, 22 bp, Homo sapiens
ccctgcctgtgggcatcaacat

SEQ ID NO: 8130771 - DNA, 22 bp, Homo sapiens
ccatggaagaactgatgtgcca

SEQ ID NO: 8130772 - DNA, 19 bp, Homo sapiens
ccatggagagagatgcatt

SEQ ID NO: 8130773 - DNA, 20 bp, Homo sapiens
ccatggccacatctgtgctg

SEQ ID NO: 8130774 - DNA, 23 bp, Homo sapiens
cccacatgtctgagtcagtgcca

SEQ ID NO: 8130775 - DNA, 22 bp, Homo sapiens
tgcagaggtgaaagactagcaa

SEQ ID NO: 8130776 - DNA, 22 bp, Homo sapiens
tgcagaggtttccaggcaagtt

SEQ ID NO: 8130777 - DNA, 22 bp, Homo sapiens
tgcagaggtttgtggtgttgct

SEQ ID NO: 8130778 - DNA, 22 bp, Homo sapiens
tgcagaggtttttaatacattt

SEQ ID NO: 8130779 - DNA, 22 bp, Homo sapiens
tgcagtctggatgtcctcagat

SEQ ID NO: 8130780 - DNA, 22 bp, Homo sapiens
tgccctctgcctcctctgcaga

SEQ ID NO: 8130781 - DNA, 22 bp, Homo sapiens
tgaccatttgatctacattcca

SEQ ID NO: 8130782 - DNA, 22 bp, Homo sapiens
tgagaaaactcaaagacagatc

SEQ ID NO: 8130783 - DNA, 22 bp, Homo sapiens
tgagaaaacagtttgtaataat

SEQ ID NO: 8130784 - DNA, 22 bp, Homo sapiens
tgacagaggcacccacaactat

SEQ ID NO: 8130785 - DNA, 22 bp, Homo sapiens
tgacagagcatgtagtgacagc

SEQ ID NO: 8130786 - DNA, 22 bp, Homo sapiens
tgacagagtccagaagtagtgt

SEQ ID NO: 8130787 - DNA, 22 bp, Homo sapiens
tgaaggagaattaataggcatt

SEQ ID NO: 8130788 - DNA, 22 bp, Homo sapiens
tgacaatgggtggacaagatag

SEQ ID NO: 8130789 - DNA, 22 bp, Homo sapiens
tgacaatgggtggacaagatag

SEQ ID NO: 8130790 - DNA, 19 bp, Homo sapiens
tgagactgggtgcagtact

SEQ ID NO: 8130791 - DNA, 22 bp, Homo sapiens
ccagggtgtgagaaggaagtag

SEQ ID NO: 8130792 - DNA, 22 bp, Homo sapiens
tgaggaatgctgagcagaggaa

SEQ ID NO: 8130793 - DNA, 22 bp, Homo sapiens
ccagcccttgagatggaaggga

SEQ ID NO: 8130794 - DNA, 22 bp, Homo sapiens
ccagccggactccacttcccgt

SEQ ID NO: 8130795 - DNA, 22 bp, Homo sapiens
tgaacaggagaaaggtttcttt

SEQ ID NO: 8130796 - DNA, 22 bp, Homo sapiens
tgaacacatttgggaaaatctt

SEQ ID NO: 8130797 - DNA, 22 bp, Homo sapiens
tgaacaggtcttagtaggttct

SEQ ID NO: 8130798 - DNA, 22 bp, Homo sapiens
tgaaagcatatgctaaagacca

SEQ ID NO: 8130799 - DNA, 22 bp, Homo sapiens
ccaggctgctcacaagctgccc

SEQ ID NO: 8130800 - DNA, 22 bp, Homo sapiens
ccaggctgccgaggaaagaaag

SEQ ID NO: 8130801 - DNA, 22 bp, Homo sapiens
ccaggctgcagtcaaggggcat

SEQ ID NO: 8130802 - DNA, 22 bp, Homo sapiens
ccagcaggtgtagggctcatgg

SEQ ID NO: 8130803 - DNA, 19 bp, Homo sapiens
ccagcaggttcatttcagg

SEQ ID NO: 8130804 - DNA, 22 bp, Homo sapiens
tctcttaaaagagtaatagaga

SEQ ID NO: 8130805 - DNA, 22 bp, Homo sapiens
tctgatataaaagtgacattca

SEQ ID NO: 8130806 - DNA, 22 bp, Homo sapiens
tctgagagctctggggcccctt

SEQ ID NO: 8130807 - DNA, 22 bp, Homo sapiens
ccagccctgtttatgtgtcact

SEQ ID NO: 8130808 - DNA, 22 bp, Homo sapiens
ccagccctgtaaggatgaggca

SEQ ID NO: 8130809 - DNA, 22 bp, Homo sapiens
ccagcagctccctcagggtccg

SEQ ID NO: 8130810 - DNA, 22 bp, Homo sapiens
ccagcagggcagtgccctggac

SEQ ID NO: 8130811 - DNA, 22 bp, Homo sapiens
ccagcagggaaaaacccaccaa

SEQ ID NO: 8130812 - DNA, 22 bp, Homo sapiens
ccacattgactgtctgtagatt

SEQ ID NO: 8130813 - DNA, 22 bp, Homo sapiens
ccacattggcctcagaggttag

SEQ ID NO: 8130814 - DNA, 18 bp, Homo sapiens
tcctctctttccccaggg

SEQ ID NO: 8130815 - DNA, 22 bp, Homo sapiens
tcctctgagctcaaaatccagc

SEQ ID NO: 8130816 - DNA, 22 bp, Homo sapiens
tcctgaatttcccagcatgaac

SEQ ID NO: 8130817 - DNA, 20 bp, Homo sapiens
tcctgaatttcctttctgct

SEQ ID NO: 8130818 - DNA, 22 bp, Homo sapiens
tcctgaattgttgagaagcagc

SEQ ID NO: 8130819 - DNA, 22 bp, Homo sapiens
tcctgaattgaactcagttaat

SEQ ID NO: 8130820 - DNA, 22 bp, Homo sapiens
tcctgaattgccttagtttctg

SEQ ID NO: 8130821 - DNA, 22 bp, Homo sapiens
tcctgaattcctctttgcatcc

SEQ ID NO: 8130822 - DNA, 22 bp, Homo sapiens
tcctgaatgagttgatcacaat

SEQ ID NO: 8130823 - DNA, 22 bp, Homo sapiens
tcctgaataaattagctgtcac

SEQ ID NO: 8130824 - DNA, 22 bp, Homo sapiens
tcctgaatccaggagagtaggg

SEQ ID NO: 8130825 - DNA, 22 bp, Homo sapiens
tcgggccataggctaggtccct

SEQ ID NO: 8130826 - DNA, 22 bp, Homo sapiens
tcgcggggaagtggtgggctaa

SEQ ID NO: 8130827 - DNA, 22 bp, Homo sapiens
ccaccagaccaccaagagcaac

SEQ ID NO: 8130828 - DNA, 22 bp, Homo sapiens
ccaccagagcttcgtggcttaa

SEQ ID NO: 8130829 - DNA, 22 bp, Homo sapiens
ccaccagaagctgggagaagct

SEQ ID NO: 8130830 - DNA, 22 bp, Homo sapiens
tctcaacaccacttgctgaaga

SEQ ID NO: 8130831 - DNA, 22 bp, Homo sapiens
tctcaacagtgaaatgtgtttg

SEQ ID NO: 8130832 - DNA, 22 bp, Homo sapiens
ccagagagagaggtcaatggca

SEQ ID NO: 8130833 - DNA, 21 bp, Homo sapiens
ccagagagagggaagtgggtt

SEQ ID NO: 8130834 - DNA, 22 bp, Homo sapiens
ccagagagagtactgggctctg

SEQ ID NO: 8130835 - DNA, 22 bp, Homo sapiens
ccagagagagtactgggctctg

SEQ ID NO: 8130836 - DNA, 22 bp, Homo sapiens
ccagagagattgcttctaaaga

SEQ ID NO: 8130837 - DNA, 22 bp, Homo sapiens
ccagagagctacaaggcataaa

SEQ ID NO: 8130838 - DNA, 19 bp, Homo sapiens
ccagagagctaggtacaga

SEQ ID NO: 8130839 - DNA, 22 bp, Homo sapiens
tctccgggtggcggcgaaggga

SEQ ID NO: 8130840 - DNA, 22 bp, Homo sapiens
tctccgggtgcatgtgtgtgcc

SEQ ID NO: 8130841 - DNA, 22 bp, Homo sapiens
ccagagaggcaaaactccttcc

SEQ ID NO: 8130842 - DNA, 22 bp, Homo sapiens
ccagagaggccaaggtcgtggt

SEQ ID NO: 8130843 - DNA, 22 bp, Homo sapiens
ccagagaggccaaggtcgtggt

SEQ ID NO: 8130844 - DNA, 22 bp, Homo sapiens
catcttttggcctattctgagg

SEQ ID NO: 8130845 - DNA, 18 bp, Homo sapiens
tcattcattaaacttggc

SEQ ID NO: 8130846 - DNA, 22 bp, Homo sapiens
tcatgaagtccaaactaaagca

SEQ ID NO: 8130847 - DNA, 22 bp, Homo sapiens
tccacagtctatttttagtcta

SEQ ID NO: 8130848 - DNA, 22 bp, Homo sapiens
tcattctcctctggaaaaggca

SEQ ID NO: 8130849 - DNA, 22 bp, Homo sapiens
tcatttatcgctgccttttaaa

SEQ ID NO: 8130850 - DNA, 22 bp, Homo sapiens
tccaggccccactgaagcccct

SEQ ID NO: 8130851 - DNA, 22 bp, Homo sapiens
tccaggcccatggagcagagct

SEQ ID NO: 8130852 - DNA, 22 bp, Homo sapiens
tccagactctgtcacttcctag

SEQ ID NO: 8130853 - DNA, 21 bp, Homo sapiens
tccagacctccctctcctagc

SEQ ID NO: 8130854 - DNA, 22 bp, Homo sapiens
tccagccgtcacagccacattc

SEQ ID NO: 8130855 - DNA, 22 bp, Homo sapiens
tccagccgccggccctgcaggt

SEQ ID NO: 8130856 - DNA, 22 bp, Homo sapiens
tccagcctaatgttcttcccac

SEQ ID NO: 8130857 - DNA, 17 bp, Homo sapiens
tccagcctcctctgctg

SEQ ID NO: 8130858 - DNA, 17 bp, Homo sapiens
tccagcctcctctgctg

SEQ ID NO: 8130859 - DNA, 22 bp, Homo sapiens
tccagcctcctatttaccctaa

SEQ ID NO: 8130860 - DNA, 22 bp, Homo sapiens
tccagcctcatttctcctgctt

SEQ ID NO: 8130861 - DNA, 22 bp, Homo sapiens
tccagcctcatttctcctgctt

SEQ ID NO: 8130862 - DNA, 22 bp, Homo sapiens
tccctataattgcacatccatt

SEQ ID NO: 8130863 - DNA, 22 bp, Homo sapiens
tcctctccatgtctcacgccac

SEQ ID NO: 8130864 - DNA, 22 bp, Homo sapiens
catttggaccaaaatagccaac

SEQ ID NO: 8130865 - DNA, 22 bp, Homo sapiens
catttggattttgaagagagta

SEQ ID NO: 8130866 - DNA, 22 bp, Homo sapiens
tccccactctctcctggagctt

SEQ ID NO: 8130867 - DNA, 22 bp, Homo sapiens
tccccactcctgggcagatgcg

SEQ ID NO: 8130868 - DNA, 22 bp, Homo sapiens
tccccactctgggccaccacaa

SEQ ID NO: 8130869 - DNA, 22 bp, Homo sapiens
tccccactgggcctcctctttc

SEQ ID NO: 8130870 - DNA, 19 bp, Homo sapiens
tccccagcacctctgagtc

SEQ ID NO: 8130871 - DNA, 22 bp, Homo sapiens
cattgaaacagatgtacccatg

SEQ ID NO: 8130872 - DNA, 22 bp, Homo sapiens
cattgaaatatggaaactgatg

SEQ ID NO: 8130873 - DNA, 18 bp, Homo sapiens
cattgacagtatatcttt

SEQ ID NO: 8130874 - DNA, 22 bp, Homo sapiens
cattgaaaatgttgcaggctgt

SEQ ID NO: 8130875 - DNA, 22 bp, Homo sapiens
tccccactcaccactggccaaa

SEQ ID NO: 8130876 - DNA, 22 bp, Homo sapiens
cattcacaaaaccacatgccat

SEQ ID NO: 8130877 - DNA, 22 bp, Homo sapiens
tcccactgagcatatgcagatg

SEQ ID NO: 8130878 - DNA, 22 bp, Homo sapiens
tcccagccacagtttccacctg

SEQ ID NO: 8130879 - DNA, 22 bp, Homo sapiens
tcacagttaattgttggaatgt

SEQ ID NO: 8130880 - DNA, 23 bp, Homo sapiens
tcacagttacttttgcatcaacc

SEQ ID NO: 8130881 - DNA, 22 bp, Homo sapiens
tcacagttactccttcagatga

SEQ ID NO: 8130882 - DNA, 22 bp, Homo sapiens
cagtgccaagccacagatcact

SEQ ID NO: 8130883 - DNA, 22 bp, Homo sapiens
tcacagttgattgaaacacagc

SEQ ID NO: 8130884 - DNA, 22 bp, Homo sapiens
tcacagttgagcaggttgtgca

SEQ ID NO: 8130885 - DNA, 21 bp, Homo sapiens
tcacagttggccaggcattta

SEQ ID NO: 8130886 - DNA, 17 bp, Homo sapiens
tcacagttggtctcagt

SEQ ID NO: 8130887 - DNA, 22 bp, Homo sapiens
tcacagttatagtctgtagaat

SEQ ID NO: 8130888 - DNA, 22 bp, Homo sapiens
tcacagttcaaaccccatatct

SEQ ID NO: 8130889 - DNA, 22 bp, Homo sapiens
tcacagttatgggccttggtca

SEQ ID NO: 8130890 - DNA, 21 bp, Homo sapiens
tcacagttcaagatgaacccc

SEQ ID NO: 8130891 - DNA, 22 bp, Homo sapiens
tcacagttcaactagttcagat

SEQ ID NO: 8130892 - DNA, 22 bp, Homo sapiens
tcacagttcatctgataaacta

SEQ ID NO: 8130893 - DNA, 22 bp, Homo sapiens
tcacagttctagaggtaagcag

SEQ ID NO: 8130894 - DNA, 18 bp, Homo sapiens
tcacagacttactgggcc

SEQ ID NO: 8130895 - DNA, 22 bp, Homo sapiens
tcacagacttgtctccagggat

SEQ ID NO: 8130896 - DNA, 22 bp, Homo sapiens
tcacagactgtgttgctactca

SEQ ID NO: 8130897 - DNA, 21 bp, Homo sapiens
tcacagactggtcagtgaggc

SEQ ID NO: 8130898 - DNA, 22 bp, Homo sapiens
tcacaactctttccatttaata

SEQ ID NO: 8130899 - DNA, 20 bp, Homo sapiens
tcacaactccatcatttccc

SEQ ID NO: 8130900 - DNA, 22 bp, Homo sapiens
tcacaactgggtgtcttcatca

SEQ ID NO: 8130901 - DNA, 22 bp, Homo sapiens
tcacaacttgaagctgatttaa

SEQ ID NO: 8130902 - DNA, 22 bp, Homo sapiens
tcacagacctggtgggaggtgg

SEQ ID NO: 8130903 - DNA, 22 bp, Homo sapiens
tcacactttatttatttcatgc

SEQ ID NO: 8130904 - DNA, 22 bp, Homo sapiens
tcacagacgcatcctcaggtag

SEQ ID NO: 8130905 - DNA, 22 bp, Homo sapiens
tcacagactcaagggcatagga

SEQ ID NO: 8130906 - DNA, 22 bp, Homo sapiens
cagtgagaccttctaaggtggt

SEQ ID NO: 8130907 - DNA, 22 bp, Homo sapiens
cagtgagaattcagtaggtact

SEQ ID NO: 8130908 - DNA, 22 bp, Homo sapiens
tatttccacaccttttgaatct

SEQ ID NO: 8130909 - DNA, 22 bp, Homo sapiens
tatttccaaaagcctattatga

SEQ ID NO: 8130910 - DNA, 22 bp, Homo sapiens
tatttccagaggagtatagaag

SEQ ID NO: 8130911 - DNA, 22 bp, Homo sapiens
tatttccacctattattttctg

SEQ ID NO: 8130912 - DNA, 22 bp, Homo sapiens
tatttctttcaggtatgtgttg

SEQ ID NO: 8130913 - DNA, 22 bp, Homo sapiens
caggtgtttcctgaagttgatg

SEQ ID NO: 8130914 - DNA, 22 bp, Homo sapiens
caggtgtttaggtttcatggat

SEQ ID NO: 8130915 - DNA, 22 bp, Homo sapiens
caggtgttgtctaaagcttcag

SEQ ID NO: 8130916 - DNA, 22 bp, Homo sapiens
caggtgttgggagaagagataa

SEQ ID NO: 8130917 - DNA, 22 bp, Homo sapiens
caggtgttggaagggcagtggg

SEQ ID NO: 8130918 - DNA, 22 bp, Homo sapiens
cagggtggggaaatagcgccct

SEQ ID NO: 8130919 - DNA, 22 bp, Homo sapiens
cagggtgggcacccagcctcca

SEQ ID NO: 8130920 - DNA, 22 bp, Homo sapiens
cagggtggccctgtggtctcat

SEQ ID NO: 8130921 - DNA, 21 bp, Homo sapiens
tatttagttttacaaatgtgg

SEQ ID NO: 8130922 - DNA, 22 bp, Homo sapiens
tatttcattctttatcaggagc

SEQ ID NO: 8130923 - DNA, 22 bp, Homo sapiens
cagtgccaggagacaagatcag

SEQ ID NO: 8130924 - DNA, 21 bp, Homo sapiens
cagtgggctgctgcgctccag

SEQ ID NO: 8130925 - DNA, 23 bp, Homo sapiens
cagtgggcttctaactgctcctg

SEQ ID NO: 8130926 - DNA, 22 bp, Homo sapiens
cagtgtttgtggaattcaggtg

SEQ ID NO: 8130927 - DNA, 22 bp, Homo sapiens
tcagcagcagctcagcatgttt

SEQ ID NO: 8130928 - DNA, 19 bp, Homo sapiens
cataaatgtacaagataca

SEQ ID NO: 8130929 - DNA, 22 bp, Homo sapiens
cataaagtagcagagcatgact

SEQ ID NO: 8130930 - DNA, 22 bp, Homo sapiens
tcagcttttgtcagaaattgta

SEQ ID NO: 8130931 - DNA, 21 bp, Homo sapiens
tcaggaaacacctcttaagga

SEQ ID NO: 8130932 - DNA, 22 bp, Homo sapiens
tcagctttggtcacattgagtt

SEQ ID NO: 8130933 - DNA, 22 bp, Homo sapiens
cagggctcactcggctggcgtc

SEQ ID NO: 8130934 - DNA, 22 bp, Homo sapiens
cagggcggggtctgccggccct

SEQ ID NO: 8130935 - DNA, 22 bp, Homo sapiens
tagctagaaagtttcagctgtg

SEQ ID NO: 8130936 - DNA, 22 bp, Homo sapiens
tagctactgatgcaagagtttg

SEQ ID NO: 8130937 - DNA, 22 bp, Homo sapiens
tagggtggagactggaagcagg

SEQ ID NO: 8130938 - DNA, 22 bp, Homo sapiens
tatcatgcttaccattttcaaa

SEQ ID NO: 8130939 - DNA, 22 bp, Homo sapiens
tatcagtgtggtttctggactg

SEQ ID NO: 8130940 - DNA, 23 bp, Homo sapiens
tatcagtgtgatgaggctgctgc

SEQ ID NO: 8130941 - DNA, 22 bp, Homo sapiens
tatcagtggtcacaagatacat

SEQ ID NO: 8130942 - DNA, 22 bp, Homo sapiens
tatcagtatggattcatggatt

SEQ ID NO: 8130943 - DNA, 22 bp, Homo sapiens
cagggtggcaggcaccatggcc

SEQ ID NO: 8130944 - DNA, 22 bp, Homo sapiens
cagggtggccaggtagataata

SEQ ID NO: 8130945 - DNA, 22 bp, Homo sapiens
cagggtggcactcagcgcatct

SEQ ID NO: 8130946 - DNA, 22 bp, Homo sapiens
tatcatttaacagaatcattgc

SEQ ID NO: 8130947 - DNA, 22 bp, Homo sapiens
caggggagttttatgcaacaga

SEQ ID NO: 8130948 - DNA, 22 bp, Homo sapiens
caggggagtgagtccctctctg

SEQ ID NO: 8130949 - DNA, 22 bp, Homo sapiens
tagtgaatgttggctattaata

SEQ ID NO: 8130950 - DNA, 19 bp, Homo sapiens
tagtgagtagtgaattaga

SEQ ID NO: 8130951 - DNA, 22 bp, Homo sapiens
tatatttaaatccaggttgaaa

SEQ ID NO: 8130952 - DNA, 22 bp, Homo sapiens
tactgtgaatacaaaataaatt

SEQ ID NO: 8130953 - DNA, 22 bp, Homo sapiens
tactgtgcagctgtgctttggg

SEQ ID NO: 8130954 - DNA, 22 bp, Homo sapiens
caggctggagtgagtgtagtgg

SEQ ID NO: 8130955 - DNA, 22 bp, Homo sapiens
caggctggagtgcaatgacgcc

SEQ ID NO: 8130956 - DNA, 22 bp, Homo sapiens
caggctggagtgcaatggtgct

SEQ ID NO: 8130957 - DNA, 22 bp, Homo sapiens
caggctggagtgcaatggcaca

SEQ ID NO: 8130958 - DNA, 22 bp, Homo sapiens
caggctggagtgcagtggcgcc

SEQ ID NO: 8130959 - DNA, 22 bp, Homo sapiens
caggctggagtgcagtggcgct

SEQ ID NO: 8130960 - DNA, 22 bp, Homo sapiens
caggctggagtgcagtggggcg

SEQ ID NO: 8130961 - DNA, 22 bp, Homo sapiens
tactgtatatgcttgtatctga

SEQ ID NO: 8130962 - DNA, 22 bp, Homo sapiens
gtgaggggccaagagtagggca

SEQ ID NO: 8130963 - DNA, 22 bp, Homo sapiens
gtgaggggtggctgagcagttt

SEQ ID NO: 8130964 - DNA, 20 bp, Homo sapiens
cagccctgtgacctggccct

SEQ ID NO: 8130965 - DNA, 22 bp, Homo sapiens
cagggcaagtttgagattattt

SEQ ID NO: 8130966 - DNA, 22 bp, Homo sapiens
cagggcagaacatatagatagt

SEQ ID NO: 8130967 - DNA, 21 bp, Homo sapiens
tagcaatacgtggaccatggg

SEQ ID NO: 8130968 - DNA, 22 bp, Homo sapiens
tagcaagatcgtgtctctaaaa

SEQ ID NO: 8130969 - DNA, 19 bp, Homo sapiens
tagaggagaagggaagtgg

SEQ ID NO: 8130970 - DNA, 22 bp, Homo sapiens
tagaggagaacacaaattatag

SEQ ID NO: 8130971 - DNA, 22 bp, Homo sapiens
caggctggtcccagagcattgc

SEQ ID NO: 8130972 - DNA, 22 bp, Homo sapiens
caggctgggctggtgttagagt

SEQ ID NO: 8130973 - DNA, 22 bp, Homo sapiens
caggctgggctccggagataaa

SEQ ID NO: 8130974 - DNA, 22 bp, Homo sapiens
caggctgggcagcctccccggc

SEQ ID NO: 8130975 - DNA, 22 bp, Homo sapiens
caggctgggcagcctccccggc

SEQ ID NO: 8130976 - DNA, 22 bp, Homo sapiens
tttcagaaaacttatcatcagt

SEQ ID NO: 8130977 - DNA, 22 bp, Homo sapiens
tttcacatttgttttaagaagt

SEQ ID NO: 8130978 - DNA, 22 bp, Homo sapiens
tttcacagcagaatttctgagg

SEQ ID NO: 8130979 - DNA, 18 bp, Homo sapiens
tttcacagattcatgact

SEQ ID NO: 8130980 - DNA, 22 bp, Homo sapiens
tttcagaaagcatcatcaaagt

SEQ ID NO: 8130981 - DNA, 22 bp, Homo sapiens
tttcagaaatggcactgaaatc

SEQ ID NO: 8130982 - DNA, 21 bp, Homo sapiens
tttattctcagatacagggag

SEQ ID NO: 8130983 - DNA, 22 bp, Homo sapiens
tttattctgtgctacatgaaga

SEQ ID NO: 8130984 - DNA, 23 bp, Homo sapiens
tttcaacaatgcttagagaaaac

SEQ ID NO: 8130985 - DNA, 22 bp, Homo sapiens
tttcaacagctctcaaatgatc

SEQ ID NO: 8130986 - DNA, 22 bp, Homo sapiens
tttcaagagggaactgaacaca

SEQ ID NO: 8130987 - DNA, 22 bp, Homo sapiens
tttcaagagggaactgaacaca

SEQ ID NO: 8130988 - DNA, 22 bp, Homo sapiens
tttcaagactcattgagtattg

SEQ ID NO: 8130989 - DNA, 22 bp, Homo sapiens
tttcaagacgttaagtcagctt

SEQ ID NO: 8130990 - DNA, 22 bp, Homo sapiens
tttcaagaagcaaattaaagtc

SEQ ID NO: 8130991 - DNA, 23 bp, Homo sapiens
tttcaacaggcagagaagactta

SEQ ID NO: 8130992 - DNA, 22 bp, Homo sapiens
tttcaacaggatgataataggc

SEQ ID NO: 8130993 - DNA, 22 bp, Homo sapiens
tttcaacatacctcagtgtatg

SEQ ID NO: 8130994 - DNA, 22 bp, Homo sapiens
tttcacagatataagatttcac

SEQ ID NO: 8130995 - DNA, 22 bp, Homo sapiens
tttcacagatgttttggagtct

SEQ ID NO: 8130996 - DNA, 22 bp, Homo sapiens
tttcacagagaaatataacagg

SEQ ID NO: 8130997 - DNA, 22 bp, Homo sapiens
tttcacagaactcactaaggag

SEQ ID NO: 8130998 - DNA, 23 bp, Homo sapiens
tttcacaatgagcattacagaat

SEQ ID NO: 8130999 - DNA, 20 bp, Homo sapiens
tttcacaatgaacatgtctc

SEQ ID NO: 8131000 - DNA, 22 bp, Homo sapiens
tttatccagcagctattcaaaa

SEQ ID NO: 8131001 - DNA, 20 bp, Homo sapiens
tttatcaggcacttactatt

SEQ ID NO: 8131002 - DNA, 23 bp, Homo sapiens
tttatccaactctgtaatctctc

SEQ ID NO: 8131003 - DNA, 22 bp, Homo sapiens
tttatccaagcacaatttctaa

SEQ ID NO: 8131004 - DNA, 22 bp, Homo sapiens
tttatcatcttgtttttaaagc

SEQ ID NO: 8131005 - DNA, 22 bp, Homo sapiens
tttaccaaggcatagtaatctc

SEQ ID NO: 8131006 - DNA, 22 bp, Homo sapiens
tttaccaactgtagatctgcta

SEQ ID NO: 8131007 - DNA, 22 bp, Homo sapiens
tttagaagttcacacatttaaa

SEQ ID NO: 8131008 - DNA, 22 bp, Homo sapiens
tttagaagggctggtcagaaat

SEQ ID NO: 8131009 - DNA, 22 bp, Homo sapiens
tttagaaggactacagtgtgat

SEQ ID NO: 8131010 - DNA, 22 bp, Homo sapiens
tttagcaagtatttactgacta

SEQ ID NO: 8131011 - DNA, 21 bp, Homo sapiens
tttagagaatactcactattt

SEQ ID NO: 8131012 - DNA, 22 bp, Homo sapiens
tttagagacacactggcatttg

SEQ ID NO: 8131013 - DNA, 22 bp, Homo sapiens
tttagagaccctctgctatttt

SEQ ID NO: 8131014 - DNA, 22 bp, Homo sapiens
tttaatgaggtctctcgctggc

SEQ ID NO: 8131015 - DNA, 22 bp, Homo sapiens
tttaaggaggggctcacgtggg

SEQ ID NO: 8131016 - DNA, 22 bp, Homo sapiens
tttaatcttcaaaatagtctta

SEQ ID NO: 8131017 - DNA, 17 bp, Homo sapiens
ttgtgtgtagttctgat

SEQ ID NO: 8131018 - DNA, 22 bp, Homo sapiens
ttgtgtgtagactcagccattg

SEQ ID NO: 8131019 - DNA, 22 bp, Homo sapiens
ttgtgtgtactggttatgggca

SEQ ID NO: 8131020 - DNA, 22 bp, Homo sapiens
ttgtgtgcataaattctgatgt

SEQ ID NO: 8131021 - DNA, 17 bp, Homo sapiens
tttaaactactacaagg

SEQ ID NO: 8131022 - DNA, 21 bp, Homo sapiens
tttaaagaataggaagggagg

SEQ ID NO: 8131023 - DNA, 22 bp, Homo sapiens
tttaaagaaattcctcatcttt

SEQ ID NO: 8131024 - DNA, 22 bp, Homo sapiens
tttaaagagaatgtgaaggagt

SEQ ID NO: 8131025 - DNA, 22 bp, Homo sapiens
ttggagctaccaggaagggctg

SEQ ID NO: 8131026 - DNA, 22 bp, Homo sapiens
ttggactctgggattctggatt

SEQ ID NO: 8131027 - DNA, 22 bp, Homo sapiens
ttggactcctctttcctcttgg

SEQ ID NO: 8131028 - DNA, 22 bp, Homo sapiens
ttggactcaaaaggagatttac

SEQ ID NO: 8131029 - DNA, 22 bp, Homo sapiens
ttggactcatgatcacttcggg

SEQ ID NO: 8131030 - DNA, 22 bp, Homo sapiens
ttgggaagtttaatgacagact

SEQ ID NO: 8131031 - DNA, 22 bp, Homo sapiens
ttgggaaggcgtggaagcagaa

SEQ ID NO: 8131032 - DNA, 22 bp, Homo sapiens
ttgggcagtctggctgcagagt

SEQ ID NO: 8131033 - DNA, 22 bp, Homo sapiens
ttgggcagtagcctcttggtgt

SEQ ID NO: 8131034 - DNA, 22 bp, Homo sapiens
ttgggcagtgattagttcatga

SEQ ID NO: 8131035 - DNA, 22 bp, Homo sapiens
ttgggcagggaaaggacaggca

SEQ ID NO: 8131036 - DNA, 22 bp, Homo sapiens
ttgggcaggtgaagagagggct

SEQ ID NO: 8131037 - DNA, 22 bp, Homo sapiens
ttgggcaggtgtggctctcctt

SEQ ID NO: 8131038 - DNA, 22 bp, Homo sapiens
ttgtcatggatggaagggatat

SEQ ID NO: 8131039 - DNA, 22 bp, Homo sapiens
ttgtcatgagtcacaaaaataa

SEQ ID NO: 8131040 - DNA, 22 bp, Homo sapiens
ttgtatttcgatgcacgtgtag

SEQ ID NO: 8131041 - DNA, 22 bp, Homo sapiens
ttgtaaatgaccttttctaatt

SEQ ID NO: 8131042 - DNA, 22 bp, Homo sapiens
ttgctgttttacatctggtggg

SEQ ID NO: 8131043 - DNA, 22 bp, Homo sapiens
ttgctgtttaatgatgtcttat

SEQ ID NO: 8131044 - DNA, 22 bp, Homo sapiens
ttgctgtttctctgtgtctggt

SEQ ID NO: 8131045 - DNA, 22 bp, Homo sapiens
ttgctctccagaggctcacagc

SEQ ID NO: 8131046 - DNA, 22 bp, Homo sapiens
ttggacactgagactagcaagc

SEQ ID NO: 8131047 - DNA, 21 bp, Homo sapiens
ttggaacaagcagcagtttgc

SEQ ID NO: 8131048 - DNA, 22 bp, Homo sapiens
ttggaaagaccgaattcctgtt

SEQ ID NO: 8131049 - DNA, 22 bp, Homo sapiens
ttggaaagattattattatgaa

SEQ ID NO: 8131050 - DNA, 22 bp, Homo sapiens
ttggaaagcaagctggacatac

SEQ ID NO: 8131051 - DNA, 22 bp, Homo sapiens
ttggaaagcaacttttgagagt

SEQ ID NO: 8131052 - DNA, 22 bp, Homo sapiens
ttggaaagaagggctgagcaag

SEQ ID NO: 8131053 - DNA, 22 bp, Homo sapiens
ttggaaaggtgcttttgtctgt

SEQ ID NO: 8131054 - DNA, 22 bp, Homo sapiens
ttggaaagggatatctgtactt

SEQ ID NO: 8131055 - DNA, 22 bp, Homo sapiens
ttggaaagtttttactgaagac

SEQ ID NO: 8131056 - DNA, 22 bp, Homo sapiens
ttggaaagtgacgttcaactgt

SEQ ID NO: 8131057 - DNA, 22 bp, Homo sapiens
ttggaaagtctcacccagttga

SEQ ID NO: 8131058 - DNA, 22 bp, Homo sapiens
ttggaaagggaggaatgtagac

SEQ ID NO: 8131059 - DNA, 22 bp, Homo sapiens
ttggaaaggagtttttagctat

SEQ ID NO: 8131060 - DNA, 22 bp, Homo sapiens
ttggaaagcagccgcagccaat

SEQ ID NO: 8131061 - DNA, 22 bp, Homo sapiens
ttggaaagcccattatttggac

SEQ ID NO: 8131062 - DNA, 22 bp, Homo sapiens
ttggaaaggagattctattgtg

SEQ ID NO: 8131063 - DNA, 22 bp, Homo sapiens
ttgacaatccctgttagaagtg

SEQ ID NO: 8131064 - DNA, 22 bp, Homo sapiens
ttgacaattgggagatataaag

SEQ ID NO: 8131065 - DNA, 22 bp, Homo sapiens
ttgacaattgggagatataaag

SEQ ID NO: 8131066 - DNA, 22 bp, Homo sapiens
ttgacaatgcactgtgctaagt

SEQ ID NO: 8131067 - DNA, 22 bp, Homo sapiens
ttgacagagctaggtcaactct

SEQ ID NO: 8131068 - DNA, 22 bp, Homo sapiens
ttgacagaatgttacatataga

SEQ ID NO: 8131069 - DNA, 22 bp, Homo sapiens
ttgacagagaaaagtgtgactt

SEQ ID NO: 8131070 - DNA, 22 bp, Homo sapiens
ttgacagatgtgaaagtgagca

SEQ ID NO: 8131071 - DNA, 22 bp, Homo sapiens
ttgacagaaatgtatttgcatg

SEQ ID NO: 8131072 - DNA, 22 bp, Homo sapiens
ttgacaggatataaagacataa

SEQ ID NO: 8131073 - DNA, 22 bp, Homo sapiens
ttgcaattgctatggagagcgt

SEQ ID NO: 8131074 - DNA, 22 bp, Homo sapiens
ttgcacaaaaaattgttgaata

SEQ ID NO: 8131075 - DNA, 23 bp, Homo sapiens
ttcagactgccttcagcattgtc

SEQ ID NO: 8131076 - DNA, 22 bp, Homo sapiens
ttcagcaatgggatggtgcagg

SEQ ID NO: 8131077 - DNA, 22 bp, Homo sapiens
ttcagcaagtgtctctactgtc

SEQ ID NO: 8131078 - DNA, 22 bp, Homo sapiens
ttcagcaatgacagcctatata

SEQ ID NO: 8131079 - DNA, 21 bp, Homo sapiens
ttcagcaagcactctggacac

SEQ ID NO: 8131080 - DNA, 22 bp, Homo sapiens
ttcagcaaggcatgtgcaggag

SEQ ID NO: 8131081 - DNA, 22 bp, Homo sapiens
ttcagcaagaccaccatgtacc

SEQ ID NO: 8131082 - DNA, 22 bp, Homo sapiens
ttcagcaagaatttactgagct

SEQ ID NO: 8131083 - DNA, 22 bp, Homo sapiens
ttcagcaactgagtgtctttta

SEQ ID NO: 8131084 - DNA, 22 bp, Homo sapiens
ttcagcaacctataaatcccag

SEQ ID NO: 8131085 - DNA, 22 bp, Homo sapiens
ttcagcaactcaaacctattag

SEQ ID NO: 8131086 - DNA, 22 bp, Homo sapiens
ttcagcaaatggactgttcagg

SEQ ID NO: 8131087 - DNA, 22 bp, Homo sapiens
ttcagcaaatggcttgagataa

SEQ ID NO: 8131088 - DNA, 22 bp, Homo sapiens
ttcagcaaccagaaaggctggg

SEQ ID NO: 8131089 - DNA, 22 bp, Homo sapiens
ttcagcaacatttgttgagtgc

SEQ ID NO: 8131090 - DNA, 22 bp, Homo sapiens
ttcagcaattttttaagctaat

SEQ ID NO: 8131091 - DNA, 22 bp, Homo sapiens
ttcacagagagaactcaaacca

SEQ ID NO: 8131092 - DNA, 21 bp, Homo sapiens
ttcaaagacttgatgctgacc

SEQ ID NO: 8131093 - DNA, 22 bp, Homo sapiens
ttcaaagagaaattgtattttc

SEQ ID NO: 8131094 - DNA, 22 bp, Homo sapiens
ttcaaagataatgtagcatttt

SEQ ID NO: 8131095 - DNA, 22 bp, Homo sapiens
ttcaaagagttgggtgtctggg

SEQ ID NO: 8131096 - DNA, 22 bp, Homo sapiens
ttcacagattgactggattcct

SEQ ID NO: 8131097 - DNA, 22 bp, Homo sapiens
ttcacagctaagagctaagtaa

SEQ ID NO: 8131098 - DNA, 22 bp, Homo sapiens
ttcacagctccttttactcaac

SEQ ID NO: 8131099 - DNA, 22 bp, Homo sapiens
ttcacagctccttttactcaac

SEQ ID NO: 8131100 - DNA, 19 bp, Homo sapiens
ttcacagctctgtgtcagt

SEQ ID NO: 8131101 - DNA, 22 bp, Homo sapiens
ttcatttgggatgagtcagaag

SEQ ID NO: 8131102 - DNA, 22 bp, Homo sapiens
ttcatttgtggtgaatgaagtg

SEQ ID NO: 8131103 - DNA, 21 bp, Homo sapiens
ttcataaaccattctcatgca

SEQ ID NO: 8131104 - DNA, 22 bp, Homo sapiens
ttcagtttcaaatcctgtgaag

SEQ ID NO: 8131105 - DNA, 22 bp, Homo sapiens
ttcagtttcaaatcctggatgc

SEQ ID NO: 8131106 - DNA, 22 bp, Homo sapiens
ttcagttttctttagaatgtag

SEQ ID NO: 8131107 - DNA, 22 bp, Homo sapiens
ttcatttattcagcaggtattt

SEQ ID NO: 8131108 - DNA, 22 bp, Homo sapiens
ttcatttaatttgtgtattaac

SEQ ID NO: 8131109 - DNA, 23 bp, Homo sapiens
ttcatttaggagttcataagagc

SEQ ID NO: 8131110 - DNA, 22 bp, Homo sapiens
ttcatttagcatgctaaacctg

SEQ ID NO: 8131111 - DNA, 22 bp, Homo sapiens
ttattacaatgcagaaaataga

SEQ ID NO: 8131112 - DNA, 22 bp, Homo sapiens
ttatagttagtaggtcattaaa

SEQ ID NO: 8131113 - DNA, 22 bp, Homo sapiens
ttagctttcttggagaattaca

SEQ ID NO: 8131114 - DNA, 22 bp, Homo sapiens
ttagctttggattgcatttagt

SEQ ID NO: 8131115 - DNA, 22 bp, Homo sapiens
ttagctctggattaagcagaaa

SEQ ID NO: 8131116 - DNA, 20 bp, Homo sapiens
ttcttttgataagcttgaca

SEQ ID NO: 8131117 - DNA, 22 bp, Homo sapiens
ttcttttgcaagactattgatt

SEQ ID NO: 8131118 - DNA, 22 bp, Homo sapiens
ttcttttgggaattacgtatgc

SEQ ID NO: 8131119 - DNA, 22 bp, Homo sapiens
ttgaaatgagcaaactgtcagc

SEQ ID NO: 8131120 - DNA, 22 bp, Homo sapiens
ttgaaatcaccactagcatttg

SEQ ID NO: 8131121 - DNA, 22 bp, Homo sapiens
ttgaaatccaattatcatatgt

SEQ ID NO: 8131122 - DNA, 20 bp, Homo sapiens
ttgaaattggatggtagcta

SEQ ID NO: 8131123 - DNA, 19 bp, Homo sapiens
ttgaaattgtttgatatgg

SEQ ID NO: 8131124 - DNA, 22 bp, Homo sapiens
ttgaacaatttggtatacaaac

SEQ ID NO: 8131125 - DNA, 22 bp, Homo sapiens
ttgaagaaagtcatatataatg

SEQ ID NO: 8131126 - DNA, 22 bp, Homo sapiens
ttcttattgggagaccttttct

SEQ ID NO: 8131127 - DNA, 22 bp, Homo sapiens
ttcttttaatgtctggctttca

SEQ ID NO: 8131128 - DNA, 22 bp, Homo sapiens
ttctttgttgagcaagtaggac

SEQ ID NO: 8131129 - DNA, 22 bp, Homo sapiens
ttctttgtttgataagtatgct

SEQ ID NO: 8131130 - DNA, 22 bp, Homo sapiens
ttctgtgtcttcttgttctgtg

SEQ ID NO: 8131131 - DNA, 22 bp, Homo sapiens
ttcttagttcaactaaaattta

SEQ ID NO: 8131132 - DNA, 22 bp, Homo sapiens
ttctgtgttctgtgcaatgagc

SEQ ID NO: 8131133 - DNA, 22 bp, Homo sapiens
ttccttctggaggctccagggg

SEQ ID NO: 8131134 - DNA, 22 bp, Homo sapiens
ttccttcttccagaggctgccc

SEQ ID NO: 8131135 - DNA, 22 bp, Homo sapiens
ttctcctctgttggccttccct

SEQ ID NO: 8131136 - DNA, 22 bp, Homo sapiens
ttctctaagagttatatgaatt

SEQ ID NO: 8131137 - DNA, 22 bp, Homo sapiens
ttctctctggacctgggatgcg

SEQ ID NO: 8131138 - DNA, 22 bp, Homo sapiens
ttctctcccatgaagcttctat

SEQ ID NO: 8131139 - DNA, 22 bp, Homo sapiens
ttctctaatggtgatgattaga

SEQ ID NO: 8131140 - DNA, 22 bp, Homo sapiens
tttgtaacatcccaacaaattt

SEQ ID NO: 8131141 - DNA, 22 bp, Homo sapiens
tttgtgtgtatatgtatataga

SEQ ID NO: 8131142 - DNA, 22 bp, Homo sapiens
tttgtgtgtgctcacatagatg

SEQ ID NO: 8131143 - DNA, 22 bp, Homo sapiens
tttgtgttttcactagcagtgt

SEQ ID NO: 8131144 - DNA, 22 bp, Homo sapiens
tttgttaaaatgcagattctgt

SEQ ID NO: 8131145 - DNA, 22 bp, Homo sapiens
tttgttaattcttatgttagag

SEQ ID NO: 8131146 - DNA, 22 bp, Homo sapiens
tttgttaaggagtattgcttct

SEQ ID NO: 8131147 - DNA, 22 bp, Homo sapiens
ttttaacactcagcactatctc

SEQ ID NO: 8131148 - DNA, 22 bp, Homo sapiens
ttttaaatctccagttgacccc

SEQ ID NO: 8131149 - DNA, 22 bp, Homo sapiens
ttttaaaggctgtatgaccaag

SEQ ID NO: 8131150 - DNA, 22 bp, Homo sapiens
ttttaaagagatgctgtgcata

SEQ ID NO: 8131151 - DNA, 22 bp, Homo sapiens
ttttaaaggatagctctggttg

SEQ ID NO: 8131152 - DNA, 22 bp, Homo sapiens
ttttaaaggatactcttgtcta

SEQ ID NO: 8131153 - DNA, 22 bp, Homo sapiens
ttttaaaggcagattatggctt

SEQ ID NO: 8131154 - DNA, 22 bp, Homo sapiens
ttttatgtaatccttactgtcg

SEQ ID NO: 8131155 - DNA, 22 bp, Homo sapiens
ttttaatgggcgactattatgg

SEQ ID NO: 8131156 - DNA, 22 bp, Homo sapiens
ttttcattgtaaatcaggaaac

SEQ ID NO: 8131157 - DNA, 22 bp, Homo sapiens
ttttatgtgtcaaagcagtggt

SEQ ID NO: 8131158 - DNA, 22 bp, Homo sapiens
ttttcttactgtctgtgatcct

SEQ ID NO: 8131159 - DNA, 22 bp, Homo sapiens
ttttctgtttgcttcaagacat

SEQ ID NO: 8131160 - DNA, 22 bp, Homo sapiens
ttttctgagctcagtgacttac

SEQ ID NO: 8131161 - DNA, 22 bp, Homo sapiens
ttttctgactctattgaggtat

SEQ ID NO: 8131162 - DNA, 22 bp, Homo sapiens
ttttctgaagtttaagacattt

SEQ ID NO: 8131163 - DNA, 22 bp, Homo sapiens
ttttctgacctatctacattta

SEQ ID NO: 8131164 - DNA, 22 bp, Homo sapiens
ttttctcagctgcactgtatta

SEQ ID NO: 8131165 - DNA, 22 bp, Homo sapiens
tttgacagacatttactacatt

SEQ ID NO: 8131166 - DNA, 22 bp, Homo sapiens
tttgacagaaagttattatttt

SEQ ID NO: 8131167 - DNA, 22 bp, Homo sapiens
tttgacagacagtgctgggaca

SEQ ID NO: 8131168 - DNA, 22 bp, Homo sapiens
tttgacagaggttgtggtgtat

SEQ ID NO: 8131169 - DNA, 22 bp, Homo sapiens
tttgacagagctcttagtctct

SEQ ID NO: 8131170 - DNA, 22 bp, Homo sapiens
tttgacagagttgtgaggattt

SEQ ID NO: 8131171 - DNA, 19 bp, Homo sapiens
tttgacagagtttgagcat

SEQ ID NO: 8131172 - DNA, 22 bp, Homo sapiens
tttgacagatagatgttatgtt

SEQ ID NO: 8131173 - DNA, 19 bp, Homo sapiens
tttgaaaggattgttattt

SEQ ID NO: 8131174 - DNA, 22 bp, Homo sapiens
tttgaaagcctggcttttctct

SEQ ID NO: 8131175 - DNA, 21 bp, Homo sapiens
tttgaaagccctatgttttca

SEQ ID NO: 8131176 - DNA, 22 bp, Homo sapiens
tttgaaaaaggcctttggtatg

SEQ ID NO: 8131177 - DNA, 22 bp, Homo sapiens
tttgaagataaatatggagaaa

SEQ ID NO: 8131178 - DNA, 22 bp, Homo sapiens
tttcctcctagcctccagccgc

SEQ ID NO: 8131179 - DNA, 22 bp, Homo sapiens
tttcctctaaacgcatttgctt

SEQ ID NO: 8131180 - DNA, 22 bp, Homo sapiens
tttcctcctagcctccagccgc

SEQ ID NO: 8131181 - DNA, 22 bp, Homo sapiens
tttcctctccggggcctccagg

SEQ ID NO: 8131182 - DNA, 22 bp, Homo sapiens
tttcctctccaccaggaggtct

SEQ ID NO: 8131183 - DNA, 22 bp, Homo sapiens
tttcctctccggggcctccagg

SEQ ID NO: 8131184 - DNA, 22 bp, Homo sapiens
tttcctctgactgctcccctgc

SEQ ID NO: 8131185 - DNA, 22 bp, Homo sapiens
tttcctctgagtgagctgggag

SEQ ID NO: 8131186 - DNA, 22 bp, Homo sapiens
tttcctctgatgctgacttgga

SEQ ID NO: 8131187 - DNA, 22 bp, Homo sapiens
tttcttttacagtgtggctatt

SEQ ID NO: 8131188 - DNA, 22 bp, Homo sapiens
tttcttttgaatagtgtgtggt

SEQ ID NO: 8131189 - DNA, 22 bp, Homo sapiens
tttcttttccaatatccctact

SEQ ID NO: 8131190 - DNA, 19 bp, Homo sapiens
tttgatatctgaattatgc

SEQ ID NO: 8131191 - DNA, 22 bp, Homo sapiens
tttgacagcagataaaataaaa

SEQ ID NO: 8131192 - DNA, 22 bp, Homo sapiens
tttgacagatccttaactcagc

SEQ ID NO: 8131193 - DNA, 22 bp, Homo sapiens
tttgacagatctcagagcattt

SEQ ID NO: 8131194 - DNA, 22 bp, Homo sapiens
tttgatttactggatattctca

SEQ ID NO: 8131195 - DNA, 22 bp, Homo sapiens
tttttataccacctctcactta

SEQ ID NO: 8131196 - DNA, 23 bp, Homo sapiens
tttttagttacacctctgccacc

SEQ ID NO: 8131197 - DNA, 22 bp, Homo sapiens
cacagcataatgaaatatactt

SEQ ID NO: 8131198 - DNA, 22 bp, Homo sapiens
ggaggagacggagtgattagtg

SEQ ID NO: 8131199 - DNA, 22 bp, Homo sapiens
ggaggagagaggttgcaaacac

SEQ ID NO: 8131200 - DNA, 22 bp, Homo sapiens
ggaggagattcccctctcactt

SEQ ID NO: 8131201 - DNA, 22 bp, Homo sapiens
ggaggagaccctgtgtcagttt

SEQ ID NO: 8131202 - DNA, 22 bp, Homo sapiens
ggaggagacagtaaaaagcacg

SEQ ID NO: 8131203 - DNA, 22 bp, Homo sapiens
ggaggggcaggtcccaagttgt

SEQ ID NO: 8131204 - DNA, 22 bp, Homo sapiens
ggaggggcagccatggaactcc

SEQ ID NO: 8131205 - DNA, 22 bp, Homo sapiens
ggaggggcatagttcaccatca

SEQ ID NO: 8131206 - DNA, 22 bp, Homo sapiens
ggaggggccggctgcctgccac

SEQ ID NO: 8131207 - DNA, 22 bp, Homo sapiens
cacaggagaaaggggaagctcg

SEQ ID NO: 8131208 - DNA, 22 bp, Homo sapiens
cacaggagagctgggaggtgcc

SEQ ID NO: 8131209 - DNA, 22 bp, Homo sapiens
cacaggagaggttaatgggggc

SEQ ID NO: 8131210 - DNA, 22 bp, Homo sapiens
ggaggggatttagtagatgcta

SEQ ID NO: 8131211 - DNA, 19 bp, Homo sapiens
cacagctctgctcagggaa

SEQ ID NO: 8131212 - DNA, 22 bp, Homo sapiens
cacagctaactttcactgagca

SEQ ID NO: 8131213 - DNA, 22 bp, Homo sapiens
cacagagaatactgctcttgct

SEQ ID NO: 8131214 - DNA, 22 bp, Homo sapiens
cacagagaactgtgggagtgtg

SEQ ID NO: 8131215 - DNA, 22 bp, Homo sapiens
cacagagacagaagcacttatg

SEQ ID NO: 8131216 - DNA, 22 bp, Homo sapiens
cacagagaattcccatatgtga

SEQ ID NO: 8131217 - DNA, 22 bp, Homo sapiens
cacagagaatgatgagtcactg

SEQ ID NO: 8131218 - DNA, 22 bp, Homo sapiens
cacagagacatgatgtcattgc

SEQ ID NO: 8131219 - DNA, 22 bp, Homo sapiens
cacagagacagatctattttgc

SEQ ID NO: 8131220 - DNA, 22 bp, Homo sapiens
ggacagagggttgacagagtat

SEQ ID NO: 8131221 - DNA, 19 bp, Homo sapiens
gctgggagcagaccctccc

SEQ ID NO: 8131222 - DNA, 22 bp, Homo sapiens
gctgggagcaaagccatgcata

SEQ ID NO: 8131223 - DNA, 22 bp, Homo sapiens
gctggcccagcgcccagggcag

SEQ ID NO: 8131224 - DNA, 22 bp, Homo sapiens
gctgggccgacctgggctgcag

SEQ ID NO: 8131225 - DNA, 22 bp, Homo sapiens
gctgggccagccagacatgtga

SEQ ID NO: 8131226 - DNA, 22 bp, Homo sapiens
gctgggagccctggtctgctcc

SEQ ID NO: 8131227 - DNA, 16 bp, Homo sapiens
gctggagggaggggtt

SEQ ID NO: 8131228 - DNA, 22 bp, Homo sapiens
caatggtggtgtcagaagagat

SEQ ID NO: 8131229 - DNA, 22 bp, Homo sapiens
caatggttctcaaactatcatg

SEQ ID NO: 8131230 - DNA, 22 bp, Homo sapiens
caatgcatgatggaattgcctt

SEQ ID NO: 8131231 - DNA, 22 bp, Homo sapiens
gcttccagaccccagtccctca

SEQ ID NO: 8131232 - DNA, 22 bp, Homo sapiens
ggaaattgatctgagctcacct

SEQ ID NO: 8131233 - DNA, 22 bp, Homo sapiens
ggaaatgtatgtattaagcacc

SEQ ID NO: 8131234 - DNA, 22 bp, Homo sapiens
gcttccagcaccagcagagggg

SEQ ID NO: 8131235 - DNA, 22 bp, Homo sapiens
caatgcatacttcgaaatttca

SEQ ID NO: 8131236 - DNA, 22 bp, Homo sapiens
gctggtggcagagctccgcggc

SEQ ID NO: 8131237 - DNA, 22 bp, Homo sapiens
gctggtgctctgggccctgagg

SEQ ID NO: 8131238 - DNA, 20 bp, Homo sapiens
gctgggctaccactggccct

SEQ ID NO: 8131239 - DNA, 19 bp, Homo sapiens
ggctcctggggctcagccc

SEQ ID NO: 8131240 - DNA, 22 bp, Homo sapiens
ggcgccgcactcggtgcagccg

SEQ ID NO: 8131241 - DNA, 20 bp, Homo sapiens
ggcgcctggcctcatggctg

SEQ ID NO: 8131242 - DNA, 20 bp, Homo sapiens
cactgccctccagcctgagc

SEQ ID NO: 8131243 - DNA, 22 bp, Homo sapiens
ggctcctgtcccctcagctgct

SEQ ID NO: 8131244 - DNA, 22 bp, Homo sapiens
ggctcctgtggcaagacagctt

SEQ ID NO: 8131245 - DNA, 22 bp, Homo sapiens
ggctcctgtcctcctggagctc

SEQ ID NO: 8131246 - DNA, 22 bp, Homo sapiens
ggctgcctcaaagctcaagctc

SEQ ID NO: 8131247 - DNA, 22 bp, Homo sapiens
ggctgcggatctaaggctggga

SEQ ID NO: 8131248 - DNA, 22 bp, Homo sapiens
ggctgctcacgcagccctccct

SEQ ID NO: 8131249 - DNA, 18 bp, Homo sapiens
ggctgctcctctccctac

SEQ ID NO: 8131250 - DNA, 22 bp, Homo sapiens
ggctgctcctttaccctggcag

SEQ ID NO: 8131251 - DNA, 18 bp, Homo sapiens
ggctgctcgctctccccg

SEQ ID NO: 8131252 - DNA, 22 bp, Homo sapiens
cagaaatgcctgcttctctctc

SEQ ID NO: 8131253 - DNA, 21 bp, Homo sapiens
ggctgctgtcaccgctgtcac

SEQ ID NO: 8131254 - DNA, 20 bp, Homo sapiens
cagaaatttgtaaaagggat

SEQ ID NO: 8131255 - DNA, 23 bp, Homo sapiens
ggctgggagctccgggtgcacgt

SEQ ID NO: 8131256 - DNA, 22 bp, Homo sapiens
cagaacagagtcaaaagtatgt

SEQ ID NO: 8131257 - DNA, 22 bp, Homo sapiens
cagaacagtcgcctgcatggat

SEQ ID NO: 8131258 - DNA, 22 bp, Homo sapiens
cagaacaggtcatgcttgctgt

SEQ ID NO: 8131259 - DNA, 23 bp, Homo sapiens
cagaacagtaaaagatgccatgg

SEQ ID NO: 8131260 - DNA, 22 bp, Homo sapiens
ggctgggagctggacaggccgg

SEQ ID NO: 8131261 - DNA, 22 bp, Homo sapiens
ggccagctcagactccacttgc

SEQ ID NO: 8131262 - DNA, 22 bp, Homo sapiens
ggccagctacccatctgcgtca

SEQ ID NO: 8131263 - DNA, 22 bp, Homo sapiens
ggccagctcagtctccatcagg

SEQ ID NO: 8131264 - DNA, 18 bp, Homo sapiens
ggccagctcctgaggcag

SEQ ID NO: 8131265 - DNA, 21 bp, Homo sapiens
ggccagctcggaaggtcccat

SEQ ID NO: 8131266 - DNA, 22 bp, Homo sapiens
ggccagctccttggcagtgcct

SEQ ID NO: 8131267 - DNA, 18 bp, Homo sapiens
ggccagccccaggccagc

SEQ ID NO: 8131268 - DNA, 22 bp, Homo sapiens
ggccagcccagtggtcctctct

SEQ ID NO: 8131269 - DNA, 22 bp, Homo sapiens
ggccagccctcctccctgggtt

SEQ ID NO: 8131270 - DNA, 22 bp, Homo sapiens
ggccagcctggggctcccagac

SEQ ID NO: 8131271 - DNA, 22 bp, Homo sapiens
ggccagcggcacagcctggccc

SEQ ID NO: 8131272 - DNA, 21 bp, Homo sapiens
cacatttgaacctcacagcaa

SEQ ID NO: 8131273 - DNA, 22 bp, Homo sapiens
cacatttgaaggaattagcatt

SEQ ID NO: 8131274 - DNA, 22 bp, Homo sapiens
cacatttgggacaggagataaa

SEQ ID NO: 8131275 - DNA, 22 bp, Homo sapiens
caccaagaatcttcacttttta

SEQ ID NO: 8131276 - DNA, 22 bp, Homo sapiens
ggcgaggccgggacaggctgga

SEQ ID NO: 8131277 - DNA, 22 bp, Homo sapiens
ggcgcacgccattggccgtgcg

SEQ ID NO: 8131278 - DNA, 22 bp, Homo sapiens
ggcgccagcccaggccgtcgtg

SEQ ID NO: 8131279 - DNA, 22 bp, Homo sapiens
ggcgccctggtgccgcaccgcg

SEQ ID NO: 8131280 - DNA, 22 bp, Homo sapiens
ggcgcaggccttggatcctggt

SEQ ID NO: 8131281 - DNA, 22 bp, Homo sapiens
ggcccagcacagtgcttggggg

SEQ ID NO: 8131282 - DNA, 22 bp, Homo sapiens
ggcccagcatcttgtgaagttt

SEQ ID NO: 8131283 - DNA, 21 bp, Homo sapiens
ggagtctgtggatgctgtttc

SEQ ID NO: 8131284 - DNA, 22 bp, Homo sapiens
ggagtctgtcacctgtttctct

SEQ ID NO: 8131285 - DNA, 22 bp, Homo sapiens
cacatgcatacctatgtgtata

SEQ ID NO: 8131286 - DNA, 22 bp, Homo sapiens
ggcaggactcttctgtgggccg

SEQ ID NO: 8131287 - DNA, 22 bp, Homo sapiens
ggcaggactgatcagtgggatg

SEQ ID NO: 8131288 - DNA, 22 bp, Homo sapiens
ggcaggactctcaggaccaagc

SEQ ID NO: 8131289 - DNA, 19 bp, Homo sapiens
ggcaggtgtgcttatgctt

SEQ ID NO: 8131290 - DNA, 22 bp, Homo sapiens
ggcaggtgtgagatcgaggcca

SEQ ID NO: 8131291 - DNA, 22 bp, Homo sapiens
cagcagagcatttggtaggagg

SEQ ID NO: 8131292 - DNA, 22 bp, Homo sapiens
cagcagagacggtaagcagaac

SEQ ID NO: 8131293 - DNA, 22 bp, Homo sapiens
cagcatgcagcccctggcagct

SEQ ID NO: 8131294 - DNA, 22 bp, Homo sapiens
cagcatgatttatcacaaccct

SEQ ID NO: 8131295 - DNA, 22 bp, Homo sapiens
cagcatgcattttctctctttg

SEQ ID NO: 8131296 - DNA, 22 bp, Homo sapiens
gtctatttgggatcatgatatg

SEQ ID NO: 8131297 - DNA, 22 bp, Homo sapiens
gtctcacacagagtagattttg

SEQ ID NO: 8131298 - DNA, 22 bp, Homo sapiens
gtcctctgtgtaggctgcagac

SEQ ID NO: 8131299 - DNA, 22 bp, Homo sapiens
cagccgtcagatgtgccgcagc

SEQ ID NO: 8131300 - DNA, 22 bp, Homo sapiens
gtgcatgctgcagtatgatttc

SEQ ID NO: 8131301 - DNA, 22 bp, Homo sapiens
cagctctgagactgaggctatg

SEQ ID NO: 8131302 - DNA, 22 bp, Homo sapiens
ggtggcagtgcttgcgggtcta

SEQ ID NO: 8131303 - DNA, 22 bp, Homo sapiens
ggtggcagtagcactgggcctg

SEQ ID NO: 8131304 - DNA, 22 bp, Homo sapiens
ggtggcagggagtgtccctggg

SEQ ID NO: 8131305 - DNA, 22 bp, Homo sapiens
cagcagactggagtaggcagtg

SEQ ID NO: 8131306 - DNA, 22 bp, Homo sapiens
ggtgtccttgctccttcagctt

SEQ ID NO: 8131307 - DNA, 22 bp, Homo sapiens
cagatgcttcgtgggtgagcac

SEQ ID NO: 8131308 - DNA, 22 bp, Homo sapiens
ggtgcagaggagccagctgggg

SEQ ID NO: 8131309 - DNA, 22 bp, Homo sapiens
ggtgcagctggacagagaagcc

SEQ ID NO: 8131310 - DNA, 22 bp, Homo sapiens
ggtgcagaagaaagcagtcatt

SEQ ID NO: 8131311 - DNA, 22 bp, Homo sapiens
ggtgcagaaggaagggagctgg

SEQ ID NO: 8131312 - DNA, 22 bp, Homo sapiens
ggtgcagagcagtgtcagagca

SEQ ID NO: 8131313 - DNA, 22 bp, Homo sapiens
cagagtgggctgtcagccacca

SEQ ID NO: 8131314 - DNA, 22 bp, Homo sapiens
ggggtgagatcaaggaagccct

SEQ ID NO: 8131315 - DNA, 22 bp, Homo sapiens
ggggtctgggttgctcggcctt

SEQ ID NO: 8131316 - DNA, 22 bp, Homo sapiens
ggggtaggtcatagcccctcta

SEQ ID NO: 8131317 - DNA, 22 bp, Homo sapiens
gggctcaggcctggcctctcac

SEQ ID NO: 8131318 - DNA, 22 bp, Homo sapiens
gggctcaggagtttgaggctgc

SEQ ID NO: 8131319 - DNA, 22 bp, Homo sapiens
gggctcagggacacatgtgtgt

SEQ ID NO: 8131320 - DNA, 22 bp, Homo sapiens
gggctcagtcctggttctaccc

SEQ ID NO: 8131321 - DNA, 22 bp, Homo sapiens
gggctcagtcggcaagcccctt

SEQ ID NO: 8131322 - DNA, 22 bp, Homo sapiens
gggctcagtcctggttctaccc

SEQ ID NO: 8131323 - DNA, 22 bp, Homo sapiens
gggctcagtctggcgtggaatg

SEQ ID NO: 8131324 - DNA, 22 bp, Homo sapiens
gggctcagtctgcggcgcgcgg

SEQ ID NO: 8131325 - DNA, 22 bp, Homo sapiens
gggctctgcacgttctggcgtc

SEQ ID NO: 8131326 - DNA, 22 bp, Homo sapiens
gggctctgcagtgacttgaggg

SEQ ID NO: 8131327 - DNA, 21 bp, Homo sapiens
gggctctgccctcctggagct

SEQ ID NO: 8131328 - DNA, 22 bp, Homo sapiens
gggctctgcctggctgggagta

SEQ ID NO: 8131329 - DNA, 22 bp, Homo sapiens
gggggaggtgaatgcaataagg

SEQ ID NO: 8131330 - DNA, 22 bp, Homo sapiens
gggggatgctcaggaggctgct

SEQ ID NO: 8131331 - DNA, 22 bp, Homo sapiens
gggggcagaatgtactcttgtc

SEQ ID NO: 8131332 - DNA, 22 bp, Homo sapiens
gggggcagtaacctcaaagtgt

SEQ ID NO: 8131333 - DNA, 22 bp, Homo sapiens
gggggcaggtctggaactttga

SEQ ID NO: 8131334 - DNA, 22 bp, Homo sapiens
cagaggaaggctctgggaatgt

SEQ ID NO: 8131335 - DNA, 22 bp, Homo sapiens
cagaggaagggtgctgcgaaag

SEQ ID NO: 8131336 - DNA, 22 bp, Homo sapiens
cagaggaagctgggtgtggagt

SEQ ID NO: 8131337 - DNA, 22 bp, Homo sapiens
cagaggaagcagacacatcttg

SEQ ID NO: 8131338 - DNA, 22 bp, Homo sapiens
cagaggaccagaaaggggccca

SEQ ID NO: 8131339 - DNA, 22 bp, Homo sapiens
ggggcgctcggagggatcccct

SEQ ID NO: 8131340 - DNA, 22 bp, Homo sapiens
cagagagagtggggtgtggatt

SEQ ID NO: 8131341 - DNA, 22 bp, Homo sapiens
cagagagagtctgtccctgaag

SEQ ID NO: 8131342 - DNA, 16 bp, Homo sapiens
cagagaggacagaggc

SEQ ID NO: 8131343 - DNA, 22 bp, Homo sapiens
gggccctgcgactcgcggcgga

SEQ ID NO: 8131344 - DNA, 22 bp, Homo sapiens
gggccctgcgtccggaagtctg

SEQ ID NO: 8131345 - DNA, 22 bp, Homo sapiens
gggccctggccgaatccctctg

SEQ ID NO: 8131346 - DNA, 22 bp, Homo sapiens
gggccctggatttaagcatgga

SEQ ID NO: 8131347 - DNA, 22 bp, Homo sapiens
gggccctggacgtggcggcaga

SEQ ID NO: 8131348 - DNA, 18 bp, Homo sapiens
gggccctggcgtccgccc

SEQ ID NO: 8131349 - DNA, 22 bp, Homo sapiens
gggccctggctttcctgttctt

SEQ ID NO: 8131350 - DNA, 20 bp, Homo sapiens
gggccctgggattcagagca

SEQ ID NO: 8131351 - DNA, 18 bp, Homo sapiens
cagagcagaggtggagcg

SEQ ID NO: 8131352 - DNA, 22 bp, Homo sapiens
cagagcagcctccagggggagc

SEQ ID NO: 8131353 - DNA, 17 bp, Homo sapiens
gggcgcgggtagagccc

SEQ ID NO: 8131354 - DNA, 22 bp, Homo sapiens
cagaagcaagagccggagctag

SEQ ID NO: 8131355 - DNA, 22 bp, Homo sapiens
cagaagcaagtagtgattcttt

SEQ ID NO: 8131356 - DNA, 22 bp, Homo sapiens
cagaagcacatgtttacatgta

SEQ ID NO: 8131357 - DNA, 22 bp, Homo sapiens
cagagacagtttcacagggtct

SEQ ID NO: 8131358 - DNA, 18 bp, Homo sapiens
cagaagcaggcagtgcag

SEQ ID NO: 8131359 - DNA, 22 bp, Homo sapiens
cagagagaatatgtagtatgga

SEQ ID NO: 8131360 - DNA, 22 bp, Homo sapiens
cagagagaatcttggcagctga

SEQ ID NO: 8131361 - DNA, 22 bp, Homo sapiens
cagagagagcaggaaacctccg

SEQ ID NO: 8131362 - DNA, 22 bp, Homo sapiens
cagagagaatcttggcagctga

SEQ ID NO: 8131363 - DNA, 19 bp, Homo sapiens
cagagagaccaaggcgcca

SEQ ID NO: 8131364 - DNA, 22 bp, Homo sapiens
cagagagaggggctgcctggcc

SEQ ID NO: 8131365 - DNA, 22 bp, Homo sapiens
cagagagaggccactgctatta

SEQ ID NO: 8131366 - DNA, 22 bp, Homo sapiens
cagagagagtcaaatctttgct

SEQ ID NO: 8131367 - DNA, 22 bp, Homo sapiens
cagagagaggtgccgataatgg

SEQ ID NO: 8131368 - DNA, 22 bp, Homo sapiens
gagaggaatgaggttaaggact

SEQ ID NO: 8131369 - DNA, 23 bp, Homo sapiens
gagctctgcactaggccctggga

SEQ ID NO: 8131370 - DNA, 22 bp, Homo sapiens
gagctttgcattattcagaagc

SEQ ID NO: 8131371 - DNA, 22 bp, Homo sapiens
gagctttggtgccaagtatttg

SEQ ID NO: 8131372 - DNA, 22 bp, Homo sapiens
gagctttgtgctggtaggtggt

SEQ ID NO: 8131373 - DNA, 22 bp, Homo sapiens
gagctttgttccgtggtggcac

SEQ ID NO: 8131374 - DNA, 22 bp, Homo sapiens
gagctttgtagcaggaaggaag

SEQ ID NO: 8131375 - DNA, 22 bp, Homo sapiens
gagctttgtcccttgggggctc

SEQ ID NO: 8131376 - DNA, 22 bp, Homo sapiens
gagctttgtctcctggagaccc

SEQ ID NO: 8131377 - DNA, 22 bp, Homo sapiens
gagctttgagattcttatggta

SEQ ID NO: 8131378 - DNA, 22 bp, Homo sapiens
gagctggggcggatactcagct

SEQ ID NO: 8131379 - DNA, 22 bp, Homo sapiens
gagctctggcagggcaggtctg

SEQ ID NO: 8131380 - DNA, 22 bp, Homo sapiens
atgtacaatctatcacaagaag

SEQ ID NO: 8131381 - DNA, 22 bp, Homo sapiens
atgtacaaaatgttttgaaatg

SEQ ID NO: 8131382 - DNA, 22 bp, Homo sapiens
atgtcacaggcaacaagattgc

SEQ ID NO: 8131383 - DNA, 22 bp, Homo sapiens
atgtcacagcaggagtattctt

SEQ ID NO: 8131384 - DNA, 22 bp, Homo sapiens
atgtcacagttgcaacatgaat

SEQ ID NO: 8131385 - DNA, 22 bp, Homo sapiens
atgtaaggctgcctatgacact

SEQ ID NO: 8131386 - DNA, 22 bp, Homo sapiens
atgtaaggttcagagtatgtga

SEQ ID NO: 8131387 - DNA, 22 bp, Homo sapiens
atgtaaattgtactgacacacg

SEQ ID NO: 8131388 - DNA, 22 bp, Homo sapiens
atgtcacatggtcacctctagc

SEQ ID NO: 8131389 - DNA, 22 bp, Homo sapiens
atgtcacatggcctgtactttg

SEQ ID NO: 8131390 - DNA, 22 bp, Homo sapiens
gagggggctagcgcagtgccca

SEQ ID NO: 8131391 - DNA, 22 bp, Homo sapiens
gaggggagcccccatcctccag

SEQ ID NO: 8131392 - DNA, 22 bp, Homo sapiens
gacagggccgcagatggagact

SEQ ID NO: 8131393 - DNA, 22 bp, Homo sapiens
gacagggcatggtgcagagttc

SEQ ID NO: 8131394 - DNA, 22 bp, Homo sapiens
gacagtttaagcacctaatatt

SEQ ID NO: 8131395 - DNA, 22 bp, Homo sapiens
gacagtttggatgggggtttgc

SEQ ID NO: 8131396 - DNA, 22 bp, Homo sapiens
gacagtttctgaatgcgtactt

SEQ ID NO: 8131397 - DNA, 22 bp, Homo sapiens
gacagttttgctaaaaggttga

SEQ ID NO: 8131398 - DNA, 22 bp, Homo sapiens
gacagtttaggttcaaatctca

SEQ ID NO: 8131399 - DNA, 22 bp, Homo sapiens
gacagtttttaatcctttcatg

SEQ ID NO: 8131400 - DNA, 22 bp, Homo sapiens
gacagttttgctgaaattgagc

SEQ ID NO: 8131401 - DNA, 22 bp, Homo sapiens
gaccccaggcagatcagggggt

SEQ ID NO: 8131402 - DNA, 22 bp, Homo sapiens
gaccccagaggaaggggcgccg

SEQ ID NO: 8131403 - DNA, 22 bp, Homo sapiens
gaatgttactttgattttgtcc

SEQ ID NO: 8131404 - DNA, 22 bp, Homo sapiens
gaatgtcagttgcgggcatttc

SEQ ID NO: 8131405 - DNA, 22 bp, Homo sapiens
gaatgtcagggccagaagaggc

SEQ ID NO: 8131406 - DNA, 22 bp, Homo sapiens
atgcatacagatttaaaatttt

SEQ ID NO: 8131407 - DNA, 19 bp, Homo sapiens
atgcatacttgcatagttt

SEQ ID NO: 8131408 - DNA, 19 bp, Homo sapiens
gaatgtttctgtctcttct

SEQ ID NO: 8131409 - DNA, 22 bp, Homo sapiens
gaatgtttaaaaggtgcagttt

SEQ ID NO: 8131410 - DNA, 22 bp, Homo sapiens
gaatgtttcatgtgtatgttag

SEQ ID NO: 8131411 - DNA, 22 bp, Homo sapiens
gaatgtttaaggaaggcgtggc

SEQ ID NO: 8131412 - DNA, 20 bp, Homo sapiens
gaatgtttcacttgctccat

SEQ ID NO: 8131413 - DNA, 22 bp, Homo sapiens
gaatcatagaacattaatagaa

SEQ ID NO: 8131414 - DNA, 22 bp, Homo sapiens
gacagggacgaggcttcaggca

SEQ ID NO: 8131415 - DNA, 22 bp, Homo sapiens
gaaaatgtgtcatccctactgt

SEQ ID NO: 8131416 - DNA, 22 bp, Homo sapiens
cttgagaagagatttatatttg

SEQ ID NO: 8131417 - DNA, 21 bp, Homo sapiens
cttgagaattaactgttcatt

SEQ ID NO: 8131418 - DNA, 22 bp, Homo sapiens
cttgagaaaggaacaggaagct

SEQ ID NO: 8131419 - DNA, 22 bp, Homo sapiens
cttgagatgtcatctgctttgg

SEQ ID NO: 8131420 - DNA, 22 bp, Homo sapiens
gccactgcactccagcccaggc

SEQ ID NO: 8131421 - DNA, 21 bp, Homo sapiens
gccactgcactccagcctggg

SEQ ID NO: 8131422 - DNA, 22 bp, Homo sapiens
atttaaatgcttaagagggttt

SEQ ID NO: 8131423 - DNA, 22 bp, Homo sapiens
attgttgacttgattactcaac

SEQ ID NO: 8131424 - DNA, 22 bp, Homo sapiens
attgttgaggagactcttcaat

SEQ ID NO: 8131425 - DNA, 22 bp, Homo sapiens
attgttgaggcagttcatcttg

SEQ ID NO: 8131426 - DNA, 22 bp, Homo sapiens
attgtttacactaacttcataa

SEQ ID NO: 8131427 - DNA, 22 bp, Homo sapiens
attgttgctaggattcaatgag

SEQ ID NO: 8131428 - DNA, 22 bp, Homo sapiens
attgtacaatgcctggaacatt

SEQ ID NO: 8131429 - DNA, 22 bp, Homo sapiens
gcagggacgccagggacagcaa

SEQ ID NO: 8131430 - DNA, 22 bp, Homo sapiens
gcagggactttggcaacaggtg

SEQ ID NO: 8131431 - DNA, 22 bp, Homo sapiens
gcaggctggtctgaccatccct

SEQ ID NO: 8131432 - DNA, 22 bp, Homo sapiens
gcaggcggaggttgcagtgagc

SEQ ID NO: 8131433 - DNA, 18 bp, Homo sapiens
gcaggagatgggtggggt

SEQ ID NO: 8131434 - DNA, 22 bp, Homo sapiens
gcaggagcaaactgcagtgtgg

SEQ ID NO: 8131435 - DNA, 22 bp, Homo sapiens
gcagggtccatggaggcagccc

SEQ ID NO: 8131436 - DNA, 22 bp, Homo sapiens
gcagggtcttgagaggcagcca

SEQ ID NO: 8131437 - DNA, 22 bp, Homo sapiens
gcaggtggatcaccacgtcagg

SEQ ID NO: 8131438 - DNA, 22 bp, Homo sapiens
gcaggtggatcacctgaggtca

SEQ ID NO: 8131439 - DNA, 20 bp, Homo sapiens
gcacagagatgagcaaagta

SEQ ID NO: 8131440 - DNA, 23 bp, Homo sapiens
gcactgggctctcagcaaggtgt

SEQ ID NO: 8131441 - DNA, 22 bp, Homo sapiens
gcacagggagcaggtctctggt

SEQ ID NO: 8131442 - DNA, 22 bp, Homo sapiens
gcaacattgcttctgaacatag

SEQ ID NO: 8131443 - DNA, 22 bp, Homo sapiens
gcaacattcatgttctgtaacc

SEQ ID NO: 8131444 - DNA, 22 bp, Homo sapiens
gcacacagggatttttgaatgg

SEQ ID NO: 8131445 - DNA, 22 bp, Homo sapiens
gatttctgtaacacttcagata

SEQ ID NO: 8131446 - DNA, 22 bp, Homo sapiens
gatttctgggctttatttcaga

SEQ ID NO: 8131447 - DNA, 22 bp, Homo sapiens
gatttctgtggcttgtacatat

SEQ ID NO: 8131448 - DNA, 22 bp, Homo sapiens
gcagaaggttgtttgggaaagg

SEQ ID NO: 8131449 - DNA, 22 bp, Homo sapiens
gcagaaggtctggcacttcagg

SEQ ID NO: 8131450 - DNA, 22 bp, Homo sapiens
gcagaaggtcaaagcaagatgt

SEQ ID NO: 8131451 - DNA, 22 bp, Homo sapiens
gcagaagggaataaggagcttt

SEQ ID NO: 8131452 - DNA, 16 bp, Homo sapiens
gcagaggaaaggggag

SEQ ID NO: 8131453 - DNA, 22 bp, Homo sapiens
gcagaggcctgaaggtggcggg

SEQ ID NO: 8131454 - DNA, 17 bp, Homo sapiens
gcagcctcttggtagtg

SEQ ID NO: 8131455 - DNA, 22 bp, Homo sapiens
attttctagatagatgatgcat

SEQ ID NO: 8131456 - DNA, 22 bp, Homo sapiens
attttcttctctccctggctgc

SEQ ID NO: 8131457 - DNA, 22 bp, Homo sapiens
gcctgccccttcctgggcaggg

SEQ ID NO: 8131458 - DNA, 22 bp, Homo sapiens
gcctgcccacggggctggcata

SEQ ID NO: 8131459 - DNA, 22 bp, Homo sapiens
atttgagaaaggagggaacttt

SEQ ID NO: 8131460 - DNA, 22 bp, Homo sapiens
attttaataagatccatttggt

SEQ ID NO: 8131461 - DNA, 22 bp, Homo sapiens
gccccgtcgtggggccagggat

SEQ ID NO: 8131462 - DNA, 22 bp, Homo sapiens
gccctcccctctgggtggtgag

SEQ ID NO: 8131463 - DNA, 22 bp, Homo sapiens
gccctgccctctcggcactcgc

SEQ ID NO: 8131464 - DNA, 22 bp, Homo sapiens
gccctgccctgagccgtagacc

SEQ ID NO: 8131465 - DNA, 22 bp, Homo sapiens
gccctgccctgttgaaactaga

SEQ ID NO: 8131466 - DNA, 22 bp, Homo sapiens
gccctgccgggtattttgtgct

SEQ ID NO: 8131467 - DNA, 23 bp, Homo sapiens
gccctgcccttagcacactcaca

SEQ ID NO: 8131468 - DNA, 22 bp, Homo sapiens
gccagaggggctcgaaggcgcg

SEQ ID NO: 8131469 - DNA, 22 bp, Homo sapiens
caaatcaccacttaatgggtta

SEQ ID NO: 8131470 - DNA, 20 bp, Homo sapiens
caaatcacaggtaattgcaa

SEQ ID NO: 8131471 - DNA, 22 bp, Homo sapiens
caaatcacaatgtgagactgag

SEQ ID NO: 8131472 - DNA, 22 bp, Homo sapiens
caaatattccaggtacatccct

SEQ ID NO: 8131473 - DNA, 20 bp, Homo sapiens
caaatccctgctctgtgctg

SEQ ID NO: 8131474 - DNA, 22 bp, Homo sapiens
gctctgggtgaatggcagattg

SEQ ID NO: 8131475 - DNA, 22 bp, Homo sapiens
gctctgggtgaacttggagcaa

SEQ ID NO: 8131476 - DNA, 22 bp, Homo sapiens
gctgaggaagtcaggtggccca

SEQ ID NO: 8131477 - DNA, 22 bp, Homo sapiens
caaattagaggtttgttttgat

SEQ ID NO: 8131478 - DNA, 22 bp, Homo sapiens
gctatttctatattataaagaa

SEQ ID NO: 8131479 - DNA, 22 bp, Homo sapiens
gctatttctttaaattgatctc

SEQ ID NO: 8131480 - DNA, 22 bp, Homo sapiens
gctcaggcaggagtgcagtggc

SEQ ID NO: 8131481 - DNA, 22 bp, Homo sapiens
gctattgtgacagcttttcgcc

SEQ ID NO: 8131482 - DNA, 22 bp, Homo sapiens
gctattgtacatttcttgtttg

SEQ ID NO: 8131483 - DNA, 22 bp, Homo sapiens
gctacacaaaaggagagtgagt

SEQ ID NO: 8131484 - DNA, 22 bp, Homo sapiens
gcgtggggtaggtagacatgga

SEQ ID NO: 8131485 - DNA, 22 bp, Homo sapiens
gctctaaagtccagtcaactag

SEQ ID NO: 8131486 - DNA, 22 bp, Homo sapiens
gctctaaagagaatctatgcgg

SEQ ID NO: 8131487 - DNA, 22 bp, Homo sapiens
gctctaggttcctagccaagtc

SEQ ID NO: 8131488 - DNA, 22 bp, Homo sapiens
gctctagcccatttcctgcttg

SEQ ID NO: 8131489 - DNA, 22 bp, Homo sapiens
gctctagattgttacaaagttc

SEQ ID NO: 8131490 - DNA, 22 bp, Homo sapiens
gctcgcgccgcaccggtccacc

SEQ ID NO: 8131491 - DNA, 22 bp, Homo sapiens
gctcggagaactgggggctccg

SEQ ID NO: 8131492 - DNA, 17 bp, Homo sapiens
gctccaggcgtgagtga

SEQ ID NO: 8131493 - DNA, 22 bp, Homo sapiens
gctccaggcgagctggaccaga

SEQ ID NO: 8131494 - DNA, 22 bp, Homo sapiens
gctcagggctaaggctgagggg

SEQ ID NO: 8131495 - DNA, 22 bp, Homo sapiens
gctcaggggaatgggctgccgt

SEQ ID NO: 8131496 - DNA, 22 bp, Homo sapiens
gctcagggtcccttggtgctgg

SEQ ID NO: 8131497 - DNA, 22 bp, Homo sapiens
cccatgaggtggaggttgcagt

SEQ ID NO: 8131498 - DNA, 22 bp, Homo sapiens
cccatgagtgctgctcagaggc

SEQ ID NO: 8131499 - DNA, 17 bp, Homo sapiens
cccatgagcccactccc

SEQ ID NO: 8131500 - DNA, 22 bp, Homo sapiens
cccatgagacctggtttaaggc

SEQ ID NO: 8131501 - DNA, 22 bp, Homo sapiens
cccatgagattctgaatttggc

SEQ ID NO: 8131502 - DNA, 22 bp, Homo sapiens
ccctgcccaccacatgctggga

SEQ ID NO: 8131503 - DNA, 22 bp, Homo sapiens
ccctgcccatcggggcggcctg

SEQ ID NO: 8131504 - DNA, 18 bp, Homo sapiens
ccctgccagctcccagca

SEQ ID NO: 8131505 - DNA, 22 bp, Homo sapiens
ccctgccagggtcctgacagac

SEQ ID NO: 8131506 - DNA, 23 bp, Homo sapiens
ccctgcccattgagcaggacgtc

SEQ ID NO: 8131507 - DNA, 22 bp, Homo sapiens
ccctccattaaaacagacctat

SEQ ID NO: 8131508 - DNA, 22 bp, Homo sapiens
cccatcaggaacccaggagccc

SEQ ID NO: 8131509 - DNA, 22 bp, Homo sapiens
aggctgggtacctgtcatatgc

SEQ ID NO: 8131510 - DNA, 20 bp, Homo sapiens
aggggcacctgcgacggggc

SEQ ID NO: 8131511 - DNA, 22 bp, Homo sapiens
aggggcacgagtagagctctag

SEQ ID NO: 8131512 - DNA, 22 bp, Homo sapiens
aggggcagcctcacaatcctct

SEQ ID NO: 8131513 - DNA, 23 bp, Homo sapiens
aggggcagcaagttttggtgtta

SEQ ID NO: 8131514 - DNA, 22 bp, Homo sapiens
aggggaggtgtccccaaatctc

SEQ ID NO: 8131515 - DNA, 22 bp, Homo sapiens
aggggaggagcttttcttgcct

SEQ ID NO: 8131516 - DNA, 22 bp, Homo sapiens
aggggaggcagcgataaacctg

SEQ ID NO: 8131517 - DNA, 22 bp, Homo sapiens
cctgaaatgactccagctgagt

SEQ ID NO: 8131518 - DNA, 22 bp, Homo sapiens
agggtagggccgtagggccatg

SEQ ID NO: 8131519 - DNA, 22 bp, Homo sapiens
agggtagggcccggagacagac

SEQ ID NO: 8131520 - DNA, 23 bp, Homo sapiens
agggcctgatggctcccgctggc

SEQ ID NO: 8131521 - DNA, 22 bp, Homo sapiens
agggcctggcgcgtggccgccg

SEQ ID NO: 8131522 - DNA, 22 bp, Homo sapiens
cctcaggccctgtccctgcgcc

SEQ ID NO: 8131523 - DNA, 22 bp, Homo sapiens
cctcaggcaggaaactgtcccg

SEQ ID NO: 8131524 - DNA, 22 bp, Homo sapiens
agggcgggctcatcacatgctc

SEQ ID NO: 8131525 - DNA, 22 bp, Homo sapiens
agggcgctgtctggccagcggt

SEQ ID NO: 8131526 - DNA, 19 bp, Homo sapiens
agggcggggcccaggcaca

SEQ ID NO: 8131527 - DNA, 22 bp, Homo sapiens
agggctgcttacctggaatggc

SEQ ID NO: 8131528 - DNA, 22 bp, Homo sapiens
agggctgctttgctaaatatgg

SEQ ID NO: 8131529 - DNA, 22 bp, Homo sapiens
agggctgcagtcctaaggtgct

SEQ ID NO: 8131530 - DNA, 22 bp, Homo sapiens
agggctgcatctgcctggtgaa

SEQ ID NO: 8131531 - DNA, 22 bp, Homo sapiens
agggctgctgctccgggcccag

SEQ ID NO: 8131532 - DNA, 22 bp, Homo sapiens
agggctgctgaggaagccttgc

SEQ ID NO: 8131533 - DNA, 22 bp, Homo sapiens
agggctggagccacagctggga

SEQ ID NO: 8131534 - DNA, 22 bp, Homo sapiens
ccagcaggagatgcctgtgtct

SEQ ID NO: 8131535 - DNA, 22 bp, Homo sapiens
ccagcaggagactagcaacata

SEQ ID NO: 8131536 - DNA, 22 bp, Homo sapiens
aggcggctggtgtcctgcaggt

SEQ ID NO: 8131537 - DNA, 19 bp, Homo sapiens
aggcggctcgcgcgcctcc

SEQ ID NO: 8131538 - DNA, 22 bp, Homo sapiens
aggcgctgtgcttggggctgga

SEQ ID NO: 8131539 - DNA, 22 bp, Homo sapiens
aggcctggcatgagacctgaga

SEQ ID NO: 8131540 - DNA, 22 bp, Homo sapiens
ccagaccctgctctggggctct

SEQ ID NO: 8131541 - DNA, 22 bp, Homo sapiens
aggccacagtactttgcagacc

SEQ ID NO: 8131542 - DNA, 22 bp, Homo sapiens
ccagaacagacctgcctgacct

SEQ ID NO: 8131543 - DNA, 22 bp, Homo sapiens
ccagcagctttgcatacactaa

SEQ ID NO: 8131544 - DNA, 22 bp, Homo sapiens
ccaggctggagtgcaatggcat

SEQ ID NO: 8131545 - DNA, 22 bp, Homo sapiens
ccaggctgggcggggaacctgg

SEQ ID NO: 8131546 - DNA, 22 bp, Homo sapiens
ccaggctgggctacaagttgag

SEQ ID NO: 8131547 - DNA, 15 bp, Homo sapiens
ccaggctgggtgagc

SEQ ID NO: 8131548 - DNA, 22 bp, Homo sapiens
ccaggctggtctgaatttctag

SEQ ID NO: 8131549 - DNA, 22 bp, Homo sapiens
ccaggctggagtatagtggcgc

SEQ ID NO: 8131550 - DNA, 22 bp, Homo sapiens
ccaggctggaatcaatattctg

SEQ ID NO: 8131551 - DNA, 22 bp, Homo sapiens
ccaggctgctttattactctgt

SEQ ID NO: 8131552 - DNA, 22 bp, Homo sapiens
ccaggctgcttagccttatctt

SEQ ID NO: 8131553 - DNA, 22 bp, Homo sapiens
ccaggctgctgttggtgtccgc

SEQ ID NO: 8131554 - DNA, 22 bp, Homo sapiens
aggcgtgggaggatctgaggcc

SEQ ID NO: 8131555 - DNA, 22 bp, Homo sapiens
aggcgtggttgaggcgagcata

SEQ ID NO: 8131556 - DNA, 22 bp, Homo sapiens
ccaggctgtaaacaccttcaaa

SEQ ID NO: 8131557 - DNA, 20 bp, Homo sapiens
ccagggctggctcctgggat

SEQ ID NO: 8131558 - DNA, 22 bp, Homo sapiens
aggctgggctccgcccaactcc

SEQ ID NO: 8131559 - DNA, 22 bp, Homo sapiens
aggctggccctactggctgcct

SEQ ID NO: 8131560 - DNA, 22 bp, Homo sapiens
ccatttggtatagtgaaaagga

SEQ ID NO: 8131561 - DNA, 22 bp, Homo sapiens
ccatttggcaagaaagagtcat

SEQ ID NO: 8131562 - DNA, 22 bp, Homo sapiens
aggctggaaagggaccagagtg

SEQ ID NO: 8131563 - DNA, 22 bp, Homo sapiens
aggctggagtgctggagtgctg

SEQ ID NO: 8131564 - DNA, 22 bp, Homo sapiens
aggctggagtgtagcagtgcag

SEQ ID NO: 8131565 - DNA, 22 bp, Homo sapiens
aggctggaggtttgttgcggct

SEQ ID NO: 8131566 - DNA, 22 bp, Homo sapiens
cagggacagcgggactctgaca

SEQ ID NO: 8131567 - DNA, 22 bp, Homo sapiens
aggaaacagaggtgccacaata

SEQ ID NO: 8131568 - DNA, 22 bp, Homo sapiens
aggaatgttaagaaggtctacc

SEQ ID NO: 8131569 - DNA, 22 bp, Homo sapiens
caggtcctcgggggaggccggc

SEQ ID NO: 8131570 - DNA, 22 bp, Homo sapiens
cagggtggggctggctatcaaa

SEQ ID NO: 8131571 - DNA, 22 bp, Homo sapiens
cagggtggtgaatagctatagt

SEQ ID NO: 8131572 - DNA, 22 bp, Homo sapiens
cagggtggtaccagcatctagt

SEQ ID NO: 8131573 - DNA, 22 bp, Homo sapiens
agctgccctggcggagctgctc

SEQ ID NO: 8131574 - DNA, 22 bp, Homo sapiens
agctgccctcgctggggccaga

SEQ ID NO: 8131575 - DNA, 20 bp, Homo sapiens
agctgcccctgggcactgcc

SEQ ID NO: 8131576 - DNA, 22 bp, Homo sapiens
agctgcccccagggctgtgctt

SEQ ID NO: 8131577 - DNA, 22 bp, Homo sapiens
agctgcccttctcttgcccttg

SEQ ID NO: 8131578 - DNA, 22 bp, Homo sapiens
agctgggcagactgcagtggtt

SEQ ID NO: 8131579 - DNA, 22 bp, Homo sapiens
agctgggactcaactgtctggg

SEQ ID NO: 8131580 - DNA, 22 bp, Homo sapiens
agctggagccagtgtgaggctt

SEQ ID NO: 8131581 - DNA, 22 bp, Homo sapiens
aggaatttggggttacatgatg

SEQ ID NO: 8131582 - DNA, 22 bp, Homo sapiens
aggaattaacaatatatttagg

SEQ ID NO: 8131583 - DNA, 22 bp, Homo sapiens
cagtctcttttcagctccatcc

SEQ ID NO: 8131584 - DNA, 22 bp, Homo sapiens
aggaggggcaatgatagtctgg

SEQ ID NO: 8131585 - DNA, 22 bp, Homo sapiens
aggaggctggttcaggccatat

SEQ ID NO: 8131586 - DNA, 22 bp, Homo sapiens
catcatttgtttgcatgcagga

SEQ ID NO: 8131587 - DNA, 20 bp, Homo sapiens
catcattttaaaatctctcc

SEQ ID NO: 8131588 - DNA, 22 bp, Homo sapiens
catcattcctaggtgcagagct

SEQ ID NO: 8131589 - DNA, 22 bp, Homo sapiens
catcatttcacttagatgaagt

SEQ ID NO: 8131590 - DNA, 22 bp, Homo sapiens
cagttcagctagaagaaacaaa

SEQ ID NO: 8131591 - DNA, 22 bp, Homo sapiens
catcacttttaaaggtgatcga

SEQ ID NO: 8131592 - DNA, 22 bp, Homo sapiens
catcagaagaaagacaaatgat

SEQ ID NO: 8131593 - DNA, 22 bp, Homo sapiens
aggaggctgcaaccctgaggcc

SEQ ID NO: 8131594 - DNA, 22 bp, Homo sapiens
aggaggctgggcacagtggcct

SEQ ID NO: 8131595 - DNA, 22 bp, Homo sapiens
aggatcagtgaatactcagggt

SEQ ID NO: 8131596 - DNA, 22 bp, Homo sapiens
aggcactgaagaactctttttg

SEQ ID NO: 8131597 - DNA, 22 bp, Homo sapiens
aggcacaggtggacttcacagt

SEQ ID NO: 8131598 - DNA, 22 bp, Homo sapiens
aggcagagagcagtggccgtct

SEQ ID NO: 8131599 - DNA, 22 bp, Homo sapiens
aggcaggctagtcgcttgagcc

SEQ ID NO: 8131600 - DNA, 22 bp, Homo sapiens
aggcaggctcaatgcccagtct

SEQ ID NO: 8131601 - DNA, 22 bp, Homo sapiens
aggcaggccctctggaaaggta

SEQ ID NO: 8131602 - DNA, 21 bp, Homo sapiens
ccaaagaactgccatttgtca

SEQ ID NO: 8131603 - DNA, 22 bp, Homo sapiens
aggcagctttcagtgtctctca

SEQ ID NO: 8131604 - DNA, 22 bp, Homo sapiens
atctggttcttcttaggcatca

SEQ ID NO: 8131605 - DNA, 22 bp, Homo sapiens
atctggttttggctgtgtccct

SEQ ID NO: 8131606 - DNA, 22 bp, Homo sapiens
atccatttgacataatttcagc

SEQ ID NO: 8131607 - DNA, 22 bp, Homo sapiens
atccatttcctccactataaag

SEQ ID NO: 8131608 - DNA, 22 bp, Homo sapiens
atcatcagggacatttctgtgc

SEQ ID NO: 8131609 - DNA, 22 bp, Homo sapiens
cttatgtatgctactttgtggt

SEQ ID NO: 8131610 - DNA, 20 bp, Homo sapiens
ctgggtggcaagcaaggggg

SEQ ID NO: 8131611 - DNA, 22 bp, Homo sapiens
ctgggtggagcctggtcatctg

SEQ ID NO: 8131612 - DNA, 22 bp, Homo sapiens
ctgggtggcagagcctgcagtg

SEQ ID NO: 8131613 - DNA, 22 bp, Homo sapiens
ctgggaggtggaggttgcattg

SEQ ID NO: 8131614 - DNA, 22 bp, Homo sapiens
ctgggaggcggaggttgtagtg

SEQ ID NO: 8131615 - DNA, 22 bp, Homo sapiens
ctgggaggacaacttggagctc

SEQ ID NO: 8131616 - DNA, 22 bp, Homo sapiens
ctgggaggcggaggttgcagtg

SEQ ID NO: 8131617 - DNA, 22 bp, Homo sapiens
ctgggagcttgttaggaatgca

SEQ ID NO: 8131618 - DNA, 22 bp, Homo sapiens
ctggggcttcaatgcttcggtg

SEQ ID NO: 8131619 - DNA, 23 bp, Homo sapiens
ctggggctttcaaatctgggcag

SEQ ID NO: 8131620 - DNA, 22 bp, Homo sapiens
atcacagcacacctgacatgta

SEQ ID NO: 8131621 - DNA, 22 bp, Homo sapiens
atcacaaaggtctcagagcaca

SEQ ID NO: 8131622 - DNA, 22 bp, Homo sapiens
ctgtaacagctgtcagagcagg

SEQ ID NO: 8131623 - DNA, 22 bp, Homo sapiens
atcagccaattacagaacatga

SEQ ID NO: 8131624 - DNA, 22 bp, Homo sapiens
atcagcatctttaacaattacc

SEQ ID NO: 8131625 - DNA, 19 bp, Homo sapiens
atcagctgaagccttcaga

SEQ ID NO: 8131626 - DNA, 22 bp, Homo sapiens
atcataaaccactttgtaatct

SEQ ID NO: 8131627 - DNA, 22 bp, Homo sapiens
atcataaaccactttgtaatct

SEQ ID NO: 8131628 - DNA, 22 bp, Homo sapiens
atcataaagtgctatctgattg

SEQ ID NO: 8131629 - DNA, 22 bp, Homo sapiens
atcataaaattgcaccatttct

SEQ ID NO: 8131630 - DNA, 22 bp, Homo sapiens
atcagtttctgtgaagaacaca

SEQ ID NO: 8131631 - DNA, 22 bp, Homo sapiens
atcagtttgagtgctgtgtcaa

SEQ ID NO: 8131632 - DNA, 22 bp, Homo sapiens
atagtttgtgaaacacagcagt

SEQ ID NO: 8131633 - DNA, 22 bp, Homo sapiens
ctggcctctctgagcagggagc

SEQ ID NO: 8131634 - DNA, 22 bp, Homo sapiens
atagtttgggcaaagaggacct

SEQ ID NO: 8131635 - DNA, 22 bp, Homo sapiens
ctggctatgtggttagacataa

SEQ ID NO: 8131636 - DNA, 22 bp, Homo sapiens
ctgggagctggatgccctgccc

SEQ ID NO: 8131637 - DNA, 22 bp, Homo sapiens
ctgggagctgtcaggagcgtgt

SEQ ID NO: 8131638 - DNA, 22 bp, Homo sapiens
atacacattactttctgtctga

SEQ ID NO: 8131639 - DNA, 20 bp, Homo sapiens
ctggccagaacgcctacaca

SEQ ID NO: 8131640 - DNA, 22 bp, Homo sapiens
ctggcctcacctcagacttact

SEQ ID NO: 8131641 - DNA, 22 bp, Homo sapiens
ctggcctcagagggtcatggtg

SEQ ID NO: 8131642 - DNA, 19 bp, Homo sapiens
ctgctcagagcagctccag

SEQ ID NO: 8131643 - DNA, 20 bp, Homo sapiens
ctgctcagaccaactcttct

SEQ ID NO: 8131644 - DNA, 22 bp, Homo sapiens
ctgctgggcagaggctgcatga

SEQ ID NO: 8131645 - DNA, 22 bp, Homo sapiens
atacacatatcaggtgtataca

SEQ ID NO: 8131646 - DNA, 22 bp, Homo sapiens
atacacagctacattgaacaat

SEQ ID NO: 8131647 - DNA, 22 bp, Homo sapiens
atacacaggtgctaggtcaata

SEQ ID NO: 8131648 - DNA, 19 bp, Homo sapiens
atacacatacgtaaactga

SEQ ID NO: 8131649 - DNA, 22 bp, Homo sapiens
atacaagttaatgagaatgaca

SEQ ID NO: 8131650 - DNA, 22 bp, Homo sapiens
ctgctgggggacacaggtccgg

SEQ ID NO: 8131651 - DNA, 22 bp, Homo sapiens
ataaagcaagcataccattaag

SEQ ID NO: 8131652 - DNA, 22 bp, Homo sapiens
ctgcagggaactgaggcccaga

SEQ ID NO: 8131653 - DNA, 22 bp, Homo sapiens
ctgcagggaccacaagcaggtt

SEQ ID NO: 8131654 - DNA, 22 bp, Homo sapiens
agttctcatcatgaagcataag

SEQ ID NO: 8131655 - DNA, 22 bp, Homo sapiens
cctggggctttctttgtatcat

SEQ ID NO: 8131656 - DNA, 22 bp, Homo sapiens
cctggggctctgcacagagcag

SEQ ID NO: 8131657 - DNA, 22 bp, Homo sapiens
cctgggggccaggaaggtgtga

SEQ ID NO: 8131658 - DNA, 22 bp, Homo sapiens
cctgggctttgagggcaggatg

SEQ ID NO: 8131659 - DNA, 22 bp, Homo sapiens
cctggggctccagagcagcgga

SEQ ID NO: 8131660 - DNA, 17 bp, Homo sapiens
aggtgcagaggcagagc

SEQ ID NO: 8131661 - DNA, 22 bp, Homo sapiens
aggtgcagctggtggagtctgg

SEQ ID NO: 8131662 - DNA, 22 bp, Homo sapiens
cctgtgggcctgcacgtgggga

SEQ ID NO: 8131663 - DNA, 22 bp, Homo sapiens
cctgtgggagcccaggcagata

SEQ ID NO: 8131664 - DNA, 22 bp, Homo sapiens
aggtggcagcagaatcagggag

SEQ ID NO: 8131665 - DNA, 21 bp, Homo sapiens
agggttttatagatctcttcc

SEQ ID NO: 8131666 - DNA, 22 bp, Homo sapiens
aggtcacatggataatgatcag

SEQ ID NO: 8131667 - DNA, 22 bp, Homo sapiens
cctgggagggcaagtgctgatg

SEQ ID NO: 8131668 - DNA, 22 bp, Homo sapiens
cctgggaggtggaggttgcagc

SEQ ID NO: 8131669 - DNA, 22 bp, Homo sapiens
cctgggaggctgtgggtctgct

SEQ ID NO: 8131670 - DNA, 22 bp, Homo sapiens
cctgggaggctgaggctgcagt

SEQ ID NO: 8131671 - DNA, 22 bp, Homo sapiens
cctgggagaactgctgggttgg

SEQ ID NO: 8131672 - DNA, 22 bp, Homo sapiens
ccttccagggctctccagaacc

SEQ ID NO: 8131673 - DNA, 22 bp, Homo sapiens
agtatttctgaatattatcata

SEQ ID NO: 8131674 - DNA, 22 bp, Homo sapiens
agtcctgggtccagcaggtcct

SEQ ID NO: 8131675 - DNA, 22 bp, Homo sapiens
ctatctcatgcatcaactcttc

SEQ ID NO: 8131676 - DNA, 22 bp, Homo sapiens
ctatctcagagaaggacatttg

SEQ ID NO: 8131677 - DNA, 22 bp, Homo sapiens
ctatattggtggccatttggaa

SEQ ID NO: 8131678 - DNA, 22 bp, Homo sapiens
ctagtctgcagcggggaggggt

SEQ ID NO: 8131679 - DNA, 22 bp, Homo sapiens
ctatatttcttggctttaaaca

SEQ ID NO: 8131680 - DNA, 22 bp, Homo sapiens
ctatatttggtgagggatgtct

SEQ ID NO: 8131681 - DNA, 22 bp, Homo sapiens
ctagctgacgggttgataggtg

SEQ ID NO: 8131682 - DNA, 22 bp, Homo sapiens
agtgagggactagtgctgggga

SEQ ID NO: 8131683 - DNA, 22 bp, Homo sapiens
agtgaaatagcatttatgaagc

SEQ ID NO: 8131684 - DNA, 22 bp, Homo sapiens
ctcacagttggctcattaatga

SEQ ID NO: 8131685 - DNA, 22 bp, Homo sapiens
ctcacagttggctcattaatga

SEQ ID NO: 8131686 - DNA, 22 bp, Homo sapiens
ctcacagtgtaatattgaaccc

SEQ ID NO: 8131687 - DNA, 22 bp, Homo sapiens
ctcacagtgtcaacattaacta

SEQ ID NO: 8131688 - DNA, 22 bp, Homo sapiens
ctcacagttggagaatttagat

SEQ ID NO: 8131689 - DNA, 22 bp, Homo sapiens
ctcacagtttcacagtgtagat

SEQ ID NO: 8131690 - DNA, 22 bp, Homo sapiens
ctcacagttgtggtacctggtt

SEQ ID NO: 8131691 - DNA, 22 bp, Homo sapiens
ctcacagttttttcctgttaat

SEQ ID NO: 8131692 - DNA, 22 bp, Homo sapiens
ctcacagttttctgtagtccaa

SEQ ID NO: 8131693 - DNA, 20 bp, Homo sapiens
ctcacagtcaatgcagaggt

SEQ ID NO: 8131694 - DNA, 21 bp, Homo sapiens
ctcacagtctgttttccttgc

SEQ ID NO: 8131695 - DNA, 22 bp, Homo sapiens
ctcacagtgatgtcttatgaca

SEQ ID NO: 8131696 - DNA, 22 bp, Homo sapiens
ctcacagtctctccctaatttt

SEQ ID NO: 8131697 - DNA, 22 bp, Homo sapiens
ctcacagtctgcctttcccttg

SEQ ID NO: 8131698 - DNA, 22 bp, Homo sapiens
ctcacagtctctccctaatttt

SEQ ID NO: 8131699 - DNA, 22 bp, Homo sapiens
ctcacaggttctgcagctcaca

SEQ ID NO: 8131700 - DNA, 22 bp, Homo sapiens
agtctatttgctgtccgagcaa

SEQ ID NO: 8131701 - DNA, 22 bp, Homo sapiens
agtctattttcagaagcagttt

SEQ ID NO: 8131702 - DNA, 22 bp, Homo sapiens
agtctagggtggggtccacagg

SEQ ID NO: 8131703 - DNA, 22 bp, Homo sapiens
agtctaggcagccctgcagggt

SEQ ID NO: 8131704 - DNA, 22 bp, Homo sapiens
agtctattgcctaacagagagg

SEQ ID NO: 8131705 - DNA, 22 bp, Homo sapiens
agtgcctaaccccttgtatgaa

SEQ ID NO: 8131706 - DNA, 22 bp, Homo sapiens
agtgccttctctgggctaggtc

SEQ ID NO: 8131707 - DNA, 22 bp, Homo sapiens
agtgccttaaacagcatcggag

SEQ ID NO: 8131708 - DNA, 22 bp, Homo sapiens
agtgccctcgtgcccagggcct

SEQ ID NO: 8131709 - DNA, 22 bp, Homo sapiens
agtggacccggaacagaggccc

SEQ ID NO: 8131710 - DNA, 22 bp, Homo sapiens
agtggactaaagccaggcagca

SEQ ID NO: 8131711 - DNA, 22 bp, Homo sapiens
agtggagcttttcctatcagag

SEQ ID NO: 8131712 - DNA, 22 bp, Homo sapiens
agtggagcaggcggcgctcact

SEQ ID NO: 8131713 - DNA, 20 bp, Homo sapiens
agtggagcagcccaagcagc

SEQ ID NO: 8131714 - DNA, 22 bp, Homo sapiens
agtggaaagaaccctggactca

SEQ ID NO: 8131715 - DNA, 21 bp, Homo sapiens
agtggaacccttagggtcagg

SEQ ID NO: 8131716 - DNA, 22 bp, Homo sapiens
agtgtcctagcaagccggtcct

SEQ ID NO: 8131717 - DNA, 22 bp, Homo sapiens
agtgtcagttgccttgtcataa

SEQ ID NO: 8131718 - DNA, 22 bp, Homo sapiens
agtgtgggccacgcagctgagc

SEQ ID NO: 8131719 - DNA, 22 bp, Homo sapiens
agttaaatcattactgacagag

SEQ ID NO: 8131720 - DNA, 22 bp, Homo sapiens
agtgtttgtaaactacagatct

SEQ ID NO: 8131721 - DNA, 20 bp, Homo sapiens
agtgtttgctcacagtctcc

SEQ ID NO: 8131722 - DNA, 22 bp, Homo sapiens
agttatttcagtaacataatag

SEQ ID NO: 8131723 - DNA, 22 bp, Homo sapiens
acgaggagcctgtggcctggta

SEQ ID NO: 8131724 - DNA, 22 bp, Homo sapiens
accttttatgtaaatatatgtt

SEQ ID NO: 8131725 - DNA, 22 bp, Homo sapiens
aggtgggcacagatggagaagt

SEQ ID NO: 8131726 - DNA, 22 bp, Homo sapiens
aggtgggcactccgctcgaggt

SEQ ID NO: 8131727 - DNA, 22 bp, Homo sapiens
aggtgggcaccaggcttgtggt

SEQ ID NO: 8131728 - DNA, 22 bp, Homo sapiens
actcctcagccagcatcaggga

SEQ ID NO: 8131729 - DNA, 22 bp, Homo sapiens
actccgggagccaggagaggct

SEQ ID NO: 8131730 - DNA, 22 bp, Homo sapiens
actccctccaaatctgcacagt

SEQ ID NO: 8131731 - DNA, 22 bp, Homo sapiens
aggtgggcatagctagaatatt

SEQ ID NO: 8131732 - DNA, 21 bp, Homo sapiens
aggtgggcaggtggagtggcc

SEQ ID NO: 8131733 - DNA, 22 bp, Homo sapiens
aggtgggcggatcacaaggtca

SEQ ID NO: 8131734 - DNA, 22 bp, Homo sapiens
aggtgggcgctgctcccgctgg

SEQ ID NO: 8131735 - DNA, 22 bp, Homo sapiens
aggtgggcccagtgggctccag

SEQ ID NO: 8131736 - DNA, 22 bp, Homo sapiens
aggtgggcttggtgccaacatg

SEQ ID NO: 8131737 - DNA, 22 bp, Homo sapiens
aggtgggcggattcatgaggtc

SEQ ID NO: 8131738 - DNA, 22 bp, Homo sapiens
agtacttttttgatatctgagt

SEQ ID NO: 8131739 - DNA, 22 bp, Homo sapiens
agtactttttgttcaattgtgc

SEQ ID NO: 8131740 - DNA, 21 bp, Homo sapiens
actggctggtggctaagaatc

SEQ ID NO: 8131741 - DNA, 21 bp, Homo sapiens
actggctgtcttcctactggt

SEQ ID NO: 8131742 - DNA, 22 bp, Homo sapiens
agtgctcctttcattgctgccc

SEQ ID NO: 8131743 - DNA, 22 bp, Homo sapiens
agtgctcctgccagctttctgg

SEQ ID NO: 8131744 - DNA, 22 bp, Homo sapiens
agtgctcctgaagcttgaggca

SEQ ID NO: 8131745 - DNA, 22 bp, Homo sapiens
agtgctcctcagaagagttgga

SEQ ID NO: 8131746 - DNA, 22 bp, Homo sapiens
agtgctccaaaggttggtcatt

SEQ ID NO: 8131747 - DNA, 22 bp, Homo sapiens
agtgctccacattgcactattc

SEQ ID NO: 8131748 - DNA, 22 bp, Homo sapiens
actgcacagtcccagaggatgc

SEQ ID NO: 8131749 - DNA, 22 bp, Homo sapiens
actgcactcctgcctgggtaac

SEQ ID NO: 8131750 - DNA, 22 bp, Homo sapiens
actctgaatgtgcatgtaaatc

SEQ ID NO: 8131751 - DNA, 22 bp, Homo sapiens
agaaggcagatgggacggagca

SEQ ID NO: 8131752 - DNA, 21 bp, Homo sapiens
agaaggcaaaagcagacatct

SEQ ID NO: 8131753 - DNA, 22 bp, Homo sapiens
agaaatcattgaattatttgct

SEQ ID NO: 8131754 - DNA, 22 bp, Homo sapiens
agaaatcttatcaagaaatgcc

SEQ ID NO: 8131755 - DNA, 22 bp, Homo sapiens
atccatttttgcaaagttgttc

SEQ ID NO: 8131756 - DNA, 22 bp, Homo sapiens
atcccaagtagcaatcctggta

SEQ ID NO: 8131757 - DNA, 19 bp, Homo sapiens
atcccaaggagctgggact

SEQ ID NO: 8131758 - DNA, 22 bp, Homo sapiens
agaacattaatgcgaggtatta

SEQ ID NO: 8131759 - DNA, 22 bp, Homo sapiens
acttttctgcagatgatctctt

SEQ ID NO: 8131760 - DNA, 22 bp, Homo sapiens
acttttctaagcaatggtcttg

SEQ ID NO: 8131761 - DNA, 22 bp, Homo sapiens
atatttctccaaatgttttcaa

SEQ ID NO: 8131762 - DNA, 22 bp, Homo sapiens
atatttttccatgtgggactct

SEQ ID NO: 8131763 - DNA, 21 bp, Homo sapiens
atatttttgtttggactgtca

SEQ ID NO: 8131764 - DNA, 22 bp, Homo sapiens
atcagcaatctcgtgtattagg

SEQ ID NO: 8131765 - DNA, 22 bp, Homo sapiens
atcagcaatcaaattgcagagt

SEQ ID NO: 8131766 - DNA, 19 bp, Homo sapiens
atcagtgcatgagtgctgt

SEQ ID NO: 8131767 - DNA, 22 bp, Homo sapiens
atcagtgccccatggctaatgc

SEQ ID NO: 8131768 - DNA, 22 bp, Homo sapiens
atcagtgtttcaaatgtaatct

SEQ ID NO: 8131769 - DNA, 22 bp, Homo sapiens
atcagtttaaatgggctgttgg

SEQ ID NO: 8131770 - DNA, 21 bp, Homo sapiens
agtttttactcttaactgtgg

SEQ ID NO: 8131771 - DNA, 21 bp, Homo sapiens
agtttttactcttaactgtgg

SEQ ID NO: 8131772 - DNA, 23 bp, Homo sapiens
agtttttaatggtcatagctgag

SEQ ID NO: 8131773 - DNA, 22 bp, Homo sapiens
agtttttctcccctggcttcat

SEQ ID NO: 8131774 - DNA, 22 bp, Homo sapiens
acttccagcccctgtcagcaaa

SEQ ID NO: 8131775 - DNA, 22 bp, Homo sapiens
acttccagatggccccatctaa

SEQ ID NO: 8131776 - DNA, 22 bp, Homo sapiens
actttctgtcatctagacaagt

SEQ ID NO: 8131777 - DNA, 22 bp, Homo sapiens
actttctgcagtgttggaaatg

SEQ ID NO: 8131778 - DNA, 22 bp, Homo sapiens
actttggattgggtccctccca

SEQ ID NO: 8131779 - DNA, 23 bp, Homo sapiens
acttttcaattagctatgcttaa

SEQ ID NO: 8131780 - DNA, 22 bp, Homo sapiens
actttaagatatttgaaaacag

SEQ ID NO: 8131781 - DNA, 22 bp, Homo sapiens
aggccacaggattgcacagcat

SEQ ID NO: 8131782 - DNA, 22 bp, Homo sapiens
aggccacaggagtactgtcggt

SEQ ID NO: 8131783 - DNA, 22 bp, Homo sapiens
aggccacaggcaccctgtgttc

SEQ ID NO: 8131784 - DNA, 22 bp, Homo sapiens
aggccacaatttgatttggttt

SEQ ID NO: 8131785 - DNA, 22 bp, Homo sapiens
aggccacacaactcttagagat

SEQ ID NO: 8131786 - DNA, 22 bp, Homo sapiens
aggccagcagacgtgggactga

SEQ ID NO: 8131787 - DNA, 22 bp, Homo sapiens
aggccagcagcatgacggcatc

SEQ ID NO: 8131788 - DNA, 22 bp, Homo sapiens
aggccagccctgggctgagaga

SEQ ID NO: 8131789 - DNA, 22 bp, Homo sapiens
aggccctgagaaaatccctgca

SEQ ID NO: 8131790 - DNA, 22 bp, Homo sapiens
aggccctgagcatccgagggca

SEQ ID NO: 8131791 - DNA, 22 bp, Homo sapiens
aggcccagggctgctctctgaa

SEQ ID NO: 8131792 - DNA, 22 bp, Homo sapiens
acattgagtgctccataaatca

SEQ ID NO: 8131793 - DNA, 22 bp, Homo sapiens
acattgagcctcacctagatgc

SEQ ID NO: 8131794 - DNA, 22 bp, Homo sapiens
acattgaagggctatccaatag

SEQ ID NO: 8131795 - DNA, 22 bp, Homo sapiens
acattgaatgtatgtgatgaaa

SEQ ID NO: 8131796 - DNA, 22 bp, Homo sapiens
acattgaattcaaaattactga

SEQ ID NO: 8131797 - DNA, 22 bp, Homo sapiens
acattgaagctgtgaaatcaaa

SEQ ID NO: 8131798 - DNA, 22 bp, Homo sapiens
aggcttccgagtagctgggact

SEQ ID NO: 8131799 - DNA, 22 bp, Homo sapiens
acattctttctcttcaggaaac

SEQ ID NO: 8131800 - DNA, 22 bp, Homo sapiens
acattcaggccacagtggagtc

SEQ ID NO: 8131801 - DNA, 22 bp, Homo sapiens
aggccctgcaggaagcaggatg

SEQ ID NO: 8131802 - DNA, 22 bp, Homo sapiens
aggccctgatccgaatccagat

SEQ ID NO: 8131803 - DNA, 22 bp, Homo sapiens
aggccctgcaggagtggggaca

SEQ ID NO: 8131804 - DNA, 22 bp, Homo sapiens
acattaatgaggtgatgacaca

SEQ ID NO: 8131805 - DNA, 22 bp, Homo sapiens
aggccctgcattgtactgaggg

SEQ ID NO: 8131806 - DNA, 22 bp, Homo sapiens
accacactggctagtgaagaag

SEQ ID NO: 8131807 - DNA, 22 bp, Homo sapiens
accaagatttaacatgcctttt

SEQ ID NO: 8131808 - DNA, 22 bp, Homo sapiens
agggccagttctacctctgaat

SEQ ID NO: 8131809 - DNA, 22 bp, Homo sapiens
accagtgtcttattgaccatct

SEQ ID NO: 8131810 - DNA, 22 bp, Homo sapiens
acccactgtagccactctgggt

SEQ ID NO: 8131811 - DNA, 22 bp, Homo sapiens
acccactgtcatctctgaccac

SEQ ID NO: 8131812 - DNA, 22 bp, Homo sapiens
agggcctgacacccttgccagc

SEQ ID NO: 8131813 - DNA, 22 bp, Homo sapiens
acccagggaccccgctgacgcc

SEQ ID NO: 8131814 - DNA, 22 bp, Homo sapiens
acccagggtagaacctcagagc

SEQ ID NO: 8131815 - DNA, 22 bp, Homo sapiens
acccagggtttgagctctgcag

SEQ ID NO: 8131816 - DNA, 22 bp, Homo sapiens
acccagggtagagtgcagtggc

SEQ ID NO: 8131817 - DNA, 22 bp, Homo sapiens
accccactaccccggcagatgg

SEQ ID NO: 8131818 - DNA, 22 bp, Homo sapiens
accccactcacacatggacctg

SEQ ID NO: 8131819 - DNA, 22 bp, Homo sapiens
accccactcctctgttttaact

SEQ ID NO: 8131820 - DNA, 22 bp, Homo sapiens
accctgcctctgcttcctgtag

SEQ ID NO: 8131821 - DNA, 22 bp, Homo sapiens
accctgcctgacaacagaggat

SEQ ID NO: 8131822 - DNA, 22 bp, Homo sapiens
accctgggaactggaaactgga

SEQ ID NO: 8131823 - DNA, 22 bp, Homo sapiens
accctgggacctggaggtggat

SEQ ID NO: 8131824 - DNA, 22 bp, Homo sapiens
accctgggacttccgagttgag

SEQ ID NO: 8131825 - DNA, 22 bp, Homo sapiens
accctgggcacaccatttcccc

SEQ ID NO: 8131826 - DNA, 18 bp, Homo sapiens
accctgggcaattcactc

SEQ ID NO: 8131827 - DNA, 23 bp, Homo sapiens
accctgggcaagtcacctaacct

SEQ ID NO: 8131828 - DNA, 22 bp, Homo sapiens
accctgggagggagaaatcaga

SEQ ID NO: 8131829 - DNA, 22 bp, Homo sapiens
accctgggttcccgcagcacca

SEQ ID NO: 8131830 - DNA, 21 bp, Homo sapiens
accctgggttctccataccct

SEQ ID NO: 8131831 - DNA, 22 bp, Homo sapiens
accctgggtgagaggcaaacag

SEQ ID NO: 8131832 - DNA, 22 bp, Homo sapiens
accctgggtctcaatcatccta

SEQ ID NO: 8131833 - DNA, 22 bp, Homo sapiens
accctgggggtggccagtgcca

SEQ ID NO: 8131834 - DNA, 22 bp, Homo sapiens
accctgggcttggcctgctcag

SEQ ID NO: 8131835 - DNA, 22 bp, Homo sapiens
accctgggtcatatacagtgtg

SEQ ID NO: 8131836 - DNA, 22 bp, Homo sapiens
accctgggtatttcccaaactt

SEQ ID NO: 8131837 - DNA, 22 bp, Homo sapiens
accctggggtcacccttctctg

SEQ ID NO: 8131838 - DNA, 16 bp, Homo sapiens
accctgggtagtcctg

SEQ ID NO: 8131839 - DNA, 21 bp, Homo sapiens
acagcctccatctcctgggct

SEQ ID NO: 8131840 - DNA, 22 bp, Homo sapiens
agcttagcacacacaggcaggt

SEQ ID NO: 8131841 - DNA, 22 bp, Homo sapiens
agctgggcaaaatgtgaggttg

SEQ ID NO: 8131842 - DNA, 22 bp, Homo sapiens
agctttgtggctttgcaagact

SEQ ID NO: 8131843 - DNA, 22 bp, Homo sapiens
aggagccatggaggtgaggcgg

SEQ ID NO: 8131844 - DNA, 22 bp, Homo sapiens
aggagccatgagtgacatcaca

SEQ ID NO: 8131845 - DNA, 22 bp, Homo sapiens
acagggtgactttgtgacagat

SEQ ID NO: 8131846 - DNA, 22 bp, Homo sapiens
aggcacagagaagtaaagtatc

SEQ ID NO: 8131847 - DNA, 22 bp, Homo sapiens
acataaatttcactgttccgtg

SEQ ID NO: 8131848 - DNA, 22 bp, Homo sapiens
acatacatatgtttaaatgcat

SEQ ID NO: 8131849 - DNA, 22 bp, Homo sapiens
aggaggggttctcgggtgctga

SEQ ID NO: 8131850 - DNA, 21 bp, Homo sapiens
aggaggggtctttcccactga

SEQ ID NO: 8131851 - DNA, 22 bp, Homo sapiens
aggaggggcatagaaatgtaat

SEQ ID NO: 8131852 - DNA, 22 bp, Homo sapiens
aggaggctgtggagcactccat

SEQ ID NO: 8131853 - DNA, 22 bp, Homo sapiens
agaggctgcacttgctcatgat

SEQ ID NO: 8131854 - DNA, 22 bp, Homo sapiens
agaggaggctgggtccagataa

SEQ ID NO: 8131855 - DNA, 22 bp, Homo sapiens
attacagcttgctcagtttgca

SEQ ID NO: 8131856 - DNA, 22 bp, Homo sapiens
agagtgcagaggtcaaagaaca

SEQ ID NO: 8131857 - DNA, 22 bp, Homo sapiens
agagtgcagataagagaatgtt

SEQ ID NO: 8131858 - DNA, 22 bp, Homo sapiens
agagtcaccaaagtaaaacagt

SEQ ID NO: 8131859 - DNA, 22 bp, Homo sapiens
agagggcttccctaggagtgag

SEQ ID NO: 8131860 - DNA, 22 bp, Homo sapiens
agagggcttccctaggagtgag

SEQ ID NO: 8131861 - DNA, 22 bp, Homo sapiens
agagggctgggatgtgctgtgt

SEQ ID NO: 8131862 - DNA, 22 bp, Homo sapiens
agagggctggacgcaggttgga

SEQ ID NO: 8131863 - DNA, 22 bp, Homo sapiens
agagggcagtctcagattggga

SEQ ID NO: 8131864 - DNA, 22 bp, Homo sapiens
agaggggcagggtctccggatt

SEQ ID NO: 8131865 - DNA, 22 bp, Homo sapiens
agaggggcccggttctccgtct

SEQ ID NO: 8131866 - DNA, 22 bp, Homo sapiens
agaggggcgggaactcaacctc

SEQ ID NO: 8131867 - DNA, 22 bp, Homo sapiens
agaggggcaagtaaagagtctt

SEQ ID NO: 8131868 - DNA, 23 bp, Homo sapiens
agatcacatgctgatggaaaatg

SEQ ID NO: 8131869 - DNA, 22 bp, Homo sapiens
agatcacataatttcctgtgac

SEQ ID NO: 8131870 - DNA, 22 bp, Homo sapiens
agatgattatgatagcactgtt

SEQ ID NO: 8131871 - DNA, 22 bp, Homo sapiens
agcaagaaatcttcagtgttct

SEQ ID NO: 8131872 - DNA, 22 bp, Homo sapiens
caaagataatcacagaataccc

SEQ ID NO: 8131873 - DNA, 22 bp, Homo sapiens
caaagcagacgcagtaagggta

SEQ ID NO: 8131874 - DNA, 22 bp, Homo sapiens
caaagcagaaggttctgtggta

SEQ ID NO: 8131875 - DNA, 22 bp, Homo sapiens
attttagttttagcatccatgc

SEQ ID NO: 8131876 - DNA, 20 bp, Homo sapiens
agcaacaataaaatgtcctg

SEQ ID NO: 8131877 - DNA, 22 bp, Homo sapiens
agcaacacgcagtagtatacga

SEQ ID NO: 8131878 - DNA, 22 bp, Homo sapiens
agcaaatctatgaatgtatatt

SEQ ID NO: 8131879 - DNA, 20 bp, Homo sapiens
agagcagcagttggtgaggt

SEQ ID NO: 8131880 - DNA, 22 bp, Homo sapiens
agagcacaggctcaccattgtt

SEQ ID NO: 8131881 - DNA, 21 bp, Homo sapiens
agagcacaggtggacaatgct

SEQ ID NO: 8131882 - DNA, 22 bp, Homo sapiens
agagcacaggtgctggagccca

SEQ ID NO: 8131883 - DNA, 22 bp, Homo sapiens
agagcacagtatctgcacatca

SEQ ID NO: 8131884 - DNA, 22 bp, Homo sapiens
agagcaccccgggaagagcaag

SEQ ID NO: 8131885 - DNA, 22 bp, Homo sapiens
agagccctcttcactgcccctt

SEQ ID NO: 8131886 - DNA, 22 bp, Homo sapiens
agagccctctgcaatgcctcag

SEQ ID NO: 8131887 - DNA, 22 bp, Homo sapiens
agagaaggggtaaagagtcctg

SEQ ID NO: 8131888 - DNA, 22 bp, Homo sapiens
agagaaaagagttcaggctttg

SEQ ID NO: 8131889 - DNA, 22 bp, Homo sapiens
agagaaaactcattgaggtgtc

SEQ ID NO: 8131890 - DNA, 23 bp, Homo sapiens
agagaaaaatatctgggcacatt

SEQ ID NO: 8131891 - DNA, 22 bp, Homo sapiens
agacttctcttggctatattat

SEQ ID NO: 8131892 - DNA, 22 bp, Homo sapiens
agacttgggacctaggaatgga

SEQ ID NO: 8131893 - DNA, 22 bp, Homo sapiens
agagaggctgggcgtagggctt

SEQ ID NO: 8131894 - DNA, 21 bp, Homo sapiens
agagagggagatgaaacatcc

SEQ ID NO: 8131895 - DNA, 22 bp, Homo sapiens
agagagggaatatttggggtat

SEQ ID NO: 8131896 - DNA, 22 bp, Homo sapiens
agagagggcatagaaaaaggga

SEQ ID NO: 8131897 - DNA, 22 bp, Homo sapiens
agagaattggagcagtgacagg

SEQ ID NO: 8131898 - DNA, 22 bp, Homo sapiens
agagacagacacatcgggctgc

SEQ ID NO: 8131899 - DNA, 21 bp, Homo sapiens
agagacagagaaagtaacatt

SEQ ID NO: 8131900 - DNA, 21 bp, Homo sapiens
agagagaaggccatatggtcc

SEQ ID NO: 8131901 - DNA, 22 bp, Homo sapiens
agagagaagcaatcagtggcca

SEQ ID NO: 8131902 - DNA, 22 bp, Homo sapiens
agagagcatggcacagaggggt

SEQ ID NO: 8131903 - DNA, 22 bp, Homo sapiens
atgcatttgtaaaatataatcg

SEQ ID NO: 8131904 - DNA, 22 bp, Homo sapiens
atgatatacttcctagaacagt

SEQ ID NO: 8131905 - DNA, 22 bp, Homo sapiens
atgatacattgcaaaattttaa

SEQ ID NO: 8131906 - DNA, 22 bp, Homo sapiens
agacccaggattggggctgccg

SEQ ID NO: 8131907 - DNA, 22 bp, Homo sapiens
atgcctgtgctatattctcaca

SEQ ID NO: 8131908 - DNA, 22 bp, Homo sapiens
atgcctgtggagatatttaagg

SEQ ID NO: 8131909 - DNA, 22 bp, Homo sapiens
atgcctgtaatcccagtgcttt

SEQ ID NO: 8131910 - DNA, 22 bp, Homo sapiens
agaatcaattcactgctgcagc

SEQ ID NO: 8131911 - DNA, 22 bp, Homo sapiens
atgaggcttaaactgctgcaac

SEQ ID NO: 8131912 - DNA, 22 bp, Homo sapiens
agacactgttctcacatgcttg

SEQ ID NO: 8131913 - DNA, 22 bp, Homo sapiens
agacacattttacattaactgt

SEQ ID NO: 8131914 - DNA, 22 bp, Homo sapiens
agacaaatttgttttcctgtct

SEQ ID NO: 8131915 - DNA, 22 bp, Homo sapiens
agacaacatctagtttggtgga

SEQ ID NO: 8131916 - DNA, 21 bp, Homo sapiens
atctgcttaggtttgttcaga

SEQ ID NO: 8131917 - DNA, 22 bp, Homo sapiens
atctgcttcctccttagggaaa

SEQ ID NO: 8131918 - DNA, 22 bp, Homo sapiens
atgaagggaatataagtgctgc

SEQ ID NO: 8131919 - DNA, 22 bp, Homo sapiens
cacagagagctacgtgcagcgt

SEQ ID NO: 8131920 - DNA, 22 bp, Homo sapiens
cacagagaggcttgtctccaag

SEQ ID NO: 8131921 - DNA, 22 bp, Homo sapiens
cacagagatcggaacagaagta

SEQ ID NO: 8131922 - DNA, 21 bp, Homo sapiens
cacagagatattggtgagcct

SEQ ID NO: 8131923 - DNA, 22 bp, Homo sapiens
cacagagatcggaacagaagta

SEQ ID NO: 8131924 - DNA, 21 bp, Homo sapiens
cacagagatattggtgagcct

SEQ ID NO: 8131925 - DNA, 22 bp, Homo sapiens
agcagctaagtagcgcagttaa

SEQ ID NO: 8131926 - DNA, 22 bp, Homo sapiens
agcagctacttaaccttgtaca

SEQ ID NO: 8131927 - DNA, 22 bp, Homo sapiens
cacagagattagaattagacta

SEQ ID NO: 8131928 - DNA, 22 bp, Homo sapiens
cacagagattagaattagacta

SEQ ID NO: 8131929 - DNA, 22 bp, Homo sapiens
cacagagatggtctggcaggtg

SEQ ID NO: 8131930 - DNA, 22 bp, Homo sapiens
cacagagatggccagggcacat

SEQ ID NO: 8131931 - DNA, 22 bp, Homo sapiens
agcagctggcagcttcttctct

SEQ ID NO: 8131932 - DNA, 22 bp, Homo sapiens
caatacaattaccagttaatca

SEQ ID NO: 8131933 - DNA, 18 bp, Homo sapiens
caatactgagaggtgggg

SEQ ID NO: 8131934 - DNA, 22 bp, Homo sapiens
caatactgagtttacattcatc

SEQ ID NO: 8131935 - DNA, 19 bp, Homo sapiens
agcagcagaagtgtgcctt

SEQ ID NO: 8131936 - DNA, 16 bp, Homo sapiens
agcagaggtgagtgaa

SEQ ID NO: 8131937 - DNA, 22 bp, Homo sapiens
agcagaggtttgttggaaacct

SEQ ID NO: 8131938 - DNA, 22 bp, Homo sapiens
agcatgcttggcatttgtcaga

SEQ ID NO: 8131939 - DNA, 22 bp, Homo sapiens
cactgtgggtcccagactggag

SEQ ID NO: 8131940 - DNA, 22 bp, Homo sapiens
cactgtttggctcctgtactta

SEQ ID NO: 8131941 - DNA, 22 bp, Homo sapiens
agcagggcaggtaaggatcaga

SEQ ID NO: 8131942 - DNA, 22 bp, Homo sapiens
agcagggcaggtaaggatcaga

SEQ ID NO: 8131943 - DNA, 22 bp, Homo sapiens
caccagagttgtccaaatgatt

SEQ ID NO: 8131944 - DNA, 22 bp, Homo sapiens
agcagggctctgtggagggtgg

SEQ ID NO: 8131945 - DNA, 22 bp, Homo sapiens
agcaggaaggtctgtgtgagtc

SEQ ID NO: 8131946 - DNA, 22 bp, Homo sapiens
agcaggaaggggcctagcctgg

SEQ ID NO: 8131947 - DNA, 22 bp, Homo sapiens
agcaggaaggggatgatgggca

SEQ ID NO: 8131948 - DNA, 22 bp, Homo sapiens
agcaggaactgacaccaagcca

SEQ ID NO: 8131949 - DNA, 22 bp, Homo sapiens
agcaggaactcagggagttctc

SEQ ID NO: 8131950 - DNA, 22 bp, Homo sapiens
agccctgcgtgccaggggactg

SEQ ID NO: 8131951 - DNA, 23 bp, Homo sapiens
agccctgctgagacccagctccc

SEQ ID NO: 8131952 - DNA, 22 bp, Homo sapiens
agccctgctcatctggatcccg

SEQ ID NO: 8131953 - DNA, 22 bp, Homo sapiens
agcccccaaaagtgcttatgat

SEQ ID NO: 8131954 - DNA, 22 bp, Homo sapiens
agcccccacgtttcctgggtcc

SEQ ID NO: 8131955 - DNA, 22 bp, Homo sapiens
agccctgctgcctgaattagct

SEQ ID NO: 8131956 - DNA, 22 bp, Homo sapiens
agccctgctgcttcttgtattt

SEQ ID NO: 8131957 - DNA, 22 bp, Homo sapiens
agccctgcttcaccatttactt

SEQ ID NO: 8131958 - DNA, 22 bp, Homo sapiens
agccctggagcaaaggtgtctt

SEQ ID NO: 8131959 - DNA, 22 bp, Homo sapiens
agccctggattctgaggtccaa

SEQ ID NO: 8131960 - DNA, 22 bp, Homo sapiens
agccctgggcgttactgggatg

SEQ ID NO: 8131961 - DNA, 22 bp, Homo sapiens
agccctgggcacctgtgagggg

SEQ ID NO: 8131962 - DNA, 22 bp, Homo sapiens
agccccaggatgggccgcagga

SEQ ID NO: 8131963 - DNA, 22 bp, Homo sapiens
agccagtgcagctggaaattca

SEQ ID NO: 8131964 - DNA, 22 bp, Homo sapiens
agccaggccttagggagaggca

SEQ ID NO: 8131965 - DNA, 22 bp, Homo sapiens
cagagacattaagtgccatgat

SEQ ID NO: 8131966 - DNA, 22 bp, Homo sapiens
cagagacccttctcagtggcca

SEQ ID NO: 8131967 - DNA, 22 bp, Homo sapiens
cagagacctgcccatttacgct

SEQ ID NO: 8131968 - DNA, 22 bp, Homo sapiens
cagagaccccgctgcccttctg

SEQ ID NO: 8131969 - DNA, 20 bp, Homo sapiens
cagagacccaggcttcagct

SEQ ID NO: 8131970 - DNA, 20 bp, Homo sapiens
cagagaccaggccaggtgtc

SEQ ID NO: 8131971 - DNA, 22 bp, Homo sapiens
agccagctaccggggctcctgg

SEQ ID NO: 8131972 - DNA, 19 bp, Homo sapiens
cactttatttctgttttgt

SEQ ID NO: 8131973 - DNA, 22 bp, Homo sapiens
cactttcaagtttcagaggata

SEQ ID NO: 8131974 - DNA, 22 bp, Homo sapiens
agcctgggcctggcttcccgcc

SEQ ID NO: 8131975 - DNA, 22 bp, Homo sapiens
agcctgggtttttattaaggag

SEQ ID NO: 8131976 - DNA, 22 bp, Homo sapiens
agcctgggtgggggttcggaga

SEQ ID NO: 8131977 - DNA, 22 bp, Homo sapiens
agctaattagaaatagattatt

SEQ ID NO: 8131978 - DNA, 22 bp, Homo sapiens
agctacaaatgtatgtgctgat

SEQ ID NO: 8131979 - DNA, 22 bp, Homo sapiens
agctacaatcaatgtacatcat

SEQ ID NO: 8131980 - DNA, 22 bp, Homo sapiens
agctacaagtcatcagctatca

SEQ ID NO: 8131981 - DNA, 23 bp, Homo sapiens
agctactaggattcattcaccct

SEQ ID NO: 8131982 - DNA, 22 bp, Homo sapiens
agctactatgtgaaagccaggc

SEQ ID NO: 8131983 - DNA, 22 bp, Homo sapiens
agctactagggtgccagacatg

SEQ ID NO: 8131984 - DNA, 22 bp, Homo sapiens
agctactactaccaaactaaag

SEQ ID NO: 8131985 - DNA, 22 bp, Homo sapiens
cagcaacttggacagcagtctt

SEQ ID NO: 8131986 - DNA, 22 bp, Homo sapiens
agctcaggcaactctgggcccc

SEQ ID NO: 8131987 - DNA, 22 bp, Homo sapiens
agctcctggtgcctcagccgaa

SEQ ID NO: 8131988 - DNA, 22 bp, Homo sapiens
acctgggaggcagaggttgcag

SEQ ID NO: 8131989 - DNA, 22 bp, Homo sapiens
acctgggaggcggaggttgcag

SEQ ID NO: 8131990 - DNA, 20 bp, Homo sapiens
acctggggttgcctgtgctc

SEQ ID NO: 8131991 - DNA, 22 bp, Homo sapiens
aagtgattttcctacttgctaa

SEQ ID NO: 8131992 - DNA, 22 bp, Homo sapiens
aagtgattttcttcttagttat

SEQ ID NO: 8131993 - DNA, 22 bp, Homo sapiens
aagtgattctagtcatgattct

SEQ ID NO: 8131994 - DNA, 22 bp, Homo sapiens
aagtgaaattgccattcttata

SEQ ID NO: 8131995 - DNA, 22 bp, Homo sapiens
aagtgaaattgccattcttata

SEQ ID NO: 8131996 - DNA, 22 bp, Homo sapiens
actgactagacttacaacagag

SEQ ID NO: 8131997 - DNA, 22 bp, Homo sapiens
aagttttattggaacatagcca

SEQ ID NO: 8131998 - DNA, 22 bp, Homo sapiens
actgagaagtcaggttctcttc

SEQ ID NO: 8131999 - DNA, 22 bp, Homo sapiens
actgagaatacaatgttgcagg

SEQ ID NO: 8132000 - DNA, 22 bp, Homo sapiens
aataacagaaacttgagcatca

SEQ ID NO: 8132001 - DNA, 22 bp, Homo sapiens
aataaagtagcgtttaaggtgc

SEQ ID NO: 8132002 - DNA, 22 bp, Homo sapiens
aataaagaatggatgagatcgt

SEQ ID NO: 8132003 - DNA, 22 bp, Homo sapiens
aagtggagctataggctcagat

SEQ ID NO: 8132004 - DNA, 22 bp, Homo sapiens
actcatcagtggttttaatcaa

SEQ ID NO: 8132005 - DNA, 22 bp, Homo sapiens
actcatatactgttgtttttaa

SEQ ID NO: 8132006 - DNA, 22 bp, Homo sapiens
actgtggagaaagaaagactgc

SEQ ID NO: 8132007 - DNA, 22 bp, Homo sapiens
actgtggctcatcaggctggtg

SEQ ID NO: 8132008 - DNA, 22 bp, Homo sapiens
aatactgtctttcacagatatt

SEQ ID NO: 8132009 - DNA, 22 bp, Homo sapiens
acttccagctttataattcagt

SEQ ID NO: 8132010 - DNA, 22 bp, Homo sapiens
acttccaggaggtgtcactgaa

SEQ ID NO: 8132011 - DNA, 21 bp, Homo sapiens
acttcccaggacctactcaga

SEQ ID NO: 8132012 - DNA, 22 bp, Homo sapiens
aatatggcttgttactatgttt

SEQ ID NO: 8132013 - DNA, 22 bp, Homo sapiens
aatcttaaagaatattctacca

SEQ ID NO: 8132014 - DNA, 22 bp, Homo sapiens
agaaactattatggtaaacaaa

SEQ ID NO: 8132015 - DNA, 22 bp, Homo sapiens
aatcttttgattctagggctgt

SEQ ID NO: 8132016 - DNA, 22 bp, Homo sapiens
aatctttttcacaagaaagcac

SEQ ID NO: 8132017 - DNA, 22 bp, Homo sapiens
aatcttcagtgtctaaaaagca

SEQ ID NO: 8132018 - DNA, 22 bp, Homo sapiens
acataataggtgcctgaatatt

SEQ ID NO: 8132019 - DNA, 22 bp, Homo sapiens
acataataggtacctgaataat

SEQ ID NO: 8132020 - DNA, 22 bp, Homo sapiens
acatacttatgctaaaaatata

SEQ ID NO: 8132021 - DNA, 22 bp, Homo sapiens
acatgcattaaaaatacttgtg

SEQ ID NO: 8132022 - DNA, 23 bp, Homo sapiens
acatgggaaatgcaaagagaagt

SEQ ID NO: 8132023 - DNA, 22 bp, Homo sapiens
acatgggacagagaaagaggcc

SEQ ID NO: 8132024 - DNA, 22 bp, Homo sapiens
accacaggggaggaatgatgcc

SEQ ID NO: 8132025 - DNA, 22 bp, Homo sapiens
acattcttataagagtgaggca

SEQ ID NO: 8132026 - DNA, 22 bp, Homo sapiens
acattcttcagctttgtcaggc

SEQ ID NO: 8132027 - DNA, 22 bp, Homo sapiens
acaggcttttacggatatcttt

SEQ ID NO: 8132028 - DNA, 22 bp, Homo sapiens
acagtgcataaaaacaactttt

SEQ ID NO: 8132029 - DNA, 22 bp, Homo sapiens
acagtgcaggtctcaacaatta

SEQ ID NO: 8132030 - DNA, 22 bp, Homo sapiens
acaggaaattggcatatcagtt

SEQ ID NO: 8132031 - DNA, 22 bp, Homo sapiens
acaggaaatgaaatggtatcta

SEQ ID NO: 8132032 - DNA, 21 bp, Homo sapiens
acaggagaccgcctggcagtc

SEQ ID NO: 8132033 - DNA, 22 bp, Homo sapiens
acaggaaagagctaggcatagg

SEQ ID NO: 8132034 - DNA, 20 bp, Homo sapiens
acaggagatctgaggaaagg

SEQ ID NO: 8132035 - DNA, 22 bp, Homo sapiens
acagaacatggatttttgaagt

SEQ ID NO: 8132036 - DNA, 22 bp, Homo sapiens
acagaacatattgcttctctca

SEQ ID NO: 8132037 - DNA, 22 bp, Homo sapiens
acagacagtaaatagtgtggct

SEQ ID NO: 8132038 - DNA, 22 bp, Homo sapiens
acagacatgctgtttgggtggt

SEQ ID NO: 8132039 - DNA, 22 bp, Homo sapiens
agcattctcagaatgtcatttt

SEQ ID NO: 8132040 - DNA, 22 bp, Homo sapiens
acagaacagagggttttagaat

SEQ ID NO: 8132041 - DNA, 22 bp, Homo sapiens
agccaggctaaatgagccatga

SEQ ID NO: 8132042 - DNA, 22 bp, Homo sapiens
agccctgcaggaggtgggagag

SEQ ID NO: 8132043 - DNA, 22 bp, Homo sapiens
agccctgcaggatgagggaggt

SEQ ID NO: 8132044 - DNA, 22 bp, Homo sapiens
agccctgcataaatcagttggt

SEQ ID NO: 8132045 - DNA, 22 bp, Homo sapiens
agccctgcacaggtctgtggct

SEQ ID NO: 8132046 - DNA, 22 bp, Homo sapiens
agccctgcacagttcgggagga

SEQ ID NO: 8132047 - DNA, 22 bp, Homo sapiens
agccctgcgatcgtgatttctt

SEQ ID NO: 8132048 - DNA, 22 bp, Homo sapiens
agccctgcgctcacgttctgca

SEQ ID NO: 8132049 - DNA, 22 bp, Homo sapiens
agccctggggctggtcttggaa

SEQ ID NO: 8132050 - DNA, 16 bp, Homo sapiens
agccctgccgtgtact

SEQ ID NO: 8132051 - DNA, 22 bp, Homo sapiens
agccctgcctctccaatgccca

SEQ ID NO: 8132052 - DNA, 22 bp, Homo sapiens
agccctgccctgccatgtggca

SEQ ID NO: 8132053 - DNA, 22 bp, Homo sapiens
agccctgcatagaagggaacac

SEQ ID NO: 8132054 - DNA, 22 bp, Homo sapiens
agccctgccattctctggagct

SEQ ID NO: 8132055 - DNA, 22 bp, Homo sapiens
agccctgggttagggtgggagc

SEQ ID NO: 8132056 - DNA, 22 bp, Homo sapiens
agcctgtgacattgactatgaa

SEQ ID NO: 8132057 - DNA, 22 bp, Homo sapiens
agcctgtgtgctttggacaggg

SEQ ID NO: 8132058 - DNA, 22 bp, Homo sapiens
agcctgtgttgctctggcgata

SEQ ID NO: 8132059 - DNA, 22 bp, Homo sapiens
agcaggtgacagggctgtggtg

SEQ ID NO: 8132060 - DNA, 22 bp, Homo sapiens
agcagggcccactaggggagat

SEQ ID NO: 8132061 - DNA, 22 bp, Homo sapiens
agcagccatagatagcatgcaa

SEQ ID NO: 8132062 - DNA, 23 bp, Homo sapiens
agcagccatagggaagcaataca

SEQ ID NO: 8132063 - DNA, 22 bp, Homo sapiens
agcaggaacgagttcatgggga

SEQ ID NO: 8132064 - DNA, 22 bp, Homo sapiens
agcaggaggagagcctggcggt

SEQ ID NO: 8132065 - DNA, 22 bp, Homo sapiens
agcacttatgtgattaggacag

SEQ ID NO: 8132066 - DNA, 22 bp, Homo sapiens
acacactgagtgccataggacc

SEQ ID NO: 8132067 - DNA, 22 bp, Homo sapiens
acacactgctcatgaggagcat

SEQ ID NO: 8132068 - DNA, 22 bp, Homo sapiens
agcactttcctggcaaatgtgg

SEQ ID NO: 8132069 - DNA, 22 bp, Homo sapiens
acacacatggtattgttcagaa

SEQ ID NO: 8132070 - DNA, 22 bp, Homo sapiens
agattttatagataatttccca

SEQ ID NO: 8132071 - DNA, 22 bp, Homo sapiens
agatttgaaacttgcttcataa

SEQ ID NO: 8132072 - DNA, 22 bp, Homo sapiens
agagtgaaaagctagagcagta

SEQ ID NO: 8132073 - DNA, 22 bp, Homo sapiens
aattttgttttagtggaggctg

SEQ ID NO: 8132074 - DNA, 22 bp, Homo sapiens
agaggtggccatgggcgctgga

SEQ ID NO: 8132075 - DNA, 22 bp, Homo sapiens
agatgttttggagacactaacc

SEQ ID NO: 8132076 - DNA, 22 bp, Homo sapiens
aattttctggtgtgtaatgaag

SEQ ID NO: 8132077 - DNA, 22 bp, Homo sapiens
agagggctgctgcacagtgctc

SEQ ID NO: 8132078 - DNA, 22 bp, Homo sapiens
agagggcatgcttggtggcctg

SEQ ID NO: 8132079 - DNA, 22 bp, Homo sapiens
aatttcaaagctcactggcata

SEQ ID NO: 8132080 - DNA, 22 bp, Homo sapiens
agagcagctgtgacatggacag

SEQ ID NO: 8132081 - DNA, 23 bp, Homo sapiens
agaggcaggagtggcttgcccgg

SEQ ID NO: 8132082 - DNA, 22 bp, Homo sapiens
aattcagttgacagctaatgcc

SEQ ID NO: 8132083 - DNA, 22 bp, Homo sapiens
agaatttctggaagattgcaag

SEQ ID NO: 8132084 - DNA, 23 bp, Homo sapiens
agaattgttgttagggaaaagta

SEQ ID NO: 8132085 - DNA, 22 bp, Homo sapiens
agaattgttggggtaataaaag

SEQ ID NO: 8132086 - DNA, 22 bp, Homo sapiens
agaatcattatatttattaagc

SEQ ID NO: 8132087 - DNA, 20 bp, Homo sapiens
agagagacctaggcctagtc

SEQ ID NO: 8132088 - DNA, 22 bp, Homo sapiens
agagaaatagattggtccagaa

SEQ ID NO: 8132089 - DNA, 22 bp, Homo sapiens
agagaaagtcctgatctctcta

SEQ ID NO: 8132090 - DNA, 22 bp, Homo sapiens
agagagagaaatgaaatgtgct

SEQ ID NO: 8132091 - DNA, 17 bp, Homo sapiens
agagagagcatgccacc

SEQ ID NO: 8132092 - DNA, 22 bp, Homo sapiens
agagagaggcagcagtgctcac

SEQ ID NO: 8132093 - DNA, 20 bp, Homo sapiens
agagagaggtaaattgagca

SEQ ID NO: 8132094 - DNA, 22 bp, Homo sapiens
agagagaggggcgagcaaacac

SEQ ID NO: 8132095 - DNA, 22 bp, Homo sapiens
agagagaggcagcagtgctcac

SEQ ID NO: 8132096 - DNA, 22 bp, Homo sapiens
agagatagtgtattagttgggc

SEQ ID NO: 8132097 - DNA, 23 bp, Homo sapiens
agagagagtttgtgtcaggtacc

SEQ ID NO: 8132098 - DNA, 21 bp, Homo sapiens
agacactggtttagcattcat

SEQ ID NO: 8132099 - DNA, 22 bp, Homo sapiens
aatgtataaccataggaaattt

SEQ ID NO: 8132100 - DNA, 22 bp, Homo sapiens
agagaaacccttcagtgttttg

SEQ ID NO: 8132101 - DNA, 19 bp, Homo sapiens
agagaaagaattgagtcta

SEQ ID NO: 8132102 - DNA, 18 bp, Homo sapiens
agagaaagaccaaagcat

SEQ ID NO: 8132103 - DNA, 22 bp, Homo sapiens
aaatgctagggagaaactctcc

SEQ ID NO: 8132104 - DNA, 22 bp, Homo sapiens
aaatggcaggctctttgctagt

SEQ ID NO: 8132105 - DNA, 22 bp, Homo sapiens
aaatggcagtagaaaagaatcc

SEQ ID NO: 8132106 - DNA, 22 bp, Homo sapiens
aaatgcctcattttctctcact

SEQ ID NO: 8132107 - DNA, 22 bp, Homo sapiens
aaatgcctagaaatcacgcaga

SEQ ID NO: 8132108 - DNA, 22 bp, Homo sapiens
aaatgcctctgctgtacacaat

SEQ ID NO: 8132109 - DNA, 22 bp, Homo sapiens
aaatgcctcccattctactgac

SEQ ID NO: 8132110 - DNA, 22 bp, Homo sapiens
aaatgcctcccaaacagcacaa

SEQ ID NO: 8132111 - DNA, 22 bp, Homo sapiens
aaatgctagaacattttaaagg

SEQ ID NO: 8132112 - DNA, 22 bp, Homo sapiens
aaatgctaacaaggaatgctgc

SEQ ID NO: 8132113 - DNA, 22 bp, Homo sapiens
aaatgcctgtgtaaattctagc

SEQ ID NO: 8132114 - DNA, 22 bp, Homo sapiens
aaatgccttcaaacacttaagg

SEQ ID NO: 8132115 - DNA, 22 bp, Homo sapiens
aaatcatgttggcacaataaaa

SEQ ID NO: 8132116 - DNA, 22 bp, Homo sapiens
aaatcagttgttatattaaaga

SEQ ID NO: 8132117 - DNA, 22 bp, Homo sapiens
aaatcatagcccccatccgatt

SEQ ID NO: 8132118 - DNA, 22 bp, Homo sapiens
aaatatgttttccagttgtcat

SEQ ID NO: 8132119 - DNA, 22 bp, Homo sapiens
aaatagaaaccaacaaggtcag

SEQ ID NO: 8132120 - DNA, 22 bp, Homo sapiens
aaatactgttttattccatgat

SEQ ID NO: 8132121 - DNA, 22 bp, Homo sapiens
aaatactgttgaatgaagtaag

SEQ ID NO: 8132122 - DNA, 22 bp, Homo sapiens
aaatactgttgaatgaagtaag

SEQ ID NO: 8132123 - DNA, 21 bp, Homo sapiens
aaatactgtcaaatggtgggt

SEQ ID NO: 8132124 - DNA, 22 bp, Homo sapiens
aaatactgtctctgagagagcc

SEQ ID NO: 8132125 - DNA, 22 bp, Homo sapiens
aaatactgtccaccatggagca

SEQ ID NO: 8132126 - DNA, 22 bp, Homo sapiens
aaatactgtgaataaaggtttt

SEQ ID NO: 8132127 - DNA, 22 bp, Homo sapiens
aaagtgccttctattttagtga

SEQ ID NO: 8132128 - DNA, 22 bp, Homo sapiens
aaacttgtgagctaaataaatg

SEQ ID NO: 8132129 - DNA, 22 bp, Homo sapiens
aaacttgttctcttgtgcctat

SEQ ID NO: 8132130 - DNA, 22 bp, Homo sapiens
aaagaagcataggctagacttc

SEQ ID NO: 8132131 - DNA, 22 bp, Homo sapiens
aaagatgagtccggcagacata

SEQ ID NO: 8132132 - DNA, 22 bp, Homo sapiens
aaaccatttgaattattactga

SEQ ID NO: 8132133 - DNA, 22 bp, Homo sapiens
aaacatgaatagatattaaaca

SEQ ID NO: 8132134 - DNA, 22 bp, Homo sapiens
aaaaagatgtcctgaagtttag

SEQ ID NO: 8132135 - DNA, 22 bp, Homo sapiens
aaacaaagcatcttgctatgca

SEQ ID NO: 8132136 - DNA, 22 bp, Homo sapiens
aaaatagctatggaatgtcact

SEQ ID NO: 8132137 - DNA, 21 bp, Homo sapiens
aacattagtaatttgactttt

SEQ ID NO: 8132138 - DNA, 22 bp, Homo sapiens
aacattagatttgtttttctag

SEQ ID NO: 8132139 - DNA, 22 bp, Homo sapiens
aacattctatgtgcattcagaa

SEQ ID NO: 8132140 - DNA, 22 bp, Homo sapiens
aacattctactgtactgcattg

SEQ ID NO: 8132141 - DNA, 22 bp, Homo sapiens
aacattctcattgggatatgtg

SEQ ID NO: 8132142 - DNA, 21 bp, Homo sapiens
aacatttctgggagaactcac

SEQ ID NO: 8132143 - DNA, 22 bp, Homo sapiens
aactgagattacaagagacatt

SEQ ID NO: 8132144 - DNA, 20 bp, Homo sapiens
aactgagagttcaggaggag

SEQ ID NO: 8132145 - DNA, 22 bp, Homo sapiens
aacttgaattctgccattcaga

SEQ ID NO: 8132146 - DNA, 22 bp, Homo sapiens
aactgacttagccagtggagct

SEQ ID NO: 8132147 - DNA, 22 bp, Homo sapiens
aacatttcttctgaaactgagt

SEQ ID NO: 8132148 - DNA, 22 bp, Homo sapiens
aactatgagagcccagcgaagg

SEQ ID NO: 8132149 - DNA, 22 bp, Homo sapiens
aaagcacatagtagaaggattt

SEQ ID NO: 8132150 - DNA, 22 bp, Homo sapiens
aaagcacatgagtagtgtagta

SEQ ID NO: 8132151 - DNA, 22 bp, Homo sapiens
aaatggtgagggaattgaacag

SEQ ID NO: 8132152 - DNA, 22 bp, Homo sapiens
aaatggtgaagtgtaatttagc

SEQ ID NO: 8132153 - DNA, 22 bp, Homo sapiens
aacacatatttatatatgcaca

SEQ ID NO: 8132154 - DNA, 23 bp, Homo sapiens
aacacattgctaattacattcaa

SEQ ID NO: 8132155 - DNA, 22 bp, Homo sapiens
aacagcagcatgacagctgggt

SEQ ID NO: 8132156 - DNA, 22 bp, Homo sapiens
aacacataggcagagcatgaca

SEQ ID NO: 8132157 - DNA, 22 bp, Homo sapiens
aagcaacattctctgtggcatt

SEQ ID NO: 8132158 - DNA, 22 bp, Homo sapiens
aagcaaaggaaagctgactttt

SEQ ID NO: 8132159 - DNA, 22 bp, Homo sapiens
aagattctcagagtgaaagaat

SEQ ID NO: 8132160 - DNA, 22 bp, Homo sapiens
aagaggagacttcagcaacttg

SEQ ID NO: 8132161 - DNA, 22 bp, Homo sapiens
aagaggaggacggttcccagaa

SEQ ID NO: 8132162 - DNA, 18 bp, Homo sapiens
aagaggaggaaacccagg

SEQ ID NO: 8132163 - DNA, 22 bp, Homo sapiens
aagcagcaagtttatttctatc

SEQ ID NO: 8132164 - DNA, 22 bp, Homo sapiens
aagcatggtggatgatacagtg

SEQ ID NO: 8132165 - DNA, 17 bp, Homo sapiens
aagacagaagccatgag

SEQ ID NO: 8132166 - DNA, 22 bp, Homo sapiens
aagacagagggaagcaatgatg

SEQ ID NO: 8132167 - DNA, 22 bp, Homo sapiens
aagagagagttcctaggcaaaa

SEQ ID NO: 8132168 - DNA, 22 bp, Homo sapiens
aagaatgttcattaaactgttg

SEQ ID NO: 8132169 - DNA, 22 bp, Homo sapiens
aagaatgttcttgtagtcatga

SEQ ID NO: 8132170 - DNA, 22 bp, Homo sapiens
aagaggacagtattcaatatga

SEQ ID NO: 8132171 - DNA, 22 bp, Homo sapiens
aagaggagaaaggctggctttg

SEQ ID NO: 8132172 - DNA, 22 bp, Homo sapiens
aagaggagaaaggctggctttg

SEQ ID NO: 8132173 - DNA, 22 bp, Homo sapiens
aagagccatacaagtaaaagca

SEQ ID NO: 8132174 - DNA, 22 bp, Homo sapiens
aagagccagtgggaaagtcttg

SEQ ID NO: 8132175 - DNA, 22 bp, Homo sapiens
aagagccagctagtgaagaggc

SEQ ID NO: 8132176 - DNA, 22 bp, Homo sapiens
aagaatgagctcaaagatctta

SEQ ID NO: 8132177 - DNA, 22 bp, Homo sapiens
aagaatgattacaaagcaacga

SEQ ID NO: 8132178 - DNA, 22 bp, Homo sapiens
aacagtttgggtaggtatgtag

SEQ ID NO: 8132179 - DNA, 22 bp, Homo sapiens
aacagtttgtggatagcttgta

SEQ ID NO: 8132180 - DNA, 22 bp, Homo sapiens
aacagtttttaaagctggcttc

SEQ ID NO: 8132181 - DNA, 22 bp, Homo sapiens
aacattcttcaaatatcactct

SEQ ID NO: 8132182 - DNA, 22 bp, Homo sapiens
aacatttcagcaaataagaaca

SEQ ID NO: 8132183 - DNA, 22 bp, Homo sapiens
aatcacatgtgctcaattttaa

SEQ ID NO: 8132184 - DNA, 22 bp, Homo sapiens
aaccatgacaaaccatagacat

SEQ ID NO: 8132185 - DNA, 22 bp, Homo sapiens
aaccagctctgcaaaatgtcat

SEQ ID NO: 8132186 - DNA, 22 bp, Homo sapiens
aatcacttttctctaatgtagc

SEQ ID NO: 8132187 - DNA, 20 bp, Homo sapiens
aatcactttgtacaggaagc

SEQ ID NO: 8132188 - DNA, 22 bp, Homo sapiens
aatcacttagaacccaggaagt

SEQ ID NO: 8132189 - DNA, 22 bp, Homo sapiens
aatcacttcagtttttggacag

SEQ ID NO: 8132190 - DNA, 22 bp, Homo sapiens
aatcacttaatagctacactgg

SEQ ID NO: 8132191 - DNA, 22 bp, Homo sapiens
aatcactttgcactcttatttg

SEQ ID NO: 8132192 - DNA, 22 bp, Homo sapiens
aatcacttgtgccatgggtacc

SEQ ID NO: 8132193 - DNA, 22 bp, Homo sapiens
aatcacttgtaaggaattcaat

SEQ ID NO: 8132194 - DNA, 23 bp, Homo sapiens
aatcacttccctccaaatggatt

SEQ ID NO: 8132195 - DNA, 22 bp, Homo sapiens
aacagtttgctttaagaggcac

SEQ ID NO: 8132196 - DNA, 22 bp, Homo sapiens
aacagtttgcctgaaatgtatt

SEQ ID NO: 8132197 - DNA, 22 bp, Homo sapiens
aacagtttgagctttgaatttc

SEQ ID NO: 8132198 - DNA, 22 bp, Homo sapiens
aacagtttctatgttagtggtt

SEQ ID NO: 8132199 - DNA, 18 bp, Homo sapiens
aacagtttccagattctc

SEQ ID NO: 8132200 - DNA, 22 bp, Homo sapiens
aacagtttcagttactgatgag

SEQ ID NO: 8132201 - DNA, 22 bp, Homo sapiens
aacagtttcctgactcctatga

SEQ ID NO: 8132202 - DNA, 22 bp, Homo sapiens
aacagtttatgtaaatgtccag

SEQ ID NO: 8132203 - DNA, 22 bp, Homo sapiens
aagtatttcagcggttctttgt

SEQ ID NO: 8132204 - DNA, 22 bp, Homo sapiens
aagtatttggaatggcattttt

SEQ ID NO: 8132205 - DNA, 22 bp, Homo sapiens
aagtatttctggcctgtgaaag

SEQ ID NO: 8132206 - DNA, 22 bp, Homo sapiens
aagtatttcgttctgaaaaagt

SEQ ID NO: 8132207 - DNA, 22 bp, Homo sapiens
aagttgagagaaagcccgtgtt

SEQ ID NO: 8132208 - DNA, 22 bp, Homo sapiens
aaggggaagtagcaccagaggt

SEQ ID NO: 8132209 - DNA, 22 bp, Homo sapiens
aaggggcatgcttttgccagga

SEQ ID NO: 8132210 - DNA, 17 bp, Homo sapiens
aacaataggatgtgtat

SEQ ID NO: 8132211 - DNA, 22 bp, Homo sapiens
aagctttgcaatgcttcattat

SEQ ID NO: 8132212 - DNA, 22 bp, Homo sapiens
aaggagaaggcatcattcaagt

SEQ ID NO: 8132213 - DNA, 22 bp, Homo sapiens
aaattaactatcacttttgtga

SEQ ID NO: 8132214 - DNA, 22 bp, Homo sapiens
aaggaaacagaggatgaccttg

SEQ ID NO: 8132215 - DNA, 22 bp, Homo sapiens
aaattagatcagtggattttct

SEQ ID NO: 8132216 - DNA, 22 bp, Homo sapiens
aaggacaggttggggcttcagg

SEQ ID NO: 8132217 - DNA, 22 bp, Homo sapiens
aaggacatggaaggaggagata

SEQ ID NO: 8132218 - DNA, 22 bp, Homo sapiens
aaattattataggcagagctga

SEQ ID NO: 8132219 - DNA, 22 bp, Homo sapiens
aaattattacaagctagttggc

SEQ ID NO: 8132220 - DNA, 22 bp, Homo sapiens
aagaattggtttcctctgtcat

SEQ ID NO: 8132221 - DNA, 22 bp, Homo sapiens
aagacacacacatatgctgagt

SEQ ID NO: 8132222 - DNA, 22 bp, Homo sapiens
acaactgatgggtcatgtggga

SEQ ID NO: 8132223 - DNA, 22 bp, Homo sapiens
acaactgttggaggaacacagg

SEQ ID NO: 8132224 - DNA, 22 bp, Homo sapiens
aatgttacaggacctaagatga

SEQ ID NO: 8132225 - DNA, 22 bp, Homo sapiens
aatgttaatgtgtttgcttatg

SEQ ID NO: 8132226 - DNA, 22 bp, Homo sapiens
aatgttaagtttagattataac

SEQ ID NO: 8132227 - DNA, 22 bp, Homo sapiens
aatgttaattcacagccaaata

SEQ ID NO: 8132228 - DNA, 22 bp, Homo sapiens
aatgtgaaaccgcacagaataa

SEQ ID NO: 8132229 - DNA, 22 bp, Homo sapiens
aattactgtaattttctacagc

SEQ ID NO: 8132230 - DNA, 22 bp, Homo sapiens
aactctcagaacttttggtggg

SEQ ID NO: 8132231 - DNA, 22 bp, Homo sapiens
aatgtattctgggaaaatgtta

SEQ ID NO: 8132232 - DNA, 22 bp, Homo sapiens
aactgaaacggtgatcttttaa

SEQ ID NO: 8132233 - DNA, 22 bp, Homo sapiens
aatgtcaaagtgctttgcaaac

SEQ ID NO: 8132234 - DNA, 22 bp, Homo sapiens
acacacagagtttatacaggca

SEQ ID NO: 8132235 - DNA, 22 bp, Homo sapiens
aagaggcatctcagcttcctct

SEQ ID NO: 8132236 - DNA, 21 bp, Homo sapiens
aagaggcatcactatttgtgt

SEQ ID NO: 8132237 - DNA, 19 bp, Homo sapiens
aagagggaaagtgctatgc

SEQ ID NO: 8132238 - DNA, 22 bp, Homo sapiens
aagaggaggattgatgtgggag

SEQ ID NO: 8132239 - DNA, 22 bp, Homo sapiens
aagaggcataaaatttatatgg

SEQ ID NO: 8132240 - DNA, 22 bp, Homo sapiens
aagaggcagtggtgatgaatgg

SEQ ID NO: 8132241 - DNA, 22 bp, Homo sapiens
aagaggagtagatgtggttggt

SEQ ID NO: 8132242 - DNA, 22 bp, Homo sapiens
aagaggagggcagattcaaggc

SEQ ID NO: 8132243 - DNA, 23 bp, Homo sapiens
aagaggaggccctgctcccgtcc

SEQ ID NO: 8132244 - DNA, 22 bp, Homo sapiens
acagaggaaggctgagctgccc

SEQ ID NO: 8132245 - DNA, 22 bp, Homo sapiens
acagaggaaggctgagctgccc

SEQ ID NO: 8132246 - DNA, 22 bp, Homo sapiens
acagaggacaactaggcgctca

SEQ ID NO: 8132247 - DNA, 22 bp, Homo sapiens
acagatgagactccaggacctt

SEQ ID NO: 8132248 - DNA, 22 bp, Homo sapiens
acagatgaatttatggatggaa

SEQ ID NO: 8132249 - DNA, 22 bp, Homo sapiens
aagcacatctcaaacttcatct

SEQ ID NO: 8132250 - DNA, 22 bp, Homo sapiens
aagcacatctcctgtgcagaac

SEQ ID NO: 8132251 - DNA, 22 bp, Homo sapiens
aagcacattaaggaacattgaa

SEQ ID NO: 8132252 - DNA, 22 bp, Homo sapiens
acagaagaccagagagctaact

SEQ ID NO: 8132253 - DNA, 22 bp, Homo sapiens
acagaagagctggctctgtgct

SEQ ID NO: 8132254 - DNA, 22 bp, Homo sapiens
acagaagacagagtgttcatct

SEQ ID NO: 8132255 - DNA, 22 bp, Homo sapiens
acagaagaaagggaggttttgc

SEQ ID NO: 8132256 - DNA, 17 bp, Homo sapiens
tcacatcacacaagcaa

SEQ ID NO: 8132257 - DNA, 22 bp, Homo sapiens
tcacatcacatgagtgcaagga

SEQ ID NO: 8132258 - DNA, 22 bp, Homo sapiens
tcacatcacatgacagtaggcc

SEQ ID NO: 8132259 - DNA, 19 bp, Homo sapiens
tcacagcatctgtctgaac

SEQ ID NO: 8132260 - DNA, 22 bp, Homo sapiens
tcacagcatttttagaaagatt

SEQ ID NO: 8132261 - DNA, 22 bp, Homo sapiens
tcacagcattgagtgtactaga

SEQ ID NO: 8132262 - DNA, 22 bp, Homo sapiens
tcacagcaggcagatattgttg

SEQ ID NO: 8132263 - DNA, 22 bp, Homo sapiens
tcacagcaccaggatctctcca

SEQ ID NO: 8132264 - DNA, 22 bp, Homo sapiens
tcacacatactcatgtgtgagt

SEQ ID NO: 8132265 - DNA, 20 bp, Homo sapiens
tcacacataagtgaacgcac

SEQ ID NO: 8132266 - DNA, 22 bp, Homo sapiens
tcacagcaaaagtgtgcagagc

SEQ ID NO: 8132267 - DNA, 20 bp, Homo sapiens
tcacagatgaaagttcaaga

SEQ ID NO: 8132268 - DNA, 22 bp, Homo sapiens
tcacagcaaatgctgcttctca

SEQ ID NO: 8132269 - DNA, 22 bp, Homo sapiens
tcacagcaaaagtgtgcagagc

SEQ ID NO: 8132270 - DNA, 22 bp, Homo sapiens
tcacagacatggtgaggtaaca

SEQ ID NO: 8132271 - DNA, 18 bp, Homo sapiens
tcacagacagctgtcttt

SEQ ID NO: 8132272 - DNA, 22 bp, Homo sapiens
tcacagacagaagggatgggat

SEQ ID NO: 8132273 - DNA, 22 bp, Homo sapiens
tcacagacacattaaacatgtg

SEQ ID NO: 8132274 - DNA, 22 bp, Homo sapiens
tcacacagggtcggaaagagtg

SEQ ID NO: 8132275 - DNA, 21 bp, Homo sapiens
tcaatacaggtgcatgtgtct

SEQ ID NO: 8132276 - DNA, 22 bp, Homo sapiens
tcaatacttaagcttaattcta

SEQ ID NO: 8132277 - DNA, 22 bp, Homo sapiens
tcaatacttggcacactgcaca

SEQ ID NO: 8132278 - DNA, 22 bp, Homo sapiens
tcaatactatgattttgtacat

SEQ ID NO: 8132279 - DNA, 22 bp, Homo sapiens
tcaatactcacaaagagatttt

SEQ ID NO: 8132280 - DNA, 22 bp, Homo sapiens
tcaatactaatcttgctggaag

SEQ ID NO: 8132281 - DNA, 22 bp, Homo sapiens
tcaatgatagtacaatcagcct

SEQ ID NO: 8132282 - DNA, 22 bp, Homo sapiens
tcaaaagtggcctgtaaaatct

SEQ ID NO: 8132283 - DNA, 22 bp, Homo sapiens
tcacctgttcaacagcaataat

SEQ ID NO: 8132284 - DNA, 22 bp, Homo sapiens
tcacctgtattaatacagaact

SEQ ID NO: 8132285 - DNA, 22 bp, Homo sapiens
tcacatgcagtcactgagcagg

SEQ ID NO: 8132286 - DNA, 22 bp, Homo sapiens
tcactgggccctgaggtgggac

SEQ ID NO: 8132287 - DNA, 17 bp, Homo sapiens
tcactgggcctgctccc

SEQ ID NO: 8132288 - DNA, 22 bp, Homo sapiens
tcactggggccatgtgagggac

SEQ ID NO: 8132289 - DNA, 22 bp, Homo sapiens
tcactggattctcttttgttcc

SEQ ID NO: 8132290 - DNA, 22 bp, Homo sapiens
tcagaacagtgcctggcactaa

SEQ ID NO: 8132291 - DNA, 23 bp, Homo sapiens
tcagaacagttcttggtgcatag

SEQ ID NO: 8132292 - DNA, 22 bp, Homo sapiens
tcagaacatatattttgtgatg

SEQ ID NO: 8132293 - DNA, 22 bp, Homo sapiens
tcagaacatcctggtttaaaat

SEQ ID NO: 8132294 - DNA, 20 bp, Homo sapiens
tcactgtaacatttgggggg

SEQ ID NO: 8132295 - DNA, 22 bp, Homo sapiens
tcactggggcctttggtcagga

SEQ ID NO: 8132296 - DNA, 22 bp, Homo sapiens
tcactgggtaggacatgctgat

SEQ ID NO: 8132297 - DNA, 22 bp, Homo sapiens
tcagaacattgacattcttatt

SEQ ID NO: 8132298 - DNA, 22 bp, Homo sapiens
tcagaacatttaaaaagtggtt

SEQ ID NO: 8132299 - DNA, 22 bp, Homo sapiens
tcagaacatttgggactttggg

SEQ ID NO: 8132300 - DNA, 22 bp, Homo sapiens
tcagaacattctcattgactgc

SEQ ID NO: 8132301 - DNA, 22 bp, Homo sapiens
tcagaacatgaaggttaatttg

SEQ ID NO: 8132302 - DNA, 22 bp, Homo sapiens
tcagaacattaaggatttgaag

SEQ ID NO: 8132303 - DNA, 22 bp, Homo sapiens
tcagaacatgtttgagtaagac

SEQ ID NO: 8132304 - DNA, 22 bp, Homo sapiens
tcagaggagaagttgggaaaat

SEQ ID NO: 8132305 - DNA, 19 bp, Homo sapiens
tcagaggatttggctatga

SEQ ID NO: 8132306 - DNA, 22 bp, Homo sapiens
tcagaggagaccaaggggaata

SEQ ID NO: 8132307 - DNA, 22 bp, Homo sapiens
tcagaggacaagctccctggtg

SEQ ID NO: 8132308 - DNA, 23 bp, Homo sapiens
tcagagagctgttgagagctgcc

SEQ ID NO: 8132309 - DNA, 23 bp, Homo sapiens
tcagagagctgttgagagctgcc

SEQ ID NO: 8132310 - DNA, 22 bp, Homo sapiens
tcagagaggattttaataagtg

SEQ ID NO: 8132311 - DNA, 22 bp, Homo sapiens
tcagaggaagccttggtgggag

SEQ ID NO: 8132312 - DNA, 22 bp, Homo sapiens
tcagagagctggtgggcagagg

SEQ ID NO: 8132313 - DNA, 22 bp, Homo sapiens
tcagagagcctcaggcactgcc

SEQ ID NO: 8132314 - DNA, 22 bp, Homo sapiens
tcagagagcagaacttttttac

SEQ ID NO: 8132315 - DNA, 20 bp, Homo sapiens
tcagagagagggtgccactt

SEQ ID NO: 8132316 - DNA, 18 bp, Homo sapiens
tcagagagcagctttatt

SEQ ID NO: 8132317 - DNA, 18 bp, Homo sapiens
tcagagagaatagtaatt

SEQ ID NO: 8132318 - DNA, 22 bp, Homo sapiens
tcagagagaaatagtttttgac

SEQ ID NO: 8132319 - DNA, 22 bp, Homo sapiens
tcagagacagttctggggcagg

SEQ ID NO: 8132320 - DNA, 22 bp, Homo sapiens
tcatccagtaccatggaaggca

SEQ ID NO: 8132321 - DNA, 23 bp, Homo sapiens
tcatcaaacagctgctcaagaaa

SEQ ID NO: 8132322 - DNA, 22 bp, Homo sapiens
tcatccctaaggacagctctgc

SEQ ID NO: 8132323 - DNA, 22 bp, Homo sapiens
tcatccatctttgatttcatag

SEQ ID NO: 8132324 - DNA, 22 bp, Homo sapiens
tcatctcagggcgacatcatgt

SEQ ID NO: 8132325 - DNA, 22 bp, Homo sapiens
tcatctcagagaggtatgttag

SEQ ID NO: 8132326 - DNA, 23 bp, Homo sapiens
tcagtgcttgggggtgacgcgcc

SEQ ID NO: 8132327 - DNA, 22 bp, Homo sapiens
tcagtgcttgcctctggaggag

SEQ ID NO: 8132328 - DNA, 22 bp, Homo sapiens
tcagtgcttgacagctctggga

SEQ ID NO: 8132329 - DNA, 22 bp, Homo sapiens
tcaggggctgtgcatttcccag

SEQ ID NO: 8132330 - DNA, 22 bp, Homo sapiens
tcaggggcttgaggtgcatgtc

SEQ ID NO: 8132331 - DNA, 22 bp, Homo sapiens
tcagggtgaaccaggcaggaat

SEQ ID NO: 8132332 - DNA, 22 bp, Homo sapiens
tcagggggaggagactgccagt

SEQ ID NO: 8132333 - DNA, 22 bp, Homo sapiens
tcaggtcctctgggtcccagcc

SEQ ID NO: 8132334 - DNA, 22 bp, Homo sapiens
tcaggcctttgaacttggagtg

SEQ ID NO: 8132335 - DNA, 22 bp, Homo sapiens
tcaggaaatggaattcttgtgt

SEQ ID NO: 8132336 - DNA, 22 bp, Homo sapiens
tcaggaaagcctagaagagaac

SEQ ID NO: 8132337 - DNA, 22 bp, Homo sapiens
tcagagtgaccttacatggtct

SEQ ID NO: 8132338 - DNA, 22 bp, Homo sapiens
tcagagtgaggcgtcaacatga

SEQ ID NO: 8132339 - DNA, 23 bp, Homo sapiens
tcagcttcattgtcttctatggc

SEQ ID NO: 8132340 - DNA, 23 bp, Homo sapiens
tcagcctcttaggacttctcacc

SEQ ID NO: 8132341 - DNA, 22 bp, Homo sapiens
tcagcttctcaaaatggcttag

SEQ ID NO: 8132342 - DNA, 22 bp, Homo sapiens
tcagcctcaggtgttcagattt

SEQ ID NO: 8132343 - DNA, 22 bp, Homo sapiens
tcagcctcattttctgctctgt

SEQ ID NO: 8132344 - DNA, 22 bp, Homo sapiens
tcagcctcctaatttcctgtga

SEQ ID NO: 8132345 - DNA, 22 bp, Homo sapiens
tcagcctctctgagtccagacc

SEQ ID NO: 8132346 - DNA, 22 bp, Homo sapiens
tcagcctccgaaagtgctggga

SEQ ID NO: 8132347 - DNA, 22 bp, Homo sapiens
tccctgccaatgattggagcaa

SEQ ID NO: 8132348 - DNA, 22 bp, Homo sapiens
tccctgccagtcctggtctgaa

SEQ ID NO: 8132349 - DNA, 22 bp, Homo sapiens
tccctgggcacaatctgctggc

SEQ ID NO: 8132350 - DNA, 22 bp, Homo sapiens
tccctgggcaagtttactcttc

SEQ ID NO: 8132351 - DNA, 22 bp, Homo sapiens
tccctgggcatcacgttgcttc

SEQ ID NO: 8132352 - DNA, 22 bp, Homo sapiens
tccctgggccacagctgtgagc

SEQ ID NO: 8132353 - DNA, 23 bp, Homo sapiens
tccctgggcccgtgccagcggtg

SEQ ID NO: 8132354 - DNA, 22 bp, Homo sapiens
tccctggggatgttggcctgcc

SEQ ID NO: 8132355 - DNA, 22 bp, Homo sapiens
tccctggggaagggcaagcaag

SEQ ID NO: 8132356 - DNA, 22 bp, Homo sapiens
tccctgggcttctccagacttg

SEQ ID NO: 8132357 - DNA, 22 bp, Homo sapiens
tccctgggcctcctgctatgca

SEQ ID NO: 8132358 - DNA, 22 bp, Homo sapiens
tccctgggcggacattctccca

SEQ ID NO: 8132359 - DNA, 22 bp, Homo sapiens
tccctgggcctatcttagctcc

SEQ ID NO: 8132360 - DNA, 22 bp, Homo sapiens
tccctggggcagtggctcggag

SEQ ID NO: 8132361 - DNA, 19 bp, Homo sapiens
tcccttctatagtaataaa

SEQ ID NO: 8132362 - DNA, 22 bp, Homo sapiens
tcctccctgcactcagtgaagt

SEQ ID NO: 8132363 - DNA, 22 bp, Homo sapiens
tccgcgtgggaggggccggtgt

SEQ ID NO: 8132364 - DNA, 22 bp, Homo sapiens
tccggcggccggcctgagcccg

SEQ ID NO: 8132365 - DNA, 22 bp, Homo sapiens
tccgagggctggacgcaggggc

SEQ ID NO: 8132366 - DNA, 22 bp, Homo sapiens
tccacacacatttctatgtgca

SEQ ID NO: 8132367 - DNA, 22 bp, Homo sapiens
tcattaataagtctaactctcc

SEQ ID NO: 8132368 - DNA, 22 bp, Homo sapiens
tccaggagaaggccatccagcg

SEQ ID NO: 8132369 - DNA, 22 bp, Homo sapiens
tccagccttgccacttttctgt

SEQ ID NO: 8132370 - DNA, 22 bp, Homo sapiens
tcccaggaaaacactcgaggac

SEQ ID NO: 8132371 - DNA, 22 bp, Homo sapiens
tcccactgtgcctgttgtaatc

SEQ ID NO: 8132372 - DNA, 22 bp, Homo sapiens
tcccactgtgaatccaaggcct

SEQ ID NO: 8132373 - DNA, 22 bp, Homo sapiens
tcccactgtctgtcttgctgca

SEQ ID NO: 8132374 - DNA, 22 bp, Homo sapiens
tcccactgtcttctcgtgctcg

SEQ ID NO: 8132375 - DNA, 22 bp, Homo sapiens
tcccactgctttgctctgctca

SEQ ID NO: 8132376 - DNA, 21 bp, Homo sapiens
tcccactgccacagcttcagg

SEQ ID NO: 8132377 - DNA, 22 bp, Homo sapiens
tcccactggacgtctgtgctgg

SEQ ID NO: 8132378 - DNA, 20 bp, Homo sapiens
tcccactgggcctcagtttc

SEQ ID NO: 8132379 - DNA, 21 bp, Homo sapiens
tcccactggcccagggctcca

SEQ ID NO: 8132380 - DNA, 20 bp, Homo sapiens
tccagtgtctctctggtgga

SEQ ID NO: 8132381 - DNA, 22 bp, Homo sapiens
tccagtgtggaggtgaccaact

SEQ ID NO: 8132382 - DNA, 22 bp, Homo sapiens
tcccactgagcccctgctggtg

SEQ ID NO: 8132383 - DNA, 22 bp, Homo sapiens
tccaggccactgcagaggctct

SEQ ID NO: 8132384 - DNA, 19 bp, Homo sapiens
tccaggccattcccagagc

SEQ ID NO: 8132385 - DNA, 22 bp, Homo sapiens
tccaggcccactcagctgaaat

SEQ ID NO: 8132386 - DNA, 20 bp, Homo sapiens
tacaggaatcaagactgcat

SEQ ID NO: 8132387 - DNA, 22 bp, Homo sapiens
tacagtttttcactgaagatgt

SEQ ID NO: 8132388 - DNA, 22 bp, Homo sapiens
tacagtttttattcatgacaag

SEQ ID NO: 8132389 - DNA, 22 bp, Homo sapiens
tacagttttggtgatgatgatg

SEQ ID NO: 8132390 - DNA, 22 bp, Homo sapiens
tacagcagagtgggatgcatct

SEQ ID NO: 8132391 - DNA, 22 bp, Homo sapiens
tactgctgattagagctgaggt

SEQ ID NO: 8132392 - DNA, 19 bp, Homo sapiens
tactaaacatgcatattgg

SEQ ID NO: 8132393 - DNA, 18 bp, Homo sapiens
taagcaatgacattgcaa

SEQ ID NO: 8132394 - DNA, 22 bp, Homo sapiens
taagttttctggaataacttgg

SEQ ID NO: 8132395 - DNA, 22 bp, Homo sapiens
taatttcaatagcttgcataat

SEQ ID NO: 8132396 - DNA, 22 bp, Homo sapiens
taatttcaccgttgctagaaat

SEQ ID NO: 8132397 - DNA, 22 bp, Homo sapiens
taatttcagtgcaagctcacgg

SEQ ID NO: 8132398 - DNA, 22 bp, Homo sapiens
taatgaatgagaatataacaga

SEQ ID NO: 8132399 - DNA, 22 bp, Homo sapiens
taatgaggcatttgagtcacct

SEQ ID NO: 8132400 - DNA, 22 bp, Homo sapiens
taatgaggggaaccatctgtag

SEQ ID NO: 8132401 - DNA, 22 bp, Homo sapiens
taatgaggaaatagagggaatg

SEQ ID NO: 8132402 - DNA, 22 bp, Homo sapiens
taatgatgctagatttatctgg

SEQ ID NO: 8132403 - DNA, 22 bp, Homo sapiens
tacaatgctgtgcatgtaatgg

SEQ ID NO: 8132404 - DNA, 22 bp, Homo sapiens
tacaatgaccatattatgtaag

SEQ ID NO: 8132405 - DNA, 22 bp, Homo sapiens
taatttcttcatctctgcagct

SEQ ID NO: 8132406 - DNA, 22 bp, Homo sapiens
tacacatttctcttagagacac

SEQ ID NO: 8132407 - DNA, 22 bp, Homo sapiens
gtttcccagtctgcagagttct

SEQ ID NO: 8132408 - DNA, 22 bp, Homo sapiens
gtttcccatatctagggagagg

SEQ ID NO: 8132409 - DNA, 20 bp, Homo sapiens
gtttctgattcagtaggtct

SEQ ID NO: 8132410 - DNA, 22 bp, Homo sapiens
gtttctgagcacttttattgca

SEQ ID NO: 8132411 - DNA, 22 bp, Homo sapiens
gtttctgaagggattacttggt

SEQ ID NO: 8132412 - DNA, 22 bp, Homo sapiens
gtttaggaaattgggtattaga

SEQ ID NO: 8132413 - DNA, 22 bp, Homo sapiens
gttccacatcacactacttgat

SEQ ID NO: 8132414 - DNA, 22 bp, Homo sapiens
gttccacaaagattgtctctct

SEQ ID NO: 8132415 - DNA, 22 bp, Homo sapiens
gtgtgtgtgcatctcttttatt

SEQ ID NO: 8132416 - DNA, 22 bp, Homo sapiens
gtgtgtgtgcctgcacacacac

SEQ ID NO: 8132417 - DNA, 22 bp, Homo sapiens
gtgtgtgtgtaaaaatccagag

SEQ ID NO: 8132418 - DNA, 22 bp, Homo sapiens
gtgtgtgttcaataaatttaag

SEQ ID NO: 8132419 - DNA, 22 bp, Homo sapiens
gtgtgtgtatctgcctatcaca

SEQ ID NO: 8132420 - DNA, 22 bp, Homo sapiens
gtgtgtgtctccgcggccgtag

SEQ ID NO: 8132421 - DNA, 22 bp, Homo sapiens
gtgtgtgtgcatataacatata

SEQ ID NO: 8132422 - DNA, 22 bp, Homo sapiens
gttaggaaggtatagttgtatt

SEQ ID NO: 8132423 - DNA, 22 bp, Homo sapiens
gttttagtgtaacggagtgtga

SEQ ID NO: 8132424 - DNA, 22 bp, Homo sapiens
gttttataattgcttcataaga

SEQ ID NO: 8132425 - DNA, 22 bp, Homo sapiens
gttttataggctgttgctatat

SEQ ID NO: 8132426 - DNA, 21 bp, Homo sapiens
taaagaagatgaatgtgatca

SEQ ID NO: 8132427 - DNA, 22 bp, Homo sapiens
taaagacaataggaaagttgtt

SEQ ID NO: 8132428 - DNA, 22 bp, Homo sapiens
taaagacaaatgacattacggc

SEQ ID NO: 8132429 - DNA, 22 bp, Homo sapiens
taaagacaaacccactagggtt

SEQ ID NO: 8132430 - DNA, 22 bp, Homo sapiens
taaagacaatttcgagctgtag

SEQ ID NO: 8132431 - DNA, 22 bp, Homo sapiens
taaagacacccagggagggact

SEQ ID NO: 8132432 - DNA, 22 bp, Homo sapiens
taaagacactggttttaatcat

SEQ ID NO: 8132433 - DNA, 22 bp, Homo sapiens
taagatgatcaccaaatgctgg

SEQ ID NO: 8132434 - DNA, 22 bp, Homo sapiens
taactgtgtgaacgtgatcatt

SEQ ID NO: 8132435 - DNA, 22 bp, Homo sapiens
taggacagagctggttacaatg

SEQ ID NO: 8132436 - DNA, 22 bp, Homo sapiens
taggacagagttccctgatggc

SEQ ID NO: 8132437 - DNA, 21 bp, Homo sapiens
taggacagcccccctgccctc

SEQ ID NO: 8132438 - DNA, 20 bp, Homo sapiens
taggacagggcctggcttct

SEQ ID NO: 8132439 - DNA, 22 bp, Homo sapiens
taggacagggacatctttttga

SEQ ID NO: 8132440 - DNA, 22 bp, Homo sapiens
tagccatgttgttaaaagacaa

SEQ ID NO: 8132441 - DNA, 22 bp, Homo sapiens
taggaaagcagtagagccagga

SEQ ID NO: 8132442 - DNA, 22 bp, Homo sapiens
tagtggatgttcagagatttga

SEQ ID NO: 8132443 - DNA, 22 bp, Homo sapiens
tagtgtaaataactgcctagac

SEQ ID NO: 8132444 - DNA, 22 bp, Homo sapiens
tagtatatctttagtacatagt

SEQ ID NO: 8132445 - DNA, 22 bp, Homo sapiens
tagtatagattgaagcagatca

SEQ ID NO: 8132446 - DNA, 22 bp, Homo sapiens
taggctggaggaagcagtgcct

SEQ ID NO: 8132447 - DNA, 22 bp, Homo sapiens
tagagcattaagtattgttgtt

SEQ ID NO: 8132448 - DNA, 22 bp, Homo sapiens
tagaggagcggcgagctgagct

SEQ ID NO: 8132449 - DNA, 22 bp, Homo sapiens
tagaggagagttgctggatgga

SEQ ID NO: 8132450 - DNA, 23 bp, Homo sapiens
tagaggaggatgtgatgcatatt

SEQ ID NO: 8132451 - DNA, 22 bp, Homo sapiens
tagaggaggcaaggccctccct

SEQ ID NO: 8132452 - DNA, 22 bp, Homo sapiens
tagaggaggtgattcttgagct

SEQ ID NO: 8132453 - DNA, 22 bp, Homo sapiens
tagaggagggctgttcttcagt

SEQ ID NO: 8132454 - DNA, 22 bp, Homo sapiens
tactttctgtccttctgttaaa

SEQ ID NO: 8132455 - DNA, 22 bp, Homo sapiens
tactttcatgggttttctttat

SEQ ID NO: 8132456 - DNA, 22 bp, Homo sapiens
tagcagtcatcggcagagaaaa

SEQ ID NO: 8132457 - DNA, 22 bp, Homo sapiens
tagccaaagaaggtatatttgt

SEQ ID NO: 8132458 - DNA, 22 bp, Homo sapiens
tagccatgtgtggaacacagcc

SEQ ID NO: 8132459 - DNA, 22 bp, Homo sapiens
tagattttacttctgtcattac

SEQ ID NO: 8132460 - DNA, 22 bp, Homo sapiens
tagattttttggagactctctg

SEQ ID NO: 8132461 - DNA, 22 bp, Homo sapiens
tatattatcataaaaccattca

SEQ ID NO: 8132462 - DNA, 22 bp, Homo sapiens
tatactctgagaaacgtgtcac

SEQ ID NO: 8132463 - DNA, 23 bp, Homo sapiens
tagtgtcatcctcagcttctgtt

SEQ ID NO: 8132464 - DNA, 22 bp, Homo sapiens
tagtgtcagggagtgataaatg

SEQ ID NO: 8132465 - DNA, 18 bp, Homo sapiens
tatatttcacacatattc

SEQ ID NO: 8132466 - DNA, 22 bp, Homo sapiens
tatcaactgagattaaatattt

SEQ ID NO: 8132467 - DNA, 22 bp, Homo sapiens
tatcttgagagacaacacagca

SEQ ID NO: 8132468 - DNA, 22 bp, Homo sapiens
tatgcacattcacacaaaaatg

SEQ ID NO: 8132469 - DNA, 22 bp, Homo sapiens
tatgcacagttacaagaatatc

SEQ ID NO: 8132470 - DNA, 22 bp, Homo sapiens
tatgcatatgtgttcattggag

SEQ ID NO: 8132471 - DNA, 22 bp, Homo sapiens
tatgcatatatcacgtgcatgc

SEQ ID NO: 8132472 - DNA, 22 bp, Homo sapiens
tatgcataattggataagtaga

SEQ ID NO: 8132473 - DNA, 22 bp, Homo sapiens
tatgcatataaatgtgtgaatt

SEQ ID NO: 8132474 - DNA, 22 bp, Homo sapiens
tatgcatagtggaattagcaaa

SEQ ID NO: 8132475 - DNA, 22 bp, Homo sapiens
tatttggagtgatggaaatgtt

SEQ ID NO: 8132476 - DNA, 22 bp, Homo sapiens
tatttggatagacagggagatg

SEQ ID NO: 8132477 - DNA, 22 bp, Homo sapiens
tatttctaagagatatctgtac

SEQ ID NO: 8132478 - DNA, 22 bp, Homo sapiens
tatttgttgcgggaattgctat

SEQ ID NO: 8132479 - DNA, 22 bp, Homo sapiens
tattttcaccttctctggatat

SEQ ID NO: 8132480 - DNA, 22 bp, Homo sapiens
tatttgtgtgggtatctatata

SEQ ID NO: 8132481 - DNA, 22 bp, Homo sapiens
tattgcaagtggcataaaattt

SEQ ID NO: 8132482 - DNA, 22 bp, Homo sapiens
tattgtacatttcaaaattgct

SEQ ID NO: 8132483 - DNA, 22 bp, Homo sapiens
tattgtacatttcaaagtagct

SEQ ID NO: 8132484 - DNA, 22 bp, Homo sapiens
tatttcaagaacttctatccat

SEQ ID NO: 8132485 - DNA, 22 bp, Homo sapiens
tattgtactgaggaataaagct

SEQ ID NO: 8132486 - DNA, 22 bp, Homo sapiens
tatttcagggagaataaatttg

SEQ ID NO: 8132487 - DNA, 19 bp, Homo sapiens
tatgttatgttgtttactc

SEQ ID NO: 8132488 - DNA, 22 bp, Homo sapiens
tatgttcttggactaagttgtt

SEQ ID NO: 8132489 - DNA, 22 bp, Homo sapiens
tatgctaaatatgttcacattg

SEQ ID NO: 8132490 - DNA, 22 bp, Homo sapiens
tatgctactagaaataaaatgg

SEQ ID NO: 8132491 - DNA, 22 bp, Homo sapiens
tatgctagatggaaaaatattg

SEQ ID NO: 8132492 - DNA, 22 bp, Homo sapiens
tatgcctacctccaaaatatat

SEQ ID NO: 8132493 - DNA, 22 bp, Homo sapiens
tattcacaggcacgaaatattg

SEQ ID NO: 8132494 - DNA, 22 bp, Homo sapiens
tattgaggattgaggaaagcac

SEQ ID NO: 8132495 - DNA, 22 bp, Homo sapiens
ggagaggaaatgccagcacttc

SEQ ID NO: 8132496 - DNA, 22 bp, Homo sapiens
ggagaggacatggctcccacag

SEQ ID NO: 8132497 - DNA, 22 bp, Homo sapiens
ggagaggagctattgggggctc

SEQ ID NO: 8132498 - DNA, 22 bp, Homo sapiens
ggagaggagctattgggggctc

SEQ ID NO: 8132499 - DNA, 19 bp, Homo sapiens
ggagaggctggagggatgc

SEQ ID NO: 8132500 - DNA, 22 bp, Homo sapiens
ggacggggagctggaaagggga

SEQ ID NO: 8132501 - DNA, 22 bp, Homo sapiens
ggactctggtatttcactcttg

SEQ ID NO: 8132502 - DNA, 22 bp, Homo sapiens
ggacctgccagaactcaggcta

SEQ ID NO: 8132503 - DNA, 22 bp, Homo sapiens
ggactctgttttcctgatcact

SEQ ID NO: 8132504 - DNA, 22 bp, Homo sapiens
ggacactgaagaatctcagatg

SEQ ID NO: 8132505 - DNA, 22 bp, Homo sapiens
ggacagagcagacgagcagcgg

SEQ ID NO: 8132506 - DNA, 22 bp, Homo sapiens
ggacagagcagacgagcagcgg

SEQ ID NO: 8132507 - DNA, 22 bp, Homo sapiens
ggacagacagtgtgagtgaggc

SEQ ID NO: 8132508 - DNA, 22 bp, Homo sapiens
gcttcctccctgctgctcacta

SEQ ID NO: 8132509 - DNA, 22 bp, Homo sapiens
ggaacagtagacgatctccttt

SEQ ID NO: 8132510 - DNA, 22 bp, Homo sapiens
gctggggctgggctgaggaaga

SEQ ID NO: 8132511 - DNA, 22 bp, Homo sapiens
gctgggaggatctctccctgtc

SEQ ID NO: 8132512 - DNA, 20 bp, Homo sapiens
gctgggggtgtgctgagtga

SEQ ID NO: 8132513 - DNA, 22 bp, Homo sapiens
gctgggaagaacaggagagaat

SEQ ID NO: 8132514 - DNA, 22 bp, Homo sapiens
gctgggacaggcttggccctgt

SEQ ID NO: 8132515 - DNA, 22 bp, Homo sapiens
gctgaaggtctctggagaggtc

SEQ ID NO: 8132516 - DNA, 22 bp, Homo sapiens
gctgcagggggtgggcgtctcc

SEQ ID NO: 8132517 - DNA, 22 bp, Homo sapiens
gctgcaggttgggcaacagagt

SEQ ID NO: 8132518 - DNA, 22 bp, Homo sapiens
gctgcaggagctggagctgtgg

SEQ ID NO: 8132519 - DNA, 22 bp, Homo sapiens
gctgcagactgggaggcaggtg

SEQ ID NO: 8132520 - DNA, 22 bp, Homo sapiens
gctcaggctctcccaggggaat

SEQ ID NO: 8132521 - DNA, 21 bp, Homo sapiens
gctcaggctcaggttcaggtt

SEQ ID NO: 8132522 - DNA, 22 bp, Homo sapiens
gctcaggcctggcccatgggac

SEQ ID NO: 8132523 - DNA, 18 bp, Homo sapiens
gctcaggccctagtcagt

SEQ ID NO: 8132524 - DNA, 22 bp, Homo sapiens
gctcaggcctccagaggggcaa

SEQ ID NO: 8132525 - DNA, 22 bp, Homo sapiens
gctcaggctggattgcagtggc

SEQ ID NO: 8132526 - DNA, 21 bp, Homo sapiens
gctcaggctcttgacagagca

SEQ ID NO: 8132527 - DNA, 22 bp, Homo sapiens
gctcagggaaagagctcctgtc

SEQ ID NO: 8132528 - DNA, 22 bp, Homo sapiens
gctctgcctggtcgcgtgctgg

SEQ ID NO: 8132529 - DNA, 22 bp, Homo sapiens
gctctgcgattattgggccttt

SEQ ID NO: 8132530 - DNA, 22 bp, Homo sapiens
gctctgcctctttgctgcgtca

SEQ ID NO: 8132531 - DNA, 17 bp, Homo sapiens
gctctgcctctcccacc

SEQ ID NO: 8132532 - DNA, 17 bp, Homo sapiens
gctctgccccagcctct

SEQ ID NO: 8132533 - DNA, 22 bp, Homo sapiens
gctctgccccaggaactcagcc

SEQ ID NO: 8132534 - DNA, 22 bp, Homo sapiens
gctctgccctgggccgttgtaa

SEQ ID NO: 8132535 - DNA, 18 bp, Homo sapiens
gctctgcccaggctgccc

SEQ ID NO: 8132536 - DNA, 22 bp, Homo sapiens
gctctgcccaggaccgtccttg

SEQ ID NO: 8132537 - DNA, 22 bp, Homo sapiens
gctctgcccagtgccctgagac

SEQ ID NO: 8132538 - DNA, 22 bp, Homo sapiens
gctctgctgagatatctgggag

SEQ ID NO: 8132539 - DNA, 22 bp, Homo sapiens
gctctgctgcttactagatggt

SEQ ID NO: 8132540 - DNA, 22 bp, Homo sapiens
gctctgctgaagccccttgcat

SEQ ID NO: 8132541 - DNA, 22 bp, Homo sapiens
gctctgctgacagctgggacag

SEQ ID NO: 8132542 - DNA, 22 bp, Homo sapiens
gcctcaggccgccctgctgctc

SEQ ID NO: 8132543 - DNA, 22 bp, Homo sapiens
gcctcaggcctatagctgctgt

SEQ ID NO: 8132544 - DNA, 22 bp, Homo sapiens
gcctcagggataggatgagcat

SEQ ID NO: 8132545 - DNA, 22 bp, Homo sapiens
gcctggggtctctgactcacag

SEQ ID NO: 8132546 - DNA, 22 bp, Homo sapiens
gcctggggtcccttgttggcac

SEQ ID NO: 8132547 - DNA, 22 bp, Homo sapiens
gcctggggggcatgtcataata

SEQ ID NO: 8132548 - DNA, 22 bp, Homo sapiens
gcctggggcatgcagctgatac

SEQ ID NO: 8132549 - DNA, 22 bp, Homo sapiens
gcctggggccagcttgggctga

SEQ ID NO: 8132550 - DNA, 22 bp, Homo sapiens
gcctggggaacttgatcctgtc

SEQ ID NO: 8132551 - DNA, 22 bp, Homo sapiens
gcgggccggttcgatccgtatg

SEQ ID NO: 8132552 - DNA, 22 bp, Homo sapiens
gcgggcgggggttcccaggtct

SEQ ID NO: 8132553 - DNA, 18 bp, Homo sapiens
gcgggcggtgcagtgggc

SEQ ID NO: 8132554 - DNA, 22 bp, Homo sapiens
gcggcccgggtccccagcagca

SEQ ID NO: 8132555 - DNA, 22 bp, Homo sapiens
gcggcccgagcaggacgggtgg

SEQ ID NO: 8132556 - DNA, 22 bp, Homo sapiens
gcgctgcctctgctctccccac

SEQ ID NO: 8132557 - DNA, 22 bp, Homo sapiens
gcgctcctcccggccctggtgg

SEQ ID NO: 8132558 - DNA, 22 bp, Homo sapiens
gcgctctgtctcaggggtccag

SEQ ID NO: 8132559 - DNA, 22 bp, Homo sapiens
gcgcggggtacacgcggtggcc

SEQ ID NO: 8132560 - DNA, 22 bp, Homo sapiens
gcggaggaaactgaggcaagag

SEQ ID NO: 8132561 - DNA, 22 bp, Homo sapiens
gcggcagaggtgttgcgagcga

SEQ ID NO: 8132562 - DNA, 22 bp, Homo sapiens
gcggagggcgagcccgcggagc

SEQ ID NO: 8132563 - DNA, 22 bp, Homo sapiens
gcgcctgccaccatgccaggct

SEQ ID NO: 8132564 - DNA, 22 bp, Homo sapiens
gcgcgctgagtgtccgttgggg

SEQ ID NO: 8132565 - DNA, 22 bp, Homo sapiens
gccttgccaaggggcagcagag

SEQ ID NO: 8132566 - DNA, 22 bp, Homo sapiens
gcgggggcggcgcagacctcag

SEQ ID NO: 8132567 - DNA, 22 bp, Homo sapiens
gcgggggcagactgggcagttc

SEQ ID NO: 8132568 - DNA, 22 bp, Homo sapiens
gcggggcctgactctgacccgc

SEQ ID NO: 8132569 - DNA, 22 bp, Homo sapiens
gcggggcccggacccagcctct

SEQ ID NO: 8132570 - DNA, 22 bp, Homo sapiens
gcggggccatgtccaacggcct

SEQ ID NO: 8132571 - DNA, 22 bp, Homo sapiens
gcggggcccccggccgagctct

SEQ ID NO: 8132572 - DNA, 22 bp, Homo sapiens
gctcacaggtctgtggctattg

SEQ ID NO: 8132573 - DNA, 22 bp, Homo sapiens
gctcaggcccagcggctggtgt

SEQ ID NO: 8132574 - DNA, 23 bp, Homo sapiens
gctcaggcatcattcttcctggc

SEQ ID NO: 8132575 - DNA, 22 bp, Homo sapiens
gctcacagttctatttttcatg

SEQ ID NO: 8132576 - DNA, 22 bp, Homo sapiens
gcacagccagcatctgagggat

SEQ ID NO: 8132577 - DNA, 22 bp, Homo sapiens
gaggggtgtggagccatcagtt

SEQ ID NO: 8132578 - DNA, 22 bp, Homo sapiens
gaggggtcacatgggctggctt

SEQ ID NO: 8132579 - DNA, 22 bp, Homo sapiens
gaggggctggggttgactccaa

SEQ ID NO: 8132580 - DNA, 21 bp, Homo sapiens
gcagaggaatggtatacataa

SEQ ID NO: 8132581 - DNA, 21 bp, Homo sapiens
gcacttggaaacttcaactag

SEQ ID NO: 8132582 - DNA, 22 bp, Homo sapiens
gcagaggagcaagctggacacc

SEQ ID NO: 8132583 - DNA, 22 bp, Homo sapiens
gcagaggagatgaagatacttt

SEQ ID NO: 8132584 - DNA, 22 bp, Homo sapiens
gcagaggacacaggagggcaag

SEQ ID NO: 8132585 - DNA, 22 bp, Homo sapiens
gcagaggacagggatttagatt

SEQ ID NO: 8132586 - DNA, 22 bp, Homo sapiens
gcagaggactcaatcaaggtat

SEQ ID NO: 8132587 - DNA, 22 bp, Homo sapiens
gcacttaactggaaaagaattt

SEQ ID NO: 8132588 - DNA, 23 bp, Homo sapiens
gcactgccatgtgctctgcaggc

SEQ ID NO: 8132589 - DNA, 22 bp, Homo sapiens
gcagcaggagagtttgtcctgc

SEQ ID NO: 8132590 - DNA, 22 bp, Homo sapiens
gcagcaggtctgtcaatgtcat

SEQ ID NO: 8132591 - DNA, 23 bp, Homo sapiens
gcagaggagcaagctggacacca

SEQ ID NO: 8132592 - DNA, 22 bp, Homo sapiens
gcagaggagcaagttgctacag

SEQ ID NO: 8132593 - DNA, 22 bp, Homo sapiens
gcaggctgaaactcggggtcta

SEQ ID NO: 8132594 - DNA, 19 bp, Homo sapiens
gcaggcctcttgggaatta

SEQ ID NO: 8132595 - DNA, 20 bp, Homo sapiens
gcagggcgacacgggggagg

SEQ ID NO: 8132596 - DNA, 22 bp, Homo sapiens
gcagggccttagcagcggctgc

SEQ ID NO: 8132597 - DNA, 22 bp, Homo sapiens
gcagggcgcgtttgagcgggct

SEQ ID NO: 8132598 - DNA, 22 bp, Homo sapiens
gcagggcggcccagagcaggcc

SEQ ID NO: 8132599 - DNA, 22 bp, Homo sapiens
gcagggctaatggggcaagtag

SEQ ID NO: 8132600 - DNA, 22 bp, Homo sapiens
gcaggaggttgagccaggactg

SEQ ID NO: 8132601 - DNA, 22 bp, Homo sapiens
gcaggagctggaaagtgatgtt

SEQ ID NO: 8132602 - DNA, 22 bp, Homo sapiens
gcataaaggactataaggatca

SEQ ID NO: 8132603 - DNA, 22 bp, Homo sapiens
gcatccttttttcctgccctgc

SEQ ID NO: 8132604 - DNA, 22 bp, Homo sapiens
gcatccttgggcccagctcctg

SEQ ID NO: 8132605 - DNA, 22 bp, Homo sapiens
gcatttggaattgtgtatagaa

SEQ ID NO: 8132606 - DNA, 19 bp, Homo sapiens
gcagtctgttgaagggcag

SEQ ID NO: 8132607 - DNA, 22 bp, Homo sapiens
gcagggctcattgccaggcatt

SEQ ID NO: 8132608 - DNA, 22 bp, Homo sapiens
gccagaggaacgctgcgcgccc

SEQ ID NO: 8132609 - DNA, 22 bp, Homo sapiens
gccagcagtcctgctgtgtgcc

SEQ ID NO: 8132610 - DNA, 22 bp, Homo sapiens
gccaaaactcccatattttaat

SEQ ID NO: 8132611 - DNA, 22 bp, Homo sapiens
gcatttttgatcccactaggat

SEQ ID NO: 8132612 - DNA, 22 bp, Homo sapiens
gcccatgcccctccttctggca

SEQ ID NO: 8132613 - DNA, 23 bp, Homo sapiens
gcccatgctgttgggcccgagca

SEQ ID NO: 8132614 - DNA, 22 bp, Homo sapiens
gcccagggcgatggtcggggcc

SEQ ID NO: 8132615 - DNA, 22 bp, Homo sapiens
gcccagggctgcaagtggacgc

SEQ ID NO: 8132616 - DNA, 22 bp, Homo sapiens
gcccaggctggagtgcagtggt

SEQ ID NO: 8132617 - DNA, 22 bp, Homo sapiens
gcctcagctcccagcccaggct

SEQ ID NO: 8132618 - DNA, 22 bp, Homo sapiens
gcctcagctgttgcaggggccc

SEQ ID NO: 8132619 - DNA, 22 bp, Homo sapiens
gcctcaggactggcatactcat

SEQ ID NO: 8132620 - DNA, 22 bp, Homo sapiens
gcctcagccggcggacgccagg

SEQ ID NO: 8132621 - DNA, 20 bp, Homo sapiens
gcctcagccaacccatgggg

SEQ ID NO: 8132622 - DNA, 22 bp, Homo sapiens
gccctgacactttgcagctgag

SEQ ID NO: 8132623 - DNA, 22 bp, Homo sapiens
gccctgaccttcactgactctc

SEQ ID NO: 8132624 - DNA, 22 bp, Homo sapiens
gccctgagaagaagtcggaggg

SEQ ID NO: 8132625 - DNA, 22 bp, Homo sapiens
gccaggacctcagatgcagggc

SEQ ID NO: 8132626 - DNA, 22 bp, Homo sapiens
gcccactgagtgactccctcag

SEQ ID NO: 8132627 - DNA, 22 bp, Homo sapiens
gcccactctggagcctgttccc

SEQ ID NO: 8132628 - DNA, 22 bp, Homo sapiens
gcccactggctggagtgctggt

SEQ ID NO: 8132629 - DNA, 19 bp, Homo sapiens
gcccactgtctttgccaac

SEQ ID NO: 8132630 - DNA, 18 bp, Homo sapiens
gcccagaggtctgggccc

SEQ ID NO: 8132631 - DNA, 22 bp, Homo sapiens
gcccacagtacgaggctcaggc

SEQ ID NO: 8132632 - DNA, 22 bp, Homo sapiens
ggtgcagggagaggcaggcccc

SEQ ID NO: 8132633 - DNA, 22 bp, Homo sapiens
ggtgggcaacatttggcctgag

SEQ ID NO: 8132634 - DNA, 22 bp, Homo sapiens
ggtgggaggcaggctgctccca

SEQ ID NO: 8132635 - DNA, 22 bp, Homo sapiens
ggtgccagagtggcccaggggc

SEQ ID NO: 8132636 - DNA, 22 bp, Homo sapiens
ggtgccagatgaggcccgcgat

SEQ ID NO: 8132637 - DNA, 22 bp, Homo sapiens
ggtgccagcctagtgcagtggt

SEQ ID NO: 8132638 - DNA, 22 bp, Homo sapiens
ggtgcgggccgcctgcccttgg

SEQ ID NO: 8132639 - DNA, 21 bp, Homo sapiens
ggtcagggggtgcctccaggt

SEQ ID NO: 8132640 - DNA, 22 bp, Homo sapiens
ggtacagacagggctgcctggg

SEQ ID NO: 8132641 - DNA, 22 bp, Homo sapiens
gggtcaggctagcccagacttc

SEQ ID NO: 8132642 - DNA, 22 bp, Homo sapiens
gggtccagagttttcccgccct

SEQ ID NO: 8132643 - DNA, 22 bp, Homo sapiens
gggggaagactgggctagtgat

SEQ ID NO: 8132644 - DNA, 22 bp, Homo sapiens
ggggcaggagcccttcttcagc

SEQ ID NO: 8132645 - DNA, 22 bp, Homo sapiens
ggggcagctcccgagggcagga

SEQ ID NO: 8132646 - DNA, 22 bp, Homo sapiens
ggggctggtggtggtttctcca

SEQ ID NO: 8132647 - DNA, 22 bp, Homo sapiens
ggggcttctttctgccaccgac

SEQ ID NO: 8132648 - DNA, 22 bp, Homo sapiens
ggggcttccagcgcccgccggt

SEQ ID NO: 8132649 - DNA, 22 bp, Homo sapiens
gggggcgggagacagcagtgac

SEQ ID NO: 8132650 - DNA, 22 bp, Homo sapiens
gggggccagtgtctcttccttg

SEQ ID NO: 8132651 - DNA, 22 bp, Homo sapiens
gggggccatcttcaaggatgtg

SEQ ID NO: 8132652 - DNA, 22 bp, Homo sapiens
gggggagagacgagcggctctg

SEQ ID NO: 8132653 - DNA, 20 bp, Homo sapiens
gggggccagcagcagacgcc

SEQ ID NO: 8132654 - DNA, 22 bp, Homo sapiens
gggggccagtcatctcccaaga

SEQ ID NO: 8132655 - DNA, 22 bp, Homo sapiens
gggggcagtaaggatatggaaa

SEQ ID NO: 8132656 - DNA, 22 bp, Homo sapiens
ggggcagaaagcccacagagtg

SEQ ID NO: 8132657 - DNA, 22 bp, Homo sapiens
ggggatggaatgtagtagtgat

SEQ ID NO: 8132658 - DNA, 22 bp, Homo sapiens
ggggatggtagaccggtgacgt

SEQ ID NO: 8132659 - DNA, 22 bp, Homo sapiens
ggggatggaggcgtgtggtcct

SEQ ID NO: 8132660 - DNA, 22 bp, Homo sapiens
ggggatggattccgggtccctg

SEQ ID NO: 8132661 - DNA, 22 bp, Homo sapiens
gggctgggatggcttgaagatt

SEQ ID NO: 8132662 - DNA, 22 bp, Homo sapiens
gggctgggattgcttgctgtga

SEQ ID NO: 8132663 - DNA, 22 bp, Homo sapiens
gggctgggcatggtgttccctc

SEQ ID NO: 8132664 - DNA, 22 bp, Homo sapiens
gggctctctttttggcctgccc

SEQ ID NO: 8132665 - DNA, 22 bp, Homo sapiens
gggctcctgcctcctggcacct

SEQ ID NO: 8132666 - DNA, 22 bp, Homo sapiens
gggctcctcctctgactgtggc

SEQ ID NO: 8132667 - DNA, 19 bp, Homo sapiens
gggctccttgggcctctct

SEQ ID NO: 8132668 - DNA, 22 bp, Homo sapiens
gggctcggcatctgtggactct

SEQ ID NO: 8132669 - DNA, 22 bp, Homo sapiens
gggctctcccacaacgtgccag

SEQ ID NO: 8132670 - DNA, 21 bp, Homo sapiens
gggctctcctgaggccatgaa

SEQ ID NO: 8132671 - DNA, 22 bp, Homo sapiens
gggctctcaaggcagggcccca

SEQ ID NO: 8132672 - DNA, 19 bp, Homo sapiens
gggcatcaaagtgctggtg

SEQ ID NO: 8132673 - DNA, 23 bp, Homo sapiens
gggcagttatgttgtccttggct

SEQ ID NO: 8132674 - DNA, 22 bp, Homo sapiens
gggcatgacttttggagtggga

SEQ ID NO: 8132675 - DNA, 22 bp, Homo sapiens
gggcctggcatgcagccccgtt

SEQ ID NO: 8132676 - DNA, 22 bp, Homo sapiens
gggcctgccattgctgccccag

SEQ ID NO: 8132677 - DNA, 22 bp, Homo sapiens
gtgagttaacgccatatatatg

SEQ ID NO: 8132678 - DNA, 22 bp, Homo sapiens
gtgagttactctggttctcatt

SEQ ID NO: 8132679 - DNA, 22 bp, Homo sapiens
gtgagttattatttatgtaaac

SEQ ID NO: 8132680 - DNA, 22 bp, Homo sapiens
gtcttctttaacctactaaagc

SEQ ID NO: 8132681 - DNA, 22 bp, Homo sapiens
gtctggggtgaggcccgggatt

SEQ ID NO: 8132682 - DNA, 22 bp, Homo sapiens
gtctcctgaggcatccattgaa

SEQ ID NO: 8132683 - DNA, 22 bp, Homo sapiens
gtctctatcatagctgaaccct

SEQ ID NO: 8132684 - DNA, 22 bp, Homo sapiens
gtgcaatgaaactgttttgtgg

SEQ ID NO: 8132685 - DNA, 22 bp, Homo sapiens
gtgcctccatcagtgcctccaa

SEQ ID NO: 8132686 - DNA, 22 bp, Homo sapiens
gtgcctcccgggaccatgcact

SEQ ID NO: 8132687 - DNA, 22 bp, Homo sapiens
gtgcctcccggggctcttcctt

SEQ ID NO: 8132688 - DNA, 21 bp, Homo sapiens
gtgccctgttcccacatgccc

SEQ ID NO: 8132689 - DNA, 22 bp, Homo sapiens
gtgctgggccctgagaccaggg

SEQ ID NO: 8132690 - DNA, 22 bp, Homo sapiens
gtctccggccgccctggtgctg

SEQ ID NO: 8132691 - DNA, 22 bp, Homo sapiens
gtcctctgagggggctgcacgc

SEQ ID NO: 8132692 - DNA, 22 bp, Homo sapiens
gtcataaaaggaccacctattg

SEQ ID NO: 8132693 - DNA, 22 bp, Homo sapiens
gtcataaaatttgtggattaga

SEQ ID NO: 8132694 - DNA, 22 bp, Homo sapiens
gtcattcaaactgtatcacttg

SEQ ID NO: 8132695 - DNA, 22 bp, Homo sapiens
gtcagtggtgcttaaagtttca

SEQ ID NO: 8132696 - DNA, 22 bp, Homo sapiens
gtcacattcatgcagaatcaaa

SEQ ID NO: 8132697 - DNA, 22 bp, Homo sapiens
gtcacagtggggtcacagtgtg

SEQ ID NO: 8132698 - DNA, 22 bp, Homo sapiens
gtcacagtgctcccaaagtttg

SEQ ID NO: 8132699 - DNA, 22 bp, Homo sapiens
gtcacagtgtcctacaggttga

SEQ ID NO: 8132700 - DNA, 22 bp, Homo sapiens
gtcacagtgtatctcttcagct

SEQ ID NO: 8132701 - DNA, 23 bp, Homo sapiens
gtcacagtgggtggtgcctacat

SEQ ID NO: 8132702 - DNA, 22 bp, Homo sapiens
gtcacagtgcctgccactcaga

SEQ ID NO: 8132703 - DNA, 22 bp, Homo sapiens
gtcacagtgcctgaagctctga

SEQ ID NO: 8132704 - DNA, 22 bp, Homo sapiens
gtcacagtgccctggtggtgtt

SEQ ID NO: 8132705 - DNA, 22 bp, Homo sapiens
gtcacagtgacagagatgttag

SEQ ID NO: 8132706 - DNA, 22 bp, Homo sapiens
gtcacagtcaaggccatgggca

SEQ ID NO: 8132707 - DNA, 22 bp, Homo sapiens
gtcacagtatcatgtttgaatg

SEQ ID NO: 8132708 - DNA, 22 bp, Homo sapiens
gtaaatcagtgtcattttagaa

SEQ ID NO: 8132709 - DNA, 22 bp, Homo sapiens
ggtgggcagctcttggcaggca

SEQ ID NO: 8132710 - DNA, 22 bp, Homo sapiens
ggtgggcacattcagtctctgt

SEQ ID NO: 8132711 - DNA, 21 bp, Homo sapiens
ggtgggcacaggagagcagag

SEQ ID NO: 8132712 - DNA, 22 bp, Homo sapiens
ggtgggcacccgagactggatc

SEQ ID NO: 8132713 - DNA, 22 bp, Homo sapiens
gtaaattatttcaagatcatct

SEQ ID NO: 8132714 - DNA, 22 bp, Homo sapiens
gtaaatcatggtcagaataaat

SEQ ID NO: 8132715 - DNA, 22 bp, Homo sapiens
gtcaacagagacagagacactg

SEQ ID NO: 8132716 - DNA, 22 bp, Homo sapiens
gtcaacagtattaggacatttg

SEQ ID NO: 8132717 - DNA, 22 bp, Homo sapiens
ggagttgattttggatatatta

SEQ ID NO: 8132718 - DNA, 22 bp, Homo sapiens
ggagcagagctgggcttggctg

SEQ ID NO: 8132719 - DNA, 22 bp, Homo sapiens
ggatgctgactttggagcatgg

SEQ ID NO: 8132720 - DNA, 18 bp, Homo sapiens
ggatgctgtgtgctcctt

SEQ ID NO: 8132721 - DNA, 22 bp, Homo sapiens
ggcactgccccctgcccaggac

SEQ ID NO: 8132722 - DNA, 21 bp, Homo sapiens
ggcactgctgggccatctgct

SEQ ID NO: 8132723 - DNA, 22 bp, Homo sapiens
ggcagcagcaaggttggagctg

SEQ ID NO: 8132724 - DNA, 22 bp, Homo sapiens
ggcagctgtttgtcctcctgtt

SEQ ID NO: 8132725 - DNA, 22 bp, Homo sapiens
ggcgggtgataggatgagcagg

SEQ ID NO: 8132726 - DNA, 22 bp, Homo sapiens
ggcgggggtccaggagcctgca

SEQ ID NO: 8132727 - DNA, 19 bp, Homo sapiens
ggcgggtggactggagccc

SEQ ID NO: 8132728 - DNA, 22 bp, Homo sapiens
ggcgggtggcgaggcttctcgg

SEQ ID NO: 8132729 - DNA, 18 bp, Homo sapiens
ggcgggtgttttattcac

SEQ ID NO: 8132730 - DNA, 22 bp, Homo sapiens
ggcgggtgtaagtaggacagcg

SEQ ID NO: 8132731 - DNA, 22 bp, Homo sapiens
ggcctgcctcacagtcagcacc

SEQ ID NO: 8132732 - DNA, 22 bp, Homo sapiens
ggccaggccaagagggttggaa

SEQ ID NO: 8132733 - DNA, 22 bp, Homo sapiens
ggccctgctcaggctgcgatga

SEQ ID NO: 8132734 - DNA, 22 bp, Homo sapiens
ggccctgctgaagccgggtcta

SEQ ID NO: 8132735 - DNA, 22 bp, Homo sapiens
ggccctgctgagtggagtggag

SEQ ID NO: 8132736 - DNA, 22 bp, Homo sapiens
ggcctcacccatcggtgccttt

SEQ ID NO: 8132737 - DNA, 23 bp, Homo sapiens
ggcctaacagaggcagggctgag

SEQ ID NO: 8132738 - DNA, 22 bp, Homo sapiens
ggccctgggcagaggagtgggc

SEQ ID NO: 8132739 - DNA, 22 bp, Homo sapiens
ggccctgggatgctcagcagtg

SEQ ID NO: 8132740 - DNA, 22 bp, Homo sapiens
ggccagcttctctgctgcctgt

SEQ ID NO: 8132741 - DNA, 19 bp, Homo sapiens
ggccagctgtctcctgcta

SEQ ID NO: 8132742 - DNA, 22 bp, Homo sapiens
ggccagctgtggggccgagcct

SEQ ID NO: 8132743 - DNA, 22 bp, Homo sapiens
ggcagtggtgggaggctcgctc

SEQ ID NO: 8132744 - DNA, 22 bp, Homo sapiens
ggcaggtgacctggcctcccag

SEQ ID NO: 8132745 - DNA, 22 bp, Homo sapiens
ggcagggtggccctccagtgag

SEQ ID NO: 8132746 - DNA, 22 bp, Homo sapiens
gggcactcctgatcgggacttg

SEQ ID NO: 8132747 - DNA, 22 bp, Homo sapiens
gggcacaggagaaggatctggc

SEQ ID NO: 8132748 - DNA, 22 bp, Homo sapiens
gggcagtgaatattggtgggaa

SEQ ID NO: 8132749 - DNA, 21 bp, Homo sapiens
gggcagtctggtggctatggc

SEQ ID NO: 8132750 - DNA, 22 bp, Homo sapiens
gggcagtcacagtgctggagca

SEQ ID NO: 8132751 - DNA, 22 bp, Homo sapiens
gggcagtgacaaaggggatgaa

SEQ ID NO: 8132752 - DNA, 22 bp, Homo sapiens
gggcaggttggcatcccgggca

SEQ ID NO: 8132753 - DNA, 18 bp, Homo sapiens
gggcagtaagtgtggggt

SEQ ID NO: 8132754 - DNA, 23 bp, Homo sapiens
gggcaggtttttataggcttcag

SEQ ID NO: 8132755 - DNA, 22 bp, Homo sapiens
gggcaggttattggagtaggga

SEQ ID NO: 8132756 - DNA, 18 bp, Homo sapiens
gggcactggggactggag

SEQ ID NO: 8132757 - DNA, 22 bp, Homo sapiens
gggcactggcagtcggggacgc

SEQ ID NO: 8132758 - DNA, 22 bp, Homo sapiens
gggaggtgatggcaagcagcgg

SEQ ID NO: 8132759 - DNA, 22 bp, Homo sapiens
gggaggtgaaaggttgctgcag

SEQ ID NO: 8132760 - DNA, 22 bp, Homo sapiens
gggaggtgttctgccaacgcgg

SEQ ID NO: 8132761 - DNA, 22 bp, Homo sapiens
gggagctggagttgtgttgcct

SEQ ID NO: 8132762 - DNA, 22 bp, Homo sapiens
gggaaggctgcctgagggatgg

SEQ ID NO: 8132763 - DNA, 22 bp, Homo sapiens
gggaaggccttgtcagcggatt

SEQ ID NO: 8132764 - DNA, 22 bp, Homo sapiens
gggagctgacctgcaggttccc

SEQ ID NO: 8132765 - DNA, 22 bp, Homo sapiens
gggagctgagctggaagagaat

SEQ ID NO: 8132766 - DNA, 22 bp, Homo sapiens
gggagctgaggagccccgtcgg

SEQ ID NO: 8132767 - DNA, 22 bp, Homo sapiens
ggctccccaggtccaggagctg

SEQ ID NO: 8132768 - DNA, 22 bp, Homo sapiens
ggctccctggaaatcccgaggc

SEQ ID NO: 8132769 - DNA, 23 bp, Homo sapiens
ggctccaggcctgacgggcgcgg

SEQ ID NO: 8132770 - DNA, 22 bp, Homo sapiens
ggctagcttagagtcatgctag

SEQ ID NO: 8132771 - DNA, 23 bp, Homo sapiens
ggctagagtggaggggaactgca

SEQ ID NO: 8132772 - DNA, 22 bp, Homo sapiens
ggcgtgggcgaggtgctctatc

SEQ ID NO: 8132773 - DNA, 22 bp, Homo sapiens
ggcgtgggaagtggggcttctg

SEQ ID NO: 8132774 - DNA, 22 bp, Homo sapiens
ggcgtggggccttctgcccgct

SEQ ID NO: 8132775 - DNA, 22 bp, Homo sapiens
ggctctgggccagagttggctt

SEQ ID NO: 8132776 - DNA, 22 bp, Homo sapiens
ggctgggtttgactcctggctt

SEQ ID NO: 8132777 - DNA, 19 bp, Homo sapiens
ggctggagaaaggaatcag

SEQ ID NO: 8132778 - DNA, 22 bp, Homo sapiens
ggctgctggggacgtgggagag

SEQ ID NO: 8132779 - DNA, 22 bp, Homo sapiens
ggctgctgtttcagagactgtt

SEQ ID NO: 8132780 - DNA, 20 bp, Homo sapiens
ggctgctgtgggcagagagg

SEQ ID NO: 8132781 - DNA, 20 bp, Homo sapiens
ggctgctgtgggcagagagg

SEQ ID NO: 8132782 - DNA, 22 bp, Homo sapiens
ggctgctgtttcagagactgtt

SEQ ID NO: 8132783 - DNA, 22 bp, Homo sapiens
ctcaggcctgagtggcagtccc

SEQ ID NO: 8132784 - DNA, 18 bp, Homo sapiens
ctcaggcctttccctgtg

SEQ ID NO: 8132785 - DNA, 23 bp, Homo sapiens
ttgcacagtttcggaaactgagg

SEQ ID NO: 8132786 - DNA, 22 bp, Homo sapiens
ttgcacagtttgaagatgactc

SEQ ID NO: 8132787 - DNA, 22 bp, Homo sapiens
ttgcacagtttgaagatgactc

SEQ ID NO: 8132788 - DNA, 22 bp, Homo sapiens
ttgcactccagtctgggaacaa

SEQ ID NO: 8132789 - DNA, 22 bp, Homo sapiens
ttgctgtagttcaatatgtggt

SEQ ID NO: 8132790 - DNA, 22 bp, Homo sapiens
ttgctggtaaagtctttatcgg

SEQ ID NO: 8132791 - DNA, 22 bp, Homo sapiens
ttgctgatttccccttgagtgt

SEQ ID NO: 8132792 - DNA, 22 bp, Homo sapiens
ctcaggccattcttccagctgc

SEQ ID NO: 8132793 - DNA, 22 bp, Homo sapiens
ctcaggccaataagctccagcc

SEQ ID NO: 8132794 - DNA, 22 bp, Homo sapiens
ctcaggccaggtttctcccaca

SEQ ID NO: 8132795 - DNA, 22 bp, Homo sapiens
ctcagccccaattctccccatt

SEQ ID NO: 8132796 - DNA, 22 bp, Homo sapiens
ctcagccaggagagtgttcaca

SEQ ID NO: 8132797 - DNA, 22 bp, Homo sapiens
ctcagaaacggagctgccattt

SEQ ID NO: 8132798 - DNA, 23 bp, Homo sapiens
ttcttcattttcagagttgagca

SEQ ID NO: 8132799 - DNA, 22 bp, Homo sapiens
ttcttcatgctgttgctgcttg

SEQ ID NO: 8132800 - DNA, 22 bp, Homo sapiens
ttcttcatctgtaagataagca

SEQ ID NO: 8132801 - DNA, 21 bp, Homo sapiens
ttcttcatgatgattaatggc

SEQ ID NO: 8132802 - DNA, 22 bp, Homo sapiens
ttcttaatcccacaaatcttca

SEQ ID NO: 8132803 - DNA, 22 bp, Homo sapiens
ttcttaatacctattttctacc

SEQ ID NO: 8132804 - DNA, 22 bp, Homo sapiens
ttctgaaatgagatataaggta

SEQ ID NO: 8132805 - DNA, 22 bp, Homo sapiens
ttctgaaaattgggtcatactt

SEQ ID NO: 8132806 - DNA, 22 bp, Homo sapiens
ttctacatgagaaaatgtattt

SEQ ID NO: 8132807 - DNA, 22 bp, Homo sapiens
ttctacatgagaaaatgtattt

SEQ ID NO: 8132808 - DNA, 22 bp, Homo sapiens
ctaaatgtcagagtagcttgca

SEQ ID NO: 8132809 - DNA, 22 bp, Homo sapiens
ttctcctgcccttggacttcca

SEQ ID NO: 8132810 - DNA, 22 bp, Homo sapiens
ttctcctggggccgtgatgtga

SEQ ID NO: 8132811 - DNA, 22 bp, Homo sapiens
ttctccttgaaaagctgcatct

SEQ ID NO: 8132812 - DNA, 22 bp, Homo sapiens
ttctccttgttcccttcaattg

SEQ ID NO: 8132813 - DNA, 22 bp, Homo sapiens
cgtcctgctcggcgcgcctcgg

SEQ ID NO: 8132814 - DNA, 22 bp, Homo sapiens
cgtctctggcccggcccctggg

SEQ ID NO: 8132815 - DNA, 22 bp, Homo sapiens
ttcctctggaggctctaggaga

SEQ ID NO: 8132816 - DNA, 22 bp, Homo sapiens
ttcctccttgtcctagttactg

SEQ ID NO: 8132817 - DNA, 22 bp, Homo sapiens
ttcctccttcccattcctgggg

SEQ ID NO: 8132818 - DNA, 17 bp, Homo sapiens
ttcctctcacatttttt

SEQ ID NO: 8132819 - DNA, 22 bp, Homo sapiens
ttcctctcctcacatgagtcac

SEQ ID NO: 8132820 - DNA, 22 bp, Homo sapiens
ttcctcctacgcttatcacttt

SEQ ID NO: 8132821 - DNA, 17 bp, Homo sapiens
ttcctcctcaccatgtt

SEQ ID NO: 8132822 - DNA, 21 bp, Homo sapiens
ttcctcctctggagaagaaga

SEQ ID NO: 8132823 - DNA, 22 bp, Homo sapiens
ttcctcctctgtaaaacgggca

SEQ ID NO: 8132824 - DNA, 22 bp, Homo sapiens
cgtctggcttctccacggtaaa

SEQ ID NO: 8132825 - DNA, 22 bp, Homo sapiens
cggctgggttcggctgcaggcc

SEQ ID NO: 8132826 - DNA, 22 bp, Homo sapiens
cggctgggtagaggtgccgggt

SEQ ID NO: 8132827 - DNA, 22 bp, Homo sapiens
tgttttcatttgatgtaacaaa

SEQ ID NO: 8132828 - DNA, 17 bp, Homo sapiens
tgttttcattcattgct

SEQ ID NO: 8132829 - DNA, 23 bp, Homo sapiens
cctggggcacttgagtcctcatc

SEQ ID NO: 8132830 - DNA, 22 bp, Homo sapiens
cctggggccccgagccagaagc

SEQ ID NO: 8132831 - DNA, 22 bp, Homo sapiens
tgtttctagagaaaatatttac

SEQ ID NO: 8132832 - DNA, 23 bp, Homo sapiens
cctgctcaggcgtgtgccctgct

SEQ ID NO: 8132833 - DNA, 22 bp, Homo sapiens
cctgctcagctgtcctcacgct

SEQ ID NO: 8132834 - DNA, 22 bp, Homo sapiens
cctgctcagccccagctcaccc

SEQ ID NO: 8132835 - DNA, 22 bp, Homo sapiens
cctgcgggctgtgctgaagcct

SEQ ID NO: 8132836 - DNA, 22 bp, Homo sapiens
cctgcgggctggtaagaggctt

SEQ ID NO: 8132837 - DNA, 23 bp, Homo sapiens
tgttgctgcctttctaggatcag

SEQ ID NO: 8132838 - DNA, 22 bp, Homo sapiens
cctgctcctatctgggctcatt

SEQ ID NO: 8132839 - DNA, 22 bp, Homo sapiens
cctgctccatgctcaccatcag

SEQ ID NO: 8132840 - DNA, 22 bp, Homo sapiens
ttaaaatctaaagcagttgtct

SEQ ID NO: 8132841 - DNA, 22 bp, Homo sapiens
ttaatagatttgattttaaagg

SEQ ID NO: 8132842 - DNA, 18 bp, Homo sapiens
cctgtggctcagcccaca

SEQ ID NO: 8132843 - DNA, 22 bp, Homo sapiens
ttaatgatgaagtctggctgta

SEQ ID NO: 8132844 - DNA, 22 bp, Homo sapiens
ttaatgatacctatgttaattt

SEQ ID NO: 8132845 - DNA, 22 bp, Homo sapiens
ttatgtaatttgtttgctcttc

SEQ ID NO: 8132846 - DNA, 22 bp, Homo sapiens
ttatgtacaatgttaatgtaaa

SEQ ID NO: 8132847 - DNA, 22 bp, Homo sapiens
cgcacattagaagtaactaatg

SEQ ID NO: 8132848 - DNA, 22 bp, Homo sapiens
cgcagaagaggttgtctagtcc

SEQ ID NO: 8132849 - DNA, 22 bp, Homo sapiens
cgcagagggagccgcgggctgc

SEQ ID NO: 8132850 - DNA, 17 bp, Homo sapiens
ttattttttgggctgag

SEQ ID NO: 8132851 - DNA, 22 bp, Homo sapiens
ttatttttaaaagttcacacag

SEQ ID NO: 8132852 - DNA, 17 bp, Homo sapiens
ttatctactgctactgt

SEQ ID NO: 8132853 - DNA, 22 bp, Homo sapiens
ccttggggaactggacgtgctg

SEQ ID NO: 8132854 - DNA, 22 bp, Homo sapiens
ccttgggagaaattgcagagtc

SEQ ID NO: 8132855 - DNA, 22 bp, Homo sapiens
ttaccgagaacatgactggaat

SEQ ID NO: 8132856 - DNA, 22 bp, Homo sapiens
ctctctggaattaaagcccaat

SEQ ID NO: 8132857 - DNA, 22 bp, Homo sapiens
ctctattctaatggattctggg

SEQ ID NO: 8132858 - DNA, 22 bp, Homo sapiens
tttctgatatactgtagaatcc

SEQ ID NO: 8132859 - DNA, 22 bp, Homo sapiens
tttctgcaaaataaatagtgac

SEQ ID NO: 8132860 - DNA, 21 bp, Homo sapiens
tttctgcaatgcacgttgagg

SEQ ID NO: 8132861 - DNA, 22 bp, Homo sapiens
tttctgcacatttctaaagttg

SEQ ID NO: 8132862 - DNA, 22 bp, Homo sapiens
tttctgcagcagactcagtgtg

SEQ ID NO: 8132863 - DNA, 20 bp, Homo sapiens
tttctgcagggagctgggct

SEQ ID NO: 8132864 - DNA, 22 bp, Homo sapiens
tttctgcagtctctcagaagcc

SEQ ID NO: 8132865 - DNA, 22 bp, Homo sapiens
tttgaagggcacgacaatagtt

SEQ ID NO: 8132866 - DNA, 20 bp, Homo sapiens
ctctgctttaggagagtcag

SEQ ID NO: 8132867 - DNA, 22 bp, Homo sapiens
ctctggagcgctgcttcccgcg

SEQ ID NO: 8132868 - DNA, 22 bp, Homo sapiens
tttgaataaacggttaatgttc

SEQ ID NO: 8132869 - DNA, 20 bp, Homo sapiens
ctctgctgcccgccggctgc

SEQ ID NO: 8132870 - DNA, 22 bp, Homo sapiens
ctctgctgcccaggcctgctag

SEQ ID NO: 8132871 - DNA, 22 bp, Homo sapiens
tttcttgagcccaggaggtgga

SEQ ID NO: 8132872 - DNA, 22 bp, Homo sapiens
ctctgcttcatccaccactggc

SEQ ID NO: 8132873 - DNA, 22 bp, Homo sapiens
ctctgcttctgagatggaagct

SEQ ID NO: 8132874 - DNA, 22 bp, Homo sapiens
ctctgcttgtatcacatttgct

SEQ ID NO: 8132875 - DNA, 22 bp, Homo sapiens
ctctgcttggaactggacagaa

SEQ ID NO: 8132876 - DNA, 22 bp, Homo sapiens
ctctgcttggaacaggggtttg

SEQ ID NO: 8132877 - DNA, 22 bp, Homo sapiens
tttcttatactatattgtcatc

SEQ ID NO: 8132878 - DNA, 22 bp, Homo sapiens
tttcaaagtcaatatcattacc

SEQ ID NO: 8132879 - DNA, 22 bp, Homo sapiens
tttcaaagtaaggattttcatc

SEQ ID NO: 8132880 - DNA, 22 bp, Homo sapiens
ctcctgtcaataggctcctggc

SEQ ID NO: 8132881 - DNA, 22 bp, Homo sapiens
ctcctgggctgtcggcgctctg

SEQ ID NO: 8132882 - DNA, 22 bp, Homo sapiens
tttcaaagttgggaattgtaat

SEQ ID NO: 8132883 - DNA, 20 bp, Homo sapiens
ctcctcagttccatgggagg

SEQ ID NO: 8132884 - DNA, 22 bp, Homo sapiens
ctcctgcctgtgggactgagga

SEQ ID NO: 8132885 - DNA, 22 bp, Homo sapiens
tttatatggttgactatgagtt

SEQ ID NO: 8132886 - DNA, 22 bp, Homo sapiens
ctccccagcattctgacttcct

SEQ ID NO: 8132887 - DNA, 22 bp, Homo sapiens
ttgtttaatgcctcatacatct

SEQ ID NO: 8132888 - DNA, 22 bp, Homo sapiens
ttgtttaatatcgtgaagtact

SEQ ID NO: 8132889 - DNA, 22 bp, Homo sapiens
ttgtttcagctgtatgctatgt

SEQ ID NO: 8132890 - DNA, 22 bp, Homo sapiens
ttgtttaatgcctcatacatct

SEQ ID NO: 8132891 - DNA, 19 bp, Homo sapiens
ctcctcagtcccagaggtc

SEQ ID NO: 8132892 - DNA, 22 bp, Homo sapiens
ctcctcagtcaggtctagggtc

SEQ ID NO: 8132893 - DNA, 21 bp, Homo sapiens
ctcctcaggaccagccacagg

SEQ ID NO: 8132894 - DNA, 22 bp, Homo sapiens
ctcctcagctgggaggagtccc

SEQ ID NO: 8132895 - DNA, 22 bp, Homo sapiens
ctccggagagcagacgagggca

SEQ ID NO: 8132896 - DNA, 22 bp, Homo sapiens
ctgcctctggcctcaggcccag

SEQ ID NO: 8132897 - DNA, 22 bp, Homo sapiens
ctgccctgggccaggaagcggc

SEQ ID NO: 8132898 - DNA, 22 bp, Homo sapiens
ctgccctgcttgatgacagcga

SEQ ID NO: 8132899 - DNA, 22 bp, Homo sapiens
ctgccctgcagctccacggact

SEQ ID NO: 8132900 - DNA, 22 bp, Homo sapiens
ctgccctgctctccgggatctt

SEQ ID NO: 8132901 - DNA, 22 bp, Homo sapiens
ctgcaggggcctcgagcacagg

SEQ ID NO: 8132902 - DNA, 22 bp, Homo sapiens
ctgcagggtttttcaaggacaa

SEQ ID NO: 8132903 - DNA, 21 bp, Homo sapiens
ctgagggccgcagctgggctc

SEQ ID NO: 8132904 - DNA, 22 bp, Homo sapiens
ctgagggctggagctgaggcct

SEQ ID NO: 8132905 - DNA, 22 bp, Homo sapiens
ctgctctaggggcagggccctt

SEQ ID NO: 8132906 - DNA, 22 bp, Homo sapiens
ctgctgccggcgagcctccctt

SEQ ID NO: 8132907 - DNA, 22 bp, Homo sapiens
ctgctgagccgcacccaggagc

SEQ ID NO: 8132908 - DNA, 22 bp, Homo sapiens
ctgctgctgagaatgcctcagg

SEQ ID NO: 8132909 - DNA, 22 bp, Homo sapiens
ctgctgcctgattgcagacctc

SEQ ID NO: 8132910 - DNA, 22 bp, Homo sapiens
ctgcgggctgtcaggcgtgcca

SEQ ID NO: 8132911 - DNA, 22 bp, Homo sapiens
ctgcggtgggctgggctgtccc

SEQ ID NO: 8132912 - DNA, 22 bp, Homo sapiens
ctgcctgcctggagacagatgg

SEQ ID NO: 8132913 - DNA, 22 bp, Homo sapiens
ctgctccaggatttcaggccag

SEQ ID NO: 8132914 - DNA, 22 bp, Homo sapiens
ctgctccccagcctgcgccttt

SEQ ID NO: 8132915 - DNA, 20 bp, Homo sapiens
ctgctccacccggctctcag

SEQ ID NO: 8132916 - DNA, 23 bp, Homo sapiens
ctgctccaggacagcatggaggt

SEQ ID NO: 8132917 - DNA, 22 bp, Homo sapiens
ctgctccaggaacagagctgct

SEQ ID NO: 8132918 - DNA, 19 bp, Homo sapiens
ctgctccaggagctgggga

SEQ ID NO: 8132919 - DNA, 22 bp, Homo sapiens
ctgctccacctccgggtcaggc

SEQ ID NO: 8132920 - DNA, 22 bp, Homo sapiens
ctgctccagacacctgcagggg

SEQ ID NO: 8132921 - DNA, 18 bp, Homo sapiens
ctgagggcagcccctggg

SEQ ID NO: 8132922 - DNA, 22 bp, Homo sapiens
ctgaggaagacagcagctgtgt

SEQ ID NO: 8132923 - DNA, 22 bp, Homo sapiens
ctgaggaagaggtaccatttgt

SEQ ID NO: 8132924 - DNA, 22 bp, Homo sapiens
ctgaggaaagctgcagcggtac

SEQ ID NO: 8132925 - DNA, 22 bp, Homo sapiens
ctgaataattttctgttgtatg

SEQ ID NO: 8132926 - DNA, 22 bp, Homo sapiens
ctgaataatattccattatgag

SEQ ID NO: 8132927 - DNA, 22 bp, Homo sapiens
ctgaataatacagactagcttc

SEQ ID NO: 8132928 - DNA, 22 bp, Homo sapiens
ctgaaacattgcaataacaaag

SEQ ID NO: 8132929 - DNA, 22 bp, Homo sapiens
tttttcttaaatgtgggttggc

SEQ ID NO: 8132930 - DNA, 22 bp, Homo sapiens
gactcctcccgctcccatgccg

SEQ ID NO: 8132931 - DNA, 22 bp, Homo sapiens
gactcctctctaacccactgga

SEQ ID NO: 8132932 - DNA, 21 bp, Homo sapiens
gactctggggtcagctcaacc

SEQ ID NO: 8132933 - DNA, 22 bp, Homo sapiens
gactgaggtattaagatggctt

SEQ ID NO: 8132934 - DNA, 22 bp, Homo sapiens
gactcccaagcttggaggaagg

SEQ ID NO: 8132935 - DNA, 22 bp, Homo sapiens
gacagagaggctgagcagtaca

SEQ ID NO: 8132936 - DNA, 22 bp, Homo sapiens
gacagagattgaatcaggaaat

SEQ ID NO: 8132937 - DNA, 22 bp, Homo sapiens
gacagagaggctgagcagtaca

SEQ ID NO: 8132938 - DNA, 22 bp, Homo sapiens
gacagagattgaatcaggaaat

SEQ ID NO: 8132939 - DNA, 22 bp, Homo sapiens
gacagagattgaatcaggaaat

SEQ ID NO: 8132940 - DNA, 22 bp, Homo sapiens
gacattgaaaataatgtgtaga

SEQ ID NO: 8132941 - DNA, 22 bp, Homo sapiens
gacattggctgttcattgggat

SEQ ID NO: 8132942 - DNA, 22 bp, Homo sapiens
gacattgggtgtacaattggca

SEQ ID NO: 8132943 - DNA, 20 bp, Homo sapiens
gacattgtaattaatgatga

SEQ ID NO: 8132944 - DNA, 22 bp, Homo sapiens
gagaaagacgtaggctgggagg

SEQ ID NO: 8132945 - DNA, 22 bp, Homo sapiens
gagaaagatgtaggctgggagg

SEQ ID NO: 8132946 - DNA, 22 bp, Homo sapiens
gagagaaagcccctgcatccct

SEQ ID NO: 8132947 - DNA, 22 bp, Homo sapiens
gagagaaaacaagttctccatt

SEQ ID NO: 8132948 - DNA, 22 bp, Homo sapiens
gagagaaaaatgagcttcattg

SEQ ID NO: 8132949 - DNA, 22 bp, Homo sapiens
gagagaaatgtgcagtttgggc

SEQ ID NO: 8132950 - DNA, 18 bp, Homo sapiens
gagagggatccctcagga

SEQ ID NO: 8132951 - DNA, 22 bp, Homo sapiens
gagagaaccctaaatgagatat

SEQ ID NO: 8132952 - DNA, 22 bp, Homo sapiens
gaagggcttggctgggaggcca

SEQ ID NO: 8132953 - DNA, 22 bp, Homo sapiens
gaagggctttctgggagaagag

SEQ ID NO: 8132954 - DNA, 22 bp, Homo sapiens
gaatcatttatttttgacagca

SEQ ID NO: 8132955 - DNA, 22 bp, Homo sapiens
gaatcatttcttctgaaaggta

SEQ ID NO: 8132956 - DNA, 22 bp, Homo sapiens
gaaggtttgatccttatttata

SEQ ID NO: 8132957 - DNA, 22 bp, Homo sapiens
gaaggtgtctggcccagagtct

SEQ ID NO: 8132958 - DNA, 22 bp, Homo sapiens
gaaaggaacttgtgagtgggag

SEQ ID NO: 8132959 - DNA, 22 bp, Homo sapiens
gaaaggaaattgagggacgcat

SEQ ID NO: 8132960 - DNA, 22 bp, Homo sapiens
gaaaggagtcagtcttactgaa

SEQ ID NO: 8132961 - DNA, 22 bp, Homo sapiens
gaagcagccacggggagacaga

SEQ ID NO: 8132962 - DNA, 20 bp, Homo sapiens
gaagcagcttcatgtagaca

SEQ ID NO: 8132963 - DNA, 22 bp, Homo sapiens
gaaggcaccctccatcactcac

SEQ ID NO: 8132964 - DNA, 22 bp, Homo sapiens
gaaggagccgagctcttcccca

SEQ ID NO: 8132965 - DNA, 22 bp, Homo sapiens
gagggctgatgttgccacctca

SEQ ID NO: 8132966 - DNA, 22 bp, Homo sapiens
gaggggctggcacgatggctgc

SEQ ID NO: 8132967 - DNA, 22 bp, Homo sapiens
gaggctgcaggcaatgctgccc

SEQ ID NO: 8132968 - DNA, 22 bp, Homo sapiens
gaggctgccaatgtgtgcatgt

SEQ ID NO: 8132969 - DNA, 22 bp, Homo sapiens
gaggctgcattcttcccactgc

SEQ ID NO: 8132970 - DNA, 22 bp, Homo sapiens
gagggagggactagcattctct

SEQ ID NO: 8132971 - DNA, 22 bp, Homo sapiens
gaggctcacgacgggacgaact

SEQ ID NO: 8132972 - DNA, 22 bp, Homo sapiens
gaggagaggggctcccaagagc

SEQ ID NO: 8132973 - DNA, 22 bp, Homo sapiens
gaggagcacatgaggctgaggg

SEQ ID NO: 8132974 - DNA, 22 bp, Homo sapiens
gaggagagatggtagattgggt

SEQ ID NO: 8132975 - DNA, 22 bp, Homo sapiens
gaggagagggctgcgggcccac

SEQ ID NO: 8132976 - DNA, 22 bp, Homo sapiens
gaggcagcttggggctgtgggt

SEQ ID NO: 8132977 - DNA, 22 bp, Homo sapiens
gagagggctgcctggtgtgagg

SEQ ID NO: 8132978 - DNA, 22 bp, Homo sapiens
gagcaggctctgcctgtgtgtc

SEQ ID NO: 8132979 - DNA, 22 bp, Homo sapiens
gagcaggcttgcagagaagggg

SEQ ID NO: 8132980 - DNA, 22 bp, Homo sapiens
gagccctgaacaacagcaggaa

SEQ ID NO: 8132981 - DNA, 22 bp, Homo sapiens
gagcccaggaagtggaggctga

SEQ ID NO: 8132982 - DNA, 22 bp, Homo sapiens
gagccatgagatagttggttcg

SEQ ID NO: 8132983 - DNA, 18 bp, Homo sapiens
gagccctgagtctgcaca

SEQ ID NO: 8132984 - DNA, 22 bp, Homo sapiens
gagccctgcggagccccgaggc

SEQ ID NO: 8132985 - DNA, 22 bp, Homo sapiens
gagccctgctgggccttgtctc

SEQ ID NO: 8132986 - DNA, 22 bp, Homo sapiens
gagctgcctacattgccaagag

SEQ ID NO: 8132987 - DNA, 22 bp, Homo sapiens
gagctgagggtctaggagggtt

SEQ ID NO: 8132988 - DNA, 18 bp, Homo sapiens
gaggaaacaaggcagagg

SEQ ID NO: 8132989 - DNA, 22 bp, Homo sapiens
gaggaaagctggtttaaagtat

SEQ ID NO: 8132990 - DNA, 22 bp, Homo sapiens
gagctgcctgtgtgccatgatg

SEQ ID NO: 8132991 - DNA, 22 bp, Homo sapiens
ctgtctgtacaaatgtggggcc

SEQ ID NO: 8132992 - DNA, 22 bp, Homo sapiens
ctgtgctctggcatcgctgcaa

SEQ ID NO: 8132993 - DNA, 22 bp, Homo sapiens
ctgtgctggagatgggccagag

SEQ ID NO: 8132994 - DNA, 22 bp, Homo sapiens
ctgtgctggtccagggagctgg

SEQ ID NO: 8132995 - DNA, 22 bp, Homo sapiens
ctgtcacactaaaacaagaagt

SEQ ID NO: 8132996 - DNA, 22 bp, Homo sapiens
ctgtacatctctgaggacagta

SEQ ID NO: 8132997 - DNA, 22 bp, Homo sapiens
ctgtacatatgtctccagagtg

SEQ ID NO: 8132998 - DNA, 22 bp, Homo sapiens
ctgtagcatttgttatggcaat

SEQ ID NO: 8132999 - DNA, 22 bp, Homo sapiens
ctgtagaacgatccaggcattt

SEQ ID NO: 8133000 - DNA, 22 bp, Homo sapiens
ctgtacagaagctagagcaaat

SEQ ID NO: 8133001 - DNA, 22 bp, Homo sapiens
ctggtctgcgggaaggcgtggg

SEQ ID NO: 8133002 - DNA, 22 bp, Homo sapiens
ctggtctgaaaaggaggcatgc

SEQ ID NO: 8133003 - DNA, 22 bp, Homo sapiens
ctggtctgggatgagggatgta

SEQ ID NO: 8133004 - DNA, 22 bp, Homo sapiens
ctggggaaggcggtgactgcgc

SEQ ID NO: 8133005 - DNA, 22 bp, Homo sapiens
ctggggagaagcgactcggctg

SEQ ID NO: 8133006 - DNA, 22 bp, Homo sapiens
ctgggaagaagtgggctacatt

SEQ ID NO: 8133007 - DNA, 22 bp, Homo sapiens
ctgggaagaaattgtgggaggc

SEQ ID NO: 8133008 - DNA, 22 bp, Homo sapiens
ctgggagatatgaggatctgga

SEQ ID NO: 8133009 - DNA, 22 bp, Homo sapiens
ctgggagaggtggtgggaagta

SEQ ID NO: 8133010 - DNA, 22 bp, Homo sapiens
ctgggagattgaggccatggtg

SEQ ID NO: 8133011 - DNA, 22 bp, Homo sapiens
ctgggagatctcctgagggcag

SEQ ID NO: 8133012 - DNA, 22 bp, Homo sapiens
ctgggagatctgttgggactgg

SEQ ID NO: 8133013 - DNA, 22 bp, Homo sapiens
ctgggcagctgtatcagggagt

SEQ ID NO: 8133014 - DNA, 22 bp, Homo sapiens
ctgggcagcctcacacaatgtt

SEQ ID NO: 8133015 - DNA, 22 bp, Homo sapiens
ctgggcagctccataccaccca

SEQ ID NO: 8133016 - DNA, 22 bp, Homo sapiens
ctgggcagctaccaccactgct

SEQ ID NO: 8133017 - DNA, 22 bp, Homo sapiens
ctgggcagaattttaggatggc

SEQ ID NO: 8133018 - DNA, 22 bp, Homo sapiens
ctgggcagagtccggaagatgg

SEQ ID NO: 8133019 - DNA, 22 bp, Homo sapiens
ctgggcagcacatcatcgtatc

SEQ ID NO: 8133020 - DNA, 22 bp, Homo sapiens
ctgggcagagctaacacctgag

SEQ ID NO: 8133021 - DNA, 22 bp, Homo sapiens
ctgggcgcgtcccctgaggcgg

SEQ ID NO: 8133022 - DNA, 22 bp, Homo sapiens
ctgtggaaaatgctttacatat

SEQ ID NO: 8133023 - DNA, 22 bp, Homo sapiens
ctgtggaagagggtcaccagta

SEQ ID NO: 8133024 - DNA, 22 bp, Homo sapiens
ctgtgcttccaggatggcagct

SEQ ID NO: 8133025 - DNA, 22 bp, Homo sapiens
cttaaagagtatttaatataat

SEQ ID NO: 8133026 - DNA, 22 bp, Homo sapiens
cttcagttagtttcatgtgagc

SEQ ID NO: 8133027 - DNA, 22 bp, Homo sapiens
cttagccctgagagttctgagc

SEQ ID NO: 8133028 - DNA, 22 bp, Homo sapiens
cttccaagttgctctgctgacc

SEQ ID NO: 8133029 - DNA, 22 bp, Homo sapiens
cttccaagtggggcacgtgcca

SEQ ID NO: 8133030 - DNA, 22 bp, Homo sapiens
gaaagagaggggctgagatgca

SEQ ID NO: 8133031 - DNA, 22 bp, Homo sapiens
gaaagcatccgcctggaggtgg

SEQ ID NO: 8133032 - DNA, 22 bp, Homo sapiens
gaaacactcaatttagtaattc

SEQ ID NO: 8133033 - DNA, 22 bp, Homo sapiens
cttttcttactcccgcaaggca

SEQ ID NO: 8133034 - DNA, 22 bp, Homo sapiens
cttttctctgcaccatgtgtga

SEQ ID NO: 8133035 - DNA, 21 bp, Homo sapiens
cttttctctccgcaggacatt

SEQ ID NO: 8133036 - DNA, 22 bp, Homo sapiens
ctttacaaatagggagggagtg

SEQ ID NO: 8133037 - DNA, 22 bp, Homo sapiens
ctttctcttcagcacccagccc

SEQ ID NO: 8133038 - DNA, 22 bp, Homo sapiens
ctttctttgcagtgagccagag

SEQ ID NO: 8133039 - DNA, 22 bp, Homo sapiens
ctttgatctactcactaaacaa

SEQ ID NO: 8133040 - DNA, 22 bp, Homo sapiens
ctttaaataatacaaggtccag

SEQ ID NO: 8133041 - DNA, 22 bp, Homo sapiens
cttctgaatggctgtgtatgct

SEQ ID NO: 8133042 - DNA, 22 bp, Homo sapiens
cttctgctgctgttcatggttg

SEQ ID NO: 8133043 - DNA, 22 bp, Homo sapiens
cttctgaaacccccagtgtggg

SEQ ID NO: 8133044 - DNA, 22 bp, Homo sapiens
tgagcagtaggtctgaatagtg

SEQ ID NO: 8133045 - DNA, 22 bp, Homo sapiens
tgagcaggtgagtctagggcag

SEQ ID NO: 8133046 - DNA, 18 bp, Homo sapiens
tgagcaggggctgacctt

SEQ ID NO: 8133047 - DNA, 22 bp, Homo sapiens
tgagcaggtcaagactccagct

SEQ ID NO: 8133048 - DNA, 22 bp, Homo sapiens
ccagggctgcctggccgtgtgt

SEQ ID NO: 8133049 - DNA, 22 bp, Homo sapiens
ccagggctgctgggggagttga

SEQ ID NO: 8133050 - DNA, 22 bp, Homo sapiens
ccaggtggaggtgtgaggtcct

SEQ ID NO: 8133051 - DNA, 22 bp, Homo sapiens
ccaggtggataaggtttctgga

SEQ ID NO: 8133052 - DNA, 22 bp, Homo sapiens
tgaggctgagatatcagggagg

SEQ ID NO: 8133053 - DNA, 22 bp, Homo sapiens
tgaggctgagatatcagggagg

SEQ ID NO: 8133054 - DNA, 23 bp, Homo sapiens
ccatcaggcctccgtgtccagcc

SEQ ID NO: 8133055 - DNA, 22 bp, Homo sapiens
ccatatatgattgcctctttca

SEQ ID NO: 8133056 - DNA, 18 bp, Homo sapiens
ccatcaccctaactagtg

SEQ ID NO: 8133057 - DNA, 22 bp, Homo sapiens
tgaggcccagccgccctgagag

SEQ ID NO: 8133058 - DNA, 22 bp, Homo sapiens
tgaggctgacaaaagatgaggt

SEQ ID NO: 8133059 - DNA, 17 bp, Homo sapiens
tgaggccatggcaccat

SEQ ID NO: 8133060 - DNA, 22 bp, Homo sapiens
tgcaggacagtttggaagagag

SEQ ID NO: 8133061 - DNA, 23 bp, Homo sapiens
tgcaggactcaagaaagaaaggc

SEQ ID NO: 8133062 - DNA, 22 bp, Homo sapiens
tgcacagatctggtggcaagga

SEQ ID NO: 8133063 - DNA, 19 bp, Homo sapiens
tgcaatcagctacccaggt

SEQ ID NO: 8133064 - DNA, 22 bp, Homo sapiens
tcttttgtagctaacacattca

SEQ ID NO: 8133065 - DNA, 22 bp, Homo sapiens
tcttttgggttcttatgattta

SEQ ID NO: 8133066 - DNA, 22 bp, Homo sapiens
tcttttgtcatcccttgtacat

SEQ ID NO: 8133067 - DNA, 22 bp, Homo sapiens
ccaggctgtaagagtgatgttg

SEQ ID NO: 8133068 - DNA, 22 bp, Homo sapiens
ccaggctgtgcttttcataaat

SEQ ID NO: 8133069 - DNA, 22 bp, Homo sapiens
ccaggctgtaagagtgatgttg

SEQ ID NO: 8133070 - DNA, 21 bp, Homo sapiens
ccaggctgggagggcagttcc

SEQ ID NO: 8133071 - DNA, 22 bp, Homo sapiens
ccaggctgtggtttagatagag

SEQ ID NO: 8133072 - DNA, 22 bp, Homo sapiens
ccaggctgttttcaaacttggg

SEQ ID NO: 8133073 - DNA, 22 bp, Homo sapiens
tgaaatgagagcacagaataaa

SEQ ID NO: 8133074 - DNA, 22 bp, Homo sapiens
tgaaatgagagcacagaataaa

SEQ ID NO: 8133075 - DNA, 22 bp, Homo sapiens
tgaaacaaatttggaaaatcta

SEQ ID NO: 8133076 - DNA, 22 bp, Homo sapiens
tcttttgtgattctttagttac

SEQ ID NO: 8133077 - DNA, 18 bp, Homo sapiens
tgaaacaagaatggtgca

SEQ ID NO: 8133078 - DNA, 22 bp, Homo sapiens
tgaaatgagatagataatcagg

SEQ ID NO: 8133079 - DNA, 23 bp, Homo sapiens
ccagggcccctacaccactgtcc

SEQ ID NO: 8133080 - DNA, 22 bp, Homo sapiens
ccagggcagtgggagaaggtgc

SEQ ID NO: 8133081 - DNA, 22 bp, Homo sapiens
tgaaggtgtttatacctcagat

SEQ ID NO: 8133082 - DNA, 22 bp, Homo sapiens
ccaggcaggcgatggtgcagtg

SEQ ID NO: 8133083 - DNA, 22 bp, Homo sapiens
tcttcctcaatgtaacaacccc

SEQ ID NO: 8133084 - DNA, 22 bp, Homo sapiens
tcttagaagttcatgttccagc

SEQ ID NO: 8133085 - DNA, 22 bp, Homo sapiens
tctgttctaagcattctatgtg

SEQ ID NO: 8133086 - DNA, 22 bp, Homo sapiens
tctgttattttcttgtgtggaa

SEQ ID NO: 8133087 - DNA, 22 bp, Homo sapiens
tctgggaggctgggtcccgtcc

SEQ ID NO: 8133088 - DNA, 22 bp, Homo sapiens
tgggagagaattctggtgactg

SEQ ID NO: 8133089 - DNA, 22 bp, Homo sapiens
tgggacaggaggcctctggaga

SEQ ID NO: 8133090 - DNA, 22 bp, Homo sapiens
tgggagagcactgcagccccgg

SEQ ID NO: 8133091 - DNA, 22 bp, Homo sapiens
tgggcagacattgagtttgttc

SEQ ID NO: 8133092 - DNA, 22 bp, Homo sapiens
tgggcagaattgtggtagttaa

SEQ ID NO: 8133093 - DNA, 22 bp, Homo sapiens
tgggcagacgggagcttgcctt

SEQ ID NO: 8133094 - DNA, 22 bp, Homo sapiens
tgggcagacgctgttggaaggc

SEQ ID NO: 8133095 - DNA, 22 bp, Homo sapiens
tgggcagaaggaagagccacct

SEQ ID NO: 8133096 - DNA, 22 bp, Homo sapiens
tgggcagaatgtgggatccaga

SEQ ID NO: 8133097 - DNA, 22 bp, Homo sapiens
tgggcagaaatcagtatcagat

SEQ ID NO: 8133098 - DNA, 22 bp, Homo sapiens
cctctcccagggagagcctgag

SEQ ID NO: 8133099 - DNA, 22 bp, Homo sapiens
cctccaggtgttacatatgact

SEQ ID NO: 8133100 - DNA, 23 bp, Homo sapiens
cctgcagctgctggggctccacc

SEQ ID NO: 8133101 - DNA, 22 bp, Homo sapiens
tgggctccggcggcctcaggct

SEQ ID NO: 8133102 - DNA, 22 bp, Homo sapiens
tgggctccgttgcctggggcag

SEQ ID NO: 8133103 - DNA, 23 bp, Homo sapiens
tgggcctggcctcccagtccagc

SEQ ID NO: 8133104 - DNA, 22 bp, Homo sapiens
tgggccgggcactgtactgggc

SEQ ID NO: 8133105 - DNA, 22 bp, Homo sapiens
tgggcaggcaagtgaatacctt

SEQ ID NO: 8133106 - DNA, 22 bp, Homo sapiens
tgggcaggataatatctcatgt

SEQ ID NO: 8133107 - DNA, 22 bp, Homo sapiens
tgggcaggatgcgttgattctt

SEQ ID NO: 8133108 - DNA, 22 bp, Homo sapiens
tgggcaggagagaagctaaaga

SEQ ID NO: 8133109 - DNA, 22 bp, Homo sapiens
cctgcctcaggactctgcatat

SEQ ID NO: 8133110 - DNA, 22 bp, Homo sapiens
cctgcccttctttccccagcat

SEQ ID NO: 8133111 - DNA, 22 bp, Homo sapiens
tgggtggagaagtggacctgct

SEQ ID NO: 8133112 - DNA, 22 bp, Homo sapiens
tgggtgggagcaccctgtctgg

SEQ ID NO: 8133113 - DNA, 22 bp, Homo sapiens
cctgcagggtgctgccacagat

SEQ ID NO: 8133114 - DNA, 22 bp, Homo sapiens
cctgcagggaatcgaggcagaa

SEQ ID NO: 8133115 - DNA, 22 bp, Homo sapiens
cctgcaggtttcccccggacgg

SEQ ID NO: 8133116 - DNA, 22 bp, Homo sapiens
tgggtcagtttgggggccagcc

SEQ ID NO: 8133117 - DNA, 22 bp, Homo sapiens
tggaaacctactgatacaggag

SEQ ID NO: 8133118 - DNA, 22 bp, Homo sapiens
tggagaattctatgttgagggg

SEQ ID NO: 8133119 - DNA, 22 bp, Homo sapiens
tggaaagaattcctatggttca

SEQ ID NO: 8133120 - DNA, 23 bp, Homo sapiens
tggaggaaacacatcagaagacc

SEQ ID NO: 8133121 - DNA, 22 bp, Homo sapiens
ccctgggacccgctgcagaggc

SEQ ID NO: 8133122 - DNA, 22 bp, Homo sapiens
ccctggagtagcactgggtcgc

SEQ ID NO: 8133123 - DNA, 22 bp, Homo sapiens
ccctggagtcctggcagttgat

SEQ ID NO: 8133124 - DNA, 22 bp, Homo sapiens
tgctgttatcacattttgtaaa

SEQ ID NO: 8133125 - DNA, 22 bp, Homo sapiens
cccagtgtggttctttggagaa

SEQ ID NO: 8133126 - DNA, 18 bp, Homo sapiens
tgctggggtagaatccac

SEQ ID NO: 8133127 - DNA, 22 bp, Homo sapiens
tgctgggggttcagatgagtaa

SEQ ID NO: 8133128 - DNA, 22 bp, Homo sapiens
tgctgggggctttctggatacc

SEQ ID NO: 8133129 - DNA, 22 bp, Homo sapiens
tgctggggctctgaccactcca

SEQ ID NO: 8133130 - DNA, 22 bp, Homo sapiens
tgctgggggtagctctgcgtag

SEQ ID NO: 8133131 - DNA, 22 bp, Homo sapiens
tgctgggggtgtctcaccaggc

SEQ ID NO: 8133132 - DNA, 19 bp, Homo sapiens
cccagtccttgtcctgggc

SEQ ID NO: 8133133 - DNA, 22 bp, Homo sapiens
tgctcaggtgccttggctgctg

SEQ ID NO: 8133134 - DNA, 22 bp, Homo sapiens
tgctcagggagcttcctggtgg

SEQ ID NO: 8133135 - DNA, 22 bp, Homo sapiens
tgctctgcaagcaggagcaaga

SEQ ID NO: 8133136 - DNA, 22 bp, Homo sapiens
tgctctgcacatccctcacaaa

SEQ ID NO: 8133137 - DNA, 22 bp, Homo sapiens
tgctcaggccctgggccatcct

SEQ ID NO: 8133138 - DNA, 22 bp, Homo sapiens
tgctcagcttcagaggatcccc

SEQ ID NO: 8133139 - DNA, 22 bp, Homo sapiens
tgctcaggaggaggctgtgagg

SEQ ID NO: 8133140 - DNA, 22 bp, Homo sapiens
tctctgtattctgatattcact

SEQ ID NO: 8133141 - DNA, 22 bp, Homo sapiens
ccagagcagggcagcagggctc

SEQ ID NO: 8133142 - DNA, 22 bp, Homo sapiens
ccagagccagagaggtgcctgc

SEQ ID NO: 8133143 - DNA, 22 bp, Homo sapiens
ccagagaggccttggcaagaca

SEQ ID NO: 8133144 - DNA, 21 bp, Homo sapiens
tctataatatgcaggtcatca

SEQ ID NO: 8133145 - DNA, 22 bp, Homo sapiens
cattttcatgagtttctgttca

SEQ ID NO: 8133146 - DNA, 22 bp, Homo sapiens
cattttcatgagtttctgttca

SEQ ID NO: 8133147 - DNA, 22 bp, Homo sapiens
tccataaaccagaaaatcaaga

SEQ ID NO: 8133148 - DNA, 22 bp, Homo sapiens
ccacagggataggaatggggct

SEQ ID NO: 8133149 - DNA, 21 bp, Homo sapiens
tcctgccttagtccagagcag

SEQ ID NO: 8133150 - DNA, 22 bp, Homo sapiens
ccaagaatgataggtgtgagca

SEQ ID NO: 8133151 - DNA, 22 bp, Homo sapiens
tcatcaaagtcaaagaatgact

SEQ ID NO: 8133152 - DNA, 20 bp, Homo sapiens
catcagtgcctgacaggtcc

SEQ ID NO: 8133153 - DNA, 22 bp, Homo sapiens
catcagtgcccttggggatgcc

SEQ ID NO: 8133154 - DNA, 22 bp, Homo sapiens
catcagtgagccccttgatgag

SEQ ID NO: 8133155 - DNA, 22 bp, Homo sapiens
catcagtgaaagtgaatgttct

SEQ ID NO: 8133156 - DNA, 22 bp, Homo sapiens
catcagtgtgttgccttgctca

SEQ ID NO: 8133157 - DNA, 22 bp, Homo sapiens
catcagtgttcactattccttc

SEQ ID NO: 8133158 - DNA, 22 bp, Homo sapiens
catcagtgtggcagttcactgt

SEQ ID NO: 8133159 - DNA, 22 bp, Homo sapiens
catcagtgtctctctggtactt

SEQ ID NO: 8133160 - DNA, 22 bp, Homo sapiens
catcagtggtaactgaatggtt

SEQ ID NO: 8133161 - DNA, 22 bp, Homo sapiens
catcagcaggcaacactcttgg

SEQ ID NO: 8133162 - DNA, 22 bp, Homo sapiens
catcagctgagggtgagcagaa

SEQ ID NO: 8133163 - DNA, 22 bp, Homo sapiens
catcagctgagggtgagcagaa

SEQ ID NO: 8133164 - DNA, 22 bp, Homo sapiens
catcagctcttcattcttgatt

SEQ ID NO: 8133165 - DNA, 22 bp, Homo sapiens
catcagctaaacttagtgaaat

SEQ ID NO: 8133166 - DNA, 22 bp, Homo sapiens
catcataaaattgagataactg

SEQ ID NO: 8133167 - DNA, 20 bp, Homo sapiens
tcagtgtggcggggacctca

SEQ ID NO: 8133168 - DNA, 22 bp, Homo sapiens
tcagtgtgattaggctatctga

SEQ ID NO: 8133169 - DNA, 22 bp, Homo sapiens
cagtgtctacagtggctggagg

SEQ ID NO: 8133170 - DNA, 22 bp, Homo sapiens
tcactgttttgcctgcacttcc

SEQ ID NO: 8133171 - DNA, 22 bp, Homo sapiens
tcacttcacacccactatcatg

SEQ ID NO: 8133172 - DNA, 20 bp, Homo sapiens
catcaacaccttgtcagcct

SEQ ID NO: 8133173 - DNA, 22 bp, Homo sapiens
catggtgggtgtagtttccgcc

SEQ ID NO: 8133174 - DNA, 22 bp, Homo sapiens
catgctttaccaaagcagtgat

SEQ ID NO: 8133175 - DNA, 22 bp, Homo sapiens
catgctttgggtcagaaatgcc

SEQ ID NO: 8133176 - DNA, 23 bp, Homo sapiens
tccagggcagtggctgggtctgc

SEQ ID NO: 8133177 - DNA, 17 bp, Homo sapiens
tccagggtttatgaaat

SEQ ID NO: 8133178 - DNA, 20 bp, Homo sapiens
tccagggtagatgaattctg

SEQ ID NO: 8133179 - DNA, 22 bp, Homo sapiens
gtggagaggaacccagctctgt

SEQ ID NO: 8133180 - DNA, 22 bp, Homo sapiens
cagctctgcctctggggctgag

SEQ ID NO: 8133181 - DNA, 22 bp, Homo sapiens
cagctctgccacttcctagcta

SEQ ID NO: 8133182 - DNA, 22 bp, Homo sapiens
tacaatagggcttttgtttatg

SEQ ID NO: 8133183 - DNA, 22 bp, Homo sapiens
tacacagaacctggtgtacagt

SEQ ID NO: 8133184 - DNA, 22 bp, Homo sapiens
caggccctcgtggtgagctggg

SEQ ID NO: 8133185 - DNA, 22 bp, Homo sapiens
caggccctcgcccgcagcgacc

SEQ ID NO: 8133186 - DNA, 22 bp, Homo sapiens
caggccctcctgtgatctgcct

SEQ ID NO: 8133187 - DNA, 22 bp, Homo sapiens
caggccccattcctcttgggac

SEQ ID NO: 8133188 - DNA, 22 bp, Homo sapiens
tacagagaataataggacaggt

SEQ ID NO: 8133189 - DNA, 22 bp, Homo sapiens
tacagagaactcatagaaagaa

SEQ ID NO: 8133190 - DNA, 22 bp, Homo sapiens
tacactgtgtaaaatgcacttt

SEQ ID NO: 8133191 - DNA, 22 bp, Homo sapiens
caggctcggaagtgctggcttt

SEQ ID NO: 8133192 - DNA, 22 bp, Homo sapiens
tacagtttgtatggtcaggaat

SEQ ID NO: 8133193 - DNA, 22 bp, Homo sapiens
tacagtttagaaccatagatgg

SEQ ID NO: 8133194 - DNA, 22 bp, Homo sapiens
tacagtttcccagcagatgcaa

SEQ ID NO: 8133195 - DNA, 22 bp, Homo sapiens
tacagtttccaagggcttgaag

SEQ ID NO: 8133196 - DNA, 22 bp, Homo sapiens
tacagtttctcattatgctctc

SEQ ID NO: 8133197 - DNA, 22 bp, Homo sapiens
tacagtttctgtccttgtggag

SEQ ID NO: 8133198 - DNA, 22 bp, Homo sapiens
tacagtttacatgagaggaagc

SEQ ID NO: 8133199 - DNA, 22 bp, Homo sapiens
tacagtttaacactttggagaa

SEQ ID NO: 8133200 - DNA, 20 bp, Homo sapiens
tacagagagctagctctctg

SEQ ID NO: 8133201 - DNA, 22 bp, Homo sapiens
tacagagagctccggacattca

SEQ ID NO: 8133202 - DNA, 22 bp, Homo sapiens
tacagagaggtgacccttgggc

SEQ ID NO: 8133203 - DNA, 22 bp, Homo sapiens
tacagcagggcgctgtgatgaa

SEQ ID NO: 8133204 - DNA, 22 bp, Homo sapiens
tacagagagaggggttaccagg

SEQ ID NO: 8133205 - DNA, 22 bp, Homo sapiens
tacagagactttatggcacaaa

SEQ ID NO: 8133206 - DNA, 22 bp, Homo sapiens
tacagagagataagtgtaaaag

SEQ ID NO: 8133207 - DNA, 22 bp, Homo sapiens
tacagagacccacaagagactg

SEQ ID NO: 8133208 - DNA, 22 bp, Homo sapiens
tagcatgtcagtcgccacacgt

SEQ ID NO: 8133209 - DNA, 22 bp, Homo sapiens
tagcagcacctacacgtcagag

SEQ ID NO: 8133210 - DNA, 22 bp, Homo sapiens
tagcagcaggggaaacagctgt

SEQ ID NO: 8133211 - DNA, 22 bp, Homo sapiens
tagaaattcaatgctctgagta

SEQ ID NO: 8133212 - DNA, 22 bp, Homo sapiens
tagaaatgttagatgtattgag

SEQ ID NO: 8133213 - DNA, 22 bp, Homo sapiens
cagggagaggcatcatagggaa

SEQ ID NO: 8133214 - DNA, 22 bp, Homo sapiens
cagggagaagtctggtcagtcc

SEQ ID NO: 8133215 - DNA, 22 bp, Homo sapiens
tagaaagacatgggccagcagc

SEQ ID NO: 8133216 - DNA, 22 bp, Homo sapiens
tagaaagactgtccagatttca

SEQ ID NO: 8133217 - DNA, 22 bp, Homo sapiens
cagtctgggactgagctccacc

SEQ ID NO: 8133218 - DNA, 22 bp, Homo sapiens
tcaaagcagcacattcgcaagc

SEQ ID NO: 8133219 - DNA, 22 bp, Homo sapiens
tcaaagcactggggaaagcctg

SEQ ID NO: 8133220 - DNA, 22 bp, Homo sapiens
tcaaagcacacttagtggtaga

SEQ ID NO: 8133221 - DNA, 20 bp, Homo sapiens
tattccaagggtagagaaaa

SEQ ID NO: 8133222 - DNA, 23 bp, Homo sapiens
tcacactggatacacatgcaaga

SEQ ID NO: 8133223 - DNA, 22 bp, Homo sapiens
tcacacatgtaagggctttgga

SEQ ID NO: 8133224 - DNA, 22 bp, Homo sapiens
tcacacatttctcaagtgtagg

SEQ ID NO: 8133225 - DNA, 16 bp, Homo sapiens
tcacacatttgttggt

SEQ ID NO: 8133226 - DNA, 22 bp, Homo sapiens
tagtttctagtcaatcttcttt

SEQ ID NO: 8133227 - DNA, 22 bp, Homo sapiens
tagtgtgtatggtaatgatgaa

SEQ ID NO: 8133228 - DNA, 22 bp, Homo sapiens
tatattcatattgttgtctctc

SEQ ID NO: 8133229 - DNA, 22 bp, Homo sapiens
tatattcaatgattagtatcag

SEQ ID NO: 8133230 - DNA, 20 bp, Homo sapiens
tagtgcaaaggcagccatag

SEQ ID NO: 8133231 - DNA, 22 bp, Homo sapiens
cagggccaagctgcagcatctg

SEQ ID NO: 8133232 - DNA, 22 bp, Homo sapiens
tatattcttaccagtgtatgta

SEQ ID NO: 8133233 - DNA, 22 bp, Homo sapiens
tatctgtaaaccaaggaggctt

SEQ ID NO: 8133234 - DNA, 22 bp, Homo sapiens
tatattgtagctgatgacaaat

SEQ ID NO: 8133235 - DNA, 22 bp, Homo sapiens
tatctgtatccccatctagcta

SEQ ID NO: 8133236 - DNA, 17 bp, Homo sapiens
tatctgtatgatggata

SEQ ID NO: 8133237 - DNA, 22 bp, Homo sapiens
tatgattaatattcttaaaatt

SEQ ID NO: 8133238 - DNA, 22 bp, Homo sapiens
tatgatttgtagacatttgatt

SEQ ID NO: 8133239 - DNA, 22 bp, Homo sapiens
caggtggggcgccctcaggcag

SEQ ID NO: 8133240 - DNA, 22 bp, Homo sapiens
caggtggggcagctgtgggagc

SEQ ID NO: 8133241 - DNA, 22 bp, Homo sapiens
caggtggggagagtgtggagca

SEQ ID NO: 8133242 - DNA, 22 bp, Homo sapiens
caggtgggctgcctctccagct

SEQ ID NO: 8133243 - DNA, 22 bp, Homo sapiens
tatgtacatgatttcatttgct

SEQ ID NO: 8133244 - DNA, 22 bp, Homo sapiens
ttgtggaagccctatgagagac

SEQ ID NO: 8133245 - DNA, 22 bp, Homo sapiens
ttgttctatggggtgaagtcta

SEQ ID NO: 8133246 - DNA, 22 bp, Homo sapiens
ttgtgcccagaagaaagtgatt

SEQ ID NO: 8133247 - DNA, 22 bp, Homo sapiens
ttgtgagtagtgccgcaataaa

SEQ ID NO: 8133248 - DNA, 22 bp, Homo sapiens
ttggccgtttcactgggcagtt

SEQ ID NO: 8133249 - DNA, 23 bp, Homo sapiens
ttgggaaatagttaagacatgag

SEQ ID NO: 8133250 - DNA, 22 bp, Homo sapiens
ttgggctcaggagtttgagacc

SEQ ID NO: 8133251 - DNA, 22 bp, Homo sapiens
ttggaagacattaaagagagtg

SEQ ID NO: 8133252 - DNA, 22 bp, Homo sapiens
ttggaatcctgagatgagaatt

SEQ ID NO: 8133253 - DNA, 22 bp, Homo sapiens
ttgcttcagtcagtgctgccca

SEQ ID NO: 8133254 - DNA, 22 bp, Homo sapiens
ttgcctgtttgagagctgtgtt

SEQ ID NO: 8133255 - DNA, 22 bp, Homo sapiens
tttcatcatcaaaatagtgagg

SEQ ID NO: 8133256 - DNA, 22 bp, Homo sapiens
tttcatcaccccaaatctatgg

SEQ ID NO: 8133257 - DNA, 22 bp, Homo sapiens
tttcatcaccccaaatctatgg

SEQ ID NO: 8133258 - DNA, 23 bp, Homo sapiens
tttcatcagttgatctggacagc

SEQ ID NO: 8133259 - DNA, 22 bp, Homo sapiens
tttcataatactgtacatgaaa

SEQ ID NO: 8133260 - DNA, 22 bp, Homo sapiens
tttcccagaggtatgaataagt

SEQ ID NO: 8133261 - DNA, 22 bp, Homo sapiens
tttcacattcagatatagactt

SEQ ID NO: 8133262 - DNA, 22 bp, Homo sapiens
tttcacaggagtcctttctata

SEQ ID NO: 8133263 - DNA, 22 bp, Homo sapiens
tttcacaggatgctgttttata

SEQ ID NO: 8133264 - DNA, 23 bp, Homo sapiens
tttcacagcttttattctgcatc

SEQ ID NO: 8133265 - DNA, 22 bp, Homo sapiens
tttcacaatcaaatggtgaaat

SEQ ID NO: 8133266 - DNA, 22 bp, Homo sapiens
tttcacatgtgctgttgtcaat

SEQ ID NO: 8133267 - DNA, 23 bp, Homo sapiens
tttatttatttaggctgagggat

SEQ ID NO: 8133268 - DNA, 21 bp, Homo sapiens
tttatttatataggacacatg

SEQ ID NO: 8133269 - DNA, 20 bp, Homo sapiens
tttcaagtcagcaattctca

SEQ ID NO: 8133270 - DNA, 22 bp, Homo sapiens
tttcacaagtaaagtcctaagt

SEQ ID NO: 8133271 - DNA, 22 bp, Homo sapiens
tttcacaagtttcaggattctg

SEQ ID NO: 8133272 - DNA, 22 bp, Homo sapiens
tttcacaactgcttatttgaga

SEQ ID NO: 8133273 - DNA, 22 bp, Homo sapiens
tttcacaagacagctactgttg

SEQ ID NO: 8133274 - DNA, 22 bp, Homo sapiens
tttcacaactgcttatttgaga

SEQ ID NO: 8133275 - DNA, 18 bp, Homo sapiens
tttcacaacctccagagg

SEQ ID NO: 8133276 - DNA, 22 bp, Homo sapiens
tttatgtagttacggactatca

SEQ ID NO: 8133277 - DNA, 22 bp, Homo sapiens
tttatgagcaatgctgagggga

SEQ ID NO: 8133278 - DNA, 22 bp, Homo sapiens
tttagcattggagtctgggcta

SEQ ID NO: 8133279 - DNA, 22 bp, Homo sapiens
tttagcgtagctgacagctaat

SEQ ID NO: 8133280 - DNA, 22 bp, Homo sapiens
tttagtgctttgctattcatgg

SEQ ID NO: 8133281 - DNA, 22 bp, Homo sapiens
tttagtgcttaggaaatgggga

SEQ ID NO: 8133282 - DNA, 22 bp, Homo sapiens
ttgtttaaaagaaatcatagaa

SEQ ID NO: 8133283 - DNA, 22 bp, Homo sapiens
ttgtttaaaagaaatcatagaa

SEQ ID NO: 8133284 - DNA, 22 bp, Homo sapiens
ttgttgtttccaggatactgtg

SEQ ID NO: 8133285 - DNA, 22 bp, Homo sapiens
ttgttggtggaattgatgctag

SEQ ID NO: 8133286 - DNA, 22 bp, Homo sapiens
ttgttgctgctcaacctctata

SEQ ID NO: 8133287 - DNA, 19 bp, Homo sapiens
tttacaagttctttgtatg

SEQ ID NO: 8133288 - DNA, 22 bp, Homo sapiens
tttaagagctagtatgtcattt

SEQ ID NO: 8133289 - DNA, 22 bp, Homo sapiens
tttaagagcatttgcaatttat

SEQ ID NO: 8133290 - DNA, 22 bp, Homo sapiens
tttacagatctgttgatttgtt

SEQ ID NO: 8133291 - DNA, 21 bp, Homo sapiens
ttagttctaccacttgcattc

SEQ ID NO: 8133292 - DNA, 22 bp, Homo sapiens
ttataattctggcataggctgt

SEQ ID NO: 8133293 - DNA, 20 bp, Homo sapiens
ttatgcaagcatcaatattg

SEQ ID NO: 8133294 - DNA, 22 bp, Homo sapiens
ttatgcaaggacttattacagt

SEQ ID NO: 8133295 - DNA, 22 bp, Homo sapiens
ttatgtgtgtacatgcatatgt

SEQ ID NO: 8133296 - DNA, 22 bp, Homo sapiens
ttatggaataacctttctgaaa

SEQ ID NO: 8133297 - DNA, 22 bp, Homo sapiens
ttatgctaaatgaatcaagtca

SEQ ID NO: 8133298 - DNA, 22 bp, Homo sapiens
ttagtgtacttagtgctctaag

SEQ ID NO: 8133299 - DNA, 19 bp, Homo sapiens
tcctccttacttcctcttg

SEQ ID NO: 8133300 - DNA, 22 bp, Homo sapiens
ttattttctcctcagaaagtgg

SEQ ID NO: 8133301 - DNA, 22 bp, Homo sapiens
ttattttgagagaatgtgtgct

SEQ ID NO: 8133302 - DNA, 21 bp, Homo sapiens
ttcaaaatggtgtgtttgtct

SEQ ID NO: 8133303 - DNA, 22 bp, Homo sapiens
ttcaaacaactcatttatgcaa

SEQ ID NO: 8133304 - DNA, 22 bp, Homo sapiens
ttatttaatgtgatctgaagag

SEQ ID NO: 8133305 - DNA, 22 bp, Homo sapiens
ttattgttagtgagactgtaga

SEQ ID NO: 8133306 - DNA, 22 bp, Homo sapiens
ttatgtttgagtatatgactca

SEQ ID NO: 8133307 - DNA, 22 bp, Homo sapiens
ttatttgttttctgagaagtat

SEQ ID NO: 8133308 - DNA, 21 bp, Homo sapiens
ttcatcagccagaaatcaagc

SEQ ID NO: 8133309 - DNA, 22 bp, Homo sapiens
ttcaatatgatattagctgtgg

SEQ ID NO: 8133310 - DNA, 22 bp, Homo sapiens
ttcaatatgatattagctgtgg

SEQ ID NO: 8133311 - DNA, 22 bp, Homo sapiens
ttcaatcattccaacactttaa

SEQ ID NO: 8133312 - DNA, 21 bp, Homo sapiens
ttcccagcacctagcacaggt

SEQ ID NO: 8133313 - DNA, 22 bp, Homo sapiens
ttcccaggaagcctctccaagc

SEQ ID NO: 8133314 - DNA, 22 bp, Homo sapiens
ttccatcacatcactgaagaca

SEQ ID NO: 8133315 - DNA, 22 bp, Homo sapiens
ttccaaggcatgttctcaagta

SEQ ID NO: 8133316 - DNA, 22 bp, Homo sapiens
ttccaagaaacaagtgatgcag

SEQ ID NO: 8133317 - DNA, 22 bp, Homo sapiens
ttcatcaggcatcatgctcaag

SEQ ID NO: 8133318 - DNA, 23 bp, Homo sapiens
ttccaaggggatgtctccaagtg

SEQ ID NO: 8133319 - DNA, 17 bp, Homo sapiens
ttctcctctgtgtcctt

SEQ ID NO: 8133320 - DNA, 22 bp, Homo sapiens
ttctgattgctgatgaggccca

SEQ ID NO: 8133321 - DNA, 22 bp, Homo sapiens
ttctcacagtacctaacatgta

SEQ ID NO: 8133322 - DNA, 22 bp, Homo sapiens
ttctcacaggatttcttttagt

SEQ ID NO: 8133323 - DNA, 22 bp, Homo sapiens
ttctcacaggctggaatgatga

SEQ ID NO: 8133324 - DNA, 22 bp, Homo sapiens
ttcctttagtgtcatatacttt

SEQ ID NO: 8133325 - DNA, 22 bp, Homo sapiens
ttctaaattttggaagatgcag

SEQ ID NO: 8133326 - DNA, 22 bp, Homo sapiens
ttctaaatgtaaatagtatgat

SEQ ID NO: 8133327 - DNA, 22 bp, Homo sapiens
ttcttcctcacactctcaccca

SEQ ID NO: 8133328 - DNA, 22 bp, Homo sapiens
ttgagaatggaactttctgaca

SEQ ID NO: 8133329 - DNA, 23 bp, Homo sapiens
ttgaaaaatatagtcccattgtc

SEQ ID NO: 8133330 - DNA, 22 bp, Homo sapiens
ttgaaaacatttatattagaat

SEQ ID NO: 8133331 - DNA, 22 bp, Homo sapiens
ttgaaaaaattggtagaggatg

SEQ ID NO: 8133332 - DNA, 20 bp, Homo sapiens
ttgaaaatgcattgtgcagt

SEQ ID NO: 8133333 - DNA, 22 bp, Homo sapiens
ttgaaaatatcacaggagcagc

SEQ ID NO: 8133334 - DNA, 22 bp, Homo sapiens
ttgaaacagacaagtaaatgtc

SEQ ID NO: 8133335 - DNA, 22 bp, Homo sapiens
ttgaaaatggtaagcatgatat

SEQ ID NO: 8133336 - DNA, 22 bp, Homo sapiens
ttgaaagatatgttaatctttc

SEQ ID NO: 8133337 - DNA, 22 bp, Homo sapiens
ttgacattttgtcatattgaca

SEQ ID NO: 8133338 - DNA, 22 bp, Homo sapiens
ttgagaaacctggcagtagaga

SEQ ID NO: 8133339 - DNA, 22 bp, Homo sapiens
ttgaaacattctcctattgatt

SEQ ID NO: 8133340 - DNA, 22 bp, Homo sapiens
ttgaaagacattatttatatat

SEQ ID NO: 8133341 - DNA, 22 bp, Homo sapiens
ttttggtgaatttaagtgctgt

SEQ ID NO: 8133342 - DNA, 22 bp, Homo sapiens
ttttcctcacctaactcaaggt

SEQ ID NO: 8133343 - DNA, 23 bp, Homo sapiens
ttttgtgtgacttaatatctctt

SEQ ID NO: 8133344 - DNA, 22 bp, Homo sapiens
ttttgtgttgccatgttaagca

SEQ ID NO: 8133345 - DNA, 22 bp, Homo sapiens
ttttacaggtcataggtatagt

SEQ ID NO: 8133346 - DNA, 22 bp, Homo sapiens
ttttacaagctgagtcgttaaa

SEQ ID NO: 8133347 - DNA, 22 bp, Homo sapiens
tttgtctaattgcaaggcaagt

SEQ ID NO: 8133348 - DNA, 22 bp, Homo sapiens
ttttattgtcaatgaagacaga

SEQ ID NO: 8133349 - DNA, 22 bp, Homo sapiens
ttttagaagtgcctatcctatg

SEQ ID NO: 8133350 - DNA, 22 bp, Homo sapiens
tttgacagcataatcctacacc

SEQ ID NO: 8133351 - DNA, 22 bp, Homo sapiens
tttgacagcatatcctcatatt

SEQ ID NO: 8133352 - DNA, 23 bp, Homo sapiens
tttgacagcgtggtttctgtggg

SEQ ID NO: 8133353 - DNA, 22 bp, Homo sapiens
tttgaacagggaatgttccaca

SEQ ID NO: 8133354 - DNA, 22 bp, Homo sapiens
tttgacagtaataaagcacaag

SEQ ID NO: 8133355 - DNA, 22 bp, Homo sapiens
tttgacagtactctgtaggatc

SEQ ID NO: 8133356 - DNA, 22 bp, Homo sapiens
tttgacagtcccctgatgtttg

SEQ ID NO: 8133357 - DNA, 22 bp, Homo sapiens
tttgacagggtgatgaggtggt

SEQ ID NO: 8133358 - DNA, 22 bp, Homo sapiens
tttgacaggactaacatatggc

SEQ ID NO: 8133359 - DNA, 22 bp, Homo sapiens
tttgacaggaggtggctactca

SEQ ID NO: 8133360 - DNA, 22 bp, Homo sapiens
tttgacaggaattctctctagg

SEQ ID NO: 8133361 - DNA, 21 bp, Homo sapiens
tttgacagctcagagggcatt

SEQ ID NO: 8133362 - DNA, 22 bp, Homo sapiens
tttgacagcttgcagtgagacc

SEQ ID NO: 8133363 - DNA, 22 bp, Homo sapiens
tttgacagcttgttacaaagtt

SEQ ID NO: 8133364 - DNA, 22 bp, Homo sapiens
tttgacagtgacgcctgtatga

SEQ ID NO: 8133365 - DNA, 22 bp, Homo sapiens
tttgacagtgatgatatataca

SEQ ID NO: 8133366 - DNA, 22 bp, Homo sapiens
tttgacagtgctgctaaaatgc

SEQ ID NO: 8133367 - DNA, 22 bp, Homo sapiens
tttgacagtgctattaagaaac

SEQ ID NO: 8133368 - DNA, 22 bp, Homo sapiens
tttgacagtgttggggcaggct

SEQ ID NO: 8133369 - DNA, 22 bp, Homo sapiens
tttctagatgcttttgaaaatc

SEQ ID NO: 8133370 - DNA, 22 bp, Homo sapiens
tttgaaattggctcattggttt

SEQ ID NO: 8133371 - DNA, 22 bp, Homo sapiens
tttgaaatgtatcagtataggt

SEQ ID NO: 8133372 - DNA, 21 bp, Homo sapiens
tttgaaagtgggtgattcttt

SEQ ID NO: 8133373 - DNA, 22 bp, Homo sapiens
tttgcagtttgttcagctcttt

SEQ ID NO: 8133374 - DNA, 22 bp, Homo sapiens
tttgctgtgggatatccatgtg

SEQ ID NO: 8133375 - DNA, 22 bp, Homo sapiens
tttgctgtgaatccattactgt

SEQ ID NO: 8133376 - DNA, 22 bp, Homo sapiens
tttgcatttataagttggtgga

SEQ ID NO: 8133377 - DNA, 22 bp, Homo sapiens
tttgcatttctaatgagctccg

SEQ ID NO: 8133378 - DNA, 22 bp, Homo sapiens
tttggcctcgtttagaaatggc

SEQ ID NO: 8133379 - DNA, 22 bp, Homo sapiens
tttggctaaggggcttctcaac

SEQ ID NO: 8133380 - DNA, 22 bp, Homo sapiens
tttggctagagaaattactata

SEQ ID NO: 8133381 - DNA, 22 bp, Homo sapiens
tttggctatgtgatacatgtca

SEQ ID NO: 8133382 - DNA, 22 bp, Homo sapiens
attcagttagtagatttggtca

SEQ ID NO: 8133383 - DNA, 22 bp, Homo sapiens
attcagttccttgtgattgtag

SEQ ID NO: 8133384 - DNA, 22 bp, Homo sapiens
attcctcatttgttgagaacca

SEQ ID NO: 8133385 - DNA, 22 bp, Homo sapiens
attcctgactgttagagtttgc

SEQ ID NO: 8133386 - DNA, 22 bp, Homo sapiens
attcctgactgctagtcattca

SEQ ID NO: 8133387 - DNA, 22 bp, Homo sapiens
attcctgactgctagtcattca

SEQ ID NO: 8133388 - DNA, 23 bp, Homo sapiens
attcctgaggctccttatgcacc

SEQ ID NO: 8133389 - DNA, 22 bp, Homo sapiens
attcctgagacttatctgtttc

SEQ ID NO: 8133390 - DNA, 22 bp, Homo sapiens
attcctgattaacgacctttca

SEQ ID NO: 8133391 - DNA, 22 bp, Homo sapiens
gcagcaggcatggccgccctgg

SEQ ID NO: 8133392 - DNA, 19 bp, Homo sapiens
attcctcaaggacagaaat

SEQ ID NO: 8133393 - DNA, 22 bp, Homo sapiens
gcagcagggagcaggggtgtca

SEQ ID NO: 8133394 - DNA, 22 bp, Homo sapiens
attgaagggcattagtcatcag

SEQ ID NO: 8133395 - DNA, 22 bp, Homo sapiens
attgaacagaaaaactcagaga

SEQ ID NO: 8133396 - DNA, 22 bp, Homo sapiens
attgctggatgagctcttggat

SEQ ID NO: 8133397 - DNA, 22 bp, Homo sapiens
attgacagtgttaaagttgcct

SEQ ID NO: 8133398 - DNA, 22 bp, Homo sapiens
attgacagtggctagtgcccag

SEQ ID NO: 8133399 - DNA, 22 bp, Homo sapiens
attgacagtggtgttctgggga

SEQ ID NO: 8133400 - DNA, 22 bp, Homo sapiens
attgacaggtctttgggagtat

SEQ ID NO: 8133401 - DNA, 22 bp, Homo sapiens
attgacaggagagcttggagtg

SEQ ID NO: 8133402 - DNA, 22 bp, Homo sapiens
attgacagcaggggctgtcact

SEQ ID NO: 8133403 - DNA, 22 bp, Homo sapiens
attgacagagctttcaccatga

SEQ ID NO: 8133404 - DNA, 20 bp, Homo sapiens
attgacagaaagtgttcacc

SEQ ID NO: 8133405 - DNA, 22 bp, Homo sapiens
attgacagaaaattggatggca

SEQ ID NO: 8133406 - DNA, 22 bp, Homo sapiens
attgacagaaaagatgttggat

SEQ ID NO: 8133407 - DNA, 22 bp, Homo sapiens
attctgtgtgtactgagatggg

SEQ ID NO: 8133408 - DNA, 22 bp, Homo sapiens
attcttaattccaaagactgag

SEQ ID NO: 8133409 - DNA, 22 bp, Homo sapiens
attcttcactgtttcagaatga

SEQ ID NO: 8133410 - DNA, 22 bp, Homo sapiens
attcttcaaagagtgtcaaagt

SEQ ID NO: 8133411 - DNA, 22 bp, Homo sapiens
attcttcacaaatatatagaag

SEQ ID NO: 8133412 - DNA, 22 bp, Homo sapiens
atgtgtgtgtttaatcctcaaa

SEQ ID NO: 8133413 - DNA, 22 bp, Homo sapiens
atgtgtgtgtatatacacacat

SEQ ID NO: 8133414 - DNA, 22 bp, Homo sapiens
atgtgtgtgtgcgcgcgcagga

SEQ ID NO: 8133415 - DNA, 22 bp, Homo sapiens
atgttttatattttgcagcagt

SEQ ID NO: 8133416 - DNA, 22 bp, Homo sapiens
atgttttattaccaacttgtac

SEQ ID NO: 8133417 - DNA, 22 bp, Homo sapiens
gatgagtgaggacagggtggca

SEQ ID NO: 8133418 - DNA, 22 bp, Homo sapiens
attacaataaggtttatttgta

SEQ ID NO: 8133419 - DNA, 22 bp, Homo sapiens
gatgagttctttctattctatt

SEQ ID NO: 8133420 - DNA, 22 bp, Homo sapiens
attaattttacctttgtaaaca

SEQ ID NO: 8133421 - DNA, 20 bp, Homo sapiens
attagagctacatggctaca

SEQ ID NO: 8133422 - DNA, 22 bp, Homo sapiens
attagagcagtaattgtggcag

SEQ ID NO: 8133423 - DNA, 22 bp, Homo sapiens
attattcttgaggtgtttattg

SEQ ID NO: 8133424 - DNA, 22 bp, Homo sapiens
attagaagcgtgaatcctttca

SEQ ID NO: 8133425 - DNA, 22 bp, Homo sapiens
attagaagatagtgatttctgc

SEQ ID NO: 8133426 - DNA, 22 bp, Homo sapiens
gcctgggagatgcgttgtggcc

SEQ ID NO: 8133427 - DNA, 22 bp, Homo sapiens
gcctgggagcacatcggggtcc

SEQ ID NO: 8133428 - DNA, 22 bp, Homo sapiens
gcctggagctcggctgagggcg

SEQ ID NO: 8133429 - DNA, 22 bp, Homo sapiens
gcctgctggaggagcctcaggg

SEQ ID NO: 8133430 - DNA, 22 bp, Homo sapiens
gcctccccaagcagcagggatt

SEQ ID NO: 8133431 - DNA, 22 bp, Homo sapiens
gcctccccaaagtgctgacagc

SEQ ID NO: 8133432 - DNA, 22 bp, Homo sapiens
atttctcagtgtacattatgtt

SEQ ID NO: 8133433 - DNA, 22 bp, Homo sapiens
gcctcactgcagccccaggaag

SEQ ID NO: 8133434 - DNA, 22 bp, Homo sapiens
atttctcaaccaggtcaaaaag

SEQ ID NO: 8133435 - DNA, 22 bp, Homo sapiens
gcctgtgactcgtcttgggcca

SEQ ID NO: 8133436 - DNA, 22 bp, Homo sapiens
gcctgggagtgcacagtgaggt

SEQ ID NO: 8133437 - DNA, 22 bp, Homo sapiens
gctcaggcaaatttctggtgaa

SEQ ID NO: 8133438 - DNA, 22 bp, Homo sapiens
gcgaggaggggtgctgggcccc

SEQ ID NO: 8133439 - DNA, 22 bp, Homo sapiens
gcgagggcacgcggttgaaggc

SEQ ID NO: 8133440 - DNA, 22 bp, Homo sapiens
gcgcactgggcgcacgcgtagg

SEQ ID NO: 8133441 - DNA, 22 bp, Homo sapiens
gcgcacacgcgtgtgactcatc

SEQ ID NO: 8133442 - DNA, 22 bp, Homo sapiens
gcgcagagtagcagagtgctga

SEQ ID NO: 8133443 - DNA, 22 bp, Homo sapiens
caaactatttacaatggaatca

SEQ ID NO: 8133444 - DNA, 22 bp, Homo sapiens
caaaccattaagcatgttgagt

SEQ ID NO: 8133445 - DNA, 22 bp, Homo sapiens
atttcatgaattccagaagctt

SEQ ID NO: 8133446 - DNA, 22 bp, Homo sapiens
atttcagtgttggttagcaagc

SEQ ID NO: 8133447 - DNA, 22 bp, Homo sapiens
atttcagcagcccatgtttgga

SEQ ID NO: 8133448 - DNA, 22 bp, Homo sapiens
atttcaggaatctgtatgaaag

SEQ ID NO: 8133449 - DNA, 22 bp, Homo sapiens
atttcagattcagaaatgtagg

SEQ ID NO: 8133450 - DNA, 22 bp, Homo sapiens
gccaggcctgcaagtgctggtg

SEQ ID NO: 8133451 - DNA, 22 bp, Homo sapiens
gccaggccactcccgggtcctg

SEQ ID NO: 8133452 - DNA, 19 bp, Homo sapiens
atttactgcctaaaatctc

SEQ ID NO: 8133453 - DNA, 22 bp, Homo sapiens
attggaaaatatggtttctgga

SEQ ID NO: 8133454 - DNA, 22 bp, Homo sapiens
atttaattttctcaacagtgct

SEQ ID NO: 8133455 - DNA, 22 bp, Homo sapiens
atttaaattttctgatggagag

SEQ ID NO: 8133456 - DNA, 22 bp, Homo sapiens
atctactgtgctttaaatagac

SEQ ID NO: 8133457 - DNA, 22 bp, Homo sapiens
cttggtgcccagcaggtggctg

SEQ ID NO: 8133458 - DNA, 22 bp, Homo sapiens
atcttctgggcagtgaaaattg

SEQ ID NO: 8133459 - DNA, 22 bp, Homo sapiens
atgaaattaatcaacacataca

SEQ ID NO: 8133460 - DNA, 22 bp, Homo sapiens
cttgttgcaaacattcactcca

SEQ ID NO: 8133461 - DNA, 22 bp, Homo sapiens
cttgttgctaacatatgcttct

SEQ ID NO: 8133462 - DNA, 22 bp, Homo sapiens
atcttttctgtttgctatgtct

SEQ ID NO: 8133463 - DNA, 22 bp, Homo sapiens
atcttggactacagaagagagg

SEQ ID NO: 8133464 - DNA, 22 bp, Homo sapiens
gaaagcagatgaaattgcaaca

SEQ ID NO: 8133465 - DNA, 22 bp, Homo sapiens
gaaagcagctaagtcttatgat

SEQ ID NO: 8133466 - DNA, 22 bp, Homo sapiens
atgattactcccatttgataga

SEQ ID NO: 8133467 - DNA, 22 bp, Homo sapiens
atgagttgaagctacaagaggc

SEQ ID NO: 8133468 - DNA, 20 bp, Homo sapiens
atgattttgcactaacttca

SEQ ID NO: 8133469 - DNA, 22 bp, Homo sapiens
atgattttttctaacacagtcg

SEQ ID NO: 8133470 - DNA, 22 bp, Homo sapiens
atgaagcaattagaaacttgaa

SEQ ID NO: 8133471 - DNA, 20 bp, Homo sapiens
gaaagattgtaagaggcaga

SEQ ID NO: 8133472 - DNA, 22 bp, Homo sapiens
atgcattatcaattgatgtagg

SEQ ID NO: 8133473 - DNA, 22 bp, Homo sapiens
gacactgaagtcactaagcagg

SEQ ID NO: 8133474 - DNA, 23 bp, Homo sapiens
atgcatcatgaaaactagagagc

SEQ ID NO: 8133475 - DNA, 22 bp, Homo sapiens
atgcagctatttgagcatgtca

SEQ ID NO: 8133476 - DNA, 20 bp, Homo sapiens
atgcaaatcccaaaatcagg

SEQ ID NO: 8133477 - DNA, 22 bp, Homo sapiens
atgcaaataaagcaactataca

SEQ ID NO: 8133478 - DNA, 22 bp, Homo sapiens
atggagcacacgccatcacata

SEQ ID NO: 8133479 - DNA, 20 bp, Homo sapiens
atggaggaagggcaagagaa

SEQ ID NO: 8133480 - DNA, 22 bp, Homo sapiens
gagaaatgctagcttaggaatc

SEQ ID NO: 8133481 - DNA, 22 bp, Homo sapiens
atggactctggaggagatagag

SEQ ID NO: 8133482 - DNA, 22 bp, Homo sapiens
atggactcactaattcctccac

SEQ ID NO: 8133483 - DNA, 22 bp, Homo sapiens
gacagatgtgggtgacagcagc

SEQ ID NO: 8133484 - DNA, 22 bp, Homo sapiens
gagccagccttcttctgaggtc

SEQ ID NO: 8133485 - DNA, 22 bp, Homo sapiens
gagccagcgccttgcctctggg

SEQ ID NO: 8133486 - DNA, 22 bp, Homo sapiens
gagaggaactcccagtgcctgg

SEQ ID NO: 8133487 - DNA, 22 bp, Homo sapiens
atggccagtctattcatggtta

SEQ ID NO: 8133488 - DNA, 22 bp, Homo sapiens
gagaggaagccagggggtgttg

SEQ ID NO: 8133489 - DNA, 22 bp, Homo sapiens
gaggctgcggggaggagcctgc

SEQ ID NO: 8133490 - DNA, 22 bp, Homo sapiens
gaggctgccccttcctcagctg

SEQ ID NO: 8133491 - DNA, 22 bp, Homo sapiens
atgtgtgtgatgggcgccgcca

SEQ ID NO: 8133492 - DNA, 22 bp, Homo sapiens
atgtgtgtatgtgcctatatct

SEQ ID NO: 8133493 - DNA, 22 bp, Homo sapiens
atgtgtgtgcatttctctccct

SEQ ID NO: 8133494 - DNA, 22 bp, Homo sapiens
atgtgtgtatatatagtcattt

SEQ ID NO: 8133495 - DNA, 22 bp, Homo sapiens
gaggggagaggcttatggatca

SEQ ID NO: 8133496 - DNA, 18 bp, Homo sapiens
atgtacatttgctaaagc

SEQ ID NO: 8133497 - DNA, 22 bp, Homo sapiens
atgtacatttagatcatttctg

SEQ ID NO: 8133498 - DNA, 22 bp, Homo sapiens
gaggagctgcccgtgtgtctgc

SEQ ID NO: 8133499 - DNA, 22 bp, Homo sapiens
gaggagctgggctgagagggtc

SEQ ID NO: 8133500 - DNA, 22 bp, Homo sapiens
gaggccaggagtgctgtaagtt

SEQ ID NO: 8133501 - DNA, 22 bp, Homo sapiens
atggctggatttgatccatggg

SEQ ID NO: 8133502 - DNA, 22 bp, Homo sapiens
atggggctctgcggctgctccc

SEQ ID NO: 8133503 - DNA, 22 bp, Homo sapiens
atggggctgggattctcctcgg

SEQ ID NO: 8133504 - DNA, 22 bp, Homo sapiens
gagctgggcctgcgagtgctgc

SEQ ID NO: 8133505 - DNA, 21 bp, Homo sapiens
gagctgggcgaggctccgggg

SEQ ID NO: 8133506 - DNA, 22 bp, Homo sapiens
gagctgggctggcttcctccct

SEQ ID NO: 8133507 - DNA, 21 bp, Homo sapiens
cactggaattttctgtgacat

SEQ ID NO: 8133508 - DNA, 22 bp, Homo sapiens
cactggcatctaagggtggtag

SEQ ID NO: 8133509 - DNA, 22 bp, Homo sapiens
cactgcctggaaggagagacat

SEQ ID NO: 8133510 - DNA, 22 bp, Homo sapiens
cactgaagatgcgactagtgct

SEQ ID NO: 8133511 - DNA, 22 bp, Homo sapiens
ggcctctcatgcccagagccaa

SEQ ID NO: 8133512 - DNA, 23 bp, Homo sapiens
ggatgggcaagcctagtgcctac

SEQ ID NO: 8133513 - DNA, 22 bp, Homo sapiens
ggaggcggaggctgcagtgagc

SEQ ID NO: 8133514 - DNA, 22 bp, Homo sapiens
ggatgggcagacaggacggcac

SEQ ID NO: 8133515 - DNA, 22 bp, Homo sapiens
ggatgggcccgggacggcgctg

SEQ ID NO: 8133516 - DNA, 23 bp, Homo sapiens
cacagggagggaaactctttcag

SEQ ID NO: 8133517 - DNA, 22 bp, Homo sapiens
cacagggagaggaacagcgcag

SEQ ID NO: 8133518 - DNA, 22 bp, Homo sapiens
cacactagcacttcagaggttc

SEQ ID NO: 8133519 - DNA, 22 bp, Homo sapiens
cacactgactggaatcaaggat

SEQ ID NO: 8133520 - DNA, 22 bp, Homo sapiens
cacactgtcaggtaaataacac

SEQ ID NO: 8133521 - DNA, 22 bp, Homo sapiens
ggaggcggagcttgcagtgagc

SEQ ID NO: 8133522 - DNA, 22 bp, Homo sapiens
ggaggcggacacaggtagtgtt

SEQ ID NO: 8133523 - DNA, 22 bp, Homo sapiens
ggaggcggaagttgcagtgagc

SEQ ID NO: 8133524 - DNA, 20 bp, Homo sapiens
ggaggcgctgggctcgcgct

SEQ ID NO: 8133525 - DNA, 22 bp, Homo sapiens
ggaggcgcggctcggctgtgcc

SEQ ID NO: 8133526 - DNA, 22 bp, Homo sapiens
ggcactgctgtaggcagtgagg

SEQ ID NO: 8133527 - DNA, 22 bp, Homo sapiens
ggcactgcttcctgagcctgag

SEQ ID NO: 8133528 - DNA, 22 bp, Homo sapiens
cacagtgcgaaagaaacccagc

SEQ ID NO: 8133529 - DNA, 22 bp, Homo sapiens
cacagtgctcaaacacaagtgc

SEQ ID NO: 8133530 - DNA, 22 bp, Homo sapiens
ggcagatggaagaggctgggtc

SEQ ID NO: 8133531 - DNA, 22 bp, Homo sapiens
cacagtgtagactaataataga

SEQ ID NO: 8133532 - DNA, 22 bp, Homo sapiens
cacagtgtggcaaatttcaact

SEQ ID NO: 8133533 - DNA, 22 bp, Homo sapiens
gcttctcctcccgctcccaggc

SEQ ID NO: 8133534 - DNA, 22 bp, Homo sapiens
gctgtggcctccagcactcccc

SEQ ID NO: 8133535 - DNA, 22 bp, Homo sapiens
gcttggctttgtcttgttcact

SEQ ID NO: 8133536 - DNA, 22 bp, Homo sapiens
caaggattaatagaatgaatca

SEQ ID NO: 8133537 - DNA, 22 bp, Homo sapiens
gctgtgctgtttccacctctct

SEQ ID NO: 8133538 - DNA, 22 bp, Homo sapiens
cacaactttccttgactgtaag

SEQ ID NO: 8133539 - DNA, 22 bp, Homo sapiens
ggaaaagaaagggactgattgg

SEQ ID NO: 8133540 - DNA, 22 bp, Homo sapiens
cacaaaccttctgcagcctgta

SEQ ID NO: 8133541 - DNA, 22 bp, Homo sapiens
cacaaacctgccagccctgccc

SEQ ID NO: 8133542 - DNA, 22 bp, Homo sapiens
cacaccagatggcagcgtggga

SEQ ID NO: 8133543 - DNA, 18 bp, Homo sapiens
cacaatttacagatgaca

SEQ ID NO: 8133544 - DNA, 22 bp, Homo sapiens
cacaatttgtattttgcatcca

SEQ ID NO: 8133545 - DNA, 22 bp, Homo sapiens
cacaatttgttttatcagtatt

SEQ ID NO: 8133546 - DNA, 22 bp, Homo sapiens
caaggacagcgtcaggtgcaac

SEQ ID NO: 8133547 - DNA, 22 bp, Homo sapiens
caaggacagcgtcaggtgcaac

SEQ ID NO: 8133548 - DNA, 21 bp, Homo sapiens
caaggacaggttgcagggcaa

SEQ ID NO: 8133549 - DNA, 21 bp, Homo sapiens
caaggacaggttgcagggcaa

SEQ ID NO: 8133550 - DNA, 22 bp, Homo sapiens
caaggacactccctgctgggca

SEQ ID NO: 8133551 - DNA, 22 bp, Homo sapiens
caagaggagcaggcaggtgtgc

SEQ ID NO: 8133552 - DNA, 22 bp, Homo sapiens
caagaggattattaataaataa

SEQ ID NO: 8133553 - DNA, 23 bp, Homo sapiens
gctgccacagggctcaggcaggt

SEQ ID NO: 8133554 - DNA, 22 bp, Homo sapiens
caacatttgtgatgagcaaact

SEQ ID NO: 8133555 - DNA, 22 bp, Homo sapiens
caacatttgagtaaagaaatgg

SEQ ID NO: 8133556 - DNA, 22 bp, Homo sapiens
caaagtatatttcatagtctca

SEQ ID NO: 8133557 - DNA, 22 bp, Homo sapiens
gctcctgcaggacccaggagac

SEQ ID NO: 8133558 - DNA, 22 bp, Homo sapiens
gggactcctgcatttcaagtcc

SEQ ID NO: 8133559 - DNA, 22 bp, Homo sapiens
gggactccataagcacatggat

SEQ ID NO: 8133560 - DNA, 22 bp, Homo sapiens
gggactcctttaaggagggtga

SEQ ID NO: 8133561 - DNA, 18 bp, Homo sapiens
gggaagccgggaagccgg

SEQ ID NO: 8133562 - DNA, 22 bp, Homo sapiens
cagaagcagtgagagatgtgca

SEQ ID NO: 8133563 - DNA, 22 bp, Homo sapiens
cagaagcagtgagagatgtgca

SEQ ID NO: 8133564 - DNA, 22 bp, Homo sapiens
cactggctccctgatttgaagc

SEQ ID NO: 8133565 - DNA, 22 bp, Homo sapiens
cagaaggtgaaggcagaacctt

SEQ ID NO: 8133566 - DNA, 20 bp, Homo sapiens
gggcaaggaaacagccccca

SEQ ID NO: 8133567 - DNA, 17 bp, Homo sapiens
cagacaggctgtcaccc

SEQ ID NO: 8133568 - DNA, 22 bp, Homo sapiens
gggcaagcagtgaggacagcac

SEQ ID NO: 8133569 - DNA, 22 bp, Homo sapiens
gggagggccagtgctctctaga

SEQ ID NO: 8133570 - DNA, 22 bp, Homo sapiens
gggagcaggagcctgcctgcca

SEQ ID NO: 8133571 - DNA, 20 bp, Homo sapiens
gggaggcattggtccctcac

SEQ ID NO: 8133572 - DNA, 22 bp, Homo sapiens
gggagggccaggctcacccagg

SEQ ID NO: 8133573 - DNA, 22 bp, Homo sapiens
gggaggtcctaaaggggaccag

SEQ ID NO: 8133574 - DNA, 22 bp, Homo sapiens
gggaggtcagggtgcctgctgg

SEQ ID NO: 8133575 - DNA, 22 bp, Homo sapiens
gggaggggttgcatgtttgagt

SEQ ID NO: 8133576 - DNA, 22 bp, Homo sapiens
gggagggtctgagagctgcacc

SEQ ID NO: 8133577 - DNA, 22 bp, Homo sapiens
gggagggtctgccatgctccct

SEQ ID NO: 8133578 - DNA, 22 bp, Homo sapiens
cagacaggcaggtgagagctcc

SEQ ID NO: 8133579 - DNA, 22 bp, Homo sapiens
cagacaggaagttcagaagaaa

SEQ ID NO: 8133580 - DNA, 22 bp, Homo sapiens
gggcactgtgctaggtgctgag

SEQ ID NO: 8133581 - DNA, 22 bp, Homo sapiens
gggcgagggcgaaagcgagagc

SEQ ID NO: 8133582 - DNA, 22 bp, Homo sapiens
gggcgaggactgactctgggca

SEQ ID NO: 8133583 - DNA, 21 bp, Homo sapiens
gggcgaggcctgatgtggctc

SEQ ID NO: 8133584 - DNA, 22 bp, Homo sapiens
gggccttcagccttggactgag

SEQ ID NO: 8133585 - DNA, 22 bp, Homo sapiens
gggccttccgactcccaaggcc

SEQ ID NO: 8133586 - DNA, 22 bp, Homo sapiens
gggccttctagttagccccaat

SEQ ID NO: 8133587 - DNA, 22 bp, Homo sapiens
gggcgcagccaatcctggccct

SEQ ID NO: 8133588 - DNA, 22 bp, Homo sapiens
gggctttttacattgaacattt

SEQ ID NO: 8133589 - DNA, 22 bp, Homo sapiens
cagagctgcagattgaaggcat

SEQ ID NO: 8133590 - DNA, 20 bp, Homo sapiens
ggggaagaaaaggatgtgat

SEQ ID NO: 8133591 - DNA, 22 bp, Homo sapiens
gggtgcaggggaccctagggac

SEQ ID NO: 8133592 - DNA, 22 bp, Homo sapiens
gggtgcagggtctccagcagct

SEQ ID NO: 8133593 - DNA, 22 bp, Homo sapiens
gggtgcctacatgtcctccatg

SEQ ID NO: 8133594 - DNA, 22 bp, Homo sapiens
gggtgctcatggataaggcgaa

SEQ ID NO: 8133595 - DNA, 22 bp, Homo sapiens
gggtgctcctggcggcctcttt

SEQ ID NO: 8133596 - DNA, 22 bp, Homo sapiens
gggtgctgaggaagacagcagg

SEQ ID NO: 8133597 - DNA, 22 bp, Homo sapiens
gggtgctcttgggaaacgtagt

SEQ ID NO: 8133598 - DNA, 22 bp, Homo sapiens
gtatttctagaaccaaaagcca

SEQ ID NO: 8133599 - DNA, 22 bp, Homo sapiens
gtatttctagaatggtagcact

SEQ ID NO: 8133600 - DNA, 22 bp, Homo sapiens
cagcaggcaggtgggccaagtc

SEQ ID NO: 8133601 - DNA, 19 bp, Homo sapiens
gtatatttatatggctgta

SEQ ID NO: 8133602 - DNA, 22 bp, Homo sapiens
gtatattttgatcaccctctat

SEQ ID NO: 8133603 - DNA, 22 bp, Homo sapiens
ggttgctctttggaccctgctg

SEQ ID NO: 8133604 - DNA, 22 bp, Homo sapiens
cagcaataaggtaagcttctcc

SEQ ID NO: 8133605 - DNA, 20 bp, Homo sapiens
gggtgggagagtctgagggt

SEQ ID NO: 8133606 - DNA, 22 bp, Homo sapiens
ggtggggctaggacctcaggat

SEQ ID NO: 8133607 - DNA, 22 bp, Homo sapiens
ggtgggacaggtaggagtggct

SEQ ID NO: 8133608 - DNA, 22 bp, Homo sapiens
gggtgggactctttggcctgag

SEQ ID NO: 8133609 - DNA, 22 bp, Homo sapiens
ggtgggtcttgcggggcagctt

SEQ ID NO: 8133610 - DNA, 22 bp, Homo sapiens
ggtgggtcttgtggggcagctt

SEQ ID NO: 8133611 - DNA, 22 bp, Homo sapiens
cagccaaatgagtcataaatgt

SEQ ID NO: 8133612 - DNA, 22 bp, Homo sapiens
cagcatgcctgggctgcctgcc

SEQ ID NO: 8133613 - DNA, 22 bp, Homo sapiens
cagcattctactttgtgaactg

SEQ ID NO: 8133614 - DNA, 22 bp, Homo sapiens
cagcatttggaggagaggcttt

SEQ ID NO: 8133615 - DNA, 22 bp, Homo sapiens
cagcatttatcttgtagcagga

SEQ ID NO: 8133616 - DNA, 22 bp, Homo sapiens
aggtgctgttggcagcgggcag

SEQ ID NO: 8133617 - DNA, 22 bp, Homo sapiens
aggtgctgggcagcagtcattg

SEQ ID NO: 8133618 - DNA, 17 bp, Homo sapiens
aggtgctggagcatcag

SEQ ID NO: 8133619 - DNA, 22 bp, Homo sapiens
aggtgctggcgccccaggagac

SEQ ID NO: 8133620 - DNA, 22 bp, Homo sapiens
aggtgctggcgccccaggagac

SEQ ID NO: 8133621 - DNA, 19 bp, Homo sapiens
cctgggacttaggctgggt

SEQ ID NO: 8133622 - DNA, 22 bp, Homo sapiens
aggtgctctaggtatctacttt

SEQ ID NO: 8133623 - DNA, 22 bp, Homo sapiens
aggtggctgcctccccgcgcgg

SEQ ID NO: 8133624 - DNA, 21 bp, Homo sapiens
aggtggggctgcacctctgct

SEQ ID NO: 8133625 - DNA, 22 bp, Homo sapiens
cgaggcaggcaggcggaggata

SEQ ID NO: 8133626 - DNA, 22 bp, Homo sapiens
cgaggaggaaacgcggagaact

SEQ ID NO: 8133627 - DNA, 22 bp, Homo sapiens
cggagcgctgggggactctgca

SEQ ID NO: 8133628 - DNA, 22 bp, Homo sapiens
cggagcgctgggggactctgca

SEQ ID NO: 8133629 - DNA, 22 bp, Homo sapiens
cggagcagaaggcgccgccggc

SEQ ID NO: 8133630 - DNA, 22 bp, Homo sapiens
cggaggggtttgaacagaggag

SEQ ID NO: 8133631 - DNA, 22 bp, Homo sapiens
cggaggggatacattttctgaa

SEQ ID NO: 8133632 - DNA, 22 bp, Homo sapiens
agtatatttgttaagattattc

SEQ ID NO: 8133633 - DNA, 22 bp, Homo sapiens
cggccctgctgagcttgtctgg

SEQ ID NO: 8133634 - DNA, 22 bp, Homo sapiens
cggccctgaccagaccttagtt

SEQ ID NO: 8133635 - DNA, 22 bp, Homo sapiens
cggccctggcggaggcgggaga

SEQ ID NO: 8133636 - DNA, 22 bp, Homo sapiens
agggtcagagtcaggtgcagta

SEQ ID NO: 8133637 - DNA, 20 bp, Homo sapiens
agggtcagagagcgtgagtg

SEQ ID NO: 8133638 - DNA, 22 bp, Homo sapiens
cctctgagttggcctgtcttgt

SEQ ID NO: 8133639 - DNA, 22 bp, Homo sapiens
cctgcccctcaaggcctggtgc

SEQ ID NO: 8133640 - DNA, 21 bp, Homo sapiens
ctctggtttgcattggattat

SEQ ID NO: 8133641 - DNA, 22 bp, Homo sapiens
ctctggtttctgacctgaattt

SEQ ID NO: 8133642 - DNA, 22 bp, Homo sapiens
ctctgtagaaagagcccaggtg

SEQ ID NO: 8133643 - DNA, 22 bp, Homo sapiens
ctctgtctatcccattctgtgc

SEQ ID NO: 8133644 - DNA, 22 bp, Homo sapiens
agtgctgggctatctactgcta

SEQ ID NO: 8133645 - DNA, 22 bp, Homo sapiens
agtgctggcccatagctgctgg

SEQ ID NO: 8133646 - DNA, 22 bp, Homo sapiens
agtgctggattacaggcgtgag

SEQ ID NO: 8133647 - DNA, 22 bp, Homo sapiens
ctccttttcctactcatactat

SEQ ID NO: 8133648 - DNA, 22 bp, Homo sapiens
ctcagcaattacctgtgtctct

SEQ ID NO: 8133649 - DNA, 19 bp, Homo sapiens
ctcagcaagatagaaatgg

SEQ ID NO: 8133650 - DNA, 22 bp, Homo sapiens
ctcagcaagattaagcagcttg

SEQ ID NO: 8133651 - DNA, 22 bp, Homo sapiens
ctcagcaaccctagaacatttg

SEQ ID NO: 8133652 - DNA, 22 bp, Homo sapiens
ctcagcaagacccccaccgtgt

SEQ ID NO: 8133653 - DNA, 22 bp, Homo sapiens
ctcagcaacccacacacggtct

SEQ ID NO: 8133654 - DNA, 22 bp, Homo sapiens
ctcagcaacagcgacttaaggg

SEQ ID NO: 8133655 - DNA, 22 bp, Homo sapiens
ctcagcaacacggcctattaag

SEQ ID NO: 8133656 - DNA, 22 bp, Homo sapiens
ctcagatcatcagaaacaatgt

SEQ ID NO: 8133657 - DNA, 22 bp, Homo sapiens
ctcagataatctttgagtcttc

SEQ ID NO: 8133658 - DNA, 22 bp, Homo sapiens
ctcagacccccagagctgctaa

SEQ ID NO: 8133659 - DNA, 22 bp, Homo sapiens
cggggtggcactctaaatagaa

SEQ ID NO: 8133660 - DNA, 22 bp, Homo sapiens
cggggtgggaatagacctgtct

SEQ ID NO: 8133661 - DNA, 22 bp, Homo sapiens
cgggtggagacagagggcataa

SEQ ID NO: 8133662 - DNA, 22 bp, Homo sapiens
cgggggagttgaggcacatggg

SEQ ID NO: 8133663 - DNA, 22 bp, Homo sapiens
ctatttatgtgctattttgtat

SEQ ID NO: 8133664 - DNA, 22 bp, Homo sapiens
ctatttatgtccaagtgtttta

SEQ ID NO: 8133665 - DNA, 22 bp, Homo sapiens
ctcaacatatgactttggtggg

SEQ ID NO: 8133666 - DNA, 22 bp, Homo sapiens
ctcagctccagccctcagcagc

SEQ ID NO: 8133667 - DNA, 22 bp, Homo sapiens
ctcagctcattgtggatccggt

SEQ ID NO: 8133668 - DNA, 22 bp, Homo sapiens
ctcagctagtaacgtacatgtc

SEQ ID NO: 8133669 - DNA, 22 bp, Homo sapiens
ctcagccctccccggggaataa

SEQ ID NO: 8133670 - DNA, 22 bp, Homo sapiens
ctcagccccaatttgccctctt

SEQ ID NO: 8133671 - DNA, 21 bp, Homo sapiens
ctcaggcatttgaggagagtc

SEQ ID NO: 8133672 - DNA, 21 bp, Homo sapiens
agtgacagaggaaggtgcata

SEQ ID NO: 8133673 - DNA, 22 bp, Homo sapiens
agtgacagctgggaaggtgaaa

SEQ ID NO: 8133674 - DNA, 22 bp, Homo sapiens
ctcagtggtcggcacagtttgt

SEQ ID NO: 8133675 - DNA, 22 bp, Homo sapiens
atcattttgtgacaatgcctgt

SEQ ID NO: 8133676 - DNA, 22 bp, Homo sapiens
atcctaaattgagagctctaat

SEQ ID NO: 8133677 - DNA, 22 bp, Homo sapiens
atccggggttcattttcactga

SEQ ID NO: 8133678 - DNA, 22 bp, Homo sapiens
atcctaaaattgttcaatttct

SEQ ID NO: 8133679 - DNA, 22 bp, Homo sapiens
atcctaaagaaatatttattaa

SEQ ID NO: 8133680 - DNA, 22 bp, Homo sapiens
atcctcacatttgggcaggtga

SEQ ID NO: 8133681 - DNA, 22 bp, Homo sapiens
atcacagtttacaaacctgctg

SEQ ID NO: 8133682 - DNA, 22 bp, Homo sapiens
atcacagttttgtgccttgtgg

SEQ ID NO: 8133683 - DNA, 22 bp, Homo sapiens
atcacagttttaccatttggta

SEQ ID NO: 8133684 - DNA, 22 bp, Homo sapiens
atcacatctcaccactgcaacc

SEQ ID NO: 8133685 - DNA, 22 bp, Homo sapiens
atcacagtctttttcttaagta

SEQ ID NO: 8133686 - DNA, 22 bp, Homo sapiens
atcacagtgctaggctgaggga

SEQ ID NO: 8133687 - DNA, 22 bp, Homo sapiens
atcacagtgccttcgtaaattt

SEQ ID NO: 8133688 - DNA, 22 bp, Homo sapiens
atcacagtgtagaccttttaaa

SEQ ID NO: 8133689 - DNA, 22 bp, Homo sapiens
atcacagttactcaaataatga

SEQ ID NO: 8133690 - DNA, 22 bp, Homo sapiens
atcacagtggctacctctggat

SEQ ID NO: 8133691 - DNA, 22 bp, Homo sapiens
atcacagtggcagggatttggg

SEQ ID NO: 8133692 - DNA, 22 bp, Homo sapiens
ctgtcctctgtcctcagcagga

SEQ ID NO: 8133693 - DNA, 22 bp, Homo sapiens
ctgtccagtcagaacgtcatta

SEQ ID NO: 8133694 - DNA, 22 bp, Homo sapiens
ctgtccgccgacttggccaggc

SEQ ID NO: 8133695 - DNA, 22 bp, Homo sapiens
ctgtgatgatggaaactttctt

SEQ ID NO: 8133696 - DNA, 18 bp, Homo sapiens
atcatgctgaattaaaga

SEQ ID NO: 8133697 - DNA, 22 bp, Homo sapiens
ctgggcaggatacttcatggga

SEQ ID NO: 8133698 - DNA, 22 bp, Homo sapiens
ctgggcaggtatacaaaaaatg

SEQ ID NO: 8133699 - DNA, 22 bp, Homo sapiens
ctgggcagtatgaatattcaaa

SEQ ID NO: 8133700 - DNA, 20 bp, Homo sapiens
ctgggcaggtgtttgatctc

SEQ ID NO: 8133701 - DNA, 22 bp, Homo sapiens
ctgggcagtgcagctatagaac

SEQ ID NO: 8133702 - DNA, 22 bp, Homo sapiens
ctgggcaggagggctctatgga

SEQ ID NO: 8133703 - DNA, 22 bp, Homo sapiens
ctgggcagtggtggcatctttg

SEQ ID NO: 8133704 - DNA, 22 bp, Homo sapiens
ctgggcagtgggcaagttgtat

SEQ ID NO: 8133705 - DNA, 22 bp, Homo sapiens
ctgggcagtggtggcccttccc

SEQ ID NO: 8133706 - DNA, 22 bp, Homo sapiens
atatttctctcagacatggaag

SEQ ID NO: 8133707 - DNA, 22 bp, Homo sapiens
atatgttgagcaagcatgatta

SEQ ID NO: 8133708 - DNA, 20 bp, Homo sapiens
atatttcttaagaactttca

SEQ ID NO: 8133709 - DNA, 22 bp, Homo sapiens
atatttcttgagcacctggtat

SEQ ID NO: 8133710 - DNA, 22 bp, Homo sapiens
atatggctgttgcacatctaag

SEQ ID NO: 8133711 - DNA, 22 bp, Homo sapiens
ctgggaagcatggtgatggtat

SEQ ID NO: 8133712 - DNA, 22 bp, Homo sapiens
ctgggaaggggaaggtcctctc

SEQ ID NO: 8133713 - DNA, 22 bp, Homo sapiens
ctgggagacaagagagggctga

SEQ ID NO: 8133714 - DNA, 19 bp, Homo sapiens
ctgggaggtgttcagagaa

SEQ ID NO: 8133715 - DNA, 22 bp, Homo sapiens
atatatatgctgatggctgcca

SEQ ID NO: 8133716 - DNA, 22 bp, Homo sapiens
atatatattgcccaggctggtt

SEQ ID NO: 8133717 - DNA, 20 bp, Homo sapiens
ataaaataactgccacaaga

SEQ ID NO: 8133718 - DNA, 22 bp, Homo sapiens
ctgcagcctccaccttttgggt

SEQ ID NO: 8133719 - DNA, 22 bp, Homo sapiens
agtttggaaaatgagacaagga

SEQ ID NO: 8133720 - DNA, 22 bp, Homo sapiens
ctgaggggtatccaaggggtaa

SEQ ID NO: 8133721 - DNA, 22 bp, Homo sapiens
agttgggacatgttctttcccc

SEQ ID NO: 8133722 - DNA, 22 bp, Homo sapiens
ctgcttctccctgagatagtgt

SEQ ID NO: 8133723 - DNA, 18 bp, Homo sapiens
ctgcttctgtctgccagt

SEQ ID NO: 8133724 - DNA, 22 bp, Homo sapiens
ctgcttctgggatgatggagta

SEQ ID NO: 8133725 - DNA, 22 bp, Homo sapiens
atacaagactcagcacagacgg

SEQ ID NO: 8133726 - DNA, 22 bp, Homo sapiens
ctgctctggcgtactcggcatc

SEQ ID NO: 8133727 - DNA, 22 bp, Homo sapiens
ctgcccaccgtgtgcacgtgcg

SEQ ID NO: 8133728 - DNA, 22 bp, Homo sapiens
ctgcccagaatcactcactcga

SEQ ID NO: 8133729 - DNA, 19 bp, Homo sapiens
ctgctcaggtcagtctgtc

SEQ ID NO: 8133730 - DNA, 22 bp, Homo sapiens
atacagagcagtaatagaggag

SEQ ID NO: 8133731 - DNA, 22 bp, Homo sapiens
atacagagaaggggtagaggat

SEQ ID NO: 8133732 - DNA, 22 bp, Homo sapiens
atacttctttaagagtaagtct

SEQ ID NO: 8133733 - DNA, 22 bp, Homo sapiens
ctggagggctgcagcgaggctg

SEQ ID NO: 8133734 - DNA, 21 bp, Homo sapiens
ccactgctcttccctagggcc

SEQ ID NO: 8133735 - DNA, 22 bp, Homo sapiens
aggcagtctatctctggagcct

SEQ ID NO: 8133736 - DNA, 22 bp, Homo sapiens
aggcccatagtagctctgggca

SEQ ID NO: 8133737 - DNA, 18 bp, Homo sapiens
aggcccgttgtgtggaat

SEQ ID NO: 8133738 - DNA, 22 bp, Homo sapiens
aggccctgggttagggcccact

SEQ ID NO: 8133739 - DNA, 22 bp, Homo sapiens
aggccctgaagtcggcccctca

SEQ ID NO: 8133740 - DNA, 22 bp, Homo sapiens
aggccggcgcttcccaggaggc

SEQ ID NO: 8133741 - DNA, 22 bp, Homo sapiens
aggccagcttccagaggggcag

SEQ ID NO: 8133742 - DNA, 22 bp, Homo sapiens
aggccagcttctaccctctgtt

SEQ ID NO: 8133743 - DNA, 22 bp, Homo sapiens
aggccagctgccacccggtccg

SEQ ID NO: 8133744 - DNA, 22 bp, Homo sapiens
aggccagctctacccttggact

SEQ ID NO: 8133745 - DNA, 22 bp, Homo sapiens
aggccagcctcaggcagggacc

SEQ ID NO: 8133746 - DNA, 23 bp, Homo sapiens
aggccagcgcagacaccgagcac

SEQ ID NO: 8133747 - DNA, 22 bp, Homo sapiens
ccaggcccgttcccttctccag

SEQ ID NO: 8133748 - DNA, 22 bp, Homo sapiens
aggcctcagtttgtcatctgta

SEQ ID NO: 8133749 - DNA, 22 bp, Homo sapiens
aggcctcacacaacagatgcat

SEQ ID NO: 8133750 - DNA, 22 bp, Homo sapiens
ccaggccaaattcagtcagcag

SEQ ID NO: 8133751 - DNA, 22 bp, Homo sapiens
aggctctgcagtgctggaggac

SEQ ID NO: 8133752 - DNA, 22 bp, Homo sapiens
aggctctgcagaccccagctgt

SEQ ID NO: 8133753 - DNA, 23 bp, Homo sapiens
ccagtgattgcctggaaggaggt

SEQ ID NO: 8133754 - DNA, 22 bp, Homo sapiens
aggctgagcctgggcgtggtgg

SEQ ID NO: 8133755 - DNA, 22 bp, Homo sapiens
agggagcagcagccacaggatg

SEQ ID NO: 8133756 - DNA, 22 bp, Homo sapiens
agggagcattgtgacatatcac

SEQ ID NO: 8133757 - DNA, 22 bp, Homo sapiens
agggagcatgggtgaagcaggc

SEQ ID NO: 8133758 - DNA, 22 bp, Homo sapiens
agggaaggaggttagaacccac

SEQ ID NO: 8133759 - DNA, 22 bp, Homo sapiens
cccagcctctgtttgctcctct

SEQ ID NO: 8133760 - DNA, 22 bp, Homo sapiens
cccagcctctggattctgccct

SEQ ID NO: 8133761 - DNA, 22 bp, Homo sapiens
cccagcctctgggttctgccgg

SEQ ID NO: 8133762 - DNA, 22 bp, Homo sapiens
ccatgagaagttagactagcca

SEQ ID NO: 8133763 - DNA, 22 bp, Homo sapiens
ccatgagacagcaactgaaagt

SEQ ID NO: 8133764 - DNA, 19 bp, Homo sapiens
ccctgggggtttctggtac

SEQ ID NO: 8133765 - DNA, 22 bp, Homo sapiens
ccctggggctgagggatggccg

SEQ ID NO: 8133766 - DNA, 22 bp, Homo sapiens
cctcagacccctgctgagcttc

SEQ ID NO: 8133767 - DNA, 22 bp, Homo sapiens
cctcccagtgcctccagagcag

SEQ ID NO: 8133768 - DNA, 22 bp, Homo sapiens
cctccaggaggaaatggaacac

SEQ ID NO: 8133769 - DNA, 18 bp, Homo sapiens
agggccagctgtgagtag

SEQ ID NO: 8133770 - DNA, 22 bp, Homo sapiens
agggccaggaacacctgaaggg

SEQ ID NO: 8133771 - DNA, 22 bp, Homo sapiens
agggccagccgacttccagcct

SEQ ID NO: 8133772 - DNA, 22 bp, Homo sapiens
agggccagctagagccctcgcc

SEQ ID NO: 8133773 - DNA, 22 bp, Homo sapiens
ccctggggagcaggcgaaggag

SEQ ID NO: 8133774 - DNA, 22 bp, Homo sapiens
agggccaggctcccatgtcagg

SEQ ID NO: 8133775 - DNA, 22 bp, Homo sapiens
agggccagggaaacgatcagca

SEQ ID NO: 8133776 - DNA, 22 bp, Homo sapiens
agggccagccccaccctctctg

SEQ ID NO: 8133777 - DNA, 22 bp, Homo sapiens
agggccagagtctgtgtagata

SEQ ID NO: 8133778 - DNA, 22 bp, Homo sapiens
agggcagagggtgcctcacctg

SEQ ID NO: 8133779 - DNA, 22 bp, Homo sapiens
aggagagggtggcattaagttt

SEQ ID NO: 8133780 - DNA, 22 bp, Homo sapiens
aggagaggtctcccttccccag

SEQ ID NO: 8133781 - DNA, 22 bp, Homo sapiens
aggaagctggggtgttcttcat

SEQ ID NO: 8133782 - DNA, 21 bp, Homo sapiens
aggacaggaactggctgaata

SEQ ID NO: 8133783 - DNA, 20 bp, Homo sapiens
aggagaaattcgggacacct

SEQ ID NO: 8133784 - DNA, 22 bp, Homo sapiens
aggacagcccttgagagcacat

SEQ ID NO: 8133785 - DNA, 22 bp, Homo sapiens
cagtctctctccttgcaggcgt

SEQ ID NO: 8133786 - DNA, 22 bp, Homo sapiens
cagtctctgccacttctaagct

SEQ ID NO: 8133787 - DNA, 21 bp, Homo sapiens
cattcctcccctgacgtcagc

SEQ ID NO: 8133788 - DNA, 22 bp, Homo sapiens
cattcccacgtgttctttgctt

SEQ ID NO: 8133789 - DNA, 22 bp, Homo sapiens
cattatgaatggagtttgaggt

SEQ ID NO: 8133790 - DNA, 22 bp, Homo sapiens
catttacagtgagagtttttac

SEQ ID NO: 8133791 - DNA, 22 bp, Homo sapiens
aggcacagcctcccttcacatg

SEQ ID NO: 8133792 - DNA, 22 bp, Homo sapiens
catgaaatgttagaattagaca

SEQ ID NO: 8133793 - DNA, 22 bp, Homo sapiens
catgaaatgtgttaatctcttg

SEQ ID NO: 8133794 - DNA, 22 bp, Homo sapiens
catgaaatattagtaactgttt

SEQ ID NO: 8133795 - DNA, 22 bp, Homo sapiens
aggaggtggcctgagcgtgccc

SEQ ID NO: 8133796 - DNA, 22 bp, Homo sapiens
catgcacttacctgaaattcaa

SEQ ID NO: 8133797 - DNA, 22 bp, Homo sapiens
catgcacagtgatatctgaaga

SEQ ID NO: 8133798 - DNA, 22 bp, Homo sapiens
catgcacactgcaacaaggact

SEQ ID NO: 8133799 - DNA, 22 bp, Homo sapiens
caggagggtgtggaaaactggg

SEQ ID NO: 8133800 - DNA, 22 bp, Homo sapiens
caggacagaaataaggaatata

SEQ ID NO: 8133801 - DNA, 19 bp, Homo sapiens
caggacagacttcaaagcc

SEQ ID NO: 8133802 - DNA, 22 bp, Homo sapiens
caggacagaccaagatcgtgct

SEQ ID NO: 8133803 - DNA, 22 bp, Homo sapiens
caggacagacagaatgcctaac

SEQ ID NO: 8133804 - DNA, 22 bp, Homo sapiens
cagctctactgggcaccattcg

SEQ ID NO: 8133805 - DNA, 22 bp, Homo sapiens
agctctgctactctgtggggtg

SEQ ID NO: 8133806 - DNA, 22 bp, Homo sapiens
cagctttgtggccttgacctcg

SEQ ID NO: 8133807 - DNA, 22 bp, Homo sapiens
cagctttgtgcaatgcagtctc

SEQ ID NO: 8133808 - DNA, 22 bp, Homo sapiens
cagctttgcaggctggtcagtg

SEQ ID NO: 8133809 - DNA, 22 bp, Homo sapiens
cagctttgccctttgcccaatc

SEQ ID NO: 8133810 - DNA, 22 bp, Homo sapiens
cagctttggagtgtgagtgctg

SEQ ID NO: 8133811 - DNA, 22 bp, Homo sapiens
agcttacagttcaatgacaaag

SEQ ID NO: 8133812 - DNA, 22 bp, Homo sapiens
caggccggtgattctggatgta

SEQ ID NO: 8133813 - DNA, 21 bp, Homo sapiens
caggccccaggcctggggtgc

SEQ ID NO: 8133814 - DNA, 22 bp, Homo sapiens
aggaagctcagagaagtctttt

SEQ ID NO: 8133815 - DNA, 20 bp, Homo sapiens
aggaactttgtagaatacaa

SEQ ID NO: 8133816 - DNA, 22 bp, Homo sapiens
aggaaatgggaatagatggtat

SEQ ID NO: 8133817 - DNA, 22 bp, Homo sapiens
aggaaattgtctttttccttgt

SEQ ID NO: 8133818 - DNA, 22 bp, Homo sapiens
aggaaagctcccagtagggctc

SEQ ID NO: 8133819 - DNA, 22 bp, Homo sapiens
agcctccatcccatgcacaaag

SEQ ID NO: 8133820 - DNA, 22 bp, Homo sapiens
cagcacagggcttgagaggtgt

SEQ ID NO: 8133821 - DNA, 22 bp, Homo sapiens
cagccagctgaatgtaccatga

SEQ ID NO: 8133822 - DNA, 22 bp, Homo sapiens
agctccctgagatgccacagca

SEQ ID NO: 8133823 - DNA, 20 bp, Homo sapiens
agctcctctgcccattcttc

SEQ ID NO: 8133824 - DNA, 22 bp, Homo sapiens
agctcctcctgagtgtctggga

SEQ ID NO: 8133825 - DNA, 20 bp, Homo sapiens
agctcctcatcactggaggt

SEQ ID NO: 8133826 - DNA, 22 bp, Homo sapiens
cagccctggcgcccccagatct

SEQ ID NO: 8133827 - DNA, 22 bp, Homo sapiens
cagccctgggagttggggccga

SEQ ID NO: 8133828 - DNA, 22 bp, Homo sapiens
cagcaggataggtttctttgga

SEQ ID NO: 8133829 - DNA, 22 bp, Homo sapiens
agctcagaaatgccagtaggta

SEQ ID NO: 8133830 - DNA, 22 bp, Homo sapiens
agctcacagcctagcactgtga

SEQ ID NO: 8133831 - DNA, 22 bp, Homo sapiens
cagcaggaggcatggcttccct

SEQ ID NO: 8133832 - DNA, 23 bp, Homo sapiens
agccttggaggttgaggctgcag

SEQ ID NO: 8133833 - DNA, 22 bp, Homo sapiens
cactctgtgattgcagcattcc

SEQ ID NO: 8133834 - DNA, 22 bp, Homo sapiens
cactgaaaggcaatgctgacag

SEQ ID NO: 8133835 - DNA, 22 bp, Homo sapiens
agccacacagcttaatgacaga

SEQ ID NO: 8133836 - DNA, 22 bp, Homo sapiens
agccacacctgtcctgccagct

SEQ ID NO: 8133837 - DNA, 22 bp, Homo sapiens
cactgaaatcgaaaaatgtagg

SEQ ID NO: 8133838 - DNA, 22 bp, Homo sapiens
agccacacttgccaggggaagg

SEQ ID NO: 8133839 - DNA, 17 bp, Homo sapiens
agcccccactcccaagt

SEQ ID NO: 8133840 - DNA, 22 bp, Homo sapiens
cagagatggggccagctgctcc

SEQ ID NO: 8133841 - DNA, 22 bp, Homo sapiens
cagagcaacaccctttacatcg

SEQ ID NO: 8133842 - DNA, 22 bp, Homo sapiens
cagagatgggtcgcagagatgg

SEQ ID NO: 8133843 - DNA, 22 bp, Homo sapiens
cagacagaggctgtatgagggc

SEQ ID NO: 8133844 - DNA, 22 bp, Homo sapiens
caccagggacaatgctaggggt

SEQ ID NO: 8133845 - DNA, 22 bp, Homo sapiens
agcataaactcagggacacaca

SEQ ID NO: 8133846 - DNA, 22 bp, Homo sapiens
agcataaaggcactagaaagag

SEQ ID NO: 8133847 - DNA, 22 bp, Homo sapiens
cacagtcacatatctatgtgtg

SEQ ID NO: 8133848 - DNA, 22 bp, Homo sapiens
cacagtcaatgtagaaatatga

SEQ ID NO: 8133849 - DNA, 22 bp, Homo sapiens
agcagggcctgagtgacctaac

SEQ ID NO: 8133850 - DNA, 23 bp, Homo sapiens
agcaggtaggttgaaattttcct

SEQ ID NO: 8133851 - DNA, 22 bp, Homo sapiens
cacatctgctctgggcagcact

SEQ ID NO: 8133852 - DNA, 22 bp, Homo sapiens
cacaggaggaggccagagcgta

SEQ ID NO: 8133853 - DNA, 22 bp, Homo sapiens
cacaggagggagcgggcagcca

SEQ ID NO: 8133854 - DNA, 22 bp, Homo sapiens
cacaggaggttaggaagtggtc

SEQ ID NO: 8133855 - DNA, 22 bp, Homo sapiens
cacaggagctgtggggcagtgt

SEQ ID NO: 8133856 - DNA, 22 bp, Homo sapiens
caaatgcaaaatataaccctgt

SEQ ID NO: 8133857 - DNA, 22 bp, Homo sapiens
caaatgttaagacaggatcaag

SEQ ID NO: 8133858 - DNA, 22 bp, Homo sapiens
caaatgttaaatgtgttaagac

SEQ ID NO: 8133859 - DNA, 22 bp, Homo sapiens
caaatgtttggtggcattttgt

SEQ ID NO: 8133860 - DNA, 22 bp, Homo sapiens
caaatgtttttattctacaaca

SEQ ID NO: 8133861 - DNA, 22 bp, Homo sapiens
caaatgttttttagtataagta

SEQ ID NO: 8133862 - DNA, 22 bp, Homo sapiens
caaatgtttgcatcacagggca

SEQ ID NO: 8133863 - DNA, 22 bp, Homo sapiens
caaatgtttcttgaacaccaac

SEQ ID NO: 8133864 - DNA, 22 bp, Homo sapiens
caaatgttgctgtaatgtttgt

SEQ ID NO: 8133865 - DNA, 22 bp, Homo sapiens
caaatgttgactaagagggttt

SEQ ID NO: 8133866 - DNA, 22 bp, Homo sapiens
caaatgtttcttatctattgtt

SEQ ID NO: 8133867 - DNA, 22 bp, Homo sapiens
caaatgttattcattcttgttt

SEQ ID NO: 8133868 - DNA, 22 bp, Homo sapiens
caaatgttagtgcccatccctc

SEQ ID NO: 8133869 - DNA, 22 bp, Homo sapiens
caaatgttaagacaggatcaag

SEQ ID NO: 8133870 - DNA, 22 bp, Homo sapiens
agcacagagctaggagtggagg

SEQ ID NO: 8133871 - DNA, 22 bp, Homo sapiens
agcacagagttgcagagagcgt

SEQ ID NO: 8133872 - DNA, 22 bp, Homo sapiens
agcacagatttgtcaacataga

SEQ ID NO: 8133873 - DNA, 22 bp, Homo sapiens
attttctatgttgtaattgtta

SEQ ID NO: 8133874 - DNA, 22 bp, Homo sapiens
caactgcttggaggaatactgc

SEQ ID NO: 8133875 - DNA, 22 bp, Homo sapiens
caactgctgacaccatcactcc

SEQ ID NO: 8133876 - DNA, 22 bp, Homo sapiens
caactgtgaattttatgatacc

SEQ ID NO: 8133877 - DNA, 22 bp, Homo sapiens
agcagcagaagggagacccagg

SEQ ID NO: 8133878 - DNA, 22 bp, Homo sapiens
agcagcacctgtcctcgctgct

SEQ ID NO: 8133879 - DNA, 22 bp, Homo sapiens
caatgaaaatttaagttgcagc

SEQ ID NO: 8133880 - DNA, 22 bp, Homo sapiens
atggaaaggctgtggaaactta

SEQ ID NO: 8133881 - DNA, 22 bp, Homo sapiens
atggaaagctaagccatttacc

SEQ ID NO: 8133882 - DNA, 22 bp, Homo sapiens
atggaaagccagtgttccatca

SEQ ID NO: 8133883 - DNA, 22 bp, Homo sapiens
atggaaagggaagcaaggaaca

SEQ ID NO: 8133884 - DNA, 22 bp, Homo sapiens
atggaaaggctgtggaaactta

SEQ ID NO: 8133885 - DNA, 22 bp, Homo sapiens
atggaaagtgcatggaagtcat

SEQ ID NO: 8133886 - DNA, 22 bp, Homo sapiens
atggaaagtgcatggaagtcat

SEQ ID NO: 8133887 - DNA, 21 bp, Homo sapiens
atggctggtggctcagcctcc

SEQ ID NO: 8133888 - DNA, 22 bp, Homo sapiens
atggacagtgctgcttcagagg

SEQ ID NO: 8133889 - DNA, 22 bp, Homo sapiens
atggagtttggggtcaaatact

SEQ ID NO: 8133890 - DNA, 22 bp, Homo sapiens
atggataacccagttcatttct

SEQ ID NO: 8133891 - DNA, 22 bp, Homo sapiens
atgtacacacaagtttgcacgc

SEQ ID NO: 8133892 - DNA, 22 bp, Homo sapiens
atgtacataaaatgtataatga

SEQ ID NO: 8133893 - DNA, 22 bp, Homo sapiens
atgtacagccacttcacagtta

SEQ ID NO: 8133894 - DNA, 22 bp, Homo sapiens
atgtccaatttcagagtctcat

SEQ ID NO: 8133895 - DNA, 22 bp, Homo sapiens
atgtcaaatgctgcaaactcat

SEQ ID NO: 8133896 - DNA, 23 bp, Homo sapiens
agacacataggagcagctattgg

SEQ ID NO: 8133897 - DNA, 22 bp, Homo sapiens
agacacagtttgggatgggttg

SEQ ID NO: 8133898 - DNA, 19 bp, Homo sapiens
agacacacttacgtggaat

SEQ ID NO: 8133899 - DNA, 22 bp, Homo sapiens
agaatgttttcatgagaatgaa

SEQ ID NO: 8133900 - DNA, 22 bp, Homo sapiens
agaagaacttagctttctatct

SEQ ID NO: 8133901 - DNA, 22 bp, Homo sapiens
agaagcacaccagtagacaggg

SEQ ID NO: 8133902 - DNA, 17 bp, Homo sapiens
atgttaatttcacattt

SEQ ID NO: 8133903 - DNA, 23 bp, Homo sapiens
atgtttgcagtaacccatcctgg

SEQ ID NO: 8133904 - DNA, 22 bp, Homo sapiens
atgtgtgcatgttagagagagt

SEQ ID NO: 8133905 - DNA, 22 bp, Homo sapiens
atgtgtgtacacacgtgactct

SEQ ID NO: 8133906 - DNA, 22 bp, Homo sapiens
atgtgtgtaaacaagtataatt

SEQ ID NO: 8133907 - DNA, 22 bp, Homo sapiens
attagcatgccaagcttttaga

SEQ ID NO: 8133908 - DNA, 22 bp, Homo sapiens
attaaacaatgtaaagttcttg

SEQ ID NO: 8133909 - DNA, 22 bp, Homo sapiens
atgtttgtcaggattgtaatta

SEQ ID NO: 8133910 - DNA, 22 bp, Homo sapiens
agaggggctcaagcagtggtct

SEQ ID NO: 8133911 - DNA, 22 bp, Homo sapiens
agaggggctcatatcctgtcat

SEQ ID NO: 8133912 - DNA, 22 bp, Homo sapiens
agagggataatatgtattgtaa

SEQ ID NO: 8133913 - DNA, 22 bp, Homo sapiens
agagggatggccccgtaactca

SEQ ID NO: 8133914 - DNA, 22 bp, Homo sapiens
attctctgtttccaagatgaaa

SEQ ID NO: 8133915 - DNA, 22 bp, Homo sapiens
attcagctgactttgattcatt

SEQ ID NO: 8133916 - DNA, 22 bp, Homo sapiens
attcacaattagaagtagataa

SEQ ID NO: 8133917 - DNA, 22 bp, Homo sapiens
attcagcacatctttgtacagc

SEQ ID NO: 8133918 - DNA, 22 bp, Homo sapiens
attcagcaaacatttattgtgt

SEQ ID NO: 8133919 - DNA, 22 bp, Homo sapiens
attcagcaagctatgggacagg

SEQ ID NO: 8133920 - DNA, 22 bp, Homo sapiens
attcagcatgcaattaggtaat

SEQ ID NO: 8133921 - DNA, 19 bp, Homo sapiens
attcagcattctgcacttc

SEQ ID NO: 8133922 - DNA, 22 bp, Homo sapiens
attcagcattcatttccaactt

SEQ ID NO: 8133923 - DNA, 22 bp, Homo sapiens
atttgctggtgaatgtatagct

SEQ ID NO: 8133924 - DNA, 22 bp, Homo sapiens
agcaaacagtgtgctaagaaat

SEQ ID NO: 8133925 - DNA, 22 bp, Homo sapiens
atttcattgaagttaattcttc

SEQ ID NO: 8133926 - DNA, 22 bp, Homo sapiens
agatgaaatttgtgttgagttg

SEQ ID NO: 8133927 - DNA, 23 bp, Homo sapiens
agatgaaagcttcccatcacagt

SEQ ID NO: 8133928 - DNA, 22 bp, Homo sapiens
agatgaaagatttttatagaga

SEQ ID NO: 8133929 - DNA, 22 bp, Homo sapiens
agagtgggcctagctgtaaaag

SEQ ID NO: 8133930 - DNA, 22 bp, Homo sapiens
atttagtgaaacccataaagca

SEQ ID NO: 8133931 - DNA, 22 bp, Homo sapiens
atttagtgaccagcactagaaa

SEQ ID NO: 8133932 - DNA, 22 bp, Homo sapiens
atttagtgtgtattgctattat

SEQ ID NO: 8133933 - DNA, 22 bp, Homo sapiens
atttagtgtatcaatgtgatat

SEQ ID NO: 8133934 - DNA, 22 bp, Homo sapiens
atttagtgtattctaatatgtg

SEQ ID NO: 8133935 - DNA, 22 bp, Homo sapiens
atttaataccacttggtgcttt

SEQ ID NO: 8133936 - DNA, 22 bp, Homo sapiens
attgttaataactattacattg

SEQ ID NO: 8133937 - DNA, 22 bp, Homo sapiens
agaggtagaggttgcagtgagc

SEQ ID NO: 8133938 - DNA, 23 bp, Homo sapiens
attcttcattatcttctagaaaa

SEQ ID NO: 8133939 - DNA, 22 bp, Homo sapiens
attcttcatttactgttacttg

SEQ ID NO: 8133940 - DNA, 22 bp, Homo sapiens
actgtgactgagcattcacatg

SEQ ID NO: 8133941 - DNA, 22 bp, Homo sapiens
actgtgactgtgtcttctgggc

SEQ ID NO: 8133942 - DNA, 22 bp, Homo sapiens
actgtgactgagcattcacatg

SEQ ID NO: 8133943 - DNA, 22 bp, Homo sapiens
actgtgaacggactgaagccca

SEQ ID NO: 8133944 - DNA, 22 bp, Homo sapiens
acttcagaaaatgttgaatgtt

SEQ ID NO: 8133945 - DNA, 22 bp, Homo sapiens
actgttatgatttacacagtcc

SEQ ID NO: 8133946 - DNA, 18 bp, Homo sapiens
actgttatctgataaggc

SEQ ID NO: 8133947 - DNA, 22 bp, Homo sapiens
actgttatagttcacttttccc

SEQ ID NO: 8133948 - DNA, 22 bp, Homo sapiens
actgtgtttctgaaacaagagg

SEQ ID NO: 8133949 - DNA, 22 bp, Homo sapiens
acttggaaccgaggacctttat

SEQ ID NO: 8133950 - DNA, 20 bp, Homo sapiens
acttggaactcatttttctt

SEQ ID NO: 8133951 - DNA, 22 bp, Homo sapiens
acttggaatattgcgtttttgc

SEQ ID NO: 8133952 - DNA, 22 bp, Homo sapiens
acttggaatctgtttccctaga

SEQ ID NO: 8133953 - DNA, 22 bp, Homo sapiens
acttgggaaaggaagaattgca

SEQ ID NO: 8133954 - DNA, 22 bp, Homo sapiens
acttccagaattagaatttaag

SEQ ID NO: 8133955 - DNA, 22 bp, Homo sapiens
agaaaatttattcatgttagtt

SEQ ID NO: 8133956 - DNA, 22 bp, Homo sapiens
agaaacaaggtgtaggttgacc

SEQ ID NO: 8133957 - DNA, 22 bp, Homo sapiens
atatatttgagaatattcatga

SEQ ID NO: 8133958 - DNA, 22 bp, Homo sapiens
atatatttactctcctgttgca

SEQ ID NO: 8133959 - DNA, 22 bp, Homo sapiens
atatccagcagcaggtgagtat

SEQ ID NO: 8133960 - DNA, 22 bp, Homo sapiens
atatccatagtaaaagtcatta

SEQ ID NO: 8133961 - DNA, 22 bp, Homo sapiens
atatattttgaatagcctctgt

SEQ ID NO: 8133962 - DNA, 22 bp, Homo sapiens
atatctcattaccttgctgttc

SEQ ID NO: 8133963 - DNA, 22 bp, Homo sapiens
atatctcaatacagctgtttta

SEQ ID NO: 8133964 - DNA, 22 bp, Homo sapiens
acttgggatggtggccagagcg

SEQ ID NO: 8133965 - DNA, 22 bp, Homo sapiens
atataatttagaaggggaaaca

SEQ ID NO: 8133966 - DNA, 22 bp, Homo sapiens
atataattgttctgaagtgttt

SEQ ID NO: 8133967 - DNA, 22 bp, Homo sapiens
atataatttttggttagctcaa

SEQ ID NO: 8133968 - DNA, 21 bp, Homo sapiens
actttgggcactttcctgccc

SEQ ID NO: 8133969 - DNA, 21 bp, Homo sapiens
agaaacatgatcaaaggaacc

SEQ ID NO: 8133970 - DNA, 22 bp, Homo sapiens
atcactgttatctagaagcaca

SEQ ID NO: 8133971 - DNA, 22 bp, Homo sapiens
atcacctgggagcatattaaat

SEQ ID NO: 8133972 - DNA, 22 bp, Homo sapiens
atcactgaaatactgaaattac

SEQ ID NO: 8133973 - DNA, 23 bp, Homo sapiens
atccagcctgggggtttaaccac

SEQ ID NO: 8133974 - DNA, 22 bp, Homo sapiens
atcattttatggctgagaggac

SEQ ID NO: 8133975 - DNA, 22 bp, Homo sapiens
atcatttgcctcaagtgaaagt

SEQ ID NO: 8133976 - DNA, 22 bp, Homo sapiens
atccagacacctactgctactt

SEQ ID NO: 8133977 - DNA, 22 bp, Homo sapiens
atcatttacaaactcagcattg

SEQ ID NO: 8133978 - DNA, 22 bp, Homo sapiens
atcattgaatataagtgctatt

SEQ ID NO: 8133979 - DNA, 22 bp, Homo sapiens
atcatttaaaacaagtctctat

SEQ ID NO: 8133980 - DNA, 21 bp, Homo sapiens
atcattgcagagcacattaaa

SEQ ID NO: 8133981 - DNA, 22 bp, Homo sapiens
atcagcaagatgtaatttctat

SEQ ID NO: 8133982 - DNA, 22 bp, Homo sapiens
atcagcaagactaggggaatac

SEQ ID NO: 8133983 - DNA, 20 bp, Homo sapiens
atcagcaactgccactcagt

SEQ ID NO: 8133984 - DNA, 21 bp, Homo sapiens
atcagcaaatgcctgtctccc

SEQ ID NO: 8133985 - DNA, 22 bp, Homo sapiens
atcagcaaaaatgccttcagaa

SEQ ID NO: 8133986 - DNA, 22 bp, Homo sapiens
atcagcaagcatggttaggtgt

SEQ ID NO: 8133987 - DNA, 22 bp, Homo sapiens
atcagcaagcatttattgagtg

SEQ ID NO: 8133988 - DNA, 22 bp, Homo sapiens
atcagcaagattgtgtcttgta

SEQ ID NO: 8133989 - DNA, 22 bp, Homo sapiens
atcagcaagtcctgttaattct

SEQ ID NO: 8133990 - DNA, 22 bp, Homo sapiens
atcagcaaggcaatcactgcag

SEQ ID NO: 8133991 - DNA, 19 bp, Homo sapiens
atcagcaaggtaggatgtg

SEQ ID NO: 8133992 - DNA, 22 bp, Homo sapiens
actgctccaccctggggcccag

SEQ ID NO: 8133993 - DNA, 22 bp, Homo sapiens
actgctggcatgcatatacaaa

SEQ ID NO: 8133994 - DNA, 22 bp, Homo sapiens
actgcttcctggatggccagca

SEQ ID NO: 8133995 - DNA, 20 bp, Homo sapiens
actgcttctttctctgacct

SEQ ID NO: 8133996 - DNA, 22 bp, Homo sapiens
actgatgagagttagtgctagt

SEQ ID NO: 8133997 - DNA, 23 bp, Homo sapiens
actgattaacatgtgtgatattc

SEQ ID NO: 8133998 - DNA, 22 bp, Homo sapiens
actgattgcattcatagggttt

SEQ ID NO: 8133999 - DNA, 22 bp, Homo sapiens
actgaatatattccattgcatg

SEQ ID NO: 8134000 - DNA, 22 bp, Homo sapiens
actgaacagcctttcaaactta

SEQ ID NO: 8134001 - DNA, 22 bp, Homo sapiens
actgaacatatgcaagaccatt

SEQ ID NO: 8134002 - DNA, 22 bp, Homo sapiens
actgaacatccataagattttt

SEQ ID NO: 8134003 - DNA, 22 bp, Homo sapiens
actgaacagaccattttgtcct

SEQ ID NO: 8134004 - DNA, 22 bp, Homo sapiens
actgaacaccatttataacatt

SEQ ID NO: 8134005 - DNA, 22 bp, Homo sapiens
actgaacacacctgcagcacgt

SEQ ID NO: 8134006 - DNA, 22 bp, Homo sapiens
actcttcatgctatgctcaact

SEQ ID NO: 8134007 - DNA, 22 bp, Homo sapiens
actcattttataacactgtagt

SEQ ID NO: 8134008 - DNA, 22 bp, Homo sapiens
actcatttgcatgatgtgctat

SEQ ID NO: 8134009 - DNA, 22 bp, Homo sapiens
actcatttgacactttaaactg

SEQ ID NO: 8134010 - DNA, 20 bp, Homo sapiens
actcatttccagcatctgat

SEQ ID NO: 8134011 - DNA, 22 bp, Homo sapiens
actccacatttgaacacagttc

SEQ ID NO: 8134012 - DNA, 19 bp, Homo sapiens
agtctctgaggcctaagtt

SEQ ID NO: 8134013 - DNA, 20 bp, Homo sapiens
agtctctgtagtgcctgaga

SEQ ID NO: 8134014 - DNA, 22 bp, Homo sapiens
agtctctgttccagggcttcag

SEQ ID NO: 8134015 - DNA, 22 bp, Homo sapiens
agtctctgtcgtagatcagcgt

SEQ ID NO: 8134016 - DNA, 22 bp, Homo sapiens
agtctctgcatgatgcagcaca

SEQ ID NO: 8134017 - DNA, 22 bp, Homo sapiens
agggtggggtgctacatcttta

SEQ ID NO: 8134018 - DNA, 20 bp, Homo sapiens
agggtggggacgttctgact

SEQ ID NO: 8134019 - DNA, 22 bp, Homo sapiens
accctcagagtaggcactgctg

SEQ ID NO: 8134020 - DNA, 22 bp, Homo sapiens
agggtgggctagactcttcccc

SEQ ID NO: 8134021 - DNA, 22 bp, Homo sapiens
agggctttcggcactctgaggg

SEQ ID NO: 8134022 - DNA, 22 bp, Homo sapiens
agggctttaatgattattttct

SEQ ID NO: 8134023 - DNA, 22 bp, Homo sapiens
acctggacttgaatcctgactt

SEQ ID NO: 8134024 - DNA, 22 bp, Homo sapiens
acctggacacctgctgtcatct

SEQ ID NO: 8134025 - DNA, 22 bp, Homo sapiens
acctggacctgccacctatgag

SEQ ID NO: 8134026 - DNA, 22 bp, Homo sapiens
aggtactaccagggattttcag

SEQ ID NO: 8134027 - DNA, 22 bp, Homo sapiens
actatgaaagtataatattgaa

SEQ ID NO: 8134028 - DNA, 18 bp, Homo sapiens
actatgctgaataaatgg

SEQ ID NO: 8134029 - DNA, 22 bp, Homo sapiens
actatagatgctggcgaggctg

SEQ ID NO: 8134030 - DNA, 22 bp, Homo sapiens
actcatttaaacatttactgaa

SEQ ID NO: 8134031 - DNA, 22 bp, Homo sapiens
actcattaaataggatgatttt

SEQ ID NO: 8134032 - DNA, 22 bp, Homo sapiens
actaaaacatagccagtcagtg

SEQ ID NO: 8134033 - DNA, 22 bp, Homo sapiens
acgggctgggacggggaagctc

SEQ ID NO: 8134034 - DNA, 22 bp, Homo sapiens
agctgctatgacaacaccagcc

SEQ ID NO: 8134035 - DNA, 22 bp, Homo sapiens
agctgctatgaacattcacata

SEQ ID NO: 8134036 - DNA, 22 bp, Homo sapiens
acagcacaggagttgaatgggc

SEQ ID NO: 8134037 - DNA, 23 bp, Homo sapiens
agctgggcaaggatccgggctcc

SEQ ID NO: 8134038 - DNA, 19 bp, Homo sapiens
agctggggcggtgtgtgtt

SEQ ID NO: 8134039 - DNA, 22 bp, Homo sapiens
agctggggttgcacacattttg

SEQ ID NO: 8134040 - DNA, 22 bp, Homo sapiens
agctgggggttggataagggta

SEQ ID NO: 8134041 - DNA, 22 bp, Homo sapiens
agctgggggtagtgagaaataa

SEQ ID NO: 8134042 - DNA, 22 bp, Homo sapiens
agctggggctgtggttgtgatt

SEQ ID NO: 8134043 - DNA, 22 bp, Homo sapiens
agctggggctgcagagaacagg

SEQ ID NO: 8134044 - DNA, 22 bp, Homo sapiens
acagctacatggaatttcattt

SEQ ID NO: 8134045 - DNA, 19 bp, Homo sapiens
aggaatggaattaattctg

SEQ ID NO: 8134046 - DNA, 22 bp, Homo sapiens
acagggtggggatggtgagctt

SEQ ID NO: 8134047 - DNA, 22 bp, Homo sapiens
acagtaattaaggtctgaaacg

SEQ ID NO: 8134048 - DNA, 22 bp, Homo sapiens
acagtgcaaaccctcgggaaag

SEQ ID NO: 8134049 - DNA, 22 bp, Homo sapiens
acagtttgttccttttcattgc

SEQ ID NO: 8134050 - DNA, 21 bp, Homo sapiens
acagttttaaggagcacatgg

SEQ ID NO: 8134051 - DNA, 22 bp, Homo sapiens
aggcaggcaaccacctgggaag

SEQ ID NO: 8134052 - DNA, 22 bp, Homo sapiens
aggcagcatgggccccagctcc

SEQ ID NO: 8134053 - DNA, 22 bp, Homo sapiens
acagtttggttgctacagtaaa

SEQ ID NO: 8134054 - DNA, 22 bp, Homo sapiens
acagtttgccctgacattctcc

SEQ ID NO: 8134055 - DNA, 22 bp, Homo sapiens
accaggcccaccgcatgctcct

SEQ ID NO: 8134056 - DNA, 20 bp, Homo sapiens
aggctggcactcctggccag

SEQ ID NO: 8134057 - DNA, 22 bp, Homo sapiens
accaaaaagatatgttgaagcc

SEQ ID NO: 8134058 - DNA, 22 bp, Homo sapiens
accctcagacagctgtggccag

SEQ ID NO: 8134059 - DNA, 22 bp, Homo sapiens
acccgatgttggtgctctagta

SEQ ID NO: 8134060 - DNA, 22 bp, Homo sapiens
acccaggcctgagagacaggag

SEQ ID NO: 8134061 - DNA, 22 bp, Homo sapiens
accatttaataagtatttccat

SEQ ID NO: 8134062 - DNA, 22 bp, Homo sapiens
agggcagttcagccacaggctc

SEQ ID NO: 8134063 - DNA, 22 bp, Homo sapiens
acatgcacccagggcattgctt

SEQ ID NO: 8134064 - DNA, 22 bp, Homo sapiens
acatgaggaaacaagggtatat

SEQ ID NO: 8134065 - DNA, 22 bp, Homo sapiens
aggcaggcactccggaagtgtc

SEQ ID NO: 8134066 - DNA, 17 bp, Homo sapiens
aggcaggcagagcggga

SEQ ID NO: 8134067 - DNA, 22 bp, Homo sapiens
aggccctgttatgagccactgt

SEQ ID NO: 8134068 - DNA, 22 bp, Homo sapiens
aggccctgttgtagcattttgg

SEQ ID NO: 8134069 - DNA, 22 bp, Homo sapiens
acatggagaccagatggaagta

SEQ ID NO: 8134070 - DNA, 21 bp, Homo sapiens
acatggactgtgaatggggac

SEQ ID NO: 8134071 - DNA, 20 bp, Homo sapiens
aggccctgccagggacggag

SEQ ID NO: 8134072 - DNA, 22 bp, Homo sapiens
aggccctggtcaggtctggctg

SEQ ID NO: 8134073 - DNA, 22 bp, Homo sapiens
aggccctgtaaggtgtggagat

SEQ ID NO: 8134074 - DNA, 22 bp, Homo sapiens
aggccctgtccatggtgctgaa

SEQ ID NO: 8134075 - DNA, 20 bp, Homo sapiens
aggccctgtgcatcttgttt

SEQ ID NO: 8134076 - DNA, 22 bp, Homo sapiens
acatttattactcaggttgttg

SEQ ID NO: 8134077 - DNA, 22 bp, Homo sapiens
acatttatataactcactagga

SEQ ID NO: 8134078 - DNA, 22 bp, Homo sapiens
aggcgcagacatacagggtctg

SEQ ID NO: 8134079 - DNA, 22 bp, Homo sapiens
aggctagctaatgagtactgtg

SEQ ID NO: 8134080 - DNA, 22 bp, Homo sapiens
aggctagctttggctcagtaaa

SEQ ID NO: 8134081 - DNA, 22 bp, Homo sapiens
aggctagctgtttcagggctag

SEQ ID NO: 8134082 - DNA, 22 bp, Homo sapiens
aggcgcagaaggccaggggcct

SEQ ID NO: 8134083 - DNA, 22 bp, Homo sapiens
aggccttcctcggagacaggga

SEQ ID NO: 8134084 - DNA, 22 bp, Homo sapiens
acattgtgcctgtgatattaca

SEQ ID NO: 8134085 - DNA, 22 bp, Homo sapiens
aagcagcttccccaaagtgcct

SEQ ID NO: 8134086 - DNA, 22 bp, Homo sapiens
acagcagagaactttagagggt

SEQ ID NO: 8134087 - DNA, 22 bp, Homo sapiens
acagcaaaagacaagaacttaa

SEQ ID NO: 8134088 - DNA, 18 bp, Homo sapiens
aagcagacagcagacagt

SEQ ID NO: 8134089 - DNA, 21 bp, Homo sapiens
aagcagacctgagcacagaac

SEQ ID NO: 8134090 - DNA, 22 bp, Homo sapiens
aagcagactcccggccagctca

SEQ ID NO: 8134091 - DNA, 22 bp, Homo sapiens
aagcagagcctgagacagggat

SEQ ID NO: 8134092 - DNA, 22 bp, Homo sapiens
aagcaatagggtaatctactca

SEQ ID NO: 8134093 - DNA, 22 bp, Homo sapiens
aagatggcaggaatcataagct

SEQ ID NO: 8134094 - DNA, 22 bp, Homo sapiens
aagatggttatttcatcaccta

SEQ ID NO: 8134095 - DNA, 22 bp, Homo sapiens
aagatgactatttatctgtaag

SEQ ID NO: 8134096 - DNA, 22 bp, Homo sapiens
aagatgacagatgcttagagtc

SEQ ID NO: 8134097 - DNA, 22 bp, Homo sapiens
aagcaagttctcatcatttata

SEQ ID NO: 8134098 - DNA, 22 bp, Homo sapiens
aagcaatagcaacaactttaca

SEQ ID NO: 8134099 - DNA, 22 bp, Homo sapiens
aagcaagacagaagttactgcc

SEQ ID NO: 8134100 - DNA, 22 bp, Homo sapiens
aagcaagaggaaatgtggacct

SEQ ID NO: 8134101 - DNA, 22 bp, Homo sapiens
aagcaagagttggagtgatgtt

SEQ ID NO: 8134102 - DNA, 22 bp, Homo sapiens
aagatgaaaatttactgtgatg

SEQ ID NO: 8134103 - DNA, 22 bp, Homo sapiens
acacattgtcatttccatacta

SEQ ID NO: 8134104 - DNA, 22 bp, Homo sapiens
acacattgcagacatctcatta

SEQ ID NO: 8134105 - DNA, 22 bp, Homo sapiens
acacatgaaagacattaaggtg

SEQ ID NO: 8134106 - DNA, 19 bp, Homo sapiens
aagagcagggaaagaattg

SEQ ID NO: 8134107 - DNA, 22 bp, Homo sapiens
aagagacagagccatgtttcta

SEQ ID NO: 8134108 - DNA, 22 bp, Homo sapiens
aagagacaatgtcttttggata

SEQ ID NO: 8134109 - DNA, 22 bp, Homo sapiens
aagagacaatgacacttgggag

SEQ ID NO: 8134110 - DNA, 21 bp, Homo sapiens
aagagacatttctcatcagca

SEQ ID NO: 8134111 - DNA, 22 bp, Homo sapiens
aagagagaacacagcttgggca

SEQ ID NO: 8134112 - DNA, 22 bp, Homo sapiens
aagagcagattcctagtggagc

SEQ ID NO: 8134113 - DNA, 20 bp, Homo sapiens
acacaaagcaatggagtaca

SEQ ID NO: 8134114 - DNA, 22 bp, Homo sapiens
aagaacaactgctttaaaagca

SEQ ID NO: 8134115 - DNA, 22 bp, Homo sapiens
aatttcactgtggagcacattt

SEQ ID NO: 8134116 - DNA, 22 bp, Homo sapiens
aattctaaatgtaatttagaat

SEQ ID NO: 8134117 - DNA, 22 bp, Homo sapiens
aattcacaatgtgtagtcatgc

SEQ ID NO: 8134118 - DNA, 21 bp, Homo sapiens
aattcccagaaacagcacaag

SEQ ID NO: 8134119 - DNA, 22 bp, Homo sapiens
aatgggaaaagagtatgattta

SEQ ID NO: 8134120 - DNA, 22 bp, Homo sapiens
aactggctgggaacacctagag

SEQ ID NO: 8134121 - DNA, 22 bp, Homo sapiens
aactggtcctcaaattttgatg

SEQ ID NO: 8134122 - DNA, 22 bp, Homo sapiens
aatgaacaaatggtgctgcttg

SEQ ID NO: 8134123 - DNA, 22 bp, Homo sapiens
aatgaattcgagtgaaggaaag

SEQ ID NO: 8134124 - DNA, 22 bp, Homo sapiens
aacctgaatttaattgaaatga

SEQ ID NO: 8134125 - DNA, 22 bp, Homo sapiens
aacctgaattacttttgcacca

SEQ ID NO: 8134126 - DNA, 23 bp, Homo sapiens
aacctgaactagggtcttgcata

SEQ ID NO: 8134127 - DNA, 22 bp, Homo sapiens
aacctgaagaaaatatttgctg

SEQ ID NO: 8134128 - DNA, 22 bp, Homo sapiens
aacctgaaactacattcttgat

SEQ ID NO: 8134129 - DNA, 22 bp, Homo sapiens
aacctgaaagtagtaaaagctg

SEQ ID NO: 8134130 - DNA, 22 bp, Homo sapiens
aaccattcactgaacagttcaa

SEQ ID NO: 8134131 - DNA, 22 bp, Homo sapiens
aaccatttgccattatcttaag

SEQ ID NO: 8134132 - DNA, 22 bp, Homo sapiens
aactagaaccacttgtatttcc

SEQ ID NO: 8134133 - DNA, 22 bp, Homo sapiens
aacatcttgtactgcacatttt

SEQ ID NO: 8134134 - DNA, 22 bp, Homo sapiens
aacatatctacggatacgatta

SEQ ID NO: 8134135 - DNA, 22 bp, Homo sapiens
aacatcacaatttcatttatgc

SEQ ID NO: 8134136 - DNA, 22 bp, Homo sapiens
aaggctgggtaacctgtccact

SEQ ID NO: 8134137 - DNA, 22 bp, Homo sapiens
aaggctgggtttgggatgtgat

SEQ ID NO: 8134138 - DNA, 22 bp, Homo sapiens
aaattattcaaaaagctgtgtt

SEQ ID NO: 8134139 - DNA, 22 bp, Homo sapiens
aaggcagccagatcctttgggt

SEQ ID NO: 8134140 - DNA, 22 bp, Homo sapiens
aaatgtcagagctggaaggggc

SEQ ID NO: 8134141 - DNA, 22 bp, Homo sapiens
aaatgtcagaagctttacttct

SEQ ID NO: 8134142 - DNA, 22 bp, Homo sapiens
aaatgtcagaaaacatggagtg

SEQ ID NO: 8134143 - DNA, 22 bp, Homo sapiens
aaatgtcatatttaagtaggaa

SEQ ID NO: 8134144 - DNA, 22 bp, Homo sapiens
aaatgtcaggtggtggatggct

SEQ ID NO: 8134145 - DNA, 22 bp, Homo sapiens
aaatgtcagaggaacatattga

SEQ ID NO: 8134146 - DNA, 22 bp, Homo sapiens
aaatgtcaaggtgatagatgca

SEQ ID NO: 8134147 - DNA, 22 bp, Homo sapiens
aaatgcattaagtcagaacaat

SEQ ID NO: 8134148 - DNA, 22 bp, Homo sapiens
aaatgcattaagtcagaacaat

SEQ ID NO: 8134149 - DNA, 22 bp, Homo sapiens
aaatgcatgtatgtaatatgct

SEQ ID NO: 8134150 - DNA, 22 bp, Homo sapiens
aaatgcatttttaattagaccc

SEQ ID NO: 8134151 - DNA, 22 bp, Homo sapiens
aaatgcatttcactaatgtttc

SEQ ID NO: 8134152 - DNA, 22 bp, Homo sapiens
aaatgcattggtttctacttgt

SEQ ID NO: 8134153 - DNA, 22 bp, Homo sapiens
aacacaatcttccagtttgctg

SEQ ID NO: 8134154 - DNA, 22 bp, Homo sapiens
aaggctggtcagatgtggtgaa

SEQ ID NO: 8134155 - DNA, 22 bp, Homo sapiens
aaggctggttccatccctggtg

SEQ ID NO: 8134156 - DNA, 22 bp, Homo sapiens
aaatttgtcaacttcatatgtt

SEQ ID NO: 8134157 - DNA, 22 bp, Homo sapiens
aacagaacccgagtgtgaatct

SEQ ID NO: 8134158 - DNA, 22 bp, Homo sapiens
aacagagatcttaattcctgta

SEQ ID NO: 8134159 - DNA, 22 bp, Homo sapiens
aacagagaggccacctcagcag

SEQ ID NO: 8134160 - DNA, 22 bp, Homo sapiens
aacactttgttgcctatgaacg

SEQ ID NO: 8134161 - DNA, 22 bp, Homo sapiens
aacatagctttactcaaatgac

SEQ ID NO: 8134162 - DNA, 22 bp, Homo sapiens
aacataatgtggccaaagtcac

SEQ ID NO: 8134163 - DNA, 22 bp, Homo sapiens
aaagcagcaaatacttttgcac

SEQ ID NO: 8134164 - DNA, 22 bp, Homo sapiens
aaagatttgagttctgcttata

SEQ ID NO: 8134165 - DNA, 22 bp, Homo sapiens
aaagattatggaacacacatga

SEQ ID NO: 8134166 - DNA, 22 bp, Homo sapiens
aaagatgtttgttccaaaattc

SEQ ID NO: 8134167 - DNA, 22 bp, Homo sapiens
aaagcctgggttcctcactatc

SEQ ID NO: 8134168 - DNA, 22 bp, Homo sapiens
aaagtaattaagaagctggaca

SEQ ID NO: 8134169 - DNA, 22 bp, Homo sapiens
aactgtcatctttcaaggaaga

SEQ ID NO: 8134170 - DNA, 22 bp, Homo sapiens
aactgtaaggcttagaacagca

SEQ ID NO: 8134171 - DNA, 22 bp, Homo sapiens
aagatcaagatttaggttgagg

SEQ ID NO: 8134172 - DNA, 22 bp, Homo sapiens
aagcaggagatgcaggaatgta

SEQ ID NO: 8134173 - DNA, 22 bp, Homo sapiens
aagcctccttattaaaggatat

SEQ ID NO: 8134174 - DNA, 22 bp, Homo sapiens
aaatgcatgtagaataatagag

SEQ ID NO: 8134175 - DNA, 22 bp, Homo sapiens
aaatgcatggctgttttaaagc

SEQ ID NO: 8134176 - DNA, 22 bp, Homo sapiens
aagacctattttaggatatgaa

SEQ ID NO: 8134177 - DNA, 21 bp, Homo sapiens
aaatactgggcagtgacttga

SEQ ID NO: 8134178 - DNA, 22 bp, Homo sapiens
aaatactgggctcaaaagggtt

SEQ ID NO: 8134179 - DNA, 22 bp, Homo sapiens
aaatactggttttggagatgct

SEQ ID NO: 8134180 - DNA, 19 bp, Homo sapiens
aaatactgaagttgttcat

SEQ ID NO: 8134181 - DNA, 22 bp, Homo sapiens
aaatactgctgctattcctttt

SEQ ID NO: 8134182 - DNA, 22 bp, Homo sapiens
aaatactggcaagtgctaattc

SEQ ID NO: 8134183 - DNA, 22 bp, Homo sapiens
aaagttttagaactaggaagca

SEQ ID NO: 8134184 - DNA, 18 bp, Homo sapiens
aagaggaggagcaggttg

SEQ ID NO: 8134185 - DNA, 22 bp, Homo sapiens
aagaggaggattgatgtgggag

SEQ ID NO: 8134186 - DNA, 22 bp, Homo sapiens
aagaggaggatgctttacagct

SEQ ID NO: 8134187 - DNA, 22 bp, Homo sapiens
aagagggctgcaatcttattgc

SEQ ID NO: 8134188 - DNA, 22 bp, Homo sapiens
aagagggcagcacaggtgggtc

SEQ ID NO: 8134189 - DNA, 22 bp, Homo sapiens
aaactgtgaagcaagtacaagg

SEQ ID NO: 8134190 - DNA, 22 bp, Homo sapiens
aaagaaacctatcagccacatg

SEQ ID NO: 8134191 - DNA, 22 bp, Homo sapiens
aaagacatgacacattggagag

SEQ ID NO: 8134192 - DNA, 22 bp, Homo sapiens
aaagaacaatgtggaatctcct

SEQ ID NO: 8134193 - DNA, 22 bp, Homo sapiens
aaagatgttatgaaataactat

SEQ ID NO: 8134194 - DNA, 22 bp, Homo sapiens
aaagagacaccaaagactctag

SEQ ID NO: 8134195 - DNA, 22 bp, Homo sapiens
aaagagaaacttagaagcctga

SEQ ID NO: 8134196 - DNA, 21 bp, Homo sapiens
aaacatctctgcttttgtgtc

SEQ ID NO: 8134197 - DNA, 20 bp, Homo sapiens
aaagccactggcaagagact

SEQ ID NO: 8134198 - DNA, 22 bp, Homo sapiens
aaacagagtttggtaaatagcc

SEQ ID NO: 8134199 - DNA, 22 bp, Homo sapiens
aaacattctcagccctgcttgc

SEQ ID NO: 8134200 - DNA, 22 bp, Homo sapiens
aaacattccatttctatgtaag

SEQ ID NO: 8134201 - DNA, 22 bp, Homo sapiens
aaacatgcattcaagaaaatct

SEQ ID NO: 8134202 - DNA, 22 bp, Homo sapiens
aaaaagtttcaactgccaactc

SEQ ID NO: 8134203 - DNA, 22 bp, Homo sapiens
aaaaccatgtatctatttcctt

SEQ ID NO: 8134204 - DNA, 22 bp, Homo sapiens
aaaactgaaatacgatccaatg

SEQ ID NO: 8134205 - DNA, 22 bp, Homo sapiens
aaaactgaggtttcctgaagaa

SEQ ID NO: 8134206 - DNA, 21 bp, Homo sapiens
aaaatgtttccttgttggtta

SEQ ID NO: 8134207 - DNA, 18 bp, Homo sapiens
aaaatgttcccccattaa

SEQ ID NO: 8134208 - DNA, 22 bp, Homo sapiens
aaaatgttcaagcatgctggtt

SEQ ID NO: 8134209 - DNA, 22 bp, Homo sapiens
aaaattaagtgtctgggaagcc

SEQ ID NO: 8134210 - DNA, 22 bp, Homo sapiens
aaacacattttaggaaaatcta

SEQ ID NO: 8134211 - DNA, 22 bp, Homo sapiens
aaactgctttccacagtggcta

SEQ ID NO: 8134212 - DNA, 22 bp, Homo sapiens
aaactgctggttgctggccagc

SEQ ID NO: 8134213 - DNA, 22 bp, Homo sapiens
aaactgctgggcatatatttct

SEQ ID NO: 8134214 - DNA, 20 bp, Homo sapiens
aaaatatgtataactcttct

SEQ ID NO: 8134215 - DNA, 22 bp, Homo sapiens
acacagagtccttactgaggta

SEQ ID NO: 8134216 - DNA, 22 bp, Homo sapiens
acacagagtatttagaaggggt

SEQ ID NO: 8134217 - DNA, 22 bp, Homo sapiens
acacagagttattatgtgaact

SEQ ID NO: 8134218 - DNA, 22 bp, Homo sapiens
acacagaggctccagagataga

SEQ ID NO: 8134219 - DNA, 22 bp, Homo sapiens
acacagaggcatgacagtggct

SEQ ID NO: 8134220 - DNA, 23 bp, Homo sapiens
agcagctggggtgctcttttgtc

SEQ ID NO: 8134221 - DNA, 22 bp, Homo sapiens
agcagattggttaagcacatta

SEQ ID NO: 8134222 - DNA, 22 bp, Homo sapiens
acactgaatatacaatgaatat

SEQ ID NO: 8134223 - DNA, 22 bp, Homo sapiens
acactgaatgctgtttagaaat

SEQ ID NO: 8134224 - DNA, 22 bp, Homo sapiens
acactgaatgtttaagaacttg

SEQ ID NO: 8134225 - DNA, 22 bp, Homo sapiens
acactgagctgagcattcttgt

SEQ ID NO: 8134226 - DNA, 22 bp, Homo sapiens
acacatgtacagattagtattt

SEQ ID NO: 8134227 - DNA, 22 bp, Homo sapiens
acacatgtgattctaagacagc

SEQ ID NO: 8134228 - DNA, 22 bp, Homo sapiens
acacagggcagagagctggctc

SEQ ID NO: 8134229 - DNA, 19 bp, Homo sapiens
acacagggatcagagggtt

SEQ ID NO: 8134230 - DNA, 17 bp, Homo sapiens
acacagggagagggagc

SEQ ID NO: 8134231 - DNA, 22 bp, Homo sapiens
acagactgtcatgacactatat

SEQ ID NO: 8134232 - DNA, 22 bp, Homo sapiens
acagactgtgagtatgcatagt

SEQ ID NO: 8134233 - DNA, 22 bp, Homo sapiens
acagagagaattgggtttacag

SEQ ID NO: 8134234 - DNA, 22 bp, Homo sapiens
acagagagctgtgattgagtta

SEQ ID NO: 8134235 - DNA, 22 bp, Homo sapiens
acagagagaggcccgaggctgc

SEQ ID NO: 8134236 - DNA, 22 bp, Homo sapiens
acagagagaaacaatcagcagc

SEQ ID NO: 8134237 - DNA, 22 bp, Homo sapiens
acagagagaaacaatcagcagc

SEQ ID NO: 8134238 - DNA, 21 bp, Homo sapiens
acagagccgggcacaaagctg

SEQ ID NO: 8134239 - DNA, 22 bp, Homo sapiens
acagagcatttgggacagagag

SEQ ID NO: 8134240 - DNA, 22 bp, Homo sapiens
agcctctgactgtcagcaaggt

SEQ ID NO: 8134241 - DNA, 22 bp, Homo sapiens
acagatgaggctggcgagggca

SEQ ID NO: 8134242 - DNA, 22 bp, Homo sapiens
acagatgagttaaagcagagtg

SEQ ID NO: 8134243 - DNA, 22 bp, Homo sapiens
acagatgagttagaataggcag

SEQ ID NO: 8134244 - DNA, 22 bp, Homo sapiens
acagatgagttaaagcagagtg

SEQ ID NO: 8134245 - DNA, 22 bp, Homo sapiens
acagcaattgtatgcatagcat

SEQ ID NO: 8134246 - DNA, 22 bp, Homo sapiens
aattgcccatatttgagaatga

SEQ ID NO: 8134247 - DNA, 22 bp, Homo sapiens
aattcttaatcccataaagtga

SEQ ID NO: 8134248 - DNA, 22 bp, Homo sapiens
aattcttggaaacattactgga

SEQ ID NO: 8134249 - DNA, 22 bp, Homo sapiens
aattcttggtcctagtgtataa

SEQ ID NO: 8134250 - DNA, 22 bp, Homo sapiens
aattgaaattctttgtggtcca

SEQ ID NO: 8134251 - DNA, 18 bp, Homo sapiens
acaaaggatcatgaggga

SEQ ID NO: 8134252 - DNA, 22 bp, Homo sapiens
agaggctgtgcccaccaggcaa

SEQ ID NO: 8134253 - DNA, 22 bp, Homo sapiens
agagggggtgtcagcactgcag

SEQ ID NO: 8134254 - DNA, 22 bp, Homo sapiens
agagggggtgttccagaagcat

SEQ ID NO: 8134255 - DNA, 22 bp, Homo sapiens
agagggggcagcggaccagtga

SEQ ID NO: 8134256 - DNA, 22 bp, Homo sapiens
agagggggaaaatagaggtgtt

SEQ ID NO: 8134257 - DNA, 22 bp, Homo sapiens
acaacatttccatttccttggt

SEQ ID NO: 8134258 - DNA, 22 bp, Homo sapiens
acaagagattatctacagatga

SEQ ID NO: 8134259 - DNA, 17 bp, Homo sapiens
acaacagaaatgtattc

SEQ ID NO: 8134260 - DNA, 22 bp, Homo sapiens
acaatgaaccaaatttaccaat

SEQ ID NO: 8134261 - DNA, 22 bp, Homo sapiens
acaatgaacgctttttaactgt

SEQ ID NO: 8134262 - DNA, 22 bp, Homo sapiens
acaatgaacacacaaggaattc

SEQ ID NO: 8134263 - DNA, 22 bp, Homo sapiens
acaatgaacacacaaggaattc

SEQ ID NO: 8134264 - DNA, 22 bp, Homo sapiens
acaatgaaaggtattctgaact

SEQ ID NO: 8134265 - DNA, 22 bp, Homo sapiens
acaatcttattagtagtataga

SEQ ID NO: 8134266 - DNA, 22 bp, Homo sapiens
acaatgaatatcatgaagtact

SEQ ID NO: 8134267 - DNA, 22 bp, Homo sapiens
aatggagaccctaaggaagagg

SEQ ID NO: 8134268 - DNA, 22 bp, Homo sapiens
agaagcagactctgaggcaagg

SEQ ID NO: 8134269 - DNA, 22 bp, Homo sapiens
agacaatatgtatattaagaat

SEQ ID NO: 8134270 - DNA, 22 bp, Homo sapiens
aatggtttatggggaccgcaaa

SEQ ID NO: 8134271 - DNA, 22 bp, Homo sapiens
aatggtttagttaagactgagt

SEQ ID NO: 8134272 - DNA, 22 bp, Homo sapiens
aatggtttcaaacacactaagt

SEQ ID NO: 8134273 - DNA, 22 bp, Homo sapiens
agagccagttaagcacttacag

SEQ ID NO: 8134274 - DNA, 22 bp, Homo sapiens
agagacaggatatctgctcatg

SEQ ID NO: 8134275 - DNA, 18 bp, Homo sapiens
agagacagcagcaaaaga

SEQ ID NO: 8134276 - DNA, 22 bp, Homo sapiens
agagacagatctgagggacctc

SEQ ID NO: 8134277 - DNA, 22 bp, Homo sapiens
aattaaaagataacccatgagt

SEQ ID NO: 8134278 - DNA, 22 bp, Homo sapiens
aatgttttaaaagagattgaga

SEQ ID NO: 8134279 - DNA, 22 bp, Homo sapiens
aatgtttgtcatcacacagata

SEQ ID NO: 8134280 - DNA, 18 bp, Homo sapiens
aatgtttgtcctctctaa

SEQ ID NO: 8134281 - DNA, 22 bp, Homo sapiens
aatgttttttggtctgatgaat

SEQ ID NO: 8134282 - DNA, 22 bp, Homo sapiens
agaccctctccatgcccactgc

SEQ ID NO: 8134283 - DNA, 21 bp, Homo sapiens
aatgtggtacattacatgcat

SEQ ID NO: 8134284 - DNA, 20 bp, Homo sapiens
agaccctctggactgggccc

SEQ ID NO: 8134285 - DNA, 22 bp, Homo sapiens
acctactaattgagataatagg

SEQ ID NO: 8134286 - DNA, 22 bp, Homo sapiens
acgtgaactgtttttggagatt

SEQ ID NO: 8134287 - DNA, 22 bp, Homo sapiens
acgtggagagaatagggcacca

SEQ ID NO: 8134288 - DNA, 22 bp, Homo sapiens
acgtggagccacagatggagca

SEQ ID NO: 8134289 - DNA, 22 bp, Homo sapiens
actcagagaaacagcagggtgt

SEQ ID NO: 8134290 - DNA, 22 bp, Homo sapiens
actctcagagggtggcagcaat

SEQ ID NO: 8134291 - DNA, 22 bp, Homo sapiens
actctcagggctccagggaaag

SEQ ID NO: 8134292 - DNA, 22 bp, Homo sapiens
actctcactagctctgtgacct

SEQ ID NO: 8134293 - DNA, 22 bp, Homo sapiens
actcaccacagagcagggaacc

SEQ ID NO: 8134294 - DNA, 22 bp, Homo sapiens
actgcactccagcctgggtaac

SEQ ID NO: 8134295 - DNA, 22 bp, Homo sapiens
actggaggcccctcccagtgaa

SEQ ID NO: 8134296 - DNA, 22 bp, Homo sapiens
actgcgggaacccgcggccggc

SEQ ID NO: 8134297 - DNA, 22 bp, Homo sapiens
actggactccccaagggccagg

SEQ ID NO: 8134298 - DNA, 22 bp, Homo sapiens
aatgatttggcaaaggaatcca

SEQ ID NO: 8134299 - DNA, 22 bp, Homo sapiens
aatgatttcccctacacagaag

SEQ ID NO: 8134300 - DNA, 22 bp, Homo sapiens
aatgatttcccctacacagaag

SEQ ID NO: 8134301 - DNA, 22 bp, Homo sapiens
aatgatttcccctacacagaag

SEQ ID NO: 8134302 - DNA, 22 bp, Homo sapiens
agaagcagaaactgggcttgtg

SEQ ID NO: 8134303 - DNA, 22 bp, Homo sapiens
aatgattactgatcgcatagga

SEQ ID NO: 8134304 - DNA, 22 bp, Homo sapiens
agaacaaaattagaggagtgca

SEQ ID NO: 8134305 - DNA, 22 bp, Homo sapiens
agaaattattagtgaatagtct

SEQ ID NO: 8134306 - DNA, 22 bp, Homo sapiens
agaaattatgcagtagttttat

SEQ ID NO: 8134307 - DNA, 22 bp, Homo sapiens
agaaatgacacacatgagacat

SEQ ID NO: 8134308 - DNA, 22 bp, Homo sapiens
agaaatgacacacatgagacat

SEQ ID NO: 8134309 - DNA, 22 bp, Homo sapiens
aatcagtgtgtaaagtggctgc

SEQ ID NO: 8134310 - DNA, 22 bp, Homo sapiens
aatcagtgtggtgacttgtctg

SEQ ID NO: 8134311 - DNA, 22 bp, Homo sapiens
aatcagtgcaaaggagagggta

SEQ ID NO: 8134312 - DNA, 22 bp, Homo sapiens
aatcagtggttcccagcccagg

SEQ ID NO: 8134313 - DNA, 22 bp, Homo sapiens
aatcataattcaaataagctta

SEQ ID NO: 8134314 - DNA, 22 bp, Homo sapiens
aatcagaaattctacatcacaa

SEQ ID NO: 8134315 - DNA, 22 bp, Homo sapiens
aatactgaattagttgagacaa

SEQ ID NO: 8134316 - DNA, 22 bp, Homo sapiens
acatttcttccctttagcagaa

SEQ ID NO: 8134317 - DNA, 22 bp, Homo sapiens
acatttcttagcctagttccag

SEQ ID NO: 8134318 - DNA, 22 bp, Homo sapiens
acatttctgctagaataggtga

SEQ ID NO: 8134319 - DNA, 22 bp, Homo sapiens
acatttctggagtttctcaaca

SEQ ID NO: 8134320 - DNA, 22 bp, Homo sapiens
acattgttgtttgcagcacagg

SEQ ID NO: 8134321 - DNA, 22 bp, Homo sapiens
acattgttgtgcaattatagtt

SEQ ID NO: 8134322 - DNA, 21 bp, Homo sapiens
aaggctggagatgcaggtctg

SEQ ID NO: 8134323 - DNA, 22 bp, Homo sapiens
aaggcctttgccccgatacagg

SEQ ID NO: 8134324 - DNA, 22 bp, Homo sapiens
acattcttcttgtgaatttact

SEQ ID NO: 8134325 - DNA, 22 bp, Homo sapiens
accctgccctctccagctcagg

SEQ ID NO: 8134326 - DNA, 20 bp, Homo sapiens
accctgccaggcatgtgaat

SEQ ID NO: 8134327 - DNA, 22 bp, Homo sapiens
accctgccgtgggctgcttgtg

SEQ ID NO: 8134328 - DNA, 22 bp, Homo sapiens
accctgccaaggatggccccga

SEQ ID NO: 8134329 - DNA, 22 bp, Homo sapiens
acatttgttgccattcatggag

SEQ ID NO: 8134330 - DNA, 20 bp, Homo sapiens
acatttgtggatctgagaga

SEQ ID NO: 8134331 - DNA, 22 bp, Homo sapiens
aaggacaggctaacctgacatt

SEQ ID NO: 8134332 - DNA, 22 bp, Homo sapiens
aaggagacatttgcagagcacc

SEQ ID NO: 8134333 - DNA, 17 bp, Homo sapiens
acagtgtctatgaaatg

SEQ ID NO: 8134334 - DNA, 22 bp, Homo sapiens
acagtctttctacattctgtgc

SEQ ID NO: 8134335 - DNA, 22 bp, Homo sapiens
acatatctttactcatcatctc

SEQ ID NO: 8134336 - DNA, 22 bp, Homo sapiens
acatatctttccctctcctgaa

SEQ ID NO: 8134337 - DNA, 22 bp, Homo sapiens
aagcgcccatgcctgagagcgt

SEQ ID NO: 8134338 - DNA, 22 bp, Homo sapiens
aagcattttgttttaagaatga

SEQ ID NO: 8134339 - DNA, 22 bp, Homo sapiens
aagcattttagataaagcatca

SEQ ID NO: 8134340 - DNA, 19 bp, Homo sapiens
gtggagctaagaaaaggaa

SEQ ID NO: 8134341 - DNA, 22 bp, Homo sapiens
gtggagctggacccaggcctct

SEQ ID NO: 8134342 - DNA, 22 bp, Homo sapiens
gtggagctggacccaggcctct

SEQ ID NO: 8134343 - DNA, 22 bp, Homo sapiens
gtggacttgagatggaccgagg

SEQ ID NO: 8134344 - DNA, 22 bp, Homo sapiens
gtggatctaaagaaggagggtg

SEQ ID NO: 8134345 - DNA, 22 bp, Homo sapiens
gtggaggagaggcgccttgcgg

SEQ ID NO: 8134346 - DNA, 22 bp, Homo sapiens
gtggcagagccaaggctggagc

SEQ ID NO: 8134347 - DNA, 16 bp, Homo sapiens
gtggaacacattttgg

SEQ ID NO: 8134348 - DNA, 22 bp, Homo sapiens
gtggaacagaactgtttattga

SEQ ID NO: 8134349 - DNA, 22 bp, Homo sapiens
gtggaacagtattttaaaagct

SEQ ID NO: 8134350 - DNA, 22 bp, Homo sapiens
gtggaaagaacacaaaattagg

SEQ ID NO: 8134351 - DNA, 22 bp, Homo sapiens
gtgcgcaccctcccggcatccc

SEQ ID NO: 8134352 - DNA, 22 bp, Homo sapiens
gtgcgggggttcccagcagccg

SEQ ID NO: 8134353 - DNA, 22 bp, Homo sapiens
gtgacagaaacagggctagaat

SEQ ID NO: 8134354 - DNA, 22 bp, Homo sapiens
gtgacagagattaatagcttgg

SEQ ID NO: 8134355 - DNA, 16 bp, Homo sapiens
gtgacagacaataggc

SEQ ID NO: 8134356 - DNA, 22 bp, Homo sapiens
gtgacagatttgctgcgcatgg

SEQ ID NO: 8134357 - DNA, 22 bp, Homo sapiens
gtgacagattatagggagcgtt

SEQ ID NO: 8134358 - DNA, 22 bp, Homo sapiens
gtgacagagttttagatctcat

SEQ ID NO: 8134359 - DNA, 22 bp, Homo sapiens
gtgacagagtgagaccttgtct

SEQ ID NO: 8134360 - DNA, 22 bp, Homo sapiens
gtgacagagctgggatttgaag

SEQ ID NO: 8134361 - DNA, 22 bp, Homo sapiens
gtgacagagtgagaccctgtct

SEQ ID NO: 8134362 - DNA, 22 bp, Homo sapiens
gtggctgcagagggcacagcat

SEQ ID NO: 8134363 - DNA, 22 bp, Homo sapiens
gtggctgcatcggggtgaccag

SEQ ID NO: 8134364 - DNA, 22 bp, Homo sapiens
gtggctgctcgggctccggccc

SEQ ID NO: 8134365 - DNA, 22 bp, Homo sapiens
gtggctgctacagagctggagg

SEQ ID NO: 8134366 - DNA, 22 bp, Homo sapiens
gtggctggtttcctgcatgcaa

SEQ ID NO: 8134367 - DNA, 22 bp, Homo sapiens
gtgggagtttgaacttcatgtt

SEQ ID NO: 8134368 - DNA, 22 bp, Homo sapiens
gtggctgcagagccagcaagct

SEQ ID NO: 8134369 - DNA, 22 bp, Homo sapiens
gtggcagttgctgtggcaataa

SEQ ID NO: 8134370 - DNA, 22 bp, Homo sapiens
gtggcccaggctggagtgcagt

SEQ ID NO: 8134371 - DNA, 22 bp, Homo sapiens
gtggcccaggttggagtgcagt

SEQ ID NO: 8134372 - DNA, 22 bp, Homo sapiens
gtggcccaggcttggcgctggc

SEQ ID NO: 8134373 - DNA, 22 bp, Homo sapiens
gtggccagcaagtgctgcctct

SEQ ID NO: 8134374 - DNA, 19 bp, Homo sapiens
gtctctgctccagggtctc

SEQ ID NO: 8134375 - DNA, 22 bp, Homo sapiens
gtccttggaaagtctaatctct

SEQ ID NO: 8134376 - DNA, 22 bp, Homo sapiens
gtctgggggtccgggtgcctgc

SEQ ID NO: 8134377 - DNA, 22 bp, Homo sapiens
gtctggggcagcaaggcgcgcg

SEQ ID NO: 8134378 - DNA, 22 bp, Homo sapiens
gtctggggaagtcagggcatca

SEQ ID NO: 8134379 - DNA, 20 bp, Homo sapiens
gtctgcagtaagagggaata

SEQ ID NO: 8134380 - DNA, 22 bp, Homo sapiens
gtatgtctgagtaataatgtgt

SEQ ID NO: 8134381 - DNA, 22 bp, Homo sapiens
gtcctgggtccccgcaggtcag

SEQ ID NO: 8134382 - DNA, 22 bp, Homo sapiens
gtcccagggaagaaggcagcac

SEQ ID NO: 8134383 - DNA, 22 bp, Homo sapiens
ggtggccataggaccagcctgg

SEQ ID NO: 8134384 - DNA, 22 bp, Homo sapiens
ggtgtccgcgctgtagaaggtc

SEQ ID NO: 8134385 - DNA, 22 bp, Homo sapiens
ggtggcagagaggaggtagttt

SEQ ID NO: 8134386 - DNA, 22 bp, Homo sapiens
ggtgatccaccagcctcggcct

SEQ ID NO: 8134387 - DNA, 22 bp, Homo sapiens
gggtgggcctgtctggccatgt

SEQ ID NO: 8134388 - DNA, 21 bp, Homo sapiens
gtatatcagcagtgaattcaa

SEQ ID NO: 8134389 - DNA, 22 bp, Homo sapiens
gtgtccttttatgtgactggtt

SEQ ID NO: 8134390 - DNA, 18 bp, Homo sapiens
gtgtgggctcctccgagt

SEQ ID NO: 8134391 - DNA, 22 bp, Homo sapiens
gtgtgggctatgtgcgtgggca

SEQ ID NO: 8134392 - DNA, 22 bp, Homo sapiens
gtgtgggcagggccgtgctccc

SEQ ID NO: 8134393 - DNA, 22 bp, Homo sapiens
gttgttgctatgttattgttat

SEQ ID NO: 8134394 - DNA, 22 bp, Homo sapiens
gttcaaaattcaaatggtatac

SEQ ID NO: 8134395 - DNA, 22 bp, Homo sapiens
gtgggctcccctggcatgtcca

SEQ ID NO: 8134396 - DNA, 22 bp, Homo sapiens
gtgggcgatcatctcagccgtc

SEQ ID NO: 8134397 - DNA, 22 bp, Homo sapiens
gtgggctcaggcctctgtgggg

SEQ ID NO: 8134398 - DNA, 22 bp, Homo sapiens
gtgggccaggcgtctaggccct

SEQ ID NO: 8134399 - DNA, 22 bp, Homo sapiens
gtgggctggatttgcttgcaga

SEQ ID NO: 8134400 - DNA, 22 bp, Homo sapiens
gtgggctggaccctcctgctcc

SEQ ID NO: 8134401 - DNA, 22 bp, Homo sapiens
gtgggctgcttcctccttccac

SEQ ID NO: 8134402 - DNA, 22 bp, Homo sapiens
gtgggcttttgacagtgcctgg

SEQ ID NO: 8134403 - DNA, 22 bp, Homo sapiens
gtgggggatgctgagttggaaa

SEQ ID NO: 8134404 - DNA, 22 bp, Homo sapiens
gtgggcagaattgaatctttaa

SEQ ID NO: 8134405 - DNA, 22 bp, Homo sapiens
gtgggcagaacatttgtaggct

SEQ ID NO: 8134406 - DNA, 22 bp, Homo sapiens
gtgggcagacagtgctttgcag

SEQ ID NO: 8134407 - DNA, 22 bp, Homo sapiens
gtgggcagacatgatagaagga

SEQ ID NO: 8134408 - DNA, 22 bp, Homo sapiens
gtgggcagagcaagggaactca

SEQ ID NO: 8134409 - DNA, 20 bp, Homo sapiens
gtgggcagagcaccacctgg

SEQ ID NO: 8134410 - DNA, 22 bp, Homo sapiens
gtgggcagattaatttctcaat

SEQ ID NO: 8134411 - DNA, 20 bp, Homo sapiens
gtgggcagatgtgtgcatgg

SEQ ID NO: 8134412 - DNA, 22 bp, Homo sapiens
gtgggcagaggagagaacatta

SEQ ID NO: 8134413 - DNA, 22 bp, Homo sapiens
gtgggcagatacatttgatatg

SEQ ID NO: 8134414 - DNA, 22 bp, Homo sapiens
gtgggcagattatagatgatgc

SEQ ID NO: 8134415 - DNA, 22 bp, Homo sapiens
gtgggcagcaccagggaagtgt

SEQ ID NO: 8134416 - DNA, 20 bp, Homo sapiens
gtgggcagcaggcatactgg

SEQ ID NO: 8134417 - DNA, 22 bp, Homo sapiens
gtgggcagttcaattctgggag

SEQ ID NO: 8134418 - DNA, 22 bp, Homo sapiens
gtgggcagttggtgattctcgt

SEQ ID NO: 8134419 - DNA, 22 bp, Homo sapiens
gtgggccaggacccgctgtccg

SEQ ID NO: 8134420 - DNA, 22 bp, Homo sapiens
gtgggcagcctgtccggagacc

SEQ ID NO: 8134421 - DNA, 22 bp, Homo sapiens
gtgggcagcctcctttattttc

SEQ ID NO: 8134422 - DNA, 22 bp, Homo sapiens
gtgggcagccccttcaaggcca

SEQ ID NO: 8134423 - DNA, 22 bp, Homo sapiens
gtgggcagtgtgtcagtatctt

SEQ ID NO: 8134424 - DNA, 22 bp, Homo sapiens
gtgggcagtggtttgcgcggtc

SEQ ID NO: 8134425 - DNA, 22 bp, Homo sapiens
gtgtcacatggtttactgcagc

SEQ ID NO: 8134426 - DNA, 22 bp, Homo sapiens
gtggggtgtccagcagcgagct

SEQ ID NO: 8134427 - DNA, 22 bp, Homo sapiens
gtggggggagctgcaagctgga

SEQ ID NO: 8134428 - DNA, 22 bp, Homo sapiens
gtgggggtttcattaagacaat

SEQ ID NO: 8134429 - DNA, 22 bp, Homo sapiens
gtgggggtggaaaggcaagttg

SEQ ID NO: 8134430 - DNA, 22 bp, Homo sapiens
gtttaagtttcagaagctaaga

SEQ ID NO: 8134431 - DNA, 22 bp, Homo sapiens
gtttaataatgttgaattacta

SEQ ID NO: 8134432 - DNA, 22 bp, Homo sapiens
gtttaaataattaggggcctgt

SEQ ID NO: 8134433 - DNA, 22 bp, Homo sapiens
gtttaaagtagcttccttttgg

SEQ ID NO: 8134434 - DNA, 22 bp, Homo sapiens
gtttaaagtcttggaaggagga

SEQ ID NO: 8134435 - DNA, 22 bp, Homo sapiens
gttgttttcagcagtttatgac

SEQ ID NO: 8134436 - DNA, 22 bp, Homo sapiens
taaaggctttattttccagtca

SEQ ID NO: 8134437 - DNA, 22 bp, Homo sapiens
taaagcaggtgctcagtgacca

SEQ ID NO: 8134438 - DNA, 22 bp, Homo sapiens
taaagcaggccacatatgtgat

SEQ ID NO: 8134439 - DNA, 22 bp, Homo sapiens
taaagcaggcatctctctcctc

SEQ ID NO: 8134440 - DNA, 22 bp, Homo sapiens
taagaacaagatgttcctgttt

SEQ ID NO: 8134441 - DNA, 22 bp, Homo sapiens
taacactggtatttcatttagt

SEQ ID NO: 8134442 - DNA, 22 bp, Homo sapiens
taaatgataataatgctagtgt

SEQ ID NO: 8134443 - DNA, 22 bp, Homo sapiens
taaatgaagaaatggagattgt

SEQ ID NO: 8134444 - DNA, 22 bp, Homo sapiens
taaatgaaagggtttaatttat

SEQ ID NO: 8134445 - DNA, 22 bp, Homo sapiens
taaatcctttttgagggtatca

SEQ ID NO: 8134446 - DNA, 22 bp, Homo sapiens
ggagaggtgaatggctgctcta

SEQ ID NO: 8134447 - DNA, 22 bp, Homo sapiens
ggagatctttgttatcttttga

SEQ ID NO: 8134448 - DNA, 22 bp, Homo sapiens
ggagcggcagatggagtgggag

SEQ ID NO: 8134449 - DNA, 22 bp, Homo sapiens
ggaaggtgctccctggacagag

SEQ ID NO: 8134450 - DNA, 22 bp, Homo sapiens
ggaagtctcagcaacagagtta

SEQ ID NO: 8134451 - DNA, 22 bp, Homo sapiens
ggagacagcaggaagaaatatc

SEQ ID NO: 8134452 - DNA, 22 bp, Homo sapiens
ggaggagcatgagagggtagtg

SEQ ID NO: 8134453 - DNA, 22 bp, Homo sapiens
ggaggccacctgacctgctgtt

SEQ ID NO: 8134454 - DNA, 22 bp, Homo sapiens
ggaggaggcaagtaccagatgc

SEQ ID NO: 8134455 - DNA, 22 bp, Homo sapiens
ggaggccaggaagagccgccct

SEQ ID NO: 8134456 - DNA, 18 bp, Homo sapiens
ggaaggtgattcagtttt

SEQ ID NO: 8134457 - DNA, 22 bp, Homo sapiens
ggaactgattaagtcatgagaa

SEQ ID NO: 8134458 - DNA, 22 bp, Homo sapiens
ggaaagaatcaagtgatcctgt

SEQ ID NO: 8134459 - DNA, 22 bp, Homo sapiens
ggaaagaaccctggatggctgg

SEQ ID NO: 8134460 - DNA, 21 bp, Homo sapiens
ggaaagaaggcaaggctcagg

SEQ ID NO: 8134461 - DNA, 22 bp, Homo sapiens
ggaaagaatagagactttatca

SEQ ID NO: 8134462 - DNA, 22 bp, Homo sapiens
ggaaagaaagtgtgaacaactt

SEQ ID NO: 8134463 - DNA, 19 bp, Homo sapiens
ggaaacaggggccagagga

SEQ ID NO: 8134464 - DNA, 22 bp, Homo sapiens
gctgggctgagctagacttggc

SEQ ID NO: 8134465 - DNA, 22 bp, Homo sapiens
gctgggctggaaggccaaggca

SEQ ID NO: 8134466 - DNA, 22 bp, Homo sapiens
gcttaattctggctcagtttcc

SEQ ID NO: 8134467 - DNA, 22 bp, Homo sapiens
gcttctgcgcctagcctcaggt

SEQ ID NO: 8134468 - DNA, 22 bp, Homo sapiens
gcttctgcagggtcctcgctgt

SEQ ID NO: 8134469 - DNA, 22 bp, Homo sapiens
ggcacagcactgtaggcctggg

SEQ ID NO: 8134470 - DNA, 18 bp, Homo sapiens
ggcagacgcgaggggcgg

SEQ ID NO: 8134471 - DNA, 22 bp, Homo sapiens
ggagtggcagctaggctgtcag

SEQ ID NO: 8134472 - DNA, 22 bp, Homo sapiens
ggagtgggcagcactgccctgt

SEQ ID NO: 8134473 - DNA, 22 bp, Homo sapiens
ggagtggctatttgtgctggtt

SEQ ID NO: 8134474 - DNA, 22 bp, Homo sapiens
ggcacacagatggagcactagc

SEQ ID NO: 8134475 - DNA, 22 bp, Homo sapiens
ggcacacagcttggcaggagat

SEQ ID NO: 8134476 - DNA, 22 bp, Homo sapiens
ggcacacatagatctgcactgg

SEQ ID NO: 8134477 - DNA, 22 bp, Homo sapiens
ggcacagagcaggccactaatc

SEQ ID NO: 8134478 - DNA, 22 bp, Homo sapiens
ggcagctggggcagtgccctgt

SEQ ID NO: 8134479 - DNA, 17 bp, Homo sapiens
ggcaggtgcggggccgc

SEQ ID NO: 8134480 - DNA, 22 bp, Homo sapiens
ggcaggtgaggcatgtgcctgg

SEQ ID NO: 8134481 - DNA, 16 bp, Homo sapiens
ggcaggcgcggagccc

SEQ ID NO: 8134482 - DNA, 22 bp, Homo sapiens
ggcaggcgtggtggcctcagaa

SEQ ID NO: 8134483 - DNA, 18 bp, Homo sapiens
ggcaggctctctgggtca

SEQ ID NO: 8134484 - DNA, 22 bp, Homo sapiens
ggcaggctccaagcatcctatg

SEQ ID NO: 8134485 - DNA, 22 bp, Homo sapiens
ggagggtgcagaccctttgcaa

SEQ ID NO: 8134486 - DNA, 22 bp, Homo sapiens
ggagggtgcattttaccctgtg

SEQ ID NO: 8134487 - DNA, 22 bp, Homo sapiens
ggaggggctgagcaactttcag

SEQ ID NO: 8134488 - DNA, 22 bp, Homo sapiens
ggaggggctcctgttcgccccc

SEQ ID NO: 8134489 - DNA, 22 bp, Homo sapiens
ggaggtggaggttgcagtgagc

SEQ ID NO: 8134490 - DNA, 22 bp, Homo sapiens
ggaggtgggagacataggcggc

SEQ ID NO: 8134491 - DNA, 22 bp, Homo sapiens
ggaggtgggagcctccagtggt

SEQ ID NO: 8134492 - DNA, 22 bp, Homo sapiens
ggagggccatcttgggtgtgat

SEQ ID NO: 8134493 - DNA, 22 bp, Homo sapiens
ggagggcccctccagtgggcag

SEQ ID NO: 8134494 - DNA, 18 bp, Homo sapiens
ggagggctttggggactg

SEQ ID NO: 8134495 - DNA, 22 bp, Homo sapiens
ggagggctgccaggtggagcgg

SEQ ID NO: 8134496 - DNA, 22 bp, Homo sapiens
ggagggctgtagaggagacctg

SEQ ID NO: 8134497 - DNA, 22 bp, Homo sapiens
ggagggctgagactggggtctg

SEQ ID NO: 8134498 - DNA, 22 bp, Homo sapiens
ggaggcggaggttgcagtgagt

SEQ ID NO: 8134499 - DNA, 22 bp, Homo sapiens
ggaggcggaggttgcagtgagc

SEQ ID NO: 8134500 - DNA, 22 bp, Homo sapiens
ggaggctccatgagctcctgca

SEQ ID NO: 8134501 - DNA, 22 bp, Homo sapiens
ggaggcggggaaggcatcccat

SEQ ID NO: 8134502 - DNA, 22 bp, Homo sapiens
ggaggctcagactccatcctca

SEQ ID NO: 8134503 - DNA, 22 bp, Homo sapiens
ggaggcccagaaggaagcccag

SEQ ID NO: 8134504 - DNA, 22 bp, Homo sapiens
ggaggcctagccagctccagtt

SEQ ID NO: 8134505 - DNA, 22 bp, Homo sapiens
ggaggcctcctgggggaggttc

SEQ ID NO: 8134506 - DNA, 22 bp, Homo sapiens
ggaggctgaggcaggcggatca

SEQ ID NO: 8134507 - DNA, 22 bp, Homo sapiens
ggaggctgaggcccctcacagg

SEQ ID NO: 8134508 - DNA, 22 bp, Homo sapiens
ggaggctgctgcctcacgtggg

SEQ ID NO: 8134509 - DNA, 22 bp, Homo sapiens
ggaggctcttgagaggggagta

SEQ ID NO: 8134510 - DNA, 22 bp, Homo sapiens
ggaggctgagaagtccaagatc

SEQ ID NO: 8134511 - DNA, 22 bp, Homo sapiens
ggccttgcggaacgctcaggcg

SEQ ID NO: 8134512 - DNA, 22 bp, Homo sapiens
ggccttgctgcttccagaaggt

SEQ ID NO: 8134513 - DNA, 22 bp, Homo sapiens
ggccttccagggaagacagggc

SEQ ID NO: 8134514 - DNA, 22 bp, Homo sapiens
ggccctccctgagccaggtggg

SEQ ID NO: 8134515 - DNA, 22 bp, Homo sapiens
ggccctgcgattaggtggcagg

SEQ ID NO: 8134516 - DNA, 22 bp, Homo sapiens
ggccctgcaaggtacccaggcc

SEQ ID NO: 8134517 - DNA, 22 bp, Homo sapiens
ggccctgcatgagattaaggtt

SEQ ID NO: 8134518 - DNA, 22 bp, Homo sapiens
ggccctgagtctagctgctctt

SEQ ID NO: 8134519 - DNA, 22 bp, Homo sapiens
ggctcaggtttccttcccagct

SEQ ID NO: 8134520 - DNA, 21 bp, Homo sapiens
ggctcctgctttgtgaggggc

SEQ ID NO: 8134521 - DNA, 22 bp, Homo sapiens
ggctcagcgcgctgggagggag

SEQ ID NO: 8134522 - DNA, 22 bp, Homo sapiens
ggctcagccccgtaacacagca

SEQ ID NO: 8134523 - DNA, 22 bp, Homo sapiens
ggctcagcacagggctggcatc

SEQ ID NO: 8134524 - DNA, 18 bp, Homo sapiens
ggctcagcaggctctctc

SEQ ID NO: 8134525 - DNA, 22 bp, Homo sapiens
ggctcagcttatctgggcaggc

SEQ ID NO: 8134526 - DNA, 22 bp, Homo sapiens
ggctcagcttggtgcgcagaaa

SEQ ID NO: 8134527 - DNA, 22 bp, Homo sapiens
ggctcaggatgagccttctcat

SEQ ID NO: 8134528 - DNA, 20 bp, Homo sapiens
ggcaggtgctcgcttggtct

SEQ ID NO: 8134529 - DNA, 20 bp, Homo sapiens
ggcaggtgctgtcccctcct

SEQ ID NO: 8134530 - DNA, 22 bp, Homo sapiens
ggcaggtgcttgtcgaaggcct

SEQ ID NO: 8134531 - DNA, 22 bp, Homo sapiens
ggcaggtggaaggtctccattc

SEQ ID NO: 8134532 - DNA, 17 bp, Homo sapiens
ggccagaggcggggctg

SEQ ID NO: 8134533 - DNA, 22 bp, Homo sapiens
ggcccctcagcatctgagtcag

SEQ ID NO: 8134534 - DNA, 21 bp, Homo sapiens
ggccccgcagacccagcacgt

SEQ ID NO: 8134535 - DNA, 22 bp, Homo sapiens
ggcccagcctcagacatgccct

SEQ ID NO: 8134536 - DNA, 22 bp, Homo sapiens
ggcccagccggcgagtctcgcg

SEQ ID NO: 8134537 - DNA, 22 bp, Homo sapiens
ggcccagcccgagtcagccttc

SEQ ID NO: 8134538 - DNA, 22 bp, Homo sapiens
ggctgcagagctgggtgggcct

SEQ ID NO: 8134539 - DNA, 22 bp, Homo sapiens
ggctcctggggaggtgagcttg

SEQ ID NO: 8134540 - DNA, 19 bp, Homo sapiens
ggctcctgtggctgcagcc

SEQ ID NO: 8134541 - DNA, 22 bp, Homo sapiens
ggctcctggaaagccctcgctc

SEQ ID NO: 8134542 - DNA, 22 bp, Homo sapiens
ggctgctgaacaagggaaccct

SEQ ID NO: 8134543 - DNA, 22 bp, Homo sapiens
ggctgctcttcttggcgacctc

SEQ ID NO: 8134544 - DNA, 22 bp, Homo sapiens
ggctgctctccatcccaggcct

SEQ ID NO: 8134545 - DNA, 22 bp, Homo sapiens
ggctgctcggcagctcctgagc

SEQ ID NO: 8134546 - DNA, 22 bp, Homo sapiens
ggctgctcggagcctcctgtga

SEQ ID NO: 8134547 - DNA, 22 bp, Homo sapiens
ggctgcaggcagaggctgtctg

SEQ ID NO: 8134548 - DNA, 22 bp, Homo sapiens
ggctgcaggatgcccagccgtg

SEQ ID NO: 8134549 - DNA, 22 bp, Homo sapiens
ggctgcaggaacgacggagggg

SEQ ID NO: 8134550 - DNA, 22 bp, Homo sapiens
ggcttcccaaggagccaggatg

SEQ ID NO: 8134551 - DNA, 22 bp, Homo sapiens
ggcttcccagcagagggcgcac

SEQ ID NO: 8134552 - DNA, 22 bp, Homo sapiens
ggcttccccacagtcctgagct

SEQ ID NO: 8134553 - DNA, 22 bp, Homo sapiens
ggctgtggtctgggtgctcccc

SEQ ID NO: 8134554 - DNA, 22 bp, Homo sapiens
gggccagtgggacctgggtctc

SEQ ID NO: 8134555 - DNA, 22 bp, Homo sapiens
gggcccagcactggctgggatc

SEQ ID NO: 8134556 - DNA, 22 bp, Homo sapiens
gggcctggtgcttctgactcct

SEQ ID NO: 8134557 - DNA, 22 bp, Homo sapiens
gggcggtgcctgtctccgaagc

SEQ ID NO: 8134558 - DNA, 22 bp, Homo sapiens
gggcgtcctggaccctcccctg

SEQ ID NO: 8134559 - DNA, 22 bp, Homo sapiens
gggcggggggagctggaatgaa

SEQ ID NO: 8134560 - DNA, 22 bp, Homo sapiens
gggcagcagaattggacagaaa

SEQ ID NO: 8134561 - DNA, 22 bp, Homo sapiens
gggcagcacgtttcaggaggat

SEQ ID NO: 8134562 - DNA, 22 bp, Homo sapiens
gggcagaggggcgcttccctct

SEQ ID NO: 8134563 - DNA, 22 bp, Homo sapiens
gggcagaggttcaacttcaaca

SEQ ID NO: 8134564 - DNA, 22 bp, Homo sapiens
gggccagtctgactctgctggt

SEQ ID NO: 8134565 - DNA, 22 bp, Homo sapiens
gggccagtagcacctgtgtgga

SEQ ID NO: 8134566 - DNA, 22 bp, Homo sapiens
gggccaggtggaccccagcctc

SEQ ID NO: 8134567 - DNA, 20 bp, Homo sapiens
gggcagcctcgggagtgggt

SEQ ID NO: 8134568 - DNA, 22 bp, Homo sapiens
gggcagcctcggtgcctgctgc

SEQ ID NO: 8134569 - DNA, 22 bp, Homo sapiens
gggactccaaaactgtacccaa

SEQ ID NO: 8134570 - DNA, 22 bp, Homo sapiens
gggactccagggccactgggcc

SEQ ID NO: 8134571 - DNA, 22 bp, Homo sapiens
gggacgggcagtccaaggggtc

SEQ ID NO: 8134572 - DNA, 22 bp, Homo sapiens
gggacgggcacggagggccctc

SEQ ID NO: 8134573 - DNA, 22 bp, Homo sapiens
gggaggcgccgagggtagctaa

SEQ ID NO: 8134574 - DNA, 22 bp, Homo sapiens
gggaggctcagtggtgtcctct

SEQ ID NO: 8134575 - DNA, 20 bp, Homo sapiens
gggaggcgagggctgagcag

SEQ ID NO: 8134576 - DNA, 22 bp, Homo sapiens
gggatggctttgtggctgactc

SEQ ID NO: 8134577 - DNA, 22 bp, Homo sapiens
gggaggcttgagccatactgcc

SEQ ID NO: 8134578 - DNA, 22 bp, Homo sapiens
gggaggctggctctggccacag

SEQ ID NO: 8134579 - DNA, 22 bp, Homo sapiens
gggaggctgccatccttcagga

SEQ ID NO: 8134580 - DNA, 22 bp, Homo sapiens
gggtgggatggcaggagccgct

SEQ ID NO: 8134581 - DNA, 23 bp, Homo sapiens
gggtgggccaaattaggtagcct

SEQ ID NO: 8134582 - DNA, 17 bp, Homo sapiens
gggtgggcactgctggc

SEQ ID NO: 8134583 - DNA, 22 bp, Homo sapiens
gggtgggccactgagcagcgtg

SEQ ID NO: 8134584 - DNA, 22 bp, Homo sapiens
gggtgggccccaggtatctgta

SEQ ID NO: 8134585 - DNA, 22 bp, Homo sapiens
gggtgggcccagcccagagaag

SEQ ID NO: 8134586 - DNA, 22 bp, Homo sapiens
gggggctggaatatccatcaac

SEQ ID NO: 8134587 - DNA, 23 bp, Homo sapiens
gggggctggttgactctctgcag

SEQ ID NO: 8134588 - DNA, 22 bp, Homo sapiens
gggggctggactttcccacaca

SEQ ID NO: 8134589 - DNA, 22 bp, Homo sapiens
gggggctctgactccctcagct

SEQ ID NO: 8134590 - DNA, 22 bp, Homo sapiens
ggggacgggacttagcatgagt

SEQ ID NO: 8134591 - DNA, 22 bp, Homo sapiens
ggggacgcagaaagagtggcag

SEQ ID NO: 8134592 - DNA, 22 bp, Homo sapiens
gggggtggttctaagtcctata

SEQ ID NO: 8134593 - DNA, 22 bp, Homo sapiens
ggggggcagctgtcctggccat

SEQ ID NO: 8134594 - DNA, 20 bp, Homo sapiens
ggggggcttcagggcctgtg

SEQ ID NO: 8134595 - DNA, 22 bp, Homo sapiens
ggggaaggattgagttgaccca

SEQ ID NO: 8134596 - DNA, 16 bp, Homo sapiens
ggggaaggcaagaggg

SEQ ID NO: 8134597 - DNA, 22 bp, Homo sapiens
gggctctggggtgccctggcat

SEQ ID NO: 8134598 - DNA, 22 bp, Homo sapiens
gggctagcctcttccctgctcc

SEQ ID NO: 8134599 - DNA, 20 bp, Homo sapiens
gggctctgtaaggttgaaag

SEQ ID NO: 8134600 - DNA, 22 bp, Homo sapiens
gggctctggtacttcctggctc

SEQ ID NO: 8134601 - DNA, 22 bp, Homo sapiens
gggctctgtggatgtgagagct

SEQ ID NO: 8134602 - DNA, 22 bp, Homo sapiens
gggctgctgtgttcctgaggca

SEQ ID NO: 8134603 - DNA, 22 bp, Homo sapiens
gggctgcttggaggaggcgctc

SEQ ID NO: 8134604 - DNA, 22 bp, Homo sapiens
gggctctgtggcttccttctta

SEQ ID NO: 8134605 - DNA, 20 bp, Homo sapiens
gagagtgcttttcattgctc

SEQ ID NO: 8134606 - DNA, 22 bp, Homo sapiens
gagagtgcgattcattcattta

SEQ ID NO: 8134607 - DNA, 22 bp, Homo sapiens
gagagtggatggagctgcgaag

SEQ ID NO: 8134608 - DNA, 22 bp, Homo sapiens
gagctgggacatgggtcctctc

SEQ ID NO: 8134609 - DNA, 22 bp, Homo sapiens
gaggaagggctgcctgccgggc

SEQ ID NO: 8134610 - DNA, 22 bp, Homo sapiens
gagctgggagttatagcatgtt

SEQ ID NO: 8134611 - DNA, 23 bp, Homo sapiens
gagctgggatacaggcttactgc

SEQ ID NO: 8134612 - DNA, 22 bp, Homo sapiens
gaggacagcttagggcttcctg

SEQ ID NO: 8134613 - DNA, 22 bp, Homo sapiens
gaggacagctctaactaaagtc

SEQ ID NO: 8134614 - DNA, 22 bp, Homo sapiens
gaggacagagccgcctggcaag

SEQ ID NO: 8134615 - DNA, 22 bp, Homo sapiens
gaggaggcttccgggaggcacg

SEQ ID NO: 8134616 - DNA, 22 bp, Homo sapiens
gaggagggagaattaggcttaa

SEQ ID NO: 8134617 - DNA, 22 bp, Homo sapiens
gaggaggctggcgccgcctgcc

SEQ ID NO: 8134618 - DNA, 22 bp, Homo sapiens
gaggaggctgaacaatgccctg

SEQ ID NO: 8134619 - DNA, 22 bp, Homo sapiens
gaggagggttggccttaggtag

SEQ ID NO: 8134620 - DNA, 22 bp, Homo sapiens
gaggcagcgggtcaggaccgtg

SEQ ID NO: 8134621 - DNA, 22 bp, Homo sapiens
gaggcagcaggctgaggaggat

SEQ ID NO: 8134622 - DNA, 22 bp, Homo sapiens
gaggcccagcagcgcaggtctt

SEQ ID NO: 8134623 - DNA, 22 bp, Homo sapiens
gaggcagctgggctggtggttt

SEQ ID NO: 8134624 - DNA, 22 bp, Homo sapiens
gaggcagctgaaggagtgacag

SEQ ID NO: 8134625 - DNA, 22 bp, Homo sapiens
gaggccctgaagacagctgggg

SEQ ID NO: 8134626 - DNA, 22 bp, Homo sapiens
gaggtgggatgtgtgtgctact

SEQ ID NO: 8134627 - DNA, 22 bp, Homo sapiens
gaggtgggcggatcacaaggtc

SEQ ID NO: 8134628 - DNA, 22 bp, Homo sapiens
gaggtgggagggcagtccctaa

SEQ ID NO: 8134629 - DNA, 22 bp, Homo sapiens
gaggggcagttgattgtgctat

SEQ ID NO: 8134630 - DNA, 22 bp, Homo sapiens
gaggggcgtcctgagtgggcct

SEQ ID NO: 8134631 - DNA, 22 bp, Homo sapiens
gaggtaggtgtaggaggcctgc

SEQ ID NO: 8134632 - DNA, 22 bp, Homo sapiens
gagtcaggctagggtgacaggc

SEQ ID NO: 8134633 - DNA, 22 bp, Homo sapiens
gagtcaggctagaggtgagtct

SEQ ID NO: 8134634 - DNA, 20 bp, Homo sapiens
gagtcacagaagaagctgaa

SEQ ID NO: 8134635 - DNA, 22 bp, Homo sapiens
gaggtggggttttgttcttgaa

SEQ ID NO: 8134636 - DNA, 19 bp, Homo sapiens
gaggtgggtccccgcagcc

SEQ ID NO: 8134637 - DNA, 22 bp, Homo sapiens
gaggtgggtgtatcacaggtca

SEQ ID NO: 8134638 - DNA, 22 bp, Homo sapiens
gaggggcagtgcacccgggccc

SEQ ID NO: 8134639 - DNA, 22 bp, Homo sapiens
gaggggcagaatgtgatcaggg

SEQ ID NO: 8134640 - DNA, 22 bp, Homo sapiens
gaggggcagaggtagagaacaa

SEQ ID NO: 8134641 - DNA, 22 bp, Homo sapiens
gaggggcagaatgtgatcaggg

SEQ ID NO: 8134642 - DNA, 22 bp, Homo sapiens
gaggggcacagcagctgttgca

SEQ ID NO: 8134643 - DNA, 22 bp, Homo sapiens
gaggggcacagtaaagggtccc

SEQ ID NO: 8134644 - DNA, 22 bp, Homo sapiens
gaggggagtgtcctccgggccc

SEQ ID NO: 8134645 - DNA, 22 bp, Homo sapiens
gagggccaactagcaccacttt

SEQ ID NO: 8134646 - DNA, 22 bp, Homo sapiens
gaggctggacgtgcatttctac

SEQ ID NO: 8134647 - DNA, 22 bp, Homo sapiens
gaggctgcccacacctgcgccg

SEQ ID NO: 8134648 - DNA, 22 bp, Homo sapiens
gaggctgcccaactggagtgga

SEQ ID NO: 8134649 - DNA, 22 bp, Homo sapiens
gaggctggaggtcaaagatgaa

SEQ ID NO: 8134650 - DNA, 22 bp, Homo sapiens
gaggctggcagaaaagcacagg

SEQ ID NO: 8134651 - DNA, 22 bp, Homo sapiens
gaggctgggggctgccttcctc

SEQ ID NO: 8134652 - DNA, 16 bp, Homo sapiens
gagggcagaggcggaa

SEQ ID NO: 8134653 - DNA, 22 bp, Homo sapiens
gaggctgggaagtccaagacca

SEQ ID NO: 8134654 - DNA, 22 bp, Homo sapiens
gaggctgggaagtccaagatca

SEQ ID NO: 8134655 - DNA, 22 bp, Homo sapiens
gatcttttcagtcttggtagtt

SEQ ID NO: 8134656 - DNA, 22 bp, Homo sapiens
gatcttttcaggtttctctagt

SEQ ID NO: 8134657 - DNA, 20 bp, Homo sapiens
gatgattatctgaagccctt

SEQ ID NO: 8134658 - DNA, 22 bp, Homo sapiens
gatgattacacttttaaaacag

SEQ ID NO: 8134659 - DNA, 22 bp, Homo sapiens
gatgcacagagggcctggaact

SEQ ID NO: 8134660 - DNA, 21 bp, Homo sapiens
gatgcacaatgggtaagtaca

SEQ ID NO: 8134661 - DNA, 22 bp, Homo sapiens
gatgcacaaagcagagggaatc

SEQ ID NO: 8134662 - DNA, 22 bp, Homo sapiens
gatgcacattgaacaatcacaa

SEQ ID NO: 8134663 - DNA, 22 bp, Homo sapiens
gatgcacatgtgagtatagaag

SEQ ID NO: 8134664 - DNA, 22 bp, Homo sapiens
gatgcacagtgaccctgccagt

SEQ ID NO: 8134665 - DNA, 22 bp, Homo sapiens
gatgcacaggtgagcaggtgca

SEQ ID NO: 8134666 - DNA, 22 bp, Homo sapiens
gatgcacagccatgttaatgtg

SEQ ID NO: 8134667 - DNA, 21 bp, Homo sapiens
gatacagagggccactgattg

SEQ ID NO: 8134668 - DNA, 22 bp, Homo sapiens
gatacacaagtggaaggagacg

SEQ ID NO: 8134669 - DNA, 22 bp, Homo sapiens
gatactgtaggtgaaagtgttt

SEQ ID NO: 8134670 - DNA, 21 bp, Homo sapiens
gatatttatgactcattcctt

SEQ ID NO: 8134671 - DNA, 22 bp, Homo sapiens
gatatatgtaaaagtagacaga

SEQ ID NO: 8134672 - DNA, 22 bp, Homo sapiens
gatatttacattaagcacattg

SEQ ID NO: 8134673 - DNA, 22 bp, Homo sapiens
gatcatcaagcaagaacctgat

SEQ ID NO: 8134674 - DNA, 22 bp, Homo sapiens
gatcatcatctttcaggcaagt

SEQ ID NO: 8134675 - DNA, 22 bp, Homo sapiens
gatcagtttaatcttcaggggt

SEQ ID NO: 8134676 - DNA, 22 bp, Homo sapiens
gagtgtggtgaacaggagcacc

SEQ ID NO: 8134677 - DNA, 22 bp, Homo sapiens
gagtgtgtgcatgatctcttat

SEQ ID NO: 8134678 - DNA, 22 bp, Homo sapiens
gagtgtgttctttatgctgtga

SEQ ID NO: 8134679 - DNA, 21 bp, Homo sapiens
gagtggaacgctcttcacacc

SEQ ID NO: 8134680 - DNA, 22 bp, Homo sapiens
gagtgcagtatgagaggctgct

SEQ ID NO: 8134681 - DNA, 22 bp, Homo sapiens
gagtgctcgggtgtcccgcggg

SEQ ID NO: 8134682 - DNA, 17 bp, Homo sapiens
gagtgctggtggagctc

SEQ ID NO: 8134683 - DNA, 22 bp, Homo sapiens
gagtgctgtaggactgagccct

SEQ ID NO: 8134684 - DNA, 22 bp, Homo sapiens
gagtgctggaggtgtgagtggg

SEQ ID NO: 8134685 - DNA, 22 bp, Homo sapiens
gagtgctgcttgggatagtgag

SEQ ID NO: 8134686 - DNA, 22 bp, Homo sapiens
gagtctggtcattttctctccc

SEQ ID NO: 8134687 - DNA, 22 bp, Homo sapiens
cttcttttcatggcttgggaag

SEQ ID NO: 8134688 - DNA, 22 bp, Homo sapiens
cttgaaatccagatttcagagg

SEQ ID NO: 8134689 - DNA, 19 bp, Homo sapiens
cttgaaatgagactgaagg

SEQ ID NO: 8134690 - DNA, 22 bp, Homo sapiens
cttgaaaaatatgccttgcttc

SEQ ID NO: 8134691 - DNA, 22 bp, Homo sapiens
cttcttttgaagggcgttgtgt

SEQ ID NO: 8134692 - DNA, 22 bp, Homo sapiens
cttgaaaataagaaagactttc

SEQ ID NO: 8134693 - DNA, 22 bp, Homo sapiens
cttgggaatgctaacagatgac

SEQ ID NO: 8134694 - DNA, 22 bp, Homo sapiens
cttgggccagcccagggggcat

SEQ ID NO: 8134695 - DNA, 22 bp, Homo sapiens
cttgggatgtaacctttgttcc

SEQ ID NO: 8134696 - DNA, 22 bp, Homo sapiens
ctttacacaatgattttcttta

SEQ ID NO: 8134697 - DNA, 20 bp, Homo sapiens
ctttatcaaagggctactag

SEQ ID NO: 8134698 - DNA, 22 bp, Homo sapiens
gaaagtttcttcattaagatgt

SEQ ID NO: 8134699 - DNA, 22 bp, Homo sapiens
gaaatttacaactttctcatgg

SEQ ID NO: 8134700 - DNA, 17 bp, Homo sapiens
gaacagcagaggggaca

SEQ ID NO: 8134701 - DNA, 21 bp, Homo sapiens
gaaaagcaagggagtagaaca

SEQ ID NO: 8134702 - DNA, 22 bp, Homo sapiens
cttttaagggataataagatgt

SEQ ID NO: 8134703 - DNA, 22 bp, Homo sapiens
cttttaatgggagcagtatttg

SEQ ID NO: 8134704 - DNA, 22 bp, Homo sapiens
gaaagggagtggacaacaggca

SEQ ID NO: 8134705 - DNA, 22 bp, Homo sapiens
gaaaggggcatgtagggatcac

SEQ ID NO: 8134706 - DNA, 21 bp, Homo sapiens
gacaggactagaccagagctc

SEQ ID NO: 8134707 - DNA, 22 bp, Homo sapiens
gacaggaacataaatgtaggag

SEQ ID NO: 8134708 - DNA, 19 bp, Homo sapiens
gacaggaaggctaccagta

SEQ ID NO: 8134709 - DNA, 18 bp, Homo sapiens
gacacaggagagagtccc

SEQ ID NO: 8134710 - DNA, 22 bp, Homo sapiens
gaaggagaccctgaagatgctg

SEQ ID NO: 8134711 - DNA, 22 bp, Homo sapiens
gaacttaacggcaactatttaa

SEQ ID NO: 8134712 - DNA, 22 bp, Homo sapiens
gaagtggaagccatcggcagtc

SEQ ID NO: 8134713 - DNA, 22 bp, Homo sapiens
gaagtggaattactgggtcata

SEQ ID NO: 8134714 - DNA, 22 bp, Homo sapiens
gagacacaagacgcaactctgt

SEQ ID NO: 8134715 - DNA, 22 bp, Homo sapiens
gagacacaatctcatttacatt

SEQ ID NO: 8134716 - DNA, 22 bp, Homo sapiens
gagacacagttatcaggcatac

SEQ ID NO: 8134717 - DNA, 22 bp, Homo sapiens
gagacacagcagatattcaatc

SEQ ID NO: 8134718 - DNA, 22 bp, Homo sapiens
gagacacaggcacagaagaggc

SEQ ID NO: 8134719 - DNA, 22 bp, Homo sapiens
gagacacaagaagacatgcaca

SEQ ID NO: 8134720 - DNA, 22 bp, Homo sapiens
gacccaggaagctacttctggt

SEQ ID NO: 8134721 - DNA, 22 bp, Homo sapiens
gacaggaggcagagctcaggtg

SEQ ID NO: 8134722 - DNA, 22 bp, Homo sapiens
gacccagggtttctgcacaggg

SEQ ID NO: 8134723 - DNA, 22 bp, Homo sapiens
gactgtgggaagactgtaggtt

SEQ ID NO: 8134724 - DNA, 22 bp, Homo sapiens
gatgcctggcacccagcaagga

SEQ ID NO: 8134725 - DNA, 22 bp, Homo sapiens
gatgcctgtggtgagcacacat

SEQ ID NO: 8134726 - DNA, 22 bp, Homo sapiens
gatgtgtgctgcatagtatatt

SEQ ID NO: 8134727 - DNA, 22 bp, Homo sapiens
gatgggggccagggcctgcttt

SEQ ID NO: 8134728 - DNA, 22 bp, Homo sapiens
gattgaaaggtctttaaattgg

SEQ ID NO: 8134729 - DNA, 22 bp, Homo sapiens
gatttacaaagctctctagtgt

SEQ ID NO: 8134730 - DNA, 22 bp, Homo sapiens
gattgttgcctggctttgacct

SEQ ID NO: 8134731 - DNA, 22 bp, Homo sapiens
gattgtctgtgatcatgagcaa

SEQ ID NO: 8134732 - DNA, 22 bp, Homo sapiens
gattgagtctgaggatgctgca

SEQ ID NO: 8134733 - DNA, 22 bp, Homo sapiens
gatttagattcgctggggctgg

SEQ ID NO: 8134734 - DNA, 22 bp, Homo sapiens
gcagaaggatccgcaggtgcaa

SEQ ID NO: 8134735 - DNA, 22 bp, Homo sapiens
gcagaacaacgtaggagtggag

SEQ ID NO: 8134736 - DNA, 22 bp, Homo sapiens
gcagaaatatgatgcataaagg

SEQ ID NO: 8134737 - DNA, 23 bp, Homo sapiens
gcacttttataggtggggaaaca

SEQ ID NO: 8134738 - DNA, 16 bp, Homo sapiens
gcacacacatcaatga

SEQ ID NO: 8134739 - DNA, 22 bp, Homo sapiens
gcaccctgctctatccttgcta

SEQ ID NO: 8134740 - DNA, 20 bp, Homo sapiens
gcacttggctgctgcttctc

SEQ ID NO: 8134741 - DNA, 22 bp, Homo sapiens
gcacctgcaggatgagccaggg

SEQ ID NO: 8134742 - DNA, 22 bp, Homo sapiens
gcaattgctttagggaaaggta

SEQ ID NO: 8134743 - DNA, 20 bp, Homo sapiens
gcaattaatttttggttaca

SEQ ID NO: 8134744 - DNA, 22 bp, Homo sapiens
gcaatataaccagttgtcatgc

SEQ ID NO: 8134745 - DNA, 22 bp, Homo sapiens
gcaatagattatgatctacagt

SEQ ID NO: 8134746 - DNA, 22 bp, Homo sapiens
gattttatagtcaggaaaaaga

SEQ ID NO: 8134747 - DNA, 22 bp, Homo sapiens
gatttctgttgagaaacatggg

SEQ ID NO: 8134748 - DNA, 22 bp, Homo sapiens
gccagcagccacagaagtcact

SEQ ID NO: 8134749 - DNA, 20 bp, Homo sapiens
gccagaggccggcaggggct

SEQ ID NO: 8134750 - DNA, 22 bp, Homo sapiens
gccagatgtagatagcaaggta

SEQ ID NO: 8134751 - DNA, 22 bp, Homo sapiens
gcaggtgggagccgctgcctga

SEQ ID NO: 8134752 - DNA, 22 bp, Homo sapiens
gcaggtggggctgctaccagaa

SEQ ID NO: 8134753 - DNA, 22 bp, Homo sapiens
gcaggtggtggcgcgcgccctg

SEQ ID NO: 8134754 - DNA, 22 bp, Homo sapiens
gcaggtggtcactcatccccag

SEQ ID NO: 8134755 - DNA, 22 bp, Homo sapiens
gcaggtggtgggggagccgttc

SEQ ID NO: 8134756 - DNA, 22 bp, Homo sapiens
gcaggtggttaaggtcccatgt

SEQ ID NO: 8134757 - DNA, 22 bp, Homo sapiens
gcagggtgacgttgcccacctc

SEQ ID NO: 8134758 - DNA, 22 bp, Homo sapiens
gcagggtgatagtgaggctcag

SEQ ID NO: 8134759 - DNA, 22 bp, Homo sapiens
gcagggtgccgacttcagggat

SEQ ID NO: 8134760 - DNA, 22 bp, Homo sapiens
gcagggtggatggcagggccag

SEQ ID NO: 8134761 - DNA, 22 bp, Homo sapiens
gcagtgggcctgaggaagggtg

SEQ ID NO: 8134762 - DNA, 22 bp, Homo sapiens
gcagtgggcaacaagagctgga

SEQ ID NO: 8134763 - DNA, 22 bp, Homo sapiens
gcagtggggaatgctggggaga

SEQ ID NO: 8134764 - DNA, 22 bp, Homo sapiens
gcagtgtcagtgcctgggtggt

SEQ ID NO: 8134765 - DNA, 19 bp, Homo sapiens
gcagtgtcatggtaggagc

SEQ ID NO: 8134766 - DNA, 22 bp, Homo sapiens
gcagtgtccagggtggtctgca

SEQ ID NO: 8134767 - DNA, 18 bp, Homo sapiens
gcagtaggcgcgcaggac

SEQ ID NO: 8134768 - DNA, 22 bp, Homo sapiens
gcagtgggagcttaggcagtgc

SEQ ID NO: 8134769 - DNA, 22 bp, Homo sapiens
gcaggagacaactgtaaggaga

SEQ ID NO: 8134770 - DNA, 19 bp, Homo sapiens
gcaggcacagccctgggtg

SEQ ID NO: 8134771 - DNA, 22 bp, Homo sapiens
gcaggagccacttcagggatgc

SEQ ID NO: 8134772 - DNA, 22 bp, Homo sapiens
gcaggagccaggccgagctggt

SEQ ID NO: 8134773 - DNA, 22 bp, Homo sapiens
gcagagcggtgatcaggcgcag

SEQ ID NO: 8134774 - DNA, 22 bp, Homo sapiens
gcagcctctgcagttcaggagg

SEQ ID NO: 8134775 - DNA, 22 bp, Homo sapiens
gcaggctggggtagccccactt

SEQ ID NO: 8134776 - DNA, 21 bp, Homo sapiens
gcaggcactctagaggagctg

SEQ ID NO: 8134777 - DNA, 22 bp, Homo sapiens
gcaggcagagaggggtttccag

SEQ ID NO: 8134778 - DNA, 21 bp, Homo sapiens
gcaggggatagaaatggtctg

SEQ ID NO: 8134779 - DNA, 22 bp, Homo sapiens
gctggagcgggttcgggccgct

SEQ ID NO: 8134780 - DNA, 22 bp, Homo sapiens
gctgggagttactgtctccttt

SEQ ID NO: 8134781 - DNA, 22 bp, Homo sapiens
gctggcggcagtggtgtctctg

SEQ ID NO: 8134782 - DNA, 22 bp, Homo sapiens
gctgggcaatgccagagaggag

SEQ ID NO: 8134783 - DNA, 22 bp, Homo sapiens
gctgggcaagtgccttgggttt

SEQ ID NO: 8134784 - DNA, 22 bp, Homo sapiens
gctgggcaggcctcgtgagggc

SEQ ID NO: 8134785 - DNA, 22 bp, Homo sapiens
gctgggcagctgaggcctctca

SEQ ID NO: 8134786 - DNA, 22 bp, Homo sapiens
gctgggcagcaggctctccggg

SEQ ID NO: 8134787 - DNA, 22 bp, Homo sapiens
gctgggcagcctggccgctgcc

SEQ ID NO: 8134788 - DNA, 22 bp, Homo sapiens
gctgagcaggtgtaaggaaggc

SEQ ID NO: 8134789 - DNA, 22 bp, Homo sapiens
gctgagctagaaaaggaccaca

SEQ ID NO: 8134790 - DNA, 21 bp, Homo sapiens
gctgctcgagatccagtgctt

SEQ ID NO: 8134791 - DNA, 22 bp, Homo sapiens
gctgctgcaagagccagctctt

SEQ ID NO: 8134792 - DNA, 21 bp, Homo sapiens
gctgctgcccctagtgaggcc

SEQ ID NO: 8134793 - DNA, 22 bp, Homo sapiens
gctgctgctggtctggggccac

SEQ ID NO: 8134794 - DNA, 22 bp, Homo sapiens
gctgctgcctgtagccagggtg

SEQ ID NO: 8134795 - DNA, 22 bp, Homo sapiens
gctgctgccgcggccgctggga

SEQ ID NO: 8134796 - DNA, 22 bp, Homo sapiens
gctctgccagcccaaggcgcag

SEQ ID NO: 8134797 - DNA, 22 bp, Homo sapiens
gctctgccagacactgtggcca

SEQ ID NO: 8134798 - DNA, 22 bp, Homo sapiens
gctctgcccaatgtccctacac

SEQ ID NO: 8134799 - DNA, 22 bp, Homo sapiens
gctctgcccaaagctgtggctg

SEQ ID NO: 8134800 - DNA, 22 bp, Homo sapiens
gctctgtgtccacagctggaaa

SEQ ID NO: 8134801 - DNA, 22 bp, Homo sapiens
gctgagagtgggtgcagtgctt

SEQ ID NO: 8134802 - DNA, 22 bp, Homo sapiens
gctgagcacagcaaagagacaa

SEQ ID NO: 8134803 - DNA, 22 bp, Homo sapiens
gctgagcagggtggggaaaggc

SEQ ID NO: 8134804 - DNA, 22 bp, Homo sapiens
gctgagcacacctagggtagag

SEQ ID NO: 8134805 - DNA, 23 bp, Homo sapiens
gctctgaggaagttgggcacggg

SEQ ID NO: 8134806 - DNA, 22 bp, Homo sapiens
gctctgccaaggacccattctc

SEQ ID NO: 8134807 - DNA, 18 bp, Homo sapiens
gctctgcagctgaggctt

SEQ ID NO: 8134808 - DNA, 22 bp, Homo sapiens
gctctgccaacagtttgggcaa

SEQ ID NO: 8134809 - DNA, 22 bp, Homo sapiens
gctcagagcatcccagtgaatg

SEQ ID NO: 8134810 - DNA, 22 bp, Homo sapiens
gctcagaaatggcagatggaga

SEQ ID NO: 8134811 - DNA, 18 bp, Homo sapiens
gctcatttggatgggctt

SEQ ID NO: 8134812 - DNA, 22 bp, Homo sapiens
gctcatttcttctttccacaat

SEQ ID NO: 8134813 - DNA, 22 bp, Homo sapiens
gctccagctctgttctggggaa

SEQ ID NO: 8134814 - DNA, 22 bp, Homo sapiens
gctccagagtgtggcatctggg

SEQ ID NO: 8134815 - DNA, 22 bp, Homo sapiens
gctccagatgaatgcacttgtt

SEQ ID NO: 8134816 - DNA, 22 bp, Homo sapiens
gcctgtggggctgaggctgcct

SEQ ID NO: 8134817 - DNA, 22 bp, Homo sapiens
gcctgtggttgctttgggatcc

SEQ ID NO: 8134818 - DNA, 23 bp, Homo sapiens
gcctgggactggtagtgtgacct

SEQ ID NO: 8134819 - DNA, 22 bp, Homo sapiens
gcctgggaaatggtggggtcag

SEQ ID NO: 8134820 - DNA, 21 bp, Homo sapiens
gcctgggaaatctgggaagcc

SEQ ID NO: 8134821 - DNA, 19 bp, Homo sapiens
gccgggcccgggttggccg

SEQ ID NO: 8134822 - DNA, 22 bp, Homo sapiens
gccgcgtcgatgccctctagtt

SEQ ID NO: 8134823 - DNA, 22 bp, Homo sapiens
gccgaggctctgcccagctgct

SEQ ID NO: 8134824 - DNA, 22 bp, Homo sapiens
gccgatgaaaagaccaaagact

SEQ ID NO: 8134825 - DNA, 22 bp, Homo sapiens
gccgtggggagagagggtgcgt

SEQ ID NO: 8134826 - DNA, 22 bp, Homo sapiens
gccgtgggtgtcatggcccata

SEQ ID NO: 8134827 - DNA, 19 bp, Homo sapiens
gccgggggcgccccgctct

SEQ ID NO: 8134828 - DNA, 22 bp, Homo sapiens
gccggtggcttttgtctcccct

SEQ ID NO: 8134829 - DNA, 22 bp, Homo sapiens
gcctctgcatgctcagcaccca

SEQ ID NO: 8134830 - DNA, 22 bp, Homo sapiens
gcctctgccaagggggctgcgg

SEQ ID NO: 8134831 - DNA, 22 bp, Homo sapiens
gcctctgcatcttcgccgcact

SEQ ID NO: 8134832 - DNA, 22 bp, Homo sapiens
gcctctgcaactccgccttggt

SEQ ID NO: 8134833 - DNA, 22 bp, Homo sapiens
gcctctgcgcctcagccgacct

SEQ ID NO: 8134834 - DNA, 22 bp, Homo sapiens
gcctctgcggggcccgagcccg

SEQ ID NO: 8134835 - DNA, 22 bp, Homo sapiens
gcccaggctggagtgcagtggc

SEQ ID NO: 8134836 - DNA, 22 bp, Homo sapiens
gcccttccaacccagagggcaa

SEQ ID NO: 8134837 - DNA, 22 bp, Homo sapiens
gcccttccttagacagcaggat

SEQ ID NO: 8134838 - DNA, 22 bp, Homo sapiens
gccagtgtgcaagaggccacca

SEQ ID NO: 8134839 - DNA, 22 bp, Homo sapiens
gccagtgtgcaagaaaacagaa

SEQ ID NO: 8134840 - DNA, 22 bp, Homo sapiens
gccagtgtcttcctgttaatcg

SEQ ID NO: 8134841 - DNA, 22 bp, Homo sapiens
gccagtgtggtgtagtcatgaa

SEQ ID NO: 8134842 - DNA, 22 bp, Homo sapiens
gccagtgtgtcatccggctgca

SEQ ID NO: 8134843 - DNA, 22 bp, Homo sapiens
gccagtgtgtcctctcagtttc

SEQ ID NO: 8134844 - DNA, 22 bp, Homo sapiens
gccagtgttattcctggggctg

SEQ ID NO: 8134845 - DNA, 19 bp, Homo sapiens
gccagtgtgtggtacagtg

SEQ ID NO: 8134846 - DNA, 22 bp, Homo sapiens
gccagtgtgtcttgcaggctcc

SEQ ID NO: 8134847 - DNA, 22 bp, Homo sapiens
gccagtgttcttcaccccctct

SEQ ID NO: 8134848 - DNA, 22 bp, Homo sapiens
gccagtgttgaactttccctgg

SEQ ID NO: 8134849 - DNA, 22 bp, Homo sapiens
gccagtgtttatagcagtgagg

SEQ ID NO: 8134850 - DNA, 22 bp, Homo sapiens
gccagtgttggtgataagctct

SEQ ID NO: 8134851 - DNA, 23 bp, Homo sapiens
gccatcacgttcaaccaaagcct

SEQ ID NO: 8134852 - DNA, 22 bp, Homo sapiens
gcccaggctggagtgcagtagc

SEQ ID NO: 8134853 - DNA, 22 bp, Homo sapiens
ctcctgggctatgtctgcttgg

SEQ ID NO: 8134854 - DNA, 18 bp, Homo sapiens
ctcctgggctgcagatgc

SEQ ID NO: 8134855 - DNA, 22 bp, Homo sapiens
ctcctcccaattgccaagtgct

SEQ ID NO: 8134856 - DNA, 17 bp, Homo sapiens
ctcctctctgggttact

SEQ ID NO: 8134857 - DNA, 22 bp, Homo sapiens
ctcctctctggagttatgcaga

SEQ ID NO: 8134858 - DNA, 22 bp, Homo sapiens
tttacatgtcaagactggcagt

SEQ ID NO: 8134859 - DNA, 22 bp, Homo sapiens
tttacatgtccttcaagagcag

SEQ ID NO: 8134860 - DNA, 22 bp, Homo sapiens
tttacatgagtagcagatgttc

SEQ ID NO: 8134861 - DNA, 22 bp, Homo sapiens
ttgcttttgtgtgctctctgga

SEQ ID NO: 8134862 - DNA, 22 bp, Homo sapiens
ttgcttttccctgtctctgatt

SEQ ID NO: 8134863 - DNA, 22 bp, Homo sapiens
ttgcttttaatctttgtacatc

SEQ ID NO: 8134864 - DNA, 22 bp, Homo sapiens
ttgatattcccgatttaaggta

SEQ ID NO: 8134865 - DNA, 22 bp, Homo sapiens
ttgatatctctgctgtgttagg

SEQ ID NO: 8134866 - DNA, 22 bp, Homo sapiens
ttgatattctgagaagctgaag

SEQ ID NO: 8134867 - DNA, 22 bp, Homo sapiens
ttgggatctcaaatccagctat

SEQ ID NO: 8134868 - DNA, 22 bp, Homo sapiens
ttgggcagaggctgtgcagagg

SEQ ID NO: 8134869 - DNA, 22 bp, Homo sapiens
ttgggcagaggccaggaggatg

SEQ ID NO: 8134870 - DNA, 22 bp, Homo sapiens
ttgggatctacatagctatgta

SEQ ID NO: 8134871 - DNA, 22 bp, Homo sapiens
ttgggcaggatgacaccacttg

SEQ ID NO: 8134872 - DNA, 22 bp, Homo sapiens
ttgggcaggcacatagagttta

SEQ ID NO: 8134873 - DNA, 22 bp, Homo sapiens
ttgggcaggctggcagactgct

SEQ ID NO: 8134874 - DNA, 22 bp, Homo sapiens
ttgggcaggaacagatgcttga

SEQ ID NO: 8134875 - DNA, 23 bp, Homo sapiens
ttgggcaggagagtaatgtgatc

SEQ ID NO: 8134876 - DNA, 22 bp, Homo sapiens
ttgggcagcattgcagttccct

SEQ ID NO: 8134877 - DNA, 22 bp, Homo sapiens
ttgggcagatgtttcctgtgga

SEQ ID NO: 8134878 - DNA, 20 bp, Homo sapiens
ttggtaaggatgaagagcaa

SEQ ID NO: 8134879 - DNA, 22 bp, Homo sapiens
ctccagggatgagacagagtag

SEQ ID NO: 8134880 - DNA, 22 bp, Homo sapiens
ttgttaaaaatagatttccagg

SEQ ID NO: 8134881 - DNA, 22 bp, Homo sapiens
ttgtattttgttatgctactgc

SEQ ID NO: 8134882 - DNA, 22 bp, Homo sapiens
ttgttaaatggatgcagaataa

SEQ ID NO: 8134883 - DNA, 22 bp, Homo sapiens
ttcctttctctggactgcagcc

SEQ ID NO: 8134884 - DNA, 22 bp, Homo sapiens
ttccttttagaatcatgaagac

SEQ ID NO: 8134885 - DNA, 22 bp, Homo sapiens
ttccttttcttaaacatatgtg

SEQ ID NO: 8134886 - DNA, 22 bp, Homo sapiens
ctattcaattttgctattgtag

SEQ ID NO: 8134887 - DNA, 22 bp, Homo sapiens
ctatttatgtgctattttgtat

SEQ ID NO: 8134888 - DNA, 22 bp, Homo sapiens
ctatttctgcctaatgacctgt

SEQ ID NO: 8134889 - DNA, 22 bp, Homo sapiens
ctatttcaaggcccagatatga

SEQ ID NO: 8134890 - DNA, 22 bp, Homo sapiens
ctatttcagcagaagccggaga

SEQ ID NO: 8134891 - DNA, 22 bp, Homo sapiens
ctatttcattgtgctgagtctg

SEQ ID NO: 8134892 - DNA, 22 bp, Homo sapiens
ctatttctaaacctataagtga

SEQ ID NO: 8134893 - DNA, 22 bp, Homo sapiens
ttcttgttttgcccaagttgta

SEQ ID NO: 8134894 - DNA, 22 bp, Homo sapiens
ctcagcagaggcagtattcagt

SEQ ID NO: 8134895 - DNA, 22 bp, Homo sapiens
ctcagcaggtaccacatgatct

SEQ ID NO: 8134896 - DNA, 17 bp, Homo sapiens
ctcagcagggctcactt

SEQ ID NO: 8134897 - DNA, 22 bp, Homo sapiens
ttgagaaaacattgagggccat

SEQ ID NO: 8134898 - DNA, 22 bp, Homo sapiens
ttcacagttcctgggaaaacag

SEQ ID NO: 8134899 - DNA, 22 bp, Homo sapiens
ttcacagttgggcaggttgtgt

SEQ ID NO: 8134900 - DNA, 22 bp, Homo sapiens
ttcacagtttaatggcaaggat

SEQ ID NO: 8134901 - DNA, 22 bp, Homo sapiens
ttcacagtttgctgggacagga

SEQ ID NO: 8134902 - DNA, 22 bp, Homo sapiens
ttcacagtgtgatctatgggca

SEQ ID NO: 8134903 - DNA, 22 bp, Homo sapiens
ttcacagtgtttctcacggtta

SEQ ID NO: 8134904 - DNA, 22 bp, Homo sapiens
ttcacagtgttgtgccttttgt

SEQ ID NO: 8134905 - DNA, 22 bp, Homo sapiens
ttcacagtggcttaggctatgg

SEQ ID NO: 8134906 - DNA, 22 bp, Homo sapiens
ttcacagtggtagtgcatttag

SEQ ID NO: 8134907 - DNA, 22 bp, Homo sapiens
ttcacagtggtaagggttgtga

SEQ ID NO: 8134908 - DNA, 22 bp, Homo sapiens
cctgggtggttccggcaaggag

SEQ ID NO: 8134909 - DNA, 22 bp, Homo sapiens
cggacaggctcctggagctcct

SEQ ID NO: 8134910 - DNA, 22 bp, Homo sapiens
cggctcaggccacaggacggca

SEQ ID NO: 8134911 - DNA, 22 bp, Homo sapiens
cgctgggggaacttcagccaat

SEQ ID NO: 8134912 - DNA, 22 bp, Homo sapiens
cgctggggctttttgcttgaga

SEQ ID NO: 8134913 - DNA, 22 bp, Homo sapiens
cgctgggggaacagcgagggtg

SEQ ID NO: 8134914 - DNA, 22 bp, Homo sapiens
cggctctgtcctcagcactgct

SEQ ID NO: 8134915 - DNA, 21 bp, Homo sapiens
cggctcagtgcctgctccttc

SEQ ID NO: 8134916 - DNA, 22 bp, Homo sapiens
cggctggggctgtccccatgac

SEQ ID NO: 8134917 - DNA, 22 bp, Homo sapiens
ttcccacacaattaagtcattt

SEQ ID NO: 8134918 - DNA, 22 bp, Homo sapiens
ttcccacaacagatctgtatta

SEQ ID NO: 8134919 - DNA, 22 bp, Homo sapiens
ttccgagggctcggcggccgcc

SEQ ID NO: 8134920 - DNA, 22 bp, Homo sapiens
ttccggggatagtgtttcccat

SEQ ID NO: 8134921 - DNA, 22 bp, Homo sapiens
ttccgctgtttagttgaagttt

SEQ ID NO: 8134922 - DNA, 22 bp, Homo sapiens
ttcccacagtgttgaatcctct

SEQ ID NO: 8134923 - DNA, 22 bp, Homo sapiens
ttcccacagtgactccagagaa

SEQ ID NO: 8134924 - DNA, 22 bp, Homo sapiens
ttcccacattctttacattcat

SEQ ID NO: 8134925 - DNA, 22 bp, Homo sapiens
ttcccacaggatgagagctgag

SEQ ID NO: 8134926 - DNA, 22 bp, Homo sapiens
ttcccacagtcactgggagaag

SEQ ID NO: 8134927 - DNA, 22 bp, Homo sapiens
ctaatttaatgaatgagtctta

SEQ ID NO: 8134928 - DNA, 22 bp, Homo sapiens
ctaattttcccaaggccttcta

SEQ ID NO: 8134929 - DNA, 22 bp, Homo sapiens
ctaatttttgttctgcattgaa

SEQ ID NO: 8134930 - DNA, 22 bp, Homo sapiens
ttttagttgctcaggtattctc

SEQ ID NO: 8134931 - DNA, 22 bp, Homo sapiens
ctctgggccaccgctggtgtat

SEQ ID NO: 8134932 - DNA, 22 bp, Homo sapiens
ttttattcatagggatggagag

SEQ ID NO: 8134933 - DNA, 17 bp, Homo sapiens
ctcttttgtcttcttcc

SEQ ID NO: 8134934 - DNA, 22 bp, Homo sapiens
ctctttttcagccttaccaaag

SEQ ID NO: 8134935 - DNA, 19 bp, Homo sapiens
ctgaaaaacattctcagga

SEQ ID NO: 8134936 - DNA, 20 bp, Homo sapiens
ctcttttgactctttgcaag

SEQ ID NO: 8134937 - DNA, 22 bp, Homo sapiens
ctctggttcgtggtagatttta

SEQ ID NO: 8134938 - DNA, 22 bp, Homo sapiens
ctctggtcttcaaggccacctc

SEQ ID NO: 8134939 - DNA, 22 bp, Homo sapiens
ctcttttaattgtcataacaac

SEQ ID NO: 8134940 - DNA, 22 bp, Homo sapiens
ctgaaattctgcctctgcacaa

SEQ ID NO: 8134941 - DNA, 22 bp, Homo sapiens
ctgaacaaagaaatagtcatgg

SEQ ID NO: 8134942 - DNA, 22 bp, Homo sapiens
ctgaacaaagttcttttgagct

SEQ ID NO: 8134943 - DNA, 22 bp, Homo sapiens
ctgaacaacttgtcattccaag

SEQ ID NO: 8134944 - DNA, 22 bp, Homo sapiens
ctgaactatgtaaaagtaagct

SEQ ID NO: 8134945 - DNA, 22 bp, Homo sapiens
ctgaactatttggaatgaagat

SEQ ID NO: 8134946 - DNA, 22 bp, Homo sapiens
ctgaagagcactgtggccagtt

SEQ ID NO: 8134947 - DNA, 22 bp, Homo sapiens
ctgcctccaggctcaccttgac

SEQ ID NO: 8134948 - DNA, 22 bp, Homo sapiens
ctgcctcatgctgcctgcagcc

SEQ ID NO: 8134949 - DNA, 22 bp, Homo sapiens
ctgccatcctcaccagagcagc

SEQ ID NO: 8134950 - DNA, 22 bp, Homo sapiens
ctgcagagctaggctgagtgaa

SEQ ID NO: 8134951 - DNA, 22 bp, Homo sapiens
ctgcagaggcctcgcctcctct

SEQ ID NO: 8134952 - DNA, 22 bp, Homo sapiens
ctgagagaaacatgactcagga

SEQ ID NO: 8134953 - DNA, 22 bp, Homo sapiens
ctgagagatcaagccacaggat

SEQ ID NO: 8134954 - DNA, 22 bp, Homo sapiens
ctgaggagctgaaggccctcca

SEQ ID NO: 8134955 - DNA, 22 bp, Homo sapiens
ctgaggagaaatgggatggttc

SEQ ID NO: 8134956 - DNA, 22 bp, Homo sapiens
ctgaggagtgggtgggcagtga

SEQ ID NO: 8134957 - DNA, 22 bp, Homo sapiens
ctgattttcaaaatgtgttaaa

SEQ ID NO: 8134958 - DNA, 22 bp, Homo sapiens
ctgagtaagatacagaagctcc

SEQ ID NO: 8134959 - DNA, 22 bp, Homo sapiens
ctgatcctcctttaagtagctg

SEQ ID NO: 8134960 - DNA, 21 bp, Homo sapiens
ctggcatgaggagctttgttt

SEQ ID NO: 8134961 - DNA, 22 bp, Homo sapiens
ctggcatggtgtatttgttcaa

SEQ ID NO: 8134962 - DNA, 22 bp, Homo sapiens
ctggaggctggcttcccctggc

SEQ ID NO: 8134963 - DNA, 22 bp, Homo sapiens
ctggaggctgagttgggtctcc

SEQ ID NO: 8134964 - DNA, 21 bp, Homo sapiens
ctggaggcaggtggtgccagg

SEQ ID NO: 8134965 - DNA, 22 bp, Homo sapiens
ctggaggaccacagaagctggt

SEQ ID NO: 8134966 - DNA, 22 bp, Homo sapiens
ctggaggcaaagcagaggcatg

SEQ ID NO: 8134967 - DNA, 23 bp, Homo sapiens
ctggactcaggggatgtgaagga

SEQ ID NO: 8134968 - DNA, 22 bp, Homo sapiens
ctggactcagggtgctccagcg

SEQ ID NO: 8134969 - DNA, 22 bp, Homo sapiens
ctggactcatccatagaggtga

SEQ ID NO: 8134970 - DNA, 22 bp, Homo sapiens
ctggactctgcagagaaaagta

SEQ ID NO: 8134971 - DNA, 22 bp, Homo sapiens
ctggactcagggtgctccagcg

SEQ ID NO: 8134972 - DNA, 22 bp, Homo sapiens
ctggactcactatggcttcaga

SEQ ID NO: 8134973 - DNA, 22 bp, Homo sapiens
ctggaggtgcttcgctggccac

SEQ ID NO: 8134974 - DNA, 22 bp, Homo sapiens
ctggaggtgcctagatgagctc

SEQ ID NO: 8134975 - DNA, 22 bp, Homo sapiens
ctggaggttgggtccaggccag

SEQ ID NO: 8134976 - DNA, 21 bp, Homo sapiens
ctggagggtagagttgggctg

SEQ ID NO: 8134977 - DNA, 22 bp, Homo sapiens
ctgctttttctaggaggacaat

SEQ ID NO: 8134978 - DNA, 22 bp, Homo sapiens
ctggaaagctgcaggacccaga

SEQ ID NO: 8134979 - DNA, 22 bp, Homo sapiens
ctggaaagatttctttggagtc

SEQ ID NO: 8134980 - DNA, 16 bp, Homo sapiens
ctggaaaggctagctc

SEQ ID NO: 8134981 - DNA, 22 bp, Homo sapiens
ctggaaagggtcctcattctgt

SEQ ID NO: 8134982 - DNA, 22 bp, Homo sapiens
ctggaaagacctgcttgctttt

SEQ ID NO: 8134983 - DNA, 22 bp, Homo sapiens
ctggaaagacagagggcatggg

SEQ ID NO: 8134984 - DNA, 22 bp, Homo sapiens
ctggaaagatttacacggggaa

SEQ ID NO: 8134985 - DNA, 22 bp, Homo sapiens
ctggaaagagatggcagggttt

SEQ ID NO: 8134986 - DNA, 22 bp, Homo sapiens
ctggaaagtagatgtactaagg

SEQ ID NO: 8134987 - DNA, 22 bp, Homo sapiens
ctggaaagtagacaatctaaaa

SEQ ID NO: 8134988 - DNA, 22 bp, Homo sapiens
ctggaaagtacagtgtgtcaca

SEQ ID NO: 8134989 - DNA, 22 bp, Homo sapiens
ctgcctggaaggagcaagggga

SEQ ID NO: 8134990 - DNA, 22 bp, Homo sapiens
ctgcctgctcaccagggctctg

SEQ ID NO: 8134991 - DNA, 22 bp, Homo sapiens
ctgcctggaccggcagccctcc

SEQ ID NO: 8134992 - DNA, 22 bp, Homo sapiens
ctgcttctaagaacctgcagct

SEQ ID NO: 8134993 - DNA, 22 bp, Homo sapiens
ctgcctgggccatgcccagtcc

SEQ ID NO: 8134994 - DNA, 22 bp, Homo sapiens
cctatattcagggaactgaccc

SEQ ID NO: 8134995 - DNA, 22 bp, Homo sapiens
cctatattacaggcttgctcta

SEQ ID NO: 8134996 - DNA, 22 bp, Homo sapiens
tggccacaaagagaacgaggtc

SEQ ID NO: 8134997 - DNA, 22 bp, Homo sapiens
ccctggcccctcactccgaggc

SEQ ID NO: 8134998 - DNA, 20 bp, Homo sapiens
ccctggcctgtttcatgccc

SEQ ID NO: 8134999 - DNA, 22 bp, Homo sapiens
ccctggcctacaggcccagaga

SEQ ID NO: 8135000 - DNA, 22 bp, Homo sapiens
ccctggcctacaggcccagaga

SEQ ID NO: 8135001 - DNA, 22 bp, Homo sapiens
ccctggagctagtctgagcaga

SEQ ID NO: 8135002 - DNA, 19 bp, Homo sapiens
ccctcaggtctgagcagtc

SEQ ID NO: 8135003 - DNA, 22 bp, Homo sapiens
cctctcccgggtgccgctgggc

SEQ ID NO: 8135004 - DNA, 22 bp, Homo sapiens
tggctgcctgaatgcaagacag

SEQ ID NO: 8135005 - DNA, 22 bp, Homo sapiens
cctctgagaggccatctctcct

SEQ ID NO: 8135006 - DNA, 22 bp, Homo sapiens
cctctgggggcttccttaccct

SEQ ID NO: 8135007 - DNA, 22 bp, Homo sapiens
cctctgggctgcctgcacgggt

SEQ ID NO: 8135008 - DNA, 22 bp, Homo sapiens
tggccctgctggacacgcctgc

SEQ ID NO: 8135009 - DNA, 22 bp, Homo sapiens
tggccctgctatgatcctgcaa

SEQ ID NO: 8135010 - DNA, 22 bp, Homo sapiens
tggcccagtgcttatgctctga

SEQ ID NO: 8135011 - DNA, 22 bp, Homo sapiens
tggcccagcagttctgccccag

SEQ ID NO: 8135012 - DNA, 22 bp, Homo sapiens
tggccctgctggccaaaggcta

SEQ ID NO: 8135013 - DNA, 22 bp, Homo sapiens
tggccctgctgggtcagagctg

SEQ ID NO: 8135014 - DNA, 22 bp, Homo sapiens
tggccctgctgtatcatctgct

SEQ ID NO: 8135015 - DNA, 21 bp, Homo sapiens
tggctcagttgctgggcacag

SEQ ID NO: 8135016 - DNA, 22 bp, Homo sapiens
tggctcagtttcagtcctggtt

SEQ ID NO: 8135017 - DNA, 22 bp, Homo sapiens
tggctcagtttctgcccagctg

SEQ ID NO: 8135018 - DNA, 22 bp, Homo sapiens
cctcggggcaccgcggcctgct

SEQ ID NO: 8135019 - DNA, 17 bp, Homo sapiens
cccagctgcgtctgagg

SEQ ID NO: 8135020 - DNA, 22 bp, Homo sapiens
tgcagggaggccccgcagccct

SEQ ID NO: 8135021 - DNA, 22 bp, Homo sapiens
cccagcctgtgacagccgtcct

SEQ ID NO: 8135022 - DNA, 20 bp, Homo sapiens
tctgtggcaggtggcgcttg

SEQ ID NO: 8135023 - DNA, 22 bp, Homo sapiens
tgccacactcccctgctgcagt

SEQ ID NO: 8135024 - DNA, 22 bp, Homo sapiens
tgccacacattgtcaggttagt

SEQ ID NO: 8135025 - DNA, 22 bp, Homo sapiens
tgccacaccaacatctttcagc

SEQ ID NO: 8135026 - DNA, 22 bp, Homo sapiens
tgccacactcacttctgtggac

SEQ ID NO: 8135027 - DNA, 22 bp, Homo sapiens
tgccacacaattactgctgcta

SEQ ID NO: 8135028 - DNA, 22 bp, Homo sapiens
tgccacacagctgtatgaggga

SEQ ID NO: 8135029 - DNA, 22 bp, Homo sapiens
tgccacacagtctggtagaata

SEQ ID NO: 8135030 - DNA, 22 bp, Homo sapiens
tgctccaggtgtgcctctcatg

SEQ ID NO: 8135031 - DNA, 22 bp, Homo sapiens
tgctccagggctgccagaccct

SEQ ID NO: 8135032 - DNA, 23 bp, Homo sapiens
tgctccaggtacagaactccagg

SEQ ID NO: 8135033 - DNA, 22 bp, Homo sapiens
cccagggaggcccaggctctgc

SEQ ID NO: 8135034 - DNA, 22 bp, Homo sapiens
tgctgaccttgttctgtgagga

SEQ ID NO: 8135035 - DNA, 20 bp, Homo sapiens
tgctgcagacagggccattg

SEQ ID NO: 8135036 - DNA, 22 bp, Homo sapiens
ccccagccagcaggacctctga

SEQ ID NO: 8135037 - DNA, 22 bp, Homo sapiens
tgctgcagacgaagcccatgcc

SEQ ID NO: 8135038 - DNA, 22 bp, Homo sapiens
cccccactaagttgagggccct

SEQ ID NO: 8135039 - DNA, 22 bp, Homo sapiens
cccctctgcaaatagccaggct

SEQ ID NO: 8135040 - DNA, 21 bp, Homo sapiens
tgtgtgggcatatctgctgca

SEQ ID NO: 8135041 - DNA, 19 bp, Homo sapiens
tgtggggagtcagggggct

SEQ ID NO: 8135042 - DNA, 22 bp, Homo sapiens
cctgggccctcaccgccggtgg

SEQ ID NO: 8135043 - DNA, 21 bp, Homo sapiens
cctgggccaaattccctggac

SEQ ID NO: 8135044 - DNA, 22 bp, Homo sapiens
cctgggaggcggaggttgcagt

SEQ ID NO: 8135045 - DNA, 19 bp, Homo sapiens
cctgggaggcggaggttgc

SEQ ID NO: 8135046 - DNA, 22 bp, Homo sapiens
cctgggaggcggaggttgcagg

SEQ ID NO: 8135047 - DNA, 22 bp, Homo sapiens
cctgggagctgtggaaaggctg

SEQ ID NO: 8135048 - DNA, 22 bp, Homo sapiens
cctgggaggcagaggttgcagt

SEQ ID NO: 8135049 - DNA, 20 bp, Homo sapiens
tgtggcaggatgagggcgga

SEQ ID NO: 8135050 - DNA, 22 bp, Homo sapiens
tgtggcaggcattctgaggctg

SEQ ID NO: 8135051 - DNA, 22 bp, Homo sapiens
tgtggcagggatactgaggcag

SEQ ID NO: 8135052 - DNA, 22 bp, Homo sapiens
tgtggcaggaagagcttctgag

SEQ ID NO: 8135053 - DNA, 22 bp, Homo sapiens
tgtggcagctggaggtggagaa

SEQ ID NO: 8135054 - DNA, 20 bp, Homo sapiens
tgtggaaaaacagaagcaga

SEQ ID NO: 8135055 - DNA, 22 bp, Homo sapiens
cctggggctcaagatggcgccg

SEQ ID NO: 8135056 - DNA, 22 bp, Homo sapiens
cctgggctttgctggcaaggcc

SEQ ID NO: 8135057 - DNA, 22 bp, Homo sapiens
cctgggcctcacccagctcttg

SEQ ID NO: 8135058 - DNA, 22 bp, Homo sapiens
tgtgtgtctgcacatgtataat

SEQ ID NO: 8135059 - DNA, 22 bp, Homo sapiens
tgtgtgtcagtcttgtttaggg

SEQ ID NO: 8135060 - DNA, 22 bp, Homo sapiens
tgtgtgggtggtaaggaaggcc

SEQ ID NO: 8135061 - DNA, 22 bp, Homo sapiens
cctgggagagtctgtggtctcc

SEQ ID NO: 8135062 - DNA, 22 bp, Homo sapiens
cctgggagagccatctgtggcc

SEQ ID NO: 8135063 - DNA, 21 bp, Homo sapiens
cctgggagaattgggtgtggc

SEQ ID NO: 8135064 - DNA, 22 bp, Homo sapiens
tgtctgtcagcagtgggtcagg

SEQ ID NO: 8135065 - DNA, 22 bp, Homo sapiens
tgtctgtccatctgtctgggac

SEQ ID NO: 8135066 - DNA, 22 bp, Homo sapiens
tgtctgtctgcaagccagaaag

SEQ ID NO: 8135067 - DNA, 22 bp, Homo sapiens
tggtgctgccaggctcctgcca

SEQ ID NO: 8135068 - DNA, 22 bp, Homo sapiens
tggtgctcccaagattgttcta

SEQ ID NO: 8135069 - DNA, 22 bp, Homo sapiens
tggtgctcttatgttttcatca

SEQ ID NO: 8135070 - DNA, 19 bp, Homo sapiens
tggtgcgcccggcccttct

SEQ ID NO: 8135071 - DNA, 22 bp, Homo sapiens
tggtccgggatggacgcgggct

SEQ ID NO: 8135072 - DNA, 18 bp, Homo sapiens
cctgccagtctggagcag

SEQ ID NO: 8135073 - DNA, 22 bp, Homo sapiens
tgtcatgtgagggaacttgttc

SEQ ID NO: 8135074 - DNA, 22 bp, Homo sapiens
tgtcatggggttgttttgtaca

SEQ ID NO: 8135075 - DNA, 22 bp, Homo sapiens
tgtcatgccatttaaaatgttt

SEQ ID NO: 8135076 - DNA, 22 bp, Homo sapiens
tgtcatgccaggaaatagtccc

SEQ ID NO: 8135077 - DNA, 22 bp, Homo sapiens
tgtcatgcaggtttgttataga

SEQ ID NO: 8135078 - DNA, 21 bp, Homo sapiens
tgtctcaatcagaagtcatta

SEQ ID NO: 8135079 - DNA, 22 bp, Homo sapiens
tgtctatgtatacatgtgtata

SEQ ID NO: 8135080 - DNA, 22 bp, Homo sapiens
tgtctctggcccatgagcagag

SEQ ID NO: 8135081 - DNA, 22 bp, Homo sapiens
gtttcaaaagtcaggctattct

SEQ ID NO: 8135082 - DNA, 22 bp, Homo sapiens
caggaagattgtggaggtggtt

SEQ ID NO: 8135083 - DNA, 22 bp, Homo sapiens
caggaaaggtgtgtcatgatgg

SEQ ID NO: 8135084 - DNA, 22 bp, Homo sapiens
caggaaaggtagtcacaatgta

SEQ ID NO: 8135085 - DNA, 22 bp, Homo sapiens
caggaacaatcttactactatt

SEQ ID NO: 8135086 - DNA, 22 bp, Homo sapiens
caggaaagtctgtaaaggaacc

SEQ ID NO: 8135087 - DNA, 19 bp, Homo sapiens
gttccgggagtaggccggg

SEQ ID NO: 8135088 - DNA, 22 bp, Homo sapiens
gttcacagtctacatagtaaag

SEQ ID NO: 8135089 - DNA, 22 bp, Homo sapiens
gtgtgtgtatatatacacacac

SEQ ID NO: 8135090 - DNA, 22 bp, Homo sapiens
gtgtttgtttgggtagctagac

SEQ ID NO: 8135091 - DNA, 22 bp, Homo sapiens
gtgtgtgctccccaggagagct

SEQ ID NO: 8135092 - DNA, 22 bp, Homo sapiens
gtgtgtgtactctgtatataaa

SEQ ID NO: 8135093 - DNA, 22 bp, Homo sapiens
gtgtgtgcaagaggtttattga

SEQ ID NO: 8135094 - DNA, 22 bp, Homo sapiens
gtgttttggccattagtgtgat

SEQ ID NO: 8135095 - DNA, 22 bp, Homo sapiens
cagctttgagcagccagtggca

SEQ ID NO: 8135096 - DNA, 22 bp, Homo sapiens
cagctttgagagttgcatttta

SEQ ID NO: 8135097 - DNA, 22 bp, Homo sapiens
cagctttgacctaaagtaggaa

SEQ ID NO: 8135098 - DNA, 22 bp, Homo sapiens
gttattctacagtcattgaagt

SEQ ID NO: 8135099 - DNA, 20 bp, Homo sapiens
cagcttggatgagaggctga

SEQ ID NO: 8135100 - DNA, 22 bp, Homo sapiens
gtggccaggcgtccgcgcggct

SEQ ID NO: 8135101 - DNA, 22 bp, Homo sapiens
gtggcagtctcatctgtggctc

SEQ ID NO: 8135102 - DNA, 22 bp, Homo sapiens
cagctctggctattgaggacca

SEQ ID NO: 8135103 - DNA, 22 bp, Homo sapiens
cagctctggctttggggagctt

SEQ ID NO: 8135104 - DNA, 22 bp, Homo sapiens
cagctctgtgcaggcctgggga

SEQ ID NO: 8135105 - DNA, 22 bp, Homo sapiens
cagctgagcatcactagtctgg

SEQ ID NO: 8135106 - DNA, 22 bp, Homo sapiens
gtggccttgggcactgaccttg

SEQ ID NO: 8135107 - DNA, 22 bp, Homo sapiens
gtggccttggcttctaccctga

SEQ ID NO: 8135108 - DNA, 22 bp, Homo sapiens
gtgggcagtgcctgacggatga

SEQ ID NO: 8135109 - DNA, 22 bp, Homo sapiens
gtgggcagtggggtcttctgcc

SEQ ID NO: 8135110 - DNA, 22 bp, Homo sapiens
gtgggcagtcatgaaatctaga

SEQ ID NO: 8135111 - DNA, 22 bp, Homo sapiens
gtgggcaggtaggcaccagcta

SEQ ID NO: 8135112 - DNA, 22 bp, Homo sapiens
gtgggcaggccctaggcgattt

SEQ ID NO: 8135113 - DNA, 22 bp, Homo sapiens
gtgggcagggttgctttctccg

SEQ ID NO: 8135114 - DNA, 22 bp, Homo sapiens
gtgggcaggagtgagcaacagg

SEQ ID NO: 8135115 - DNA, 22 bp, Homo sapiens
gtgggcaggccccaaagcaggg

SEQ ID NO: 8135116 - DNA, 22 bp, Homo sapiens
gtgggcaggaggccctgccctg

SEQ ID NO: 8135117 - DNA, 22 bp, Homo sapiens
gtggggcagtggcctgggagca

SEQ ID NO: 8135118 - DNA, 22 bp, Homo sapiens
gtggggcctgtggcttccgtgg

SEQ ID NO: 8135119 - DNA, 22 bp, Homo sapiens
gtggggctcccatctcctggct

SEQ ID NO: 8135120 - DNA, 22 bp, Homo sapiens
gtgggtggaggcgtcgagggca

SEQ ID NO: 8135121 - DNA, 22 bp, Homo sapiens
cagctgctgttcagttttgttt

SEQ ID NO: 8135122 - DNA, 22 bp, Homo sapiens
cagctgcttctcctccagagct

SEQ ID NO: 8135123 - DNA, 22 bp, Homo sapiens
cagctgctgagaagcctccctt

SEQ ID NO: 8135124 - DNA, 22 bp, Homo sapiens
gtggtaagactaacatttctca

SEQ ID NO: 8135125 - DNA, 22 bp, Homo sapiens
cagctggggcagccacgtgcgg

SEQ ID NO: 8135126 - DNA, 22 bp, Homo sapiens
cagctggggagagacatggcag

SEQ ID NO: 8135127 - DNA, 22 bp, Homo sapiens
gtgtgcgcgcgcgtcccgggtg

SEQ ID NO: 8135128 - DNA, 17 bp, Homo sapiens
gtgtgctactatcattt

SEQ ID NO: 8135129 - DNA, 22 bp, Homo sapiens
tacagtttgttacattgttagt

SEQ ID NO: 8135130 - DNA, 21 bp, Homo sapiens
tacatcagttttcttggctca

SEQ ID NO: 8135131 - DNA, 22 bp, Homo sapiens
tacagtttgtgtggagctggag

SEQ ID NO: 8135132 - DNA, 22 bp, Homo sapiens
caggccctgggcaggatcagcc

SEQ ID NO: 8135133 - DNA, 22 bp, Homo sapiens
tacaaattaatgggcatgttta

SEQ ID NO: 8135134 - DNA, 20 bp, Homo sapiens
tacaaacctccacactggtg

SEQ ID NO: 8135135 - DNA, 22 bp, Homo sapiens
tacagggctgagtgagacatgg

SEQ ID NO: 8135136 - DNA, 22 bp, Homo sapiens
taattgtatggagaaggctgca

SEQ ID NO: 8135137 - DNA, 22 bp, Homo sapiens
caggcagctgaggactttgcta

SEQ ID NO: 8135138 - DNA, 22 bp, Homo sapiens
taacaactgaggaagaggcaga

SEQ ID NO: 8135139 - DNA, 22 bp, Homo sapiens
taacattgtcagttcaactgct

SEQ ID NO: 8135140 - DNA, 22 bp, Homo sapiens
taacattccatggatctgcaga

SEQ ID NO: 8135141 - DNA, 21 bp, Homo sapiens
caggatgatgataattcatgg

SEQ ID NO: 8135142 - DNA, 22 bp, Homo sapiens
caggcacagagagaataccttt

SEQ ID NO: 8135143 - DNA, 22 bp, Homo sapiens
caggcacagacgcaaacttctt

SEQ ID NO: 8135144 - DNA, 22 bp, Homo sapiens
caggcacagagttattcattta

SEQ ID NO: 8135145 - DNA, 22 bp, Homo sapiens
caggcacagttccaagcatttt

SEQ ID NO: 8135146 - DNA, 22 bp, Homo sapiens
taagcaaaagtcgagtgtgagc

SEQ ID NO: 8135147 - DNA, 22 bp, Homo sapiens
taaagcagtggttctcaaactt

SEQ ID NO: 8135148 - DNA, 22 bp, Homo sapiens
taaagcagtgtggttgtgtccc

SEQ ID NO: 8135149 - DNA, 22 bp, Homo sapiens
caggagaggaggctacttctta

SEQ ID NO: 8135150 - DNA, 22 bp, Homo sapiens
caggagaggctgtacgtttctc

SEQ ID NO: 8135151 - DNA, 15 bp, Homo sapiens
caggagaggaaggtt

SEQ ID NO: 8135152 - DNA, 19 bp, Homo sapiens
caggagagcatgcactttg

SEQ ID NO: 8135153 - DNA, 22 bp, Homo sapiens
taaagcatttttgaaattatga

SEQ ID NO: 8135154 - DNA, 20 bp, Homo sapiens
caggagggacatttcagcat

SEQ ID NO: 8135155 - DNA, 22 bp, Homo sapiens
caggagggggtggagtttcgcc

SEQ ID NO: 8135156 - DNA, 22 bp, Homo sapiens
caggagggcccgagactcttcc

SEQ ID NO: 8135157 - DNA, 22 bp, Homo sapiens
caggagtgcaggtggtgaggca

SEQ ID NO: 8135158 - DNA, 22 bp, Homo sapiens
caggaggcagcgctctcaggac

SEQ ID NO: 8135159 - DNA, 22 bp, Homo sapiens
taaatgtataggcactaaacct

SEQ ID NO: 8135160 - DNA, 20 bp, Homo sapiens
taaatggtgcatttcttata

SEQ ID NO: 8135161 - DNA, 22 bp, Homo sapiens
taaatggttccgtgattcatga

SEQ ID NO: 8135162 - DNA, 18 bp, Homo sapiens
gtttggacttttctccct

SEQ ID NO: 8135163 - DNA, 22 bp, Homo sapiens
gtttggaatgagtcctgccatt

SEQ ID NO: 8135164 - DNA, 22 bp, Homo sapiens
caggacagtataggctttagga

SEQ ID NO: 8135165 - DNA, 22 bp, Homo sapiens
caggacaggtgttctagatcag

SEQ ID NO: 8135166 - DNA, 22 bp, Homo sapiens
caggacagctgggccaccacca

SEQ ID NO: 8135167 - DNA, 22 bp, Homo sapiens
caggacaggagtggggtcaaag

SEQ ID NO: 8135168 - DNA, 22 bp, Homo sapiens
caggacagctcaacacctcctc

SEQ ID NO: 8135169 - DNA, 22 bp, Homo sapiens
gttttctgattagcaaatctga

SEQ ID NO: 8135170 - DNA, 22 bp, Homo sapiens
gttttcttcctgcaattggcat

SEQ ID NO: 8135171 - DNA, 22 bp, Homo sapiens
caggagaaggtttggagtgcag

SEQ ID NO: 8135172 - DNA, 22 bp, Homo sapiens
caggagaagtctctagggggtg

SEQ ID NO: 8135173 - DNA, 22 bp, Homo sapiens
caggagacaagttagcagctga

SEQ ID NO: 8135174 - DNA, 22 bp, Homo sapiens
caggacagtttgctttgccctg

SEQ ID NO: 8135175 - DNA, 22 bp, Homo sapiens
caggacagttggcatctgctgc

SEQ ID NO: 8135176 - DNA, 22 bp, Homo sapiens
caggacagtgcaggtccatcct

SEQ ID NO: 8135177 - DNA, 22 bp, Homo sapiens
taaactgaagctcaactcaaat

SEQ ID NO: 8135178 - DNA, 22 bp, Homo sapiens
tctgtcaggagattggcagctg

SEQ ID NO: 8135179 - DNA, 22 bp, Homo sapiens
tctgcgtgaaactagatggcag

SEQ ID NO: 8135180 - DNA, 22 bp, Homo sapiens
tctgcgtgatgagggtgcagca

SEQ ID NO: 8135181 - DNA, 22 bp, Homo sapiens
tctgcgtgggactgaggaggct

SEQ ID NO: 8135182 - DNA, 21 bp, Homo sapiens
tctggagctgcaggctgggca

SEQ ID NO: 8135183 - DNA, 22 bp, Homo sapiens
tctcttggaggttcttcctgtt

SEQ ID NO: 8135184 - DNA, 22 bp, Homo sapiens
tctgaaataggaaagcaaatgg

SEQ ID NO: 8135185 - DNA, 22 bp, Homo sapiens
tctgaaataggagccatgtaga

SEQ ID NO: 8135186 - DNA, 22 bp, Homo sapiens
tctgaaataggcttcttttggt

SEQ ID NO: 8135187 - DNA, 22 bp, Homo sapiens
tctgaaatattggtaatacttt

SEQ ID NO: 8135188 - DNA, 22 bp, Homo sapiens
ccagccagtcccgcatgaccgc

SEQ ID NO: 8135189 - DNA, 22 bp, Homo sapiens
tctgcctcgctaacagcagcca

SEQ ID NO: 8135190 - DNA, 22 bp, Homo sapiens
ccagcctcatcatattcctgct

SEQ ID NO: 8135191 - DNA, 22 bp, Homo sapiens
ccacagagttacaaaacagtca

SEQ ID NO: 8135192 - DNA, 18 bp, Homo sapiens
ccacagcagagttcttac

SEQ ID NO: 8135193 - DNA, 22 bp, Homo sapiens
tcctccccaaagcccagcctgg

SEQ ID NO: 8135194 - DNA, 22 bp, Homo sapiens
ccacaaaactgtgtgtcaaaga

SEQ ID NO: 8135195 - DNA, 22 bp, Homo sapiens
ccacacagggggatgagttatt

SEQ ID NO: 8135196 - DNA, 22 bp, Homo sapiens
tcctgcagtgtgtctcctgcac

SEQ ID NO: 8135197 - DNA, 22 bp, Homo sapiens
tcctgcagttacatcccagcca

SEQ ID NO: 8135198 - DNA, 22 bp, Homo sapiens
tccctgcctctcagacttcctt

SEQ ID NO: 8135199 - DNA, 22 bp, Homo sapiens
catttggaaagagactagagaa

SEQ ID NO: 8135200 - DNA, 20 bp, Homo sapiens
tccctgccttttactgctgg

SEQ ID NO: 8135201 - DNA, 22 bp, Homo sapiens
catttagtacaacttttacagt

SEQ ID NO: 8135202 - DNA, 22 bp, Homo sapiens
catttagtctgatatggatgaa

SEQ ID NO: 8135203 - DNA, 22 bp, Homo sapiens
catttagaaactgtttttaaca

SEQ ID NO: 8135204 - DNA, 21 bp, Homo sapiens
ccagatgcaaatgcagacatt

SEQ ID NO: 8135205 - DNA, 22 bp, Homo sapiens
ccagaggacttgggggctgaat

SEQ ID NO: 8135206 - DNA, 22 bp, Homo sapiens
ccactgccagccgcccggaggc

SEQ ID NO: 8135207 - DNA, 22 bp, Homo sapiens
ccactgcctctccagggccatc

SEQ ID NO: 8135208 - DNA, 22 bp, Homo sapiens
ccactgccgtgggccttgggga

SEQ ID NO: 8135209 - DNA, 22 bp, Homo sapiens
ccactgatcctgactttggagc

SEQ ID NO: 8135210 - DNA, 22 bp, Homo sapiens
ccactgagtgagcagagcaggg

SEQ ID NO: 8135211 - DNA, 22 bp, Homo sapiens
caggggcctggctgtctaggaa

SEQ ID NO: 8135212 - DNA, 22 bp, Homo sapiens
cagggtgcttccgtggagctgt

SEQ ID NO: 8135213 - DNA, 22 bp, Homo sapiens
caggggcagtctgtgtgcgtgg

SEQ ID NO: 8135214 - DNA, 22 bp, Homo sapiens
caggggcaggtgtgagatcatc

SEQ ID NO: 8135215 - DNA, 22 bp, Homo sapiens
cagggtggaatggaatgctggc

SEQ ID NO: 8135216 - DNA, 22 bp, Homo sapiens
cagggtggaatggaatgctggc

SEQ ID NO: 8135217 - DNA, 22 bp, Homo sapiens
cagggtggaagctgtagagtgg

SEQ ID NO: 8135218 - DNA, 22 bp, Homo sapiens
cagggtggcacatcacagcatt

SEQ ID NO: 8135219 - DNA, 23 bp, Homo sapiens
tatctcagaggaatgtagttact

SEQ ID NO: 8135220 - DNA, 22 bp, Homo sapiens
tatgcacacattagcacagggt

SEQ ID NO: 8135221 - DNA, 22 bp, Homo sapiens
cagtgattaaaacatgacagcc

SEQ ID NO: 8135222 - DNA, 22 bp, Homo sapiens
cagtgatttttacagtaaggaa

SEQ ID NO: 8135223 - DNA, 22 bp, Homo sapiens
tatttagaacagacaatagaaa

SEQ ID NO: 8135224 - DNA, 22 bp, Homo sapiens
tatttagttatctttcataaaa

SEQ ID NO: 8135225 - DNA, 22 bp, Homo sapiens
tcacattgaagaaattttaagt

SEQ ID NO: 8135226 - DNA, 22 bp, Homo sapiens
tcacattgattacattccatgt

SEQ ID NO: 8135227 - DNA, 22 bp, Homo sapiens
tcacattgaatggaagaataga

SEQ ID NO: 8135228 - DNA, 22 bp, Homo sapiens
cagtgctgttgggcccagagag

SEQ ID NO: 8135229 - DNA, 22 bp, Homo sapiens
tcactcagcattcactgggcct

SEQ ID NO: 8135230 - DNA, 21 bp, Homo sapiens
tcagaacaattccatgcctcc

SEQ ID NO: 8135231 - DNA, 22 bp, Homo sapiens
tcagccctgggcttcctcatgg

SEQ ID NO: 8135232 - DNA, 22 bp, Homo sapiens
tcagccctagcctcagtccagg

SEQ ID NO: 8135233 - DNA, 20 bp, Homo sapiens
tcagccctgagtccaggctg

SEQ ID NO: 8135234 - DNA, 22 bp, Homo sapiens
cataatttttttaagtcagaac

SEQ ID NO: 8135235 - DNA, 22 bp, Homo sapiens
tcagctgcagcaggcaccattt

SEQ ID NO: 8135236 - DNA, 22 bp, Homo sapiens
cagtttggtacatagttcaaaa

SEQ ID NO: 8135237 - DNA, 22 bp, Homo sapiens
cagtttggggtcggagtcaggg

SEQ ID NO: 8135238 - DNA, 22 bp, Homo sapiens
tcagcagtgagaattaatgttg

SEQ ID NO: 8135239 - DNA, 22 bp, Homo sapiens
tcagaagggaaacacaagtgac

SEQ ID NO: 8135240 - DNA, 22 bp, Homo sapiens
catatattctggttttcactgg

SEQ ID NO: 8135241 - DNA, 22 bp, Homo sapiens
catcacaggtcctgatgacatt

SEQ ID NO: 8135242 - DNA, 22 bp, Homo sapiens
catcatctctggcccttgaagt

SEQ ID NO: 8135243 - DNA, 22 bp, Homo sapiens
catcacatcagtgtgaacagtt

SEQ ID NO: 8135244 - DNA, 21 bp, Homo sapiens
catcacaggatgattttttca

SEQ ID NO: 8135245 - DNA, 22 bp, Homo sapiens
tcagggccatcttttgcctcaa

SEQ ID NO: 8135246 - DNA, 22 bp, Homo sapiens
catgattatattaatggcttca

SEQ ID NO: 8135247 - DNA, 22 bp, Homo sapiens
catgatcagaaagagaagctag

SEQ ID NO: 8135248 - DNA, 22 bp, Homo sapiens
catgatcaccacttgacagccc

SEQ ID NO: 8135249 - DNA, 22 bp, Homo sapiens
catgatacttgaatttggaagg

SEQ ID NO: 8135250 - DNA, 22 bp, Homo sapiens
catgattatgtgttagagtttg

SEQ ID NO: 8135251 - DNA, 22 bp, Homo sapiens
tcatgtaagagcttttgtgtca

SEQ ID NO: 8135252 - DNA, 22 bp, Homo sapiens
catccattaactcatttgtttc

SEQ ID NO: 8135253 - DNA, 22 bp, Homo sapiens
tcaggtggctggttgctggcta

SEQ ID NO: 8135254 - DNA, 22 bp, Homo sapiens
tcaggtggcttcggggagtggc

SEQ ID NO: 8135255 - DNA, 22 bp, Homo sapiens
tcaggtgggacctgctaggaca

SEQ ID NO: 8135256 - DNA, 22 bp, Homo sapiens
tcaggtgggagtagaatgctag

SEQ ID NO: 8135257 - DNA, 22 bp, Homo sapiens
catgggagctatctccatcact

SEQ ID NO: 8135258 - DNA, 22 bp, Homo sapiens
catgtgcagtgtaagacatgct

SEQ ID NO: 8135259 - DNA, 22 bp, Homo sapiens
catgcacaagggatgatgaaat

SEQ ID NO: 8135260 - DNA, 22 bp, Homo sapiens
catgcacaaaggtaagatgcgt

SEQ ID NO: 8135261 - DNA, 23 bp, Homo sapiens
catgcaaacactattgcatttgg

SEQ ID NO: 8135262 - DNA, 22 bp, Homo sapiens
tcattttcccactgaagctgtc

SEQ ID NO: 8135263 - DNA, 22 bp, Homo sapiens
tcattttcacacataaatagca

SEQ ID NO: 8135264 - DNA, 22 bp, Homo sapiens
tcattttcacacataaatagca

SEQ ID NO: 8135265 - DNA, 22 bp, Homo sapiens
tcattttcaagtttgaacagga

SEQ ID NO: 8135266 - DNA, 22 bp, Homo sapiens
tcattttcaagtttgaacagga

SEQ ID NO: 8135267 - DNA, 22 bp, Homo sapiens
tgtgtgtgactcatactagaac

SEQ ID NO: 8135268 - DNA, 22 bp, Homo sapiens
tgtgtgtgagtcctggctttcc

SEQ ID NO: 8135269 - DNA, 22 bp, Homo sapiens
tgtgtgtgacaacctagttcag

SEQ ID NO: 8135270 - DNA, 22 bp, Homo sapiens
tgtgtgggagcacgggctgttg

SEQ ID NO: 8135271 - DNA, 20 bp, Homo sapiens
tgtgtgtgtacttctaaata

SEQ ID NO: 8135272 - DNA, 22 bp, Homo sapiens
tgtgtgtgttcctcctcagcta

SEQ ID NO: 8135273 - DNA, 22 bp, Homo sapiens
tgtgtgttggctggagagggct

SEQ ID NO: 8135274 - DNA, 22 bp, Homo sapiens
tgtgtgttctcaattattgatg

SEQ ID NO: 8135275 - DNA, 22 bp, Homo sapiens
tgtgtgttcagagatagatata

SEQ ID NO: 8135276 - DNA, 22 bp, Homo sapiens
tgtgtgttattttcagccatta

SEQ ID NO: 8135277 - DNA, 22 bp, Homo sapiens
tgtgtgttagtctcaaagccgt

SEQ ID NO: 8135278 - DNA, 22 bp, Homo sapiens
tgtgtgttaacttatttaatgt

SEQ ID NO: 8135279 - DNA, 22 bp, Homo sapiens
tgtgtgttatcttagttcatct

SEQ ID NO: 8135280 - DNA, 22 bp, Homo sapiens
tgtgtgtgtttctgctcataca

SEQ ID NO: 8135281 - DNA, 22 bp, Homo sapiens
tgtgtgtgtttataaatctaaa

SEQ ID NO: 8135282 - DNA, 22 bp, Homo sapiens
tgtgttaaggtgcatctagtgc

SEQ ID NO: 8135283 - DNA, 19 bp, Homo sapiens
tgtgtgtttatatatgtat

SEQ ID NO: 8135284 - DNA, 22 bp, Homo sapiens
tgttaaaaattcagctctagat

SEQ ID NO: 8135285 - DNA, 23 bp, Homo sapiens
tgtgggcgcattgtaagggtagc

SEQ ID NO: 8135286 - DNA, 22 bp, Homo sapiens
tgtgggccaggaggcctcagtg

SEQ ID NO: 8135287 - DNA, 22 bp, Homo sapiens
tgtgggagaaggaagcaagctg

SEQ ID NO: 8135288 - DNA, 22 bp, Homo sapiens
tgtggctgactcctggtcccca

SEQ ID NO: 8135289 - DNA, 22 bp, Homo sapiens
tgtttttgtctccttgtctgct

SEQ ID NO: 8135290 - DNA, 22 bp, Homo sapiens
tgtttgctctgactatcttgcg

SEQ ID NO: 8135291 - DNA, 22 bp, Homo sapiens
tgtttgctagggttggtattta

SEQ ID NO: 8135292 - DNA, 22 bp, Homo sapiens
tgtttcaaaacagtgataattt

SEQ ID NO: 8135293 - DNA, 22 bp, Homo sapiens
tgtttggaaacactggcagaaa

SEQ ID NO: 8135294 - DNA, 22 bp, Homo sapiens
tgtttgcttacttgtatgctgc

SEQ ID NO: 8135295 - DNA, 22 bp, Homo sapiens
tgtttttgttcaatgctaggtc

SEQ ID NO: 8135296 - DNA, 20 bp, Homo sapiens
ttaaaaagagtcacaggaga

SEQ ID NO: 8135297 - DNA, 22 bp, Homo sapiens
ttaaaatgcagattctgattca

SEQ ID NO: 8135298 - DNA, 22 bp, Homo sapiens
ttaaaatgcagattatgactca

SEQ ID NO: 8135299 - DNA, 22 bp, Homo sapiens
ttaaaagacctgttgaggttag

SEQ ID NO: 8135300 - DNA, 22 bp, Homo sapiens
tgttgagtatatacctacaagt

SEQ ID NO: 8135301 - DNA, 18 bp, Homo sapiens
tgttgaaacttcaggtaa

SEQ ID NO: 8135302 - DNA, 22 bp, Homo sapiens
tgttgtactcaacagatgaatt

SEQ ID NO: 8135303 - DNA, 22 bp, Homo sapiens
tgttgtttctactaataggcca

SEQ ID NO: 8135304 - DNA, 21 bp, Homo sapiens
tgttgttttatggctatgaat

SEQ ID NO: 8135305 - DNA, 22 bp, Homo sapiens
tgtttaaatagaacatactgca

SEQ ID NO: 8135306 - DNA, 22 bp, Homo sapiens
tgttactgggcatctagtgggt

SEQ ID NO: 8135307 - DNA, 18 bp, Homo sapiens
tgttactgagttatgttc

SEQ ID NO: 8135308 - DNA, 22 bp, Homo sapiens
tgttactgagtaatgtatagat

SEQ ID NO: 8135309 - DNA, 22 bp, Homo sapiens
tgtcttttggagcatctttctt

SEQ ID NO: 8135310 - DNA, 22 bp, Homo sapiens
tgtctttttactatgttcaatc

SEQ ID NO: 8135311 - DNA, 22 bp, Homo sapiens
tgtgaaaaaagttctagaagga

SEQ ID NO: 8135312 - DNA, 22 bp, Homo sapiens
tgtgaaaagggctttgtacaaa

SEQ ID NO: 8135313 - DNA, 22 bp, Homo sapiens
tgtctgggatgttggcagccac

SEQ ID NO: 8135314 - DNA, 22 bp, Homo sapiens
tgtcttaacataaaaggaaatc

SEQ ID NO: 8135315 - DNA, 22 bp, Homo sapiens
tgtcttaatttggatgatgttt

SEQ ID NO: 8135316 - DNA, 22 bp, Homo sapiens
tgtctaggggcaggggtttgaa

SEQ ID NO: 8135317 - DNA, 22 bp, Homo sapiens
tgtctaggttgcggttttatgt

SEQ ID NO: 8135318 - DNA, 22 bp, Homo sapiens
tgtctccatagagtagcttgat

SEQ ID NO: 8135319 - DNA, 22 bp, Homo sapiens
tgtctaagggaagatgcaatgt

SEQ ID NO: 8135320 - DNA, 22 bp, Homo sapiens
tgtctaagagtgcaatgcatga

SEQ ID NO: 8135321 - DNA, 22 bp, Homo sapiens
tgtctaaatgcaatggatttcc

SEQ ID NO: 8135322 - DNA, 22 bp, Homo sapiens
tgtctaaatgaaaagagatgcc

SEQ ID NO: 8135323 - DNA, 20 bp, Homo sapiens
tgtctgctgagctgctgccc

SEQ ID NO: 8135324 - DNA, 22 bp, Homo sapiens
tgtgacagccagtaaagtaagc

SEQ ID NO: 8135325 - DNA, 22 bp, Homo sapiens
tgtgacagatctttaaataatg

SEQ ID NO: 8135326 - DNA, 22 bp, Homo sapiens
tgtgaacattcagatcaagctc

SEQ ID NO: 8135327 - DNA, 21 bp, Homo sapiens
tgtgaaatagctatgctacat

SEQ ID NO: 8135328 - DNA, 21 bp, Homo sapiens
tgtgacctgatgtagtacatt

SEQ ID NO: 8135329 - DNA, 22 bp, Homo sapiens
tgtgacctcatcttaactggaa

SEQ ID NO: 8135330 - DNA, 22 bp, Homo sapiens
tgtgcgggtgcgcatgcagagg

SEQ ID NO: 8135331 - DNA, 22 bp, Homo sapiens
tgtgcgtgatggaccgggcctg

SEQ ID NO: 8135332 - DNA, 22 bp, Homo sapiens
tgtgctgctctcagtgacagcc

SEQ ID NO: 8135333 - DNA, 22 bp, Homo sapiens
tgtgcgtggttcccggggccat

SEQ ID NO: 8135334 - DNA, 22 bp, Homo sapiens
tgtgctccaacaatttatattc

SEQ ID NO: 8135335 - DNA, 22 bp, Homo sapiens
tgtgctccacactcccagtcct

SEQ ID NO: 8135336 - DNA, 22 bp, Homo sapiens
tgtgctcatggtccagcatggt

SEQ ID NO: 8135337 - DNA, 23 bp, Homo sapiens
tgtgctcccaaatgtaggtctat

SEQ ID NO: 8135338 - DNA, 22 bp, Homo sapiens
tgtgctccatcatccataatct

SEQ ID NO: 8135339 - DNA, 22 bp, Homo sapiens
tgtgcacatatactcatattcc

SEQ ID NO: 8135340 - DNA, 22 bp, Homo sapiens
tgtgcaatttcaatttacacag

SEQ ID NO: 8135341 - DNA, 22 bp, Homo sapiens
tgtgcaatcatattttaaaatg

SEQ ID NO: 8135342 - DNA, 18 bp, Homo sapiens
tgtgcaatattaaccacc

SEQ ID NO: 8135343 - DNA, 22 bp, Homo sapiens
tgtgcatgtattgatttgtacc

SEQ ID NO: 8135344 - DNA, 22 bp, Homo sapiens
tgtgcatgtaccttattctgga

SEQ ID NO: 8135345 - DNA, 22 bp, Homo sapiens
tgtgcatgcatatgtatttttg

SEQ ID NO: 8135346 - DNA, 22 bp, Homo sapiens
tgtgcatgcacatatatgttgc

SEQ ID NO: 8135347 - DNA, 22 bp, Homo sapiens
tgtgcatattactacctactcc

SEQ ID NO: 8135348 - DNA, 21 bp, Homo sapiens
ttcagcagtcctctagagata

SEQ ID NO: 8135349 - DNA, 21 bp, Homo sapiens
ttcagctctgcttcagggaat

SEQ ID NO: 8135350 - DNA, 22 bp, Homo sapiens
ttcagctcagcactgacaagat

SEQ ID NO: 8135351 - DNA, 22 bp, Homo sapiens
ttcagcctgtctgcagacccct

SEQ ID NO: 8135352 - DNA, 22 bp, Homo sapiens
ttatttgaatgatggcacaatt

SEQ ID NO: 8135353 - DNA, 22 bp, Homo sapiens
ttatttcttgtctatgtagcca

SEQ ID NO: 8135354 - DNA, 22 bp, Homo sapiens
ttatttcttgtctatgtagcca

SEQ ID NO: 8135355 - DNA, 22 bp, Homo sapiens
ttcattagagattataaaatga

SEQ ID NO: 8135356 - DNA, 22 bp, Homo sapiens
ttcattcatctctaaaatgcct

SEQ ID NO: 8135357 - DNA, 21 bp, Homo sapiens
ttcattcatggcataatatag

SEQ ID NO: 8135358 - DNA, 22 bp, Homo sapiens
ttcattcagcacatatttattg

SEQ ID NO: 8135359 - DNA, 22 bp, Homo sapiens
ttcattgatagttttatgtatg

SEQ ID NO: 8135360 - DNA, 22 bp, Homo sapiens
ttaaagcaaccatcaatttgga

SEQ ID NO: 8135361 - DNA, 22 bp, Homo sapiens
ttaaagcagtttgtatacatgg

SEQ ID NO: 8135362 - DNA, 22 bp, Homo sapiens
ttaaagagtaatcataggtcaa

SEQ ID NO: 8135363 - DNA, 22 bp, Homo sapiens
ttacagatactttgtaggcaag

SEQ ID NO: 8135364 - DNA, 22 bp, Homo sapiens
ttacagagggcttctctgaact

SEQ ID NO: 8135365 - DNA, 22 bp, Homo sapiens
ttacagagataaactgtaagtg

SEQ ID NO: 8135366 - DNA, 22 bp, Homo sapiens
ttacattagacccactttcatg

SEQ ID NO: 8135367 - DNA, 22 bp, Homo sapiens
ttacattaagccaatggattct

SEQ ID NO: 8135368 - DNA, 22 bp, Homo sapiens
ttacatgcaggtcagactgcat

SEQ ID NO: 8135369 - DNA, 22 bp, Homo sapiens
ttacagatggatctagcaaaat

SEQ ID NO: 8135370 - DNA, 22 bp, Homo sapiens
ttacagatggggttgcaataaa

SEQ ID NO: 8135371 - DNA, 22 bp, Homo sapiens
ttagaagcactaattactcaca

SEQ ID NO: 8135372 - DNA, 22 bp, Homo sapiens
ttagatatgtttttgctaatgc

SEQ ID NO: 8135373 - DNA, 22 bp, Homo sapiens
ttatttcattgatttctaagac

SEQ ID NO: 8135374 - DNA, 19 bp, Homo sapiens
ttattctgtcagagcacac

SEQ ID NO: 8135375 - DNA, 21 bp, Homo sapiens
ttattctgagatgagattctt

SEQ ID NO: 8135376 - DNA, 21 bp, Homo sapiens
tgggcaagtttgggggtcctc

SEQ ID NO: 8135377 - DNA, 22 bp, Homo sapiens
tgggcaagtatcggactctgag

SEQ ID NO: 8135378 - DNA, 22 bp, Homo sapiens
tgggcagactaaggtcaaagct

SEQ ID NO: 8135379 - DNA, 22 bp, Homo sapiens
tgggcagactgagccctgtccc

SEQ ID NO: 8135380 - DNA, 22 bp, Homo sapiens
tgggcagagtcatacaggagac

SEQ ID NO: 8135381 - DNA, 22 bp, Homo sapiens
tgggcagaggctctgaagtcca

SEQ ID NO: 8135382 - DNA, 22 bp, Homo sapiens
tgggcagagtagctcagaagaa

SEQ ID NO: 8135383 - DNA, 22 bp, Homo sapiens
tgggcagagatctggatcaaac

SEQ ID NO: 8135384 - DNA, 22 bp, Homo sapiens
tgggcagagagtagaggcaacg

SEQ ID NO: 8135385 - DNA, 22 bp, Homo sapiens
tgggcagaggacagggaagatc

SEQ ID NO: 8135386 - DNA, 22 bp, Homo sapiens
tgggcagaggcagcagaaacct

SEQ ID NO: 8135387 - DNA, 22 bp, Homo sapiens
tgggaggtctcttgcggcctag

SEQ ID NO: 8135388 - DNA, 22 bp, Homo sapiens
tgggaggcttccagaccttgct

SEQ ID NO: 8135389 - DNA, 22 bp, Homo sapiens
tgggaggccgaggcaggtggat

SEQ ID NO: 8135390 - DNA, 22 bp, Homo sapiens
tgggaggccaaggcaggcggat

SEQ ID NO: 8135391 - DNA, 22 bp, Homo sapiens
tgggaggcaggtaggtgatgat

SEQ ID NO: 8135392 - DNA, 22 bp, Homo sapiens
tgggaggcccaggcctggcagg

SEQ ID NO: 8135393 - DNA, 20 bp, Homo sapiens
tgggcagcactgctggctgg

SEQ ID NO: 8135394 - DNA, 22 bp, Homo sapiens
tgggcagattaatgcagtggct

SEQ ID NO: 8135395 - DNA, 22 bp, Homo sapiens
tgggcagatctttggtggctag

SEQ ID NO: 8135396 - DNA, 16 bp, Homo sapiens
tgggcagatgagaaga

SEQ ID NO: 8135397 - DNA, 22 bp, Homo sapiens
tgggcagagtcgtggggaatag

SEQ ID NO: 8135398 - DNA, 22 bp, Homo sapiens
tgggcagagttgtgatgaactg

SEQ ID NO: 8135399 - DNA, 15 bp, Homo sapiens
tgggcagatcacttg

SEQ ID NO: 8135400 - DNA, 22 bp, Homo sapiens
tgggcagatgtcctctgaagtg

SEQ ID NO: 8135401 - DNA, 21 bp, Homo sapiens
tgggcagatggcagtgtggct

SEQ ID NO: 8135402 - DNA, 22 bp, Homo sapiens
tgggcagatgtggctctccttg

SEQ ID NO: 8135403 - DNA, 19 bp, Homo sapiens
tgggcagctccctctgtcc

SEQ ID NO: 8135404 - DNA, 22 bp, Homo sapiens
tgggcagggatctcttttgcaa

SEQ ID NO: 8135405 - DNA, 22 bp, Homo sapiens
tgggcagggagctggaaccaca

SEQ ID NO: 8135406 - DNA, 22 bp, Homo sapiens
tgggccagcaattgctgctcag

SEQ ID NO: 8135407 - DNA, 22 bp, Homo sapiens
tgggccagctgaagtgccgccc

SEQ ID NO: 8135408 - DNA, 22 bp, Homo sapiens
tgggccagctccctgcccctgg

SEQ ID NO: 8135409 - DNA, 22 bp, Homo sapiens
tgggccagcactgggtgctcat

SEQ ID NO: 8135410 - DNA, 22 bp, Homo sapiens
tgggcaggtgctattttccatg

SEQ ID NO: 8135411 - DNA, 22 bp, Homo sapiens
tgggcagggtctctgttatcag

SEQ ID NO: 8135412 - DNA, 19 bp, Homo sapiens
tgggcaggttcagtaatgg

SEQ ID NO: 8135413 - DNA, 22 bp, Homo sapiens
tgggcaggggccctgcttccgt

SEQ ID NO: 8135414 - DNA, 22 bp, Homo sapiens
tgggcagtggctgggcctctct

SEQ ID NO: 8135415 - DNA, 22 bp, Homo sapiens
tgggcaggttgttatttgacat

SEQ ID NO: 8135416 - DNA, 22 bp, Homo sapiens
tgggcagtcatcagcacaccgg

SEQ ID NO: 8135417 - DNA, 22 bp, Homo sapiens
tgggcatggactgtggagccgc

SEQ ID NO: 8135418 - DNA, 22 bp, Homo sapiens
tgggcatcccgcgtctggctgc

SEQ ID NO: 8135419 - DNA, 22 bp, Homo sapiens
tgggcctctgtttcctcatctg

SEQ ID NO: 8135420 - DNA, 20 bp, Homo sapiens
tgggcctctggtgcctctgg

SEQ ID NO: 8135421 - DNA, 22 bp, Homo sapiens
tgggcctcctttccattcagag

SEQ ID NO: 8135422 - DNA, 22 bp, Homo sapiens
tgggcctcggggaagcccgtgt

SEQ ID NO: 8135423 - DNA, 22 bp, Homo sapiens
tgggcctctgggttagtcccta

SEQ ID NO: 8135424 - DNA, 22 bp, Homo sapiens
tgggcctctgccacgctccccc

SEQ ID NO: 8135425 - DNA, 22 bp, Homo sapiens
tgggcctcatgcccagccaccc

SEQ ID NO: 8135426 - DNA, 22 bp, Homo sapiens
tgggcctcagtttccttaggat

SEQ ID NO: 8135427 - DNA, 22 bp, Homo sapiens
tgggcctcctgccctggcctag

SEQ ID NO: 8135428 - DNA, 22 bp, Homo sapiens
tgggcctcccatgtcttaggga

SEQ ID NO: 8135429 - DNA, 22 bp, Homo sapiens
tgggccagttctttactcgtcc

SEQ ID NO: 8135430 - DNA, 22 bp, Homo sapiens
tgggccagttatttcacctctg

SEQ ID NO: 8135431 - DNA, 22 bp, Homo sapiens
tgggccagtcctgcctaaggtg

SEQ ID NO: 8135432 - DNA, 22 bp, Homo sapiens
tgggccagtccagccccaggga

SEQ ID NO: 8135433 - DNA, 22 bp, Homo sapiens
tgggccaggtctgtgtcagctg

SEQ ID NO: 8135434 - DNA, 22 bp, Homo sapiens
tgggccaggggcctcttctgat

SEQ ID NO: 8135435 - DNA, 23 bp, Homo sapiens
tgggccagggagtccggtttctt

SEQ ID NO: 8135436 - DNA, 22 bp, Homo sapiens
tgggccagggcacccagtccag

SEQ ID NO: 8135437 - DNA, 22 bp, Homo sapiens
tgggcgaggagaatgctgtgaa

SEQ ID NO: 8135438 - DNA, 22 bp, Homo sapiens
tgggctagatatttttgggctg

SEQ ID NO: 8135439 - DNA, 22 bp, Homo sapiens
tgggcggactcgggcatggaat

SEQ ID NO: 8135440 - DNA, 22 bp, Homo sapiens
tgggcgggcaggagcgcacctg

SEQ ID NO: 8135441 - DNA, 23 bp, Homo sapiens
tgggcggggcttttcactctgcc

SEQ ID NO: 8135442 - DNA, 22 bp, Homo sapiens
tgggcggtgtgcaggctctgct

SEQ ID NO: 8135443 - DNA, 22 bp, Homo sapiens
tgggcgaggcccagggctgcgt

SEQ ID NO: 8135444 - DNA, 23 bp, Homo sapiens
tgggcgaggcaggagtggagcac

SEQ ID NO: 8135445 - DNA, 22 bp, Homo sapiens
tgggctcagggaagcttggcct

SEQ ID NO: 8135446 - DNA, 21 bp, Homo sapiens
tgggctctttaacccaggcac

SEQ ID NO: 8135447 - DNA, 22 bp, Homo sapiens
tgggctgccctgatggtcctca

SEQ ID NO: 8135448 - DNA, 22 bp, Homo sapiens
tgggctgccggcaggctctgcc

SEQ ID NO: 8135449 - DNA, 22 bp, Homo sapiens
tgggctgcccaaggtggccatg

SEQ ID NO: 8135450 - DNA, 22 bp, Homo sapiens
tgggctgccagctctccagatg

SEQ ID NO: 8135451 - DNA, 22 bp, Homo sapiens
tgggctgcagagcccggccttc

SEQ ID NO: 8135452 - DNA, 22 bp, Homo sapiens
tgggctgcaggggttgagagct

SEQ ID NO: 8135453 - DNA, 22 bp, Homo sapiens
tgggctgcacctttgtaaatct

SEQ ID NO: 8135454 - DNA, 22 bp, Homo sapiens
tgggctgcactccattttctgc

SEQ ID NO: 8135455 - DNA, 22 bp, Homo sapiens
tgggctgcactgctctttatcg

SEQ ID NO: 8135456 - DNA, 22 bp, Homo sapiens
tgggctgcaccctcagcctctg

SEQ ID NO: 8135457 - DNA, 22 bp, Homo sapiens
tgggctctgcatcagtgcccat

SEQ ID NO: 8135458 - DNA, 22 bp, Homo sapiens
tgggctctggagggcctaggat

SEQ ID NO: 8135459 - DNA, 22 bp, Homo sapiens
tgggctctgggtggcctgagca

SEQ ID NO: 8135460 - DNA, 22 bp, Homo sapiens
tgggctctctttacctcataac

SEQ ID NO: 8135461 - DNA, 22 bp, Homo sapiens
tggggaggttcgggaatcttgt

SEQ ID NO: 8135462 - DNA, 22 bp, Homo sapiens
tggggaggtaacaatttcaggc

SEQ ID NO: 8135463 - DNA, 21 bp, Homo sapiens
tggggaggggacctgattatg

SEQ ID NO: 8135464 - DNA, 22 bp, Homo sapiens
tggggatgtcatataagaggaa

SEQ ID NO: 8135465 - DNA, 23 bp, Homo sapiens
tggggagggaagtcatttctgta

SEQ ID NO: 8135466 - DNA, 22 bp, Homo sapiens
tggggaggatatgtgagttatt

SEQ ID NO: 8135467 - DNA, 22 bp, Homo sapiens
tggggaggacgggcgccttcct

SEQ ID NO: 8135468 - DNA, 22 bp, Homo sapiens
tggggaggaagtcagatttcag

SEQ ID NO: 8135469 - DNA, 22 bp, Homo sapiens
tgggggagagaggcattctttc

SEQ ID NO: 8135470 - DNA, 22 bp, Homo sapiens
tgggggagagtgcaagcatgaa

SEQ ID NO: 8135471 - DNA, 22 bp, Homo sapiens
tgggggagagtttagatgattt

SEQ ID NO: 8135472 - DNA, 22 bp, Homo sapiens
tgggggagatagagtctgatgg

SEQ ID NO: 8135473 - DNA, 22 bp, Homo sapiens
tgggggagattagagcttctta

SEQ ID NO: 8135474 - DNA, 22 bp, Homo sapiens
tggggctggctattgtctccct

SEQ ID NO: 8135475 - DNA, 22 bp, Homo sapiens
tggggctggcacagtctctatt

SEQ ID NO: 8135476 - DNA, 22 bp, Homo sapiens
tggggctgtcccggtttggcga

SEQ ID NO: 8135477 - DNA, 22 bp, Homo sapiens
tgggggcacttcgaggtcgcct

SEQ ID NO: 8135478 - DNA, 22 bp, Homo sapiens
tgggggcatggaccagcctggc

SEQ ID NO: 8135479 - DNA, 22 bp, Homo sapiens
tgggggagctcagtccagccca

SEQ ID NO: 8135480 - DNA, 22 bp, Homo sapiens
tgggggagtatagtctggcctc

SEQ ID NO: 8135481 - DNA, 22 bp, Homo sapiens
tgggggagattgtgcatctcta

SEQ ID NO: 8135482 - DNA, 22 bp, Homo sapiens
tgggggagccttcacagtagct

SEQ ID NO: 8135483 - DNA, 22 bp, Homo sapiens
tgggggagcgacagacataatt

SEQ ID NO: 8135484 - DNA, 22 bp, Homo sapiens
tggggccacagcctcctagctt

SEQ ID NO: 8135485 - DNA, 22 bp, Homo sapiens
tggggccacactgatctcccag

SEQ ID NO: 8135486 - DNA, 22 bp, Homo sapiens
tggggccagagatggggcgcag

SEQ ID NO: 8135487 - DNA, 22 bp, Homo sapiens
tggggcagagtaggattttggc

SEQ ID NO: 8135488 - DNA, 22 bp, Homo sapiens
tggggccatctcacccactgtt

SEQ ID NO: 8135489 - DNA, 22 bp, Homo sapiens
tggggccaggtggctgcaggtc

SEQ ID NO: 8135490 - DNA, 22 bp, Homo sapiens
tggggccagagctgcagggagc

SEQ ID NO: 8135491 - DNA, 22 bp, Homo sapiens
tggggccagcggggaggactca

SEQ ID NO: 8135492 - DNA, 22 bp, Homo sapiens
tggggccagggaggaccagaca

SEQ ID NO: 8135493 - DNA, 22 bp, Homo sapiens
tggggctcctcctggcaggagg

SEQ ID NO: 8135494 - DNA, 22 bp, Homo sapiens
tggggctctccacagtgtctca

SEQ ID NO: 8135495 - DNA, 22 bp, Homo sapiens
tggggctcatgcctgctggaac

SEQ ID NO: 8135496 - DNA, 22 bp, Homo sapiens
tggggctcacctaggctggaag

SEQ ID NO: 8135497 - DNA, 23 bp, Homo sapiens
tggggctctggcaggcctgaggt

SEQ ID NO: 8135498 - DNA, 22 bp, Homo sapiens
tggggctgaggagcctcactct

SEQ ID NO: 8135499 - DNA, 23 bp, Homo sapiens
tggggctgatggagacggaccag

SEQ ID NO: 8135500 - DNA, 22 bp, Homo sapiens
tggggcgcccccactccacaga

SEQ ID NO: 8135501 - DNA, 21 bp, Homo sapiens
tgggtggaagcgggaggccgc

SEQ ID NO: 8135502 - DNA, 22 bp, Homo sapiens
tgggtgctctgcttccctgcac

SEQ ID NO: 8135503 - DNA, 23 bp, Homo sapiens
tgggtgctaatctgctctgtgga

SEQ ID NO: 8135504 - DNA, 19 bp, Homo sapiens
tgggtgtgaccatctctgc

SEQ ID NO: 8135505 - DNA, 21 bp, Homo sapiens
tgggtgggcagagtctcttca

SEQ ID NO: 8135506 - DNA, 16 bp, Homo sapiens
tgggtgggaggagcgg

SEQ ID NO: 8135507 - DNA, 22 bp, Homo sapiens
tgggtgggagcgccctgtctgg

SEQ ID NO: 8135508 - DNA, 22 bp, Homo sapiens
tggtatgtaaattgtaactcaa

SEQ ID NO: 8135509 - DNA, 22 bp, Homo sapiens
tggtatgtaataagtgttctaa

SEQ ID NO: 8135510 - DNA, 22 bp, Homo sapiens
tggtatctgtgaatgtgacatt

SEQ ID NO: 8135511 - DNA, 22 bp, Homo sapiens
tggggttgcctcccgccctgga

SEQ ID NO: 8135512 - DNA, 22 bp, Homo sapiens
tggggtggaacccttctgctgg

SEQ ID NO: 8135513 - DNA, 22 bp, Homo sapiens
tggggtgccgacagggagggca

SEQ ID NO: 8135514 - DNA, 22 bp, Homo sapiens
tggggtgacagtgcagtggtca

SEQ ID NO: 8135515 - DNA, 22 bp, Homo sapiens
tggggtgggcatgcgctgtcct

SEQ ID NO: 8135516 - DNA, 22 bp, Homo sapiens
tgggggtgctgagaagacagga

SEQ ID NO: 8135517 - DNA, 22 bp, Homo sapiens
tgggggtgaaagtctggacagt

SEQ ID NO: 8135518 - DNA, 22 bp, Homo sapiens
tgtcagtgtatacatacagtat

SEQ ID NO: 8135519 - DNA, 18 bp, Homo sapiens
tgtcataatatatcacct

SEQ ID NO: 8135520 - DNA, 22 bp, Homo sapiens
tgtcataacttagtgacaaatc

SEQ ID NO: 8135521 - DNA, 22 bp, Homo sapiens
tgtcatagtgtggtagcagtgg

SEQ ID NO: 8135522 - DNA, 22 bp, Homo sapiens
tgtcataatgctgctagaaatt

SEQ ID NO: 8135523 - DNA, 21 bp, Homo sapiens
tgtcagaaataagcatgtgat

SEQ ID NO: 8135524 - DNA, 22 bp, Homo sapiens
tgtcacagagcaactatttctt

SEQ ID NO: 8135525 - DNA, 22 bp, Homo sapiens
tgtcacaacagaggaactgaat

SEQ ID NO: 8135526 - DNA, 22 bp, Homo sapiens
tgtcaatgggaatttgttttag

SEQ ID NO: 8135527 - DNA, 22 bp, Homo sapiens
tgtcaatgaaaatgtataaggt

SEQ ID NO: 8135528 - DNA, 22 bp, Homo sapiens
tgtatttagtccagtctctcat

SEQ ID NO: 8135529 - DNA, 22 bp, Homo sapiens
tgtatttaattgtatcatcaca

SEQ ID NO: 8135530 - DNA, 22 bp, Homo sapiens
tgtatgcttgagtgtgtatact

SEQ ID NO: 8135531 - DNA, 22 bp, Homo sapiens
tgtatgctttggttgtttctct

SEQ ID NO: 8135532 - DNA, 22 bp, Homo sapiens
tgtatgctttccttctttctgg

SEQ ID NO: 8135533 - DNA, 22 bp, Homo sapiens
tgtagcatgtaaattggttatt

SEQ ID NO: 8135534 - DNA, 22 bp, Homo sapiens
tgtatctttctgtacttttatg

SEQ ID NO: 8135535 - DNA, 22 bp, Homo sapiens
tggttttaaaagatgtttgaga

SEQ ID NO: 8135536 - DNA, 22 bp, Homo sapiens
tgtaaatcactgaactaaatga

SEQ ID NO: 8135537 - DNA, 22 bp, Homo sapiens
tgtaaacaaatgcattcttgct

SEQ ID NO: 8135538 - DNA, 22 bp, Homo sapiens
tggttgtgtcacttagattaga

SEQ ID NO: 8135539 - DNA, 22 bp, Homo sapiens
tggttctaaaggactatacaga

SEQ ID NO: 8135540 - DNA, 23 bp, Homo sapiens
tggttctaggcctataattatat

SEQ ID NO: 8135541 - DNA, 22 bp, Homo sapiens
tgtacaatctgatgatgtatgg

SEQ ID NO: 8135542 - DNA, 22 bp, Homo sapiens
tgtacagaggtgtacatatgat

SEQ ID NO: 8135543 - DNA, 22 bp, Homo sapiens
tggtgagcgatgctgcatgttc

SEQ ID NO: 8135544 - DNA, 22 bp, Homo sapiens
tggtctcccagagcagggacgc

SEQ ID NO: 8135545 - DNA, 22 bp, Homo sapiens
tggtcctggggtgcaggctgac

SEQ ID NO: 8135546 - DNA, 22 bp, Homo sapiens
tggtcctcaggttctctgtgcg

SEQ ID NO: 8135547 - DNA, 22 bp, Homo sapiens
tggtcctgccccgtgcacagag

SEQ ID NO: 8135548 - DNA, 19 bp, Homo sapiens
tggtggaggtgcacctgac

SEQ ID NO: 8135549 - DNA, 22 bp, Homo sapiens
tggtggagacctcgctaacccc

SEQ ID NO: 8135550 - DNA, 22 bp, Homo sapiens
tggtgctgtggaggggcagaag

SEQ ID NO: 8135551 - DNA, 22 bp, Homo sapiens
tggtgcccttgtgggtgagatg

SEQ ID NO: 8135552 - DNA, 22 bp, Homo sapiens
tggtgcagtagaaggccgactt

SEQ ID NO: 8135553 - DNA, 22 bp, Homo sapiens
tggtgcagtagagctgtctggg

SEQ ID NO: 8135554 - DNA, 22 bp, Homo sapiens
tggtgcaggagttggcagggac

SEQ ID NO: 8135555 - DNA, 22 bp, Homo sapiens
tggtgccattagccctgctgtt

SEQ ID NO: 8135556 - DNA, 22 bp, Homo sapiens
tggtgccatcatagctcactgc

SEQ ID NO: 8135557 - DNA, 22 bp, Homo sapiens
tggtgcagtccaaagggagcag

SEQ ID NO: 8135558 - DNA, 22 bp, Homo sapiens
tggtgcagttcccagggccggg

SEQ ID NO: 8135559 - DNA, 23 bp, Homo sapiens
tggtgggccctgcttgctcactg

SEQ ID NO: 8135560 - DNA, 22 bp, Homo sapiens
tggtgggctgagtctcatcgga

SEQ ID NO: 8135561 - DNA, 22 bp, Homo sapiens
tggtgggcacagtgcccaggct

SEQ ID NO: 8135562 - DNA, 22 bp, Homo sapiens
tggaatctgtgctgttttagtg

SEQ ID NO: 8135563 - DNA, 22 bp, Homo sapiens
tggaagggagtgacagtcagag

SEQ ID NO: 8135564 - DNA, 22 bp, Homo sapiens
tggaagggggaagacagctctg

SEQ ID NO: 8135565 - DNA, 22 bp, Homo sapiens
tggacattccacccatatcaga

SEQ ID NO: 8135566 - DNA, 22 bp, Homo sapiens
tggactcagagttggtggcagt

SEQ ID NO: 8135567 - DNA, 22 bp, Homo sapiens
tggactcccagagctgctctcc

SEQ ID NO: 8135568 - DNA, 22 bp, Homo sapiens
tggactccagtgtctgtgttct

SEQ ID NO: 8135569 - DNA, 22 bp, Homo sapiens
tggaccctttatgcggaacagg

SEQ ID NO: 8135570 - DNA, 22 bp, Homo sapiens
tggaccggcagtggctatacag

SEQ ID NO: 8135571 - DNA, 21 bp, Homo sapiens
tggaatgaggctgagcagtgc

SEQ ID NO: 8135572 - DNA, 22 bp, Homo sapiens
tggaatgttgggatttaagtgt

SEQ ID NO: 8135573 - DNA, 22 bp, Homo sapiens
tggaattatctgaagtgatttg

SEQ ID NO: 8135574 - DNA, 20 bp, Homo sapiens
tggacagaattagacacttt

SEQ ID NO: 8135575 - DNA, 22 bp, Homo sapiens
tggacagagaggaaggccattt

SEQ ID NO: 8135576 - DNA, 19 bp, Homo sapiens
tggaaatggaagctcagcc

SEQ ID NO: 8135577 - DNA, 22 bp, Homo sapiens
tggaaatggatctgatgagtct

SEQ ID NO: 8135578 - DNA, 22 bp, Homo sapiens
tggaaaggtgtaaagcagaacc

SEQ ID NO: 8135579 - DNA, 22 bp, Homo sapiens
tggaaagtttctgatttcctaa

SEQ ID NO: 8135580 - DNA, 22 bp, Homo sapiens
tggaaagtgagacatatttata

SEQ ID NO: 8135581 - DNA, 22 bp, Homo sapiens
tggaaattactaacacttagag

SEQ ID NO: 8135582 - DNA, 22 bp, Homo sapiens
tggaaagatgaagatgtttaag

SEQ ID NO: 8135583 - DNA, 19 bp, Homo sapiens
tggaaaatggattgaatca

SEQ ID NO: 8135584 - DNA, 22 bp, Homo sapiens
tggaaaaactgagacttagaca

SEQ ID NO: 8135585 - DNA, 22 bp, Homo sapiens
tgctttgtgatatgctgtgtct

SEQ ID NO: 8135586 - DNA, 22 bp, Homo sapiens
tgcttgaagatatactacttcc

SEQ ID NO: 8135587 - DNA, 22 bp, Homo sapiens
tgcttgaaaggggtttcccagt

SEQ ID NO: 8135588 - DNA, 22 bp, Homo sapiens
tgctttaacataagatatcttt

SEQ ID NO: 8135589 - DNA, 22 bp, Homo sapiens
tgctttaaaatggactgttttg

SEQ ID NO: 8135590 - DNA, 22 bp, Homo sapiens
tgcttctgctgatattttgtga

SEQ ID NO: 8135591 - DNA, 22 bp, Homo sapiens
tggagcaggtgctcagggtaat

SEQ ID NO: 8135592 - DNA, 22 bp, Homo sapiens
tggagccagcaggactcagagg

SEQ ID NO: 8135593 - DNA, 22 bp, Homo sapiens
tggagccagcccaggcccctct

SEQ ID NO: 8135594 - DNA, 22 bp, Homo sapiens
tggagccagcggcctgctgagg

SEQ ID NO: 8135595 - DNA, 22 bp, Homo sapiens
tggagccaggagcctgggagtc

SEQ ID NO: 8135596 - DNA, 22 bp, Homo sapiens
tggagcagctaagcctctgaga

SEQ ID NO: 8135597 - DNA, 22 bp, Homo sapiens
tggagcagctctagcgggcgcc

SEQ ID NO: 8135598 - DNA, 22 bp, Homo sapiens
tggagccaggctggccctgcca

SEQ ID NO: 8135599 - DNA, 18 bp, Homo sapiens
tggagccattgccaccat

SEQ ID NO: 8135600 - DNA, 22 bp, Homo sapiens
tggagcagccatgatgacagag

SEQ ID NO: 8135601 - DNA, 22 bp, Homo sapiens
tggagcagcacaagaaagggga

SEQ ID NO: 8135602 - DNA, 22 bp, Homo sapiens
tggagaaggacagcctgagaaa

SEQ ID NO: 8135603 - DNA, 22 bp, Homo sapiens
tggagaagctgtaggtggactc

SEQ ID NO: 8135604 - DNA, 22 bp, Homo sapiens
tggagaagtcaaagtgaacagg

SEQ ID NO: 8135605 - DNA, 22 bp, Homo sapiens
tggaggagtgtgattgtctgcc

SEQ ID NO: 8135606 - DNA, 22 bp, Homo sapiens
tggaggaggaacttcttatctc

SEQ ID NO: 8135607 - DNA, 22 bp, Homo sapiens
tggaggccgcgtagtctgagca

SEQ ID NO: 8135608 - DNA, 22 bp, Homo sapiens
tggaggccggactgagaggcat

SEQ ID NO: 8135609 - DNA, 22 bp, Homo sapiens
tggaggcccacactgggtagat

SEQ ID NO: 8135610 - DNA, 22 bp, Homo sapiens
tggaggccatgccagagcccta

SEQ ID NO: 8135611 - DNA, 22 bp, Homo sapiens
tggagggaacaaaggagtccca

SEQ ID NO: 8135612 - DNA, 22 bp, Homo sapiens
tggaggctggtttctgctgagg

SEQ ID NO: 8135613 - DNA, 23 bp, Homo sapiens
tggatatttcagagatacttcag

SEQ ID NO: 8135614 - DNA, 22 bp, Homo sapiens
tgctccagggcctccagtgggg

SEQ ID NO: 8135615 - DNA, 22 bp, Homo sapiens
tgctccgggaaagagcagccgc

SEQ ID NO: 8135616 - DNA, 18 bp, Homo sapiens
tgctccaggcccatgggc

SEQ ID NO: 8135617 - DNA, 21 bp, Homo sapiens
tgctccaggagggggcagtcc

SEQ ID NO: 8135618 - DNA, 22 bp, Homo sapiens
tgctccaggccgcctggggctg

SEQ ID NO: 8135619 - DNA, 19 bp, Homo sapiens
tgctccaggccttgccgca

SEQ ID NO: 8135620 - DNA, 20 bp, Homo sapiens
tgctccaggaacactggccg

SEQ ID NO: 8135621 - DNA, 22 bp, Homo sapiens
tgctccagcgctgccaccagtt

SEQ ID NO: 8135622 - DNA, 22 bp, Homo sapiens
tgctccagcctatgctctccgg

SEQ ID NO: 8135623 - DNA, 22 bp, Homo sapiens
tgctccagcaccaagagctcca

SEQ ID NO: 8135624 - DNA, 22 bp, Homo sapiens
tgctccagcccctggtgcacag

SEQ ID NO: 8135625 - DNA, 22 bp, Homo sapiens
tgctccagcatgaccctcaatg

SEQ ID NO: 8135626 - DNA, 22 bp, Homo sapiens
tgctcctggcatctctgcgtcc

SEQ ID NO: 8135627 - DNA, 22 bp, Homo sapiens
tgctctccggcttccgtggcct

SEQ ID NO: 8135628 - DNA, 20 bp, Homo sapiens
tgctctgtctaaaacttccc

SEQ ID NO: 8135629 - DNA, 22 bp, Homo sapiens
tgctctgtaacaaattgacatg

SEQ ID NO: 8135630 - DNA, 22 bp, Homo sapiens
tgctctgttcagtgtatcttgt

SEQ ID NO: 8135631 - DNA, 22 bp, Homo sapiens
tgctctgtgtgtggttatttcc

SEQ ID NO: 8135632 - DNA, 22 bp, Homo sapiens
tgctgcagggccttccctgcat

SEQ ID NO: 8135633 - DNA, 22 bp, Homo sapiens
tgctgcaggccttggctgggaa

SEQ ID NO: 8135634 - DNA, 18 bp, Homo sapiens
tgctcagctggtgctgaa

SEQ ID NO: 8135635 - DNA, 22 bp, Homo sapiens
tgctcagctggtgccagggtcc

SEQ ID NO: 8135636 - DNA, 22 bp, Homo sapiens
tgctccagaacctgaccatgct

SEQ ID NO: 8135637 - DNA, 22 bp, Homo sapiens
tgctccagcaacaggcttagct

SEQ ID NO: 8135638 - DNA, 22 bp, Homo sapiens
tgctcacagcccagaacataat

SEQ ID NO: 8135639 - DNA, 22 bp, Homo sapiens
tgctcacattaggcatccatgg

SEQ ID NO: 8135640 - DNA, 22 bp, Homo sapiens
tgctcacagcccagaacataat

SEQ ID NO: 8135641 - DNA, 22 bp, Homo sapiens
tgctcacaattatcagaagtat

SEQ ID NO: 8135642 - DNA, 22 bp, Homo sapiens
tgctcacactcatgtccacgct

SEQ ID NO: 8135643 - DNA, 22 bp, Homo sapiens
tgctcagactagctccagggaa

SEQ ID NO: 8135644 - DNA, 22 bp, Homo sapiens
tgctcagctaggctgaagaaga

SEQ ID NO: 8135645 - DNA, 22 bp, Homo sapiens
tgctcagcagtcaaggtcatag

SEQ ID NO: 8135646 - DNA, 22 bp, Homo sapiens
tgctcagcacagaccaggccag

SEQ ID NO: 8135647 - DNA, 22 bp, Homo sapiens
tgctcagcagatctcaggagat

SEQ ID NO: 8135648 - DNA, 22 bp, Homo sapiens
tgctataagaattatattactc

SEQ ID NO: 8135649 - DNA, 22 bp, Homo sapiens
tgctataagagtcacttttcct

SEQ ID NO: 8135650 - DNA, 16 bp, Homo sapiens
tgctattttagagagg

SEQ ID NO: 8135651 - DNA, 19 bp, Homo sapiens
tgctatttgaagaagtgta

SEQ ID NO: 8135652 - DNA, 22 bp, Homo sapiens
tgctatttggaaaagcatttgg

SEQ ID NO: 8135653 - DNA, 22 bp, Homo sapiens
tgcgcgggtgcctatctgtata

SEQ ID NO: 8135654 - DNA, 22 bp, Homo sapiens
tgcgcggctcagtcatctccag

SEQ ID NO: 8135655 - DNA, 22 bp, Homo sapiens
tgcggcggcgggcagaggacta

SEQ ID NO: 8135656 - DNA, 22 bp, Homo sapiens
tgcggcagccaccgcgtggccc

SEQ ID NO: 8135657 - DNA, 22 bp, Homo sapiens
tgcgggagggcaacgcggcatt

SEQ ID NO: 8135658 - DNA, 22 bp, Homo sapiens
tgcgggagtgcgccgagctctc

SEQ ID NO: 8135659 - DNA, 22 bp, Homo sapiens
tgcgggggaagctgtgggagaa

SEQ ID NO: 8135660 - DNA, 22 bp, Homo sapiens
tgccttgaacatagtggacagt

SEQ ID NO: 8135661 - DNA, 22 bp, Homo sapiens
tgcctgtgtccccttcttggca

SEQ ID NO: 8135662 - DNA, 22 bp, Homo sapiens
tgcctgtgtcagcaggtggaag

SEQ ID NO: 8135663 - DNA, 22 bp, Homo sapiens
tgcctgtgtcacagtgatgttt

SEQ ID NO: 8135664 - DNA, 22 bp, Homo sapiens
tgcctgtgtatttccggcctgc

SEQ ID NO: 8135665 - DNA, 22 bp, Homo sapiens
tgcctgtgtatgtgcatgcaca

SEQ ID NO: 8135666 - DNA, 22 bp, Homo sapiens
tgcctgtgggtgatgatttgat

SEQ ID NO: 8135667 - DNA, 22 bp, Homo sapiens
tgcctgtgggtgccaccaccct

SEQ ID NO: 8135668 - DNA, 22 bp, Homo sapiens
tgcctgtggttccagttttttc

SEQ ID NO: 8135669 - DNA, 19 bp, Homo sapiens
tgcctgtggcgagcatctt

SEQ ID NO: 8135670 - DNA, 22 bp, Homo sapiens
tgcctgtgggcagagggccaga

SEQ ID NO: 8135671 - DNA, 22 bp, Homo sapiens
tgcctgtgggcagagggccaga

SEQ ID NO: 8135672 - DNA, 22 bp, Homo sapiens
tgcctgtgcccttcttggcatt

SEQ ID NO: 8135673 - DNA, 22 bp, Homo sapiens
tgcctgtgatcagctgagttca

SEQ ID NO: 8135674 - DNA, 22 bp, Homo sapiens
tgcctgtgctgggattgcatgt

SEQ ID NO: 8135675 - DNA, 22 bp, Homo sapiens
tgcctgtgccctttgctgggag

SEQ ID NO: 8135676 - DNA, 22 bp, Homo sapiens
tgcctgtggagccactagtttt

SEQ ID NO: 8135677 - DNA, 22 bp, Homo sapiens
tgcctgtggaaaggctggtgct

SEQ ID NO: 8135678 - DNA, 22 bp, Homo sapiens
tgcctggggattgctctgggcc

SEQ ID NO: 8135679 - DNA, 22 bp, Homo sapiens
tgcctgggctcaccgcctcttt

SEQ ID NO: 8135680 - DNA, 22 bp, Homo sapiens
tgcctgggtgctggctggtcac

SEQ ID NO: 8135681 - DNA, 22 bp, Homo sapiens
tgcctgggtccaggccaagcct

SEQ ID NO: 8135682 - DNA, 22 bp, Homo sapiens
tgcctgggtgccctctgctcct

SEQ ID NO: 8135683 - DNA, 22 bp, Homo sapiens
tgcctgggtgtaaagggccaac

SEQ ID NO: 8135684 - DNA, 22 bp, Homo sapiens
tgcctgtgacccaaggatgcga

SEQ ID NO: 8135685 - DNA, 22 bp, Homo sapiens
tgcctgtgaaaaccctggggtt

SEQ ID NO: 8135686 - DNA, 17 bp, Homo sapiens
tgcctgtgataagcaca

SEQ ID NO: 8135687 - DNA, 22 bp, Homo sapiens
tgctggaaccaggaatttgaag

SEQ ID NO: 8135688 - DNA, 22 bp, Homo sapiens
tgctggaagaaaattctttaac

SEQ ID NO: 8135689 - DNA, 22 bp, Homo sapiens
tgctggaactcagtgaatcatt

SEQ ID NO: 8135690 - DNA, 22 bp, Homo sapiens
tgctggaaagttaaattttgga

SEQ ID NO: 8135691 - DNA, 22 bp, Homo sapiens
tgctggaaataggcattgtagc

SEQ ID NO: 8135692 - DNA, 22 bp, Homo sapiens
tgctggaataatttcatgttaa

SEQ ID NO: 8135693 - DNA, 22 bp, Homo sapiens
tgctggaagggtagtattaact

SEQ ID NO: 8135694 - DNA, 22 bp, Homo sapiens
tgctgcttttagttggatagaa

SEQ ID NO: 8135695 - DNA, 22 bp, Homo sapiens
tgctgggtcccttgagagctca

SEQ ID NO: 8135696 - DNA, 22 bp, Homo sapiens
tgctggttgtattttctctgtg

SEQ ID NO: 8135697 - DNA, 22 bp, Homo sapiens
tgctgtatatattttgaagtga

SEQ ID NO: 8135698 - DNA, 22 bp, Homo sapiens
tgctggggtctctccggtgccc

SEQ ID NO: 8135699 - DNA, 22 bp, Homo sapiens
tgctgggtcagtgagagcaggg

SEQ ID NO: 8135700 - DNA, 22 bp, Homo sapiens
tgctggggtcatggggcgcccg

SEQ ID NO: 8135701 - DNA, 23 bp, Homo sapiens
tgctggggtagtttgtggcacag

SEQ ID NO: 8135702 - DNA, 22 bp, Homo sapiens
tgctggggcagaagagccaaga

SEQ ID NO: 8135703 - DNA, 16 bp, Homo sapiens
tgctggggcgccgtcc

SEQ ID NO: 8135704 - DNA, 22 bp, Homo sapiens
tgctggggatccgtaccaaccc

SEQ ID NO: 8135705 - DNA, 20 bp, Homo sapiens
tgctggggacatacagggtg

SEQ ID NO: 8135706 - DNA, 22 bp, Homo sapiens
tgctggggagtgattgaccatc

SEQ ID NO: 8135707 - DNA, 22 bp, Homo sapiens
tgctgtctttcattgtctgcct

SEQ ID NO: 8135708 - DNA, 22 bp, Homo sapiens
tgcttctgacatgttcttggtt

SEQ ID NO: 8135709 - DNA, 22 bp, Homo sapiens
tgcttctgactgggtcagttga

SEQ ID NO: 8135710 - DNA, 22 bp, Homo sapiens
tgcttctgcattcaatgttgga

SEQ ID NO: 8135711 - DNA, 22 bp, Homo sapiens
tgcttctgattcatggttattg

SEQ ID NO: 8135712 - DNA, 22 bp, Homo sapiens
tgcttctgcaacttgaatgtac

SEQ ID NO: 8135713 - DNA, 22 bp, Homo sapiens
tgcttctccattgatgctaagt

SEQ ID NO: 8135714 - DNA, 22 bp, Homo sapiens
tggcagagtctgggcttgggca

SEQ ID NO: 8135715 - DNA, 20 bp, Homo sapiens
tggattccctcctgggactc

SEQ ID NO: 8135716 - DNA, 22 bp, Homo sapiens
tggcactcactctcagagtctg

SEQ ID NO: 8135717 - DNA, 22 bp, Homo sapiens
tggcagagacaaggccgggcct

SEQ ID NO: 8135718 - DNA, 22 bp, Homo sapiens
tggcagagagagtgcagtcgac

SEQ ID NO: 8135719 - DNA, 22 bp, Homo sapiens
tggcctctggctgaggactaac

SEQ ID NO: 8135720 - DNA, 22 bp, Homo sapiens
tggccctgtgtgcaggctgcac

SEQ ID NO: 8135721 - DNA, 22 bp, Homo sapiens
tggccctgtgtcctgctgccag

SEQ ID NO: 8135722 - DNA, 22 bp, Homo sapiens
tggccctgtggcttcagaacag

SEQ ID NO: 8135723 - DNA, 22 bp, Homo sapiens
tggccctgtggaggtcagtgag

SEQ ID NO: 8135724 - DNA, 23 bp, Homo sapiens
tggccctgtgcatgctgcttccc

SEQ ID NO: 8135725 - DNA, 22 bp, Homo sapiens
tggccctgttctgtacctcata

SEQ ID NO: 8135726 - DNA, 20 bp, Homo sapiens
tggccctgttttctccaggc

SEQ ID NO: 8135727 - DNA, 22 bp, Homo sapiens
tggccgggccgggcgcctccac

SEQ ID NO: 8135728 - DNA, 22 bp, Homo sapiens
tggccggggctgatggacagtg

SEQ ID NO: 8135729 - DNA, 22 bp, Homo sapiens
tggccgggaagggacagtgtgg

SEQ ID NO: 8135730 - DNA, 22 bp, Homo sapiens
tggccctgtcctcatttcatct

SEQ ID NO: 8135731 - DNA, 22 bp, Homo sapiens
tggccctgtgactgagttctag

SEQ ID NO: 8135732 - DNA, 22 bp, Homo sapiens
tggccctgtctgcacacaggat

SEQ ID NO: 8135733 - DNA, 22 bp, Homo sapiens
tggccctgggtggaatgtccca

SEQ ID NO: 8135734 - DNA, 22 bp, Homo sapiens
tggccctggtggcacagcctgc

SEQ ID NO: 8135735 - DNA, 22 bp, Homo sapiens
tggccctgtccctggagcctgg

SEQ ID NO: 8135736 - DNA, 22 bp, Homo sapiens
tggccctgccctcttcatcttt

SEQ ID NO: 8135737 - DNA, 22 bp, Homo sapiens
tggccctgccgcactatcctca

SEQ ID NO: 8135738 - DNA, 22 bp, Homo sapiens
tggccctgccactcactgctga

SEQ ID NO: 8135739 - DNA, 22 bp, Homo sapiens
tggccctgggcagaggcaacat

SEQ ID NO: 8135740 - DNA, 22 bp, Homo sapiens
tggccctgggcatctttcgtga

SEQ ID NO: 8135741 - DNA, 22 bp, Homo sapiens
tggccctgccgccacgacgtct

SEQ ID NO: 8135742 - DNA, 21 bp, Homo sapiens
tggccctggccacggctgcca

SEQ ID NO: 8135743 - DNA, 22 bp, Homo sapiens
tggccctggctgagttagattt

SEQ ID NO: 8135744 - DNA, 22 bp, Homo sapiens
tggcccagctcagggtgggcgg

SEQ ID NO: 8135745 - DNA, 22 bp, Homo sapiens
tggcccaggccaaagccctgga

SEQ ID NO: 8135746 - DNA, 22 bp, Homo sapiens
tggcccaggcgaggtgggcaga

SEQ ID NO: 8135747 - DNA, 22 bp, Homo sapiens
tggcccagggagttcatggtgt

SEQ ID NO: 8135748 - DNA, 22 bp, Homo sapiens
tggccctgagggctcggagcca

SEQ ID NO: 8135749 - DNA, 22 bp, Homo sapiens
tggccctgaggggctgtgcccc

SEQ ID NO: 8135750 - DNA, 22 bp, Homo sapiens
tggccctgcacccagagcagtt

SEQ ID NO: 8135751 - DNA, 22 bp, Homo sapiens
tggccctgcagaactagcctgg

SEQ ID NO: 8135752 - DNA, 22 bp, Homo sapiens
tggccctgactgatgtggaggg

SEQ ID NO: 8135753 - DNA, 22 bp, Homo sapiens
tggccctgacttggaggcctga

SEQ ID NO: 8135754 - DNA, 22 bp, Homo sapiens
tggccctgaggacccagtgtgg

SEQ ID NO: 8135755 - DNA, 22 bp, Homo sapiens
tggccctgacaggtcctgggca

SEQ ID NO: 8135756 - DNA, 22 bp, Homo sapiens
tggccctgacacgtggtactgg

SEQ ID NO: 8135757 - DNA, 22 bp, Homo sapiens
tggccctgaaggccttgagcat

SEQ ID NO: 8135758 - DNA, 22 bp, Homo sapiens
tggccctgaatcaaggccagca

SEQ ID NO: 8135759 - DNA, 23 bp, Homo sapiens
tggccctgaatctgtcctggagg

SEQ ID NO: 8135760 - DNA, 22 bp, Homo sapiens
tggcccggctctgagctgtgct

SEQ ID NO: 8135761 - DNA, 22 bp, Homo sapiens
tggccagcccttcagccatgcc

SEQ ID NO: 8135762 - DNA, 22 bp, Homo sapiens
tggccagcagagttcactctct

SEQ ID NO: 8135763 - DNA, 22 bp, Homo sapiens
tggccagcagagttcactctct

SEQ ID NO: 8135764 - DNA, 21 bp, Homo sapiens
tggccagctgctcgtctcctc

SEQ ID NO: 8135765 - DNA, 22 bp, Homo sapiens
tggccagccttgtcatcgcttt

SEQ ID NO: 8135766 - DNA, 22 bp, Homo sapiens
tggccacacccacctagaggag

SEQ ID NO: 8135767 - DNA, 22 bp, Homo sapiens
tggccacagtgtccagcagcag

SEQ ID NO: 8135768 - DNA, 22 bp, Homo sapiens
tggccacatatgtgggacagct

SEQ ID NO: 8135769 - DNA, 22 bp, Homo sapiens
tggccacatgcgtctgtgaggc

SEQ ID NO: 8135770 - DNA, 21 bp, Homo sapiens
tgggagagggctcagctaccc

SEQ ID NO: 8135771 - DNA, 22 bp, Homo sapiens
tgggagcagcagggagatgcgg

SEQ ID NO: 8135772 - DNA, 22 bp, Homo sapiens
tgggaggcagaagttgactgga

SEQ ID NO: 8135773 - DNA, 23 bp, Homo sapiens
tgggaatgacatctagagcagag

SEQ ID NO: 8135774 - DNA, 22 bp, Homo sapiens
tgggaatgctgatttcaggaac

SEQ ID NO: 8135775 - DNA, 22 bp, Homo sapiens
tgggaagagttagagacagctg

SEQ ID NO: 8135776 - DNA, 22 bp, Homo sapiens
tgggaagatatgagtgaccaac

SEQ ID NO: 8135777 - DNA, 22 bp, Homo sapiens
tgggaagggccgatggagcctc

SEQ ID NO: 8135778 - DNA, 22 bp, Homo sapiens
tgggaagggtcaacagctggaa

SEQ ID NO: 8135779 - DNA, 22 bp, Homo sapiens
tgggaaggtacacgggaaagag

SEQ ID NO: 8135780 - DNA, 22 bp, Homo sapiens
tggctgtgttaccacttcatgt

SEQ ID NO: 8135781 - DNA, 22 bp, Homo sapiens
tgggaactctctgggaggcatc

SEQ ID NO: 8135782 - DNA, 22 bp, Homo sapiens
tgggaagactcctcaggaggcg

SEQ ID NO: 8135783 - DNA, 22 bp, Homo sapiens
tggctcagagagggagtgtgga

SEQ ID NO: 8135784 - DNA, 22 bp, Homo sapiens
tggctcagagcagggactctgg

SEQ ID NO: 8135785 - DNA, 22 bp, Homo sapiens
tggctcagataattcaaggggc

SEQ ID NO: 8135786 - DNA, 22 bp, Homo sapiens
tggctcagatgctcttccagtg

SEQ ID NO: 8135787 - DNA, 22 bp, Homo sapiens
tggctcagaactacttctagtt

SEQ ID NO: 8135788 - DNA, 17 bp, Homo sapiens
tggcgctcccagggtgc

SEQ ID NO: 8135789 - DNA, 22 bp, Homo sapiens
tggcgcgctcgctctcgctgag

SEQ ID NO: 8135790 - DNA, 21 bp, Homo sapiens
tggcggggacttgtggctgcc

SEQ ID NO: 8135791 - DNA, 22 bp, Homo sapiens
tggctcagtgcattcacagtaa

SEQ ID NO: 8135792 - DNA, 22 bp, Homo sapiens
tggctcagtagcagtgtggtca

SEQ ID NO: 8135793 - DNA, 22 bp, Homo sapiens
tggctcagtaatcgagtctcct

SEQ ID NO: 8135794 - DNA, 22 bp, Homo sapiens
tggctcaggggtctggctctgt

SEQ ID NO: 8135795 - DNA, 22 bp, Homo sapiens
tggctcagcttacttttgaggg

SEQ ID NO: 8135796 - DNA, 22 bp, Homo sapiens
tggctcaggcctacgacgcctt

SEQ ID NO: 8135797 - DNA, 22 bp, Homo sapiens
tggctcagctttccccatctgg

SEQ ID NO: 8135798 - DNA, 22 bp, Homo sapiens
tggctcagttccatcatctgga

SEQ ID NO: 8135799 - DNA, 22 bp, Homo sapiens
tggctcagtggcagccgcagct

SEQ ID NO: 8135800 - DNA, 23 bp, Homo sapiens
tggctctgagcttcctggtggcc

SEQ ID NO: 8135801 - DNA, 22 bp, Homo sapiens
tggctctgctgaacctagtgca

SEQ ID NO: 8135802 - DNA, 22 bp, Homo sapiens
tggctctggagctcctgggccc

SEQ ID NO: 8135803 - DNA, 22 bp, Homo sapiens
tggctctgcagcagtgtgcgtg

SEQ ID NO: 8135804 - DNA, 22 bp, Homo sapiens
tggctctggccaccgggagggc

SEQ ID NO: 8135805 - DNA, 22 bp, Homo sapiens
tggctctggagctggcggctga

SEQ ID NO: 8135806 - DNA, 19 bp, Homo sapiens
tggctctgtttctctggag

SEQ ID NO: 8135807 - DNA, 22 bp, Homo sapiens
tggctgcagatcaagggcaggc

SEQ ID NO: 8135808 - DNA, 22 bp, Homo sapiens
tggctgcagtgcttgagatgtc

SEQ ID NO: 8135809 - DNA, 22 bp, Homo sapiens
tgaagcaggaaccagcagcatt

SEQ ID NO: 8135810 - DNA, 21 bp, Homo sapiens
tgaactctggtcatcttcatt

SEQ ID NO: 8135811 - DNA, 21 bp, Homo sapiens
tgaacaaagttcttatcgtga

SEQ ID NO: 8135812 - DNA, 22 bp, Homo sapiens
tgaacaactgcaaaaatctcca

SEQ ID NO: 8135813 - DNA, 22 bp, Homo sapiens
tgaaatttaggtgcagataaat

SEQ ID NO: 8135814 - DNA, 22 bp, Homo sapiens
tgaaattccaggagagttaaaa

SEQ ID NO: 8135815 - DNA, 22 bp, Homo sapiens
tgaacaaactgcattcttcact

SEQ ID NO: 8135816 - DNA, 22 bp, Homo sapiens
tgaaattatgcattgttgtacc

SEQ ID NO: 8135817 - DNA, 22 bp, Homo sapiens
tgaaattattcttaccaaggtg

SEQ ID NO: 8135818 - DNA, 22 bp, Homo sapiens
tgaaatgtttgtatataaggtc

SEQ ID NO: 8135819 - DNA, 22 bp, Homo sapiens
tgaaattagaaatatgtatggg

SEQ ID NO: 8135820 - DNA, 22 bp, Homo sapiens
tgaaattagtgaagttacagtt

SEQ ID NO: 8135821 - DNA, 22 bp, Homo sapiens
tgaaataatatctggatcaatc

SEQ ID NO: 8135822 - DNA, 22 bp, Homo sapiens
tgaaatcaattgcaatgtttat

SEQ ID NO: 8135823 - DNA, 22 bp, Homo sapiens
tgaaatcagtatgtctttctca

SEQ ID NO: 8135824 - DNA, 22 bp, Homo sapiens
tgaaatgcctatgaagtcagga

SEQ ID NO: 8135825 - DNA, 22 bp, Homo sapiens
tgaaatgcttctctgaaaatac

SEQ ID NO: 8135826 - DNA, 22 bp, Homo sapiens
tgaaatgtacaagtgctttttt

SEQ ID NO: 8135827 - DNA, 22 bp, Homo sapiens
tgaaatcatctgccaataagtt

SEQ ID NO: 8135828 - DNA, 22 bp, Homo sapiens
tgaaatcatgtagttattgcaa

SEQ ID NO: 8135829 - DNA, 22 bp, Homo sapiens
tgaaatcatgtagttattgcaa

SEQ ID NO: 8135830 - DNA, 22 bp, Homo sapiens
tgaaatcatgtagttattgcaa

SEQ ID NO: 8135831 - DNA, 22 bp, Homo sapiens
tgaaatcatgagatagtgtcac

SEQ ID NO: 8135832 - DNA, 22 bp, Homo sapiens
tgaaatcattgccaagtattga

SEQ ID NO: 8135833 - DNA, 22 bp, Homo sapiens
tgaaatgtgttctagtgttttg

SEQ ID NO: 8135834 - DNA, 22 bp, Homo sapiens
tgaaatgttctggagtttctgt

SEQ ID NO: 8135835 - DNA, 22 bp, Homo sapiens
tgaaatgtgtccatgttatttc

SEQ ID NO: 8135836 - DNA, 22 bp, Homo sapiens
tctttggaaggagcagtttttg

SEQ ID NO: 8135837 - DNA, 22 bp, Homo sapiens
tcttttagagcatttctgattc

SEQ ID NO: 8135838 - DNA, 22 bp, Homo sapiens
tctttgttattgtgaatagggt

SEQ ID NO: 8135839 - DNA, 22 bp, Homo sapiens
tctttgtttgcctttatcaaga

SEQ ID NO: 8135840 - DNA, 22 bp, Homo sapiens
tgaaacattgcactgtatgaat

SEQ ID NO: 8135841 - DNA, 22 bp, Homo sapiens
tgaaacattaggaaatcattat

SEQ ID NO: 8135842 - DNA, 22 bp, Homo sapiens
tgaaagaaacaggtatattggg

SEQ ID NO: 8135843 - DNA, 22 bp, Homo sapiens
tgaaagaagggtggaaaatgta

SEQ ID NO: 8135844 - DNA, 21 bp, Homo sapiens
tgaaagaaggtgcagtctgaa

SEQ ID NO: 8135845 - DNA, 22 bp, Homo sapiens
tgaaagaagccttcgaggctcg

SEQ ID NO: 8135846 - DNA, 22 bp, Homo sapiens
tgaaagaagcctccctttggag

SEQ ID NO: 8135847 - DNA, 22 bp, Homo sapiens
tgaaagaactagcatcttcaag

SEQ ID NO: 8135848 - DNA, 22 bp, Homo sapiens
tgaaagaagtgtcacattgcca

SEQ ID NO: 8135849 - DNA, 17 bp, Homo sapiens
tgaaagaatcagggaga

SEQ ID NO: 8135850 - DNA, 22 bp, Homo sapiens
tcttttgttgcctacttattaa

SEQ ID NO: 8135851 - DNA, 23 bp, Homo sapiens
tctttttaagagatctagtgacg

SEQ ID NO: 8135852 - DNA, 22 bp, Homo sapiens
tgaaaaactttaatccataaag

SEQ ID NO: 8135853 - DNA, 22 bp, Homo sapiens
tgaaaagactgcaagagagcat

SEQ ID NO: 8135854 - DNA, 22 bp, Homo sapiens
tgaaaatgccctctatgtctca

SEQ ID NO: 8135855 - DNA, 22 bp, Homo sapiens
tgaaaattaagcagatgaatga

SEQ ID NO: 8135856 - DNA, 22 bp, Homo sapiens
tgaaaattgttgtacttgataa

SEQ ID NO: 8135857 - DNA, 22 bp, Homo sapiens
tgacagtagtgttagaactgat

SEQ ID NO: 8135858 - DNA, 22 bp, Homo sapiens
tgacagtaattcactgggaccc

SEQ ID NO: 8135859 - DNA, 22 bp, Homo sapiens
tgacaggtgattgtgaactaag

SEQ ID NO: 8135860 - DNA, 22 bp, Homo sapiens
tgacaggattggttgcttctga

SEQ ID NO: 8135861 - DNA, 22 bp, Homo sapiens
tgacaggatgatgagcaggggg

SEQ ID NO: 8135862 - DNA, 22 bp, Homo sapiens
tgacaggatagtaggaagatct

SEQ ID NO: 8135863 - DNA, 22 bp, Homo sapiens
tgacaggaaacatgcagtgatt

SEQ ID NO: 8135864 - DNA, 22 bp, Homo sapiens
tgacaggacagagaaatgacct

SEQ ID NO: 8135865 - DNA, 22 bp, Homo sapiens
tgacagcagcatagtgagcaat

SEQ ID NO: 8135866 - DNA, 21 bp, Homo sapiens
tgacagcatagagcagggagg

SEQ ID NO: 8135867 - DNA, 22 bp, Homo sapiens
tgacagcatgaccacagggtct

SEQ ID NO: 8135868 - DNA, 22 bp, Homo sapiens
tgacagattttttctgagctaa

SEQ ID NO: 8135869 - DNA, 22 bp, Homo sapiens
tgacactgccgaaactgtagag

SEQ ID NO: 8135870 - DNA, 22 bp, Homo sapiens
tgacacagtgggggatcctttt

SEQ ID NO: 8135871 - DNA, 22 bp, Homo sapiens
tgacacagtatcaaacatgatt

SEQ ID NO: 8135872 - DNA, 22 bp, Homo sapiens
tgacacagtatcaaacatgatt

SEQ ID NO: 8135873 - DNA, 22 bp, Homo sapiens
tgacacagttgtcgactctaca

SEQ ID NO: 8135874 - DNA, 22 bp, Homo sapiens
tgacacagattagagacatacc

SEQ ID NO: 8135875 - DNA, 22 bp, Homo sapiens
tgacacagattagagacatacc

SEQ ID NO: 8135876 - DNA, 22 bp, Homo sapiens
tgacacacagggggatggagtt

SEQ ID NO: 8135877 - DNA, 22 bp, Homo sapiens
tgacacagggcatgcagcagaa

SEQ ID NO: 8135878 - DNA, 19 bp, Homo sapiens
tgactctgtggaacagaag

SEQ ID NO: 8135879 - DNA, 22 bp, Homo sapiens
tgactctgataagacatatggc

SEQ ID NO: 8135880 - DNA, 22 bp, Homo sapiens
tgactctgaattgggaaatggg

SEQ ID NO: 8135881 - DNA, 22 bp, Homo sapiens
tgactctgaatttatgaaatgg

SEQ ID NO: 8135882 - DNA, 22 bp, Homo sapiens
tgactctggcttcaagtttctt

SEQ ID NO: 8135883 - DNA, 22 bp, Homo sapiens
tgacctgacatgaattaaaaac

SEQ ID NO: 8135884 - DNA, 22 bp, Homo sapiens
tgactgtgcctgttgaatgaat

SEQ ID NO: 8135885 - DNA, 22 bp, Homo sapiens
tgaatcaattgtcttaagacat

SEQ ID NO: 8135886 - DNA, 22 bp, Homo sapiens
tgaatcatggataaatagctta

SEQ ID NO: 8135887 - DNA, 22 bp, Homo sapiens
tgaatcaatgaattgcacttca

SEQ ID NO: 8135888 - DNA, 22 bp, Homo sapiens
tgaaggtgacctgacagtggct

SEQ ID NO: 8135889 - DNA, 22 bp, Homo sapiens
tgaaggtgggaattcaccaggt

SEQ ID NO: 8135890 - DNA, 22 bp, Homo sapiens
tgaaggagctgatgtaaggggt

SEQ ID NO: 8135891 - DNA, 19 bp, Homo sapiens
tgaggggctcacagtctca

SEQ ID NO: 8135892 - DNA, 22 bp, Homo sapiens
tgaggggcagagaggtgtccag

SEQ ID NO: 8135893 - DNA, 22 bp, Homo sapiens
tgaggggcatgtgtttacacat

SEQ ID NO: 8135894 - DNA, 22 bp, Homo sapiens
tgaggggccagaccccacctag

SEQ ID NO: 8135895 - DNA, 22 bp, Homo sapiens
tgaggggccgcccaagcacttc

SEQ ID NO: 8135896 - DNA, 22 bp, Homo sapiens
tgaggggcggcctgcagaggcc

SEQ ID NO: 8135897 - DNA, 22 bp, Homo sapiens
tgaggggcgctggcaggttcct

SEQ ID NO: 8135898 - DNA, 22 bp, Homo sapiens
tgagggtgtgcggcccagacag

SEQ ID NO: 8135899 - DNA, 22 bp, Homo sapiens
tgagggtgggcctgcaggaaga

SEQ ID NO: 8135900 - DNA, 22 bp, Homo sapiens
tgagggtggcacaggcacaaag

SEQ ID NO: 8135901 - DNA, 22 bp, Homo sapiens
tgaggtggttactgtggtgctc

SEQ ID NO: 8135902 - DNA, 22 bp, Homo sapiens
tgaggtggctggatctcagcct

SEQ ID NO: 8135903 - DNA, 22 bp, Homo sapiens
tgaggctgccttgggaagaggg

SEQ ID NO: 8135904 - DNA, 22 bp, Homo sapiens
tgaggctggcaaggctggtatt

SEQ ID NO: 8135905 - DNA, 22 bp, Homo sapiens
tgaggctgttctaccagggcca

SEQ ID NO: 8135906 - DNA, 22 bp, Homo sapiens
tgaggcaggagaatcaccggaa

SEQ ID NO: 8135907 - DNA, 22 bp, Homo sapiens
tgaggaagggtgtgacggcacc

SEQ ID NO: 8135908 - DNA, 22 bp, Homo sapiens
tgaggagaaatgctcagagcca

SEQ ID NO: 8135909 - DNA, 22 bp, Homo sapiens
tgaggaaatatggtgaactctt

SEQ ID NO: 8135910 - DNA, 22 bp, Homo sapiens
tgaggaaattgaggctcacaga

SEQ ID NO: 8135911 - DNA, 22 bp, Homo sapiens
tgaggatggcagtgtgctcagc

SEQ ID NO: 8135912 - DNA, 22 bp, Homo sapiens
tgaggaggtgggcacacagagt

SEQ ID NO: 8135913 - DNA, 22 bp, Homo sapiens
tgaggagcttctggaaagtgca

SEQ ID NO: 8135914 - DNA, 19 bp, Homo sapiens
tgaggagcagctggttgat

SEQ ID NO: 8135915 - DNA, 23 bp, Homo sapiens
tgaggagcatagctgactgacag

SEQ ID NO: 8135916 - DNA, 22 bp, Homo sapiens
tgaggaggcccaggttggggct

SEQ ID NO: 8135917 - DNA, 22 bp, Homo sapiens
tgaggaggtcagagtctggctg

SEQ ID NO: 8135918 - DNA, 22 bp, Homo sapiens
tgaggccaggatcccaggctct

SEQ ID NO: 8135919 - DNA, 22 bp, Homo sapiens
tgaggccctctgggctggtcct

SEQ ID NO: 8135920 - DNA, 22 bp, Homo sapiens
tgaggccagcttcagcagtgga

SEQ ID NO: 8135921 - DNA, 22 bp, Homo sapiens
tgaggccaggacccccagcagg

SEQ ID NO: 8135922 - DNA, 22 bp, Homo sapiens
tgaggccacttccccacagccc

SEQ ID NO: 8135923 - DNA, 22 bp, Homo sapiens
tgaggccacagtatcagaacag

SEQ ID NO: 8135924 - DNA, 21 bp, Homo sapiens
tgaggccaatagcccctggac

SEQ ID NO: 8135925 - DNA, 22 bp, Homo sapiens
tgaggcaggagaatggcgggaa

SEQ ID NO: 8135926 - DNA, 22 bp, Homo sapiens
tgaggccaagcctcctctgcca

SEQ ID NO: 8135927 - DNA, 19 bp, Homo sapiens
tgaggccaaggtcacagat

SEQ ID NO: 8135928 - DNA, 22 bp, Homo sapiens
tgaggcagttgagcttcctgag

SEQ ID NO: 8135929 - DNA, 22 bp, Homo sapiens
tgagaggaacaggcagtaggtt

SEQ ID NO: 8135930 - DNA, 22 bp, Homo sapiens
tgagaggatattttgggaggat

SEQ ID NO: 8135931 - DNA, 22 bp, Homo sapiens
tgagagcctgtgttcaaatgcc

SEQ ID NO: 8135932 - DNA, 21 bp, Homo sapiens
tgagagagtagcaggacatat

SEQ ID NO: 8135933 - DNA, 22 bp, Homo sapiens
tgagagaggatgccctcatatt

SEQ ID NO: 8135934 - DNA, 22 bp, Homo sapiens
tgagagagcgcctgggatcatt

SEQ ID NO: 8135935 - DNA, 22 bp, Homo sapiens
tgagatgtaaggtatgcttact

SEQ ID NO: 8135936 - DNA, 20 bp, Homo sapiens
tgagatttgtattataagtc

SEQ ID NO: 8135937 - DNA, 22 bp, Homo sapiens
tgagaacatttgcagggagagt

SEQ ID NO: 8135938 - DNA, 22 bp, Homo sapiens
tgagaacagttggaagcagtca

SEQ ID NO: 8135939 - DNA, 22 bp, Homo sapiens
tgagaacatacaaacagagaaa

SEQ ID NO: 8135940 - DNA, 22 bp, Homo sapiens
tgagaacatacaaacagagaaa

SEQ ID NO: 8135941 - DNA, 22 bp, Homo sapiens
tgagaacattgggaaagctatg

SEQ ID NO: 8135942 - DNA, 22 bp, Homo sapiens
tgagaaatattgcacagtgagg

SEQ ID NO: 8135943 - DNA, 20 bp, Homo sapiens
tgagaaagtagagactcagg

SEQ ID NO: 8135944 - DNA, 22 bp, Homo sapiens
tgagaaaggtatttcatgcact

SEQ ID NO: 8135945 - DNA, 22 bp, Homo sapiens
tgagaaaagtgtggaggtcaat

SEQ ID NO: 8135946 - DNA, 22 bp, Homo sapiens
tgagaaaattactataattgtc

SEQ ID NO: 8135947 - DNA, 22 bp, Homo sapiens
tgagaaaatccagaggctagtt

SEQ ID NO: 8135948 - DNA, 22 bp, Homo sapiens
tgagaaagacagacattcctaa

SEQ ID NO: 8135949 - DNA, 22 bp, Homo sapiens
tgagaaagcctttagtcccagg

SEQ ID NO: 8135950 - DNA, 22 bp, Homo sapiens
tgagacagcagtcagggaaata

SEQ ID NO: 8135951 - DNA, 19 bp, Homo sapiens
tgagacagggattcaggtg

SEQ ID NO: 8135952 - DNA, 22 bp, Homo sapiens
tgagacagtcaccaggcaggcc

SEQ ID NO: 8135953 - DNA, 17 bp, Homo sapiens
tgagacagggcaggccc

SEQ ID NO: 8135954 - DNA, 22 bp, Homo sapiens
tgagcaggcgcagcaggaggtc

SEQ ID NO: 8135955 - DNA, 22 bp, Homo sapiens
tgagcaggattcgcctcttgca

SEQ ID NO: 8135956 - DNA, 22 bp, Homo sapiens
tgagcaggactgaccggcctta

SEQ ID NO: 8135957 - DNA, 22 bp, Homo sapiens
tgagcagggagctgggctgagc

SEQ ID NO: 8135958 - DNA, 22 bp, Homo sapiens
tgagcagggactttggagtctg

SEQ ID NO: 8135959 - DNA, 22 bp, Homo sapiens
tgaggaaactgaggcacagatg

SEQ ID NO: 8135960 - DNA, 22 bp, Homo sapiens
tgaggaaaatgtcttatagatt

SEQ ID NO: 8135961 - DNA, 22 bp, Homo sapiens
tgaggaaaacgtattgaaagga

SEQ ID NO: 8135962 - DNA, 22 bp, Homo sapiens
tgagccaggttaagacaggagc

SEQ ID NO: 8135963 - DNA, 23 bp, Homo sapiens
tgcatcctcatttttcacacgag

SEQ ID NO: 8135964 - DNA, 22 bp, Homo sapiens
tgcataaaaaccacatacaagg

SEQ ID NO: 8135965 - DNA, 21 bp, Homo sapiens
tgcataaagaaatacaaatac

SEQ ID NO: 8135966 - DNA, 22 bp, Homo sapiens
tgcataaagtgccatagtatta

SEQ ID NO: 8135967 - DNA, 22 bp, Homo sapiens
tgcatgaaatattttctgtagg

SEQ ID NO: 8135968 - DNA, 22 bp, Homo sapiens
tgccaaatttgtatcttaagga

SEQ ID NO: 8135969 - DNA, 22 bp, Homo sapiens
tgccagccaggttctgaggcta

SEQ ID NO: 8135970 - DNA, 22 bp, Homo sapiens
tgcagggaaaacccaggatgct

SEQ ID NO: 8135971 - DNA, 20 bp, Homo sapiens
tgcagggctgcctcccagct

SEQ ID NO: 8135972 - DNA, 19 bp, Homo sapiens
tgcagggctgcgcctgggg

SEQ ID NO: 8135973 - DNA, 23 bp, Homo sapiens
tgcaggggaggcttaaagcaggt

SEQ ID NO: 8135974 - DNA, 22 bp, Homo sapiens
tgcagtgggccggaggccaggg

SEQ ID NO: 8135975 - DNA, 22 bp, Homo sapiens
tgcctcagctgaggccgctcca

SEQ ID NO: 8135976 - DNA, 19 bp, Homo sapiens
tgcctggagcataacaggc

SEQ ID NO: 8135977 - DNA, 22 bp, Homo sapiens
tgccctgcttggtttattttca

SEQ ID NO: 8135978 - DNA, 22 bp, Homo sapiens
tgccctgcttctcttgggacag

SEQ ID NO: 8135979 - DNA, 22 bp, Homo sapiens
tgccctgctgtgcctggagcca

SEQ ID NO: 8135980 - DNA, 22 bp, Homo sapiens
tgccctgctgtggctctgccca

SEQ ID NO: 8135981 - DNA, 19 bp, Homo sapiens
tgccctgcacgctgtcctg

SEQ ID NO: 8135982 - DNA, 22 bp, Homo sapiens
tgccctgcagaccctgcagtgt

SEQ ID NO: 8135983 - DNA, 22 bp, Homo sapiens
tgccctgcagtgagtgcgtctg

SEQ ID NO: 8135984 - DNA, 22 bp, Homo sapiens
tgccctgcctgagagacagtaa

SEQ ID NO: 8135985 - DNA, 19 bp, Homo sapiens
tgccctgcccgcagccttg

SEQ ID NO: 8135986 - DNA, 22 bp, Homo sapiens
tgccctgcccttgctatttcta

SEQ ID NO: 8135987 - DNA, 22 bp, Homo sapiens
tgccctgctaaccttggttcca

SEQ ID NO: 8135988 - DNA, 22 bp, Homo sapiens
tgccctgctaaatataggtagc

SEQ ID NO: 8135989 - DNA, 22 bp, Homo sapiens
tgccctgcggctatctagatga

SEQ ID NO: 8135990 - DNA, 22 bp, Homo sapiens
tgccctgcatgcagggagctgt

SEQ ID NO: 8135991 - DNA, 22 bp, Homo sapiens
tgccctgccaagaccaagtggt

SEQ ID NO: 8135992 - DNA, 22 bp, Homo sapiens
tgccctgccaagactcagtggt

SEQ ID NO: 8135993 - DNA, 22 bp, Homo sapiens
tgccctgcccatctaccctgtc

SEQ ID NO: 8135994 - DNA, 22 bp, Homo sapiens
tgccctgccaagactgagtggt

SEQ ID NO: 8135995 - DNA, 19 bp, Homo sapiens
tgcccaggcctcccaaaag

SEQ ID NO: 8135996 - DNA, 22 bp, Homo sapiens
tgcccaggattgtgaggtcagg

SEQ ID NO: 8135997 - DNA, 22 bp, Homo sapiens
tgcccagggtggagtgcagcgg

SEQ ID NO: 8135998 - DNA, 22 bp, Homo sapiens
tgcccaagtgtttggctgagtc

SEQ ID NO: 8135999 - DNA, 20 bp, Homo sapiens
tgcccacaattcacaatgcc

SEQ ID NO: 8136000 - DNA, 22 bp, Homo sapiens
tgcccacagctcagggctgctc

SEQ ID NO: 8136001 - DNA, 21 bp, Homo sapiens
tgcccacagcaaatgcagagg

SEQ ID NO: 8136002 - DNA, 22 bp, Homo sapiens
tgcccacaggaagacaccagcg

SEQ ID NO: 8136003 - DNA, 22 bp, Homo sapiens
tgcccagcactgtgccagtcac

SEQ ID NO: 8136004 - DNA, 20 bp, Homo sapiens
tgcccagcaagagtgcagtt

SEQ ID NO: 8136005 - DNA, 22 bp, Homo sapiens
tgccaggcttagagcaggggct

SEQ ID NO: 8136006 - DNA, 20 bp, Homo sapiens
tgccaggcacggagtgcatg

SEQ ID NO: 8136007 - DNA, 18 bp, Homo sapiens
tgccagccgactggcctg

SEQ ID NO: 8136008 - DNA, 22 bp, Homo sapiens
tgccaggctaagtggaggactt

SEQ ID NO: 8136009 - DNA, 22 bp, Homo sapiens
tgccaggccaatgaaggcaggg

SEQ ID NO: 8136010 - DNA, 22 bp, Homo sapiens
tgagtgggacctgcgtgtgtca

SEQ ID NO: 8136011 - DNA, 22 bp, Homo sapiens
tgagtgtgctaggtgtctcggt

SEQ ID NO: 8136012 - DNA, 22 bp, Homo sapiens
tgagtgtggggaatgtcatgag

SEQ ID NO: 8136013 - DNA, 22 bp, Homo sapiens
tgagtgtgtattatgtatcagg

SEQ ID NO: 8136014 - DNA, 19 bp, Homo sapiens
tgagtgggcccctgcagac

SEQ ID NO: 8136015 - DNA, 23 bp, Homo sapiens
tgagtgtgttccctgtgagattt

SEQ ID NO: 8136016 - DNA, 22 bp, Homo sapiens
tgatatgtgaagctattagttc

SEQ ID NO: 8136017 - DNA, 22 bp, Homo sapiens
tgatatttgctgactgcattgt

SEQ ID NO: 8136018 - DNA, 22 bp, Homo sapiens
tgatatgtaactactccttata

SEQ ID NO: 8136019 - DNA, 22 bp, Homo sapiens
tgatatcagctggcagcagtgg

SEQ ID NO: 8136020 - DNA, 22 bp, Homo sapiens
tgatgcatcattttcataaatt

SEQ ID NO: 8136021 - DNA, 22 bp, Homo sapiens
tgatgatttgaaaccagtttct

SEQ ID NO: 8136022 - DNA, 22 bp, Homo sapiens
tgatggaaatattgacaccaca

SEQ ID NO: 8136023 - DNA, 22 bp, Homo sapiens
tgattaaaggtggaaggcaggt

SEQ ID NO: 8136024 - DNA, 22 bp, Homo sapiens
tgatgtgtgattcattctcaaa

SEQ ID NO: 8136025 - DNA, 23 bp, Homo sapiens
tgattcagaaggttgttattgct

SEQ ID NO: 8136026 - DNA, 22 bp, Homo sapiens
tgattctttctccaccaattca

SEQ ID NO: 8136027 - DNA, 21 bp, Homo sapiens
tgattctgttttatcatcagc

SEQ ID NO: 8136028 - DNA, 22 bp, Homo sapiens
tgattctgtctccttcactccg

SEQ ID NO: 8136029 - DNA, 22 bp, Homo sapiens
tgattctgttctccttgagaat

SEQ ID NO: 8136030 - DNA, 22 bp, Homo sapiens
tgcacacagccagtgagtggca

SEQ ID NO: 8136031 - DNA, 22 bp, Homo sapiens
tgcacacaggtctaggacatgg

SEQ ID NO: 8136032 - DNA, 22 bp, Homo sapiens
tgcacacacacgtagagaaaag

SEQ ID NO: 8136033 - DNA, 22 bp, Homo sapiens
tgcacacacatgaagtagcatg

SEQ ID NO: 8136034 - DNA, 22 bp, Homo sapiens
tgcacacacatgcagagggaga

SEQ ID NO: 8136035 - DNA, 22 bp, Homo sapiens
tgcacacacggagataggcttt

SEQ ID NO: 8136036 - DNA, 22 bp, Homo sapiens
tgcaatgaattacttcccaaac

SEQ ID NO: 8136037 - DNA, 22 bp, Homo sapiens
tgcacacaagttggagaatgaa

SEQ ID NO: 8136038 - DNA, 22 bp, Homo sapiens
tgcaactggaagggttatgtgg

SEQ ID NO: 8136039 - DNA, 22 bp, Homo sapiens
tgcaagaaacatattccacaag

SEQ ID NO: 8136040 - DNA, 22 bp, Homo sapiens
tgattttattggtgaggaaatt

SEQ ID NO: 8136041 - DNA, 22 bp, Homo sapiens
tgcaaactgggacactattcaa

SEQ ID NO: 8136042 - DNA, 22 bp, Homo sapiens
tgcaaactgggatactattcaa

SEQ ID NO: 8136043 - DNA, 22 bp, Homo sapiens
tgcacacagttctcaggaaaga

SEQ ID NO: 8136044 - DNA, 22 bp, Homo sapiens
tgcacatttgttattttgaggt

SEQ ID NO: 8136045 - DNA, 22 bp, Homo sapiens
tgcacattgaatgagcaaactg

SEQ ID NO: 8136046 - DNA, 22 bp, Homo sapiens
tgcacattgaaatgaccagctg

SEQ ID NO: 8136047 - DNA, 22 bp, Homo sapiens
tgcacattcacttaggtattgt

SEQ ID NO: 8136048 - DNA, 22 bp, Homo sapiens
tgcacattagtgtttgagatgc

SEQ ID NO: 8136049 - DNA, 22 bp, Homo sapiens
tgcacagttcgccttctccaag

SEQ ID NO: 8136050 - DNA, 20 bp, Homo sapiens
tgcagcagaagcccatgctc

SEQ ID NO: 8136051 - DNA, 19 bp, Homo sapiens
tgcagagggtaggaaggcc

SEQ ID NO: 8136052 - DNA, 22 bp, Homo sapiens
tgcagagggagtgacggttcac

SEQ ID NO: 8136053 - DNA, 23 bp, Homo sapiens
tgcagagggactgaagccagctt

SEQ ID NO: 8136054 - DNA, 22 bp, Homo sapiens
tgcagagggaaaaggtgctcct

SEQ ID NO: 8136055 - DNA, 22 bp, Homo sapiens
tgcagaggagctggaaggctgg

SEQ ID NO: 8136056 - DNA, 22 bp, Homo sapiens
tgcagaggagtcagcctgggca

SEQ ID NO: 8136057 - DNA, 22 bp, Homo sapiens
tgcagaggcatttattgatgta

SEQ ID NO: 8136058 - DNA, 22 bp, Homo sapiens
tgcagaggcgccgtgggtgggg

SEQ ID NO: 8136059 - DNA, 22 bp, Homo sapiens
tgcagagaaaccagtggaggac

SEQ ID NO: 8136060 - DNA, 22 bp, Homo sapiens
tgcagcaggagccaggcctggt

SEQ ID NO: 8136061 - DNA, 22 bp, Homo sapiens
tgcagcagaatatggctgcagg

SEQ ID NO: 8136062 - DNA, 22 bp, Homo sapiens
tgcagcagagtgggcctgggtg

SEQ ID NO: 8136063 - DNA, 22 bp, Homo sapiens
tgcagcctagacattctggtca

SEQ ID NO: 8136064 - DNA, 22 bp, Homo sapiens
tgcagcctggtggtcactggag

SEQ ID NO: 8136065 - DNA, 18 bp, Homo sapiens
tgcagcctgtagtcttgt

SEQ ID NO: 8136066 - DNA, 22 bp, Homo sapiens
tgcagcctggcttcgcgcctcc

SEQ ID NO: 8136067 - DNA, 21 bp, Homo sapiens
tgcagcctctgcccagcagtg

SEQ ID NO: 8136068 - DNA, 22 bp, Homo sapiens
tgcagcctctctgcttcaggaa

SEQ ID NO: 8136069 - DNA, 22 bp, Homo sapiens
tgcagccttggcaaccagggac

SEQ ID NO: 8136070 - DNA, 18 bp, Homo sapiens
tgcaggagtgaccccggc

SEQ ID NO: 8136071 - DNA, 22 bp, Homo sapiens
tgcaggagagctggtctggccc

SEQ ID NO: 8136072 - DNA, 22 bp, Homo sapiens
tgcaggagcagagatggctgga

SEQ ID NO: 8136073 - DNA, 22 bp, Homo sapiens
tgcagcttatctctttggcagt

SEQ ID NO: 8136074 - DNA, 19 bp, Homo sapiens
tcctgggctgggccaggtc

SEQ ID NO: 8136075 - DNA, 22 bp, Homo sapiens
tcctggggagggttctggctcc

SEQ ID NO: 8136076 - DNA, 19 bp, Homo sapiens
tcctggggatgtggtcacc

SEQ ID NO: 8136077 - DNA, 16 bp, Homo sapiens
tcctggggatactgga

SEQ ID NO: 8136078 - DNA, 22 bp, Homo sapiens
tcctggggaggtcgaggctgag

SEQ ID NO: 8136079 - DNA, 22 bp, Homo sapiens
tcctggggccaggcacctctgg

SEQ ID NO: 8136080 - DNA, 22 bp, Homo sapiens
tcctggggctcatgggatttgt

SEQ ID NO: 8136081 - DNA, 22 bp, Homo sapiens
tcctggggccagcactggtgga

SEQ ID NO: 8136082 - DNA, 22 bp, Homo sapiens
tcctggggctctttgatgtgat

SEQ ID NO: 8136083 - DNA, 22 bp, Homo sapiens
tcctggggctctgagcgagaca

SEQ ID NO: 8136084 - DNA, 21 bp, Homo sapiens
tcctggggggtaggtgagttt

SEQ ID NO: 8136085 - DNA, 22 bp, Homo sapiens
tcctggggctgcaaggcctgtc

SEQ ID NO: 8136086 - DNA, 22 bp, Homo sapiens
tcctggggtgtgttttgctgct

SEQ ID NO: 8136087 - DNA, 20 bp, Homo sapiens
tcctggggtaagccatggtc

SEQ ID NO: 8136088 - DNA, 22 bp, Homo sapiens
tcctggggtcctgactgcttcc

SEQ ID NO: 8136089 - DNA, 22 bp, Homo sapiens
tcctggggttttggccgcagct

SEQ ID NO: 8136090 - DNA, 22 bp, Homo sapiens
tcctggggtttagagggaagtg

SEQ ID NO: 8136091 - DNA, 22 bp, Homo sapiens
tcctgtctaaagacctgcaggc

SEQ ID NO: 8136092 - DNA, 21 bp, Homo sapiens
taagaacattatcttcttcct

SEQ ID NO: 8136093 - DNA, 22 bp, Homo sapiens
taagaacagtgtctgtctcaca

SEQ ID NO: 8136094 - DNA, 22 bp, Homo sapiens
taagaacataaattcatacggg

SEQ ID NO: 8136095 - DNA, 21 bp, Homo sapiens
taagaacattatcttcttcct

SEQ ID NO: 8136096 - DNA, 22 bp, Homo sapiens
taagaacagataaagtttcccc

SEQ ID NO: 8136097 - DNA, 23 bp, Homo sapiens
taagaacagacaagcatttacat

SEQ ID NO: 8136098 - DNA, 22 bp, Homo sapiens
tcctgcttgaaactctgccttc

SEQ ID NO: 8136099 - DNA, 22 bp, Homo sapiens
taagacaaatactatttcaaga

SEQ ID NO: 8136100 - DNA, 22 bp, Homo sapiens
taagaatgactaccaaactgga

SEQ ID NO: 8136101 - DNA, 19 bp, Homo sapiens
tcgtggggaggtgggcagc

SEQ ID NO: 8136102 - DNA, 22 bp, Homo sapiens
tcgtgaggctctgcatcgcaca

SEQ ID NO: 8136103 - DNA, 22 bp, Homo sapiens
tctaaagatttggattcatttg

SEQ ID NO: 8136104 - DNA, 23 bp, Homo sapiens
tctaaaattcatcatttacgttc

SEQ ID NO: 8136105 - DNA, 22 bp, Homo sapiens
tctaaaagagggaggagagcct

SEQ ID NO: 8136106 - DNA, 22 bp, Homo sapiens
tccttttccctgaaggtattta

SEQ ID NO: 8136107 - DNA, 22 bp, Homo sapiens
tccttggctagtactggccagc

SEQ ID NO: 8136108 - DNA, 22 bp, Homo sapiens
tccttcagggggccgcctgcac

SEQ ID NO: 8136109 - DNA, 19 bp, Homo sapiens
tccttctccggccaccccg

SEQ ID NO: 8136110 - DNA, 22 bp, Homo sapiens
tccttacatagtgctgaaatat

SEQ ID NO: 8136111 - DNA, 19 bp, Homo sapiens
tctcacagctctactatgt

SEQ ID NO: 8136112 - DNA, 22 bp, Homo sapiens
tctattttgtttccagctctac

SEQ ID NO: 8136113 - DNA, 22 bp, Homo sapiens
tctattttatactcaaatcttc

SEQ ID NO: 8136114 - DNA, 22 bp, Homo sapiens
tctatgaattccatttcacgat

SEQ ID NO: 8136115 - DNA, 22 bp, Homo sapiens
tctatgaagtgcaattaactgt

SEQ ID NO: 8136116 - DNA, 22 bp, Homo sapiens
tctatattttgaaaggtattta

SEQ ID NO: 8136117 - DNA, 21 bp, Homo sapiens
tctatgtacgcatctatgcct

SEQ ID NO: 8136118 - DNA, 22 bp, Homo sapiens
tctatgtatatctttccattca

SEQ ID NO: 8136119 - DNA, 22 bp, Homo sapiens
tctattatggtacttatcatga

SEQ ID NO: 8136120 - DNA, 22 bp, Homo sapiens
tctagggttgaggccacaggga

SEQ ID NO: 8136121 - DNA, 22 bp, Homo sapiens
tctataaagggccagatagtag

SEQ ID NO: 8136122 - DNA, 22 bp, Homo sapiens
tctacaaaggttgaggtgccct

SEQ ID NO: 8136123 - DNA, 19 bp, Homo sapiens
tctaacagctttcattcta

SEQ ID NO: 8136124 - DNA, 22 bp, Homo sapiens
tctacaaactaaggagggtaat

SEQ ID NO: 8136125 - DNA, 22 bp, Homo sapiens
tctagaaaaccaatattacatg

SEQ ID NO: 8136126 - DNA, 19 bp, Homo sapiens
tctaggagatctgaacctt

SEQ ID NO: 8136127 - DNA, 22 bp, Homo sapiens
tctctcctgcactgaattatgt

SEQ ID NO: 8136128 - DNA, 22 bp, Homo sapiens
tctctcctgtgttctgatgttt

SEQ ID NO: 8136129 - DNA, 21 bp, Homo sapiens
tctctcctcaagctcgacccc

SEQ ID NO: 8136130 - DNA, 19 bp, Homo sapiens
tctcttctccctggtttta

SEQ ID NO: 8136131 - DNA, 20 bp, Homo sapiens
tctgaacacaatatatcccc

SEQ ID NO: 8136132 - DNA, 21 bp, Homo sapiens
tctgaacaacatacgaatctt

SEQ ID NO: 8136133 - DNA, 22 bp, Homo sapiens
tctgaacatggcttcctcttca

SEQ ID NO: 8136134 - DNA, 22 bp, Homo sapiens
tctgaacattttttgcagccta

SEQ ID NO: 8136135 - DNA, 22 bp, Homo sapiens
tctgaacatgatgtcatctgga

SEQ ID NO: 8136136 - DNA, 22 bp, Homo sapiens
tctgaacagaaaagatgcacaa

SEQ ID NO: 8136137 - DNA, 22 bp, Homo sapiens
tctgaacagcatggaatcattt

SEQ ID NO: 8136138 - DNA, 22 bp, Homo sapiens
tctgaaatgcaggcaatttgct

SEQ ID NO: 8136139 - DNA, 22 bp, Homo sapiens
tctgaaatagaagtgtctttct

SEQ ID NO: 8136140 - DNA, 18 bp, Homo sapiens
tctctttcctcagtggag

SEQ ID NO: 8136141 - DNA, 17 bp, Homo sapiens
tctctttccctttctgc

SEQ ID NO: 8136142 - DNA, 22 bp, Homo sapiens
tctctttctttgtatgtctatt

SEQ ID NO: 8136143 - DNA, 21 bp, Homo sapiens
tctctttctggaagcttccct

SEQ ID NO: 8136144 - DNA, 22 bp, Homo sapiens
tctgaaaatgttgactttgttt

SEQ ID NO: 8136145 - DNA, 22 bp, Homo sapiens
tctgaaataaatgcactgttag

SEQ ID NO: 8136146 - DNA, 23 bp, Homo sapiens
tctgaaagggatgctgggcagga

SEQ ID NO: 8136147 - DNA, 22 bp, Homo sapiens
tctcacagttgtccactgaaaa

SEQ ID NO: 8136148 - DNA, 22 bp, Homo sapiens
tctcagagaggggccgggcctt

SEQ ID NO: 8136149 - DNA, 18 bp, Homo sapiens
tctcagcccagctccggc

SEQ ID NO: 8136150 - DNA, 22 bp, Homo sapiens
tctcagagtttagagctgagcc

SEQ ID NO: 8136151 - DNA, 22 bp, Homo sapiens
tctcagcagccagatccagagc

SEQ ID NO: 8136152 - DNA, 22 bp, Homo sapiens
tctcagcagggccatcctgagc

SEQ ID NO: 8136153 - DNA, 22 bp, Homo sapiens
tctcagcacgttgttttcattg

SEQ ID NO: 8136154 - DNA, 22 bp, Homo sapiens
tctcatgctgtagtgcactaac

SEQ ID NO: 8136155 - DNA, 22 bp, Homo sapiens
tctcatgccctgtttttggttg

SEQ ID NO: 8136156 - DNA, 22 bp, Homo sapiens
tctcatcattccttcaaagccc

SEQ ID NO: 8136157 - DNA, 22 bp, Homo sapiens
tctcattttgagtcagacacta

SEQ ID NO: 8136158 - DNA, 22 bp, Homo sapiens
tctcatttgtgtgcaattcaga

SEQ ID NO: 8136159 - DNA, 23 bp, Homo sapiens
tctcatttcccttgatctatctt

SEQ ID NO: 8136160 - DNA, 22 bp, Homo sapiens
tctcatttgcctcatctataaa

SEQ ID NO: 8136161 - DNA, 22 bp, Homo sapiens
tctcatttggctttgttttaaa

SEQ ID NO: 8136162 - DNA, 22 bp, Homo sapiens
tctcatttgcctcatctataaa

SEQ ID NO: 8136163 - DNA, 22 bp, Homo sapiens
tctcattcataccctacatgct

SEQ ID NO: 8136164 - DNA, 22 bp, Homo sapiens
tctcctcccaggctcttccagg

SEQ ID NO: 8136165 - DNA, 22 bp, Homo sapiens
tctcctgtgcaccctccctgtg

SEQ ID NO: 8136166 - DNA, 22 bp, Homo sapiens
tctcctgtcttctcagcacccc

SEQ ID NO: 8136167 - DNA, 22 bp, Homo sapiens
tctcctttaagatttcctcagg

SEQ ID NO: 8136168 - DNA, 22 bp, Homo sapiens
tctccaggtaaatggcatcctg

SEQ ID NO: 8136169 - DNA, 22 bp, Homo sapiens
tctgggagagcacgtggctgac

SEQ ID NO: 8136170 - DNA, 22 bp, Homo sapiens
tctgggagtgtgtctggccatc

SEQ ID NO: 8136171 - DNA, 22 bp, Homo sapiens
tctgggaggtggcagggtgcat

SEQ ID NO: 8136172 - DNA, 22 bp, Homo sapiens
tctgggagtttctgtgggagct

SEQ ID NO: 8136173 - DNA, 22 bp, Homo sapiens
tctggctcctgagtccatgctc

SEQ ID NO: 8136174 - DNA, 22 bp, Homo sapiens
tctggcttttctcttggatggt

SEQ ID NO: 8136175 - DNA, 22 bp, Homo sapiens
tctggctggcagtgatggtgtg

SEQ ID NO: 8136176 - DNA, 22 bp, Homo sapiens
tctggctggctcggccgggagt

SEQ ID NO: 8136177 - DNA, 22 bp, Homo sapiens
tctggctgtgtaaggtagcacc

SEQ ID NO: 8136178 - DNA, 22 bp, Homo sapiens
tctggctgtcattggaggcccc

SEQ ID NO: 8136179 - DNA, 22 bp, Homo sapiens
tctgctggccttagcaggtcta

SEQ ID NO: 8136180 - DNA, 22 bp, Homo sapiens
tctgctgtgaggaggcaggatg

SEQ ID NO: 8136181 - DNA, 22 bp, Homo sapiens
tctgctctgtggcttcagctaa

SEQ ID NO: 8136182 - DNA, 22 bp, Homo sapiens
tctgctgcctgcagggcagaga

SEQ ID NO: 8136183 - DNA, 22 bp, Homo sapiens
tctggacaggggcgctttgggg

SEQ ID NO: 8136184 - DNA, 22 bp, Homo sapiens
tctggacagtagagcaatgatt

SEQ ID NO: 8136185 - DNA, 22 bp, Homo sapiens
tctggacatcctggagaatgac

SEQ ID NO: 8136186 - DNA, 22 bp, Homo sapiens
tctggactataggctgccaagt

SEQ ID NO: 8136187 - DNA, 22 bp, Homo sapiens
tctggattgtggctattgttct

SEQ ID NO: 8136188 - DNA, 22 bp, Homo sapiens
tctgacagtgtgaatattgact

SEQ ID NO: 8136189 - DNA, 22 bp, Homo sapiens
tctgacaggtcattttctatag

SEQ ID NO: 8136190 - DNA, 22 bp, Homo sapiens
tctgacagggccaaacatgaca

SEQ ID NO: 8136191 - DNA, 22 bp, Homo sapiens
tctgacaagtcaagtcttgact

SEQ ID NO: 8136192 - DNA, 22 bp, Homo sapiens
tctgagacccatacaggcccac

SEQ ID NO: 8136193 - DNA, 22 bp, Homo sapiens
tctgagcagctttgttttgtgt

SEQ ID NO: 8136194 - DNA, 22 bp, Homo sapiens
tctgagcagggcagtgtccatg

SEQ ID NO: 8136195 - DNA, 22 bp, Homo sapiens
tctgagctgcccctttactttg

SEQ ID NO: 8136196 - DNA, 22 bp, Homo sapiens
tctgagctgtggccattcttcc

SEQ ID NO: 8136197 - DNA, 22 bp, Homo sapiens
tctgagggttgtagagagggac

SEQ ID NO: 8136198 - DNA, 18 bp, Homo sapiens
tctgagggtgcgggagct

SEQ ID NO: 8136199 - DNA, 22 bp, Homo sapiens
tctgattacttgagttatttag

SEQ ID NO: 8136200 - DNA, 22 bp, Homo sapiens
tctgatttatatatgcagatac

SEQ ID NO: 8136201 - DNA, 18 bp, Homo sapiens
tctgcccaggacttggac

SEQ ID NO: 8136202 - DNA, 20 bp, Homo sapiens
tctgcccaccccggctccca

SEQ ID NO: 8136203 - DNA, 22 bp, Homo sapiens
tctgcctgcagtgtggcagggc

SEQ ID NO: 8136204 - DNA, 22 bp, Homo sapiens
tctgcctgccagtctggtcctc

SEQ ID NO: 8136205 - DNA, 22 bp, Homo sapiens
tctgcctgagggagctgaggaa

SEQ ID NO: 8136206 - DNA, 22 bp, Homo sapiens
tctgccttccccataatctgat

SEQ ID NO: 8136207 - DNA, 22 bp, Homo sapiens
tctgcctgttcccgattccatg

SEQ ID NO: 8136208 - DNA, 22 bp, Homo sapiens
tctgctcacatggctccatgca

SEQ ID NO: 8136209 - DNA, 22 bp, Homo sapiens
tctgctcagcatccctctgaga

SEQ ID NO: 8136210 - DNA, 22 bp, Homo sapiens
tctgctcagccgatctgctccg

SEQ ID NO: 8136211 - DNA, 22 bp, Homo sapiens
tctgcctggatgatggcagggc

SEQ ID NO: 8136212 - DNA, 22 bp, Homo sapiens
tctgcctgggtgtggagcagag

SEQ ID NO: 8136213 - DNA, 22 bp, Homo sapiens
tctgcctgcggctgcaggtggc

SEQ ID NO: 8136214 - DNA, 22 bp, Homo sapiens
tctgcctgcgctcacggggccg

SEQ ID NO: 8136215 - DNA, 21 bp, Homo sapiens
tctgcccacactggccactgc

SEQ ID NO: 8136216 - DNA, 22 bp, Homo sapiens
tctgcaggtgggcccctagaat

SEQ ID NO: 8136217 - DNA, 22 bp, Homo sapiens
tctgcatggagaggagatgcta

SEQ ID NO: 8136218 - DNA, 22 bp, Homo sapiens
tctgcaggcttataggatgggt

SEQ ID NO: 8136219 - DNA, 17 bp, Homo sapiens
tctgcagggggccgtgt

SEQ ID NO: 8136220 - DNA, 22 bp, Homo sapiens
tctgcagggcccttggctcctg

SEQ ID NO: 8136221 - DNA, 22 bp, Homo sapiens
tctgcagggatgtgaggggtga

SEQ ID NO: 8136222 - DNA, 22 bp, Homo sapiens
tctgcaggatcagagccagagg

SEQ ID NO: 8136223 - DNA, 22 bp, Homo sapiens
tctgcaggaggctggctgcagg

SEQ ID NO: 8136224 - DNA, 22 bp, Homo sapiens
tctgcaggagcagggcgtggag

SEQ ID NO: 8136225 - DNA, 22 bp, Homo sapiens
tctgcaggagagtgccctagag

SEQ ID NO: 8136226 - DNA, 18 bp, Homo sapiens
tctgcaggacctcagggc

SEQ ID NO: 8136227 - DNA, 22 bp, Homo sapiens
tctgcaggactgaggcctgttt

SEQ ID NO: 8136228 - DNA, 22 bp, Homo sapiens
tctgcaggaagctggcggctga

SEQ ID NO: 8136229 - DNA, 22 bp, Homo sapiens
tctgcagctttcccctgattta

SEQ ID NO: 8136230 - DNA, 22 bp, Homo sapiens
tcttgatagagtgctttcagag

SEQ ID NO: 8136231 - DNA, 22 bp, Homo sapiens
tcttgaaagtatcttattttgt

SEQ ID NO: 8136232 - DNA, 22 bp, Homo sapiens
tcttgacattgttgttagcagg

SEQ ID NO: 8136233 - DNA, 22 bp, Homo sapiens
tcttgacattgcaatcttcaga

SEQ ID NO: 8136234 - DNA, 22 bp, Homo sapiens
tctttccttagaataattcttt

SEQ ID NO: 8136235 - DNA, 22 bp, Homo sapiens
tctttctggttatgtatagaga

SEQ ID NO: 8136236 - DNA, 22 bp, Homo sapiens
tcttccagcttctagaggatgc

SEQ ID NO: 8136237 - DNA, 22 bp, Homo sapiens
tcttcctctctaattgatcaga

SEQ ID NO: 8136238 - DNA, 22 bp, Homo sapiens
tcttctccagttcatcctacca

SEQ ID NO: 8136239 - DNA, 22 bp, Homo sapiens
tcttctctacaccagcagcccc

SEQ ID NO: 8136240 - DNA, 22 bp, Homo sapiens
tcttcacaaagctgttgttaaa

SEQ ID NO: 8136241 - DNA, 22 bp, Homo sapiens
tcttcacagatgcatatacttc

SEQ ID NO: 8136242 - DNA, 22 bp, Homo sapiens
tcttcacagctttgtccagaag

SEQ ID NO: 8136243 - DNA, 22 bp, Homo sapiens
tcttcacatcatgttttttaat

SEQ ID NO: 8136244 - DNA, 22 bp, Homo sapiens
tcttcacatgaccttcatgtct

SEQ ID NO: 8136245 - DNA, 22 bp, Homo sapiens
tcttcagatggccagttgtccc

SEQ ID NO: 8136246 - DNA, 22 bp, Homo sapiens
tcttcagattgcactgagcaag

SEQ ID NO: 8136247 - DNA, 22 bp, Homo sapiens
tctgtgacattgaacatctaca

SEQ ID NO: 8136248 - DNA, 19 bp, Homo sapiens
tctgtggagctcagagtag

SEQ ID NO: 8136249 - DNA, 22 bp, Homo sapiens
tctgtgggtttcagggggctgt

SEQ ID NO: 8136250 - DNA, 22 bp, Homo sapiens
tctgtttttgaggctatcttct

SEQ ID NO: 8136251 - DNA, 22 bp, Homo sapiens
tcttaaagcttacttcaattgt

SEQ ID NO: 8136252 - DNA, 22 bp, Homo sapiens
tctgtttaatgggaatgatact

SEQ ID NO: 8136253 - DNA, 22 bp, Homo sapiens
tctgttgtctgcaattctggga

SEQ ID NO: 8136254 - DNA, 22 bp, Homo sapiens
tctgtttatgcatatttaaaac

SEQ ID NO: 8136255 - DNA, 20 bp, Homo sapiens
tctgtgtgccatcacctaac

SEQ ID NO: 8136256 - DNA, 20 bp, Homo sapiens
tctgtacactcatcttctgc

SEQ ID NO: 8136257 - DNA, 22 bp, Homo sapiens
tctgtaatcaagatatttgaga

SEQ ID NO: 8136258 - DNA, 22 bp, Homo sapiens
tctggggcagttactggggcct

SEQ ID NO: 8136259 - DNA, 22 bp, Homo sapiens
tctgggggcgaccagggactgc

SEQ ID NO: 8136260 - DNA, 21 bp, Homo sapiens
tctgggggtgagcctagaaat

SEQ ID NO: 8136261 - DNA, 22 bp, Homo sapiens
tctgggggaggaggcatggccc

SEQ ID NO: 8136262 - DNA, 22 bp, Homo sapiens
tctgtaaaacaatattgtattc

SEQ ID NO: 8136263 - DNA, 22 bp, Homo sapiens
tctgggtgtagggcctggcaac

SEQ ID NO: 8136264 - DNA, 23 bp, Homo sapiens
tctgggttctaatcatgtgtgat

SEQ ID NO: 8136265 - DNA, 22 bp, Homo sapiens
tctgggttgggttcctggaatt

SEQ ID NO: 8136266 - DNA, 22 bp, Homo sapiens
tctgggtgaccctgggcaaggc

SEQ ID NO: 8136267 - DNA, 22 bp, Homo sapiens
tctgggggttaagtgaggacaa

SEQ ID NO: 8136268 - DNA, 22 bp, Homo sapiens
aagcctttgtttgggaagtttt

SEQ ID NO: 8136269 - DNA, 22 bp, Homo sapiens
aagcctttctctctgggaagga

SEQ ID NO: 8136270 - DNA, 22 bp, Homo sapiens
acattgtttgagaatacagatg

SEQ ID NO: 8136271 - DNA, 22 bp, Homo sapiens
agaaatgaaaccaaagcctaga

SEQ ID NO: 8136272 - DNA, 22 bp, Homo sapiens
aatgattggcactagatacaca

SEQ ID NO: 8136273 - DNA, 23 bp, Homo sapiens
aatgatttcatgatgatagcagc

SEQ ID NO: 8136274 - DNA, 22 bp, Homo sapiens
aataccttttcagtgcacaaaa

SEQ ID NO: 8136275 - DNA, 22 bp, Homo sapiens
aataccttccaacatcaagaca

SEQ ID NO: 8136276 - DNA, 22 bp, Homo sapiens
actacacagggatgtgactacc

SEQ ID NO: 8136277 - DNA, 22 bp, Homo sapiens
acgtgcatatgtatacacacat

SEQ ID NO: 8136278 - DNA, 22 bp, Homo sapiens
aatggtttaacatatgcttgag

SEQ ID NO: 8136279 - DNA, 22 bp, Homo sapiens
acaagcttccaggtgatgctga

SEQ ID NO: 8136280 - DNA, 22 bp, Homo sapiens
acaagatgtgtttatacaagct

SEQ ID NO: 8136281 - DNA, 22 bp, Homo sapiens
acaagagattatctacagatga

SEQ ID NO: 8136282 - DNA, 22 bp, Homo sapiens
acaagagtgagattatcatgta

SEQ ID NO: 8136283 - DNA, 22 bp, Homo sapiens
acaagaattatttctagttaac

SEQ ID NO: 8136284 - DNA, 22 bp, Homo sapiens
acaaagtaggtcatcaaagctc

SEQ ID NO: 8136285 - DNA, 22 bp, Homo sapiens
acaaagacgggataaggtttgg

SEQ ID NO: 8136286 - DNA, 22 bp, Homo sapiens
aattgcaacaggtagacttttc

SEQ ID NO: 8136287 - DNA, 22 bp, Homo sapiens
aattgcttagagaatccaggta

SEQ ID NO: 8136288 - DNA, 22 bp, Homo sapiens
acagagactgggatgcctgcct

SEQ ID NO: 8136289 - DNA, 22 bp, Homo sapiens
acagagacttggagcaggctga

SEQ ID NO: 8136290 - DNA, 22 bp, Homo sapiens
acagagactgggagcaagaggc

SEQ ID NO: 8136291 - DNA, 22 bp, Homo sapiens
acagagaccagttacagcgtcc

SEQ ID NO: 8136292 - DNA, 22 bp, Homo sapiens
acagagacaggcagacagtctt

SEQ ID NO: 8136293 - DNA, 22 bp, Homo sapiens
acagagacaaatgttagtagtt

SEQ ID NO: 8136294 - DNA, 22 bp, Homo sapiens
acagagacacggaagctaaaga

SEQ ID NO: 8136295 - DNA, 22 bp, Homo sapiens
acacatgtgattctaagacagc

SEQ ID NO: 8136296 - DNA, 22 bp, Homo sapiens
agcagatgagcctcatgactgg

SEQ ID NO: 8136297 - DNA, 22 bp, Homo sapiens
aaaatgtgatctacaaatgcaa

SEQ ID NO: 8136298 - DNA, 22 bp, Homo sapiens
aaagagctggcatttatagtct

SEQ ID NO: 8136299 - DNA, 22 bp, Homo sapiens
aaaattgaagtgatcaggaact

SEQ ID NO: 8136300 - DNA, 22 bp, Homo sapiens
aaaattgagagtcttgtgcaag

SEQ ID NO: 8136301 - DNA, 22 bp, Homo sapiens
aaaattgagagttatagatggt

SEQ ID NO: 8136302 - DNA, 22 bp, Homo sapiens
aaaattgaggccagtatgccat

SEQ ID NO: 8136303 - DNA, 22 bp, Homo sapiens
aaaattgaggctcatgttaaat

SEQ ID NO: 8136304 - DNA, 22 bp, Homo sapiens
aaaattcatggcttgggaaaag

SEQ ID NO: 8136305 - DNA, 22 bp, Homo sapiens
aaacatgctatgttttggataa

SEQ ID NO: 8136306 - DNA, 22 bp, Homo sapiens
aaacattgacctcatcctggca

SEQ ID NO: 8136307 - DNA, 22 bp, Homo sapiens
aaacattgctaaataatgctgc

SEQ ID NO: 8136308 - DNA, 22 bp, Homo sapiens
aaacatgatgtcatatatgcca

SEQ ID NO: 8136309 - DNA, 22 bp, Homo sapiens
aaagaaatagatggcatttaaa

SEQ ID NO: 8136310 - DNA, 22 bp, Homo sapiens
aaacttctggctacaagcaata

SEQ ID NO: 8136311 - DNA, 22 bp, Homo sapiens
aaacttctctccctactttgtg

SEQ ID NO: 8136312 - DNA, 22 bp, Homo sapiens
aagacctgcacagtttaccatt

SEQ ID NO: 8136313 - DNA, 22 bp, Homo sapiens
aagacctgcatgcggactaaca

SEQ ID NO: 8136314 - DNA, 22 bp, Homo sapiens
aagacctgcagtttctctacct

SEQ ID NO: 8136315 - DNA, 22 bp, Homo sapiens
aagactgtctgggacaagatga

SEQ ID NO: 8136316 - DNA, 22 bp, Homo sapiens
aagactgtatgagacaatataa

SEQ ID NO: 8136317 - DNA, 22 bp, Homo sapiens
aaagtgattatgctgtcaaaga

SEQ ID NO: 8136318 - DNA, 22 bp, Homo sapiens
aagatcaccaagtaacagtctg

SEQ ID NO: 8136319 - DNA, 22 bp, Homo sapiens
aagatcaccttgacatgaaaag

SEQ ID NO: 8136320 - DNA, 22 bp, Homo sapiens
aagatgttgcattagaatacct

SEQ ID NO: 8136321 - DNA, 22 bp, Homo sapiens
aaagccttcttcggtctgtgat

SEQ ID NO: 8136322 - DNA, 22 bp, Homo sapiens
aaagccttgcccgtcactggga

SEQ ID NO: 8136323 - DNA, 22 bp, Homo sapiens
aaagccttgggatttgtgatca

SEQ ID NO: 8136324 - DNA, 22 bp, Homo sapiens
aaagccttggtcatctggttcc

SEQ ID NO: 8136325 - DNA, 22 bp, Homo sapiens
aaagcaagtctctacaaagtac

SEQ ID NO: 8136326 - DNA, 22 bp, Homo sapiens
aaagcactttgagactgacagg

SEQ ID NO: 8136327 - DNA, 22 bp, Homo sapiens
aacactttttagtaaagattga

SEQ ID NO: 8136328 - DNA, 22 bp, Homo sapiens
aacacagacatagtgattacag

SEQ ID NO: 8136329 - DNA, 22 bp, Homo sapiens
aaggaagatatatcaagcttaa

SEQ ID NO: 8136330 - DNA, 22 bp, Homo sapiens
aatacatgttttctactattct

SEQ ID NO: 8136331 - DNA, 22 bp, Homo sapiens
aacatgaaaacctccacagcaa

SEQ ID NO: 8136332 - DNA, 22 bp, Homo sapiens
aatgacaataatcattaacttt

SEQ ID NO: 8136333 - DNA, 22 bp, Homo sapiens
aatgacaatattaatttggagg

SEQ ID NO: 8136334 - DNA, 22 bp, Homo sapiens
aatggccattgggtcatgctag

SEQ ID NO: 8136335 - DNA, 22 bp, Homo sapiens
aatgaatgttttaaggcataaa

SEQ ID NO: 8136336 - DNA, 21 bp, Homo sapiens
aagaaagataattaaggaccc

SEQ ID NO: 8136337 - DNA, 22 bp, Homo sapiens
aagaaagataaggtttgcttgg

SEQ ID NO: 8136338 - DNA, 22 bp, Homo sapiens
aagaaagagatcactcctccat

SEQ ID NO: 8136339 - DNA, 22 bp, Homo sapiens
acacaaagttggatgacaaaat

SEQ ID NO: 8136340 - DNA, 19 bp, Homo sapiens
acaatgttgttggacactc

SEQ ID NO: 8136341 - DNA, 22 bp, Homo sapiens
acaatgttttgaaacatctagg

SEQ ID NO: 8136342 - DNA, 22 bp, Homo sapiens
aagagacaatgtcttttggata

SEQ ID NO: 8136343 - DNA, 22 bp, Homo sapiens
aagagacagagccatgtttcta

SEQ ID NO: 8136344 - DNA, 22 bp, Homo sapiens
aagagaatacaagcaggcagga

SEQ ID NO: 8136345 - DNA, 22 bp, Homo sapiens
aagactttctgtaaagctacag

SEQ ID NO: 8136346 - DNA, 22 bp, Homo sapiens
aagactttccctcatcagaacg

SEQ ID NO: 8136347 - DNA, 22 bp, Homo sapiens
acacatgcacaacagttctttc

SEQ ID NO: 8136348 - DNA, 22 bp, Homo sapiens
acacatgagaaacatcagttgt

SEQ ID NO: 8136349 - DNA, 21 bp, Homo sapiens
acatgagacacacatatatgt

SEQ ID NO: 8136350 - DNA, 22 bp, Homo sapiens
acatgaggtgctataggtctac

SEQ ID NO: 8136351 - DNA, 22 bp, Homo sapiens
acatgcacacgattcagtctgg

SEQ ID NO: 8136352 - DNA, 22 bp, Homo sapiens
accaaacttctgggctcctttg

SEQ ID NO: 8136353 - DNA, 22 bp, Homo sapiens
aggctggatctctgttgccttc

SEQ ID NO: 8136354 - DNA, 22 bp, Homo sapiens
actcaacagggaacaagatcag

SEQ ID NO: 8136355 - DNA, 22 bp, Homo sapiens
actatagatgctggcgaggctg

SEQ ID NO: 8136356 - DNA, 18 bp, Homo sapiens
acctgctgagtctaagca

SEQ ID NO: 8136357 - DNA, 22 bp, Homo sapiens
acctgctgaggagggggaatta

SEQ ID NO: 8136358 - DNA, 22 bp, Homo sapiens
acctgctgtcttgggggaatgc

SEQ ID NO: 8136359 - DNA, 22 bp, Homo sapiens
acctgcttgagccagtatgaga

SEQ ID NO: 8136360 - DNA, 22 bp, Homo sapiens
actccacatttgaacacagttc

SEQ ID NO: 8136361 - DNA, 20 bp, Homo sapiens
atcagcaactgccactcagt

SEQ ID NO: 8136362 - DNA, 22 bp, Homo sapiens
atcaccagtaagttttcagttt

SEQ ID NO: 8136363 - DNA, 22 bp, Homo sapiens
atcactgggcttctaatcactg

SEQ ID NO: 8136364 - DNA, 23 bp, Homo sapiens
acttcatggcactgtcttagagg

SEQ ID NO: 8136365 - DNA, 22 bp, Homo sapiens
acttccaaagaagtgattacag

SEQ ID NO: 8136366 - DNA, 22 bp, Homo sapiens
acttcatgttgtttacaactta

SEQ ID NO: 8136367 - DNA, 22 bp, Homo sapiens
acttggcaggtcaggggatatt

SEQ ID NO: 8136368 - DNA, 17 bp, Homo sapiens
acttcaagttcagtgac

SEQ ID NO: 8136369 - DNA, 22 bp, Homo sapiens
atttaagggatttggagaccaa

SEQ ID NO: 8136370 - DNA, 22 bp, Homo sapiens
attctctgtttccaagatgaaa

SEQ ID NO: 8136371 - DNA, 22 bp, Homo sapiens
atgtttgtccctgacatcctct

SEQ ID NO: 8136372 - DNA, 22 bp, Homo sapiens
atgtttgtcaggattgtaatta

SEQ ID NO: 8136373 - DNA, 22 bp, Homo sapiens
atgtttgtaggtaagtgacact

SEQ ID NO: 8136374 - DNA, 22 bp, Homo sapiens
atgtttgtgttacactctgcag

SEQ ID NO: 8136375 - DNA, 22 bp, Homo sapiens
atgtttgtgggataaacaaatg

SEQ ID NO: 8136376 - DNA, 22 bp, Homo sapiens
atgtttgttgatcatttatgaa

SEQ ID NO: 8136377 - DNA, 22 bp, Homo sapiens
atgtttgttgaatgaagaaagg

SEQ ID NO: 8136378 - DNA, 22 bp, Homo sapiens
atgtttgtgtttcccattcagg

SEQ ID NO: 8136379 - DNA, 22 bp, Homo sapiens
atgtttgtgtttgctatgcggt

SEQ ID NO: 8136380 - DNA, 22 bp, Homo sapiens
atgtttgttgaacatctactgc

SEQ ID NO: 8136381 - DNA, 22 bp, Homo sapiens
attaaagttgaaattgaactga

SEQ ID NO: 8136382 - DNA, 22 bp, Homo sapiens
attagatgtgtttaagtagaga

SEQ ID NO: 8136383 - DNA, 22 bp, Homo sapiens
agaatacatctagtgctgcatg

SEQ ID NO: 8136384 - DNA, 22 bp, Homo sapiens
agaatgataatgccatgatgga

SEQ ID NO: 8136385 - DNA, 22 bp, Homo sapiens
agaatgatactctatgccaaat

SEQ ID NO: 8136386 - DNA, 22 bp, Homo sapiens
agaatgattttggacaatatgg

SEQ ID NO: 8136387 - DNA, 17 bp, Homo sapiens
agaatgcaaagcaggct

SEQ ID NO: 8136388 - DNA, 22 bp, Homo sapiens
agaatgcaaatgatcccacaca

SEQ ID NO: 8136389 - DNA, 22 bp, Homo sapiens
agaatgcagtttgaaataaggt

SEQ ID NO: 8136390 - DNA, 19 bp, Homo sapiens
agacacacttgatatgtgt

SEQ ID NO: 8136391 - DNA, 22 bp, Homo sapiens
agacacaggtgtaatttctgct

SEQ ID NO: 8136392 - DNA, 22 bp, Homo sapiens
atggagttctttaaattcacag

SEQ ID NO: 8136393 - DNA, 22 bp, Homo sapiens
caacttcttggcttcctaatgg

SEQ ID NO: 8136394 - DNA, 22 bp, Homo sapiens
agcagcacacgggagaaagaca

SEQ ID NO: 8136395 - DNA, 22 bp, Homo sapiens
attttctgagtccagaatttac

SEQ ID NO: 8136396 - DNA, 22 bp, Homo sapiens
caaatgttattcattcttgttt

SEQ ID NO: 8136397 - DNA, 22 bp, Homo sapiens
caaatgttgctgtaatgtttgt

SEQ ID NO: 8136398 - DNA, 22 bp, Homo sapiens
caaatgcatagaaagatgaaac

SEQ ID NO: 8136399 - DNA, 22 bp, Homo sapiens
cagcagaggtggttcacattgt

SEQ ID NO: 8136400 - DNA, 22 bp, Homo sapiens
cagcagcattgctctggattcc

SEQ ID NO: 8136401 - DNA, 23 bp, Homo sapiens
agcttgcttttcccagtactgca

SEQ ID NO: 8136402 - DNA, 22 bp, Homo sapiens
catgcacatgtggctatgtaat

SEQ ID NO: 8136403 - DNA, 22 bp, Homo sapiens
catgaaagcaggaatggtttta

SEQ ID NO: 8136404 - DNA, 22 bp, Homo sapiens
cattaacactttggatttagac

SEQ ID NO: 8136405 - DNA, 22 bp, Homo sapiens
agggcagatggaacttccccga

SEQ ID NO: 8136406 - DNA, 22 bp, Homo sapiens
aggcattttgttcaagatgaca

SEQ ID NO: 8136407 - DNA, 22 bp, Homo sapiens
atacagaattcactacagtttc

SEQ ID NO: 8136408 - DNA, 22 bp, Homo sapiens
atacaagactcagcacagacgg

SEQ ID NO: 8136409 - DNA, 22 bp, Homo sapiens
atacaagatcactccagaaaat

SEQ ID NO: 8136410 - DNA, 22 bp, Homo sapiens
atacaagacagtaggaaactga

SEQ ID NO: 8136411 - DNA, 19 bp, Homo sapiens
atacaagactagcatttac

SEQ ID NO: 8136412 - DNA, 22 bp, Homo sapiens
ctgctttaagtattcaacaaag

SEQ ID NO: 8136413 - DNA, 22 bp, Homo sapiens
agttggcactgagctgtgattg

SEQ ID NO: 8136414 - DNA, 22 bp, Homo sapiens
agtttaaatcatgttttgtaac

SEQ ID NO: 8136415 - DNA, 22 bp, Homo sapiens
atcatgttaaatatttcaatct

SEQ ID NO: 8136416 - DNA, 22 bp, Homo sapiens
atcacatggaatgattttagac

SEQ ID NO: 8136417 - DNA, 22 bp, Homo sapiens
atcacatcgaggagcaatcaga

SEQ ID NO: 8136418 - DNA, 22 bp, Homo sapiens
gtagggatggaagccatgaaat

SEQ ID NO: 8136419 - DNA, 22 bp, Homo sapiens
cagcagcaaatctagaagagga

SEQ ID NO: 8136420 - DNA, 22 bp, Homo sapiens
cagaggtttgatcgagtaggtc

SEQ ID NO: 8136421 - DNA, 20 bp, Homo sapiens
caacatgagcaagtgaactg

SEQ ID NO: 8136422 - DNA, 22 bp, Homo sapiens
caacatatgattttgtatataa

SEQ ID NO: 8136423 - DNA, 22 bp, Homo sapiens
caagagttgagggatgtcagtt

SEQ ID NO: 8136424 - DNA, 22 bp, Homo sapiens
caagagtttaaatcaatggcca

SEQ ID NO: 8136425 - DNA, 23 bp, Homo sapiens
cacacctgttaagaagagtgcct

SEQ ID NO: 8136426 - DNA, 22 bp, Homo sapiens
cacaaaatctttctcgattatt

SEQ ID NO: 8136427 - DNA, 22 bp, Homo sapiens
ggaaaagaattgcagtgaagta

SEQ ID NO: 8136428 - DNA, 22 bp, Homo sapiens
cacaaagttggacaacgcaccc

SEQ ID NO: 8136429 - DNA, 22 bp, Homo sapiens
cacaaagtctgcagctgctgta

SEQ ID NO: 8136430 - DNA, 22 bp, Homo sapiens
cacaaagtgggtggaaaactaa

SEQ ID NO: 8136431 - DNA, 22 bp, Homo sapiens
cacaaaatatcaagcactttta

SEQ ID NO: 8136432 - DNA, 22 bp, Homo sapiens
gcttggcatttgctgggagctg

SEQ ID NO: 8136433 - DNA, 22 bp, Homo sapiens
cacagcttgtttagtgactcac

SEQ ID NO: 8136434 - DNA, 22 bp, Homo sapiens
ggatgttctggggttctcttgt

SEQ ID NO: 8136435 - DNA, 22 bp, Homo sapiens
caccagtctttattttgttatt

SEQ ID NO: 8136436 - DNA, 22 bp, Homo sapiens
cacccagagcagacactgtcca

SEQ ID NO: 8136437 - DNA, 22 bp, Homo sapiens
caccattccaggccttaagaag

SEQ ID NO: 8136438 - DNA, 22 bp, Homo sapiens
atgtctttggctttgacatggc

SEQ ID NO: 8136439 - DNA, 22 bp, Homo sapiens
atgtctttataaatgtataatg

SEQ ID NO: 8136440 - DNA, 22 bp, Homo sapiens
atgccactgcgctccagcctgg

SEQ ID NO: 8136441 - DNA, 22 bp, Homo sapiens
atggaaatgatggaacattaaa

SEQ ID NO: 8136442 - DNA, 22 bp, Homo sapiens
atgccacttcattccagcctcg

SEQ ID NO: 8136443 - DNA, 22 bp, Homo sapiens
gagaaatgctagcttaggaatc

SEQ ID NO: 8136444 - DNA, 22 bp, Homo sapiens
gagaaatgcatgcatgtcatca

SEQ ID NO: 8136445 - DNA, 22 bp, Homo sapiens
atggagactgcgtctgccatcc

SEQ ID NO: 8136446 - DNA, 22 bp, Homo sapiens
atggagagagaaggcttgctgt

SEQ ID NO: 8136447 - DNA, 21 bp, Homo sapiens
atgcagagaactccagggaag

SEQ ID NO: 8136448 - DNA, 22 bp, Homo sapiens
atgcagatttaattagtatagg

SEQ ID NO: 8136449 - DNA, 22 bp, Homo sapiens
atgcagatatgcaaactgtagt

SEQ ID NO: 8136450 - DNA, 22 bp, Homo sapiens
atgcagatctgtgaaaggaata

SEQ ID NO: 8136451 - DNA, 22 bp, Homo sapiens
atgcagatgggtgccaaagtct

SEQ ID NO: 8136452 - DNA, 22 bp, Homo sapiens
atgcagatggtggatggagaaa

SEQ ID NO: 8136453 - DNA, 22 bp, Homo sapiens
atgcagcagtttacaaagcaat

SEQ ID NO: 8136454 - DNA, 22 bp, Homo sapiens
atgcatgtatatattacactca

SEQ ID NO: 8136455 - DNA, 22 bp, Homo sapiens
atgattagttaccttgatttaa

SEQ ID NO: 8136456 - DNA, 22 bp, Homo sapiens
cttttcatgccagcccatcaca

SEQ ID NO: 8136457 - DNA, 23 bp, Homo sapiens
cttttcattgccttagcgcagag

SEQ ID NO: 8136458 - DNA, 22 bp, Homo sapiens
atgaaatgtaagtagagagttt

SEQ ID NO: 8136459 - DNA, 22 bp, Homo sapiens
cttggcattgtgttgatagaag

SEQ ID NO: 8136460 - DNA, 22 bp, Homo sapiens
cttggcatgttcatctgcttgg

SEQ ID NO: 8136461 - DNA, 22 bp, Homo sapiens
cttgctgattcatgtcttcctg

SEQ ID NO: 8136462 - DNA, 22 bp, Homo sapiens
cttgctgaaggaacttcccaga

SEQ ID NO: 8136463 - DNA, 22 bp, Homo sapiens
attgcttttccttaacacatgc

SEQ ID NO: 8136464 - DNA, 22 bp, Homo sapiens
caaactttcagttataacatga

SEQ ID NO: 8136465 - DNA, 22 bp, Homo sapiens
gcaagttatttccatttaaagc

SEQ ID NO: 8136466 - DNA, 22 bp, Homo sapiens
attacaactacataatctcaga

SEQ ID NO: 8136467 - DNA, 22 bp, Homo sapiens
attacaactgttcccactgtct

SEQ ID NO: 8136468 - DNA, 22 bp, Homo sapiens
atgttttgctggatgttggcta

SEQ ID NO: 8136469 - DNA, 22 bp, Homo sapiens
atgtgtttgtacctttaaatat

SEQ ID NO: 8136470 - DNA, 22 bp, Homo sapiens
attctagataagaaaagggctg

SEQ ID NO: 8136471 - DNA, 22 bp, Homo sapiens
attctagagtttcaatccaagg

SEQ ID NO: 8136472 - DNA, 22 bp, Homo sapiens
attctagaatttaaatttgcca

SEQ ID NO: 8136473 - DNA, 21 bp, Homo sapiens
attctagacaacactgaaatc

SEQ ID NO: 8136474 - DNA, 18 bp, Homo sapiens
attctagaagatgccttg

SEQ ID NO: 8136475 - DNA, 22 bp, Homo sapiens
attccctgaaattgtgctttca

SEQ ID NO: 8136476 - DNA, 22 bp, Homo sapiens
tcattttcccactgaagctgtc

SEQ ID NO: 8136477 - DNA, 22 bp, Homo sapiens
catgattgatccttctaaatgc

SEQ ID NO: 8136478 - DNA, 22 bp, Homo sapiens
catcacagtggctgtttattta

SEQ ID NO: 8136479 - DNA, 22 bp, Homo sapiens
catccaccgcgtgcacctctac

SEQ ID NO: 8136480 - DNA, 22 bp, Homo sapiens
tcactatctcagtaaagcactc

SEQ ID NO: 8136481 - DNA, 22 bp, Homo sapiens
tcactatgcccagaatacagtt

SEQ ID NO: 8136482 - DNA, 22 bp, Homo sapiens
tcaccatcctcacctagaaatg

SEQ ID NO: 8136483 - DNA, 22 bp, Homo sapiens
tcaccatcaggataaaatctca

SEQ ID NO: 8136484 - DNA, 22 bp, Homo sapiens
caggtctgtattaacagagggt

SEQ ID NO: 8136485 - DNA, 22 bp, Homo sapiens
caggtctgcagacagggccatg

SEQ ID NO: 8136486 - DNA, 22 bp, Homo sapiens
tacatgttatttcactattggt

SEQ ID NO: 8136487 - DNA, 22 bp, Homo sapiens
ccagagttttatacaacttttt

SEQ ID NO: 8136488 - DNA, 22 bp, Homo sapiens
caggagactcagcatccaggat

SEQ ID NO: 8136489 - DNA, 22 bp, Homo sapiens
gttttcttcctgcaattggcat

SEQ ID NO: 8136490 - DNA, 22 bp, Homo sapiens
caggagtttctattgttccaaa

SEQ ID NO: 8136491 - DNA, 22 bp, Homo sapiens
caggagttggtaatattgtgga

SEQ ID NO: 8136492 - DNA, 22 bp, Homo sapiens
taaatatcacctggaattgtta

SEQ ID NO: 8136493 - DNA, 22 bp, Homo sapiens
caggagatgacagggaagaacc

SEQ ID NO: 8136494 - DNA, 22 bp, Homo sapiens
cagctgcaggagaaacagaggc

SEQ ID NO: 8136495 - DNA, 23 bp, Homo sapiens
cagctgaagcagcctgggctgga

SEQ ID NO: 8136496 - DNA, 22 bp, Homo sapiens
cagctgaagaaagagtggttag

SEQ ID NO: 8136497 - DNA, 22 bp, Homo sapiens
cagctgaagagaggtgctgagt

SEQ ID NO: 8136498 - DNA, 22 bp, Homo sapiens
cagctgaacctttccctggagc

SEQ ID NO: 8136499 - DNA, 22 bp, Homo sapiens
cagctgaacatgtagagcatct

SEQ ID NO: 8136500 - DNA, 22 bp, Homo sapiens
cagctgaaagaaggaagtgtca

SEQ ID NO: 8136501 - DNA, 22 bp, Homo sapiens
gtgtttgtttagtgcagagaga

SEQ ID NO: 8136502 - DNA, 22 bp, Homo sapiens
gtgtttgttcgtgactccaaag

SEQ ID NO: 8136503 - DNA, 22 bp, Homo sapiens
gtgtttgtttgggtagctagac

SEQ ID NO: 8136504 - DNA, 22 bp, Homo sapiens
gtgtttgtctcttggcctacct

SEQ ID NO: 8136505 - DNA, 22 bp, Homo sapiens
gtgtttgtgagctaggtgacat

SEQ ID NO: 8136506 - DNA, 22 bp, Homo sapiens
gtgtttgttcatcctctcttct

SEQ ID NO: 8136507 - DNA, 22 bp, Homo sapiens
gttcttcagattccatttcagt

SEQ ID NO: 8136508 - DNA, 22 bp, Homo sapiens
gttcttcagcattagaagtcat

SEQ ID NO: 8136509 - DNA, 22 bp, Homo sapiens
gttggcagaaagctttcgatcg

SEQ ID NO: 8136510 - DNA, 22 bp, Homo sapiens
tgtaggattttcaccagacctt

SEQ ID NO: 8136511 - DNA, 22 bp, Homo sapiens
tgtaggatgtaaggcaggcatc

SEQ ID NO: 8136512 - DNA, 16 bp, Homo sapiens
tgtaggataaccatac

SEQ ID NO: 8136513 - DNA, 21 bp, Homo sapiens
tggtaggatccaggaatctgc

SEQ ID NO: 8136514 - DNA, 22 bp, Homo sapiens
tggtaggatagtgacttatatg

SEQ ID NO: 8136515 - DNA, 22 bp, Homo sapiens
tggtaggagggaaatgcgggtt

SEQ ID NO: 8136516 - DNA, 22 bp, Homo sapiens
tgccacagagactttcattgta

SEQ ID NO: 8136517 - DNA, 22 bp, Homo sapiens
tggcaagttcatatggtttaag

SEQ ID NO: 8136518 - DNA, 22 bp, Homo sapiens
ctgagacattatgacaagtgga

SEQ ID NO: 8136519 - DNA, 22 bp, Homo sapiens
ctgcagcagcctccagccttgg

SEQ ID NO: 8136520 - DNA, 22 bp, Homo sapiens
ctgcagcagggcttgcccacct

SEQ ID NO: 8136521 - DNA, 22 bp, Homo sapiens
ctgcagcagtactcagcagcca

SEQ ID NO: 8136522 - DNA, 22 bp, Homo sapiens
ctgcagcaggaggctcctgcag

SEQ ID NO: 8136523 - DNA, 22 bp, Homo sapiens
ctgcagcatcgccacctgcctc

SEQ ID NO: 8136524 - DNA, 22 bp, Homo sapiens
ctgaagatagtgtctgatcatg

SEQ ID NO: 8136525 - DNA, 22 bp, Homo sapiens
ctgaagatgatgatactaagga

SEQ ID NO: 8136526 - DNA, 22 bp, Homo sapiens
ctgaagatgtctgagatgctca

SEQ ID NO: 8136527 - DNA, 22 bp, Homo sapiens
ctgaacaaagttcttttgagct

SEQ ID NO: 8136528 - DNA, 22 bp, Homo sapiens
tttgtcttgtaagttaaattca

SEQ ID NO: 8136529 - DNA, 22 bp, Homo sapiens
ttgttaaaggcaaaacaagcac

SEQ ID NO: 8136530 - DNA, 22 bp, Homo sapiens
ttgtatttgattgtcatatcgt

SEQ ID NO: 8136531 - DNA, 22 bp, Homo sapiens
tttacatgtaatgttatacaaa

SEQ ID NO: 8136532 - DNA, 22 bp, Homo sapiens
tttcagttcatctgtgaagatt

SEQ ID NO: 8136533 - DNA, 22 bp, Homo sapiens
gctcagagataaaactgatcag

SEQ ID NO: 8136534 - DNA, 22 bp, Homo sapiens
gctgaagacaatggaattgact

SEQ ID NO: 8136535 - DNA, 22 bp, Homo sapiens
gctgaagaccccagctccccag

SEQ ID NO: 8136536 - DNA, 21 bp, Homo sapiens
gctgaagacaaattctcttag

SEQ ID NO: 8136537 - DNA, 20 bp, Homo sapiens
gctgaagaagtagcatgtac

SEQ ID NO: 8136538 - DNA, 21 bp, Homo sapiens
gctgaagaactctttattttc

SEQ ID NO: 8136539 - DNA, 22 bp, Homo sapiens
gcagggacgccagggacagcaa

SEQ ID NO: 8136540 - DNA, 22 bp, Homo sapiens
gcagggaccttgcccaccctcc

SEQ ID NO: 8136541 - DNA, 22 bp, Homo sapiens
gcagggacgcagcactctccgt

SEQ ID NO: 8136542 - DNA, 22 bp, Homo sapiens
gatttcttcattcattagatgg

SEQ ID NO: 8136543 - DNA, 22 bp, Homo sapiens
gatttcttgataattcaaatcc

SEQ ID NO: 8136544 - DNA, 22 bp, Homo sapiens
gatttcttgacccctgtctcag

SEQ ID NO: 8136545 - DNA, 22 bp, Homo sapiens
gcacaaagatgaatacagaatg

SEQ ID NO: 8136546 - DNA, 22 bp, Homo sapiens
gcacaaaggtggaaggaggaag

SEQ ID NO: 8136547 - DNA, 23 bp, Homo sapiens
gcacaagacctggcagcttccat

SEQ ID NO: 8136548 - DNA, 22 bp, Homo sapiens
gattgcttatacacaagatgaa

SEQ ID NO: 8136549 - DNA, 22 bp, Homo sapiens
gatgttgagtatcaatgcttta

SEQ ID NO: 8136550 - DNA, 22 bp, Homo sapiens
gactgtattacaattggcagca

SEQ ID NO: 8136551 - DNA, 22 bp, Homo sapiens
gagacacaatctcatttacatt

SEQ ID NO: 8136552 - DNA, 22 bp, Homo sapiens
gagacacagagaggctgtgtga

SEQ ID NO: 8136553 - DNA, 22 bp, Homo sapiens
gagagctccatgttcatgctgt

SEQ ID NO: 8136554 - DNA, 22 bp, Homo sapiens
gagagctgcattctcagacaca

SEQ ID NO: 8136555 - DNA, 22 bp, Homo sapiens
gagtggctgtgtacatgcccag

SEQ ID NO: 8136556 - DNA, 22 bp, Homo sapiens
gatcacatctttatgagtattt

SEQ ID NO: 8136557 - DNA, 22 bp, Homo sapiens
gataccagacagggagggagaa

SEQ ID NO: 8136558 - DNA, 22 bp, Homo sapiens
gggctgcttttaagggtctcag

SEQ ID NO: 8136559 - DNA, 22 bp, Homo sapiens
gggctggagagtcccacgtggg

SEQ ID NO: 8136560 - DNA, 23 bp, Homo sapiens
ggctccttgcccatccagcagcc

SEQ ID NO: 8136561 - DNA, 22 bp, Homo sapiens
ggctcaggtttaaagtgcttta

SEQ ID NO: 8136562 - DNA, 22 bp, Homo sapiens
gcttacaagatcgtgctccagt

SEQ ID NO: 8136563 - DNA, 22 bp, Homo sapiens
ggaaagctactggtgtcctctg

SEQ ID NO: 8136564 - DNA, 18 bp, Homo sapiens
ggaagaaaaggaactcag

SEQ ID NO: 8136565 - DNA, 22 bp, Homo sapiens
ggagacacagagcaacaaaata

SEQ ID NO: 8136566 - DNA, 22 bp, Homo sapiens
taaatccagcttctaatttaga

SEQ ID NO: 8136567 - DNA, 22 bp, Homo sapiens
taaatagaatctaaactgctca

SEQ ID NO: 8136568 - DNA, 22 bp, Homo sapiens
taaatgacattcttaagtcttg

SEQ ID NO: 8136569 - DNA, 22 bp, Homo sapiens
gttgttttgctgtctgtcttag

SEQ ID NO: 8136570 - DNA, 22 bp, Homo sapiens
gtttttctttgtgtgaagacaa

SEQ ID NO: 8136571 - DNA, 22 bp, Homo sapiens
gtggttccgaatatttatttct

SEQ ID NO: 8136572 - DNA, 21 bp, Homo sapiens
gtggttctagagaaacagaat

SEQ ID NO: 8136573 - DNA, 22 bp, Homo sapiens
gtggtgtaggtcacagttagga

SEQ ID NO: 8136574 - DNA, 22 bp, Homo sapiens
gttgtgattgtagctaaactag

SEQ ID NO: 8136575 - DNA, 22 bp, Homo sapiens
gttctcctcttagctgtgccac

SEQ ID NO: 8136576 - DNA, 22 bp, Homo sapiens
gttctccttgtggctgcagcag

SEQ ID NO: 8136577 - DNA, 22 bp, Homo sapiens
gttctcctcttgtcccaggctg

SEQ ID NO: 8136578 - DNA, 22 bp, Homo sapiens
gttctcctggctcccaccctgc

SEQ ID NO: 8136579 - DNA, 22 bp, Homo sapiens
gtacatgattccccataaaaag

SEQ ID NO: 8136580 - DNA, 22 bp, Homo sapiens
gtcaggatcaaattgaagttat

SEQ ID NO: 8136581 - DNA, 22 bp, Homo sapiens
gtcgccatgacaacaccagccg

SEQ ID NO: 8136582 - DNA, 22 bp, Homo sapiens
gtgacaaaggtcaagcttttga

SEQ ID NO: 8136583 - DNA, 22 bp, Homo sapiens
tctgtttagactcagttgaaac

SEQ ID NO: 8136584 - DNA, 22 bp, Homo sapiens
tctgttgcaatgtgcatggtga

SEQ ID NO: 8136585 - DNA, 22 bp, Homo sapiens
tctgttctttccaacaagacag

SEQ ID NO: 8136586 - DNA, 22 bp, Homo sapiens
tctgtttattcaatttctatat

SEQ ID NO: 8136587 - DNA, 17 bp, Homo sapiens
tctgtttctcctttctt

SEQ ID NO: 8136588 - DNA, 22 bp, Homo sapiens
tcttcaaaatattccatccatt

SEQ ID NO: 8136589 - DNA, 22 bp, Homo sapiens
tcttcaaaccctggctcttcct

SEQ ID NO: 8136590 - DNA, 22 bp, Homo sapiens
tcttcaaaaaatatccatcagt

SEQ ID NO: 8136591 - DNA, 22 bp, Homo sapiens
tcttcaaactgaaaatttagaa

SEQ ID NO: 8136592 - DNA, 22 bp, Homo sapiens
tcttcaaagaattttagtaatt

SEQ ID NO: 8136593 - DNA, 22 bp, Homo sapiens
tcttcatactcatcacataggt

SEQ ID NO: 8136594 - DNA, 22 bp, Homo sapiens
tctttctggttatgtatagaga

SEQ ID NO: 8136595 - DNA, 22 bp, Homo sapiens
tctgcagcttgcacaggcaggc

SEQ ID NO: 8136596 - DNA, 22 bp, Homo sapiens
tctgccaccaactgtcactaca

SEQ ID NO: 8136597 - DNA, 22 bp, Homo sapiens
tctggagaatctgtcagtgtgg

SEQ ID NO: 8136598 - DNA, 22 bp, Homo sapiens
tctggagagcagatgcctctgg

SEQ ID NO: 8136599 - DNA, 22 bp, Homo sapiens
tctcataaggtcagatttcaca

SEQ ID NO: 8136600 - DNA, 22 bp, Homo sapiens
tctcataaactcagttttctca

SEQ ID NO: 8136601 - DNA, 22 bp, Homo sapiens
tctcttatgggatagagagggg

SEQ ID NO: 8136602 - DNA, 22 bp, Homo sapiens
tctctcaagcactatccaccca

SEQ ID NO: 8136603 - DNA, 22 bp, Homo sapiens
tcctttccctttccatcctggc

SEQ ID NO: 8136604 - DNA, 22 bp, Homo sapiens
tcctgcttccttgtctttagac

SEQ ID NO: 8136605 - DNA, 19 bp, Homo sapiens
tcctgctttctactctgct

SEQ ID NO: 8136606 - DNA, 22 bp, Homo sapiens
tgcagagccagtcttgtgcttc

SEQ ID NO: 8136607 - DNA, 22 bp, Homo sapiens
tgcagatattctcccaagtgtt

SEQ ID NO: 8136608 - DNA, 21 bp, Homo sapiens
tgcagataattgaaagctgac

SEQ ID NO: 8136609 - DNA, 22 bp, Homo sapiens
tgcagcaagtaaccatcttcct

SEQ ID NO: 8136610 - DNA, 18 bp, Homo sapiens
tgcagcaagtgctaaata

SEQ ID NO: 8136611 - DNA, 22 bp, Homo sapiens
tgcagcaacaagatagaatggc

SEQ ID NO: 8136612 - DNA, 22 bp, Homo sapiens
tgcacgtgggctctctgctctt

SEQ ID NO: 8136613 - DNA, 22 bp, Homo sapiens
tgcaaagaactaagcagcctta

SEQ ID NO: 8136614 - DNA, 23 bp, Homo sapiens
tgcaaagaaatctgggtcattgt

SEQ ID NO: 8136615 - DNA, 22 bp, Homo sapiens
tgcaaagaaaacactgcaagac

SEQ ID NO: 8136616 - DNA, 17 bp, Homo sapiens
tgcaaacaatcacatat

SEQ ID NO: 8136617 - DNA, 22 bp, Homo sapiens
tgcaaagaagccacagtcccag

SEQ ID NO: 8136618 - DNA, 22 bp, Homo sapiens
tgcaaagaagcaacatccttgt

SEQ ID NO: 8136619 - DNA, 22 bp, Homo sapiens
tgcaaagaaggggaggaggatt

SEQ ID NO: 8136620 - DNA, 22 bp, Homo sapiens
tgcaaagaagcctttgccttct

SEQ ID NO: 8136621 - DNA, 22 bp, Homo sapiens
tgcaaagaagggctgaggagca

SEQ ID NO: 8136622 - DNA, 22 bp, Homo sapiens
tgcaaagatttatctttctcca

SEQ ID NO: 8136623 - DNA, 23 bp, Homo sapiens
tgcaaagatttaatgcaggggca

SEQ ID NO: 8136624 - DNA, 22 bp, Homo sapiens
tgcaaagatgaaatattaaagg

SEQ ID NO: 8136625 - DNA, 22 bp, Homo sapiens
tgcaaagatatgagaagctgta

SEQ ID NO: 8136626 - DNA, 22 bp, Homo sapiens
tgcacaaatttgtgtatgctca

SEQ ID NO: 8136627 - DNA, 22 bp, Homo sapiens
tgcacaaacacagagaatagat

SEQ ID NO: 8136628 - DNA, 22 bp, Homo sapiens
tgattgtttcctatgtacacct

SEQ ID NO: 8136629 - DNA, 22 bp, Homo sapiens
tgatatgtccctcgacatcagg

SEQ ID NO: 8136630 - DNA, 17 bp, Homo sapiens
tgatagttcattttaag

SEQ ID NO: 8136631 - DNA, 22 bp, Homo sapiens
tgcccactggataatgcaaact

SEQ ID NO: 8136632 - DNA, 22 bp, Homo sapiens
tgcatggagctgtctgcatggt

SEQ ID NO: 8136633 - DNA, 22 bp, Homo sapiens
tgagaggaacaggcagtaggtt

SEQ ID NO: 8136634 - DNA, 22 bp, Homo sapiens
tgaatgaatgaattaatagagt

SEQ ID NO: 8136635 - DNA, 22 bp, Homo sapiens
tgacacattaaatgctcacaaa

SEQ ID NO: 8136636 - DNA, 22 bp, Homo sapiens
tgaaaatggcctgaagaagcaa

SEQ ID NO: 8136637 - DNA, 17 bp, Homo sapiens
tgaaagaatcagggaga

SEQ ID NO: 8136638 - DNA, 22 bp, Homo sapiens
tgaaagaagtgtcacattgcca

SEQ ID NO: 8136639 - DNA, 22 bp, Homo sapiens
tgaaagaactagcatcttcaag

SEQ ID NO: 8136640 - DNA, 18 bp, Homo sapiens
tgaaattgcatccatgag

SEQ ID NO: 8136641 - DNA, 22 bp, Homo sapiens
tgaagcaggaaacttcttgttt

SEQ ID NO: 8136642 - DNA, 20 bp, Homo sapiens
tgaagcagccttgattctgt

SEQ ID NO: 8136643 - DNA, 20 bp, Homo sapiens
tgaagattttgtgtttagaa

SEQ ID NO: 8136644 - DNA, 22 bp, Homo sapiens
tgaagaaacagaccaagaggat

SEQ ID NO: 8136645 - DNA, 22 bp, Homo sapiens
tggctggaatatgtggagacca

SEQ ID NO: 8136646 - DNA, 22 bp, Homo sapiens
tggctcagttaggtcagaaaca

SEQ ID NO: 8136647 - DNA, 22 bp, Homo sapiens
tggcgagctttgttctccagga

SEQ ID NO: 8136648 - DNA, 22 bp, Homo sapiens
tggctggaatggagctgagcct

SEQ ID NO: 8136649 - DNA, 19 bp, Homo sapiens
tggctggagatctgctact

SEQ ID NO: 8136650 - DNA, 22 bp, Homo sapiens
tggctggagagggtcccatgag

SEQ ID NO: 8136651 - DNA, 22 bp, Homo sapiens
tggctggacctgggctggaatt

SEQ ID NO: 8136652 - DNA, 22 bp, Homo sapiens
tggctggagcgccctcctctgc

SEQ ID NO: 8136653 - DNA, 22 bp, Homo sapiens
tggctggagggttagtgagata

SEQ ID NO: 8136654 - DNA, 22 bp, Homo sapiens
tggctggagcattccttgtctt

SEQ ID NO: 8136655 - DNA, 22 bp, Homo sapiens
tggctggagcccctcaagagca

SEQ ID NO: 8136656 - DNA, 22 bp, Homo sapiens
tggctggattattggctagtac

SEQ ID NO: 8136657 - DNA, 21 bp, Homo sapiens
tggctggatagatgggaactg

SEQ ID NO: 8136658 - DNA, 22 bp, Homo sapiens
tggctggagtctggtgctagcc

SEQ ID NO: 8136659 - DNA, 22 bp, Homo sapiens
tggctggagtataggagtagga

SEQ ID NO: 8136660 - DNA, 22 bp, Homo sapiens
tggcacatggtaagactcagta

SEQ ID NO: 8136661 - DNA, 22 bp, Homo sapiens
tgcttaaaaagtaactgctgat

SEQ ID NO: 8136662 - DNA, 18 bp, Homo sapiens
tggagagcagcagtgggg

SEQ ID NO: 8136663 - DNA, 22 bp, Homo sapiens
tggagagcacagttcctgcttc

SEQ ID NO: 8136664 - DNA, 22 bp, Homo sapiens
tggagagcaggggatgcgggcg

SEQ ID NO: 8136665 - DNA, 22 bp, Homo sapiens
tggagagcactgtctcattttg

SEQ ID NO: 8136666 - DNA, 22 bp, Homo sapiens
tggagagcagggctggagttca

SEQ ID NO: 8136667 - DNA, 20 bp, Homo sapiens
tggagagcctctggactgtg

SEQ ID NO: 8136668 - DNA, 21 bp, Homo sapiens
tggagagcccttgcctgagtc

SEQ ID NO: 8136669 - DNA, 22 bp, Homo sapiens
tggagagcaagtcgcagacatg

SEQ ID NO: 8136670 - DNA, 22 bp, Homo sapiens
tggagagcaatgaggggcaggc

SEQ ID NO: 8136671 - DNA, 22 bp, Homo sapiens
tggagagctggttcaaagcaga

SEQ ID NO: 8136672 - DNA, 22 bp, Homo sapiens
tggagagctgttgaaatgcaga

SEQ ID NO: 8136673 - DNA, 22 bp, Homo sapiens
tggagagcgcgacgggaggaag

SEQ ID NO: 8136674 - DNA, 22 bp, Homo sapiens
tggagagcccgagacatcctgt

SEQ ID NO: 8136675 - DNA, 22 bp, Homo sapiens
tggagagccttcccggcatcgc

SEQ ID NO: 8136676 - DNA, 22 bp, Homo sapiens
tggagagcctggagtccctgat

SEQ ID NO: 8136677 - DNA, 22 bp, Homo sapiens
tggagagcgtgcttagcactct

SEQ ID NO: 8136678 - DNA, 22 bp, Homo sapiens
tggagagctcctatttgctgtc

SEQ ID NO: 8136679 - DNA, 22 bp, Homo sapiens
tggagagctatttggacctcca

SEQ ID NO: 8136680 - DNA, 22 bp, Homo sapiens
tggagagctccagaagctaaac

SEQ ID NO: 8136681 - DNA, 22 bp, Homo sapiens
tgctttaaatatgaattagcat

SEQ ID NO: 8136682 - DNA, 22 bp, Homo sapiens
tgctttaaaatggactgttttg

SEQ ID NO: 8136683 - DNA, 22 bp, Homo sapiens
tgctttaagacactaagtttga

SEQ ID NO: 8136684 - DNA, 22 bp, Homo sapiens
tgctttggagagaccattttca

SEQ ID NO: 8136685 - DNA, 22 bp, Homo sapiens
tggtccttctctgcctgcagtg

SEQ ID NO: 8136686 - DNA, 22 bp, Homo sapiens
tggtccttgtggcttttcagta

SEQ ID NO: 8136687 - DNA, 22 bp, Homo sapiens
tggtccttctgtcttccgcacc

SEQ ID NO: 8136688 - DNA, 22 bp, Homo sapiens
tggtttaatttccatttccttg

SEQ ID NO: 8136689 - DNA, 22 bp, Homo sapiens
tggtttctgccctcagagctca

SEQ ID NO: 8136690 - DNA, 22 bp, Homo sapiens
tgtatcaatcatgtaatttggt

SEQ ID NO: 8136691 - DNA, 22 bp, Homo sapiens
tgtatacactatgctatatggt

SEQ ID NO: 8136692 - DNA, 22 bp, Homo sapiens
tgtatgctttccaaaaatgctg

SEQ ID NO: 8136693 - DNA, 22 bp, Homo sapiens
tgtcacttcaggaatgcaggga

SEQ ID NO: 8136694 - DNA, 22 bp, Homo sapiens
tgtccttttctttagtgcagct

SEQ ID NO: 8136695 - DNA, 22 bp, Homo sapiens
tgtccttttccccaaattcact

SEQ ID NO: 8136696 - DNA, 22 bp, Homo sapiens
tgggtaggggacgtggaagaaa

SEQ ID NO: 8136697 - DNA, 22 bp, Homo sapiens
tgggtaggaccagaaatgcact

SEQ ID NO: 8136698 - DNA, 22 bp, Homo sapiens
tgggtaggccaggaagcagtgt

SEQ ID NO: 8136699 - DNA, 22 bp, Homo sapiens
ttacatgatgatttcataaaca

SEQ ID NO: 8136700 - DNA, 22 bp, Homo sapiens
ttacatgaggttaattaagcat

SEQ ID NO: 8136701 - DNA, 22 bp, Homo sapiens
ttacacaaaaataagatatggc

SEQ ID NO: 8136702 - DNA, 22 bp, Homo sapiens
ttacaagacagtgtggtaaata

SEQ ID NO: 8136703 - DNA, 22 bp, Homo sapiens
ttacaagataacctgatgctgt

SEQ ID NO: 8136704 - DNA, 22 bp, Homo sapiens
ttacaagatctttgaaggcaag

SEQ ID NO: 8136705 - DNA, 22 bp, Homo sapiens
ttacaaagtgttatgataaaca

SEQ ID NO: 8136706 - DNA, 22 bp, Homo sapiens
ttacaagacactgctgacacag

SEQ ID NO: 8136707 - DNA, 23 bp, Homo sapiens
ttcattcaaaaggaaaagtcatg

SEQ ID NO: 8136708 - DNA, 22 bp, Homo sapiens
ttcatgttttgagccattctga

SEQ ID NO: 8136709 - DNA, 19 bp, Homo sapiens
ttcatgtttgtagatggtg

SEQ ID NO: 8136710 - DNA, 22 bp, Homo sapiens
ttcatgtttgtaggactgaggc

SEQ ID NO: 8136711 - DNA, 22 bp, Homo sapiens
ttccagaggtagcaatgacttg

SEQ ID NO: 8136712 - DNA, 22 bp, Homo sapiens
ttccagaggcttcagggaagaa

SEQ ID NO: 8136713 - DNA, 22 bp, Homo sapiens
ttccagaggcttgaggaaaatt

SEQ ID NO: 8136714 - DNA, 22 bp, Homo sapiens
ttcaccatgttggccaggctgg

SEQ ID NO: 8136715 - DNA, 22 bp, Homo sapiens
tgtgccacatacacagtacatt

SEQ ID NO: 8136716 - DNA, 22 bp, Homo sapiens
tgtgcagagcggggaagagcac

SEQ ID NO: 8136717 - DNA, 22 bp, Homo sapiens
tgtgctctgcccctgactgttt

SEQ ID NO: 8136718 - DNA, 22 bp, Homo sapiens
tgtctttttactatgttcaatc

SEQ ID NO: 8136719 - DNA, 22 bp, Homo sapiens
tgtcttttacctaatgagctgg

SEQ ID NO: 8136720 - DNA, 22 bp, Homo sapiens
tgtcttttgccaaagatcagtt

SEQ ID NO: 8136721 - DNA, 22 bp, Homo sapiens
tgttcttttctctaaactgata

SEQ ID NO: 8136722 - DNA, 22 bp, Homo sapiens
tgttcttgagcctttagaccta

SEQ ID NO: 8136723 - DNA, 22 bp, Homo sapiens
tgtttaaatagaacatactgca

SEQ ID NO: 8136724 - DNA, 22 bp, Homo sapiens
tgttgtcagtattaatttcaca

SEQ ID NO: 8136725 - DNA, 22 bp, Homo sapiens
tgttgtgacctctctgcattca

SEQ ID NO: 8136726 - DNA, 22 bp, Homo sapiens
tgttgactcaacactgtgggca

SEQ ID NO: 8136727 - DNA, 22 bp, Homo sapiens
ttaaaagacctgttgaggttag

SEQ ID NO: 8136728 - DNA, 23 bp, Homo sapiens
ttaaacactagttcgagtagcat

SEQ ID NO: 8136729 - DNA, 22 bp, Homo sapiens
tgtttgcttacttgtatgctgc

SEQ ID NO: 8136730 - DNA, 22 bp, Homo sapiens
tgtttgttccctctctttcctg

SEQ ID NO: 8136731 - DNA, 22 bp, Homo sapiens
tgtttgctatatcctacttcat

SEQ ID NO: 8136732 - DNA, 22 bp, Homo sapiens
tgttttcaagtcaaggccaaat

SEQ ID NO: 8136733 - DNA, 23 bp, Homo sapiens
tgtttgtttctatgagagatagc

SEQ ID NO: 8136734 - DNA, 22 bp, Homo sapiens
acagaagcagccgtcacagata

SEQ ID NO: 8136735 - DNA, 22 bp, Homo sapiens
aagatttttttccacagactca

SEQ ID NO: 8136736 - DNA, 22 bp, Homo sapiens
aagattttctcaactgtatttg

SEQ ID NO: 8136737 - DNA, 22 bp, Homo sapiens
aatgttattacacttgtgaaat

SEQ ID NO: 8136738 - DNA, 22 bp, Homo sapiens
acaagaataaggataagagatt

SEQ ID NO: 8136739 - DNA, 17 bp, Homo sapiens
aagacaagacaaatgca

SEQ ID NO: 8136740 - DNA, 23 bp, Homo sapiens
aattcaaattcagtgtgactagg

SEQ ID NO: 8136741 - DNA, 22 bp, Homo sapiens
aaggactagatattcatacatg

SEQ ID NO: 8136742 - DNA, 22 bp, Homo sapiens
aaggaccagattatccttaata

SEQ ID NO: 8136743 - DNA, 22 bp, Homo sapiens
aacaatgaccacacaatgtact

SEQ ID NO: 8136744 - DNA, 22 bp, Homo sapiens
aaggccactttaccttaaatcc

SEQ ID NO: 8136745 - DNA, 22 bp, Homo sapiens
aaatttcagttacctttacgtt

SEQ ID NO: 8136746 - DNA, 22 bp, Homo sapiens
aacagtttgcctgaaatgtatt

SEQ ID NO: 8136747 - DNA, 20 bp, Homo sapiens
aagtttgccccaggaaattg

SEQ ID NO: 8136748 - DNA, 22 bp, Homo sapiens
aatcacttgtaaggaattcaat

SEQ ID NO: 8136749 - DNA, 22 bp, Homo sapiens
aaccagctccagcctccattca

SEQ ID NO: 8136750 - DNA, 22 bp, Homo sapiens
aaccagctctgcaaaatgtcat

SEQ ID NO: 8136751 - DNA, 22 bp, Homo sapiens
aaccagctttgatacgcattat

SEQ ID NO: 8136752 - DNA, 22 bp, Homo sapiens
aaccagctgagaatgcttctgc

SEQ ID NO: 8136753 - DNA, 22 bp, Homo sapiens
aagaatgattacaaagcaacga

SEQ ID NO: 8136754 - DNA, 22 bp, Homo sapiens
aagcagcagacctgattttgaa

SEQ ID NO: 8136755 - DNA, 22 bp, Homo sapiens
aagccacttggggaaagatgga

SEQ ID NO: 8136756 - DNA, 22 bp, Homo sapiens
aagcaaaggaaagctgactttt

SEQ ID NO: 8136757 - DNA, 22 bp, Homo sapiens
aagcaaatgaaccagaggtaat

SEQ ID NO: 8136758 - DNA, 23 bp, Homo sapiens
aacacaaagctgattccagtggc

SEQ ID NO: 8136759 - DNA, 22 bp, Homo sapiens
aacacaaagaagctgcaggatc

SEQ ID NO: 8136760 - DNA, 22 bp, Homo sapiens
aacaagaagagagggacgtaat

SEQ ID NO: 8136761 - DNA, 22 bp, Homo sapiens
aacaagaagggaaggcatgatt

SEQ ID NO: 8136762 - DNA, 22 bp, Homo sapiens
aaatggtataatgtcatgtatt

SEQ ID NO: 8136763 - DNA, 22 bp, Homo sapiens
aaagcactcggcttcatccagg

SEQ ID NO: 8136764 - DNA, 22 bp, Homo sapiens
aactcactttgtggcttctgaa

SEQ ID NO: 8136765 - DNA, 22 bp, Homo sapiens
aaaattcattcctcagactgcc

SEQ ID NO: 8136766 - DNA, 22 bp, Homo sapiens
aaacaaagccagggaagttatg

SEQ ID NO: 8136767 - DNA, 19 bp, Homo sapiens
aaacacagatttcttacca

SEQ ID NO: 8136768 - DNA, 22 bp, Homo sapiens
aaaagtcagtctctcctagctc

SEQ ID NO: 8136769 - DNA, 22 bp, Homo sapiens
aaacatgaatagatattaaaca

SEQ ID NO: 8136770 - DNA, 22 bp, Homo sapiens
aaacacagggatatatattcca

SEQ ID NO: 8136771 - DNA, 22 bp, Homo sapiens
aaaccatggctcattggagatg

SEQ ID NO: 8136772 - DNA, 22 bp, Homo sapiens
aaacttgaaaggtactgttggt

SEQ ID NO: 8136773 - DNA, 22 bp, Homo sapiens
agaataaccagtgtttcacagt

SEQ ID NO: 8136774 - DNA, 22 bp, Homo sapiens
aatgcttttacgacatgtacct

SEQ ID NO: 8136775 - DNA, 22 bp, Homo sapiens
aatgctttgagggaagatgaaa

SEQ ID NO: 8136776 - DNA, 22 bp, Homo sapiens
aatgtactaataagcaacattt

SEQ ID NO: 8136777 - DNA, 22 bp, Homo sapiens
agattacaacatgggacgcata

SEQ ID NO: 8136778 - DNA, 22 bp, Homo sapiens
agaggttgggtctgaggtgaga

SEQ ID NO: 8136779 - DNA, 22 bp, Homo sapiens
agcagaaaactttcatgctctg

SEQ ID NO: 8136780 - DNA, 22 bp, Homo sapiens
agctcagggctccaggaccgct

SEQ ID NO: 8136781 - DNA, 22 bp, Homo sapiens
agctcaggctctgcagggacta

SEQ ID NO: 8136782 - DNA, 22 bp, Homo sapiens
agctcaggccggagctacaggc

SEQ ID NO: 8136783 - DNA, 22 bp, Homo sapiens
acaggtctccagagtgagagga

SEQ ID NO: 8136784 - DNA, 22 bp, Homo sapiens
accagctgctgattgctaaatg

SEQ ID NO: 8136785 - DNA, 22 bp, Homo sapiens
accagctgccttttcttagtag

SEQ ID NO: 8136786 - DNA, 23 bp, Homo sapiens
accagctgccctgaactttgtgc

SEQ ID NO: 8136787 - DNA, 22 bp, Homo sapiens
accagctgcctggtctatctgc

SEQ ID NO: 8136788 - DNA, 22 bp, Homo sapiens
accagctgccaagggctacact

SEQ ID NO: 8136789 - DNA, 22 bp, Homo sapiens
accagctgatttaagaataaag

SEQ ID NO: 8136790 - DNA, 22 bp, Homo sapiens
accagctgagttctcggatggt

SEQ ID NO: 8136791 - DNA, 22 bp, Homo sapiens
aaggtttaaggtctataaatgt

SEQ ID NO: 8136792 - DNA, 22 bp, Homo sapiens
accagctgttatctgtagtatc

SEQ ID NO: 8136793 - DNA, 22 bp, Homo sapiens
accagctgtgtgacctgaggca

SEQ ID NO: 8136794 - DNA, 22 bp, Homo sapiens
accagctgttaggcttggtgct

SEQ ID NO: 8136795 - DNA, 22 bp, Homo sapiens
accagctgtgtgacttttaatg

SEQ ID NO: 8136796 - DNA, 22 bp, Homo sapiens
accagctggtcacctgggcact

SEQ ID NO: 8136797 - DNA, 22 bp, Homo sapiens
accagctggcccatgagcacgt

SEQ ID NO: 8136798 - DNA, 22 bp, Homo sapiens
accagctgtgtcctggctgcag

SEQ ID NO: 8136799 - DNA, 22 bp, Homo sapiens
accagctggtcagggcttttct

SEQ ID NO: 8136800 - DNA, 22 bp, Homo sapiens
accagctggtcagttgaagatt

SEQ ID NO: 8136801 - DNA, 22 bp, Homo sapiens
agaaaccatctttatatatctg

SEQ ID NO: 8136802 - DNA, 22 bp, Homo sapiens
aagtgactatttgagtacatca

SEQ ID NO: 8136803 - DNA, 22 bp, Homo sapiens
agctccagcctcttctggaggt

SEQ ID NO: 8136804 - DNA, 22 bp, Homo sapiens
cactttcaagtttcagaggata

SEQ ID NO: 8136805 - DNA, 22 bp, Homo sapiens
cagagacattcagtaaattatc

SEQ ID NO: 8136806 - DNA, 22 bp, Homo sapiens
caccagctacagactactgtgt

SEQ ID NO: 8136807 - DNA, 22 bp, Homo sapiens
caccagctaattaaaacagcag

SEQ ID NO: 8136808 - DNA, 22 bp, Homo sapiens
caccagatgaaaggacatatca

SEQ ID NO: 8136809 - DNA, 22 bp, Homo sapiens
caccagatgaatgtttgatgct

SEQ ID NO: 8136810 - DNA, 22 bp, Homo sapiens
cactgttttattccaacatagg

SEQ ID NO: 8136811 - DNA, 22 bp, Homo sapiens
agcatgcatgaagattcagcaa

SEQ ID NO: 8136812 - DNA, 22 bp, Homo sapiens
agcaggttaccattgatttcct

SEQ ID NO: 8136813 - DNA, 22 bp, Homo sapiens
caatacaattaccagttaatca

SEQ ID NO: 8136814 - DNA, 22 bp, Homo sapiens
atgaagcagttaaggtgcatga

SEQ ID NO: 8136815 - DNA, 22 bp, Homo sapiens
agacaacatctagtttggtgga

SEQ ID NO: 8136816 - DNA, 22 bp, Homo sapiens
atgcctttctggtgttcttcct

SEQ ID NO: 8136817 - DNA, 22 bp, Homo sapiens
atgccaattgcaggaagaaaac

SEQ ID NO: 8136818 - DNA, 17 bp, Homo sapiens
atgcaggtgtgaggggc

SEQ ID NO: 8136819 - DNA, 22 bp, Homo sapiens
agagccctgtggttctggtaag

SEQ ID NO: 8136820 - DNA, 22 bp, Homo sapiens
agagccctgccaatggatgagg

SEQ ID NO: 8136821 - DNA, 22 bp, Homo sapiens
agagattggggatgaatctttc

SEQ ID NO: 8136822 - DNA, 23 bp, Homo sapiens
attttagctgaatgacttcttta

SEQ ID NO: 8136823 - DNA, 22 bp, Homo sapiens
caaagcaagggctgaagactcc

SEQ ID NO: 8136824 - DNA, 22 bp, Homo sapiens
caaagcaaggctcagtttgaac

SEQ ID NO: 8136825 - DNA, 22 bp, Homo sapiens
agcaagaagctttgctgtgata

SEQ ID NO: 8136826 - DNA, 22 bp, Homo sapiens
agatggatttcttccagtgaga

SEQ ID NO: 8136827 - DNA, 22 bp, Homo sapiens
agatggagttgtagcagtgact

SEQ ID NO: 8136828 - DNA, 22 bp, Homo sapiens
agatggagaccttggatgaact

SEQ ID NO: 8136829 - DNA, 21 bp, Homo sapiens
aggattttgttgaagtttctg

SEQ ID NO: 8136830 - DNA, 22 bp, Homo sapiens
acatacacaagcgtacatgaac

SEQ ID NO: 8136831 - DNA, 17 bp, Homo sapiens
acatacactggtgaaca

SEQ ID NO: 8136832 - DNA, 22 bp, Homo sapiens
accagctctttcttttcactat

SEQ ID NO: 8136833 - DNA, 22 bp, Homo sapiens
accagctgaactgcagcccagg

SEQ ID NO: 8136834 - DNA, 22 bp, Homo sapiens
accagctgagtaggggagggcc

SEQ ID NO: 8136835 - DNA, 22 bp, Homo sapiens
atacatcatgctccatatattt

SEQ ID NO: 8136836 - DNA, 22 bp, Homo sapiens
atacatcacctatatattcaca

SEQ ID NO: 8136837 - DNA, 22 bp, Homo sapiens
atacaaaatatatactggagac

SEQ ID NO: 8136838 - DNA, 22 bp, Homo sapiens
actgtttagtaaattgaaatgg

SEQ ID NO: 8136839 - DNA, 22 bp, Homo sapiens
agaaatcatgactaagagcagt

SEQ ID NO: 8136840 - DNA, 23 bp, Homo sapiens
agaaatcatctccaccccatgtc

SEQ ID NO: 8136841 - DNA, 22 bp, Homo sapiens
agaaatcattgaattatttgct

SEQ ID NO: 8136842 - DNA, 22 bp, Homo sapiens
atcagtaaatattcattgtgca

SEQ ID NO: 8136843 - DNA, 22 bp, Homo sapiens
agaaagattttcaacaggaggt

SEQ ID NO: 8136844 - DNA, 22 bp, Homo sapiens
atatttttccatgtgggactct

SEQ ID NO: 8136845 - DNA, 22 bp, Homo sapiens
agaaccctaatacaatggacat

SEQ ID NO: 8136846 - DNA, 22 bp, Homo sapiens
atccccagactttagatttctc

SEQ ID NO: 8136847 - DNA, 22 bp, Homo sapiens
actggctgtgcagagggcagta

SEQ ID NO: 8136848 - DNA, 21 bp, Homo sapiens
agtagtttagcacagggtttg

SEQ ID NO: 8136849 - DNA, 22 bp, Homo sapiens
agtcaccatctgtggcagcctg

SEQ ID NO: 8136850 - DNA, 22 bp, Homo sapiens
agtcaccattttcacctgcctc

SEQ ID NO: 8136851 - DNA, 22 bp, Homo sapiens
agtcaccaggttttagagacct

SEQ ID NO: 8136852 - DNA, 22 bp, Homo sapiens
agtcaccagggtttgctgggtt

SEQ ID NO: 8136853 - DNA, 22 bp, Homo sapiens
aggtaggagttgatggatgttc

SEQ ID NO: 8136854 - DNA, 22 bp, Homo sapiens
aggtaggaaagtctccttgtat

SEQ ID NO: 8136855 - DNA, 22 bp, Homo sapiens
agtgtttgggggccttgtaaca

SEQ ID NO: 8136856 - DNA, 22 bp, Homo sapiens
agtgtttggggtgattgtaacc

SEQ ID NO: 8136857 - DNA, 22 bp, Homo sapiens
agtgcttttgtcattgaatctt

SEQ ID NO: 8136858 - DNA, 22 bp, Homo sapiens
ctcacatgagatctgtacatcc

SEQ ID NO: 8136859 - DNA, 22 bp, Homo sapiens
agtaggataagagcctgtccaa

SEQ ID NO: 8136860 - DNA, 22 bp, Homo sapiens
agtaggatgctttatatgaaag

SEQ ID NO: 8136861 - DNA, 22 bp, Homo sapiens
agggttttcatttctgagcatt

SEQ ID NO: 8136862 - DNA, 22 bp, Homo sapiens
ctgctgggggacacaggtccgg

SEQ ID NO: 8136863 - DNA, 22 bp, Homo sapiens
atacatgatgggtgtatagttt

SEQ ID NO: 8136864 - DNA, 22 bp, Homo sapiens
atacatgtcatcatatgtttgt

SEQ ID NO: 8136865 - DNA, 22 bp, Homo sapiens
atcataaagtgctatctgattg

SEQ ID NO: 8136866 - DNA, 19 bp, Homo sapiens
atcatcactcatggtcctg

SEQ ID NO: 8136867 - DNA, 22 bp, Homo sapiens
cttctccttatatgtcccgttc

SEQ ID NO: 8136868 - DNA, 19 bp, Homo sapiens
cttctgatggaaagccaac

SEQ ID NO: 8136869 - DNA, 22 bp, Homo sapiens
ccaaacttaacgatgtttttgt

SEQ ID NO: 8136870 - DNA, 22 bp, Homo sapiens
ccaaaattattacatttgtagg

SEQ ID NO: 8136871 - DNA, 22 bp, Homo sapiens
ccaaaattaagcctcttatgtt

SEQ ID NO: 8136872 - DNA, 22 bp, Homo sapiens
ccaaaatgtttgaatgcatgtg

SEQ ID NO: 8136873 - DNA, 22 bp, Homo sapiens
cagttcagctagaagaaacaaa

SEQ ID NO: 8136874 - DNA, 22 bp, Homo sapiens
cagttcatccccatgttttcaa

SEQ ID NO: 8136875 - DNA, 22 bp, Homo sapiens
agctgaagaaatgggaagcatt

SEQ ID NO: 8136876 - DNA, 22 bp, Homo sapiens
agctgaagacctcaagtaagag

SEQ ID NO: 8136877 - DNA, 22 bp, Homo sapiens
aggaagcactggaaggggttgg

SEQ ID NO: 8136878 - DNA, 22 bp, Homo sapiens
cagggacagggatcatttgctt

SEQ ID NO: 8136879 - DNA, 22 bp, Homo sapiens
aggctggagtgcagtggcgtga

SEQ ID NO: 8136880 - DNA, 22 bp, Homo sapiens
aggctggagtgcaatggcgtga

SEQ ID NO: 8136881 - DNA, 22 bp, Homo sapiens
ccagaacacagtggaagaatat

SEQ ID NO: 8136882 - DNA, 21 bp, Homo sapiens
ccagacttgagtgtatgttgt

SEQ ID NO: 8136883 - DNA, 22 bp, Homo sapiens
aggcctgggacgggagccgtga

SEQ ID NO: 8136884 - DNA, 20 bp, Homo sapiens
ccagctgagccaaggggaga

SEQ ID NO: 8136885 - DNA, 22 bp, Homo sapiens
ccagctgacgatgcctggtctc

SEQ ID NO: 8136886 - DNA, 22 bp, Homo sapiens
ccagctgagaagtgtaaagtga

SEQ ID NO: 8136887 - DNA, 22 bp, Homo sapiens
ccctgctttcaaccttctagct

SEQ ID NO: 8136888 - DNA, 22 bp, Homo sapiens
cctgaagacaacttttatcacc

SEQ ID NO: 8136889 - DNA, 22 bp, Homo sapiens
caaatgaatttccctgcaaatg

SEQ ID NO: 8136890 - DNA, 22 bp, Homo sapiens
caaatgaatagggagtgtgatg

SEQ ID NO: 8136891 - DNA, 18 bp, Homo sapiens
gccagaggtactactgat

SEQ ID NO: 8136892 - DNA, 22 bp, Homo sapiens
gcagagtttctggcacattgga

SEQ ID NO: 8136893 - DNA, 22 bp, Homo sapiens
gcagagtttgaagtcaagatgt

SEQ ID NO: 8136894 - DNA, 22 bp, Homo sapiens
gcagatgagtgagatagacttc

SEQ ID NO: 8136895 - DNA, 22 bp, Homo sapiens
gcaaaatgatcttcttcaggct

SEQ ID NO: 8136896 - DNA, 22 bp, Homo sapiens
attggcagttggctgtggttca

SEQ ID NO: 8136897 - DNA, 22 bp, Homo sapiens
gcagggactgtgatctcacaga

SEQ ID NO: 8136898 - DNA, 22 bp, Homo sapiens
gcagggactttggcaacaggtg

SEQ ID NO: 8136899 - DNA, 22 bp, Homo sapiens
attgttttccaaagatgctgct

SEQ ID NO: 8136900 - DNA, 22 bp, Homo sapiens
gccactcacatgtaccagatgc

SEQ ID NO: 8136901 - DNA, 22 bp, Homo sapiens
gccactcatgggaggtgtgcaa

SEQ ID NO: 8136902 - DNA, 22 bp, Homo sapiens
gccactcaaatccagctttaga

SEQ ID NO: 8136903 - DNA, 22 bp, Homo sapiens
atgaatgaaatacagagtactt

SEQ ID NO: 8136904 - DNA, 22 bp, Homo sapiens
atgaatgagattaccaatgtga

SEQ ID NO: 8136905 - DNA, 22 bp, Homo sapiens
atgaatgattaaagagtacagt

SEQ ID NO: 8136906 - DNA, 19 bp, Homo sapiens
gaacaatttgttagctctc

SEQ ID NO: 8136907 - DNA, 22 bp, Homo sapiens
atgcaagattcagcaggaagat

SEQ ID NO: 8136908 - DNA, 22 bp, Homo sapiens
atgcttttatgtcacatggtca

SEQ ID NO: 8136909 - DNA, 22 bp, Homo sapiens
atgcttttcctaaaatgatgcc

SEQ ID NO: 8136910 - DNA, 22 bp, Homo sapiens
gaggttggggctgcagtgagct

SEQ ID NO: 8136911 - DNA, 22 bp, Homo sapiens
atgtttccattttcttgtatca

SEQ ID NO: 8136912 - DNA, 22 bp, Homo sapiens
atgtcacagttgcaacatgaat

SEQ ID NO: 8136913 - DNA, 22 bp, Homo sapiens
gagcttggtgttatttctgtgg

SEQ ID NO: 8136914 - DNA, 22 bp, Homo sapiens
atgcttttggtctttggtccgg

SEQ ID NO: 8136915 - DNA, 22 bp, Homo sapiens
cagaagcactaggaggaaacgt

SEQ ID NO: 8136916 - DNA, 22 bp, Homo sapiens
cagaagcagattctaaagcaag

SEQ ID NO: 8136917 - DNA, 22 bp, Homo sapiens
cagaagcaagggccaaagtctt

SEQ ID NO: 8136918 - DNA, 21 bp, Homo sapiens
gggctcagtggaaaagagtgt

SEQ ID NO: 8136919 - DNA, 22 bp, Homo sapiens
gggctcagtctggcgtggaatg

SEQ ID NO: 8136920 - DNA, 22 bp, Homo sapiens
gggctcagtcggcaagcccctt

SEQ ID NO: 8136921 - DNA, 22 bp, Homo sapiens
gggctcagtctgcggcgcgcgg

SEQ ID NO: 8136922 - DNA, 22 bp, Homo sapiens
gggctcagtcctggttctaccc

SEQ ID NO: 8136923 - DNA, 22 bp, Homo sapiens
gggctcaggtcagggcatcagc

SEQ ID NO: 8136924 - DNA, 22 bp, Homo sapiens
gggctcagggacacatgtgtgt

SEQ ID NO: 8136925 - DNA, 22 bp, Homo sapiens
gggctcaggagtttgaggctgc

SEQ ID NO: 8136926 - DNA, 22 bp, Homo sapiens
gggctcaggcctggcctctcac

SEQ ID NO: 8136927 - DNA, 22 bp, Homo sapiens
cagatacaggtttttgttagat

SEQ ID NO: 8136928 - DNA, 22 bp, Homo sapiens
cagatacattaaaatgatgatt

SEQ ID NO: 8136929 - DNA, 22 bp, Homo sapiens
cagatacctgggtatcatttag

SEQ ID NO: 8136930 - DNA, 22 bp, Homo sapiens
gtctgtttggggacctgtggcc

SEQ ID NO: 8136931 - DNA, 22 bp, Homo sapiens
cacatgcccagaacttctcatt

SEQ ID NO: 8136932 - DNA, 22 bp, Homo sapiens
cacatgcatacctatgtgtata

SEQ ID NO: 8136933 - DNA, 21 bp, Homo sapiens
ggagtttttctggaagggact

SEQ ID NO: 8136934 - DNA, 22 bp, Homo sapiens
ggataggaattgagatgctatt

SEQ ID NO: 8136935 - DNA, 19 bp, Homo sapiens
cacattttgagtctgagat

SEQ ID NO: 8136936 - DNA, 22 bp, Homo sapiens
cagaaatgttctaatgattcag

SEQ ID NO: 8136937 - DNA, 22 bp, Homo sapiens
cagaaatgcctgcttctctctc

SEQ ID NO: 8136938 - DNA, 22 bp, Homo sapiens
caagtcacatggccaactgatg

SEQ ID NO: 8136939 - DNA, 22 bp, Homo sapiens
caagtttaaggcactgataagt

SEQ ID NO: 8136940 - DNA, 18 bp, Homo sapiens
caaattctcattgatttc

SEQ ID NO: 8136941 - DNA, 18 bp, Homo sapiens
caaattcagtgctggaag

SEQ ID NO: 8136942 - DNA, 22 bp, Homo sapiens
ggaagagcctggggtgtcaggc

SEQ ID NO: 8136943 - DNA, 22 bp, Homo sapiens
cacagcattcacagaaagacat

SEQ ID NO: 8136944 - DNA, 22 bp, Homo sapiens
tatgtacatggagagcaattga

SEQ ID NO: 8136945 - DNA, 22 bp, Homo sapiens
tcaaaggaatttgattttgatg

SEQ ID NO: 8136946 - DNA, 19 bp, Homo sapiens
tcaaattcctaagttctgg

SEQ ID NO: 8136947 - DNA, 22 bp, Homo sapiens
tagaaagactgtccagatttca

SEQ ID NO: 8136948 - DNA, 22 bp, Homo sapiens
tagaaagacatgggccagcagc

SEQ ID NO: 8136949 - DNA, 22 bp, Homo sapiens
tagaaagagcatagtattataa

SEQ ID NO: 8136950 - DNA, 22 bp, Homo sapiens
tagaaagatctgtaggcaagag

SEQ ID NO: 8136951 - DNA, 22 bp, Homo sapiens
tagaaagagctttgcttccttt

SEQ ID NO: 8136952 - DNA, 19 bp, Homo sapiens
tagaaagatgatgggtggg

SEQ ID NO: 8136953 - DNA, 22 bp, Homo sapiens
tagaaagacagaggttttgtct

SEQ ID NO: 8136954 - DNA, 22 bp, Homo sapiens
tagaaagacaatgggaagtgct

SEQ ID NO: 8136955 - DNA, 22 bp, Homo sapiens
tacctagaccagttacaatgca

SEQ ID NO: 8136956 - DNA, 22 bp, Homo sapiens
tagaaatgttagatgtattgag

SEQ ID NO: 8136957 - DNA, 22 bp, Homo sapiens
tagaaattcaatgctctgagta

SEQ ID NO: 8136958 - DNA, 22 bp, Homo sapiens
cagggcagtaccgccctctggc

SEQ ID NO: 8136959 - DNA, 22 bp, Homo sapiens
tagcacaaagagtctttcagag

SEQ ID NO: 8136960 - DNA, 22 bp, Homo sapiens
tacagagagtacagcatccaca

SEQ ID NO: 8136961 - DNA, 20 bp, Homo sapiens
tacagagagctagctctctg

SEQ ID NO: 8136962 - DNA, 19 bp, Homo sapiens
tacacttgtaatgagcaga

SEQ ID NO: 8136963 - DNA, 22 bp, Homo sapiens
tacacagactcttcaattcaga

SEQ ID NO: 8136964 - DNA, 22 bp, Homo sapiens
tacacagatttcagtatcatca

SEQ ID NO: 8136965 - DNA, 20 bp, Homo sapiens
gtggagaggctggcgggact

SEQ ID NO: 8136966 - DNA, 22 bp, Homo sapiens
cattacaaagttataaacagtt

SEQ ID NO: 8136967 - DNA, 22 bp, Homo sapiens
catcaaatctgacttttcttcc

SEQ ID NO: 8136968 - DNA, 22 bp, Homo sapiens
tcactgtttgcagtgaagagaa

SEQ ID NO: 8136969 - DNA, 22 bp, Homo sapiens
tcactgtttcctgtactggaca

SEQ ID NO: 8136970 - DNA, 22 bp, Homo sapiens
tcactgttgacctggaagtggg

SEQ ID NO: 8136971 - DNA, 22 bp, Homo sapiens
tcaggaggccggcaggatttga

SEQ ID NO: 8136972 - DNA, 22 bp, Homo sapiens
tcatacataaataagagtttag

SEQ ID NO: 8136973 - DNA, 22 bp, Homo sapiens
tcatacaactaagagtttcaga

SEQ ID NO: 8136974 - DNA, 22 bp, Homo sapiens
ccaacacagatgtgttagtgtt

SEQ ID NO: 8136975 - DNA, 18 bp, Homo sapiens
tctagaaacccagactct

SEQ ID NO: 8136976 - DNA, 22 bp, Homo sapiens
tggagacatttctcattaaaaa

SEQ ID NO: 8136977 - DNA, 22 bp, Homo sapiens
tggtaggaatgattacgacttt

SEQ ID NO: 8136978 - DNA, 22 bp, Homo sapiens
tggtaggagatatggtctccga

SEQ ID NO: 8136979 - DNA, 22 bp, Homo sapiens
tgcagagaagaggacagttcta

SEQ ID NO: 8136980 - DNA, 22 bp, Homo sapiens
ccatatcagaagattgtcaccc

SEQ ID NO: 8136981 - DNA, 22 bp, Homo sapiens
ccatccacagtcttgattattt

SEQ ID NO: 8136982 - DNA, 21 bp, Homo sapiens
ccatccactgagtggttccct

SEQ ID NO: 8136983 - DNA, 22 bp, Homo sapiens
ccagtccagtgccatgcatggc

SEQ ID NO: 8136984 - DNA, 22 bp, Homo sapiens
ccagtccaggccatggattttg

SEQ ID NO: 8136985 - DNA, 22 bp, Homo sapiens
gaaagctctgcttcagcctgca

SEQ ID NO: 8136986 - DNA, 22 bp, Homo sapiens
gaaaattgaatcagtagctgat

SEQ ID NO: 8136987 - DNA, 22 bp, Homo sapiens
cttacattaagtaagagattga

SEQ ID NO: 8136988 - DNA, 22 bp, Homo sapiens
ctgtttgtgatttctacgattt

SEQ ID NO: 8136989 - DNA, 22 bp, Homo sapiens
ctgtttgtgattagcagtgggt

SEQ ID NO: 8136990 - DNA, 17 bp, Homo sapiens
ctgtttgttctgggagc

SEQ ID NO: 8136991 - DNA, 22 bp, Homo sapiens
ctgtttgttggctattgacagt

SEQ ID NO: 8136992 - DNA, 22 bp, Homo sapiens
ctgtttgtccaacttgtcccga

SEQ ID NO: 8136993 - DNA, 22 bp, Homo sapiens
ctgtttgtctctctcctgaccc

SEQ ID NO: 8136994 - DNA, 22 bp, Homo sapiens
ctgtacataaaggaataggtgt

SEQ ID NO: 8136995 - DNA, 22 bp, Homo sapiens
ctgtacatatgtctccagagtg

SEQ ID NO: 8136996 - DNA, 22 bp, Homo sapiens
ctgtacatcccaagatatttct

SEQ ID NO: 8136997 - DNA, 20 bp, Homo sapiens
ctgtacatcaccaaggtgac

SEQ ID NO: 8136998 - DNA, 22 bp, Homo sapiens
ctgtacatcccgagagccagta

SEQ ID NO: 8136999 - DNA, 22 bp, Homo sapiens
ctgtacatctctgaggacagta

SEQ ID NO: 8137000 - DNA, 22 bp, Homo sapiens
ctgtcaaatggaaacttatcct

SEQ ID NO: 8137001 - DNA, 22 bp, Homo sapiens
gaatattttcagtacagatggt

SEQ ID NO: 8137002 - DNA, 22 bp, Homo sapiens
gacactgtcccacagaattcga

SEQ ID NO: 8137003 - DNA, 22 bp, Homo sapiens
gagaaagattgtccttcagggg

SEQ ID NO: 8137004 - DNA, 22 bp, Homo sapiens
gagaaagatgtaggctgggagg

SEQ ID NO: 8137005 - DNA, 22 bp, Homo sapiens
gagaaagatgaagagtggcgtt

SEQ ID NO: 8137006 - DNA, 22 bp, Homo sapiens
gagaaagatggaatcttacagg

SEQ ID NO: 8137007 - DNA, 22 bp, Homo sapiens
gagaaagaaagggaagtttgtt

SEQ ID NO: 8137008 - DNA, 22 bp, Homo sapiens
gagaaagacgtaggctgggagg

SEQ ID NO: 8137009 - DNA, 22 bp, Homo sapiens
ctgaagatttttggtaatcatg

SEQ ID NO: 8137010 - DNA, 22 bp, Homo sapiens
ctgaagattcgcctttgtttat

SEQ ID NO: 8137011 - DNA, 22 bp, Homo sapiens
ctgaagatgttctttttggttc

SEQ ID NO: 8137012 - DNA, 22 bp, Homo sapiens
ctgaagattataaacagacata

SEQ ID NO: 8137013 - DNA, 20 bp, Homo sapiens
ttttcctgtggtttgatatg

SEQ ID NO: 8137014 - DNA, 22 bp, Homo sapiens
ttgtttcaaatatttcagaata

SEQ ID NO: 8137015 - DNA, 22 bp, Homo sapiens
ttgtttaatatcgtgaagtact

SEQ ID NO: 8137016 - DNA, 22 bp, Homo sapiens
ttgtttaatgcctcatacatct

SEQ ID NO: 8137017 - DNA, 22 bp, Homo sapiens
tttacaattggttttctctaat

SEQ ID NO: 8137018 - DNA, 22 bp, Homo sapiens
tttcttcttgatttaaacaggg

SEQ ID NO: 8137019 - DNA, 22 bp, Homo sapiens
cgcaaagagctctaaatcagac

SEQ ID NO: 8137020 - DNA, 22 bp, Homo sapiens
ttatgtaagtggagtcatatag

SEQ ID NO: 8137021 - DNA, 17 bp, Homo sapiens
tgttttcattcattgct

SEQ ID NO: 8137022 - DNA, 22 bp, Homo sapiens
tgttttcatggttatgtgtcta

SEQ ID NO: 8137023 - DNA, 22 bp, Homo sapiens
tgttttcatggagatggtggcg

SEQ ID NO: 8137024 - DNA, 22 bp, Homo sapiens
tgttttcatcacagaatgtaac

SEQ ID NO: 8137025 - DNA, 22 bp, Homo sapiens
tgttttcatttgatgtaacaaa

SEQ ID NO: 8137026 - DNA, 19 bp, Homo sapiens
tgtttcttcctccatctga

SEQ ID NO: 8137027 - DNA, 22 bp, Homo sapiens
tgtttcttctcacacaaactca

SEQ ID NO: 8137028 - DNA, 22 bp, Homo sapiens
ttccactgattttggttgacct

SEQ ID NO: 8137029 - DNA, 21 bp, Homo sapiens
ttctccttcttgatccaagca

SEQ ID NO: 8137030 - DNA, 22 bp, Homo sapiens
ttctcatatgcactctatttga

SEQ ID NO: 8137031 - DNA, 22 bp, Homo sapiens
ttctcatacaggatctcttatt

SEQ ID NO: 8137032 - DNA, 22 bp, Homo sapiens
ttctcatagagacatgattata

SEQ ID NO: 8137033 - DNA, 22 bp, Homo sapiens
ctacatacatatacatgcagtt

SEQ ID NO: 8137034 - DNA, 22 bp, Homo sapiens
ttctctttttgcatctcaacct

SEQ ID NO: 8137035 - DNA, 21 bp, Homo sapiens
ttcttcatgatgattaatggc

SEQ ID NO: 8137036 - DNA, 22 bp, Homo sapiens
ttcttcatgctgttgctgcttg

SEQ ID NO: 8137037 - DNA, 22 bp, Homo sapiens
ttgaaggaggctcctttttaaa

SEQ ID NO: 8137038 - DNA, 22 bp, Homo sapiens
ttgcaccaaatgagttaaaatt

SEQ ID NO: 8137039 - DNA, 21 bp, Homo sapiens
ttgcaccatgataaattcaga

SEQ ID NO: 8137040 - DNA, 22 bp, Homo sapiens
ttgcaccatttcacttccatta

SEQ ID NO: 8137041 - DNA, 21 bp, Homo sapiens
ggctggacatcccaggagact

SEQ ID NO: 8137042 - DNA, 22 bp, Homo sapiens
ggctggactctgggcctctcca

SEQ ID NO: 8137043 - DNA, 22 bp, Homo sapiens
ggctggaccatgctgccccttc

SEQ ID NO: 8137044 - DNA, 22 bp, Homo sapiens
ggctccagggagtggagagaag

SEQ ID NO: 8137045 - DNA, 22 bp, Homo sapiens
gggaatatggaagtggacactt

SEQ ID NO: 8137046 - DNA, 22 bp, Homo sapiens
gtagcagaatcagtgctacaga

SEQ ID NO: 8137047 - DNA, 22 bp, Homo sapiens
ggtaggagtgaagacttaagat

SEQ ID NO: 8137048 - DNA, 22 bp, Homo sapiens
ggtgggatgcctctggagaagt

SEQ ID NO: 8137049 - DNA, 22 bp, Homo sapiens
gcaagaaaagagccttcagtgg

SEQ ID NO: 8137050 - DNA, 22 bp, Homo sapiens
gctgaagagacttctgttcgaa

SEQ ID NO: 8137051 - DNA, 22 bp, Homo sapiens
gctgaagacctccctctccatg

SEQ ID NO: 8137052 - DNA, 22 bp, Homo sapiens
gctgaagataagtgaagaggct

SEQ ID NO: 8137053 - DNA, 22 bp, Homo sapiens
gctgaagagcaaggctgggtct

SEQ ID NO: 8137054 - DNA, 22 bp, Homo sapiens
gctgaagagagatgcgtccagc

SEQ ID NO: 8137055 - DNA, 23 bp, Homo sapiens
gctgaagagcaaaccaggcaaaa

SEQ ID NO: 8137056 - DNA, 22 bp, Homo sapiens
gctgaagagaggccttgagcac

SEQ ID NO: 8137057 - DNA, 22 bp, Homo sapiens
gctcaggcctccagaggggcaa

SEQ ID NO: 8137058 - DNA, 22 bp, Homo sapiens
gctcaggctctcccaggggaat

SEQ ID NO: 8137059 - DNA, 20 bp, Homo sapiens
gctgaagattcccatgcaag

SEQ ID NO: 8137060 - DNA, 22 bp, Homo sapiens
gctgaagatgcatcccttctct

SEQ ID NO: 8137061 - DNA, 22 bp, Homo sapiens
gctgaagataggcatttcagca

SEQ ID NO: 8137062 - DNA, 22 bp, Homo sapiens
gctgaagatttttgctagcccc

SEQ ID NO: 8137063 - DNA, 22 bp, Homo sapiens
gctggcacaggtggatgctggc

SEQ ID NO: 8137064 - DNA, 22 bp, Homo sapiens
gctggcactgggaaggactgag

SEQ ID NO: 8137065 - DNA, 22 bp, Homo sapiens
gctgggttttcttccgggccta

SEQ ID NO: 8137066 - DNA, 22 bp, Homo sapiens
ggaaagctttgttttcctcacc

SEQ ID NO: 8137067 - DNA, 22 bp, Homo sapiens
ggaaagctcagatcttgttgga

SEQ ID NO: 8137068 - DNA, 22 bp, Homo sapiens
ggagagctggtagctggctcca

SEQ ID NO: 8137069 - DNA, 22 bp, Homo sapiens
tattcacaggcacgaaatattg

SEQ ID NO: 8137070 - DNA, 23 bp, Homo sapiens
tatgttaggtttgcaagccagat

SEQ ID NO: 8137071 - DNA, 22 bp, Homo sapiens
tattgcagacaaaatgagctac

SEQ ID NO: 8137072 - DNA, 22 bp, Homo sapiens
tattttcaccttctctggatat

SEQ ID NO: 8137073 - DNA, 22 bp, Homo sapiens
tagcacaagaagtacacataga

SEQ ID NO: 8137074 - DNA, 22 bp, Homo sapiens
tagtcacctttggcacctgcaa

SEQ ID NO: 8137075 - DNA, 22 bp, Homo sapiens
taacttctgcacagaaaatttg

SEQ ID NO: 8137076 - DNA, 22 bp, Homo sapiens
taacttctgaatagcaatagta

SEQ ID NO: 8137077 - DNA, 22 bp, Homo sapiens
taacttctttggtttaaagaga

SEQ ID NO: 8137078 - DNA, 16 bp, Homo sapiens
taacttcttccttcaa

SEQ ID NO: 8137079 - DNA, 22 bp, Homo sapiens
taacttctggaaatgcatctgc

SEQ ID NO: 8137080 - DNA, 22 bp, Homo sapiens
taacacatggttagtacacaat

SEQ ID NO: 8137081 - DNA, 22 bp, Homo sapiens
taacacatgtctgggatgtgaa

SEQ ID NO: 8137082 - DNA, 22 bp, Homo sapiens
taacacattttaagccatttta

SEQ ID NO: 8137083 - DNA, 21 bp, Homo sapiens
taacacattttggtactttgg

SEQ ID NO: 8137084 - DNA, 22 bp, Homo sapiens
taaatacagtcatttgagccat

SEQ ID NO: 8137085 - DNA, 22 bp, Homo sapiens
gttttatttccatgagagaccg

SEQ ID NO: 8137086 - DNA, 21 bp, Homo sapiens
gttttcatgatagagtctgta

SEQ ID NO: 8137087 - DNA, 20 bp, Homo sapiens
gttaggaggttggacatgga

SEQ ID NO: 8137088 - DNA, 22 bp, Homo sapiens
gttactcttgagaggctgaggt

SEQ ID NO: 8137089 - DNA, 22 bp, Homo sapiens
gtttctcatcagtttctgatat

SEQ ID NO: 8137090 - DNA, 22 bp, Homo sapiens
tacacatgctcagattcctgtg

SEQ ID NO: 8137091 - DNA, 22 bp, Homo sapiens
tacacatgtttggcaagtatgt

SEQ ID NO: 8137092 - DNA, 22 bp, Homo sapiens
tacacaaaggcactctgttgtt

SEQ ID NO: 8137093 - DNA, 21 bp, Homo sapiens
tacacaaagcgtggtccagag

SEQ ID NO: 8137094 - DNA, 22 bp, Homo sapiens
tacacatgacagtggactgaga

SEQ ID NO: 8137095 - DNA, 22 bp, Homo sapiens
taatgactgccgtctctcttca

SEQ ID NO: 8137096 - DNA, 22 bp, Homo sapiens
taatttcacagttcaacgcaca

SEQ ID NO: 8137097 - DNA, 22 bp, Homo sapiens
taatgcttaattttcacaagcc

SEQ ID NO: 8137098 - DNA, 22 bp, Homo sapiens
taatgcttcctatatagcactc

SEQ ID NO: 8137099 - DNA, 22 bp, Homo sapiens
tactgctgattagagctgaggt

SEQ ID NO: 8137100 - DNA, 22 bp, Homo sapiens
tacatacagtggatgctttagg

SEQ ID NO: 8137101 - DNA, 22 bp, Homo sapiens
tacatacacaaatatactgttt

SEQ ID NO: 8137102 - DNA, 22 bp, Homo sapiens
tacatacagagatgctagttaa

SEQ ID NO: 8137103 - DNA, 22 bp, Homo sapiens
tcccagagtgtgggcatcaagg

SEQ ID NO: 8137104 - DNA, 20 bp, Homo sapiens
tcatgttgggccatcagaat

SEQ ID NO: 8137105 - DNA, 22 bp, Homo sapiens
tccaccagttcaccttgtagca

SEQ ID NO: 8137106 - DNA, 18 bp, Homo sapiens
tccaccagtcaatctgtc

SEQ ID NO: 8137107 - DNA, 22 bp, Homo sapiens
tccaccagcagcctgtcagcct

SEQ ID NO: 8137108 - DNA, 22 bp, Homo sapiens
tccaccagagccctctttgcgg

SEQ ID NO: 8137109 - DNA, 22 bp, Homo sapiens
tccaccagagccttcccatgct

SEQ ID NO: 8137110 - DNA, 22 bp, Homo sapiens
tccaccagggtttcatctccct

SEQ ID NO: 8137111 - DNA, 22 bp, Homo sapiens
tccaccaggctccatgttcagt

SEQ ID NO: 8137112 - DNA, 20 bp, Homo sapiens
tccaccaggaagggtaggga

SEQ ID NO: 8137113 - DNA, 22 bp, Homo sapiens
tccaccagccaggcccaggctg

SEQ ID NO: 8137114 - DNA, 21 bp, Homo sapiens
tccaccagctcttcctcttca

SEQ ID NO: 8137115 - DNA, 22 bp, Homo sapiens
tccaccagcttcttcaccagct

SEQ ID NO: 8137116 - DNA, 22 bp, Homo sapiens
tcctcatagactgactgcttgc

SEQ ID NO: 8137117 - DNA, 22 bp, Homo sapiens
tccctgtgcctatatgtgctga

SEQ ID NO: 8137118 - DNA, 22 bp, Homo sapiens
tcagggactaggtgctgcctga

SEQ ID NO: 8137119 - DNA, 21 bp, Homo sapiens
tcagggactaggtactgggga

SEQ ID NO: 8137120 - DNA, 22 bp, Homo sapiens
tcagggacttacaaaccagaag

SEQ ID NO: 8137121 - DNA, 22 bp, Homo sapiens
tcagggactgttactgcctttg

SEQ ID NO: 8137122 - DNA, 22 bp, Homo sapiens
tcagggactgcagagggaagct

SEQ ID NO: 8137123 - DNA, 22 bp, Homo sapiens
tcagggttgtgaaggaaagggg

SEQ ID NO: 8137124 - DNA, 22 bp, Homo sapiens
tcagggttgtggtggaattcag

SEQ ID NO: 8137125 - DNA, 20 bp, Homo sapiens
tcatggctgctgagaggttc

SEQ ID NO: 8137126 - DNA, 22 bp, Homo sapiens
tcataaagagtgctgttgtttt

SEQ ID NO: 8137127 - DNA, 22 bp, Homo sapiens
tcagagacagtattggctattg

SEQ ID NO: 8137128 - DNA, 22 bp, Homo sapiens
tcagagactggtctgcagatgc

SEQ ID NO: 8137129 - DNA, 22 bp, Homo sapiens
tcagagacctagcaagaaattg

SEQ ID NO: 8137130 - DNA, 22 bp, Homo sapiens
tcagaggcagctgatgttctgt

SEQ ID NO: 8137131 - DNA, 21 bp, Homo sapiens
tcactggaatacaattgattt

SEQ ID NO: 8137132 - DNA, 20 bp, Homo sapiens
tcacatgcatattcgtttct

SEQ ID NO: 8137133 - DNA, 22 bp, Homo sapiens
tcacatgagtcactatcttaat

SEQ ID NO: 8137134 - DNA, 22 bp, Homo sapiens
tcacatgaggttatgacaaagc

SEQ ID NO: 8137135 - DNA, 21 bp, Homo sapiens
tcacgtggtcacatgagcttt

SEQ ID NO: 8137136 - DNA, 22 bp, Homo sapiens
tcaaaagtttcacatagagata

SEQ ID NO: 8137137 - DNA, 22 bp, Homo sapiens
tcaaaagtctgcattcttcaca

SEQ ID NO: 8137138 - DNA, 22 bp, Homo sapiens
tcaaaagtggcctgtaaaatct

SEQ ID NO: 8137139 - DNA, 22 bp, Homo sapiens
tcaaacactgtaacatggaaaa

SEQ ID NO: 8137140 - DNA, 22 bp, Homo sapiens
tcaaacaccatctgaccttatg

SEQ ID NO: 8137141 - DNA, 22 bp, Homo sapiens
tcaaaattctagggagaatggt

SEQ ID NO: 8137142 - DNA, 22 bp, Homo sapiens
tcaatgtttggaaatcctttgt

SEQ ID NO: 8137143 - DNA, 22 bp, Homo sapiens
tcacagcatttttagaaagatt

SEQ ID NO: 8137144 - DNA, 22 bp, Homo sapiens
tttgtcatttccctgattaaag

SEQ ID NO: 8137145 - DNA, 22 bp, Homo sapiens
tttgtcatcccttttgaaactg

SEQ ID NO: 8137146 - DNA, 22 bp, Homo sapiens
tttgtcatcagttattaatatg

SEQ ID NO: 8137147 - DNA, 22 bp, Homo sapiens
tttgtcttatccaatctctcag

SEQ ID NO: 8137148 - DNA, 22 bp, Homo sapiens
ttttacacctcagatgagcaga

SEQ ID NO: 8137149 - DNA, 22 bp, Homo sapiens
tttgtgtaccttgtacatttgt

SEQ ID NO: 8137150 - DNA, 22 bp, Homo sapiens
tttgtgtatgcttcacctagcc

SEQ ID NO: 8137151 - DNA, 22 bp, Homo sapiens
ttctaaattttggaagatgcag

SEQ ID NO: 8137152 - DNA, 22 bp, Homo sapiens
ttctcttttagaggctccatga

SEQ ID NO: 8137153 - DNA, 20 bp, Homo sapiens
ttctgcctagggttagcctg

SEQ ID NO: 8137154 - DNA, 22 bp, Homo sapiens
ttctgccagtgatcaataattg

SEQ ID NO: 8137155 - DNA, 22 bp, Homo sapiens
ttctcttacattttctcagcct

SEQ ID NO: 8137156 - DNA, 22 bp, Homo sapiens
ttcaatatctctaagaatgagg

SEQ ID NO: 8137157 - DNA, 22 bp, Homo sapiens
ttcaagtagtcacacatgatat

SEQ ID NO: 8137158 - DNA, 22 bp, Homo sapiens
ttcaagtacattgtgttttcct

SEQ ID NO: 8137159 - DNA, 22 bp, Homo sapiens
ttcaagtaaatcactttttgtc

SEQ ID NO: 8137160 - DNA, 22 bp, Homo sapiens
ttcactgtgatggtgcagaggc

SEQ ID NO: 8137161 - DNA, 22 bp, Homo sapiens
ttcactgttggctttgcttgtc

SEQ ID NO: 8137162 - DNA, 22 bp, Homo sapiens
ttcatactcactccaataactg

SEQ ID NO: 8137163 - DNA, 22 bp, Homo sapiens
ttcaaacacagacagcagcatg

SEQ ID NO: 8137164 - DNA, 22 bp, Homo sapiens
ttcaagaatcttcctgaccact

SEQ ID NO: 8137165 - DNA, 22 bp, Homo sapiens
ttcaaggagattggagtctact

SEQ ID NO: 8137166 - DNA, 22 bp, Homo sapiens
ttcaaggaaaccagcatttggt

SEQ ID NO: 8137167 - DNA, 22 bp, Homo sapiens
ttcaaaagcggtccaggaagat

SEQ ID NO: 8137168 - DNA, 22 bp, Homo sapiens
ttcaaaagtaatcagtattaga

SEQ ID NO: 8137169 - DNA, 22 bp, Homo sapiens
ttcaaaagactcagatgtagcg

SEQ ID NO: 8137170 - DNA, 22 bp, Homo sapiens
ttgtttaaaagaaatcatagaa

SEQ ID NO: 8137171 - DNA, 22 bp, Homo sapiens
ttgtttaaaatgtagcaagaaa

SEQ ID NO: 8137172 - DNA, 22 bp, Homo sapiens
tttcaagtggcgagataaggaa

SEQ ID NO: 8137173 - DNA, 22 bp, Homo sapiens
tttcctttgcccaatacatgtc

SEQ ID NO: 8137174 - DNA, 23 bp, Homo sapiens
tttcatatggtgtggatgaagaa

SEQ ID NO: 8137175 - DNA, 22 bp, Homo sapiens
ttgccacacaagtaaagaaaca

SEQ ID NO: 8137176 - DNA, 22 bp, Homo sapiens
ttggaatcaattcatgttgcaa

SEQ ID NO: 8137177 - DNA, 22 bp, Homo sapiens
ttggattcagtcttgcagattc

SEQ ID NO: 8137178 - DNA, 22 bp, Homo sapiens
ttgttatttacaacaatcctat

SEQ ID NO: 8137179 - DNA, 22 bp, Homo sapiens
ttgtagcagggatcagaataca

SEQ ID NO: 8137180 - DNA, 22 bp, Homo sapiens
aaagtcacatagcatcacttct

SEQ ID NO: 8137181 - DNA, 22 bp, Homo sapiens
aaagtcacaatattggaaggtg

SEQ ID NO: 8137182 - DNA, 22 bp, Homo sapiens
aaagtcacagtttaggggatat

SEQ ID NO: 8137183 - DNA, 22 bp, Homo sapiens
aaagcttttcagtatgttcatg

SEQ ID NO: 8137184 - DNA, 22 bp, Homo sapiens
aaagccatcagtaaaatgattt

SEQ ID NO: 8137185 - DNA, 22 bp, Homo sapiens
aacaaacaaacattttgtcatc

SEQ ID NO: 8137186 - DNA, 22 bp, Homo sapiens
aaagtgttatgcaaaactctgt

SEQ ID NO: 8137187 - DNA, 22 bp, Homo sapiens
aaagtgttgaagaaaatgttca

SEQ ID NO: 8137188 - DNA, 22 bp, Homo sapiens
aaagtgttatgagaactaagtg

SEQ ID NO: 8137189 - DNA, 22 bp, Homo sapiens
aaaatgaataagttaacccagg

SEQ ID NO: 8137190 - DNA, 22 bp, Homo sapiens
aaacaaggtccttctgtgacat

SEQ ID NO: 8137191 - DNA, 22 bp, Homo sapiens
aaagacctgtggtagctctaaa

SEQ ID NO: 8137192 - DNA, 22 bp, Homo sapiens
aaagactaaacaaccaatatct

SEQ ID NO: 8137193 - DNA, 22 bp, Homo sapiens
aaagacctgaaatataatctag

SEQ ID NO: 8137194 - DNA, 23 bp, Homo sapiens
aaagacctaggatgagggagacg

SEQ ID NO: 8137195 - DNA, 21 bp, Homo sapiens
aaaatcaccttaggtcactgg

SEQ ID NO: 8137196 - DNA, 22 bp, Homo sapiens
aaattagaaatactttcaaagc

SEQ ID NO: 8137197 - DNA, 22 bp, Homo sapiens
acaaagattcatttgcattatt

SEQ ID NO: 8137198 - DNA, 22 bp, Homo sapiens
aagaataagaggatttagaaca

SEQ ID NO: 8137199 - DNA, 22 bp, Homo sapiens
aatgttttacagatcccattag

SEQ ID NO: 8137200 - DNA, 22 bp, Homo sapiens
aatgttttagattactgctggg

SEQ ID NO: 8137201 - DNA, 22 bp, Homo sapiens
aagcatttggcatgaaactctt

SEQ ID NO: 8137202 - DNA, 22 bp, Homo sapiens
aagcatttgtgaaattcagatg

SEQ ID NO: 8137203 - DNA, 22 bp, Homo sapiens
aacatgcccgctgtatgccatt

SEQ ID NO: 8137204 - DNA, 22 bp, Homo sapiens
aacatgaaacccaaacagaata

SEQ ID NO: 8137205 - DNA, 22 bp, Homo sapiens
aaattgcattgagctgcttatt

SEQ ID NO: 8137206 - DNA, 22 bp, Homo sapiens
aaatgtgcttgtgatcagctgt

SEQ ID NO: 8137207 - DNA, 22 bp, Homo sapiens
aaatgtgatactgttcttttta

SEQ ID NO: 8137208 - DNA, 22 bp, Homo sapiens
aaatgttttgctcccatgtggt

SEQ ID NO: 8137209 - DNA, 22 bp, Homo sapiens
aacaaagtttcaggaagataga

SEQ ID NO: 8137210 - DNA, 22 bp, Homo sapiens
aacagcagctttcaggatcatc

SEQ ID NO: 8137211 - DNA, 22 bp, Homo sapiens
aagtttatgttggtaagatatc

SEQ ID NO: 8137212 - DNA, 22 bp, Homo sapiens
aagtcacccacaggcagcagaa

SEQ ID NO: 8137213 - DNA, 22 bp, Homo sapiens
aagtcaccctagggcctggact

SEQ ID NO: 8137214 - DNA, 18 bp, Homo sapiens
aagtcacccctgctccct

SEQ ID NO: 8137215 - DNA, 22 bp, Homo sapiens
aagtcaccccacactcttggga

SEQ ID NO: 8137216 - DNA, 18 bp, Homo sapiens
aatatcaataagggggag

SEQ ID NO: 8137217 - DNA, 22 bp, Homo sapiens
aatatcacaggaggagaccaag

SEQ ID NO: 8137218 - DNA, 22 bp, Homo sapiens
aatcaaaacctacagaggtaat

SEQ ID NO: 8137219 - DNA, 22 bp, Homo sapiens
aatattttaggctttccaggct

SEQ ID NO: 8137220 - DNA, 19 bp, Homo sapiens
aatgactgagtacattgtc

SEQ ID NO: 8137221 - DNA, 22 bp, Homo sapiens
aatgaatgtttgttgagtgaag

SEQ ID NO: 8137222 - DNA, 22 bp, Homo sapiens
aatgagcaaatgaagacgctgt

SEQ ID NO: 8137223 - DNA, 22 bp, Homo sapiens
aaggaaatacttctgcagagca

SEQ ID NO: 8137224 - DNA, 22 bp, Homo sapiens
accatccaaactgctttctgtg

SEQ ID NO: 8137225 - DNA, 22 bp, Homo sapiens
accatgttggccaagctggtct

SEQ ID NO: 8137226 - DNA, 22 bp, Homo sapiens
acaatgtttttgttcaaagagt

SEQ ID NO: 8137227 - DNA, 22 bp, Homo sapiens
acaattctgatggtttcccagt

SEQ ID NO: 8137228 - DNA, 22 bp, Homo sapiens
acaaatgagaatgtagacagag

SEQ ID NO: 8137229 - DNA, 22 bp, Homo sapiens
acaaagaaggaattggtcttta

SEQ ID NO: 8137230 - DNA, 22 bp, Homo sapiens
acaaacttatgtttcatatgta

SEQ ID NO: 8137231 - DNA, 22 bp, Homo sapiens
acaaacttccatcatgaatttt

SEQ ID NO: 8137232 - DNA, 22 bp, Homo sapiens
acaaaccagcttaagcaagatg

SEQ ID NO: 8137233 - DNA, 22 bp, Homo sapiens
acaaaattatgaagaggccttg

SEQ ID NO: 8137234 - DNA, 22 bp, Homo sapiens
acaaacacgagacgccactgtg

SEQ ID NO: 8137235 - DNA, 22 bp, Homo sapiens
acaaaattgtgttaaactttat

SEQ ID NO: 8137236 - DNA, 22 bp, Homo sapiens
aatgtttggctagatagatgga

SEQ ID NO: 8137237 - DNA, 22 bp, Homo sapiens
aatgttatttctgcatagtagt

SEQ ID NO: 8137238 - DNA, 22 bp, Homo sapiens
acagaaattgggcaaatggaag

SEQ ID NO: 8137239 - DNA, 22 bp, Homo sapiens
acagaaattgctaatagctcat

SEQ ID NO: 8137240 - DNA, 22 bp, Homo sapiens
acacagcaacttgcagtatgga

SEQ ID NO: 8137241 - DNA, 22 bp, Homo sapiens
acagagttacataacttgtcca

SEQ ID NO: 8137242 - DNA, 22 bp, Homo sapiens
acagagttgtgtttgtacaacg

SEQ ID NO: 8137243 - DNA, 22 bp, Homo sapiens
acagagtttatgtgtgtacaaa

SEQ ID NO: 8137244 - DNA, 22 bp, Homo sapiens
acagcaggcatgaagaaatgtt

SEQ ID NO: 8137245 - DNA, 22 bp, Homo sapiens
atttggatatcactgaatacat

SEQ ID NO: 8137246 - DNA, 21 bp, Homo sapiens
atttggatattgctggcaaat

SEQ ID NO: 8137247 - DNA, 22 bp, Homo sapiens
atttggattcttatttagcact

SEQ ID NO: 8137248 - DNA, 22 bp, Homo sapiens
atttggatgcactaaataaaat

SEQ ID NO: 8137249 - DNA, 22 bp, Homo sapiens
atttggatgaacaatggaaaaa

SEQ ID NO: 8137250 - DNA, 22 bp, Homo sapiens
atttgttgttgctcccctaaga

SEQ ID NO: 8137251 - DNA, 17 bp, Homo sapiens
atttgtgatgtaacgtc

SEQ ID NO: 8137252 - DNA, 22 bp, Homo sapiens
agagtttgtatttttcagtgaa

SEQ ID NO: 8137253 - DNA, 22 bp, Homo sapiens
agagtttggtgaagcaatttga

SEQ ID NO: 8137254 - DNA, 22 bp, Homo sapiens
agagtttggaggtgttcctgga

SEQ ID NO: 8137255 - DNA, 22 bp, Homo sapiens
agagtttgaagttatctttgac

SEQ ID NO: 8137256 - DNA, 22 bp, Homo sapiens
agagtttggagagggtgaggca

SEQ ID NO: 8137257 - DNA, 22 bp, Homo sapiens
agagtttgtgggcttttcctcc

SEQ ID NO: 8137258 - DNA, 22 bp, Homo sapiens
agagtttgttgaatttacttgg

SEQ ID NO: 8137259 - DNA, 22 bp, Homo sapiens
attcatttagagggattaagca

SEQ ID NO: 8137260 - DNA, 22 bp, Homo sapiens
attcatttaggtattcacttac

SEQ ID NO: 8137261 - DNA, 22 bp, Homo sapiens
attcatgtagtgattgagtcac

SEQ ID NO: 8137262 - DNA, 22 bp, Homo sapiens
attcatgtaaaattggatagac

SEQ ID NO: 8137263 - DNA, 22 bp, Homo sapiens
attcatgtaacattagagaaat

SEQ ID NO: 8137264 - DNA, 22 bp, Homo sapiens
attcatgttagcccacatgtag

SEQ ID NO: 8137265 - DNA, 22 bp, Homo sapiens
agagctgtttattgatgtcaca

SEQ ID NO: 8137266 - DNA, 22 bp, Homo sapiens
agacatattggcttgctttaat

SEQ ID NO: 8137267 - DNA, 17 bp, Homo sapiens
atgcacatgtaagagga

SEQ ID NO: 8137268 - DNA, 22 bp, Homo sapiens
atgcacatgtatgtcaatattt

SEQ ID NO: 8137269 - DNA, 22 bp, Homo sapiens
atgcacattgtagccacacaat

SEQ ID NO: 8137270 - DNA, 22 bp, Homo sapiens
atgacaagggttgacacatgtc

SEQ ID NO: 8137271 - DNA, 20 bp, Homo sapiens
atgcacatacgcatgcacat

SEQ ID NO: 8137272 - DNA, 22 bp, Homo sapiens
atgcacataggccaaatcattt

SEQ ID NO: 8137273 - DNA, 22 bp, Homo sapiens
atgacaaattcagaccatagca

SEQ ID NO: 8137274 - DNA, 21 bp, Homo sapiens
agaagtcaattgaactgaaat

SEQ ID NO: 8137275 - DNA, 22 bp, Homo sapiens
agagaccttttgccttctagtt

SEQ ID NO: 8137276 - DNA, 22 bp, Homo sapiens
agagacctttgttattctagga

SEQ ID NO: 8137277 - DNA, 23 bp, Homo sapiens
agagactataagttatgttctgt

SEQ ID NO: 8137278 - DNA, 22 bp, Homo sapiens
agagacatgcagttgttgtgaa

SEQ ID NO: 8137279 - DNA, 22 bp, Homo sapiens
agagaccaagggaatagtctca

SEQ ID NO: 8137280 - DNA, 22 bp, Homo sapiens
cagaaatatatatgggtcagag

SEQ ID NO: 8137281 - DNA, 22 bp, Homo sapiens
cagcaggatatggtggagagag

SEQ ID NO: 8137282 - DNA, 22 bp, Homo sapiens
caagcactgtggcactcgcagg

SEQ ID NO: 8137283 - DNA, 20 bp, Homo sapiens
cacaagagaatacacactgg

SEQ ID NO: 8137284 - DNA, 22 bp, Homo sapiens
cacaagaaataagctgcctttc

SEQ ID NO: 8137285 - DNA, 20 bp, Homo sapiens
cacaagaggagttccctgag

SEQ ID NO: 8137286 - DNA, 22 bp, Homo sapiens
caacagaaggtgtactactgaa

SEQ ID NO: 8137287 - DNA, 22 bp, Homo sapiens
agcaaagacagggacgaccaag

SEQ ID NO: 8137288 - DNA, 22 bp, Homo sapiens
agcaaagagtaattttgttttg

SEQ ID NO: 8137289 - DNA, 22 bp, Homo sapiens
agcaaagatgtccggggcaagc

SEQ ID NO: 8137290 - DNA, 22 bp, Homo sapiens
agcaaagaaatggaggctcaga

SEQ ID NO: 8137291 - DNA, 22 bp, Homo sapiens
agcaaagaagacacaggcttca

SEQ ID NO: 8137292 - DNA, 22 bp, Homo sapiens
agcaaagaagggttcttcatta

SEQ ID NO: 8137293 - DNA, 22 bp, Homo sapiens
caaaagtctgtcctttaacttc

SEQ ID NO: 8137294 - DNA, 22 bp, Homo sapiens
caaaagtcttcctattctctta

SEQ ID NO: 8137295 - DNA, 22 bp, Homo sapiens
cacacaaatattctggaggcaa

SEQ ID NO: 8137296 - DNA, 22 bp, Homo sapiens
cacaattttcctttaagtgtat

SEQ ID NO: 8137297 - DNA, 22 bp, Homo sapiens
cacagtttggttttgctgtaat

SEQ ID NO: 8137298 - DNA, 22 bp, Homo sapiens
actgtatttggatataagatct

SEQ ID NO: 8137299 - DNA, 22 bp, Homo sapiens
atacaggttgaattttctttta

SEQ ID NO: 8137300 - DNA, 22 bp, Homo sapiens
atactgtaatacctaaatgaac

SEQ ID NO: 8137301 - DNA, 22 bp, Homo sapiens
atacatgttgtaccatatgttt

SEQ ID NO: 8137302 - DNA, 22 bp, Homo sapiens
acttctttcacaatgtttctag

SEQ ID NO: 8137303 - DNA, 22 bp, Homo sapiens
agtcaacacattaaacctaggg

SEQ ID NO: 8137304 - DNA, 22 bp, Homo sapiens
acccagctggatgcatggaggc

SEQ ID NO: 8137305 - DNA, 22 bp, Homo sapiens
accagctctggacaggcatttc

SEQ ID NO: 8137306 - DNA, 22 bp, Homo sapiens
accagcattggacttagaatgc

SEQ ID NO: 8137307 - DNA, 22 bp, Homo sapiens
acatgcttccaaattatgttgg

SEQ ID NO: 8137308 - DNA, 22 bp, Homo sapiens
acatgccagcactgcttttcag

SEQ ID NO: 8137309 - DNA, 22 bp, Homo sapiens
acatgccatgaaggtatttttg

SEQ ID NO: 8137310 - DNA, 22 bp, Homo sapiens
acatgccatggttgtttgctgc

SEQ ID NO: 8137311 - DNA, 22 bp, Homo sapiens
acatcatgagagacttaaattg

SEQ ID NO: 8137312 - DNA, 22 bp, Homo sapiens
acatgttgtttgccccagttgt

SEQ ID NO: 8137313 - DNA, 22 bp, Homo sapiens
acatgttgctaaatccaatggt

SEQ ID NO: 8137314 - DNA, 22 bp, Homo sapiens
acatgtgtaaggtctctcagtc

SEQ ID NO: 8137315 - DNA, 22 bp, Homo sapiens
agctgaaggctagaacagctgg

SEQ ID NO: 8137316 - DNA, 22 bp, Homo sapiens
agctgaagggaggatatgtaca

SEQ ID NO: 8137317 - DNA, 20 bp, Homo sapiens
agctgaagcccttggggaaa

SEQ ID NO: 8137318 - DNA, 22 bp, Homo sapiens
agctgaagctcagcccagtagt

SEQ ID NO: 8137319 - DNA, 22 bp, Homo sapiens
agctgaagcagtcagttcagct

SEQ ID NO: 8137320 - DNA, 22 bp, Homo sapiens
agctgaagcactgggatggaag

SEQ ID NO: 8137321 - DNA, 22 bp, Homo sapiens
agctgaagtttagaattgtgaa

SEQ ID NO: 8137322 - DNA, 22 bp, Homo sapiens
agctgaagttcagtccagagaa

SEQ ID NO: 8137323 - DNA, 22 bp, Homo sapiens
agctgaagtgttggtggtttca

SEQ ID NO: 8137324 - DNA, 22 bp, Homo sapiens
agctgaagtcctcgcggtgcta

SEQ ID NO: 8137325 - DNA, 22 bp, Homo sapiens
acagctgtattcaagttgcaag

SEQ ID NO: 8137326 - DNA, 22 bp, Homo sapiens
aggacacaacatcatttctgtg

SEQ ID NO: 8137327 - DNA, 22 bp, Homo sapiens
acagggacctgtgagctccata

SEQ ID NO: 8137328 - DNA, 22 bp, Homo sapiens
acagggaccttggaagctggaa

SEQ ID NO: 8137329 - DNA, 22 bp, Homo sapiens
acaggtttgtctgatgtaatga

SEQ ID NO: 8137330 - DNA, 20 bp, Homo sapiens
acatatcatggtagagtcct

SEQ ID NO: 8137331 - DNA, 22 bp, Homo sapiens
catttgttctgatttcaaaagg

SEQ ID NO: 8137332 - DNA, 22 bp, Homo sapiens
aggatttgaacctaggcaatca

SEQ ID NO: 8137333 - DNA, 22 bp, Homo sapiens
catgtccacagttctgagaggc

SEQ ID NO: 8137334 - DNA, 22 bp, Homo sapiens
catagacattgataggttatat

SEQ ID NO: 8137335 - DNA, 22 bp, Homo sapiens
cagctgaagcccaggcagaacc

SEQ ID NO: 8137336 - DNA, 22 bp, Homo sapiens
cagctgaatcagtgagtggaaa

SEQ ID NO: 8137337 - DNA, 22 bp, Homo sapiens
cagctgaaggtaggaaccagga

SEQ ID NO: 8137338 - DNA, 22 bp, Homo sapiens
cagctgaagctcttgtcaaagg

SEQ ID NO: 8137339 - DNA, 22 bp, Homo sapiens
cagctgaattcttcagactcca

SEQ ID NO: 8137340 - DNA, 22 bp, Homo sapiens
cagctgaatggctccctgctaa

SEQ ID NO: 8137341 - DNA, 22 bp, Homo sapiens
agggctgcaggcaagatatggc

SEQ ID NO: 8137342 - DNA, 22 bp, Homo sapiens
agggctcattgacatggaaaag

SEQ ID NO: 8137343 - DNA, 22 bp, Homo sapiens
agggctcatctgagactgacat

SEQ ID NO: 8137344 - DNA, 22 bp, Homo sapiens
agggctcataattcctgacttc

SEQ ID NO: 8137345 - DNA, 21 bp, Homo sapiens
agggctcaaatgtgcttgctg

SEQ ID NO: 8137346 - DNA, 22 bp, Homo sapiens
ccagctttatagcttcaaagga

SEQ ID NO: 8137347 - DNA, 22 bp, Homo sapiens
ccagggactttgcattgtttat

SEQ ID NO: 8137348 - DNA, 22 bp, Homo sapiens
aggctcagttctgtggtgagcc

SEQ ID NO: 8137349 - DNA, 22 bp, Homo sapiens
aggctcagtatagctggcaagt

SEQ ID NO: 8137350 - DNA, 22 bp, Homo sapiens
aggctcagtctgttcatgcact

SEQ ID NO: 8137351 - DNA, 22 bp, Homo sapiens
atacatgacagcatagcatcct

SEQ ID NO: 8137352 - DNA, 22 bp, Homo sapiens
atactttgctagtatcagtgtg

SEQ ID NO: 8137353 - DNA, 22 bp, Homo sapiens
agttttcagaaattgcgaccca

SEQ ID NO: 8137354 - DNA, 22 bp, Homo sapiens
agttttcacactcaccaaaagg

SEQ ID NO: 8137355 - DNA, 22 bp, Homo sapiens
agttttcaggaaagagttggtg

SEQ ID NO: 8137356 - DNA, 20 bp, Homo sapiens
agttttcagcagaacaccca

SEQ ID NO: 8137357 - DNA, 22 bp, Homo sapiens
agttttcagggtttctgtcctc

SEQ ID NO: 8137358 - DNA, 22 bp, Homo sapiens
agttttcagtaaatattagtga

SEQ ID NO: 8137359 - DNA, 22 bp, Homo sapiens
agttttcattaccatgctgcaa

SEQ ID NO: 8137360 - DNA, 22 bp, Homo sapiens
agttttcaatatatgatagtga

SEQ ID NO: 8137361 - DNA, 23 bp, Homo sapiens
agttttcaagttggtggctggca

SEQ ID NO: 8137362 - DNA, 22 bp, Homo sapiens
atatcacaaacaagtctgtact

SEQ ID NO: 8137363 - DNA, 22 bp, Homo sapiens
atatcaaaataaacagcatgca

SEQ ID NO: 8137364 - DNA, 22 bp, Homo sapiens
atatcacagatgcagaaagaga

SEQ ID NO: 8137365 - DNA, 22 bp, Homo sapiens
ctgtttccaccttcatggctaa

SEQ ID NO: 8137366 - DNA, 22 bp, Homo sapiens
agtcaccaacatggttcccagg

SEQ ID NO: 8137367 - DNA, 22 bp, Homo sapiens
aggttggctgctcttttcctaa

SEQ ID NO: 8137368 - DNA, 22 bp, Homo sapiens
aggtctggtgagagcaggtgct

SEQ ID NO: 8137369 - DNA, 22 bp, Homo sapiens
aggtctggagtgggatctgaga

SEQ ID NO: 8137370 - DNA, 22 bp, Homo sapiens
aggtctggaggcggagtcagga

SEQ ID NO: 8137371 - DNA, 22 bp, Homo sapiens
aggtctggtgttgggcctgaaa

SEQ ID NO: 8137372 - DNA, 22 bp, Homo sapiens
gcagagacagactaatgaaaag

SEQ ID NO: 8137373 - DNA, 22 bp, Homo sapiens
gatggcacacagacatccccgc

SEQ ID NO: 8137374 - DNA, 22 bp, Homo sapiens
gattcctagcaaactcttggag

SEQ ID NO: 8137375 - DNA, 22 bp, Homo sapiens
attcacaaatgctgccccattc

SEQ ID NO: 8137376 - DNA, 22 bp, Homo sapiens
attcaatgggggtttctagttg

SEQ ID NO: 8137377 - DNA, 22 bp, Homo sapiens
attgcaccttgggttttgaaag

SEQ ID NO: 8137378 - DNA, 22 bp, Homo sapiens
attgcacagctgaatattttgg

SEQ ID NO: 8137379 - DNA, 22 bp, Homo sapiens
attgcacaaagagggaaactga

SEQ ID NO: 8137380 - DNA, 22 bp, Homo sapiens
caaagactgcataacacatgaa

SEQ ID NO: 8137381 - DNA, 19 bp, Homo sapiens
gctcagagacacctgttgc

SEQ ID NO: 8137382 - DNA, 22 bp, Homo sapiens
attttcatggcttctgctcagt

SEQ ID NO: 8137383 - DNA, 22 bp, Homo sapiens
attttcatgactaccttaaata

SEQ ID NO: 8137384 - DNA, 22 bp, Homo sapiens
atttcaaggactacttttcaat

SEQ ID NO: 8137385 - DNA, 22 bp, Homo sapiens
atttatgatagctgcattaaag

SEQ ID NO: 8137386 - DNA, 22 bp, Homo sapiens
atttatgagctgaaccatgaaa

SEQ ID NO: 8137387 - DNA, 22 bp, Homo sapiens
atgtcagagcttccacaatagt

SEQ ID NO: 8137388 - DNA, 22 bp, Homo sapiens
atgtcagattcctaaatatctt

SEQ ID NO: 8137389 - DNA, 22 bp, Homo sapiens
atgtgccacatgatattgtctc

SEQ ID NO: 8137390 - DNA, 22 bp, Homo sapiens
atgtgcgaggtgcttgtcagca

SEQ ID NO: 8137391 - DNA, 22 bp, Homo sapiens
gaggttgggatgagggatacag

SEQ ID NO: 8137392 - DNA, 22 bp, Homo sapiens
gaggttggcgccctgcctggcc

SEQ ID NO: 8137393 - DNA, 22 bp, Homo sapiens
atgttagaaggaatgttaaaag

SEQ ID NO: 8137394 - DNA, 22 bp, Homo sapiens
atgccactgcacttcagcttgg

SEQ ID NO: 8137395 - DNA, 22 bp, Homo sapiens
atgccactgcactccagcctag

SEQ ID NO: 8137396 - DNA, 22 bp, Homo sapiens
atgccactgcactccagcctgg

SEQ ID NO: 8137397 - DNA, 22 bp, Homo sapiens
atgagcaagagctatgtacaga

SEQ ID NO: 8137398 - DNA, 22 bp, Homo sapiens
ctttgccatgttgcctgcagaa

SEQ ID NO: 8137399 - DNA, 22 bp, Homo sapiens
atgacaaaagaagacatgaggt

SEQ ID NO: 8137400 - DNA, 22 bp, Homo sapiens
cttctcctgtaagaagatcaaa

SEQ ID NO: 8137401 - DNA, 22 bp, Homo sapiens
cttctcctaaggtcagaattgc

SEQ ID NO: 8137402 - DNA, 22 bp, Homo sapiens
cttctcctctgagtcctgggag

SEQ ID NO: 8137403 - DNA, 22 bp, Homo sapiens
gtccagagctggcacactgtca

SEQ ID NO: 8137404 - DNA, 20 bp, Homo sapiens
cagcaaaatgaaaatggatt

SEQ ID NO: 8137405 - DNA, 22 bp, Homo sapiens
cagcaaagcttaatttatatct

SEQ ID NO: 8137406 - DNA, 22 bp, Homo sapiens
cagcaaaggtagaagcacagga

SEQ ID NO: 8137407 - DNA, 22 bp, Homo sapiens
cagcaaagcaggctcctagaac

SEQ ID NO: 8137408 - DNA, 22 bp, Homo sapiens
cagagacaacctggtagagaaa

SEQ ID NO: 8137409 - DNA, 22 bp, Homo sapiens
cagagacaacaagtttaactat

SEQ ID NO: 8137410 - DNA, 22 bp, Homo sapiens
cagagacaccccagaaaataag

SEQ ID NO: 8137411 - DNA, 22 bp, Homo sapiens
cagagacacttaacaggaatgg

SEQ ID NO: 8137412 - DNA, 22 bp, Homo sapiens
cagacacagatatgcatatggc

SEQ ID NO: 8137413 - DNA, 22 bp, Homo sapiens
cagacacagcaattctgtgttg

SEQ ID NO: 8137414 - DNA, 22 bp, Homo sapiens
cagaataagctgtgttgtcaag

SEQ ID NO: 8137415 - DNA, 22 bp, Homo sapiens
gggttcagtccctcttgctact

SEQ ID NO: 8137416 - DNA, 22 bp, Homo sapiens
gggtaggaaatccagaggtggc

SEQ ID NO: 8137417 - DNA, 22 bp, Homo sapiens
gggtaacgttggaatttttgtg

SEQ ID NO: 8137418 - DNA, 22 bp, Homo sapiens
caaagtcataaaacttgtaagt

SEQ ID NO: 8137419 - DNA, 22 bp, Homo sapiens
caagaaattctgttcagatagc

SEQ ID NO: 8137420 - DNA, 22 bp, Homo sapiens
caactttctgttaaatgttagt

SEQ ID NO: 8137421 - DNA, 22 bp, Homo sapiens
caagacaagatctaagcatgct

SEQ ID NO: 8137422 - DNA, 22 bp, Homo sapiens
caatgttttgttgaatgaatag

SEQ ID NO: 8137423 - DNA, 22 bp, Homo sapiens
cacagtgcgaaagaaacccagc

SEQ ID NO: 8137424 - DNA, 22 bp, Homo sapiens
cacatgcaccagaaatcaacat

SEQ ID NO: 8137425 - DNA, 22 bp, Homo sapiens
caccagctactccagggccgtg

SEQ ID NO: 8137426 - DNA, 22 bp, Homo sapiens
caccagctactcgggtttcctg

SEQ ID NO: 8137427 - DNA, 22 bp, Homo sapiens
caccagctccaccagggcaggt

SEQ ID NO: 8137428 - DNA, 22 bp, Homo sapiens
caccagctttgcccactgccca

SEQ ID NO: 8137429 - DNA, 22 bp, Homo sapiens
caccagcttctcattgcgggtc

SEQ ID NO: 8137430 - DNA, 22 bp, Homo sapiens
caccagcttcccatcgcgggtc

SEQ ID NO: 8137431 - DNA, 22 bp, Homo sapiens
caccagcttgcagtcttaaccc

SEQ ID NO: 8137432 - DNA, 22 bp, Homo sapiens
caccagcttgggctgtggaaat

SEQ ID NO: 8137433 - DNA, 22 bp, Homo sapiens
caccagcttacagtctcacccc

SEQ ID NO: 8137434 - DNA, 22 bp, Homo sapiens
caccagctctccaccaggtttc

SEQ ID NO: 8137435 - DNA, 22 bp, Homo sapiens
caccagctgcaacaccatctcc

SEQ ID NO: 8137436 - DNA, 22 bp, Homo sapiens
cacatgtttcaggccatatttg

SEQ ID NO: 8137437 - DNA, 22 bp, Homo sapiens
cacatgtttgctacatttttct

SEQ ID NO: 8137438 - DNA, 22 bp, Homo sapiens
cacatgttcttaacttctgttt

SEQ ID NO: 8137439 - DNA, 22 bp, Homo sapiens
cacatgttaacttcctacagtg

SEQ ID NO: 8137440 - DNA, 22 bp, Homo sapiens
cacttctcacaaagtgacattc

SEQ ID NO: 8137441 - DNA, 22 bp, Homo sapiens
cacttcaattaacttcagcatt

SEQ ID NO: 8137442 - DNA, 22 bp, Homo sapiens
cacttcaaggaatatctagaaa

SEQ ID NO: 8137443 - DNA, 21 bp, Homo sapiens
cactgtatagcaggagaaaac

SEQ ID NO: 8137444 - DNA, 21 bp, Homo sapiens
cactcaataaatgtcatatgc

SEQ ID NO: 8137445 - DNA, 21 bp, Homo sapiens
cactccacttagaacagggtt

SEQ ID NO: 8137446 - DNA, 22 bp, Homo sapiens
tagagttatccttcacaggtat

SEQ ID NO: 8137447 - DNA, 18 bp, Homo sapiens
tagagttactacatgatt

SEQ ID NO: 8137448 - DNA, 22 bp, Homo sapiens
tagatacacacacagtcatgtg

SEQ ID NO: 8137449 - DNA, 22 bp, Homo sapiens
cagggcagccaggccccgtggg

SEQ ID NO: 8137450 - DNA, 22 bp, Homo sapiens
cagtgtttgtatagaatatgca

SEQ ID NO: 8137451 - DNA, 22 bp, Homo sapiens
tatttcatgtgcaccataattc

SEQ ID NO: 8137452 - DNA, 22 bp, Homo sapiens
tatttcttgttccctccaagtt

SEQ ID NO: 8137453 - DNA, 22 bp, Homo sapiens
catgttatttatccattaaaca

SEQ ID NO: 8137454 - DNA, 22 bp, Homo sapiens
catgttggctgaggctgtattt

SEQ ID NO: 8137455 - DNA, 22 bp, Homo sapiens
catgttggcttgtcacaatgaa

SEQ ID NO: 8137456 - DNA, 22 bp, Homo sapiens
catgttggcaaggatacagcag

SEQ ID NO: 8137457 - DNA, 22 bp, Homo sapiens
catgtttgtacaaaggtacaca

SEQ ID NO: 8137458 - DNA, 22 bp, Homo sapiens
catgttgggaatcagctgagag

SEQ ID NO: 8137459 - DNA, 22 bp, Homo sapiens
catgttgggcatgcatatgtgt

SEQ ID NO: 8137460 - DNA, 22 bp, Homo sapiens
catttggaccaaaatagccaac

SEQ ID NO: 8137461 - DNA, 22 bp, Homo sapiens
tccagctgctagctagatgcaa

SEQ ID NO: 8137462 - DNA, 22 bp, Homo sapiens
catgtgtgtgagggaaacatgt

SEQ ID NO: 8137463 - DNA, 22 bp, Homo sapiens
tccacatgacttctaataactg

SEQ ID NO: 8137464 - DNA, 22 bp, Homo sapiens
ccaccagcagtgtgcaaggatt

SEQ ID NO: 8137465 - DNA, 22 bp, Homo sapiens
ccaccagcttcagcagccgcgg

SEQ ID NO: 8137466 - DNA, 22 bp, Homo sapiens
ccaccagctgcatatgcacgta

SEQ ID NO: 8137467 - DNA, 22 bp, Homo sapiens
ccaccagctttgccaccctgct

SEQ ID NO: 8137468 - DNA, 22 bp, Homo sapiens
ccaccagctttggcggtgacag

SEQ ID NO: 8137469 - DNA, 22 bp, Homo sapiens
ccacatggtcctcatttactct

SEQ ID NO: 8137470 - DNA, 23 bp, Homo sapiens
tctctgcatgtcctgagcacatc

SEQ ID NO: 8137471 - DNA, 22 bp, Homo sapiens
tctctgcaagatgagaaatatt

SEQ ID NO: 8137472 - DNA, 22 bp, Homo sapiens
tctctgcacagaagtagatagc

SEQ ID NO: 8137473 - DNA, 22 bp, Homo sapiens
tctctgcacttgcacataagct

SEQ ID NO: 8137474 - DNA, 22 bp, Homo sapiens
tctctgcagctaagaaattaat

SEQ ID NO: 8137475 - DNA, 22 bp, Homo sapiens
tctctgcatgacccaaggctga

SEQ ID NO: 8137476 - DNA, 22 bp, Homo sapiens
tctctgcatccccagggctctc

SEQ ID NO: 8137477 - DNA, 22 bp, Homo sapiens
tgaaagcaggcgggctacttta

SEQ ID NO: 8137478 - DNA, 22 bp, Homo sapiens
tgaagattgagaaattatccaa

SEQ ID NO: 8137479 - DNA, 22 bp, Homo sapiens
tgaagatttaagcatctcaatt

SEQ ID NO: 8137480 - DNA, 22 bp, Homo sapiens
tgaagatttccaccaaatcaca

SEQ ID NO: 8137481 - DNA, 22 bp, Homo sapiens
tgacagagacttcagagccaaa

SEQ ID NO: 8137482 - DNA, 22 bp, Homo sapiens
tgcagcatgcaggagaggctct

SEQ ID NO: 8137483 - DNA, 22 bp, Homo sapiens
tgcagcattgcaaagcagtctt

SEQ ID NO: 8137484 - DNA, 22 bp, Homo sapiens
tgcagcattttataccatcatt

SEQ ID NO: 8137485 - DNA, 19 bp, Homo sapiens
cccaacttgactattttct

SEQ ID NO: 8137486 - DNA, 22 bp, Homo sapiens
tgctttcagatatctgtttcaa

SEQ ID NO: 8137487 - DNA, 22 bp, Homo sapiens
tgtacatacatagatatacaca

SEQ ID NO: 8137488 - DNA, 22 bp, Homo sapiens
tgggtaggtgtggcctgaatgt

SEQ ID NO: 8137489 - DNA, 22 bp, Homo sapiens
ctggaagagtcctaaacagata

SEQ ID NO: 8137490 - DNA, 22 bp, Homo sapiens
ctggaagaggggaaatgccatg

SEQ ID NO: 8137491 - DNA, 22 bp, Homo sapiens
ctggaagaggacacacgaatca

SEQ ID NO: 8137492 - DNA, 22 bp, Homo sapiens
ttttgctttaagatggagagga

SEQ ID NO: 8137493 - DNA, 22 bp, Homo sapiens
tttattcatcatctgttcatat

SEQ ID NO: 8137494 - DNA, 22 bp, Homo sapiens
tttccactcctattgcatctca

SEQ ID NO: 8137495 - DNA, 22 bp, Homo sapiens
tttccacactgcagccagcaaa

SEQ ID NO: 8137496 - DNA, 22 bp, Homo sapiens
tttccactcctattgcatctca

SEQ ID NO: 8137497 - DNA, 22 bp, Homo sapiens
tttccacaatttgagcagcaga

SEQ ID NO: 8137498 - DNA, 22 bp, Homo sapiens
tttccaactgtaccccagtgtt

SEQ ID NO: 8137499 - DNA, 22 bp, Homo sapiens
tttcatgttacatttaaaatgt

SEQ ID NO: 8137500 - DNA, 22 bp, Homo sapiens
tttcatgttggatactgtttca

SEQ ID NO: 8137501 - DNA, 22 bp, Homo sapiens
tttcatgtttatggaaaatgag

SEQ ID NO: 8137502 - DNA, 22 bp, Homo sapiens
tttggaatgacagatatcaata

SEQ ID NO: 8137503 - DNA, 22 bp, Homo sapiens
tttgacttctatctagtaagaa

SEQ ID NO: 8137504 - DNA, 22 bp, Homo sapiens
ctctgcagaggcccaaggctga

SEQ ID NO: 8137505 - DNA, 22 bp, Homo sapiens
ctctgcagagcctccagcccag

SEQ ID NO: 8137506 - DNA, 22 bp, Homo sapiens
ctctgcagaatttgagctgctc

SEQ ID NO: 8137507 - DNA, 22 bp, Homo sapiens
tttcttggagctcttagggtcg

SEQ ID NO: 8137508 - DNA, 22 bp, Homo sapiens
ttaaattccagcctcataatag

SEQ ID NO: 8137509 - DNA, 21 bp, Homo sapiens
ctcagggcttggtgtcctcat

SEQ ID NO: 8137510 - DNA, 22 bp, Homo sapiens
ctcagggcagtatggctgagag

SEQ ID NO: 8137511 - DNA, 22 bp, Homo sapiens
ctcaggacggccgggggagcct

SEQ ID NO: 8137512 - DNA, 22 bp, Homo sapiens
ttctggaaggatgtttctatct

SEQ ID NO: 8137513 - DNA, 22 bp, Homo sapiens
ttctggaactatactgttggtg

SEQ ID NO: 8137514 - DNA, 22 bp, Homo sapiens
cgttttcatgggtagaggttct

SEQ ID NO: 8137515 - DNA, 22 bp, Homo sapiens
ttctttctctgtaaaaggaaaa

SEQ ID NO: 8137516 - DNA, 22 bp, Homo sapiens
ctcactcagtttttagttcatc

SEQ ID NO: 8137517 - DNA, 22 bp, Homo sapiens
ctggtacagtgttacaaaatgg

SEQ ID NO: 8137518 - DNA, 22 bp, Homo sapiens
ctggtacatttgatgataatag

SEQ ID NO: 8137519 - DNA, 22 bp, Homo sapiens
ctttttcccaggtggagagagg

SEQ ID NO: 8137520 - DNA, 22 bp, Homo sapiens
ctttggaaggtcgtccgtgtgg

SEQ ID NO: 8137521 - DNA, 22 bp, Homo sapiens
gaaattgaaaccgatctgtgtt

SEQ ID NO: 8137522 - DNA, 22 bp, Homo sapiens
gaaattgaataccctgcatgaa

SEQ ID NO: 8137523 - DNA, 22 bp, Homo sapiens
gaaattgaaagaccaactgcat

SEQ ID NO: 8137524 - DNA, 22 bp, Homo sapiens
gaacttcttcaacataatggac

SEQ ID NO: 8137525 - DNA, 22 bp, Homo sapiens
gaacttcttctttaagagactc

SEQ ID NO: 8137526 - DNA, 22 bp, Homo sapiens
gaagaactgtgacagaagcagt

SEQ ID NO: 8137527 - DNA, 22 bp, Homo sapiens
cttcactgtttggttcacagca

SEQ ID NO: 8137528 - DNA, 22 bp, Homo sapiens
cttcactgtgcttcaagcagct

SEQ ID NO: 8137529 - DNA, 22 bp, Homo sapiens
cttcacttcacagatgccaaga

SEQ ID NO: 8137530 - DNA, 20 bp, Homo sapiens
cttcttcagcctatgcttca

SEQ ID NO: 8137531 - DNA, 22 bp, Homo sapiens
cttcttcaagaggaccatccag

SEQ ID NO: 8137532 - DNA, 22 bp, Homo sapiens
gaatgcatgtgaagcaaagaat

SEQ ID NO: 8137533 - DNA, 22 bp, Homo sapiens
gaatgcagtggtgagatcttgg

SEQ ID NO: 8137534 - DNA, 19 bp, Homo sapiens
gaatgcagaagagagtgga

SEQ ID NO: 8137535 - DNA, 22 bp, Homo sapiens
gaatgcagtgacggaggcttac

SEQ ID NO: 8137536 - DNA, 22 bp, Homo sapiens
gaatgcagctgacagtcgtttt

SEQ ID NO: 8137537 - DNA, 22 bp, Homo sapiens
gaagaattgcccatttctgtct

SEQ ID NO: 8137538 - DNA, 22 bp, Homo sapiens
tatgacaaggtggagtatgagt

SEQ ID NO: 8137539 - DNA, 22 bp, Homo sapiens
tatcacatacttctcatccagg

SEQ ID NO: 8137540 - DNA, 21 bp, Homo sapiens
tcaaatcatgtactgaccaca

SEQ ID NO: 8137541 - DNA, 22 bp, Homo sapiens
tcaaatgaagacagttgacttg

SEQ ID NO: 8137542 - DNA, 22 bp, Homo sapiens
tcaaatatgtgatagaagctaa

SEQ ID NO: 8137543 - DNA, 22 bp, Homo sapiens
tcaaagaacatcatctgaaatg

SEQ ID NO: 8137544 - DNA, 22 bp, Homo sapiens
tcaaagaatgttatgagggtag

SEQ ID NO: 8137545 - DNA, 17 bp, Homo sapiens
tcaaagaatgcatgcag

SEQ ID NO: 8137546 - DNA, 22 bp, Homo sapiens
tatttgatagagataaatgata

SEQ ID NO: 8137547 - DNA, 22 bp, Homo sapiens
tattacaatttacattgcactt

SEQ ID NO: 8137548 - DNA, 22 bp, Homo sapiens
tagatagataaaatgttgcaga

SEQ ID NO: 8137549 - DNA, 22 bp, Homo sapiens
tagaaatgggttacatttagag

SEQ ID NO: 8137550 - DNA, 22 bp, Homo sapiens
tagtttaatggtcaactaatga

SEQ ID NO: 8137551 - DNA, 22 bp, Homo sapiens
taccatgtcaagcgagacatgt

SEQ ID NO: 8137552 - DNA, 22 bp, Homo sapiens
taccagctcacacaatctttgt

SEQ ID NO: 8137553 - DNA, 22 bp, Homo sapiens
tactgtttgcagtttgcagtat

SEQ ID NO: 8137554 - DNA, 22 bp, Homo sapiens
tactgtttcctgaagcagatgc

SEQ ID NO: 8137555 - DNA, 22 bp, Homo sapiens
tactgtttcaagccctcacaga

SEQ ID NO: 8137556 - DNA, 22 bp, Homo sapiens
tacatgcatgtgtgtaaatata

SEQ ID NO: 8137557 - DNA, 18 bp, Homo sapiens
tacatgccagagagttac

SEQ ID NO: 8137558 - DNA, 22 bp, Homo sapiens
tacatgacctagacttgctaaa

SEQ ID NO: 8137559 - DNA, 18 bp, Homo sapiens
tacatgcataaatgaagc

SEQ ID NO: 8137560 - DNA, 22 bp, Homo sapiens
tacatgaagttgtctaaactgg

SEQ ID NO: 8137561 - DNA, 22 bp, Homo sapiens
tacatgaatgtttcaatattgt

SEQ ID NO: 8137562 - DNA, 22 bp, Homo sapiens
taattgcagctatcattttagt

SEQ ID NO: 8137563 - DNA, 22 bp, Homo sapiens
taattattctagtcacatagca

SEQ ID NO: 8137564 - DNA, 22 bp, Homo sapiens
tacaagaagaggcagagctgga

SEQ ID NO: 8137565 - DNA, 22 bp, Homo sapiens
tacaagaaatttctgcatatat

SEQ ID NO: 8137566 - DNA, 22 bp, Homo sapiens
tacaagagcagtaagcttgtcc

SEQ ID NO: 8137567 - DNA, 22 bp, Homo sapiens
tacaagaggatgtggacatgga

SEQ ID NO: 8137568 - DNA, 22 bp, Homo sapiens
tacaagagaactaatgtaagtc

SEQ ID NO: 8137569 - DNA, 22 bp, Homo sapiens
tacaagagacaccagggaggct

SEQ ID NO: 8137570 - DNA, 22 bp, Homo sapiens
tacaagaaggaaaactagcaat

SEQ ID NO: 8137571 - DNA, 22 bp, Homo sapiens
tacaagaaggatggagcccact

SEQ ID NO: 8137572 - DNA, 22 bp, Homo sapiens
tacaagagtgagattatcatgt

SEQ ID NO: 8137573 - DNA, 22 bp, Homo sapiens
tacaagaggtatatagaaacag

SEQ ID NO: 8137574 - DNA, 22 bp, Homo sapiens
tacacaatgacttaagatgtca

SEQ ID NO: 8137575 - DNA, 22 bp, Homo sapiens
tacacataggtctgaataaaaa

SEQ ID NO: 8137576 - DNA, 22 bp, Homo sapiens
taagacttgatccaaagaacta

SEQ ID NO: 8137577 - DNA, 22 bp, Homo sapiens
taaatgttggcattggaggccg

SEQ ID NO: 8137578 - DNA, 22 bp, Homo sapiens
taaatgttgtaagtacatctaa

SEQ ID NO: 8137579 - DNA, 22 bp, Homo sapiens
taaaagttagctaggacaaagt

SEQ ID NO: 8137580 - DNA, 22 bp, Homo sapiens
gttcttcatcttaaccatctgt

SEQ ID NO: 8137581 - DNA, 22 bp, Homo sapiens
gtttgattcaagaacaaagagt

SEQ ID NO: 8137582 - DNA, 22 bp, Homo sapiens
gtttgtcaggaggttgaagtca

SEQ ID NO: 8137583 - DNA, 22 bp, Homo sapiens
gtttgtcatttgtacttctagc

SEQ ID NO: 8137584 - DNA, 22 bp, Homo sapiens
gtttcttttgtgatcaccaacc

SEQ ID NO: 8137585 - DNA, 22 bp, Homo sapiens
gtttctttctattgactgaaca

SEQ ID NO: 8137586 - DNA, 22 bp, Homo sapiens
tcattgttttgattccttcatg

SEQ ID NO: 8137587 - DNA, 22 bp, Homo sapiens
tccaacatttatcaaggttgtt

SEQ ID NO: 8137588 - DNA, 22 bp, Homo sapiens
tccaaacaccctccatgctgca

SEQ ID NO: 8137589 - DNA, 22 bp, Homo sapiens
tcagggctgcagaagaggcagg

SEQ ID NO: 8137590 - DNA, 22 bp, Homo sapiens
tcagggctccggaagtggcctc

SEQ ID NO: 8137591 - DNA, 22 bp, Homo sapiens
tcagtatcaatagcgtcacaat

SEQ ID NO: 8137592 - DNA, 22 bp, Homo sapiens
tcagtatccacaaatgctcaaa

SEQ ID NO: 8137593 - DNA, 22 bp, Homo sapiens
tcagtatcatgcggtagccatg

SEQ ID NO: 8137594 - DNA, 22 bp, Homo sapiens
tcagtaaatgagcaaaaatttc

SEQ ID NO: 8137595 - DNA, 22 bp, Homo sapiens
tcatgaaaatagatcagaaatt

SEQ ID NO: 8137596 - DNA, 22 bp, Homo sapiens
tcatacattcagcagatatttg

SEQ ID NO: 8137597 - DNA, 22 bp, Homo sapiens
tcacataaattatacaatttca

SEQ ID NO: 8137598 - DNA, 22 bp, Homo sapiens
tcacattgttatgtaaatgttt

SEQ ID NO: 8137599 - DNA, 22 bp, Homo sapiens
tcacattgtaggatagcagaga

SEQ ID NO: 8137600 - DNA, 22 bp, Homo sapiens
tcacagtgagaaatttgttggc

SEQ ID NO: 8137601 - DNA, 22 bp, Homo sapiens
tcaaatgagtgactcacacagg

SEQ ID NO: 8137602 - DNA, 22 bp, Homo sapiens
tcaaccaggaaactattttgct

SEQ ID NO: 8137603 - DNA, 22 bp, Homo sapiens
tcagaacaattgggaaccatta

SEQ ID NO: 8137604 - DNA, 22 bp, Homo sapiens
tcaggacaacctgttttcagac

SEQ ID NO: 8137605 - DNA, 22 bp, Homo sapiens
tcaggacaacaagacttgttta

SEQ ID NO: 8137606 - DNA, 22 bp, Homo sapiens
tcagcaaaggcaattcattatt

SEQ ID NO: 8137607 - DNA, 22 bp, Homo sapiens
tcagagttctctgtccagatga

SEQ ID NO: 8137608 - DNA, 22 bp, Homo sapiens
tccctggcactgctgtgattag

SEQ ID NO: 8137609 - DNA, 22 bp, Homo sapiens
tcccaagactcaatttccttac

SEQ ID NO: 8137610 - DNA, 22 bp, Homo sapiens
tcccaagacctggcatccaagt

SEQ ID NO: 8137611 - DNA, 22 bp, Homo sapiens
tccatgttggtgattctaatgt

SEQ ID NO: 8137612 - DNA, 22 bp, Homo sapiens
tccatgttgagaatgctataat

SEQ ID NO: 8137613 - DNA, 22 bp, Homo sapiens
gcacatttaactgagctcagga

SEQ ID NO: 8137614 - DNA, 22 bp, Homo sapiens
gcaggtcccagaaagttaattc

SEQ ID NO: 8137615 - DNA, 22 bp, Homo sapiens
gcagcacatataaacaaagaga

SEQ ID NO: 8137616 - DNA, 19 bp, Homo sapiens
gcagcaatagaagacaaat

SEQ ID NO: 8137617 - DNA, 22 bp, Homo sapiens
ggactgctccagtgtgatttgt

SEQ ID NO: 8137618 - DNA, 22 bp, Homo sapiens
ggactgctgtggacagagtcat

SEQ ID NO: 8137619 - DNA, 22 bp, Homo sapiens
gcttttggacctctgatgtttc

SEQ ID NO: 8137620 - DNA, 22 bp, Homo sapiens
gcttttgtggctgtcttcattg

SEQ ID NO: 8137621 - DNA, 22 bp, Homo sapiens
gcttttgtgagctctcactttg

SEQ ID NO: 8137622 - DNA, 22 bp, Homo sapiens
gctttaaacctctactctgtcc

SEQ ID NO: 8137623 - DNA, 22 bp, Homo sapiens
gcttggcagggcctgctggagc

SEQ ID NO: 8137624 - DNA, 20 bp, Homo sapiens
gctcagggaattcaggaagc

SEQ ID NO: 8137625 - DNA, 22 bp, Homo sapiens
ggttaggatcagatcctggagg

SEQ ID NO: 8137626 - DNA, 22 bp, Homo sapiens
gtgaggatgcagatgagggcct

SEQ ID NO: 8137627 - DNA, 22 bp, Homo sapiens
gtgagccgagtatagttcatag

SEQ ID NO: 8137628 - DNA, 22 bp, Homo sapiens
gtacaagaggagaaaatggagt

SEQ ID NO: 8137629 - DNA, 22 bp, Homo sapiens
gtcaccattgcccactccatgg

SEQ ID NO: 8137630 - DNA, 22 bp, Homo sapiens
gtcaccatggataagaatcact

SEQ ID NO: 8137631 - DNA, 19 bp, Homo sapiens
gtcaccatttccaaatgcc

SEQ ID NO: 8137632 - DNA, 23 bp, Homo sapiens
gtcaccataatccgttagaccag

SEQ ID NO: 8137633 - DNA, 22 bp, Homo sapiens
gtcaccatctacagctccaaac

SEQ ID NO: 8137634 - DNA, 16 bp, Homo sapiens
gtcaccatcatgtagt

SEQ ID NO: 8137635 - DNA, 22 bp, Homo sapiens
gtataaagtataagcttgtttt

SEQ ID NO: 8137636 - DNA, 22 bp, Homo sapiens
ggctggagtgggctccagagtt

SEQ ID NO: 8137637 - DNA, 22 bp, Homo sapiens
gggctcagttctgcttcatgct

SEQ ID NO: 8137638 - DNA, 21 bp, Homo sapiens
gggctcagcgctcggctcctc

SEQ ID NO: 8137639 - DNA, 22 bp, Homo sapiens
gggctcagctccttccttccta

SEQ ID NO: 8137640 - DNA, 22 bp, Homo sapiens
gggctcagctgggcgtgctggt

SEQ ID NO: 8137641 - DNA, 22 bp, Homo sapiens
gggctcagagcatttgggttgg

SEQ ID NO: 8137642 - DNA, 22 bp, Homo sapiens
gggctcagacatccctcctgga

SEQ ID NO: 8137643 - DNA, 22 bp, Homo sapiens
gggctcagaggagtggcctggg

SEQ ID NO: 8137644 - DNA, 16 bp, Homo sapiens
gggctcagatctttga

SEQ ID NO: 8137645 - DNA, 23 bp, Homo sapiens
gggctcagatttcattctgtgcc

SEQ ID NO: 8137646 - DNA, 22 bp, Homo sapiens
gggctcagccccattgaaccag

SEQ ID NO: 8137647 - DNA, 22 bp, Homo sapiens
gggctcagcctcctcacttcga

SEQ ID NO: 8137648 - DNA, 22 bp, Homo sapiens
tttttatgcctacgctgaaaag

SEQ ID NO: 8137649 - DNA, 22 bp, Homo sapiens
tttttcatattcccctctctgg

SEQ ID NO: 8137650 - DNA, 22 bp, Homo sapiens
tttgatgatgatgataaagttt

SEQ ID NO: 8137651 - DNA, 22 bp, Homo sapiens
tttcttttccaatatccctact

SEQ ID NO: 8137652 - DNA, 20 bp, Homo sapiens
ttttctgtgccaagaaaact

SEQ ID NO: 8137653 - DNA, 22 bp, Homo sapiens
ttttcatagtaatggtgcatgt

SEQ ID NO: 8137654 - DNA, 22 bp, Homo sapiens
ttttaaatctccagttgacccc

SEQ ID NO: 8137655 - DNA, 22 bp, Homo sapiens
ttttaagaaatgtatgactgtc

SEQ ID NO: 8137656 - DNA, 22 bp, Homo sapiens
tttgtaaatagcagtactcatg

SEQ ID NO: 8137657 - DNA, 22 bp, Homo sapiens
ttctctgcattgtaaagagcca

SEQ ID NO: 8137658 - DNA, 22 bp, Homo sapiens
ttcctggcactgcagtggttga

SEQ ID NO: 8137659 - DNA, 22 bp, Homo sapiens
ttctggaaatgcacaactaatt

SEQ ID NO: 8137660 - DNA, 22 bp, Homo sapiens
ttctggaagtggaatttttgta

SEQ ID NO: 8137661 - DNA, 22 bp, Homo sapiens
ttctggaatgcctgttctaatt

SEQ ID NO: 8137662 - DNA, 22 bp, Homo sapiens
ttcttcaaagtaatagagacta

SEQ ID NO: 8137663 - DNA, 22 bp, Homo sapiens
ttcttcaattttccatatactg

SEQ ID NO: 8137664 - DNA, 22 bp, Homo sapiens
ttcttcaaatgctgaaagtcta

SEQ ID NO: 8137665 - DNA, 22 bp, Homo sapiens
ttcttcaaccatctacataaac

SEQ ID NO: 8137666 - DNA, 22 bp, Homo sapiens
ttattcttttctccagaatccc

SEQ ID NO: 8137667 - DNA, 22 bp, Homo sapiens
ttcaaacagttgcacaacttat

SEQ ID NO: 8137668 - DNA, 22 bp, Homo sapiens
ttcaaacagtgtagaatatatg

SEQ ID NO: 8137669 - DNA, 22 bp, Homo sapiens
ttcaaacaggggtcagggagat

SEQ ID NO: 8137670 - DNA, 22 bp, Homo sapiens
ttcaaacagatgactctgctct

SEQ ID NO: 8137671 - DNA, 22 bp, Homo sapiens
ttcaaacactgttggcactggg

SEQ ID NO: 8137672 - DNA, 22 bp, Homo sapiens
ttcattgtactttaagagatgc

SEQ ID NO: 8137673 - DNA, 21 bp, Homo sapiens
ttcataaaccattctcatgca

SEQ ID NO: 8137674 - DNA, 22 bp, Homo sapiens
ttcatttgttgacagagacatg

SEQ ID NO: 8137675 - DNA, 22 bp, Homo sapiens
ttcatttttaccgcgtgtcaaa

SEQ ID NO: 8137676 - DNA, 23 bp, Homo sapiens
ttccagtgagactgagaggtctt

SEQ ID NO: 8137677 - DNA, 22 bp, Homo sapiens
ttccagtgactaagcttctgct

SEQ ID NO: 8137678 - DNA, 22 bp, Homo sapiens
ttccagtgaccatagagtatgg

SEQ ID NO: 8137679 - DNA, 22 bp, Homo sapiens
ttcagagaaactgaggtttaga

SEQ ID NO: 8137680 - DNA, 22 bp, Homo sapiens
ttcagagaagcaaaggcagatt

SEQ ID NO: 8137681 - DNA, 22 bp, Homo sapiens
ttcagagatggaaggcagaatg

SEQ ID NO: 8137682 - DNA, 22 bp, Homo sapiens
ttcagagagtccagtatgcagt

SEQ ID NO: 8137683 - DNA, 22 bp, Homo sapiens
ttcagagaattggataattcgt

SEQ ID NO: 8137684 - DNA, 22 bp, Homo sapiens
ttcagagaagtgcacaaaatca

SEQ ID NO: 8137685 - DNA, 21 bp, Homo sapiens
ttgcacagaaaaccatagaga

SEQ ID NO: 8137686 - DNA, 22 bp, Homo sapiens
ttgcagagcagtaggaatatag

SEQ ID NO: 8137687 - DNA, 22 bp, Homo sapiens
ttgacaagcgaagtaccataat

SEQ ID NO: 8137688 - DNA, 23 bp, Homo sapiens
ttgcatgtagcccatgagtaact

SEQ ID NO: 8137689 - DNA, 22 bp, Homo sapiens
ttgctgacctttgctctccgtt

SEQ ID NO: 8137690 - DNA, 22 bp, Homo sapiens
ttggcagggctgcttgtctagg

SEQ ID NO: 8137691 - DNA, 22 bp, Homo sapiens
tttaaagaaattcctcatcttt

SEQ ID NO: 8137692 - DNA, 22 bp, Homo sapiens
tttcactgttaggagtatgcta

SEQ ID NO: 8137693 - DNA, 20 bp, Homo sapiens
tttcactgtggtgctggaga

SEQ ID NO: 8137694 - DNA, 20 bp, Homo sapiens
tttcactggcttgataaggt

SEQ ID NO: 8137695 - DNA, 22 bp, Homo sapiens
tttcactgggcttgcagaaatc

SEQ ID NO: 8137696 - DNA, 22 bp, Homo sapiens
tttcatgttacagtgtaaaagt

SEQ ID NO: 8137697 - DNA, 22 bp, Homo sapiens
aaatggagttctaagtatagta

SEQ ID NO: 8137698 - DNA, 22 bp, Homo sapiens
aaggcactgaacttaaattctg

SEQ ID NO: 8137699 - DNA, 22 bp, Homo sapiens
aaggttagtaagtatcttatgt

SEQ ID NO: 8137700 - DNA, 22 bp, Homo sapiens
aagtacaacgcatacagagaaa

SEQ ID NO: 8137701 - DNA, 22 bp, Homo sapiens
aagtacaaattttgaagagctt

SEQ ID NO: 8137702 - DNA, 22 bp, Homo sapiens
aagtacaatctttctgtaaagg

SEQ ID NO: 8137703 - DNA, 22 bp, Homo sapiens
aatattgagaaccagcatgttt

SEQ ID NO: 8137704 - DNA, 22 bp, Homo sapiens
aatgaaagaatgaaacagccca

SEQ ID NO: 8137705 - DNA, 22 bp, Homo sapiens
aatgcttatgggttccataata

SEQ ID NO: 8137706 - DNA, 22 bp, Homo sapiens
aatgcttatacctaatgatctt

SEQ ID NO: 8137707 - DNA, 22 bp, Homo sapiens
aatgcttaattcaatactgtgt

SEQ ID NO: 8137708 - DNA, 22 bp, Homo sapiens
aatgctttaattgcatgtagtg

SEQ ID NO: 8137709 - DNA, 22 bp, Homo sapiens
aatgctttagcagtgattagtg

SEQ ID NO: 8137710 - DNA, 22 bp, Homo sapiens
aatgctttcaaaaatgtgcagt

SEQ ID NO: 8137711 - DNA, 23 bp, Homo sapiens
acagaaatcatttgtaaggtacc

SEQ ID NO: 8137712 - DNA, 22 bp, Homo sapiens
aagcaggtaaatatgtttccct

SEQ ID NO: 8137713 - DNA, 22 bp, Homo sapiens
acaaatgactatttggtacagg

SEQ ID NO: 8137714 - DNA, 17 bp, Homo sapiens
acacagagattaacaca

SEQ ID NO: 8137715 - DNA, 22 bp, Homo sapiens
acaatgttctctgagttgtgtg

SEQ ID NO: 8137716 - DNA, 22 bp, Homo sapiens
acaatgttctgtctgacttgtc

SEQ ID NO: 8137717 - DNA, 22 bp, Homo sapiens
acacagagcaaatcatgacaga

SEQ ID NO: 8137718 - DNA, 22 bp, Homo sapiens
aaagtcacttccttctgtcagc

SEQ ID NO: 8137719 - DNA, 22 bp, Homo sapiens
aaatgacagagtaagctgttta

SEQ ID NO: 8137720 - DNA, 23 bp, Homo sapiens
aaatgtgagggaaaatctttctg

SEQ ID NO: 8137721 - DNA, 22 bp, Homo sapiens
aaaagatgaaatggtgtcttgg

SEQ ID NO: 8137722 - DNA, 20 bp, Homo sapiens
aaaaattgatatcgcttcct

SEQ ID NO: 8137723 - DNA, 22 bp, Homo sapiens
aaaaattgctgagaacggaatt

SEQ ID NO: 8137724 - DNA, 22 bp, Homo sapiens
aaaatgggtttcttcaacctca

SEQ ID NO: 8137725 - DNA, 22 bp, Homo sapiens
aacttgaatgagaacttttgcc

SEQ ID NO: 8137726 - DNA, 22 bp, Homo sapiens
aaagtcacttacagctcttttg

SEQ ID NO: 8137727 - DNA, 22 bp, Homo sapiens
aaagtcacgctgatgggaaatg

SEQ ID NO: 8137728 - DNA, 22 bp, Homo sapiens
aaagggaactctaattatcttc

SEQ ID NO: 8137729 - DNA, 22 bp, Homo sapiens
aaagtcacatataacaagggca

SEQ ID NO: 8137730 - DNA, 22 bp, Homo sapiens
aacatgaaggtaggatggtttt

SEQ ID NO: 8137731 - DNA, 22 bp, Homo sapiens
aaagcatttcatgtctagaaag

SEQ ID NO: 8137732 - DNA, 22 bp, Homo sapiens
aaattggattttaaactgttgg

SEQ ID NO: 8137733 - DNA, 22 bp, Homo sapiens
aaattggattgggagaatgtga

SEQ ID NO: 8137734 - DNA, 22 bp, Homo sapiens
aaatacaatttcaggctgtaat

SEQ ID NO: 8137735 - DNA, 22 bp, Homo sapiens
aaatatgagatgttctctttcg

SEQ ID NO: 8137736 - DNA, 22 bp, Homo sapiens
aagagagagtgcgctcacagaa

SEQ ID NO: 8137737 - DNA, 22 bp, Homo sapiens
aaatgcaaggccatgtgaagga

SEQ ID NO: 8137738 - DNA, 22 bp, Homo sapiens
aaatgcaaggattttgttaggc

SEQ ID NO: 8137739 - DNA, 22 bp, Homo sapiens
aaatgcaattgtatgtactcca

SEQ ID NO: 8137740 - DNA, 22 bp, Homo sapiens
aaatgcaattcaggaagacaag

SEQ ID NO: 8137741 - DNA, 22 bp, Homo sapiens
agagatttctactgcactcttt

SEQ ID NO: 8137742 - DNA, 22 bp, Homo sapiens
agaggattttaaaagcatatgt

SEQ ID NO: 8137743 - DNA, 20 bp, Homo sapiens
agaggatttatgtggatgtg

SEQ ID NO: 8137744 - DNA, 22 bp, Homo sapiens
agcacaaatataaaaatgtctg

SEQ ID NO: 8137745 - DNA, 22 bp, Homo sapiens
acacaaaatcaaagtcctaggc

SEQ ID NO: 8137746 - DNA, 22 bp, Homo sapiens
acaatacaggcttctggactta

SEQ ID NO: 8137747 - DNA, 20 bp, Homo sapiens
acaatacaggttgtgtctga

SEQ ID NO: 8137748 - DNA, 22 bp, Homo sapiens
agatgctgattgaatagatttc

SEQ ID NO: 8137749 - DNA, 22 bp, Homo sapiens
agatgcagacttggttcaggca

SEQ ID NO: 8137750 - DNA, 22 bp, Homo sapiens
aatttgattccctgcacctgtt

SEQ ID NO: 8137751 - DNA, 22 bp, Homo sapiens
agagttaagacgtacatgagtg

SEQ ID NO: 8137752 - DNA, 22 bp, Homo sapiens
agagttaatgcaggccaagcct

SEQ ID NO: 8137753 - DNA, 22 bp, Homo sapiens
acacataagaaactacaaagag

SEQ ID NO: 8137754 - DNA, 22 bp, Homo sapiens
acagatacagggacttggtatt

SEQ ID NO: 8137755 - DNA, 22 bp, Homo sapiens
acagaggtaggacatgagatat

SEQ ID NO: 8137756 - DNA, 22 bp, Homo sapiens
aaggacaaagcagagctggatg

SEQ ID NO: 8137757 - DNA, 22 bp, Homo sapiens
aagcttcttagaatgcatgtgc

SEQ ID NO: 8137758 - DNA, 22 bp, Homo sapiens
aatgcattgattgctggaaata

SEQ ID NO: 8137759 - DNA, 22 bp, Homo sapiens
aatgaatgaaccacatataaca

SEQ ID NO: 8137760 - DNA, 22 bp, Homo sapiens
actggctgatatggctaggaag

SEQ ID NO: 8137761 - DNA, 22 bp, Homo sapiens
aataatacatgagattaatgtt

SEQ ID NO: 8137762 - DNA, 22 bp, Homo sapiens
actgtacacagtggtgtactgt

SEQ ID NO: 8137763 - DNA, 22 bp, Homo sapiens
actgcatgataataatagcaga

SEQ ID NO: 8137764 - DNA, 22 bp, Homo sapiens
actgcatgtaaggcaatatgtt

SEQ ID NO: 8137765 - DNA, 22 bp, Homo sapiens
aagtgtttaaattatttgcagg

SEQ ID NO: 8137766 - DNA, 22 bp, Homo sapiens
aagtgtttcaataatttggacc

SEQ ID NO: 8137767 - DNA, 22 bp, Homo sapiens
aagtgtttacttaaagtcatgg

SEQ ID NO: 8137768 - DNA, 22 bp, Homo sapiens
attctccttctattaagttatt

SEQ ID NO: 8137769 - DNA, 22 bp, Homo sapiens
attctccttattctgaaaaaag

SEQ ID NO: 8137770 - DNA, 22 bp, Homo sapiens
agagcttcactggagagcacat

SEQ ID NO: 8137771 - DNA, 22 bp, Homo sapiens
attgaaatacataaaattgcca

SEQ ID NO: 8137772 - DNA, 22 bp, Homo sapiens
caaagttttagtaaacatatat

SEQ ID NO: 8137773 - DNA, 22 bp, Homo sapiens
caaagtttggctctcatgacat

SEQ ID NO: 8137774 - DNA, 22 bp, Homo sapiens
attttctgtgtgcagataaata

SEQ ID NO: 8137775 - DNA, 21 bp, Homo sapiens
atgtgattatatgacttttac

SEQ ID NO: 8137776 - DNA, 22 bp, Homo sapiens
atgtctttaaacttgagttgtt

SEQ ID NO: 8137777 - DNA, 22 bp, Homo sapiens
agagattgctagctggctttaa

SEQ ID NO: 8137778 - DNA, 22 bp, Homo sapiens
attaaggcgttggcgtgcttat

SEQ ID NO: 8137779 - DNA, 22 bp, Homo sapiens
atggacaatgtgaaactacaag

SEQ ID NO: 8137780 - DNA, 22 bp, Homo sapiens
agagactgcaatgagtggtagg

SEQ ID NO: 8137781 - DNA, 22 bp, Homo sapiens
atgacttaatcatacttgcatt

SEQ ID NO: 8137782 - DNA, 22 bp, Homo sapiens
atgcttaggttaaatttgtaat

SEQ ID NO: 8137783 - DNA, 22 bp, Homo sapiens
atgctgaaatttattggtaagg

SEQ ID NO: 8137784 - DNA, 22 bp, Homo sapiens
cagaaagacctgggctcaagag

SEQ ID NO: 8137785 - DNA, 22 bp, Homo sapiens
cagaaagacctgattggcagtt

SEQ ID NO: 8137786 - DNA, 20 bp, Homo sapiens
cagaaagaaggtagattttt

SEQ ID NO: 8137787 - DNA, 22 bp, Homo sapiens
cacatgtcctgggaaaataact

SEQ ID NO: 8137788 - DNA, 22 bp, Homo sapiens
caaggaaaacagatgatcaaca

SEQ ID NO: 8137789 - DNA, 22 bp, Homo sapiens
agctgaagcaacaacaggatgg

SEQ ID NO: 8137790 - DNA, 20 bp, Homo sapiens
agctgaagatctggatgggg

SEQ ID NO: 8137791 - DNA, 22 bp, Homo sapiens
agctgaagatccagggttgggg

SEQ ID NO: 8137792 - DNA, 22 bp, Homo sapiens
agttaccacccacaagcttgtt

SEQ ID NO: 8137793 - DNA, 22 bp, Homo sapiens
agtgctttccctgaaaccttcc

SEQ ID NO: 8137794 - DNA, 19 bp, Homo sapiens
aggtgcaggtcacagggga

SEQ ID NO: 8137795 - DNA, 21 bp, Homo sapiens
atcaatgacctggcatgaggg

SEQ ID NO: 8137796 - DNA, 22 bp, Homo sapiens
atcaatgttgggccaaagcaaa

SEQ ID NO: 8137797 - DNA, 22 bp, Homo sapiens
agaaatcacaggaggcagaagg

SEQ ID NO: 8137798 - DNA, 22 bp, Homo sapiens
ataaggacttgaattagacatt

SEQ ID NO: 8137799 - DNA, 22 bp, Homo sapiens
atacacaattgtgtttttatga

SEQ ID NO: 8137800 - DNA, 22 bp, Homo sapiens
atacaatgaagtatagatgaaa

SEQ ID NO: 8137801 - DNA, 22 bp, Homo sapiens
atagcttacaggtgatatcagc

SEQ ID NO: 8137802 - DNA, 23 bp, Homo sapiens
aggactgctcacttgaggcttcc

SEQ ID NO: 8137803 - DNA, 22 bp, Homo sapiens
aggaaataggaccagacaaagc

SEQ ID NO: 8137804 - DNA, 22 bp, Homo sapiens
acagtgttcctttgttgtgact

SEQ ID NO: 8137805 - DNA, 22 bp, Homo sapiens
aggcactctgggtttaaattct

SEQ ID NO: 8137806 - DNA, 20 bp, Homo sapiens
aggctcagggtgtttaggaa

SEQ ID NO: 8137807 - DNA, 22 bp, Homo sapiens
aggctcaggtctcaggtctggc

SEQ ID NO: 8137808 - DNA, 22 bp, Homo sapiens
aggctcaggaggagctgccgga

SEQ ID NO: 8137809 - DNA, 22 bp, Homo sapiens
aggctcagctggtggtgatcgc

SEQ ID NO: 8137810 - DNA, 20 bp, Homo sapiens
aggctcagctgagctcttgg

SEQ ID NO: 8137811 - DNA, 22 bp, Homo sapiens
acatgtatgtgtgcaaacacat

SEQ ID NO: 8137812 - DNA, 22 bp, Homo sapiens
agggctcagttgcctggagccc

SEQ ID NO: 8137813 - DNA, 22 bp, Homo sapiens
agggctcagggtcaccatctgt

SEQ ID NO: 8137814 - DNA, 22 bp, Homo sapiens
agggctcagtaaacggtggatt

SEQ ID NO: 8137815 - DNA, 22 bp, Homo sapiens
agggctcaggggccccaagctg

SEQ ID NO: 8137816 - DNA, 22 bp, Homo sapiens
agggctcagggcacgtcatcca

SEQ ID NO: 8137817 - DNA, 22 bp, Homo sapiens
agggctcagcctcctcctcagc

SEQ ID NO: 8137818 - DNA, 22 bp, Homo sapiens
agggctcagccagcctgtgtgc

SEQ ID NO: 8137819 - DNA, 22 bp, Homo sapiens
agggctcagcatctcattctgt

SEQ ID NO: 8137820 - DNA, 22 bp, Homo sapiens
agggctcactacaaccctggga

SEQ ID NO: 8137821 - DNA, 22 bp, Homo sapiens
agggctcactgggaggctataa

SEQ ID NO: 8137822 - DNA, 22 bp, Homo sapiens
agggctcagaaagcaggttttc

SEQ ID NO: 8137823 - DNA, 22 bp, Homo sapiens
agggctcagaacaatgagtgta

SEQ ID NO: 8137824 - DNA, 22 bp, Homo sapiens
agggctcagaaatgtctacggg

SEQ ID NO: 8137825 - DNA, 22 bp, Homo sapiens
agggctcagagcaaaagggcac

SEQ ID NO: 8137826 - DNA, 22 bp, Homo sapiens
agggctcagagtagttcggttt

SEQ ID NO: 8137827 - DNA, 22 bp, Homo sapiens
agggctcaatggtgggcatgta

SEQ ID NO: 8137828 - DNA, 22 bp, Homo sapiens
agggctcaccactgtgcactcc

SEQ ID NO: 8137829 - DNA, 22 bp, Homo sapiens
agggctcaagggcatgctacgt

SEQ ID NO: 8137830 - DNA, 22 bp, Homo sapiens
agggctcaagaaagtgtacctc

SEQ ID NO: 8137831 - DNA, 22 bp, Homo sapiens
aggctcagagatgagtaagcac

SEQ ID NO: 8137832 - DNA, 22 bp, Homo sapiens
aggctcagcccctgggaggaga

SEQ ID NO: 8137833 - DNA, 22 bp, Homo sapiens
aggctcagcctgggcctagagc

SEQ ID NO: 8137834 - DNA, 22 bp, Homo sapiens
aggctcagcccaaggtggagag

SEQ ID NO: 8137835 - DNA, 22 bp, Homo sapiens
agggactatttacccatctcac

SEQ ID NO: 8137836 - DNA, 19 bp, Homo sapiens
agctttggacttgcatttc

SEQ ID NO: 8137837 - DNA, 22 bp, Homo sapiens
cagggcagggccacaccccctg

SEQ ID NO: 8137838 - DNA, 22 bp, Homo sapiens
cagggcagggatgttgcggcag

SEQ ID NO: 8137839 - DNA, 22 bp, Homo sapiens
ccacccagccagatgcaggaag

SEQ ID NO: 8137840 - DNA, 22 bp, Homo sapiens
ccaatgcagataagacaaacac

SEQ ID NO: 8137841 - DNA, 22 bp, Homo sapiens
cagtgtttaatcattgtgaatt

SEQ ID NO: 8137842 - DNA, 22 bp, Homo sapiens
cagtgtttagatcaagaaggcc

SEQ ID NO: 8137843 - DNA, 22 bp, Homo sapiens
aggatttgcactggtgtttgag

SEQ ID NO: 8137844 - DNA, 22 bp, Homo sapiens
aggattttagataagacagcaa

SEQ ID NO: 8137845 - DNA, 22 bp, Homo sapiens
atcaaagtgatttgtaaacagg

SEQ ID NO: 8137846 - DNA, 22 bp, Homo sapiens
ctggctggcagatgctcttgct

SEQ ID NO: 8137847 - DNA, 22 bp, Homo sapiens
ctggagagaatgtggaatgatt

SEQ ID NO: 8137848 - DNA, 22 bp, Homo sapiens
ctggagagaatgttcattgcag

SEQ ID NO: 8137849 - DNA, 23 bp, Homo sapiens
atacatacagtcttactgacttt

SEQ ID NO: 8137850 - DNA, 22 bp, Homo sapiens
atacatacgtacatacgtatgt

SEQ ID NO: 8137851 - DNA, 22 bp, Homo sapiens
ataccaaagcacatactgtttg

SEQ ID NO: 8137852 - DNA, 22 bp, Homo sapiens
atacaacagaaaatgattattc

SEQ ID NO: 8137853 - DNA, 21 bp, Homo sapiens
ctgaatgccccaaatgacctt

SEQ ID NO: 8137854 - DNA, 22 bp, Homo sapiens
ctctgcagtgtaacagcgcttg

SEQ ID NO: 8137855 - DNA, 17 bp, Homo sapiens
ctctgcagtgcatggct

SEQ ID NO: 8137856 - DNA, 22 bp, Homo sapiens
ctctgcaggccttgagtgtggt

SEQ ID NO: 8137857 - DNA, 22 bp, Homo sapiens
ctctgcaggggaggcatgcact

SEQ ID NO: 8137858 - DNA, 23 bp, Homo sapiens
ctctgcaggagagtgggcagggc

SEQ ID NO: 8137859 - DNA, 21 bp, Homo sapiens
ctctgcagccctgcttccagg

SEQ ID NO: 8137860 - DNA, 22 bp, Homo sapiens
ctctgcaggcctgtgaagggtg

SEQ ID NO: 8137861 - DNA, 22 bp, Homo sapiens
ctctgcaggcacccagggtggg

SEQ ID NO: 8137862 - DNA, 20 bp, Homo sapiens
aggtaggatcggtgtcataa

SEQ ID NO: 8137863 - DNA, 22 bp, Homo sapiens
aggtaggatgggtggagatgat

SEQ ID NO: 8137864 - DNA, 22 bp, Homo sapiens
aggtaggatagataggaagacc

SEQ ID NO: 8137865 - DNA, 22 bp, Homo sapiens
ctaccatccttaggctgaagtg

SEQ ID NO: 8137866 - DNA, 22 bp, Homo sapiens
agtacacaagacacatttaaaa

SEQ ID NO: 8137867 - DNA, 22 bp, Homo sapiens
agtacacagtagactttctcat

SEQ ID NO: 8137868 - DNA, 22 bp, Homo sapiens
agtacacagagttattttgtgt

SEQ ID NO: 8137869 - DNA, 22 bp, Homo sapiens
cagcaagatttttaaagcaagg

SEQ ID NO: 8137870 - DNA, 22 bp, Homo sapiens
cagcaagagggtaaggttgaag

SEQ ID NO: 8137871 - DNA, 22 bp, Homo sapiens
cagagacagtttcacagggtct

SEQ ID NO: 8137872 - DNA, 22 bp, Homo sapiens
cagagacagggcagggagtgtg

SEQ ID NO: 8137873 - DNA, 22 bp, Homo sapiens
cagagacagcctgggagggaca

SEQ ID NO: 8137874 - DNA, 22 bp, Homo sapiens
cacatacaatggtgttatttgg

SEQ ID NO: 8137875 - DNA, 22 bp, Homo sapiens
cacatacatacgtatgtataca

SEQ ID NO: 8137876 - DNA, 22 bp, Homo sapiens
cacatacattcatgttactcta

SEQ ID NO: 8137877 - DNA, 22 bp, Homo sapiens
cagaaatagacaatggcagtgg

SEQ ID NO: 8137878 - DNA, 23 bp, Homo sapiens
cagaaataaactggtttgtagat

SEQ ID NO: 8137879 - DNA, 22 bp, Homo sapiens
ggctcaggctggagtgcagtgg

SEQ ID NO: 8137880 - DNA, 22 bp, Homo sapiens
gctttgcacaacctttaagaca

SEQ ID NO: 8137881 - DNA, 22 bp, Homo sapiens
caagtatttgcggagttccacg

SEQ ID NO: 8137882 - DNA, 22 bp, Homo sapiens
caagtttacaatgtgtatgtgt

SEQ ID NO: 8137883 - DNA, 19 bp, Homo sapiens
ggagccgccgcccttcatt

SEQ ID NO: 8137884 - DNA, 22 bp, Homo sapiens
cacactgttgaggacgagatgt

SEQ ID NO: 8137885 - DNA, 22 bp, Homo sapiens
atgttgaactaggatctcttga

SEQ ID NO: 8137886 - DNA, 22 bp, Homo sapiens
atgttcttgttcaaatgtcagt

SEQ ID NO: 8137887 - DNA, 22 bp, Homo sapiens
atgttggactaggctcttaatt

SEQ ID NO: 8137888 - DNA, 22 bp, Homo sapiens
gataatattagaagatacaaat

SEQ ID NO: 8137889 - DNA, 22 bp, Homo sapiens
atgtttaaggaactggtttgct

SEQ ID NO: 8137890 - DNA, 22 bp, Homo sapiens
gactggatttatagatatcata

SEQ ID NO: 8137891 - DNA, 22 bp, Homo sapiens
atgctccagtgtgatgcttcat

SEQ ID NO: 8137892 - DNA, 22 bp, Homo sapiens
gacacaaagtttgtcagaaatt

SEQ ID NO: 8137893 - DNA, 21 bp, Homo sapiens
gacacaaagggtagtaatggt

SEQ ID NO: 8137894 - DNA, 22 bp, Homo sapiens
gaatacaaacttaaggctttac

SEQ ID NO: 8137895 - DNA, 22 bp, Homo sapiens
atgcacaattaggatatagctt

SEQ ID NO: 8137896 - DNA, 22 bp, Homo sapiens
gaaagtcatggatgaacactac

SEQ ID NO: 8137897 - DNA, 22 bp, Homo sapiens
atgatctgataatcatccacta

SEQ ID NO: 8137898 - DNA, 22 bp, Homo sapiens
atgatgctgtttatcatatact

SEQ ID NO: 8137899 - DNA, 22 bp, Homo sapiens
ctttctggagtggaaaggtatt

SEQ ID NO: 8137900 - DNA, 22 bp, Homo sapiens
cttctttaccaagagatagagt

SEQ ID NO: 8137901 - DNA, 21 bp, Homo sapiens
gctcttggaaggggctcagct

SEQ ID NO: 8137902 - DNA, 21 bp, Homo sapiens
caaaggactgtagctcactga

SEQ ID NO: 8137903 - DNA, 22 bp, Homo sapiens
caaaattgttgatgctgctttg

SEQ ID NO: 8137904 - DNA, 22 bp, Homo sapiens
caaaattgattgtggtgatggt

SEQ ID NO: 8137905 - DNA, 22 bp, Homo sapiens
caaaattgatgaatgtatgatt

SEQ ID NO: 8137906 - DNA, 22 bp, Homo sapiens
caaaattagggagtgagctgga

SEQ ID NO: 8137907 - DNA, 22 bp, Homo sapiens
atttttccaattaggataaaga

SEQ ID NO: 8137908 - DNA, 22 bp, Homo sapiens
attaggcattatggggataagg

SEQ ID NO: 8137909 - DNA, 22 bp, Homo sapiens
attagatgtgaccttagataaa

SEQ ID NO: 8137910 - DNA, 22 bp, Homo sapiens
attcaaattaagttaattcagc

SEQ ID NO: 8137911 - DNA, 22 bp, Homo sapiens
attagaggttgttttgtaaaga

SEQ ID NO: 8137912 - DNA, 22 bp, Homo sapiens
attcactggcagacagaactca

SEQ ID NO: 8137913 - DNA, 22 bp, Homo sapiens
attcactggtgtcagggatcag

SEQ ID NO: 8137914 - DNA, 22 bp, Homo sapiens
attgatttaggcttgttatgac

SEQ ID NO: 8137915 - DNA, 21 bp, Homo sapiens
gccaagaacaagacagacatg

SEQ ID NO: 8137916 - DNA, 22 bp, Homo sapiens
tctggcagcaagtctgtttctc

SEQ ID NO: 8137917 - DNA, 22 bp, Homo sapiens
ccagctgaggcagccacacagg

SEQ ID NO: 8137918 - DNA, 22 bp, Homo sapiens
ccagctgaggttgaagaaagag

SEQ ID NO: 8137919 - DNA, 22 bp, Homo sapiens
ccagctgattcggtggtggttg

SEQ ID NO: 8137920 - DNA, 22 bp, Homo sapiens
ccagtgtttccgtcagtacacg

SEQ ID NO: 8137921 - DNA, 22 bp, Homo sapiens
ccatgttgtatctcttatcggc

SEQ ID NO: 8137922 - DNA, 22 bp, Homo sapiens
ccatgttggaacttcacattct

SEQ ID NO: 8137923 - DNA, 22 bp, Homo sapiens
ccatgttgtcaaacttagagta

SEQ ID NO: 8137924 - DNA, 21 bp, Homo sapiens
tgatttctagatattggccca

SEQ ID NO: 8137925 - DNA, 22 bp, Homo sapiens
tgatttctcatattgttcaaaa

SEQ ID NO: 8137926 - DNA, 22 bp, Homo sapiens
tgatttcttctaatttccatca

SEQ ID NO: 8137927 - DNA, 22 bp, Homo sapiens
tgatttctcttggcaatatgtt

SEQ ID NO: 8137928 - DNA, 20 bp, Homo sapiens
tgatttctcttctattcctt

SEQ ID NO: 8137929 - DNA, 22 bp, Homo sapiens
tgacaagatcacagtcaagtgt

SEQ ID NO: 8137930 - DNA, 22 bp, Homo sapiens
tgacaagaatttgggactgtta

SEQ ID NO: 8137931 - DNA, 22 bp, Homo sapiens
tgacaagagacccctccgcagg

SEQ ID NO: 8137932 - DNA, 22 bp, Homo sapiens
tgaatgcaagtcacacatttct

SEQ ID NO: 8137933 - DNA, 22 bp, Homo sapiens
tgaatgcacattagtaagtgca

SEQ ID NO: 8137934 - DNA, 22 bp, Homo sapiens
tgaatgcaaatcatgattgtaa

SEQ ID NO: 8137935 - DNA, 22 bp, Homo sapiens
tgaatgcatggcttagatctac

SEQ ID NO: 8137936 - DNA, 22 bp, Homo sapiens
tgaatgcagagactgtgggaaa

SEQ ID NO: 8137937 - DNA, 22 bp, Homo sapiens
taagtcacttattccacaagat

SEQ ID NO: 8137938 - DNA, 22 bp, Homo sapiens
taatacaaggcaggaagcagta

SEQ ID NO: 8137939 - DNA, 22 bp, Homo sapiens
taatcacagaaatgcccattca

SEQ ID NO: 8137940 - DNA, 22 bp, Homo sapiens
tagaaaatgttccactgccatt

SEQ ID NO: 8137941 - DNA, 23 bp, Homo sapiens
cagggctggtagggaagagcgtg

SEQ ID NO: 8137942 - DNA, 22 bp, Homo sapiens
cagggctgtctccaaaggcccc

SEQ ID NO: 8137943 - DNA, 22 bp, Homo sapiens
tcaacaagaataccatcctcct

SEQ ID NO: 8137944 - DNA, 19 bp, Homo sapiens
cagtatcattgcacatagt

SEQ ID NO: 8137945 - DNA, 22 bp, Homo sapiens
catgaatgctgggttcatgtaa

SEQ ID NO: 8137946 - DNA, 22 bp, Homo sapiens
tcagataccattgaatttgttg

SEQ ID NO: 8137947 - DNA, 22 bp, Homo sapiens
cattgttttgagaacaacctga

SEQ ID NO: 8137948 - DNA, 22 bp, Homo sapiens
cattgttctggagaaggttcca

SEQ ID NO: 8137949 - DNA, 22 bp, Homo sapiens
cattacatttcaaaatgtttcc

SEQ ID NO: 8137950 - DNA, 22 bp, Homo sapiens
ttggtcagcactgatgtttcag

SEQ ID NO: 8137951 - DNA, 22 bp, Homo sapiens
ttgtcttttgtgggaaatatgg

SEQ ID NO: 8137952 - DNA, 22 bp, Homo sapiens
tttcacagtagaaatcattatg

SEQ ID NO: 8137953 - DNA, 22 bp, Homo sapiens
tttgttctattttagagatgaa

SEQ ID NO: 8137954 - DNA, 19 bp, Homo sapiens
ttttaagtcctctctattc

SEQ ID NO: 8137955 - DNA, 22 bp, Homo sapiens
ctctgctttcctcttacacact

SEQ ID NO: 8137956 - DNA, 22 bp, Homo sapiens
tttgggattttacattgtatgg

SEQ ID NO: 8137957 - DNA, 22 bp, Homo sapiens
ctctgcagattcatcccttcac

SEQ ID NO: 8137958 - DNA, 20 bp, Homo sapiens
ctctgcagcaaggcctgggt

SEQ ID NO: 8137959 - DNA, 22 bp, Homo sapiens
ctgcaccacagcctgaggcagc

SEQ ID NO: 8137960 - DNA, 22 bp, Homo sapiens
ctgacatgtataagctttaagt

SEQ ID NO: 8137961 - DNA, 22 bp, Homo sapiens
tgttcagagacagaaattctaa

SEQ ID NO: 8137962 - DNA, 23 bp, Homo sapiens
tgttccagatacgccttttcctc

SEQ ID NO: 8137963 - DNA, 22 bp, Homo sapiens
ttagaattattgtttccttcta

SEQ ID NO: 8137964 - DNA, 22 bp, Homo sapiens
tgtttagagtctctgtcaacat

SEQ ID NO: 8137965 - DNA, 22 bp, Homo sapiens
tgtttagaggaacaacagactt

SEQ ID NO: 8137966 - DNA, 22 bp, Homo sapiens
tgtttagactcaaaattgaaag

SEQ ID NO: 8137967 - DNA, 22 bp, Homo sapiens
ctacttctgtggctctaagaga

SEQ ID NO: 8137968 - DNA, 22 bp, Homo sapiens
ctcaagaggatatgtccagaaa

SEQ ID NO: 8137969 - DNA, 22 bp, Homo sapiens
cgtaggatactcagtgctcatt

SEQ ID NO: 8137970 - DNA, 22 bp, Homo sapiens
ttcatgaagggtgaatatagtc

SEQ ID NO: 8137971 - DNA, 22 bp, Homo sapiens
ttcagaaataaaatatcccaac

SEQ ID NO: 8137972 - DNA, 22 bp, Homo sapiens
ttcagataaactacaaataatt

SEQ ID NO: 8137973 - DNA, 22 bp, Homo sapiens
ttcagatgtggctttgtcaggc

SEQ ID NO: 8137974 - DNA, 22 bp, Homo sapiens
ctggctggagcaggcatcttgt

SEQ ID NO: 8137975 - DNA, 22 bp, Homo sapiens
ctgttacaagagagagacatga

SEQ ID NO: 8137976 - DNA, 22 bp, Homo sapiens
ctgtttaaccagatctcatatc

SEQ ID NO: 8137977 - DNA, 22 bp, Homo sapiens
cttgcacaggatctgaagtggg

SEQ ID NO: 8137978 - DNA, 22 bp, Homo sapiens
cttgcacagtgactaacacgta

SEQ ID NO: 8137979 - DNA, 22 bp, Homo sapiens
cttgcacagaactcttagaggt

SEQ ID NO: 8137980 - DNA, 22 bp, Homo sapiens
cttgcacacgtgtatgtacatg

SEQ ID NO: 8137981 - DNA, 22 bp, Homo sapiens
cttgcacacatgtacatgtgta

SEQ ID NO: 8137982 - DNA, 22 bp, Homo sapiens
cttgcacaaagtcacctagtca

SEQ ID NO: 8137983 - DNA, 22 bp, Homo sapiens
cttgcacatttcacacaatagg

SEQ ID NO: 8137984 - DNA, 22 bp, Homo sapiens
cttgcacatgttttactctcca

SEQ ID NO: 8137985 - DNA, 22 bp, Homo sapiens
cttgcacatggctgctttctcg

SEQ ID NO: 8137986 - DNA, 22 bp, Homo sapiens
gaataacagcaagtttgcaggc

SEQ ID NO: 8137987 - DNA, 22 bp, Homo sapiens
gaataacattggaaccctgaag

SEQ ID NO: 8137988 - DNA, 22 bp, Homo sapiens
gaaggaaaaatactctgtaagg

SEQ ID NO: 8137989 - DNA, 22 bp, Homo sapiens
gaagattttctcctttaaatga

SEQ ID NO: 8137990 - DNA, 22 bp, Homo sapiens
gaagatttctgatgagttactt

SEQ ID NO: 8137991 - DNA, 22 bp, Homo sapiens
gaagatttaagcacaatagtct

SEQ ID NO: 8137992 - DNA, 22 bp, Homo sapiens
gaaccatgagaaattgctattt

SEQ ID NO: 8137993 - DNA, 22 bp, Homo sapiens
gagctgaatcagagatattatt

SEQ ID NO: 8137994 - DNA, 22 bp, Homo sapiens
gagctcttcgcctgtcgctgag

SEQ ID NO: 8137995 - DNA, 22 bp, Homo sapiens
gagcagcaggtggctgtgatgg

SEQ ID NO: 8137996 - DNA, 22 bp, Homo sapiens
gagcagcagattgtctccatgg

SEQ ID NO: 8137997 - DNA, 22 bp, Homo sapiens
gtgcaccagtcacatgggcaga

SEQ ID NO: 8137998 - DNA, 22 bp, Homo sapiens
gtccacagggatggccacacat

SEQ ID NO: 8137999 - DNA, 18 bp, Homo sapiens
gtccacagccctcacagc

SEQ ID NO: 8138000 - DNA, 22 bp, Homo sapiens
ggtttctctagggctgaccagt

SEQ ID NO: 8138001 - DNA, 22 bp, Homo sapiens
ggttttcaaagaggcatttcat

SEQ ID NO: 8138002 - DNA, 23 bp, Homo sapiens
ggttttcatggcattccttgcct

SEQ ID NO: 8138003 - DNA, 22 bp, Homo sapiens
ggttttcagtttgtgagctctg

SEQ ID NO: 8138004 - DNA, 22 bp, Homo sapiens
ggttttcacctccagaatgtgc

SEQ ID NO: 8138005 - DNA, 22 bp, Homo sapiens
gggtaggatggtagaagggacc

SEQ ID NO: 8138006 - DNA, 22 bp, Homo sapiens
gggtaggagaggtgtctgtgtg

SEQ ID NO: 8138007 - DNA, 22 bp, Homo sapiens
ggggctcaggggaagtgtccag

SEQ ID NO: 8138008 - DNA, 22 bp, Homo sapiens
ggggctcacacctccctaaggg

SEQ ID NO: 8138009 - DNA, 23 bp, Homo sapiens
gggctgctccaggccaaggctgg

SEQ ID NO: 8138010 - DNA, 22 bp, Homo sapiens
ggctgaaggaactttttccatg

SEQ ID NO: 8138011 - DNA, 22 bp, Homo sapiens
ggcaaagagatgatctttgcaa

SEQ ID NO: 8138012 - DNA, 22 bp, Homo sapiens
ggcaaagagacatgcatcgggg

SEQ ID NO: 8138013 - DNA, 22 bp, Homo sapiens
ggcaaagaaccacaccacgtgt

SEQ ID NO: 8138014 - DNA, 22 bp, Homo sapiens
gcacatgacagtaagtagagca

SEQ ID NO: 8138015 - DNA, 21 bp, Homo sapiens
gcacatgagggagggcatgcc

SEQ ID NO: 8138016 - DNA, 22 bp, Homo sapiens
gcaaagaaatgtcagtgagagg

SEQ ID NO: 8138017 - DNA, 22 bp, Homo sapiens
gcaaagaaagttttaatgaggt

SEQ ID NO: 8138018 - DNA, 22 bp, Homo sapiens
gcaaagaaagccaaggtctaac

SEQ ID NO: 8138019 - DNA, 22 bp, Homo sapiens
gcaaagaatgcagatttgcctc

SEQ ID NO: 8138020 - DNA, 22 bp, Homo sapiens
gcagggacatctttgtctagta

SEQ ID NO: 8138021 - DNA, 22 bp, Homo sapiens
gcagggacatcttcagatcact

SEQ ID NO: 8138022 - DNA, 22 bp, Homo sapiens
gcagggacagggcagggccttt

SEQ ID NO: 8138023 - DNA, 22 bp, Homo sapiens
gcagggacacctttgtgaagct

SEQ ID NO: 8138024 - DNA, 18 bp, Homo sapiens
gcagggacacagggtcac

SEQ ID NO: 8138025 - DNA, 22 bp, Homo sapiens
gcagggacaactgtgcacctga

SEQ ID NO: 8138026 - DNA, 22 bp, Homo sapiens
gcagggacaaggcaggtgttct

SEQ ID NO: 8138027 - DNA, 22 bp, Homo sapiens
gcagggaccagggccagatcca

SEQ ID NO: 8138028 - DNA, 21 bp, Homo sapiens
gcagggaccgcgacttctggg

SEQ ID NO: 8138029 - DNA, 22 bp, Homo sapiens
gcagggacctatgacgatggaa

SEQ ID NO: 8138030 - DNA, 22 bp, Homo sapiens
gcagggaccaaaagaggcagta

SEQ ID NO: 8138031 - DNA, 22 bp, Homo sapiens
gcagggacctgccactgctgtc

SEQ ID NO: 8138032 - DNA, 22 bp, Homo sapiens
gcagggacctcactacccccag

SEQ ID NO: 8138033 - DNA, 21 bp, Homo sapiens
gcagggacaaagcttcaggag

SEQ ID NO: 8138034 - DNA, 22 bp, Homo sapiens
gcatgctgcagggaatgcttgt

SEQ ID NO: 8138035 - DNA, 22 bp, Homo sapiens
ggaatgcaattttacaattctg

SEQ ID NO: 8138036 - DNA, 21 bp, Homo sapiens
gctgagacgcaacctcagtga

SEQ ID NO: 8138037 - DNA, 22 bp, Homo sapiens
gcggggttccgtgccccagagt

SEQ ID NO: 8138038 - DNA, 22 bp, Homo sapiens
taggatctcaccatagaaggaa

SEQ ID NO: 8138039 - DNA, 22 bp, Homo sapiens
taggatgtgccaggaaagaaag

SEQ ID NO: 8138040 - DNA, 22 bp, Homo sapiens
taggattccagaacagtgctgc

SEQ ID NO: 8138041 - DNA, 22 bp, Homo sapiens
tagctgaaggctacagcagaac

SEQ ID NO: 8138042 - DNA, 22 bp, Homo sapiens
tagaaagaacttcatgtaaaac

SEQ ID NO: 8138043 - DNA, 22 bp, Homo sapiens
tagaaatccccagtctcatagt

SEQ ID NO: 8138044 - DNA, 22 bp, Homo sapiens
tagaaatctacttagactttct

SEQ ID NO: 8138045 - DNA, 22 bp, Homo sapiens
tagaaatcaggtttttagaaag

SEQ ID NO: 8138046 - DNA, 22 bp, Homo sapiens
tagaaatcatttagaagtattg

SEQ ID NO: 8138047 - DNA, 22 bp, Homo sapiens
tagacacatcaagtatagttaa

SEQ ID NO: 8138048 - DNA, 22 bp, Homo sapiens
tagacacatccgtggaagcttc

SEQ ID NO: 8138049 - DNA, 22 bp, Homo sapiens
tagacacaaatctcagtgacac

SEQ ID NO: 8138050 - DNA, 22 bp, Homo sapiens
tagacacatacccttgcccaaa

SEQ ID NO: 8138051 - DNA, 22 bp, Homo sapiens
tagacacaagagaagggtataa

SEQ ID NO: 8138052 - DNA, 22 bp, Homo sapiens
tagaaagaaattcagattggct

SEQ ID NO: 8138053 - DNA, 22 bp, Homo sapiens
tatacacacctccaaagcagga

SEQ ID NO: 8138054 - DNA, 22 bp, Homo sapiens
tatacacaaggtgtgcatttgt

SEQ ID NO: 8138055 - DNA, 23 bp, Homo sapiens
tatacacatgtggcagtatagtg

SEQ ID NO: 8138056 - DNA, 17 bp, Homo sapiens
tatacacagacagactg

SEQ ID NO: 8138057 - DNA, 22 bp, Homo sapiens
tatctacagttaatatgtcatc

SEQ ID NO: 8138058 - DNA, 22 bp, Homo sapiens
tatccaattcaccattgatggg

SEQ ID NO: 8138059 - DNA, 22 bp, Homo sapiens
tatgtacagggatagaacttga

SEQ ID NO: 8138060 - DNA, 22 bp, Homo sapiens
tatttattctttgtactgcctt

SEQ ID NO: 8138061 - DNA, 22 bp, Homo sapiens
tatttattcattcagcaagcat

SEQ ID NO: 8138062 - DNA, 22 bp, Homo sapiens
tatttattggacagtgttgctg

SEQ ID NO: 8138063 - DNA, 22 bp, Homo sapiens
tatttatgtggaccataagcct

SEQ ID NO: 8138064 - DNA, 21 bp, Homo sapiens
tatttattaatttgtaaggct

SEQ ID NO: 8138065 - DNA, 22 bp, Homo sapiens
taatacatcattcatctaagga

SEQ ID NO: 8138066 - DNA, 22 bp, Homo sapiens
taattacaaagcaagcacaggg

SEQ ID NO: 8138067 - DNA, 22 bp, Homo sapiens
tacaaagaggtaattgcatata

SEQ ID NO: 8138068 - DNA, 22 bp, Homo sapiens
tacaaagagtttggtctctaga

SEQ ID NO: 8138069 - DNA, 22 bp, Homo sapiens
tacaacaatttccacattagaa

SEQ ID NO: 8138070 - DNA, 22 bp, Homo sapiens
tacagaaagggatgattgatct

SEQ ID NO: 8138071 - DNA, 22 bp, Homo sapiens
tacagataaaaatgctgttctt

SEQ ID NO: 8138072 - DNA, 22 bp, Homo sapiens
tacatacatgtatgtgtgtatt

SEQ ID NO: 8138073 - DNA, 22 bp, Homo sapiens
tacataccttgacggtagatgg

SEQ ID NO: 8138074 - DNA, 22 bp, Homo sapiens
gttcagagtattaattgattta

SEQ ID NO: 8138075 - DNA, 22 bp, Homo sapiens
gttcagagaaagagacacctta

SEQ ID NO: 8138076 - DNA, 22 bp, Homo sapiens
gttgcagatgtggaactcgtgc

SEQ ID NO: 8138077 - DNA, 22 bp, Homo sapiens
gttgcacaacttgaatggctgg

SEQ ID NO: 8138078 - DNA, 22 bp, Homo sapiens
taaacaagctgtctgatattct

SEQ ID NO: 8138079 - DNA, 22 bp, Homo sapiens
taaacaagggttactgagcatg

SEQ ID NO: 8138080 - DNA, 22 bp, Homo sapiens
taaaattgcggtgaatatttcc

SEQ ID NO: 8138081 - DNA, 22 bp, Homo sapiens
gttttgttttgagtcaactcca

SEQ ID NO: 8138082 - DNA, 19 bp, Homo sapiens
gttttgtttgcagaactta

SEQ ID NO: 8138083 - DNA, 21 bp, Homo sapiens
gttttctttgatagagggaag

SEQ ID NO: 8138084 - DNA, 22 bp, Homo sapiens
gttttcattactgctgtgattt

SEQ ID NO: 8138085 - DNA, 22 bp, Homo sapiens
gttttccactggattgtttgga

SEQ ID NO: 8138086 - DNA, 22 bp, Homo sapiens
tccatccatgtaggaagatggt

SEQ ID NO: 8138087 - DNA, 22 bp, Homo sapiens
tccagctgtagtggatttgaga

SEQ ID NO: 8138088 - DNA, 22 bp, Homo sapiens
tccagcagtaaggaaagtacat

SEQ ID NO: 8138089 - DNA, 22 bp, Homo sapiens
tcattgcaagctcatttatctg

SEQ ID NO: 8138090 - DNA, 22 bp, Homo sapiens
tcattgcagactaacaatctca

SEQ ID NO: 8138091 - DNA, 22 bp, Homo sapiens
tccagcagactcatcagcaagg

SEQ ID NO: 8138092 - DNA, 22 bp, Homo sapiens
tccagcagaggttgataatacc

SEQ ID NO: 8138093 - DNA, 22 bp, Homo sapiens
tccagcaggtgtttgccaactt

SEQ ID NO: 8138094 - DNA, 22 bp, Homo sapiens
tcaagtattattacagatgtag

SEQ ID NO: 8138095 - DNA, 22 bp, Homo sapiens
tcaatacagaaaggatattttg

SEQ ID NO: 8138096 - DNA, 22 bp, Homo sapiens
tcacaatggcatagtataaaat

SEQ ID NO: 8138097 - DNA, 22 bp, Homo sapiens
tcacaatgaaaaacactacata

SEQ ID NO: 8138098 - DNA, 22 bp, Homo sapiens
tcacaaagctttgataagcaga

SEQ ID NO: 8138099 - DNA, 22 bp, Homo sapiens
tcacagggtgtacatcacctat

SEQ ID NO: 8138100 - DNA, 22 bp, Homo sapiens
tcactctgcctccatattacta

SEQ ID NO: 8138101 - DNA, 22 bp, Homo sapiens
tcactgttaataaatagcaaag

SEQ ID NO: 8138102 - DNA, 22 bp, Homo sapiens
tcacttgagagatattagaagt

SEQ ID NO: 8138103 - DNA, 22 bp, Homo sapiens
tcattcaagatttcaatagatt

SEQ ID NO: 8138104 - DNA, 22 bp, Homo sapiens
tcattcatactcttttctatta

SEQ ID NO: 8138105 - DNA, 18 bp, Homo sapiens
tcattattgtttctggag

SEQ ID NO: 8138106 - DNA, 22 bp, Homo sapiens
tcagggacccctctgagtggag

SEQ ID NO: 8138107 - DNA, 22 bp, Homo sapiens
tcagggacgtgagctcagagtc

SEQ ID NO: 8138108 - DNA, 22 bp, Homo sapiens
tcagggacaataagggaattga

SEQ ID NO: 8138109 - DNA, 22 bp, Homo sapiens
tcagggaccaccactcacccag

SEQ ID NO: 8138110 - DNA, 22 bp, Homo sapiens
tcagggacatttagacactgat

SEQ ID NO: 8138111 - DNA, 23 bp, Homo sapiens
tcagggacatgatgtgtcatatc

SEQ ID NO: 8138112 - DNA, 22 bp, Homo sapiens
tcagggacaggatgggcatttc

SEQ ID NO: 8138113 - DNA, 22 bp, Homo sapiens
tcagggacagggtgctgctgcg

SEQ ID NO: 8138114 - DNA, 22 bp, Homo sapiens
tcagggacagttcttagggtgg

SEQ ID NO: 8138115 - DNA, 22 bp, Homo sapiens
tttgcacagatgggatacagca

SEQ ID NO: 8138116 - DNA, 22 bp, Homo sapiens
tttgcacacattcttagaaatg

SEQ ID NO: 8138117 - DNA, 22 bp, Homo sapiens
tttctttccatacatattgcta

SEQ ID NO: 8138118 - DNA, 22 bp, Homo sapiens
tttgtcataactctgctgcaag

SEQ ID NO: 8138119 - DNA, 22 bp, Homo sapiens
tttgttctgcatcacagaaaaa

SEQ ID NO: 8138120 - DNA, 22 bp, Homo sapiens
tttttgcaccaacctaatagaa

SEQ ID NO: 8138121 - DNA, 22 bp, Homo sapiens
tttttcattgcagcctctctcc

SEQ ID NO: 8138122 - DNA, 22 bp, Homo sapiens
tttcttctaggactaataagag

SEQ ID NO: 8138123 - DNA, 23 bp, Homo sapiens
tttcttctcgaagagggagctta

SEQ ID NO: 8138124 - DNA, 19 bp, Homo sapiens
tttctgttagaaggataca

SEQ ID NO: 8138125 - DNA, 23 bp, Homo sapiens
tttctgttgggtatatatccaag

SEQ ID NO: 8138126 - DNA, 22 bp, Homo sapiens
tttctccttgtgtctcctttga

SEQ ID NO: 8138127 - DNA, 17 bp, Homo sapiens
tttctccttccatctca

SEQ ID NO: 8138128 - DNA, 22 bp, Homo sapiens
tttctcctgtgtaagccgccca

SEQ ID NO: 8138129 - DNA, 22 bp, Homo sapiens
tttctcctgctagaacaaggag

SEQ ID NO: 8138130 - DNA, 22 bp, Homo sapiens
tttctcctgtgaggtcagaagt

SEQ ID NO: 8138131 - DNA, 22 bp, Homo sapiens
tttctcctgcccagatgcctgg

SEQ ID NO: 8138132 - DNA, 22 bp, Homo sapiens
tttctcctgagttccacgctac

SEQ ID NO: 8138133 - DNA, 22 bp, Homo sapiens
tttctactttggaatgcactga

SEQ ID NO: 8138134 - DNA, 22 bp, Homo sapiens
tttctcatagtcatgcctctta

SEQ ID NO: 8138135 - DNA, 21 bp, Homo sapiens
tttctcataaaatactcatta

SEQ ID NO: 8138136 - DNA, 22 bp, Homo sapiens
tttctcatggacccttcatgat

SEQ ID NO: 8138137 - DNA, 16 bp, Homo sapiens
tttctcattgtcatca

SEQ ID NO: 8138138 - DNA, 22 bp, Homo sapiens
tttctcatggaacatagctcct

SEQ ID NO: 8138139 - DNA, 22 bp, Homo sapiens
tttctcctccagagagacacag

SEQ ID NO: 8138140 - DNA, 22 bp, Homo sapiens
tttctcctctccagagtgcagt

SEQ ID NO: 8138141 - DNA, 22 bp, Homo sapiens
tttctcctaactcaaatttaag

SEQ ID NO: 8138142 - DNA, 22 bp, Homo sapiens
tttctcctcatgactggttgtg

SEQ ID NO: 8138143 - DNA, 22 bp, Homo sapiens
tttcattttggttatgccataa

SEQ ID NO: 8138144 - DNA, 22 bp, Homo sapiens
tttcagagttagtagagcatgt

SEQ ID NO: 8138145 - DNA, 22 bp, Homo sapiens
ttggtcttttctattaaatata

SEQ ID NO: 8138146 - DNA, 22 bp, Homo sapiens
ttgtttgtgctatttaatgtag

SEQ ID NO: 8138147 - DNA, 17 bp, Homo sapiens
ttgtttgttcttgcccc

SEQ ID NO: 8138148 - DNA, 22 bp, Homo sapiens
ttgttttatctttctacagact

SEQ ID NO: 8138149 - DNA, 22 bp, Homo sapiens
ttgtttgtaaggctcttagaat

SEQ ID NO: 8138150 - DNA, 22 bp, Homo sapiens
ttgtttgtatgctgagaagaat

SEQ ID NO: 8138151 - DNA, 22 bp, Homo sapiens
ttgtttgtcataatatcattac

SEQ ID NO: 8138152 - DNA, 22 bp, Homo sapiens
tttaaaaaactagtctgagtct

SEQ ID NO: 8138153 - DNA, 22 bp, Homo sapiens
ttctagacaaatgtgttcattc

SEQ ID NO: 8138154 - DNA, 23 bp, Homo sapiens
ttcaacaaatatggccaccagaa

SEQ ID NO: 8138155 - DNA, 22 bp, Homo sapiens
ttcatcattacagtcatgttat

SEQ ID NO: 8138156 - DNA, 22 bp, Homo sapiens
ttcatgcttgttcctccacctg

SEQ ID NO: 8138157 - DNA, 22 bp, Homo sapiens
ttcatgctgtgtctacaactta

SEQ ID NO: 8138158 - DNA, 22 bp, Homo sapiens
ttcatcatcagaactgttcact

SEQ ID NO: 8138159 - DNA, 22 bp, Homo sapiens
ttcatgtagcttagcagagagg

SEQ ID NO: 8138160 - DNA, 22 bp, Homo sapiens
ttcatgtttgcctatttgactt

SEQ ID NO: 8138161 - DNA, 22 bp, Homo sapiens
ttcatgtttcctcttgtgctgc

SEQ ID NO: 8138162 - DNA, 22 bp, Homo sapiens
ttcatgttgtagtatgtatcag

SEQ ID NO: 8138163 - DNA, 22 bp, Homo sapiens
ttcatgtttcatttgttactat

SEQ ID NO: 8138164 - DNA, 23 bp, Homo sapiens
ttcatgttccctccttctggtga

SEQ ID NO: 8138165 - DNA, 22 bp, Homo sapiens
ttcatgtgccagagctgaaaat

SEQ ID NO: 8138166 - DNA, 20 bp, Homo sapiens
ttcttgaatacccaacccca

SEQ ID NO: 8138167 - DNA, 22 bp, Homo sapiens
ttcttctttccaattacatggt

SEQ ID NO: 8138168 - DNA, 22 bp, Homo sapiens
ttctggaaagatttgcgtgtaa

SEQ ID NO: 8138169 - DNA, 22 bp, Homo sapiens
ttgagcacaggtgaacagcatc

SEQ ID NO: 8138170 - DNA, 22 bp, Homo sapiens
ttgatttcttactcttccaagg

SEQ ID NO: 8138171 - DNA, 22 bp, Homo sapiens
ttaattgttggaaatagattat

SEQ ID NO: 8138172 - DNA, 22 bp, Homo sapiens
tgttttgtgcatttacaacatg

SEQ ID NO: 8138173 - DNA, 22 bp, Homo sapiens
ttaaatgtgatttcatttatgt

SEQ ID NO: 8138174 - DNA, 22 bp, Homo sapiens
ttaaatgtcaatagattgcttg

SEQ ID NO: 8138175 - DNA, 22 bp, Homo sapiens
ttacacaaagctccccaaatag

SEQ ID NO: 8138176 - DNA, 22 bp, Homo sapiens
tgttcagaacaaaggtaaatga

SEQ ID NO: 8138177 - DNA, 20 bp, Homo sapiens
tgttcagaaatgcagagagg

SEQ ID NO: 8138178 - DNA, 22 bp, Homo sapiens
tgtgttttaaatggaaatttga

SEQ ID NO: 8138179 - DNA, 22 bp, Homo sapiens
tgttttcacaatgatgtcagat

SEQ ID NO: 8138180 - DNA, 19 bp, Homo sapiens
tgttttcaagtgggattat

SEQ ID NO: 8138181 - DNA, 22 bp, Homo sapiens
tgttttcagtcatatagcaggt

SEQ ID NO: 8138182 - DNA, 22 bp, Homo sapiens
tgttttcagatgcagggacaca

SEQ ID NO: 8138183 - DNA, 22 bp, Homo sapiens
tgtttcttgggtgctcacatca

SEQ ID NO: 8138184 - DNA, 22 bp, Homo sapiens
tgtttcatgaaacatgtttagg

SEQ ID NO: 8138185 - DNA, 22 bp, Homo sapiens
tgtttccaactgtgatcttact

SEQ ID NO: 8138186 - DNA, 20 bp, Homo sapiens
gccaacgcgctggggctgcc

SEQ ID NO: 8138187 - DNA, 22 bp, Homo sapiens
gccaacaggccttgctctgctc

SEQ ID NO: 8138188 - DNA, 22 bp, Homo sapiens
gccaaatactggaatcatagaa

SEQ ID NO: 8138189 - DNA, 22 bp, Homo sapiens
gccaaagtacctagccctctgc

SEQ ID NO: 8138190 - DNA, 22 bp, Homo sapiens
gccaaaggttggcctgtgagtt

SEQ ID NO: 8138191 - DNA, 23 bp, Homo sapiens
gccaaaggtctgttcagtggtga

SEQ ID NO: 8138192 - DNA, 22 bp, Homo sapiens
gccaaagtcctccagccatgca

SEQ ID NO: 8138193 - DNA, 22 bp, Homo sapiens
gccaaaggacctgtgggtgaca

SEQ ID NO: 8138194 - DNA, 22 bp, Homo sapiens
gccaaagcccaggagacagcca

SEQ ID NO: 8138195 - DNA, 16 bp, Homo sapiens
gccaaagggcaaagaa

SEQ ID NO: 8138196 - DNA, 17 bp, Homo sapiens
gccaaagggttccaatc

SEQ ID NO: 8138197 - DNA, 22 bp, Homo sapiens
gccaagaatgtggcatagctta

SEQ ID NO: 8138198 - DNA, 20 bp, Homo sapiens
gccaagaatatgcccgactc

SEQ ID NO: 8138199 - DNA, 22 bp, Homo sapiens
gccaagaaggtggggacatgca

SEQ ID NO: 8138200 - DNA, 22 bp, Homo sapiens
gccacagggcagatgcgcagag

SEQ ID NO: 8138201 - DNA, 22 bp, Homo sapiens
gccacagggcagatgcgcagag

SEQ ID NO: 8138202 - DNA, 22 bp, Homo sapiens
gccacagggcagatgcgcagag

SEQ ID NO: 8138203 - DNA, 22 bp, Homo sapiens
gccacagggcgagcggaggcca

SEQ ID NO: 8138204 - DNA, 22 bp, Homo sapiens
gccacagggcgagcggaggcca

SEQ ID NO: 8138205 - DNA, 22 bp, Homo sapiens
gccacagggcgagcggaggcca

SEQ ID NO: 8138206 - DNA, 22 bp, Homo sapiens
gccacagggcgagcggaggcca

SEQ ID NO: 8138207 - DNA, 22 bp, Homo sapiens
gccacagggcagatgcgcagag

SEQ ID NO: 8138208 - DNA, 22 bp, Homo sapiens
attgtctgaatccaaagctctg

SEQ ID NO: 8138209 - DNA, 22 bp, Homo sapiens
attgtcttggcattcaaattag

SEQ ID NO: 8138210 - DNA, 22 bp, Homo sapiens
attgtctttccactgagaagtt

SEQ ID NO: 8138211 - DNA, 22 bp, Homo sapiens
attgtctttccactgagaagtt

SEQ ID NO: 8138212 - DNA, 20 bp, Homo sapiens
attgtgaatactgcatatgt

SEQ ID NO: 8138213 - DNA, 22 bp, Homo sapiens
attgtctttccactgagaagtt

SEQ ID NO: 8138214 - DNA, 22 bp, Homo sapiens
attgtgaattgagagtacttct

SEQ ID NO: 8138215 - DNA, 22 bp, Homo sapiens
attgtgaatagtgccgcagtaa

SEQ ID NO: 8138216 - DNA, 22 bp, Homo sapiens
attgtgaggcagggaaaggtgg

SEQ ID NO: 8138217 - DNA, 23 bp, Homo sapiens
attgtgagattactatcacactg

SEQ ID NO: 8138218 - DNA, 22 bp, Homo sapiens
attgtgaatagtgccgcagtaa

SEQ ID NO: 8138219 - DNA, 22 bp, Homo sapiens
attgtgcaatgttttacaattt

SEQ ID NO: 8138220 - DNA, 22 bp, Homo sapiens
attgtgcaaatattatctgtag

SEQ ID NO: 8138221 - DNA, 22 bp, Homo sapiens
attgtgcaaaacctcaggcctc

SEQ ID NO: 8138222 - DNA, 22 bp, Homo sapiens
attgtgcaccaccttgtggcag

SEQ ID NO: 8138223 - DNA, 22 bp, Homo sapiens
attgtgcaatgttttacaattt

SEQ ID NO: 8138224 - DNA, 22 bp, Homo sapiens
gcattctgtgctacagccattc

SEQ ID NO: 8138225 - DNA, 17 bp, Homo sapiens
gcatcacagataacacg

SEQ ID NO: 8138226 - DNA, 17 bp, Homo sapiens
gcatcacagataacacg

SEQ ID NO: 8138227 - DNA, 22 bp, Homo sapiens
attgtataacagcatgtatttt

SEQ ID NO: 8138228 - DNA, 22 bp, Homo sapiens
gcatattttcacaagctcttgg

SEQ ID NO: 8138229 - DNA, 22 bp, Homo sapiens
gcatatgatcacgtgtgtcggt

SEQ ID NO: 8138230 - DNA, 22 bp, Homo sapiens
gcatatgatcacgtgtgtcggt

SEQ ID NO: 8138231 - DNA, 22 bp, Homo sapiens
gcatatgatcacgtgtgtcggt

SEQ ID NO: 8138232 - DNA, 22 bp, Homo sapiens
gcataggcactttcctcctcct

SEQ ID NO: 8138233 - DNA, 22 bp, Homo sapiens
gcataggccactagtgccagga

SEQ ID NO: 8138234 - DNA, 22 bp, Homo sapiens
gcatagcctcgctgtttcacaa

SEQ ID NO: 8138235 - DNA, 22 bp, Homo sapiens
gcatagtaggctgtcaaaaatg

SEQ ID NO: 8138236 - DNA, 22 bp, Homo sapiens
gcataggccactagtgccagga

SEQ ID NO: 8138237 - DNA, 22 bp, Homo sapiens
attgtcattccagtcattgtta

SEQ ID NO: 8138238 - DNA, 22 bp, Homo sapiens
attgtctatggctgctttcact

SEQ ID NO: 8138239 - DNA, 17 bp, Homo sapiens
attgtctcttcacttat

SEQ ID NO: 8138240 - DNA, 22 bp, Homo sapiens
attgtcgtcaatggacacatag

SEQ ID NO: 8138241 - DNA, 20 bp, Homo sapiens
attgtcagccttcagaggag

SEQ ID NO: 8138242 - DNA, 22 bp, Homo sapiens
attgtcagagtttgagaaagta

SEQ ID NO: 8138243 - DNA, 22 bp, Homo sapiens
attgtcatcgatgttagccagt

SEQ ID NO: 8138244 - DNA, 22 bp, Homo sapiens
attgtcatcgatgttagccagt

SEQ ID NO: 8138245 - DNA, 22 bp, Homo sapiens
attgtatttgtacaagacatgt

SEQ ID NO: 8138246 - DNA, 18 bp, Homo sapiens
attgtcagaagtcatgtg

SEQ ID NO: 8138247 - DNA, 22 bp, Homo sapiens
attgtatttgtacaagacatgt

SEQ ID NO: 8138248 - DNA, 22 bp, Homo sapiens
gcatacaaaggtttacaactga

SEQ ID NO: 8138249 - DNA, 22 bp, Homo sapiens
gcatacagagaggatgtggcat

SEQ ID NO: 8138250 - DNA, 22 bp, Homo sapiens
gcatacaaaggtttacaactga

SEQ ID NO: 8138251 - DNA, 22 bp, Homo sapiens
gcatacaaaggtttacaactga

SEQ ID NO: 8138252 - DNA, 22 bp, Homo sapiens
gcagtgttacttggtttgcaga

SEQ ID NO: 8138253 - DNA, 22 bp, Homo sapiens
gcatacattgcaccctggtagt

SEQ ID NO: 8138254 - DNA, 22 bp, Homo sapiens
gcagtgttacttggagtactaa

SEQ ID NO: 8138255 - DNA, 22 bp, Homo sapiens
gcagtgttaccttgggctggtt

SEQ ID NO: 8138256 - DNA, 22 bp, Homo sapiens
gcagtgttaaacaactgctgct

SEQ ID NO: 8138257 - DNA, 22 bp, Homo sapiens
gcagtgttacctcttcagtggg

SEQ ID NO: 8138258 - DNA, 22 bp, Homo sapiens
gcagtgttaatgcgagtgttca

SEQ ID NO: 8138259 - DNA, 22 bp, Homo sapiens
gcagtgtgtgtccccacactgg

SEQ ID NO: 8138260 - DNA, 22 bp, Homo sapiens
gcagtgtgtgtccccacactgg

SEQ ID NO: 8138261 - DNA, 22 bp, Homo sapiens
gcagtgtgtgtccccacactgg

SEQ ID NO: 8138262 - DNA, 22 bp, Homo sapiens
gcagtgtgtttctgagatatgg

SEQ ID NO: 8138263 - DNA, 22 bp, Homo sapiens
gcagtgtgtttggataacacac

SEQ ID NO: 8138264 - DNA, 23 bp, Homo sapiens
gcagtgcttggcacagctgggtc

SEQ ID NO: 8138265 - DNA, 22 bp, Homo sapiens
gcagtgcttgctcaggcttcat

SEQ ID NO: 8138266 - DNA, 21 bp, Homo sapiens
gcagtgcttcgagactgtggt

SEQ ID NO: 8138267 - DNA, 22 bp, Homo sapiens
gcagggctgggatttgagccca

SEQ ID NO: 8138268 - DNA, 22 bp, Homo sapiens
gcagggctgcagagggcactgt

SEQ ID NO: 8138269 - DNA, 22 bp, Homo sapiens
gcagtgtgacgctgttctccgt

SEQ ID NO: 8138270 - DNA, 22 bp, Homo sapiens
gcagtgtgatgcttccagccac

SEQ ID NO: 8138271 - DNA, 22 bp, Homo sapiens
gcagtgtgatgcttccagccac

SEQ ID NO: 8138272 - DNA, 22 bp, Homo sapiens
gcagtgctttagtctgtccttt

SEQ ID NO: 8138273 - DNA, 22 bp, Homo sapiens
gcagtgtgaccgagcttgcttc

SEQ ID NO: 8138274 - DNA, 20 bp, Homo sapiens
gcagtgtgtatgaatagctg

SEQ ID NO: 8138275 - DNA, 22 bp, Homo sapiens
gcagtgtggcgtggggacctaa

SEQ ID NO: 8138276 - DNA, 22 bp, Homo sapiens
gcagtgtggccccagtatcacg

SEQ ID NO: 8138277 - DNA, 22 bp, Homo sapiens
gcagtgtgtctcttggcttcct

SEQ ID NO: 8138278 - DNA, 22 bp, Homo sapiens
attgatttagctcaagacacat

SEQ ID NO: 8138279 - DNA, 22 bp, Homo sapiens
attgatttaggcttgttatgac

SEQ ID NO: 8138280 - DNA, 22 bp, Homo sapiens
attgatttaggcttgttatgac

SEQ ID NO: 8138281 - DNA, 22 bp, Homo sapiens
attgatttctgcttactcactg

SEQ ID NO: 8138282 - DNA, 22 bp, Homo sapiens
attgatttctgcttactcactg

SEQ ID NO: 8138283 - DNA, 22 bp, Homo sapiens
attgatttgaacaaagatatta

SEQ ID NO: 8138284 - DNA, 22 bp, Homo sapiens
attgatttagctcaagacacat

SEQ ID NO: 8138285 - DNA, 18 bp, Homo sapiens
attgattgggagaggatt

SEQ ID NO: 8138286 - DNA, 22 bp, Homo sapiens
attgattgggtatgtgcatgca

SEQ ID NO: 8138287 - DNA, 22 bp, Homo sapiens
attgcaaagaaatacatgctta

SEQ ID NO: 8138288 - DNA, 22 bp, Homo sapiens
gcagggctgactcagccaccct

SEQ ID NO: 8138289 - DNA, 22 bp, Homo sapiens
gcagggctgactcagccaccct

SEQ ID NO: 8138290 - DNA, 22 bp, Homo sapiens
gcagggctgactcagccaccct

SEQ ID NO: 8138291 - DNA, 22 bp, Homo sapiens
attgattttcagactatgcgag

SEQ ID NO: 8138292 - DNA, 22 bp, Homo sapiens
attgatttgtagtgcctgcact

SEQ ID NO: 8138293 - DNA, 22 bp, Homo sapiens
attgatttgaacaaagatatta

SEQ ID NO: 8138294 - DNA, 22 bp, Homo sapiens
gcagggctgcagagggcactgt

SEQ ID NO: 8138295 - DNA, 22 bp, Homo sapiens
gcagggctgcagagggcactgt

SEQ ID NO: 8138296 - DNA, 22 bp, Homo sapiens
gcagggctgcagagggcactgt

SEQ ID NO: 8138297 - DNA, 22 bp, Homo sapiens
gcagggctgcagagggcactgt

SEQ ID NO: 8138298 - DNA, 22 bp, Homo sapiens
gcagggctgggacttactggta

SEQ ID NO: 8138299 - DNA, 22 bp, Homo sapiens
gcagggctgggacttactggta

SEQ ID NO: 8138300 - DNA, 22 bp, Homo sapiens
gcagggctgggacttactggta

SEQ ID NO: 8138301 - DNA, 18 bp, Homo sapiens
gcagggctggacaagtca

SEQ ID NO: 8138302 - DNA, 18 bp, Homo sapiens
gcagggctggacaagtca

SEQ ID NO: 8138303 - DNA, 22 bp, Homo sapiens
gcagggctgggacttactggta

SEQ ID NO: 8138304 - DNA, 22 bp, Homo sapiens
gcagggctgctgaaacttgttt

SEQ ID NO: 8138305 - DNA, 22 bp, Homo sapiens
gcagggctgctgaaacttgttt

SEQ ID NO: 8138306 - DNA, 22 bp, Homo sapiens
gcagggctgctgaaacttgttt

SEQ ID NO: 8138307 - DNA, 22 bp, Homo sapiens
gcagggctgctgaaacttgttt

SEQ ID NO: 8138308 - DNA, 22 bp, Homo sapiens
gcagggctgagtcatgtgtgcc

SEQ ID NO: 8138309 - DNA, 22 bp, Homo sapiens
gcagggctgagtcatgtgtgcc

SEQ ID NO: 8138310 - DNA, 22 bp, Homo sapiens
gcagggctgagtcatgtgtgcc

SEQ ID NO: 8138311 - DNA, 22 bp, Homo sapiens
gcagggctgagtcatgtgtgcc

SEQ ID NO: 8138312 - DNA, 22 bp, Homo sapiens
gcagggctgatggcttccctca

SEQ ID NO: 8138313 - DNA, 22 bp, Homo sapiens
gcagggctgatgttattgacga

SEQ ID NO: 8138314 - DNA, 18 bp, Homo sapiens
gcagggctgcacacgcat

SEQ ID NO: 8138315 - DNA, 18 bp, Homo sapiens
gcagggctgcacacgcat

SEQ ID NO: 8138316 - DNA, 18 bp, Homo sapiens
gcagggctgcacacgcat

SEQ ID NO: 8138317 - DNA, 22 bp, Homo sapiens
gcagggctgatggcttccctca

SEQ ID NO: 8138318 - DNA, 22 bp, Homo sapiens
gcagggctgatggcttccctca

SEQ ID NO: 8138319 - DNA, 22 bp, Homo sapiens
gcagggctgatgttattgacga

SEQ ID NO: 8138320 - DNA, 22 bp, Homo sapiens
gcagggctgatgttattgacga

SEQ ID NO: 8138321 - DNA, 22 bp, Homo sapiens
attgatatattatttctaactg

SEQ ID NO: 8138322 - DNA, 17 bp, Homo sapiens
attgactcatttatcat

SEQ ID NO: 8138323 - DNA, 22 bp, Homo sapiens
attgactagagtcacagttgca

SEQ ID NO: 8138324 - DNA, 22 bp, Homo sapiens
gcaggcctttatccctgcctca

SEQ ID NO: 8138325 - DNA, 22 bp, Homo sapiens
attgatggtgcttatagtcatg

SEQ ID NO: 8138326 - DNA, 22 bp, Homo sapiens
attgatggtgatagtgctgtgg

SEQ ID NO: 8138327 - DNA, 22 bp, Homo sapiens
attgatgggtgccaatggagtg

SEQ ID NO: 8138328 - DNA, 22 bp, Homo sapiens
attgatgggaatggctaaactt

SEQ ID NO: 8138329 - DNA, 22 bp, Homo sapiens
attgatgtgtaatgaaggagtt

SEQ ID NO: 8138330 - DNA, 22 bp, Homo sapiens
attgatgttagaatctactcct

SEQ ID NO: 8138331 - DNA, 22 bp, Homo sapiens
attgatatcagtttgctgattg

SEQ ID NO: 8138332 - DNA, 22 bp, Homo sapiens
attgatatattatttctaactg

SEQ ID NO: 8138333 - DNA, 22 bp, Homo sapiens
attgatggcggcctctccatat

SEQ ID NO: 8138334 - DNA, 22 bp, Homo sapiens
attgatggagagatttccattg

SEQ ID NO: 8138335 - DNA, 22 bp, Homo sapiens
attgatggaaaacaaatgatga

SEQ ID NO: 8138336 - DNA, 22 bp, Homo sapiens
attgatccacagtttcgcttaa

SEQ ID NO: 8138337 - DNA, 22 bp, Homo sapiens
attgatgacacatgttagtttt

SEQ ID NO: 8138338 - DNA, 22 bp, Homo sapiens
gcaggcctgtcttgctcgccct

SEQ ID NO: 8138339 - DNA, 22 bp, Homo sapiens
gcaggcctgtaatgaagggaca

SEQ ID NO: 8138340 - DNA, 22 bp, Homo sapiens
gcaggcctgtaatgaagggaca

SEQ ID NO: 8138341 - DNA, 22 bp, Homo sapiens
gcaggcctgtaatgaagggaca

SEQ ID NO: 8138342 - DNA, 22 bp, Homo sapiens
gcaggcctggtttacatggtag

SEQ ID NO: 8138343 - DNA, 22 bp, Homo sapiens
gcaggcctttatccctgcctca

SEQ ID NO: 8138344 - DNA, 22 bp, Homo sapiens
gcaggccttggcaatgagcctg

SEQ ID NO: 8138345 - DNA, 22 bp, Homo sapiens
gcaggccttggcaatgagcctg

SEQ ID NO: 8138346 - DNA, 22 bp, Homo sapiens
gcaggcctgtcttgctcgccct

SEQ ID NO: 8138347 - DNA, 22 bp, Homo sapiens
gcaggcctgcccagcaggatgg

SEQ ID NO: 8138348 - DNA, 22 bp, Homo sapiens
gcaggcctgcccagcaggatgg

SEQ ID NO: 8138349 - DNA, 22 bp, Homo sapiens
gcaggcctgcccagcaggatgg

SEQ ID NO: 8138350 - DNA, 22 bp, Homo sapiens
gcaggcctggtttacatggtag

SEQ ID NO: 8138351 - DNA, 22 bp, Homo sapiens
gcaggcctgactgtagggggca

SEQ ID NO: 8138352 - DNA, 22 bp, Homo sapiens
gcaggcctgactgtagggggca

SEQ ID NO: 8138353 - DNA, 22 bp, Homo sapiens
gcaggcctgactgtagggggca

SEQ ID NO: 8138354 - DNA, 22 bp, Homo sapiens
gcaggcctgactgtagggggca

SEQ ID NO: 8138355 - DNA, 22 bp, Homo sapiens
gcaggcctgcaggtatggccgg

SEQ ID NO: 8138356 - DNA, 22 bp, Homo sapiens
gcaggcctgcaggtatggccgg

SEQ ID NO: 8138357 - DNA, 22 bp, Homo sapiens
gcaggcctgcccagcaggatgg

SEQ ID NO: 8138358 - DNA, 19 bp, Homo sapiens
attcttcagcagtgagacc

SEQ ID NO: 8138359 - DNA, 19 bp, Homo sapiens
attcttcagcagtgagacc

SEQ ID NO: 8138360 - DNA, 22 bp, Homo sapiens
attccttgtttcactgaaaagg

SEQ ID NO: 8138361 - DNA, 22 bp, Homo sapiens
attccttgtatatctacatgca

SEQ ID NO: 8138362 - DNA, 22 bp, Homo sapiens
attccttgggctgccttattat

SEQ ID NO: 8138363 - DNA, 22 bp, Homo sapiens
attccttgggaattattgaatg

SEQ ID NO: 8138364 - DNA, 22 bp, Homo sapiens
attccttggcattctggacttg

SEQ ID NO: 8138365 - DNA, 19 bp, Homo sapiens
attcttcagcagtgagacc

SEQ ID NO: 8138366 - DNA, 19 bp, Homo sapiens
attcttcagcagtgagacc

SEQ ID NO: 8138367 - DNA, 22 bp, Homo sapiens
attcttcttgagtcttggactc

SEQ ID NO: 8138368 - DNA, 19 bp, Homo sapiens
attcttggtgcaccttgta

SEQ ID NO: 8138369 - DNA, 21 bp, Homo sapiens
attcttggcttagctctctgg

SEQ ID NO: 8138370 - DNA, 22 bp, Homo sapiens
attcttggcccgtcctcacgca

SEQ ID NO: 8138371 - DNA, 22 bp, Homo sapiens
attctttagttggcttcttgcc

SEQ ID NO: 8138372 - DNA, 22 bp, Homo sapiens
attctttattgctgatggttat

SEQ ID NO: 8138373 - DNA, 22 bp, Homo sapiens
attctttcaaggaatagttatt

SEQ ID NO: 8138374 - DNA, 22 bp, Homo sapiens
attctttcaaggaatagttatt

SEQ ID NO: 8138375 - DNA, 22 bp, Homo sapiens
attctttcatataaaggctcag

SEQ ID NO: 8138376 - DNA, 22 bp, Homo sapiens
attcttgtttaatttgcatccc

SEQ ID NO: 8138377 - DNA, 22 bp, Homo sapiens
attcttgtttaatttgcatccc

SEQ ID NO: 8138378 - DNA, 22 bp, Homo sapiens
attcttgtaaattttgtgtgaa

SEQ ID NO: 8138379 - DNA, 19 bp, Homo sapiens
attcttgttaagtgtcatc

SEQ ID NO: 8138380 - DNA, 22 bp, Homo sapiens
attctttaattcaattgaagga

SEQ ID NO: 8138381 - DNA, 22 bp, Homo sapiens
gcagctgccttcagctggatgg

SEQ ID NO: 8138382 - DNA, 22 bp, Homo sapiens
gcagctgccttcagctggatgg

SEQ ID NO: 8138383 - DNA, 22 bp, Homo sapiens
gcagctgcctattcagggcttg

SEQ ID NO: 8138384 - DNA, 22 bp, Homo sapiens
gcagcgaggtgatgaaatagct

SEQ ID NO: 8138385 - DNA, 22 bp, Homo sapiens
gcagcgaggtgatgaaatagct

SEQ ID NO: 8138386 - DNA, 22 bp, Homo sapiens
gcagctgctggaagttcctgcc

SEQ ID NO: 8138387 - DNA, 22 bp, Homo sapiens
gcagctgctcccttttacagtg

SEQ ID NO: 8138388 - DNA, 22 bp, Homo sapiens
gcagctgctggaagttcctgcc

SEQ ID NO: 8138389 - DNA, 22 bp, Homo sapiens
gcagctgctggaagttcctgcc

SEQ ID NO: 8138390 - DNA, 22 bp, Homo sapiens
gcagctgctcacattctcacaa

SEQ ID NO: 8138391 - DNA, 22 bp, Homo sapiens
gcagctgcgctggtgtggggca

SEQ ID NO: 8138392 - DNA, 22 bp, Homo sapiens
gcagctgcgaagaagtctatct

SEQ ID NO: 8138393 - DNA, 22 bp, Homo sapiens
gcagctgctgggatcatttagg

SEQ ID NO: 8138394 - DNA, 22 bp, Homo sapiens
gcagctgctgtggcatcaagct

SEQ ID NO: 8138395 - DNA, 22 bp, Homo sapiens
gcagctgctggagggaggcagg

SEQ ID NO: 8138396 - DNA, 22 bp, Homo sapiens
gcagctgctggagggaggcagg

SEQ ID NO: 8138397 - DNA, 22 bp, Homo sapiens
gcagctggaagtgacactctgt

SEQ ID NO: 8138398 - DNA, 22 bp, Homo sapiens
gcagctggaagtgacactctgt

SEQ ID NO: 8138399 - DNA, 22 bp, Homo sapiens
gcagctggaagtgacactctgt

SEQ ID NO: 8138400 - DNA, 22 bp, Homo sapiens
gcagctgctgtggcatcaagct

SEQ ID NO: 8138401 - DNA, 22 bp, Homo sapiens
attccttctttgagaataagca

SEQ ID NO: 8138402 - DNA, 22 bp, Homo sapiens
attccttctttgagaataagca

SEQ ID NO: 8138403 - DNA, 22 bp, Homo sapiens
attccttgcacatcagatagtt

SEQ ID NO: 8138404 - DNA, 22 bp, Homo sapiens
gcagctggacccacacggctta

SEQ ID NO: 8138405 - DNA, 22 bp, Homo sapiens
attccttgctctcatcaacctt

SEQ ID NO: 8138406 - DNA, 22 bp, Homo sapiens
attccttggaacagatgcgaag

SEQ ID NO: 8138407 - DNA, 22 bp, Homo sapiens
attcactgtcagcttgcatggg

SEQ ID NO: 8138408 - DNA, 22 bp, Homo sapiens
attcagaaagatatgcctggtt

SEQ ID NO: 8138409 - DNA, 22 bp, Homo sapiens
attcagaaagttgtcatatttg

SEQ ID NO: 8138410 - DNA, 21 bp, Homo sapiens
attcagaaagggaataaactc

SEQ ID NO: 8138411 - DNA, 21 bp, Homo sapiens
attcagaaagggaataaactc

SEQ ID NO: 8138412 - DNA, 22 bp, Homo sapiens
attcagaaagggttgcctggtt

SEQ ID NO: 8138413 - DNA, 22 bp, Homo sapiens
attcacattgagcttcactgtg

SEQ ID NO: 8138414 - DNA, 22 bp, Homo sapiens
attcacattttatttcactgga

SEQ ID NO: 8138415 - DNA, 22 bp, Homo sapiens
attcaccaagaatgatttcagt

SEQ ID NO: 8138416 - DNA, 22 bp, Homo sapiens
gcacggctaatttttgtatttt

SEQ ID NO: 8138417 - DNA, 22 bp, Homo sapiens
gcacggctaatttttgtatttt

SEQ ID NO: 8138418 - DNA, 22 bp, Homo sapiens
gcacggctaatttttgtatttt

SEQ ID NO: 8138419 - DNA, 22 bp, Homo sapiens
gcacgtggaatgctcatgagcc

SEQ ID NO: 8138420 - DNA, 22 bp, Homo sapiens
gcactagaagtacgccttgtaa

SEQ ID NO: 8138421 - DNA, 22 bp, Homo sapiens
attcacaatgatacataagcga

SEQ ID NO: 8138422 - DNA, 22 bp, Homo sapiens
attcacaatgatacataagcga

SEQ ID NO: 8138423 - DNA, 22 bp, Homo sapiens
attcacagtttcctcatattct

SEQ ID NO: 8138424 - DNA, 22 bp, Homo sapiens
gcacggctaatttttgtatttt

SEQ ID NO: 8138425 - DNA, 22 bp, Homo sapiens
gcacggcaagacggggcctcct

SEQ ID NO: 8138426 - DNA, 22 bp, Homo sapiens
gcacctggtttatataatcata

SEQ ID NO: 8138427 - DNA, 22 bp, Homo sapiens
gcacctggggtacacagctaca

SEQ ID NO: 8138428 - DNA, 18 bp, Homo sapiens
gcaccttaccaattctac

SEQ ID NO: 8138429 - DNA, 22 bp, Homo sapiens
gcaccttggctttcttggtggc

SEQ ID NO: 8138430 - DNA, 22 bp, Homo sapiens
gcacctggggtacacagctaca

SEQ ID NO: 8138431 - DNA, 22 bp, Homo sapiens
attcaaggtttattcagtttag

SEQ ID NO: 8138432 - DNA, 22 bp, Homo sapiens
attcaaggtatttaaaacataa

SEQ ID NO: 8138433 - DNA, 22 bp, Homo sapiens
attcagttccttgtgattgtag

SEQ ID NO: 8138434 - DNA, 22 bp, Homo sapiens
gcagcagagtttgggagatggt

SEQ ID NO: 8138435 - DNA, 22 bp, Homo sapiens
gcagcagagtttgggagatggt

SEQ ID NO: 8138436 - DNA, 22 bp, Homo sapiens
gcagcagagtagacagagccct

SEQ ID NO: 8138437 - DNA, 22 bp, Homo sapiens
gcagcagagtagacagagccct

SEQ ID NO: 8138438 - DNA, 22 bp, Homo sapiens
gcagcagagtttgggagatggt

SEQ ID NO: 8138439 - DNA, 22 bp, Homo sapiens
attcatatcatagagttattga

SEQ ID NO: 8138440 - DNA, 22 bp, Homo sapiens
gcagcctttggaattagagact

SEQ ID NO: 8138441 - DNA, 22 bp, Homo sapiens
attcatcagctaatggacattt

SEQ ID NO: 8138442 - DNA, 22 bp, Homo sapiens
attcataacggcaaatgtcacc

SEQ ID NO: 8138443 - DNA, 22 bp, Homo sapiens
attcataacggcaaatgtcacc

SEQ ID NO: 8138444 - DNA, 22 bp, Homo sapiens
gcagcagagaccccaggaagga

SEQ ID NO: 8138445 - DNA, 22 bp, Homo sapiens
gcagcagagaacacaatgatgg

SEQ ID NO: 8138446 - DNA, 22 bp, Homo sapiens
gcagcagagaacacaatgatgg

SEQ ID NO: 8138447 - DNA, 20 bp, Homo sapiens
gcagcagacagacaggggac

SEQ ID NO: 8138448 - DNA, 20 bp, Homo sapiens
gcagcagacagacaggggac

SEQ ID NO: 8138449 - DNA, 21 bp, Homo sapiens
gcagcagaggcttgacagaca

SEQ ID NO: 8138450 - DNA, 21 bp, Homo sapiens
gcagcagaggcttgacagaca

SEQ ID NO: 8138451 - DNA, 22 bp, Homo sapiens
gcagcagaggccctactctttg

SEQ ID NO: 8138452 - DNA, 22 bp, Homo sapiens
gcagatgcttggcactgacagt

SEQ ID NO: 8138453 - DNA, 22 bp, Homo sapiens
gcagatggaaagtgcttgaggg

SEQ ID NO: 8138454 - DNA, 22 bp, Homo sapiens
attcagaattgtgggcagtaca

SEQ ID NO: 8138455 - DNA, 22 bp, Homo sapiens
attcagaatggcaaacttctag

SEQ ID NO: 8138456 - DNA, 22 bp, Homo sapiens
attcagaatggcaaacttctag

SEQ ID NO: 8138457 - DNA, 22 bp, Homo sapiens
attcagaagctattcttagttc

SEQ ID NO: 8138458 - DNA, 20 bp, Homo sapiens
attcagaataggcatgtaaa

SEQ ID NO: 8138459 - DNA, 22 bp, Homo sapiens
attcagaagcaatcacagtgag

SEQ ID NO: 8138460 - DNA, 22 bp, Homo sapiens
gatttctctgcacccactcagg

SEQ ID NO: 8138461 - DNA, 22 bp, Homo sapiens
gatttctcatttgtggattgaa

SEQ ID NO: 8138462 - DNA, 22 bp, Homo sapiens
gatttctcactgtggatttcct

SEQ ID NO: 8138463 - DNA, 22 bp, Homo sapiens
gatttctagtaagtcatgaagg

SEQ ID NO: 8138464 - DNA, 19 bp, Homo sapiens
gatttctacaaatgtcaga

SEQ ID NO: 8138465 - DNA, 22 bp, Homo sapiens
gatttcctaatgtggatctctg

SEQ ID NO: 8138466 - DNA, 22 bp, Homo sapiens
gatttccctatagttttctctt

SEQ ID NO: 8138467 - DNA, 22 bp, Homo sapiens
gatttcccagcaaaagctggtt

SEQ ID NO: 8138468 - DNA, 22 bp, Homo sapiens
gatttcccagaaaagtgatctc

SEQ ID NO: 8138469 - DNA, 22 bp, Homo sapiens
gatttccattttcaactcctgc

SEQ ID NO: 8138470 - DNA, 22 bp, Homo sapiens
gatttccattttcaactcctgc

SEQ ID NO: 8138471 - DNA, 22 bp, Homo sapiens
gatttccaggtcattaataaag

SEQ ID NO: 8138472 - DNA, 22 bp, Homo sapiens
gatttccaggtcattaataaag

SEQ ID NO: 8138473 - DNA, 22 bp, Homo sapiens
gatttccatgattgggccagaa

SEQ ID NO: 8138474 - DNA, 22 bp, Homo sapiens
gatttccttgcatattggtaat

SEQ ID NO: 8138475 - DNA, 22 bp, Homo sapiens
gatttccttgcatattggtaat

SEQ ID NO: 8138476 - DNA, 22 bp, Homo sapiens
gatttcctagacatggggcaga

SEQ ID NO: 8138477 - DNA, 17 bp, Homo sapiens
gatttcctgaagttctt

SEQ ID NO: 8138478 - DNA, 22 bp, Homo sapiens
gatttcctcactaacatccatc

SEQ ID NO: 8138479 - DNA, 22 bp, Homo sapiens
attagaaaaactcaagggctct

SEQ ID NO: 8138480 - DNA, 22 bp, Homo sapiens
attacttcaatttctcagtgaa

SEQ ID NO: 8138481 - DNA, 22 bp, Homo sapiens
attactttcagatgtgctgtaa

SEQ ID NO: 8138482 - DNA, 22 bp, Homo sapiens
attagaaaccaagaggcaggct

SEQ ID NO: 8138483 - DNA, 22 bp, Homo sapiens
gatttccaggtcattaataaag

SEQ ID NO: 8138484 - DNA, 22 bp, Homo sapiens
gatttccaggacgggaggtggg

SEQ ID NO: 8138485 - DNA, 22 bp, Homo sapiens
gatttcagtggctgtctcaaat

SEQ ID NO: 8138486 - DNA, 23 bp, Homo sapiens
attagaaaggctttctggtgaaa

SEQ ID NO: 8138487 - DNA, 22 bp, Homo sapiens
gatttcactggctttaagcaca

SEQ ID NO: 8138488 - DNA, 22 bp, Homo sapiens
gatttcactggctttaagcaca

SEQ ID NO: 8138489 - DNA, 22 bp, Homo sapiens
gatttcagccccgctcccagct

SEQ ID NO: 8138490 - DNA, 22 bp, Homo sapiens
gatattgtgatgatgtctttgg

SEQ ID NO: 8138491 - DNA, 22 bp, Homo sapiens
gatatttaactctcacaggtcc

SEQ ID NO: 8138492 - DNA, 22 bp, Homo sapiens
attacaatcgagagaaacaaat

SEQ ID NO: 8138493 - DNA, 22 bp, Homo sapiens
attacaatcgagagaaacaaat

SEQ ID NO: 8138494 - DNA, 22 bp, Homo sapiens
attacagtggacagctatgcac

SEQ ID NO: 8138495 - DNA, 22 bp, Homo sapiens
attacagtggacagctatgcac

SEQ ID NO: 8138496 - DNA, 22 bp, Homo sapiens
attacagtgggtaaacagaatt

SEQ ID NO: 8138497 - DNA, 22 bp, Homo sapiens
attacagtggacagctatgcac

SEQ ID NO: 8138498 - DNA, 22 bp, Homo sapiens
attacagtgggtaaacagaatt

SEQ ID NO: 8138499 - DNA, 22 bp, Homo sapiens
attacagtgggtaaacagaatt

SEQ ID NO: 8138500 - DNA, 22 bp, Homo sapiens
gatatgtattgaatgatcattt

SEQ ID NO: 8138501 - DNA, 22 bp, Homo sapiens
gatatgtattccactataaagg

SEQ ID NO: 8138502 - DNA, 22 bp, Homo sapiens
gatatgtatgaggagtatgtat

SEQ ID NO: 8138503 - DNA, 22 bp, Homo sapiens
gatatgtatgaggagtatgtat

SEQ ID NO: 8138504 - DNA, 22 bp, Homo sapiens
gatattcctgaaggacagggtt

SEQ ID NO: 8138505 - DNA, 22 bp, Homo sapiens
gatattcaagtggaattattct

SEQ ID NO: 8138506 - DNA, 22 bp, Homo sapiens
gatattctattttagccagcta

SEQ ID NO: 8138507 - DNA, 22 bp, Homo sapiens
gatattctggtgaaacctttgg

SEQ ID NO: 8138508 - DNA, 22 bp, Homo sapiens
gatattctacctgctgaccaag

SEQ ID NO: 8138509 - DNA, 22 bp, Homo sapiens
gatattctacctgctgaccaag

SEQ ID NO: 8138510 - DNA, 22 bp, Homo sapiens
gatattctatgtagaatgagct

SEQ ID NO: 8138511 - DNA, 22 bp, Homo sapiens
attacagttaatttaccttctt

SEQ ID NO: 8138512 - DNA, 22 bp, Homo sapiens
attacagtgggtaaacagaatt

SEQ ID NO: 8138513 - DNA, 23 bp, Homo sapiens
attacagttaattacaacatctt

SEQ ID NO: 8138514 - DNA, 23 bp, Homo sapiens
attacagttaattacaacatctt

SEQ ID NO: 8138515 - DNA, 22 bp, Homo sapiens
attacagttctgcaggtagttt

SEQ ID NO: 8138516 - DNA, 22 bp, Homo sapiens
attacagttctgcaggtagttt

SEQ ID NO: 8138517 - DNA, 22 bp, Homo sapiens
attacagttctacacatccttt

SEQ ID NO: 8138518 - DNA, 22 bp, Homo sapiens
attacagttaatttaccttctt

SEQ ID NO: 8138519 - DNA, 22 bp, Homo sapiens
attacagttctacacatccttt

SEQ ID NO: 8138520 - DNA, 22 bp, Homo sapiens
attacatatgttggcaacattt

SEQ ID NO: 8138521 - DNA, 22 bp, Homo sapiens
attacagttctgcaggtagttt

SEQ ID NO: 8138522 - DNA, 22 bp, Homo sapiens
attacatatgttggcaacattt

SEQ ID NO: 8138523 - DNA, 22 bp, Homo sapiens
attacctatttcattttctgtc

SEQ ID NO: 8138524 - DNA, 22 bp, Homo sapiens
attacctatttcattttctgtc

SEQ ID NO: 8138525 - DNA, 23 bp, Homo sapiens
attacatgagcaaatatagctat

SEQ ID NO: 8138526 - DNA, 22 bp, Homo sapiens
attcaaattaagttaattcagc

SEQ ID NO: 8138527 - DNA, 22 bp, Homo sapiens
attcaaattaagttaattcagc

SEQ ID NO: 8138528 - DNA, 22 bp, Homo sapiens
attcaaagtagatgaagtttca

SEQ ID NO: 8138529 - DNA, 22 bp, Homo sapiens
attcaaagtactagctattttt

SEQ ID NO: 8138530 - DNA, 22 bp, Homo sapiens
attcaaagtctagatgtagtgt

SEQ ID NO: 8138531 - DNA, 22 bp, Homo sapiens
attcaaattaagttaattcagc

SEQ ID NO: 8138532 - DNA, 22 bp, Homo sapiens
attcaacatattctgagtaaaa

SEQ ID NO: 8138533 - DNA, 22 bp, Homo sapiens
attcaactgtaaacttgttcac

SEQ ID NO: 8138534 - DNA, 22 bp, Homo sapiens
attcaagagcccatgtttcctg

SEQ ID NO: 8138535 - DNA, 22 bp, Homo sapiens
attatttctcactcacataata

SEQ ID NO: 8138536 - DNA, 22 bp, Homo sapiens
attcaaagtaataaccagaact

SEQ ID NO: 8138537 - DNA, 22 bp, Homo sapiens
attcaaagtactagctattttt

SEQ ID NO: 8138538 - DNA, 22 bp, Homo sapiens
attatttccttgctttgaggaa

SEQ ID NO: 8138539 - DNA, 22 bp, Homo sapiens
attatttccttgctttgaggaa

SEQ ID NO: 8138540 - DNA, 22 bp, Homo sapiens
attatttccttgctttgaggaa

SEQ ID NO: 8138541 - DNA, 22 bp, Homo sapiens
attagtgttgtggcttcatggc

SEQ ID NO: 8138542 - DNA, 22 bp, Homo sapiens
attagtgttgtaagaagctgcc

SEQ ID NO: 8138543 - DNA, 22 bp, Homo sapiens
attagtgtctgtgaataattct

SEQ ID NO: 8138544 - DNA, 22 bp, Homo sapiens
attagtgttgtggcttcatggc

SEQ ID NO: 8138545 - DNA, 22 bp, Homo sapiens
attagtgttcttatcttctagg

SEQ ID NO: 8138546 - DNA, 22 bp, Homo sapiens
attagtgtgtaggctggaaaaa

SEQ ID NO: 8138547 - DNA, 22 bp, Homo sapiens
attagtgtggaccctaatttaa

SEQ ID NO: 8138548 - DNA, 22 bp, Homo sapiens
attagtgttcttatcttctagg

SEQ ID NO: 8138549 - DNA, 22 bp, Homo sapiens
attagtgtctgtgaataattct

SEQ ID NO: 8138550 - DNA, 22 bp, Homo sapiens
attagtgtctgtgaataattct

SEQ ID NO: 8138551 - DNA, 20 bp, Homo sapiens
attagtgcatctggacatgc

SEQ ID NO: 8138552 - DNA, 22 bp, Homo sapiens
attagtgcccaggctgcctctt

SEQ ID NO: 8138553 - DNA, 22 bp, Homo sapiens
attagtgtcatgttgaggactt

SEQ ID NO: 8138554 - DNA, 22 bp, Homo sapiens
attagtgtacatctcacacgca

SEQ ID NO: 8138555 - DNA, 22 bp, Homo sapiens
attagtgtacatctcacacgca

SEQ ID NO: 8138556 - DNA, 22 bp, Homo sapiens
attagatacacagatttccact

SEQ ID NO: 8138557 - DNA, 22 bp, Homo sapiens
attagatacacagatttccact

SEQ ID NO: 8138558 - DNA, 20 bp, Homo sapiens
attagcttggagacagtggc

SEQ ID NO: 8138559 - DNA, 22 bp, Homo sapiens
attagcttatcccatttctgaa

SEQ ID NO: 8138560 - DNA, 22 bp, Homo sapiens
attaggcatatatgcttttaat

SEQ ID NO: 8138561 - DNA, 22 bp, Homo sapiens
attaggtatgattctcatttca

SEQ ID NO: 8138562 - DNA, 22 bp, Homo sapiens
attaggtagtataatctttgtt

SEQ ID NO: 8138563 - DNA, 22 bp, Homo sapiens
atttttccaattaggataaaga

SEQ ID NO: 8138564 - DNA, 22 bp, Homo sapiens
atttttccaattaggataaaga

SEQ ID NO: 8138565 - DNA, 22 bp, Homo sapiens
atttttccatgatacttatctg

SEQ ID NO: 8138566 - DNA, 22 bp, Homo sapiens
atttttcaactttggaaatggc

SEQ ID NO: 8138567 - DNA, 22 bp, Homo sapiens
atttttcagcttcattgaggca

SEQ ID NO: 8138568 - DNA, 22 bp, Homo sapiens
atttttcagcttcattgaggca

SEQ ID NO: 8138569 - DNA, 22 bp, Homo sapiens
atttttcagcttcattgaggca

SEQ ID NO: 8138570 - DNA, 22 bp, Homo sapiens
atttttcagcttcattgaggca

SEQ ID NO: 8138571 - DNA, 22 bp, Homo sapiens
attttgtttcctttggagtaga

SEQ ID NO: 8138572 - DNA, 22 bp, Homo sapiens
attttgtttcctttggagtaga

SEQ ID NO: 8138573 - DNA, 22 bp, Homo sapiens
atttttatgacaaaccatcctc

SEQ ID NO: 8138574 - DNA, 22 bp, Homo sapiens
atttttatgacaaaccatcctc

SEQ ID NO: 8138575 - DNA, 22 bp, Homo sapiens
atttttatgacaaaccatcctc

SEQ ID NO: 8138576 - DNA, 22 bp, Homo sapiens
attttagagctccaagtacagc

SEQ ID NO: 8138577 - DNA, 22 bp, Homo sapiens
attttagagctccaagtacagc

SEQ ID NO: 8138578 - DNA, 22 bp, Homo sapiens
attttagagctccaagtacagc

SEQ ID NO: 8138579 - DNA, 22 bp, Homo sapiens
attttagagaaacaaacgtagg

SEQ ID NO: 8138580 - DNA, 22 bp, Homo sapiens
attttagagctccaagtacagc

SEQ ID NO: 8138581 - DNA, 22 bp, Homo sapiens
attttagagctccaagtacagc

SEQ ID NO: 8138582 - DNA, 22 bp, Homo sapiens
attttagagctccaagtacagc

SEQ ID NO: 8138583 - DNA, 22 bp, Homo sapiens
attttactttgtgaatattgac

SEQ ID NO: 8138584 - DNA, 22 bp, Homo sapiens
attttactttgtgaatattgac

SEQ ID NO: 8138585 - DNA, 22 bp, Homo sapiens
attttagagaaacaaacgtagg

SEQ ID NO: 8138586 - DNA, 22 bp, Homo sapiens
attttagagaaacaaacgtagg

SEQ ID NO: 8138587 - DNA, 22 bp, Homo sapiens
attttactttgtgaatattgac

SEQ ID NO: 8138588 - DNA, 22 bp, Homo sapiens
attttacttcatttgaaatgcc

SEQ ID NO: 8138589 - DNA, 22 bp, Homo sapiens
attttacttcatttgaaatgcc

SEQ ID NO: 8138590 - DNA, 22 bp, Homo sapiens
attttacttcatttgaaatgcc

SEQ ID NO: 8138591 - DNA, 22 bp, Homo sapiens
caaaagcagttctatctgagtt

SEQ ID NO: 8138592 - DNA, 22 bp, Homo sapiens
caaaataccacgacttgtttta

SEQ ID NO: 8138593 - DNA, 22 bp, Homo sapiens
atttttgagctgtgaacatagc

SEQ ID NO: 8138594 - DNA, 22 bp, Homo sapiens
atttttgccctgcagtacataa

SEQ ID NO: 8138595 - DNA, 22 bp, Homo sapiens
attttttagaacctggcctgat

SEQ ID NO: 8138596 - DNA, 19 bp, Homo sapiens
atttttcttcctctgtgca

SEQ ID NO: 8138597 - DNA, 22 bp, Homo sapiens
atttttgagctgtgaacatagc

SEQ ID NO: 8138598 - DNA, 19 bp, Homo sapiens
atttttcttcctctgtgca

SEQ ID NO: 8138599 - DNA, 22 bp, Homo sapiens
atttttctctttccactgagat

SEQ ID NO: 8138600 - DNA, 22 bp, Homo sapiens
atttttctctttccactgagat

SEQ ID NO: 8138601 - DNA, 22 bp, Homo sapiens
atttttctctttccactgagat

SEQ ID NO: 8138602 - DNA, 22 bp, Homo sapiens
atttttctctccactccattaa

SEQ ID NO: 8138603 - DNA, 22 bp, Homo sapiens
atttttctctccactccattaa

SEQ ID NO: 8138604 - DNA, 22 bp, Homo sapiens
atttttctctccactccattaa

SEQ ID NO: 8138605 - DNA, 22 bp, Homo sapiens
atttttctctccactccattaa

SEQ ID NO: 8138606 - DNA, 22 bp, Homo sapiens
atttttctctccactccattaa

SEQ ID NO: 8138607 - DNA, 22 bp, Homo sapiens
atttttctctcacacttaccag

SEQ ID NO: 8138608 - DNA, 22 bp, Homo sapiens
atttttctctcacacttaccag

SEQ ID NO: 8138609 - DNA, 22 bp, Homo sapiens
atttttcctgggtgctttagtt

SEQ ID NO: 8138610 - DNA, 22 bp, Homo sapiens
atttttcctgggtgctttagtt

SEQ ID NO: 8138611 - DNA, 23 bp, Homo sapiens
atttttcctggaacagtcaccca

SEQ ID NO: 8138612 - DNA, 22 bp, Homo sapiens
atttttcctgggtgctttagtt

SEQ ID NO: 8138613 - DNA, 22 bp, Homo sapiens
atttttcctgctggatctgctc

SEQ ID NO: 8138614 - DNA, 23 bp, Homo sapiens
atttttcctggaacagtcaccca

SEQ ID NO: 8138615 - DNA, 23 bp, Homo sapiens
atttttcctggaacagtcaccca

SEQ ID NO: 8138616 - DNA, 18 bp, Homo sapiens
atttttcccagatggata

SEQ ID NO: 8138617 - DNA, 22 bp, Homo sapiens
atttttcctgctggatctgctc

SEQ ID NO: 8138618 - DNA, 22 bp, Homo sapiens
atttttcctgctggatctgctc

SEQ ID NO: 8138619 - DNA, 18 bp, Homo sapiens
atttttcccagatggata

SEQ ID NO: 8138620 - DNA, 18 bp, Homo sapiens
atttttcccagatggata

SEQ ID NO: 8138621 - DNA, 22 bp, Homo sapiens
atttttccatgatacttatctg

SEQ ID NO: 8138622 - DNA, 22 bp, Homo sapiens
atttttccatgatacttatctg

SEQ ID NO: 8138623 - DNA, 22 bp, Homo sapiens
atttttccattctctgttagta

SEQ ID NO: 8138624 - DNA, 22 bp, Homo sapiens
atttttccattctctgttagta

SEQ ID NO: 8138625 - DNA, 22 bp, Homo sapiens
caaaattagggagtgagctgga

SEQ ID NO: 8138626 - DNA, 22 bp, Homo sapiens
caaaattagggagtgagctgga

SEQ ID NO: 8138627 - DNA, 22 bp, Homo sapiens
caaaattagggagtgagctgga

SEQ ID NO: 8138628 - DNA, 22 bp, Homo sapiens
caaaattctgcatttctaataa

SEQ ID NO: 8138629 - DNA, 22 bp, Homo sapiens
caaaattctgcatttctaataa

SEQ ID NO: 8138630 - DNA, 22 bp, Homo sapiens
caaaattgatgaatgtatgatt

SEQ ID NO: 8138631 - DNA, 22 bp, Homo sapiens
caaaattgattgtggtgatggt

SEQ ID NO: 8138632 - DNA, 22 bp, Homo sapiens
caaacattcaagtacaagtctt

SEQ ID NO: 8138633 - DNA, 22 bp, Homo sapiens
caaaatgatgtgattttattgt

SEQ ID NO: 8138634 - DNA, 22 bp, Homo sapiens
caaaatgatgtgattttattgt

SEQ ID NO: 8138635 - DNA, 22 bp, Homo sapiens
caaaatgcatctgagaccaggc

SEQ ID NO: 8138636 - DNA, 22 bp, Homo sapiens
caaaatgatgtgattttattgt

SEQ ID NO: 8138637 - DNA, 22 bp, Homo sapiens
caaaatagatgttaacctggaa

SEQ ID NO: 8138638 - DNA, 22 bp, Homo sapiens
caaaatagatgttaacctggaa

SEQ ID NO: 8138639 - DNA, 22 bp, Homo sapiens
caaaataccacgacttgtttta

SEQ ID NO: 8138640 - DNA, 22 bp, Homo sapiens
caaaataccacgacttgtttta

SEQ ID NO: 8138641 - DNA, 22 bp, Homo sapiens
caaaatgttctggcacctttaa

SEQ ID NO: 8138642 - DNA, 22 bp, Homo sapiens
caaaatgtgagtcccacctcaa

SEQ ID NO: 8138643 - DNA, 22 bp, Homo sapiens
caaaatgtgagtcccacctcaa

SEQ ID NO: 8138644 - DNA, 22 bp, Homo sapiens
caaaattagaaatgcagctgtt

SEQ ID NO: 8138645 - DNA, 22 bp, Homo sapiens
caaaattagaaatgcagctgtt

SEQ ID NO: 8138646 - DNA, 22 bp, Homo sapiens
caaaattagaaatgcagctgtt

SEQ ID NO: 8138647 - DNA, 22 bp, Homo sapiens
caaagcagcggattgggatagt

SEQ ID NO: 8138648 - DNA, 22 bp, Homo sapiens
caaagcagcctgcagtgtggac

SEQ ID NO: 8138649 - DNA, 22 bp, Homo sapiens
caaagcagagaactgtctcatt

SEQ ID NO: 8138650 - DNA, 22 bp, Homo sapiens
caaagagttttttcatataatg

SEQ ID NO: 8138651 - DNA, 22 bp, Homo sapiens
caaacattcaagtacaagtctt

SEQ ID NO: 8138652 - DNA, 22 bp, Homo sapiens
caaacattcaagtacaagtctt

SEQ ID NO: 8138653 - DNA, 22 bp, Homo sapiens
caaacattcaagtacaagtctt

SEQ ID NO: 8138654 - DNA, 22 bp, Homo sapiens
caaagcaggcttgtcaaattgc

SEQ ID NO: 8138655 - DNA, 20 bp, Homo sapiens
caaagcagtaggataaaaat

SEQ ID NO: 8138656 - DNA, 20 bp, Homo sapiens
caaagcagtaggataaaaat

SEQ ID NO: 8138657 - DNA, 22 bp, Homo sapiens
caaagcagtgatccttaaagga

SEQ ID NO: 8138658 - DNA, 21 bp, Homo sapiens
caaagccaggcaactctctcc

SEQ ID NO: 8138659 - DNA, 22 bp, Homo sapiens
caaagccaggctttctaatgta

SEQ ID NO: 8138660 - DNA, 21 bp, Homo sapiens
caaagccaggcaactctctcc

SEQ ID NO: 8138661 - DNA, 21 bp, Homo sapiens
caaagccaggcaactctctcc

SEQ ID NO: 8138662 - DNA, 22 bp, Homo sapiens
caaagccaggctttctaatgta

SEQ ID NO: 8138663 - DNA, 22 bp, Homo sapiens
caaagccaggctttctaatgta

SEQ ID NO: 8138664 - DNA, 22 bp, Homo sapiens
caaagccatagagtagataaga

SEQ ID NO: 8138665 - DNA, 22 bp, Homo sapiens
caaagccatagagtagataaga

SEQ ID NO: 8138666 - DNA, 22 bp, Homo sapiens
caaagccatagagtagataaga

SEQ ID NO: 8138667 - DNA, 22 bp, Homo sapiens
caaagccatagagtagataaga

SEQ ID NO: 8138668 - DNA, 22 bp, Homo sapiens
caaaggaggtgataggccctct

SEQ ID NO: 8138669 - DNA, 22 bp, Homo sapiens
caaaggaggtgataggccctct

SEQ ID NO: 8138670 - DNA, 22 bp, Homo sapiens
caaatacaaatacgggcagctt

SEQ ID NO: 8138671 - DNA, 22 bp, Homo sapiens
caaatacaaatacgggcagctt

SEQ ID NO: 8138672 - DNA, 22 bp, Homo sapiens
caaataattactatcctcactt

SEQ ID NO: 8138673 - DNA, 22 bp, Homo sapiens
caaatactaaacataagatttt

SEQ ID NO: 8138674 - DNA, 22 bp, Homo sapiens
caaatactaaacataagatttt

SEQ ID NO: 8138675 - DNA, 22 bp, Homo sapiens
caaagcctctgatttcacttgt

SEQ ID NO: 8138676 - DNA, 22 bp, Homo sapiens
caaagctggaaaaggaggctgg

SEQ ID NO: 8138677 - DNA, 22 bp, Homo sapiens
caaagctggactgctcagttca

SEQ ID NO: 8138678 - DNA, 22 bp, Homo sapiens
caaatagaactcacagacaaga

SEQ ID NO: 8138679 - DNA, 22 bp, Homo sapiens
caaatagaactcacagacaaga

SEQ ID NO: 8138680 - DNA, 22 bp, Homo sapiens
caaatagaactcacagacaaga

SEQ ID NO: 8138681 - DNA, 22 bp, Homo sapiens
caaatagaaggtactcagagaa

SEQ ID NO: 8138682 - DNA, 22 bp, Homo sapiens
caaatagacaagatggcaggaa

SEQ ID NO: 8138683 - DNA, 21 bp, Homo sapiens
caaatacttagaaacttaaga

SEQ ID NO: 8138684 - DNA, 22 bp, Homo sapiens
caaatactttatatacttcaaa

SEQ ID NO: 8138685 - DNA, 22 bp, Homo sapiens
caaatactctggatgtgtttgt

SEQ ID NO: 8138686 - DNA, 22 bp, Homo sapiens
caaatactgagtttattttcaa

SEQ ID NO: 8138687 - DNA, 22 bp, Homo sapiens
caaatactgggtaagttaattt

SEQ ID NO: 8138688 - DNA, 18 bp, Homo sapiens
caaatactgttgtcttat

SEQ ID NO: 8138689 - DNA, 22 bp, Homo sapiens
gctcttggaagacaggatgtgt

SEQ ID NO: 8138690 - DNA, 18 bp, Homo sapiens
gctctggttccttcaacc

SEQ ID NO: 8138691 - DNA, 22 bp, Homo sapiens
gctctggttccagcgcgcccga

SEQ ID NO: 8138692 - DNA, 22 bp, Homo sapiens
gctctggttccagttccgcacc

SEQ ID NO: 8138693 - DNA, 22 bp, Homo sapiens
gctctggttccagcgcgcccga

SEQ ID NO: 8138694 - DNA, 22 bp, Homo sapiens
gctcttgtcaaaaattagttga

SEQ ID NO: 8138695 - DNA, 22 bp, Homo sapiens
gctcttgggggacagatggagt

SEQ ID NO: 8138696 - DNA, 22 bp, Homo sapiens
gctcttggccaagtggaagggt

SEQ ID NO: 8138697 - DNA, 22 bp, Homo sapiens
gctctttagttgatggcctgcc

SEQ ID NO: 8138698 - DNA, 22 bp, Homo sapiens
gctctttggattcctttacaaa

SEQ ID NO: 8138699 - DNA, 22 bp, Homo sapiens
gctctttgcacagctctgccct

SEQ ID NO: 8138700 - DNA, 22 bp, Homo sapiens
gctctttagtccaagccatgtc

SEQ ID NO: 8138701 - DNA, 22 bp, Homo sapiens
gctctttagcgggggccaggcc

SEQ ID NO: 8138702 - DNA, 22 bp, Homo sapiens
gctctttagtccaagccatgtc

SEQ ID NO: 8138703 - DNA, 22 bp, Homo sapiens
gctctttagcgggggccaggcc

SEQ ID NO: 8138704 - DNA, 16 bp, Homo sapiens
gctctttagagggagg

SEQ ID NO: 8138705 - DNA, 22 bp, Homo sapiens
gctctttactgtgagggtggtc

SEQ ID NO: 8138706 - DNA, 22 bp, Homo sapiens
gctctttactgtgagggtggtc

SEQ ID NO: 8138707 - DNA, 22 bp, Homo sapiens
gctctttagacatagtctgaag

SEQ ID NO: 8138708 - DNA, 22 bp, Homo sapiens
gctctttaattcattcatggat

SEQ ID NO: 8138709 - DNA, 22 bp, Homo sapiens
gctctttaattcattcatggat

SEQ ID NO: 8138710 - DNA, 22 bp, Homo sapiens
gctcttgtcaaaaattagttga

SEQ ID NO: 8138711 - DNA, 22 bp, Homo sapiens
gctcttgtcaaaaattagttga

SEQ ID NO: 8138712 - DNA, 22 bp, Homo sapiens
gctcttgtcaaaaattagttga

SEQ ID NO: 8138713 - DNA, 22 bp, Homo sapiens
gctgacagcgtttccagtgatg

SEQ ID NO: 8138714 - DNA, 22 bp, Homo sapiens
gctgacagcaaggggctgccct

SEQ ID NO: 8138715 - DNA, 22 bp, Homo sapiens
gctgacagcgtttccagtgatg

SEQ ID NO: 8138716 - DNA, 22 bp, Homo sapiens
gctgacagttgtacctgcccct

SEQ ID NO: 8138717 - DNA, 22 bp, Homo sapiens
gctgacaggctctgtgtatgct

SEQ ID NO: 8138718 - DNA, 22 bp, Homo sapiens
gctgacagttgtacctgcccct

SEQ ID NO: 8138719 - DNA, 22 bp, Homo sapiens
gctgacagttactgctgtaaca

SEQ ID NO: 8138720 - DNA, 22 bp, Homo sapiens
gctgacagttactgctgtaaca

SEQ ID NO: 8138721 - DNA, 22 bp, Homo sapiens
gctgacccctacaggttgtgtt

SEQ ID NO: 8138722 - DNA, 20 bp, Homo sapiens
gctgaccataaatcacactg

SEQ ID NO: 8138723 - DNA, 22 bp, Homo sapiens
gctgaaaaatagtgtcgtgttt

SEQ ID NO: 8138724 - DNA, 22 bp, Homo sapiens
gctctttgtattttggaatcaa

SEQ ID NO: 8138725 - DNA, 20 bp, Homo sapiens
gctctttgtaagggaatttg

SEQ ID NO: 8138726 - DNA, 22 bp, Homo sapiens
gctgaaatcccagcattcccca

SEQ ID NO: 8138727 - DNA, 22 bp, Homo sapiens
gctgaaatgaaaacacaggtcg

SEQ ID NO: 8138728 - DNA, 22 bp, Homo sapiens
gctgaaatgaaaacacaggtcg

SEQ ID NO: 8138729 - DNA, 22 bp, Homo sapiens
gctgacagagtgcctggcctca

SEQ ID NO: 8138730 - DNA, 22 bp, Homo sapiens
gctgacagagtgcctggcctca

SEQ ID NO: 8138731 - DNA, 22 bp, Homo sapiens
gctgaaatgcagatccctcact

SEQ ID NO: 8138732 - DNA, 22 bp, Homo sapiens
caaatgatacctattactaggc

SEQ ID NO: 8138733 - DNA, 22 bp, Homo sapiens
gctgactgtccgctgctcccgg

SEQ ID NO: 8138734 - DNA, 22 bp, Homo sapiens
gctgactgtccgctgctcccgg

SEQ ID NO: 8138735 - DNA, 22 bp, Homo sapiens
caaatgcatagtttataagaag

SEQ ID NO: 8138736 - DNA, 22 bp, Homo sapiens
caaatgatacctattactaggc

SEQ ID NO: 8138737 - DNA, 22 bp, Homo sapiens
gctgactgagctggcttttcgt

SEQ ID NO: 8138738 - DNA, 22 bp, Homo sapiens
gctgacctgctctcagcagaga

SEQ ID NO: 8138739 - DNA, 20 bp, Homo sapiens
gctgacccctgctgtcatgc

SEQ ID NO: 8138740 - DNA, 22 bp, Homo sapiens
gctgactggttcaggtcccgct

SEQ ID NO: 8138741 - DNA, 22 bp, Homo sapiens
gctgactgctcagggccagctg

SEQ ID NO: 8138742 - DNA, 22 bp, Homo sapiens
caaatgcatgagaaataagagg

SEQ ID NO: 8138743 - DNA, 22 bp, Homo sapiens
caaatggctggcatccttctac

SEQ ID NO: 8138744 - DNA, 22 bp, Homo sapiens
caaatggcaacaagaacactgg

SEQ ID NO: 8138745 - DNA, 22 bp, Homo sapiens
caaatggatacaggcaaacatt

SEQ ID NO: 8138746 - DNA, 22 bp, Homo sapiens
gcctgacctcttctgccctggg

SEQ ID NO: 8138747 - DNA, 22 bp, Homo sapiens
gcctgagaaggataggaagcga

SEQ ID NO: 8138748 - DNA, 22 bp, Homo sapiens
gcctgagaaggataggaagcga

SEQ ID NO: 8138749 - DNA, 22 bp, Homo sapiens
gcctgagaaggataggaagcga

SEQ ID NO: 8138750 - DNA, 22 bp, Homo sapiens
gcctgagaaggacacagcaggt

SEQ ID NO: 8138751 - DNA, 22 bp, Homo sapiens
gcctgagaaggacacagcaggt

SEQ ID NO: 8138752 - DNA, 22 bp, Homo sapiens
gcctgagaaggacacagcaggt

SEQ ID NO: 8138753 - DNA, 22 bp, Homo sapiens
gcctgagagtctccagaccttg

SEQ ID NO: 8138754 - DNA, 22 bp, Homo sapiens
gcctgagacagtgtggtccaat

SEQ ID NO: 8138755 - DNA, 22 bp, Homo sapiens
gcctgagacagtgtggtccaat

SEQ ID NO: 8138756 - DNA, 22 bp, Homo sapiens
gcctgagagaactgaccaagag

SEQ ID NO: 8138757 - DNA, 22 bp, Homo sapiens
gcctgagagttgaagttcagtg

SEQ ID NO: 8138758 - DNA, 22 bp, Homo sapiens
gcctgagatcaggagaaagcca

SEQ ID NO: 8138759 - DNA, 22 bp, Homo sapiens
gcctgagatcaggagaaagcca

SEQ ID NO: 8138760 - DNA, 22 bp, Homo sapiens
gcctgagagtctccagaccttg

SEQ ID NO: 8138761 - DNA, 22 bp, Homo sapiens
gcctgagagttgaagttcagtg

SEQ ID NO: 8138762 - DNA, 22 bp, Homo sapiens
gcctgagagttgaagttcagtg

SEQ ID NO: 8138763 - DNA, 22 bp, Homo sapiens
atttggaaggcgtttctctgta

SEQ ID NO: 8138764 - DNA, 22 bp, Homo sapiens
atttggaaggtttacaaagaga

SEQ ID NO: 8138765 - DNA, 22 bp, Homo sapiens
gcctgagattcccggagccgtg

SEQ ID NO: 8138766 - DNA, 22 bp, Homo sapiens
atttggaagcatttccaaagca

SEQ ID NO: 8138767 - DNA, 22 bp, Homo sapiens
atttggaagcttgaagattatt

SEQ ID NO: 8138768 - DNA, 22 bp, Homo sapiens
gcctggcaccacagcctttcag

SEQ ID NO: 8138769 - DNA, 22 bp, Homo sapiens
attttactactccaattaatga

SEQ ID NO: 8138770 - DNA, 22 bp, Homo sapiens
gcctggcacattgcagtggatt

SEQ ID NO: 8138771 - DNA, 22 bp, Homo sapiens
gcctggcacattgcagtggatt

SEQ ID NO: 8138772 - DNA, 22 bp, Homo sapiens
gcctggcacattgcagtggatt

SEQ ID NO: 8138773 - DNA, 22 bp, Homo sapiens
gcctggcacattgcagtggatt

SEQ ID NO: 8138774 - DNA, 22 bp, Homo sapiens
attttactactccaattaatga

SEQ ID NO: 8138775 - DNA, 22 bp, Homo sapiens
attttactactccaattaatga

SEQ ID NO: 8138776 - DNA, 22 bp, Homo sapiens
attttactactccaattaatga

SEQ ID NO: 8138777 - DNA, 22 bp, Homo sapiens
attttacttagtgtaatgtcca

SEQ ID NO: 8138778 - DNA, 22 bp, Homo sapiens
attttacttagtgtaatgtcca

SEQ ID NO: 8138779 - DNA, 22 bp, Homo sapiens
gcctggcaatggcctcaggaag

SEQ ID NO: 8138780 - DNA, 22 bp, Homo sapiens
gcctggcaatggcctcaggaag

SEQ ID NO: 8138781 - DNA, 22 bp, Homo sapiens
gcctggcacagtagggacccaa

SEQ ID NO: 8138782 - DNA, 22 bp, Homo sapiens
gcctggcacagtagggacccaa

SEQ ID NO: 8138783 - DNA, 22 bp, Homo sapiens
gcctggcacaggaattaggagg

SEQ ID NO: 8138784 - DNA, 22 bp, Homo sapiens
gcctggcacaggaattaggagg

SEQ ID NO: 8138785 - DNA, 21 bp, Homo sapiens
gcctggcaaaaaccggccctg

SEQ ID NO: 8138786 - DNA, 23 bp, Homo sapiens
gcctggcaaagcactaccgagag

SEQ ID NO: 8138787 - DNA, 23 bp, Homo sapiens
gcctggcaaagcactaccgagag

SEQ ID NO: 8138788 - DNA, 22 bp, Homo sapiens
gcctggcaaggccctgttgact

SEQ ID NO: 8138789 - DNA, 22 bp, Homo sapiens
gcctggcaatggcctcaggaag

SEQ ID NO: 8138790 - DNA, 22 bp, Homo sapiens
gcctggcaatggcctcaggaag

SEQ ID NO: 8138791 - DNA, 22 bp, Homo sapiens
gcctggcaaggccctgttgact

SEQ ID NO: 8138792 - DNA, 22 bp, Homo sapiens
gcctggcaaggccctgttgact

SEQ ID NO: 8138793 - DNA, 22 bp, Homo sapiens
gcctggagttgtggtgaagcca

SEQ ID NO: 8138794 - DNA, 22 bp, Homo sapiens
gcctggagttgtggtgaagcca

SEQ ID NO: 8138795 - DNA, 22 bp, Homo sapiens
gcctggagttgtggtgaagcca

SEQ ID NO: 8138796 - DNA, 22 bp, Homo sapiens
gcctggagttgtggtgaagcca

SEQ ID NO: 8138797 - DNA, 22 bp, Homo sapiens
gcctggagttgtggtgaagcca

SEQ ID NO: 8138798 - DNA, 21 bp, Homo sapiens
gcctggcaaaaaccggccctg

SEQ ID NO: 8138799 - DNA, 22 bp, Homo sapiens
atttggaatagctgtagaaata

SEQ ID NO: 8138800 - DNA, 22 bp, Homo sapiens
gcctggaggaatgtagctgagg

SEQ ID NO: 8138801 - DNA, 20 bp, Homo sapiens
gcctggaggcaatgggaaga

SEQ ID NO: 8138802 - DNA, 22 bp, Homo sapiens
gcctggaggaatgtagctgagg

SEQ ID NO: 8138803 - DNA, 22 bp, Homo sapiens
gcctggagttgaaactattatt

SEQ ID NO: 8138804 - DNA, 22 bp, Homo sapiens
gcctggagttgaaactattatt

SEQ ID NO: 8138805 - DNA, 22 bp, Homo sapiens
gcctggagttcagccaagtccc

SEQ ID NO: 8138806 - DNA, 22 bp, Homo sapiens
gcctcaagacatttttaattgc

SEQ ID NO: 8138807 - DNA, 19 bp, Homo sapiens
gcctcacaggtctcaggcc

SEQ ID NO: 8138808 - DNA, 22 bp, Homo sapiens
gcctcacatattcatggttact

SEQ ID NO: 8138809 - DNA, 22 bp, Homo sapiens
gcctcacatattcatggttact

SEQ ID NO: 8138810 - DNA, 19 bp, Homo sapiens
gcctcacaggtctcaggcc

SEQ ID NO: 8138811 - DNA, 22 bp, Homo sapiens
gcctagtggtgggtatgcagag

SEQ ID NO: 8138812 - DNA, 22 bp, Homo sapiens
gcctagggttggcctgagaatc

SEQ ID NO: 8138813 - DNA, 22 bp, Homo sapiens
gcctagtgcactggcagggctc

SEQ ID NO: 8138814 - DNA, 22 bp, Homo sapiens
gcctagggtgctcagggacgag

SEQ ID NO: 8138815 - DNA, 22 bp, Homo sapiens
gcctagggtgctcagggacgag

SEQ ID NO: 8138816 - DNA, 21 bp, Homo sapiens
gcctagggagatgggactgcc

SEQ ID NO: 8138817 - DNA, 21 bp, Homo sapiens
gcctagggagatgggactgcc

SEQ ID NO: 8138818 - DNA, 20 bp, Homo sapiens
gcctaggggttgggaaagca

SEQ ID NO: 8138819 - DNA, 22 bp, Homo sapiens
atttggaagaaatctgtcacag

SEQ ID NO: 8138820 - DNA, 22 bp, Homo sapiens
gcctaggagtacagaatggttt

SEQ ID NO: 8138821 - DNA, 22 bp, Homo sapiens
atttggaactgggcatgcaaac

SEQ ID NO: 8138822 - DNA, 22 bp, Homo sapiens
atttggaacttataataagttt

SEQ ID NO: 8138823 - DNA, 22 bp, Homo sapiens
atttggaacaaatattagtaaa

SEQ ID NO: 8138824 - DNA, 22 bp, Homo sapiens
gcccccagaagggccacagatt

SEQ ID NO: 8138825 - DNA, 22 bp, Homo sapiens
gcccccagaagggccacagatt

SEQ ID NO: 8138826 - DNA, 22 bp, Homo sapiens
gcccccaggcactacatgtgaa

SEQ ID NO: 8138827 - DNA, 22 bp, Homo sapiens
gcccccagctctcaagctcaaa

SEQ ID NO: 8138828 - DNA, 22 bp, Homo sapiens
gcccccgtagtagatgaggcgc

SEQ ID NO: 8138829 - DNA, 22 bp, Homo sapiens
gccccctaaaggtgtcctcatc

SEQ ID NO: 8138830 - DNA, 22 bp, Homo sapiens
atttggaaacaattatattctt

SEQ ID NO: 8138831 - DNA, 22 bp, Homo sapiens
atttggaaaatctggttataga

SEQ ID NO: 8138832 - DNA, 22 bp, Homo sapiens
atttgctgagctcaaagaaaag

SEQ ID NO: 8138833 - DNA, 22 bp, Homo sapiens
atttggaaaagtttcttcaact

SEQ ID NO: 8138834 - DNA, 22 bp, Homo sapiens
gccccctctttggagccagcca

SEQ ID NO: 8138835 - DNA, 22 bp, Homo sapiens
gccccaggttgcctgtcccagg

SEQ ID NO: 8138836 - DNA, 22 bp, Homo sapiens
atttctgttgcttataaattac

SEQ ID NO: 8138837 - DNA, 22 bp, Homo sapiens
gccccaggttgcctgtcccagg

SEQ ID NO: 8138838 - DNA, 22 bp, Homo sapiens
atttctgttgcttataaattac

SEQ ID NO: 8138839 - DNA, 22 bp, Homo sapiens
atttctgttgcttataaattac

SEQ ID NO: 8138840 - DNA, 22 bp, Homo sapiens
atttctgttgcttataaattac

SEQ ID NO: 8138841 - DNA, 22 bp, Homo sapiens
atttctgtgcagtaaatggtga

SEQ ID NO: 8138842 - DNA, 22 bp, Homo sapiens
atttctgctactgcaccctagt

SEQ ID NO: 8138843 - DNA, 22 bp, Homo sapiens
atttctgatagtaaaggtcttt

SEQ ID NO: 8138844 - DNA, 22 bp, Homo sapiens
atttctgcatctctggagatct

SEQ ID NO: 8138845 - DNA, 22 bp, Homo sapiens
atttctgctactgcaccctagt

SEQ ID NO: 8138846 - DNA, 22 bp, Homo sapiens
atttctgctctgacctgaaagt

SEQ ID NO: 8138847 - DNA, 22 bp, Homo sapiens
atttctgtagtccacattcttt

SEQ ID NO: 8138848 - DNA, 22 bp, Homo sapiens
atttctgtaacttatgaaagtt

SEQ ID NO: 8138849 - DNA, 17 bp, Homo sapiens
gcccacccttaggagct

SEQ ID NO: 8138850 - DNA, 22 bp, Homo sapiens
atttctgataaacgtaagctgc

SEQ ID NO: 8138851 - DNA, 22 bp, Homo sapiens
atttctcagttcctactgttta

SEQ ID NO: 8138852 - DNA, 22 bp, Homo sapiens
atttctcagtgtgatcaggcct

SEQ ID NO: 8138853 - DNA, 22 bp, Homo sapiens
gcccacagtgtagcaggtactc

SEQ ID NO: 8138854 - DNA, 22 bp, Homo sapiens
gcccacagtgtagcaggtactc

SEQ ID NO: 8138855 - DNA, 22 bp, Homo sapiens
gcccacagttaatgggggctct

SEQ ID NO: 8138856 - DNA, 22 bp, Homo sapiens
gcccacagttaatgggggctct

SEQ ID NO: 8138857 - DNA, 22 bp, Homo sapiens
gcccacagtgtagcaggtactc

SEQ ID NO: 8138858 - DNA, 21 bp, Homo sapiens
gcccacagtgaggaggatccc

SEQ ID NO: 8138859 - DNA, 22 bp, Homo sapiens
gcccacagtctatcagtttgcg

SEQ ID NO: 8138860 - DNA, 23 bp, Homo sapiens
gcccaccctcagcgtcctcacgg

SEQ ID NO: 8138861 - DNA, 23 bp, Homo sapiens
gcccaccctcagcgtcctcacgg

SEQ ID NO: 8138862 - DNA, 23 bp, Homo sapiens
gcccaccctcagcgtcctcacgg

SEQ ID NO: 8138863 - DNA, 17 bp, Homo sapiens
gcccacccttaggagct

SEQ ID NO: 8138864 - DNA, 22 bp, Homo sapiens
atttccattatcatgacaaatt

SEQ ID NO: 8138865 - DNA, 22 bp, Homo sapiens
atttcccaacacattagaaaat

SEQ ID NO: 8138866 - DNA, 22 bp, Homo sapiens
atttccatgtccaaaaattagt

SEQ ID NO: 8138867 - DNA, 22 bp, Homo sapiens
atttccatgtccaaaaattagt

SEQ ID NO: 8138868 - DNA, 22 bp, Homo sapiens
atttccatgtcggtattttata

SEQ ID NO: 8138869 - DNA, 22 bp, Homo sapiens
atttccagtgcactgaatagaa

SEQ ID NO: 8138870 - DNA, 22 bp, Homo sapiens
atttccatacacccatttctga

SEQ ID NO: 8138871 - DNA, 22 bp, Homo sapiens
gccaggtctgggtagcagagga

SEQ ID NO: 8138872 - DNA, 22 bp, Homo sapiens
gccaggtgagaggactgaggct

SEQ ID NO: 8138873 - DNA, 22 bp, Homo sapiens
gccaggtgagaggactgaggct

SEQ ID NO: 8138874 - DNA, 19 bp, Homo sapiens
gccaggtcttgggtccagg

SEQ ID NO: 8138875 - DNA, 22 bp, Homo sapiens
gccaggtgcacctgccctggcc

SEQ ID NO: 8138876 - DNA, 22 bp, Homo sapiens
gccaggtgcacctgccctggcc

SEQ ID NO: 8138877 - DNA, 22 bp, Homo sapiens
gccaggtgcacctgccctggcc

SEQ ID NO: 8138878 - DNA, 22 bp, Homo sapiens
gccaggtgagaggactgaggct

SEQ ID NO: 8138879 - DNA, 22 bp, Homo sapiens
gccaggtgagtgcgcgccgtcc

SEQ ID NO: 8138880 - DNA, 22 bp, Homo sapiens
gccaggtgagaggactgaggct

SEQ ID NO: 8138881 - DNA, 22 bp, Homo sapiens
gccaggtgagaggactgaggct

SEQ ID NO: 8138882 - DNA, 22 bp, Homo sapiens
gccaggtggaggttgcagtgag

SEQ ID NO: 8138883 - DNA, 22 bp, Homo sapiens
gccaggtggaggttgcagtgag

SEQ ID NO: 8138884 - DNA, 22 bp, Homo sapiens
gccaggtggaggttgcagtgag

SEQ ID NO: 8138885 - DNA, 22 bp, Homo sapiens
gccaggtggaggttgcagtgag

SEQ ID NO: 8138886 - DNA, 22 bp, Homo sapiens
gccaggtggaggttgcagtgag

SEQ ID NO: 8138887 - DNA, 22 bp, Homo sapiens
gccaggtggaggttgcagtgag

SEQ ID NO: 8138888 - DNA, 22 bp, Homo sapiens
gccaggtgctatccctgcgctg

SEQ ID NO: 8138889 - DNA, 22 bp, Homo sapiens
gccaggtgctatccctgcgctg

SEQ ID NO: 8138890 - DNA, 22 bp, Homo sapiens
gccaggtgctatccctgcgctg

SEQ ID NO: 8138891 - DNA, 22 bp, Homo sapiens
gccaggtgcatattagaagcat

SEQ ID NO: 8138892 - DNA, 22 bp, Homo sapiens
gccaggtgcatattagaagcat

SEQ ID NO: 8138893 - DNA, 22 bp, Homo sapiens
gccaggtgcatattagaagcat

SEQ ID NO: 8138894 - DNA, 22 bp, Homo sapiens
gccaggtgcatattagaagcat

SEQ ID NO: 8138895 - DNA, 22 bp, Homo sapiens
gccaggtgcatattagaagcat

SEQ ID NO: 8138896 - DNA, 22 bp, Homo sapiens
gccaggtgcatggctgagtctc

SEQ ID NO: 8138897 - DNA, 22 bp, Homo sapiens
gccaggtgcatattagaagcat

SEQ ID NO: 8138898 - DNA, 22 bp, Homo sapiens
gccaggtgcatggctgagtctc

SEQ ID NO: 8138899 - DNA, 22 bp, Homo sapiens
gccaggtggctgagcagctgca

SEQ ID NO: 8138900 - DNA, 22 bp, Homo sapiens
gccaggtggctgagcagctgca

SEQ ID NO: 8138901 - DNA, 22 bp, Homo sapiens
gccaggtggctgagcagctgca

SEQ ID NO: 8138902 - DNA, 22 bp, Homo sapiens
atttccaggagaaaggatttta

SEQ ID NO: 8138903 - DNA, 22 bp, Homo sapiens
atttccaggagaaaggatttta

SEQ ID NO: 8138904 - DNA, 22 bp, Homo sapiens
atttccagcataggcttattga

SEQ ID NO: 8138905 - DNA, 22 bp, Homo sapiens
atttccaggagaaaggatttta

SEQ ID NO: 8138906 - DNA, 22 bp, Homo sapiens
atttccaggagttgaggtctga

SEQ ID NO: 8138907 - DNA, 22 bp, Homo sapiens
atttccagtacccagaacagag

SEQ ID NO: 8138908 - DNA, 22 bp, Homo sapiens
atttccagtactattttctgct

SEQ ID NO: 8138909 - DNA, 22 bp, Homo sapiens
atttccagtacccagaacagag

SEQ ID NO: 8138910 - DNA, 22 bp, Homo sapiens
atttccagtacccagaacagag

SEQ ID NO: 8138911 - DNA, 22 bp, Homo sapiens
atttccaggctgttttgtgaat

SEQ ID NO: 8138912 - DNA, 22 bp, Homo sapiens
atttccaggctgttttgtgaat

SEQ ID NO: 8138913 - DNA, 22 bp, Homo sapiens
atttccaggtaacctgttgagt

SEQ ID NO: 8138914 - DNA, 22 bp, Homo sapiens
atttccaggtaacctgttgagt

SEQ ID NO: 8138915 - DNA, 22 bp, Homo sapiens
atttccaggctgttttgtgaat

SEQ ID NO: 8138916 - DNA, 22 bp, Homo sapiens
atttccaggagttgaggtctga

SEQ ID NO: 8138917 - DNA, 22 bp, Homo sapiens
atttccaggagttgaggtctga

SEQ ID NO: 8138918 - DNA, 22 bp, Homo sapiens
atttccaggctgttttgtgaat

SEQ ID NO: 8138919 - DNA, 22 bp, Homo sapiens
atttccaggagttgaggtctga

SEQ ID NO: 8138920 - DNA, 22 bp, Homo sapiens
atttccagtgcactgaatagaa

SEQ ID NO: 8138921 - DNA, 22 bp, Homo sapiens
atttccagtgcactgaatagaa

SEQ ID NO: 8138922 - DNA, 22 bp, Homo sapiens
atttccagtgactctcacaggt

SEQ ID NO: 8138923 - DNA, 22 bp, Homo sapiens
atttccagtcctaatgatctgg

SEQ ID NO: 8138924 - DNA, 22 bp, Homo sapiens
atttccagtgactctcacaggt

SEQ ID NO: 8138925 - DNA, 22 bp, Homo sapiens
atttccagtgactctcacaggt

SEQ ID NO: 8138926 - DNA, 22 bp, Homo sapiens
atttccagtactattttctgct

SEQ ID NO: 8138927 - DNA, 22 bp, Homo sapiens
atttccagtatgcaaatgcctc

SEQ ID NO: 8138928 - DNA, 22 bp, Homo sapiens
atttccagtatgcaaatgcctc

SEQ ID NO: 8138929 - DNA, 22 bp, Homo sapiens
atttccagtactattttctgct

SEQ ID NO: 8138930 - DNA, 22 bp, Homo sapiens
atttccagtatgcaaatgcctc

SEQ ID NO: 8138931 - DNA, 22 bp, Homo sapiens
atttccagtcctaatgatctgg

SEQ ID NO: 8138932 - DNA, 22 bp, Homo sapiens
atttccagtcctaatgatctgg

SEQ ID NO: 8138933 - DNA, 22 bp, Homo sapiens
gccaggcgggtctcaaactcct

SEQ ID NO: 8138934 - DNA, 19 bp, Homo sapiens
gccaggcctggacctgcag

SEQ ID NO: 8138935 - DNA, 22 bp, Homo sapiens
gccacaggtgggctctgggaaa

SEQ ID NO: 8138936 - DNA, 22 bp, Homo sapiens
gccacaggtggaattaagaaat

SEQ ID NO: 8138937 - DNA, 22 bp, Homo sapiens
gccacaggtactatgggagaga

SEQ ID NO: 8138938 - DNA, 22 bp, Homo sapiens
gccacaggtcggctagagggtc

SEQ ID NO: 8138939 - DNA, 22 bp, Homo sapiens
gccacaggtcggctagagggtc

SEQ ID NO: 8138940 - DNA, 22 bp, Homo sapiens
gccacaggtcggctagagggtc

SEQ ID NO: 8138941 - DNA, 22 bp, Homo sapiens
gccacaggtactatgggagaga

SEQ ID NO: 8138942 - DNA, 22 bp, Homo sapiens
gccacaggtactatgggagaga

SEQ ID NO: 8138943 - DNA, 22 bp, Homo sapiens
gccaggctggaaagaacagaca

SEQ ID NO: 8138944 - DNA, 22 bp, Homo sapiens
gccaggctggaaagaacagaca

SEQ ID NO: 8138945 - DNA, 22 bp, Homo sapiens
gccaggctggccagcaccttct

SEQ ID NO: 8138946 - DNA, 22 bp, Homo sapiens
gccaggctggcaaaaggaaacc

SEQ ID NO: 8138947 - DNA, 22 bp, Homo sapiens
gccaggctggcaaaaggaaacc

SEQ ID NO: 8138948 - DNA, 22 bp, Homo sapiens
gccaggctggccagcaccttct

SEQ ID NO: 8138949 - DNA, 22 bp, Homo sapiens
gccaggctggccagcaccttct

SEQ ID NO: 8138950 - DNA, 22 bp, Homo sapiens
gccaggctggggggagatgtct

SEQ ID NO: 8138951 - DNA, 22 bp, Homo sapiens
gccaggctggggggagatgtct

SEQ ID NO: 8138952 - DNA, 22 bp, Homo sapiens
gccaggctggggggagatgtct

SEQ ID NO: 8138953 - DNA, 22 bp, Homo sapiens
gccaggctggtcttgaactcct

SEQ ID NO: 8138954 - DNA, 22 bp, Homo sapiens
gccaggctggtcttgaactcct

SEQ ID NO: 8138955 - DNA, 22 bp, Homo sapiens
gccaggctggtgcaaggatatt

SEQ ID NO: 8138956 - DNA, 22 bp, Homo sapiens
gccaggctggtgcaaggatatt

SEQ ID NO: 8138957 - DNA, 22 bp, Homo sapiens
gccaggctggtgcaaggatatt

SEQ ID NO: 8138958 - DNA, 22 bp, Homo sapiens
gccaggctggtgcaaggatatt

SEQ ID NO: 8138959 - DNA, 22 bp, Homo sapiens
cttctttaccaagagatagagt

SEQ ID NO: 8138960 - DNA, 22 bp, Homo sapiens
cttctttactttctagaaataa

SEQ ID NO: 8138961 - DNA, 22 bp, Homo sapiens
cttctttaatgtatacaaaaga

SEQ ID NO: 8138962 - DNA, 22 bp, Homo sapiens
cttctttaatgtatacaaaaga

SEQ ID NO: 8138963 - DNA, 22 bp, Homo sapiens
cttctttaatgtatacaaaaga

SEQ ID NO: 8138964 - DNA, 22 bp, Homo sapiens
cttcttgttttagccctcatac

SEQ ID NO: 8138965 - DNA, 22 bp, Homo sapiens
cttctttaatgtatacaaaaga

SEQ ID NO: 8138966 - DNA, 22 bp, Homo sapiens
cttcttgtgctgggccagcttc

SEQ ID NO: 8138967 - DNA, 22 bp, Homo sapiens
cttcttgtcaatttgccattgt

SEQ ID NO: 8138968 - DNA, 22 bp, Homo sapiens
atctggaggcaaaggggcgtga

SEQ ID NO: 8138969 - DNA, 22 bp, Homo sapiens
atctggagatcagctggtggca

SEQ ID NO: 8138970 - DNA, 22 bp, Homo sapiens
atctggagcaagattaagagat

SEQ ID NO: 8138971 - DNA, 22 bp, Homo sapiens
atctggagcagggccacaaggc

SEQ ID NO: 8138972 - DNA, 22 bp, Homo sapiens
atctggagcttgttagatgttt

SEQ ID NO: 8138973 - DNA, 22 bp, Homo sapiens
atctggaggattctgggacttg

SEQ ID NO: 8138974 - DNA, 22 bp, Homo sapiens
ctttccaggtctaaaggcaggg

SEQ ID NO: 8138975 - DNA, 22 bp, Homo sapiens
ctttccaggtctaaaggcaggg

SEQ ID NO: 8138976 - DNA, 22 bp, Homo sapiens
ctttccagtaccaggaagcgga

SEQ ID NO: 8138977 - DNA, 22 bp, Homo sapiens
ctttccagtaccaggaagcgga

SEQ ID NO: 8138978 - DNA, 22 bp, Homo sapiens
ctttccaggctgagtttgcttg

SEQ ID NO: 8138979 - DNA, 22 bp, Homo sapiens
ctttccaggctgagtttgcttg

SEQ ID NO: 8138980 - DNA, 22 bp, Homo sapiens
ctttccaggctgagtttgcttg

SEQ ID NO: 8138981 - DNA, 22 bp, Homo sapiens
ctttccaggctgagtttgcttg

SEQ ID NO: 8138982 - DNA, 22 bp, Homo sapiens
ctttccaggaatcctcacagcc

SEQ ID NO: 8138983 - DNA, 22 bp, Homo sapiens
ctttccaggaatcctcacagcc

SEQ ID NO: 8138984 - DNA, 19 bp, Homo sapiens
ctttccagctcgagcaatt

SEQ ID NO: 8138985 - DNA, 19 bp, Homo sapiens
ctttccagctcgagcaatt

SEQ ID NO: 8138986 - DNA, 22 bp, Homo sapiens
ctttccagcatttccttgtgaa

SEQ ID NO: 8138987 - DNA, 19 bp, Homo sapiens
ctttccaggagatgctgag

SEQ ID NO: 8138988 - DNA, 19 bp, Homo sapiens
ctttccaggagatgctgag

SEQ ID NO: 8138989 - DNA, 22 bp, Homo sapiens
ctttccaggacttgcatttctg

SEQ ID NO: 8138990 - DNA, 22 bp, Homo sapiens
ctttccaggaatcctcacagcc

SEQ ID NO: 8138991 - DNA, 22 bp, Homo sapiens
ctttccaggacttgcatttctg

SEQ ID NO: 8138992 - DNA, 22 bp, Homo sapiens
ctttccaggacttgcatttctg

SEQ ID NO: 8138993 - DNA, 22 bp, Homo sapiens
atctggctcacctgggtaaata

SEQ ID NO: 8138994 - DNA, 22 bp, Homo sapiens
atctggctatttctggtcgggg

SEQ ID NO: 8138995 - DNA, 22 bp, Homo sapiens
ctttcaaagaccttggcatggg

SEQ ID NO: 8138996 - DNA, 22 bp, Homo sapiens
ctttcaagctcgcccccgctct

SEQ ID NO: 8138997 - DNA, 22 bp, Homo sapiens
ctttccagcatttccttgtgaa

SEQ ID NO: 8138998 - DNA, 22 bp, Homo sapiens
ctttcccttagccccattctat

SEQ ID NO: 8138999 - DNA, 22 bp, Homo sapiens
ctttcccttagccccattctat

SEQ ID NO: 8139000 - DNA, 22 bp, Homo sapiens
ctttccagtttctaagtacagt

SEQ ID NO: 8139001 - DNA, 22 bp, Homo sapiens
ctttcccttagccccattctat

SEQ ID NO: 8139002 - DNA, 22 bp, Homo sapiens
ctttccagtttctaagtacagt

SEQ ID NO: 8139003 - DNA, 22 bp, Homo sapiens
ctttcccttagccccattctat

SEQ ID NO: 8139004 - DNA, 22 bp, Homo sapiens
ctttcccttttgccttgcgtgg

SEQ ID NO: 8139005 - DNA, 22 bp, Homo sapiens
ctttcctagaaatatatactta

SEQ ID NO: 8139006 - DNA, 22 bp, Homo sapiens
ctttcctagtagttacagaatg

SEQ ID NO: 8139007 - DNA, 22 bp, Homo sapiens
ctttcctagatggccatctttc

SEQ ID NO: 8139008 - DNA, 22 bp, Homo sapiens
ctttcctagatggccatctttc

SEQ ID NO: 8139009 - DNA, 22 bp, Homo sapiens
atgaaaagttcgatctagaagg

SEQ ID NO: 8139010 - DNA, 22 bp, Homo sapiens
ctttctgattttaagctctaat

SEQ ID NO: 8139011 - DNA, 22 bp, Homo sapiens
ctttcttaatttttaaggacac

SEQ ID NO: 8139012 - DNA, 22 bp, Homo sapiens
ctttctggcacagccgcgggat

SEQ ID NO: 8139013 - DNA, 22 bp, Homo sapiens
ctttctcttcgaaaacctgccc

SEQ ID NO: 8139014 - DNA, 22 bp, Homo sapiens
atgaagactaatgtgaatggga

SEQ ID NO: 8139015 - DNA, 22 bp, Homo sapiens
atgaagacaggtctcatcacca

SEQ ID NO: 8139016 - DNA, 23 bp, Homo sapiens
atgaagacccgtggtgtccccac

SEQ ID NO: 8139017 - DNA, 22 bp, Homo sapiens
atgaactaagagtcattagtgt

SEQ ID NO: 8139018 - DNA, 22 bp, Homo sapiens
atgaacatttggtttggcagca

SEQ ID NO: 8139019 - DNA, 23 bp, Homo sapiens
atgaacattagtttcagatattg

SEQ ID NO: 8139020 - DNA, 22 bp, Homo sapiens
atgaacatgtgactcagacctg

SEQ ID NO: 8139021 - DNA, 22 bp, Homo sapiens
atgaacatctctgatccaagca

SEQ ID NO: 8139022 - DNA, 22 bp, Homo sapiens
atgaacatctctgatccaagca

SEQ ID NO: 8139023 - DNA, 22 bp, Homo sapiens
atgaacattaaaatggtagaat

SEQ ID NO: 8139024 - DNA, 22 bp, Homo sapiens
atgaactttctttacagttttg

SEQ ID NO: 8139025 - DNA, 22 bp, Homo sapiens
atgaactttctttacagttttg

SEQ ID NO: 8139026 - DNA, 22 bp, Homo sapiens
atgaactgcatgtattttagtg

SEQ ID NO: 8139027 - DNA, 22 bp, Homo sapiens
atgaactgcatgtattttagtg

SEQ ID NO: 8139028 - DNA, 22 bp, Homo sapiens
atgaactgagcttaattgctga

SEQ ID NO: 8139029 - DNA, 22 bp, Homo sapiens
atgaactcttgctttatttcag

SEQ ID NO: 8139030 - DNA, 22 bp, Homo sapiens
atgaactcttctggttattttt

SEQ ID NO: 8139031 - DNA, 22 bp, Homo sapiens
atgaactcatttattttcctct

SEQ ID NO: 8139032 - DNA, 22 bp, Homo sapiens
atgaacttatttctgaactttt

SEQ ID NO: 8139033 - DNA, 22 bp, Homo sapiens
atgaagacaaactgggtagaaa

SEQ ID NO: 8139034 - DNA, 20 bp, Homo sapiens
atgaagacaaatccgacttg

SEQ ID NO: 8139035 - DNA, 22 bp, Homo sapiens
atgaacatcctaggaggcattt

SEQ ID NO: 8139036 - DNA, 22 bp, Homo sapiens
atgaacatcctaggaggcattt

SEQ ID NO: 8139037 - DNA, 22 bp, Homo sapiens
atgaacatcggaaatgagactg

SEQ ID NO: 8139038 - DNA, 22 bp, Homo sapiens
atgaaattcatctgagaatgct

SEQ ID NO: 8139039 - DNA, 22 bp, Homo sapiens
atgaaattcatctgagaatgct

SEQ ID NO: 8139040 - DNA, 18 bp, Homo sapiens
atgaacactgagctgaat

SEQ ID NO: 8139041 - DNA, 22 bp, Homo sapiens
atgaacagaggaatagaattct

SEQ ID NO: 8139042 - DNA, 22 bp, Homo sapiens
atgaacagaggaatagaattct

SEQ ID NO: 8139043 - DNA, 22 bp, Homo sapiens
atgaaacagtgaattagtcaag

SEQ ID NO: 8139044 - DNA, 22 bp, Homo sapiens
atgaaacagtgtgtatagcaaa

SEQ ID NO: 8139045 - DNA, 22 bp, Homo sapiens
atgaaacagtgaattagtcaag

SEQ ID NO: 8139046 - DNA, 22 bp, Homo sapiens
atgaaacaacagacttggtcaa

SEQ ID NO: 8139047 - DNA, 22 bp, Homo sapiens
atgaaaatgtacatgtgtataa

SEQ ID NO: 8139048 - DNA, 22 bp, Homo sapiens
atgaaaatgtacatgtgtataa

SEQ ID NO: 8139049 - DNA, 22 bp, Homo sapiens
atgaaaatactgtggttgatag

SEQ ID NO: 8139050 - DNA, 22 bp, Homo sapiens
atgaaaatactgtggttgatag

SEQ ID NO: 8139051 - DNA, 22 bp, Homo sapiens
atgatgctgtttatcatatact

SEQ ID NO: 8139052 - DNA, 22 bp, Homo sapiens
atgatggaccatcccaatgtga

SEQ ID NO: 8139053 - DNA, 18 bp, Homo sapiens
atgatcttagcaaatatt

SEQ ID NO: 8139054 - DNA, 22 bp, Homo sapiens
atgatgaaatgataggtttgtt

SEQ ID NO: 8139055 - DNA, 22 bp, Homo sapiens
atgatgaaaactgaaggttagg

SEQ ID NO: 8139056 - DNA, 22 bp, Homo sapiens
atgatcatacagagccctggta

SEQ ID NO: 8139057 - DNA, 22 bp, Homo sapiens
atgatattttagtaaagtgata

SEQ ID NO: 8139058 - DNA, 22 bp, Homo sapiens
atgatcagcagttttcagtgtt

SEQ ID NO: 8139059 - DNA, 21 bp, Homo sapiens
atgatatgcttgtatttccaa

SEQ ID NO: 8139060 - DNA, 22 bp, Homo sapiens
atgatatatgtgttgagcttgc

SEQ ID NO: 8139061 - DNA, 22 bp, Homo sapiens
atgatatttgcaatgtgcttgc

SEQ ID NO: 8139062 - DNA, 22 bp, Homo sapiens
gaaatagtacagcatagttctt

SEQ ID NO: 8139063 - DNA, 22 bp, Homo sapiens
gaaatagatctctgggatgcaa

SEQ ID NO: 8139064 - DNA, 22 bp, Homo sapiens
gaaatagaggacagctggatca

SEQ ID NO: 8139065 - DNA, 19 bp, Homo sapiens
atgatacaggtgaaaattg

SEQ ID NO: 8139066 - DNA, 22 bp, Homo sapiens
gaaatagtacagcatagttctt

SEQ ID NO: 8139067 - DNA, 19 bp, Homo sapiens
atgatacaggtgaaaattg

SEQ ID NO: 8139068 - DNA, 22 bp, Homo sapiens
gaaagtcatggatgaacactac

SEQ ID NO: 8139069 - DNA, 19 bp, Homo sapiens
gaaagtcatagagcttgtc

SEQ ID NO: 8139070 - DNA, 23 bp, Homo sapiens
gaaagtcaatatggtagctttga

SEQ ID NO: 8139071 - DNA, 22 bp, Homo sapiens
gaaagtatttacattaacatct

SEQ ID NO: 8139072 - DNA, 22 bp, Homo sapiens
gaaaggtttggcttttcagtag

SEQ ID NO: 8139073 - DNA, 22 bp, Homo sapiens
gaaaggtttcatctacttttca

SEQ ID NO: 8139074 - DNA, 22 bp, Homo sapiens
gaaagtaacatttcttgaatta

SEQ ID NO: 8139075 - DNA, 22 bp, Homo sapiens
gaaagtattagcctagaagtca

SEQ ID NO: 8139076 - DNA, 22 bp, Homo sapiens
gaaagtatgccatctacctctt

SEQ ID NO: 8139077 - DNA, 19 bp, Homo sapiens
gaaagtcatagagcttgtc

SEQ ID NO: 8139078 - DNA, 22 bp, Homo sapiens
gaaatacagttgggaggaggta

SEQ ID NO: 8139079 - DNA, 22 bp, Homo sapiens
gaaatacagttgggaggaggta

SEQ ID NO: 8139080 - DNA, 22 bp, Homo sapiens
gaaatacagttgggaggaggta

SEQ ID NO: 8139081 - DNA, 22 bp, Homo sapiens
gaaatagaagctgccaatttct

SEQ ID NO: 8139082 - DNA, 22 bp, Homo sapiens
gaaatagacactttctatgaat

SEQ ID NO: 8139083 - DNA, 22 bp, Homo sapiens
gaaagcagtatttagttctgtt

SEQ ID NO: 8139084 - DNA, 22 bp, Homo sapiens
gaaaggttgtaacaagactctt

SEQ ID NO: 8139085 - DNA, 22 bp, Homo sapiens
gaaaggtttcatctacttttca

SEQ ID NO: 8139086 - DNA, 22 bp, Homo sapiens
gaaaggtttaagtaggatttgt

SEQ ID NO: 8139087 - DNA, 22 bp, Homo sapiens
gaaagcataactaatatttatt

SEQ ID NO: 8139088 - DNA, 22 bp, Homo sapiens
atgacataagtgaaaaacatca

SEQ ID NO: 8139089 - DNA, 22 bp, Homo sapiens
atgacatatgattctgaagaca

SEQ ID NO: 8139090 - DNA, 22 bp, Homo sapiens
atgacataagtgaaaaacatca

SEQ ID NO: 8139091 - DNA, 22 bp, Homo sapiens
atgacataaagctatgctaggt

SEQ ID NO: 8139092 - DNA, 22 bp, Homo sapiens
atgacagttctacacttaatct

SEQ ID NO: 8139093 - DNA, 22 bp, Homo sapiens
atgacataaagctatgctaggt

SEQ ID NO: 8139094 - DNA, 21 bp, Homo sapiens
atgacagatgctgcagatcgt

SEQ ID NO: 8139095 - DNA, 21 bp, Homo sapiens
atgacagatgctgcagatcgt

SEQ ID NO: 8139096 - DNA, 22 bp, Homo sapiens
gaaacatttgttgagtacttgc

SEQ ID NO: 8139097 - DNA, 22 bp, Homo sapiens
atgacagatgctgtggggaggt

SEQ ID NO: 8139098 - DNA, 22 bp, Homo sapiens
atgacagatgctgtggggaggt

SEQ ID NO: 8139099 - DNA, 22 bp, Homo sapiens
atgacagctctagcacacagta

SEQ ID NO: 8139100 - DNA, 22 bp, Homo sapiens
atgacaggaggcagctgggcag

SEQ ID NO: 8139101 - DNA, 22 bp, Homo sapiens
atgacagctctagcacacagta

SEQ ID NO: 8139102 - DNA, 22 bp, Homo sapiens
atgacaggtatgccttataatc

SEQ ID NO: 8139103 - DNA, 22 bp, Homo sapiens
gaaacattgtgttctacagatt

SEQ ID NO: 8139104 - DNA, 22 bp, Homo sapiens
gaaacattgtgttctacagatt

SEQ ID NO: 8139105 - DNA, 20 bp, Homo sapiens
gaaacattggcagcaactga

SEQ ID NO: 8139106 - DNA, 22 bp, Homo sapiens
gaaacattcagtcaacagtgtt

SEQ ID NO: 8139107 - DNA, 22 bp, Homo sapiens
gaaacattcatatgagaaacct

SEQ ID NO: 8139108 - DNA, 22 bp, Homo sapiens
gaaacattcatatgagaaacct

SEQ ID NO: 8139109 - DNA, 22 bp, Homo sapiens
gaaacatattaatccagtgaaa

SEQ ID NO: 8139110 - DNA, 22 bp, Homo sapiens
gaaacattcagtcaacagtgtt

SEQ ID NO: 8139111 - DNA, 22 bp, Homo sapiens
ctttctttcgaagacgtgatta

SEQ ID NO: 8139112 - DNA, 22 bp, Homo sapiens
ctttctttcgaagacgtgatta

SEQ ID NO: 8139113 - DNA, 22 bp, Homo sapiens
ctttctttcgaagacgtgatta

SEQ ID NO: 8139114 - DNA, 22 bp, Homo sapiens
ctttcttcatcaagtgccacgt

SEQ ID NO: 8139115 - DNA, 22 bp, Homo sapiens
ctttcttcatctgtaatatgga

SEQ ID NO: 8139116 - DNA, 22 bp, Homo sapiens
ctttcttctccctcaatattac

SEQ ID NO: 8139117 - DNA, 22 bp, Homo sapiens
ctttcttccatagggcccagtc

SEQ ID NO: 8139118 - DNA, 22 bp, Homo sapiens
ctttctttcgaagacgtgatta

SEQ ID NO: 8139119 - DNA, 22 bp, Homo sapiens
gaaaatgttagcttcatagtca

SEQ ID NO: 8139120 - DNA, 22 bp, Homo sapiens
gaaaatgttagcttcatagtca

SEQ ID NO: 8139121 - DNA, 22 bp, Homo sapiens
atgcacaatgttttgatttgag

SEQ ID NO: 8139122 - DNA, 22 bp, Homo sapiens
atgcacaagttatatgtatgga

SEQ ID NO: 8139123 - DNA, 22 bp, Homo sapiens
atgcacaaggtagattattatt

SEQ ID NO: 8139124 - DNA, 22 bp, Homo sapiens
gaaggctgtttctggtagtgat

SEQ ID NO: 8139125 - DNA, 22 bp, Homo sapiens
gaaggctgtggctggtctcagt

SEQ ID NO: 8139126 - DNA, 22 bp, Homo sapiens
gaaggctgtcagagaggagggc

SEQ ID NO: 8139127 - DNA, 22 bp, Homo sapiens
gaaggctgtcagagaggagggc

SEQ ID NO: 8139128 - DNA, 22 bp, Homo sapiens
gaaggctgtcagagaggagggc

SEQ ID NO: 8139129 - DNA, 22 bp, Homo sapiens
gaaggctgtcagagaggagggc

SEQ ID NO: 8139130 - DNA, 22 bp, Homo sapiens
atgcacaggaagtgtccccatt

SEQ ID NO: 8139131 - DNA, 22 bp, Homo sapiens
atgcacagctgaacactctaaa

SEQ ID NO: 8139132 - DNA, 22 bp, Homo sapiens
atgcacactgaatgcttacttt

SEQ ID NO: 8139133 - DNA, 22 bp, Homo sapiens
atgcacactgggattcaactgg

SEQ ID NO: 8139134 - DNA, 22 bp, Homo sapiens
atgcacacgtaccctacaaggc

SEQ ID NO: 8139135 - DNA, 22 bp, Homo sapiens
atgcacacgtaccctacaaggc

SEQ ID NO: 8139136 - DNA, 19 bp, Homo sapiens
atgcacacattgaagagga

SEQ ID NO: 8139137 - DNA, 22 bp, Homo sapiens
atgcacacacattatgtctgtg

SEQ ID NO: 8139138 - DNA, 22 bp, Homo sapiens
atgcacacaagcttatgtatta

SEQ ID NO: 8139139 - DNA, 22 bp, Homo sapiens
atgcacacaagcttatgtatta

SEQ ID NO: 8139140 - DNA, 22 bp, Homo sapiens
atgcacaattaggatatagctt

SEQ ID NO: 8139141 - DNA, 22 bp, Homo sapiens
gaacaaggattcccaaagaaga

SEQ ID NO: 8139142 - DNA, 22 bp, Homo sapiens
gaaggctgctgggaagtgtggt

SEQ ID NO: 8139143 - DNA, 22 bp, Homo sapiens
gaaggctggctttctgagagca

SEQ ID NO: 8139144 - DNA, 22 bp, Homo sapiens
gaaggctggaaggcaagtagga

SEQ ID NO: 8139145 - DNA, 22 bp, Homo sapiens
gaaggctggaaggcaagtagga

SEQ ID NO: 8139146 - DNA, 22 bp, Homo sapiens
gaaggctgctgggaagtgtggt

SEQ ID NO: 8139147 - DNA, 22 bp, Homo sapiens
gaaggctgctgggaagtgtggt

SEQ ID NO: 8139148 - DNA, 22 bp, Homo sapiens
gaacaactccaagggacatcat

SEQ ID NO: 8139149 - DNA, 22 bp, Homo sapiens
gaacaaattggagaaatcagga

SEQ ID NO: 8139150 - DNA, 22 bp, Homo sapiens
gaacaaattggagaaatcagga

SEQ ID NO: 8139151 - DNA, 22 bp, Homo sapiens
gaacaaattggagaaatcagga

SEQ ID NO: 8139152 - DNA, 22 bp, Homo sapiens
gaacaaattctcatcaacttgt

SEQ ID NO: 8139153 - DNA, 22 bp, Homo sapiens
gaacaaatcccttcctgtctcc

SEQ ID NO: 8139154 - DNA, 22 bp, Homo sapiens
gaacaaattctcatcaacttgt

SEQ ID NO: 8139155 - DNA, 22 bp, Homo sapiens
gaacaaattctcatcaacttgt

SEQ ID NO: 8139156 - DNA, 22 bp, Homo sapiens
gaacaaattctcatcaacttgt

SEQ ID NO: 8139157 - DNA, 22 bp, Homo sapiens
gaacaaactgggtcccaatgat

SEQ ID NO: 8139158 - DNA, 22 bp, Homo sapiens
gaataattttgatcagaaggga

SEQ ID NO: 8139159 - DNA, 22 bp, Homo sapiens
gaataattttgatcagaaggga

SEQ ID NO: 8139160 - DNA, 22 bp, Homo sapiens
gaataatattgactttgcaggc

SEQ ID NO: 8139161 - DNA, 22 bp, Homo sapiens
gaataatcatgaaattcagtga

SEQ ID NO: 8139162 - DNA, 23 bp, Homo sapiens
gaatacaaagcagatggtccagc

SEQ ID NO: 8139163 - DNA, 22 bp, Homo sapiens
gaatacaaagcagaactcatac

SEQ ID NO: 8139164 - DNA, 22 bp, Homo sapiens
gaatacaaagcagaactcatac

SEQ ID NO: 8139165 - DNA, 22 bp, Homo sapiens
atgcacaggtgctgatgcacgc

SEQ ID NO: 8139166 - DNA, 22 bp, Homo sapiens
gaagtcttcatctgatgctctg

SEQ ID NO: 8139167 - DNA, 22 bp, Homo sapiens
gaagtcttgaaacacaaactag

SEQ ID NO: 8139168 - DNA, 22 bp, Homo sapiens
gaagtcttcattctctctgaga

SEQ ID NO: 8139169 - DNA, 22 bp, Homo sapiens
gaagtcttgaagagcactgtaa

SEQ ID NO: 8139170 - DNA, 22 bp, Homo sapiens
gaagtcttggctgaaaaccctc

SEQ ID NO: 8139171 - DNA, 22 bp, Homo sapiens
gaagtcttttagcaaaacgaac

SEQ ID NO: 8139172 - DNA, 22 bp, Homo sapiens
gaagtcttttcttccacccaaa

SEQ ID NO: 8139173 - DNA, 22 bp, Homo sapiens
gaataatagcagaaattagcag

SEQ ID NO: 8139174 - DNA, 22 bp, Homo sapiens
gaataacattttttcctttaca

SEQ ID NO: 8139175 - DNA, 22 bp, Homo sapiens
gaataacattttttcctttaca

SEQ ID NO: 8139176 - DNA, 22 bp, Homo sapiens
gaatattttcagtacagatggt

SEQ ID NO: 8139177 - DNA, 22 bp, Homo sapiens
gaatattttcagtacagatggt

SEQ ID NO: 8139178 - DNA, 22 bp, Homo sapiens
gaatattttcagtacagatggt

SEQ ID NO: 8139179 - DNA, 22 bp, Homo sapiens
gaatattttcagtacagatggt

SEQ ID NO: 8139180 - DNA, 22 bp, Homo sapiens
gaatatttttaaagggactaat

SEQ ID NO: 8139181 - DNA, 22 bp, Homo sapiens
gaatatttttaaagggactaat

SEQ ID NO: 8139182 - DNA, 22 bp, Homo sapiens
gaatatttttaaagggactaat

SEQ ID NO: 8139183 - DNA, 22 bp, Homo sapiens
gaatcacactcgtaagtgagtt

SEQ ID NO: 8139184 - DNA, 22 bp, Homo sapiens
gaatcacagaggcaaattctga

SEQ ID NO: 8139185 - DNA, 22 bp, Homo sapiens
gacaataaagtgatacatggga

SEQ ID NO: 8139186 - DNA, 22 bp, Homo sapiens
gacaatatagttgaatgagcaa

SEQ ID NO: 8139187 - DNA, 22 bp, Homo sapiens
gacaatggtggatacatgtcat

SEQ ID NO: 8139188 - DNA, 22 bp, Homo sapiens
gaatcagactacaaatgacccc

SEQ ID NO: 8139189 - DNA, 22 bp, Homo sapiens
gaatcagatactgatttcagtc

SEQ ID NO: 8139190 - DNA, 22 bp, Homo sapiens
gaatcagcctgagtttgcagct

SEQ ID NO: 8139191 - DNA, 22 bp, Homo sapiens
gaatcagcctgagtttgcagct

SEQ ID NO: 8139192 - DNA, 21 bp, Homo sapiens
gacacaaagggtagtaatggt

SEQ ID NO: 8139193 - DNA, 22 bp, Homo sapiens
gacaatttctcaatatagaaac

SEQ ID NO: 8139194 - DNA, 22 bp, Homo sapiens
gacaatttctcaatatagaaac

SEQ ID NO: 8139195 - DNA, 22 bp, Homo sapiens
gacaattaggttaagagcaaga

SEQ ID NO: 8139196 - DNA, 22 bp, Homo sapiens
gacaattgcttttgccgaataa

SEQ ID NO: 8139197 - DNA, 22 bp, Homo sapiens
gacaatttctcaatatagaaac

SEQ ID NO: 8139198 - DNA, 19 bp, Homo sapiens
gacaattagagatcactca

SEQ ID NO: 8139199 - DNA, 22 bp, Homo sapiens
gacaattagatcattcctttga

SEQ ID NO: 8139200 - DNA, 22 bp, Homo sapiens
gacaatgtgcaattgcagctag

SEQ ID NO: 8139201 - DNA, 19 bp, Homo sapiens
gacaattagagatcactca

SEQ ID NO: 8139202 - DNA, 22 bp, Homo sapiens
gacacaaagtttgtcagaaatt

SEQ ID NO: 8139203 - DNA, 21 bp, Homo sapiens
gacacaaagggtagtaatggt

SEQ ID NO: 8139204 - DNA, 22 bp, Homo sapiens
gacacaaagtttgtcagaaatt

SEQ ID NO: 8139205 - DNA, 22 bp, Homo sapiens
gacacagtttttctcacggtgg

SEQ ID NO: 8139206 - DNA, 18 bp, Homo sapiens
gacacatccccaggcctc

SEQ ID NO: 8139207 - DNA, 22 bp, Homo sapiens
gacacatgaccataaatgctaa

SEQ ID NO: 8139208 - DNA, 16 bp, Homo sapiens
gacacatgggggaaaa

SEQ ID NO: 8139209 - DNA, 23 bp, Homo sapiens
gacacctttgccagatcaagatg

SEQ ID NO: 8139210 - DNA, 22 bp, Homo sapiens
gacaccagcaaggctgtgagga

SEQ ID NO: 8139211 - DNA, 22 bp, Homo sapiens
gacaccagcaaggctgtgagga

SEQ ID NO: 8139212 - DNA, 18 bp, Homo sapiens
gacaccagcctctgcccc

SEQ ID NO: 8139213 - DNA, 22 bp, Homo sapiens
gacatacaagctggtacctcct

SEQ ID NO: 8139214 - DNA, 22 bp, Homo sapiens
gacatttatgaaggagatatgc

SEQ ID NO: 8139215 - DNA, 22 bp, Homo sapiens
gacatttatgaaggagatatgc

SEQ ID NO: 8139216 - DNA, 22 bp, Homo sapiens
gacataaatgaagtttgactat

SEQ ID NO: 8139217 - DNA, 22 bp, Homo sapiens
gacactcagtaggacttcaagg

SEQ ID NO: 8139218 - DNA, 22 bp, Homo sapiens
gacactctcctccagtggatag

SEQ ID NO: 8139219 - DNA, 22 bp, Homo sapiens
gacatttattagaaaactatca

SEQ ID NO: 8139220 - DNA, 22 bp, Homo sapiens
gacatttattagaaaactatca

SEQ ID NO: 8139221 - DNA, 22 bp, Homo sapiens
gacatttattagaaaactatca

SEQ ID NO: 8139222 - DNA, 22 bp, Homo sapiens
gacatttattagaaaactatca

SEQ ID NO: 8139223 - DNA, 22 bp, Homo sapiens
gacatttctagcccataaaact

SEQ ID NO: 8139224 - DNA, 22 bp, Homo sapiens
gacatttctagcccataaaact

SEQ ID NO: 8139225 - DNA, 22 bp, Homo sapiens
gacatttctagcccataaaact

SEQ ID NO: 8139226 - DNA, 22 bp, Homo sapiens
gacatttattggattttacgag

SEQ ID NO: 8139227 - DNA, 22 bp, Homo sapiens
gacatttattggattttacgag

SEQ ID NO: 8139228 - DNA, 22 bp, Homo sapiens
gaccaaggccaggccagggcgt

SEQ ID NO: 8139229 - DNA, 22 bp, Homo sapiens
gaccacacgtcccagagagccc

SEQ ID NO: 8139230 - DNA, 22 bp, Homo sapiens
gacatttgttcctctaagtgac

SEQ ID NO: 8139231 - DNA, 22 bp, Homo sapiens
gacatttgtatcttaggggaaa

SEQ ID NO: 8139232 - DNA, 22 bp, Homo sapiens
gacatttgttaaagcacttagc

SEQ ID NO: 8139233 - DNA, 22 bp, Homo sapiens
gaccaagatacagcatcataga

SEQ ID NO: 8139234 - DNA, 22 bp, Homo sapiens
gaccaagatacagcatcataga

SEQ ID NO: 8139235 - DNA, 22 bp, Homo sapiens
gaccacagactggaaagagggc

SEQ ID NO: 8139236 - DNA, 22 bp, Homo sapiens
gaccacagagcacggcctgctt

SEQ ID NO: 8139237 - DNA, 22 bp, Homo sapiens
gaccacagactggaaagagggc

SEQ ID NO: 8139238 - DNA, 22 bp, Homo sapiens
gaccacagaggtgtgggagaga

SEQ ID NO: 8139239 - DNA, 22 bp, Homo sapiens
gaccacagaggtgtgggagaga

SEQ ID NO: 8139240 - DNA, 22 bp, Homo sapiens
gaccacagattcctaagtggca

SEQ ID NO: 8139241 - DNA, 22 bp, Homo sapiens
atgctattccagaatgtaaatt

SEQ ID NO: 8139242 - DNA, 22 bp, Homo sapiens
atgctccaccttttgcaggaac

SEQ ID NO: 8139243 - DNA, 22 bp, Homo sapiens
atgctcagtagctggctgaccc

SEQ ID NO: 8139244 - DNA, 22 bp, Homo sapiens
atgctccagtgtgatgcttcat

SEQ ID NO: 8139245 - DNA, 17 bp, Homo sapiens
atgctccattcagaagc

SEQ ID NO: 8139246 - DNA, 18 bp, Homo sapiens
atgctcctatctctgagc

SEQ ID NO: 8139247 - DNA, 22 bp, Homo sapiens
atgctcctcgagtgtctcacag

SEQ ID NO: 8139248 - DNA, 18 bp, Homo sapiens
atgctcctatctctgagc

SEQ ID NO: 8139249 - DNA, 20 bp, Homo sapiens
atgctcgtcccactaagctc

SEQ ID NO: 8139250 - DNA, 22 bp, Homo sapiens
atgctatttaccacacatcatt

SEQ ID NO: 8139251 - DNA, 22 bp, Homo sapiens
atgctatttaccacacatcatt

SEQ ID NO: 8139252 - DNA, 22 bp, Homo sapiens
atgctcaggttttgcccaagac

SEQ ID NO: 8139253 - DNA, 22 bp, Homo sapiens
atgctcacttcagagaagatga

SEQ ID NO: 8139254 - DNA, 22 bp, Homo sapiens
gaccttgtgatctgcctgcctt

SEQ ID NO: 8139255 - DNA, 22 bp, Homo sapiens
gaccttgtgatctgcccacctt

SEQ ID NO: 8139256 - DNA, 22 bp, Homo sapiens
gacctttaatgtttctaccact

SEQ ID NO: 8139257 - DNA, 22 bp, Homo sapiens
gaccttgtgatccacctgcctt

SEQ ID NO: 8139258 - DNA, 22 bp, Homo sapiens
gaccttgtgatccccctgcctt

SEQ ID NO: 8139259 - DNA, 22 bp, Homo sapiens
gaccttgtgatccgcccgcctt

SEQ ID NO: 8139260 - DNA, 22 bp, Homo sapiens
gaccctggagccgtctgaggca

SEQ ID NO: 8139261 - DNA, 22 bp, Homo sapiens
gaccctggcaggtagcctcaca

SEQ ID NO: 8139262 - DNA, 22 bp, Homo sapiens
gaccctggagttagtcctgtgt

SEQ ID NO: 8139263 - DNA, 22 bp, Homo sapiens
gactggcctggagatgcagctg

SEQ ID NO: 8139264 - DNA, 22 bp, Homo sapiens
gactggcctggggctgggcaca

SEQ ID NO: 8139265 - DNA, 22 bp, Homo sapiens
gactgggccaaggtcagcagct

SEQ ID NO: 8139266 - DNA, 22 bp, Homo sapiens
gactgggcagccggtagggaag

SEQ ID NO: 8139267 - DNA, 22 bp, Homo sapiens
gactgggagggttcagctgggt

SEQ ID NO: 8139268 - DNA, 22 bp, Homo sapiens
gactggagtgcctccaggaaag

SEQ ID NO: 8139269 - DNA, 22 bp, Homo sapiens
gactggagtcaatgagcagcac

SEQ ID NO: 8139270 - DNA, 22 bp, Homo sapiens
gactggagcccccaaggacacc

SEQ ID NO: 8139271 - DNA, 22 bp, Homo sapiens
gactggagtcaatgagcagcac

SEQ ID NO: 8139272 - DNA, 21 bp, Homo sapiens
gactggagagaggaagtctgg

SEQ ID NO: 8139273 - DNA, 22 bp, Homo sapiens
gacgggtgtccctatgtccatt

SEQ ID NO: 8139274 - DNA, 22 bp, Homo sapiens
gacgggtgtatgctcccagcca

SEQ ID NO: 8139275 - DNA, 22 bp, Homo sapiens
gactaaattcctgttcgcgatg

SEQ ID NO: 8139276 - DNA, 22 bp, Homo sapiens
gactaaatcagacttttccaaa

SEQ ID NO: 8139277 - DNA, 22 bp, Homo sapiens
gacggggcagccagctggtggc

SEQ ID NO: 8139278 - DNA, 22 bp, Homo sapiens
gactaaataaaagccaaacttc

SEQ ID NO: 8139279 - DNA, 22 bp, Homo sapiens
gactggaaagcctgtcctcaga

SEQ ID NO: 8139280 - DNA, 19 bp, Homo sapiens
gactacagggggaagaagt

SEQ ID NO: 8139281 - DNA, 22 bp, Homo sapiens
gactggaaagcctgtcctcaga

SEQ ID NO: 8139282 - DNA, 22 bp, Homo sapiens
gactacaacaataagaacagct

SEQ ID NO: 8139283 - DNA, 22 bp, Homo sapiens
gactacaggccggcatcagaga

SEQ ID NO: 8139284 - DNA, 22 bp, Homo sapiens
gactacagatagccaattaagt

SEQ ID NO: 8139285 - DNA, 22 bp, Homo sapiens
gacggagctggttgctgcggct

SEQ ID NO: 8139286 - DNA, 22 bp, Homo sapiens
gacggggcagccagctggtggc

SEQ ID NO: 8139287 - DNA, 22 bp, Homo sapiens
gacctttttactgtgtacgctg

SEQ ID NO: 8139288 - DNA, 22 bp, Homo sapiens
gacgcatcaggaggcgaggagc

SEQ ID NO: 8139289 - DNA, 22 bp, Homo sapiens
atgtttaaggaactggtttgct

SEQ ID NO: 8139290 - DNA, 22 bp, Homo sapiens
atgtttaaggaactggtttgct

SEQ ID NO: 8139291 - DNA, 22 bp, Homo sapiens
atgtttaagaaagtcttccata

SEQ ID NO: 8139292 - DNA, 22 bp, Homo sapiens
gataatgatgacaatgacaacc

SEQ ID NO: 8139293 - DNA, 22 bp, Homo sapiens
atgtttaatcggctgcctttcc

SEQ ID NO: 8139294 - DNA, 21 bp, Homo sapiens
atgttggaatccaaaaacatt

SEQ ID NO: 8139295 - DNA, 22 bp, Homo sapiens
atgttggagtcgtaaggcatgg

SEQ ID NO: 8139296 - DNA, 22 bp, Homo sapiens
atgttgtagcatatgaaatata

SEQ ID NO: 8139297 - DNA, 22 bp, Homo sapiens
atgttgtattatgttattgtct

SEQ ID NO: 8139298 - DNA, 22 bp, Homo sapiens
atgttgtaggtctcatggtaca

SEQ ID NO: 8139299 - DNA, 22 bp, Homo sapiens
atgttgtgtttgactgttaccc

SEQ ID NO: 8139300 - DNA, 22 bp, Homo sapiens
atgttgttgaactctttgcatg

SEQ ID NO: 8139301 - DNA, 22 bp, Homo sapiens
atgttgttccctctacacaggt

SEQ ID NO: 8139302 - DNA, 22 bp, Homo sapiens
atgttgttaaatgggtgtattt

SEQ ID NO: 8139303 - DNA, 20 bp, Homo sapiens
atgttgtttactcatagcat

SEQ ID NO: 8139304 - DNA, 22 bp, Homo sapiens
atgttgtttttgtcccagaagg

SEQ ID NO: 8139305 - DNA, 22 bp, Homo sapiens
atgttgttttttcataaagtat

SEQ ID NO: 8139306 - DNA, 22 bp, Homo sapiens
atgttgttttttcataaagtat

SEQ ID NO: 8139307 - DNA, 22 bp, Homo sapiens
gatatcattgagcccaggagtt

SEQ ID NO: 8139308 - DNA, 22 bp, Homo sapiens
gatatgaagtggcattgtgaag

SEQ ID NO: 8139309 - DNA, 18 bp, Homo sapiens
gatatggaaggccatgcc

SEQ ID NO: 8139310 - DNA, 22 bp, Homo sapiens
gatatgaagtggcattgtgaag

SEQ ID NO: 8139311 - DNA, 22 bp, Homo sapiens
gatatgcacattcaaaaattgc

SEQ ID NO: 8139312 - DNA, 18 bp, Homo sapiens
gatatggaaggccatgcc

SEQ ID NO: 8139313 - DNA, 18 bp, Homo sapiens
gatatggaaggccatgcc

SEQ ID NO: 8139314 - DNA, 22 bp, Homo sapiens
gatatgtaccacctcttaaaag

SEQ ID NO: 8139315 - DNA, 22 bp, Homo sapiens
gatatgtaccacctcttaaaag

SEQ ID NO: 8139316 - DNA, 22 bp, Homo sapiens
gatacacaaaagtctagtgagg

SEQ ID NO: 8139317 - DNA, 22 bp, Homo sapiens
gatacaaattcatgtctgaatt

SEQ ID NO: 8139318 - DNA, 22 bp, Homo sapiens
gatatatttggaccagagcatt

SEQ ID NO: 8139319 - DNA, 22 bp, Homo sapiens
gatacacaagtggaaggagacg

SEQ ID NO: 8139320 - DNA, 22 bp, Homo sapiens
gatatattttccatggtctgca

SEQ ID NO: 8139321 - DNA, 22 bp, Homo sapiens
gatatattttccatggtctgca

SEQ ID NO: 8139322 - DNA, 22 bp, Homo sapiens
gataattttagtctgaaaattg

SEQ ID NO: 8139323 - DNA, 22 bp, Homo sapiens
gatacaaattcatgtctgaatt

SEQ ID NO: 8139324 - DNA, 22 bp, Homo sapiens
gatacaaaatataaatggagag

SEQ ID NO: 8139325 - DNA, 22 bp, Homo sapiens
gatacaaaatataaatggagag

SEQ ID NO: 8139326 - DNA, 22 bp, Homo sapiens
gataatttctccatctcaaggt

SEQ ID NO: 8139327 - DNA, 22 bp, Homo sapiens
gataattataggctaagccact

SEQ ID NO: 8139328 - DNA, 22 bp, Homo sapiens
gataattataggctaagccact

SEQ ID NO: 8139329 - DNA, 22 bp, Homo sapiens
gataatgtggatttattgtgat

SEQ ID NO: 8139330 - DNA, 22 bp, Homo sapiens
gataatgtggatttattgtgat

SEQ ID NO: 8139331 - DNA, 22 bp, Homo sapiens
gataatggggaatgataagtca

SEQ ID NO: 8139332 - DNA, 22 bp, Homo sapiens
gataatgtgccgataatttcta

SEQ ID NO: 8139333 - DNA, 22 bp, Homo sapiens
atgttcttctatctttattaaa

SEQ ID NO: 8139334 - DNA, 22 bp, Homo sapiens
atgttcttccaaatctgtaaca

SEQ ID NO: 8139335 - DNA, 22 bp, Homo sapiens
atgttcttagcaaagtacttgc

SEQ ID NO: 8139336 - DNA, 22 bp, Homo sapiens
atgttctttgtgattctgagct

SEQ ID NO: 8139337 - DNA, 22 bp, Homo sapiens
atgttgaactaggatctcttga

SEQ ID NO: 8139338 - DNA, 22 bp, Homo sapiens
atgttctttcagccagtgcatc

SEQ ID NO: 8139339 - DNA, 22 bp, Homo sapiens
atgttcttgttcaaatgtcagt

SEQ ID NO: 8139340 - DNA, 22 bp, Homo sapiens
atgtgtctggcatggctctatt

SEQ ID NO: 8139341 - DNA, 22 bp, Homo sapiens
atgtgtctggcatggctctatt

SEQ ID NO: 8139342 - DNA, 22 bp, Homo sapiens
atgtgtctgtgggcacacacac

SEQ ID NO: 8139343 - DNA, 20 bp, Homo sapiens
atgtgtcttagagcatcagg

SEQ ID NO: 8139344 - DNA, 20 bp, Homo sapiens
atgtgtcttagagcatcagg

SEQ ID NO: 8139345 - DNA, 22 bp, Homo sapiens
atgttattttggaaaatacaaa

SEQ ID NO: 8139346 - DNA, 22 bp, Homo sapiens
gaggtggcagaggcctggacct

SEQ ID NO: 8139347 - DNA, 22 bp, Homo sapiens
gaggtggcagaggcctggacct

SEQ ID NO: 8139348 - DNA, 22 bp, Homo sapiens
gaggtggcattaagattctggt

SEQ ID NO: 8139349 - DNA, 22 bp, Homo sapiens
gaggtggcactgtgaggagcac

SEQ ID NO: 8139350 - DNA, 22 bp, Homo sapiens
gaggtggcactgtgaggagcac

SEQ ID NO: 8139351 - DNA, 22 bp, Homo sapiens
gaggtggcactgtgaggagcac

SEQ ID NO: 8139352 - DNA, 22 bp, Homo sapiens
gaggtggcaatttaatgcagtc

SEQ ID NO: 8139353 - DNA, 22 bp, Homo sapiens
gaggtggcaatttaatgcagtc

SEQ ID NO: 8139354 - DNA, 22 bp, Homo sapiens
gaggtggcactgtgaggagcac

SEQ ID NO: 8139355 - DNA, 22 bp, Homo sapiens
gaggtggcactgtgaggagcac

SEQ ID NO: 8139356 - DNA, 22 bp, Homo sapiens
gaggtggcactgtgaggagcac

SEQ ID NO: 8139357 - DNA, 22 bp, Homo sapiens
gaggtggccagagtcaagagcc

SEQ ID NO: 8139358 - DNA, 22 bp, Homo sapiens
gaggtggccagagtcaagagcc

SEQ ID NO: 8139359 - DNA, 22 bp, Homo sapiens
gaggtggccagagtcaagagcc

SEQ ID NO: 8139360 - DNA, 22 bp, Homo sapiens
gaggtggccaagcgaggaaggg

SEQ ID NO: 8139361 - DNA, 22 bp, Homo sapiens
gaggtggccaagcgaggaaggg

SEQ ID NO: 8139362 - DNA, 22 bp, Homo sapiens
gaggtggccaagcgaggaaggg

SEQ ID NO: 8139363 - DNA, 22 bp, Homo sapiens
gaggtggccaagcgaggaaggg

SEQ ID NO: 8139364 - DNA, 22 bp, Homo sapiens
gaggtggcctcaagcagtcttc

SEQ ID NO: 8139365 - DNA, 22 bp, Homo sapiens
gaggtggcctcaagcagtcttc

SEQ ID NO: 8139366 - DNA, 22 bp, Homo sapiens
gaggtggcccttgctcagcctt

SEQ ID NO: 8139367 - DNA, 22 bp, Homo sapiens
gaggtggcccttgctcagcctt

SEQ ID NO: 8139368 - DNA, 22 bp, Homo sapiens
gaggtggcccttgctcagcctt

SEQ ID NO: 8139369 - DNA, 22 bp, Homo sapiens
gaggtggcctcaagcagtcttc

SEQ ID NO: 8139370 - DNA, 22 bp, Homo sapiens
gaggtggcgcgccatccctgcc

SEQ ID NO: 8139371 - DNA, 22 bp, Homo sapiens
gaggtggcgcgccatccctgcc

SEQ ID NO: 8139372 - DNA, 22 bp, Homo sapiens
gaggtggcgcgccatccctgcc

SEQ ID NO: 8139373 - DNA, 22 bp, Homo sapiens
gaggtggcctcaagcagtcttc

SEQ ID NO: 8139374 - DNA, 22 bp, Homo sapiens
atgtgtccttataagaagaaga

SEQ ID NO: 8139375 - DNA, 22 bp, Homo sapiens
gaggtggcgcgccatccctgcc

SEQ ID NO: 8139376 - DNA, 22 bp, Homo sapiens
atgtgtccttgttcccattcca

SEQ ID NO: 8139377 - DNA, 22 bp, Homo sapiens
atgtgtctaattccaggagcac

SEQ ID NO: 8139378 - DNA, 22 bp, Homo sapiens
atgtgtctaattccaggagcac

SEQ ID NO: 8139379 - DNA, 22 bp, Homo sapiens
atgtgtctaattccaggagcac

SEQ ID NO: 8139380 - DNA, 22 bp, Homo sapiens
atgtgtctagattgctgtaccg

SEQ ID NO: 8139381 - DNA, 22 bp, Homo sapiens
atgtgtctggcatggaaagtgt

SEQ ID NO: 8139382 - DNA, 22 bp, Homo sapiens
atgtgtctggcatggaaagtgt

SEQ ID NO: 8139383 - DNA, 20 bp, Homo sapiens
atgtgtctgcctctgtgttc

SEQ ID NO: 8139384 - DNA, 17 bp, Homo sapiens
atgtgtctgagtgtcct

SEQ ID NO: 8139385 - DNA, 22 bp, Homo sapiens
atgtgtctgaccactgtattgg

SEQ ID NO: 8139386 - DNA, 17 bp, Homo sapiens
atgtgtctagtgcaacc

SEQ ID NO: 8139387 - DNA, 20 bp, Homo sapiens
atgtagatgaaagcaaaggc

SEQ ID NO: 8139388 - DNA, 22 bp, Homo sapiens
atgtagctgcagatgataatgc

SEQ ID NO: 8139389 - DNA, 20 bp, Homo sapiens
atgtagcagtgtgctgggaa

SEQ ID NO: 8139390 - DNA, 22 bp, Homo sapiens
atgtccctgagggtctctctga

SEQ ID NO: 8139391 - DNA, 22 bp, Homo sapiens
atgtcattgccaagatgctaat

SEQ ID NO: 8139392 - DNA, 22 bp, Homo sapiens
atgtcctcttctgcctcaggcc

SEQ ID NO: 8139393 - DNA, 22 bp, Homo sapiens
atgtcctcttctgcctcaggcc

SEQ ID NO: 8139394 - DNA, 22 bp, Homo sapiens
atgtcctcggctctgtgctgct

SEQ ID NO: 8139395 - DNA, 22 bp, Homo sapiens
atgtcctcaaaactgattgcag

SEQ ID NO: 8139396 - DNA, 20 bp, Homo sapiens
atgtcctcagccactgccct

SEQ ID NO: 8139397 - DNA, 22 bp, Homo sapiens
atgtcctcaaaactgattgcag

SEQ ID NO: 8139398 - DNA, 22 bp, Homo sapiens
gaggcagcgggtcaggaccgtg

SEQ ID NO: 8139399 - DNA, 22 bp, Homo sapiens
gaggcagcgggtcaggaccgtg

SEQ ID NO: 8139400 - DNA, 22 bp, Homo sapiens
atgtagaacaggttaatgacag

SEQ ID NO: 8139401 - DNA, 22 bp, Homo sapiens
atgtagaaattaggatgatagt

SEQ ID NO: 8139402 - DNA, 22 bp, Homo sapiens
atgtagaaattaggatgatagt

SEQ ID NO: 8139403 - DNA, 22 bp, Homo sapiens
atgtagaaattaggatgatagt

SEQ ID NO: 8139404 - DNA, 22 bp, Homo sapiens
atgtagaaagttcatagatgcg

SEQ ID NO: 8139405 - DNA, 22 bp, Homo sapiens
atgtagaaataatttcagttcc

SEQ ID NO: 8139406 - DNA, 22 bp, Homo sapiens
atgtagaaagttattttactct

SEQ ID NO: 8139407 - DNA, 22 bp, Homo sapiens
atgtagaaagttattttactct

SEQ ID NO: 8139408 - DNA, 22 bp, Homo sapiens
gaggcagcgggtcaggaccgtg

SEQ ID NO: 8139409 - DNA, 22 bp, Homo sapiens
atgtagaagtgggcattataga

SEQ ID NO: 8139410 - DNA, 22 bp, Homo sapiens
atgtagaagtgggcattataga

SEQ ID NO: 8139411 - DNA, 22 bp, Homo sapiens
atgtagaagctgacagtgctgt

SEQ ID NO: 8139412 - DNA, 22 bp, Homo sapiens
atgtagaagctgacagtgctgt

SEQ ID NO: 8139413 - DNA, 22 bp, Homo sapiens
atgtagaagtgggcattataga

SEQ ID NO: 8139414 - DNA, 22 bp, Homo sapiens
atgtagaattccttctactttg

SEQ ID NO: 8139415 - DNA, 22 bp, Homo sapiens
atgtagagctccttgatcctcc

SEQ ID NO: 8139416 - DNA, 22 bp, Homo sapiens
atgtagagtagaatagtacaac

SEQ ID NO: 8139417 - DNA, 22 bp, Homo sapiens
atgtccttaatctgaatgttag

SEQ ID NO: 8139418 - DNA, 22 bp, Homo sapiens
atgtcctggagcagaggcaagg

SEQ ID NO: 8139419 - DNA, 20 bp, Homo sapiens
atgtcctgcttctcctcacc

SEQ ID NO: 8139420 - DNA, 22 bp, Homo sapiens
atgtcctggcccgaggatggag

SEQ ID NO: 8139421 - DNA, 21 bp, Homo sapiens
atgtcctggctaccagcgcag

SEQ ID NO: 8139422 - DNA, 22 bp, Homo sapiens
atgtcctgctgattcacattat

SEQ ID NO: 8139423 - DNA, 23 bp, Homo sapiens
atgtcctgcatagttgcttctgt

SEQ ID NO: 8139424 - DNA, 22 bp, Homo sapiens
atgtcctggtctagcttccggg

SEQ ID NO: 8139425 - DNA, 22 bp, Homo sapiens
atgtcctggtcctccaccatgg

SEQ ID NO: 8139426 - DNA, 22 bp, Homo sapiens
atgtcctggggtcttctcttca

SEQ ID NO: 8139427 - DNA, 22 bp, Homo sapiens
atgtcctgggctgggttatgtt

SEQ ID NO: 8139428 - DNA, 20 bp, Homo sapiens
atgtcctgttgctgccccag

SEQ ID NO: 8139429 - DNA, 22 bp, Homo sapiens
atgtcctgttaaatagattgta

SEQ ID NO: 8139430 - DNA, 23 bp, Homo sapiens
atgtcctgtgatgcttaatgacc

SEQ ID NO: 8139431 - DNA, 22 bp, Homo sapiens
atgtcctgttttggcttgctct

SEQ ID NO: 8139432 - DNA, 22 bp, Homo sapiens
atgtctctcaggtttaacttta

SEQ ID NO: 8139433 - DNA, 22 bp, Homo sapiens
atgtctctcaggtttaacttta

SEQ ID NO: 8139434 - DNA, 22 bp, Homo sapiens
atgtctctctctgagtgccaga

SEQ ID NO: 8139435 - DNA, 22 bp, Homo sapiens
atgtctctgccccagagagctt

SEQ ID NO: 8139436 - DNA, 22 bp, Homo sapiens
atgtccttttaaaatgtgagaa

SEQ ID NO: 8139437 - DNA, 22 bp, Homo sapiens
atgtctatatagtcaataatca

SEQ ID NO: 8139438 - DNA, 22 bp, Homo sapiens
atgtctatggaatttccacaca

SEQ ID NO: 8139439 - DNA, 22 bp, Homo sapiens
atgtctatgttctttactgtgt

SEQ ID NO: 8139440 - DNA, 22 bp, Homo sapiens
atgtgacagtgtttgacagatg

SEQ ID NO: 8139441 - DNA, 22 bp, Homo sapiens
atgtgaatgcagttatctataa

SEQ ID NO: 8139442 - DNA, 21 bp, Homo sapiens
atgtgaaatatcatcagagca

SEQ ID NO: 8139443 - DNA, 21 bp, Homo sapiens
atgtgaaatatcatcagagca

SEQ ID NO: 8139444 - DNA, 22 bp, Homo sapiens
gagggctgaagattgtggcccc

SEQ ID NO: 8139445 - DNA, 22 bp, Homo sapiens
atgtgaaacgcaatgggatcat

SEQ ID NO: 8139446 - DNA, 23 bp, Homo sapiens
gaggtggcaatgagggcagttgg

SEQ ID NO: 8139447 - DNA, 23 bp, Homo sapiens
gaggtggcaatgagggcagttgg

SEQ ID NO: 8139448 - DNA, 23 bp, Homo sapiens
gaggtggcaatgagggcagttgg

SEQ ID NO: 8139449 - DNA, 22 bp, Homo sapiens
gaggtggatgttgcagtgagct

SEQ ID NO: 8139450 - DNA, 20 bp, Homo sapiens
gaggtagggcttaaggcaag

SEQ ID NO: 8139451 - DNA, 22 bp, Homo sapiens
gaggtagggcagaggctgaatg

SEQ ID NO: 8139452 - DNA, 22 bp, Homo sapiens
gaggtagggcagaggctgaatg

SEQ ID NO: 8139453 - DNA, 22 bp, Homo sapiens
atgtgagggctcaggctgactg

SEQ ID NO: 8139454 - DNA, 22 bp, Homo sapiens
atgtgagggctcaggctgactg

SEQ ID NO: 8139455 - DNA, 22 bp, Homo sapiens
atgtgacagtgtttgacagatg

SEQ ID NO: 8139456 - DNA, 22 bp, Homo sapiens
atgtgagatgcacataattata

SEQ ID NO: 8139457 - DNA, 22 bp, Homo sapiens
gagggctcaactactactaggc

SEQ ID NO: 8139458 - DNA, 22 bp, Homo sapiens
gagggcagagacagtgattcac

SEQ ID NO: 8139459 - DNA, 22 bp, Homo sapiens
gagggcctggcacagggaggct

SEQ ID NO: 8139460 - DNA, 22 bp, Homo sapiens
gagggcagaaaattatgcggtg

SEQ ID NO: 8139461 - DNA, 22 bp, Homo sapiens
gagggcagagacagtgattcac

SEQ ID NO: 8139462 - DNA, 19 bp, Homo sapiens
atgtctctgtagcacatac

SEQ ID NO: 8139463 - DNA, 19 bp, Homo sapiens
atgtctctgtagcacatac

SEQ ID NO: 8139464 - DNA, 19 bp, Homo sapiens
atgtctctgtagcacatac

SEQ ID NO: 8139465 - DNA, 22 bp, Homo sapiens
atgtctctttactcttagaacc

SEQ ID NO: 8139466 - DNA, 22 bp, Homo sapiens
atgtctctttactcttagaacc

SEQ ID NO: 8139467 - DNA, 22 bp, Homo sapiens
atgtctgcaaatatctgccagt

SEQ ID NO: 8139468 - DNA, 23 bp, Homo sapiens
gagggctctgagtgcttgggcca

SEQ ID NO: 8139469 - DNA, 22 bp, Homo sapiens
gagggctgaagattgtggcccc

SEQ ID NO: 8139470 - DNA, 22 bp, Homo sapiens
gagggctgaagattgtggcccc

SEQ ID NO: 8139471 - DNA, 22 bp, Homo sapiens
gagggctctaccaagtaactct

SEQ ID NO: 8139472 - DNA, 22 bp, Homo sapiens
gagggctcctcacattctctat

SEQ ID NO: 8139473 - DNA, 22 bp, Homo sapiens
gagggctcactgagaaagcagt

SEQ ID NO: 8139474 - DNA, 22 bp, Homo sapiens
gagggctccacacgggcccagc

SEQ ID NO: 8139475 - DNA, 22 bp, Homo sapiens
gagggctccattccccgtgccc

SEQ ID NO: 8139476 - DNA, 22 bp, Homo sapiens
gagagatccagactgtgggtga

SEQ ID NO: 8139477 - DNA, 22 bp, Homo sapiens
gagagcaatggggacgggcagg

SEQ ID NO: 8139478 - DNA, 22 bp, Homo sapiens
gagagcagactctcaaagctgg

SEQ ID NO: 8139479 - DNA, 22 bp, Homo sapiens
gagagcagactctcaaagctgg

SEQ ID NO: 8139480 - DNA, 22 bp, Homo sapiens
gagagcagactctcaaagctgg

SEQ ID NO: 8139481 - DNA, 22 bp, Homo sapiens
gagagcagactctcaaagctgg

SEQ ID NO: 8139482 - DNA, 23 bp, Homo sapiens
gagagagattgctaaaccactcc

SEQ ID NO: 8139483 - DNA, 22 bp, Homo sapiens
gagagagctctgtgcctgggat

SEQ ID NO: 8139484 - DNA, 22 bp, Homo sapiens
gagagagctctgtgcctgggat

SEQ ID NO: 8139485 - DNA, 22 bp, Homo sapiens
gagagaggcctccatgtactga

SEQ ID NO: 8139486 - DNA, 22 bp, Homo sapiens
gagagaggcctccatgtactga

SEQ ID NO: 8139487 - DNA, 22 bp, Homo sapiens
gagagaggcctccatgtactga

SEQ ID NO: 8139488 - DNA, 22 bp, Homo sapiens
gagagaggcctccatgtactga

SEQ ID NO: 8139489 - DNA, 19 bp, Homo sapiens
gagacatgtagatagaaga

SEQ ID NO: 8139490 - DNA, 22 bp, Homo sapiens
gagagagaagtgggtgtcacct

SEQ ID NO: 8139491 - DNA, 22 bp, Homo sapiens
gagagagaagtgggtgtcacct

SEQ ID NO: 8139492 - DNA, 22 bp, Homo sapiens
gagagagaggtgctgccaggca

SEQ ID NO: 8139493 - DNA, 22 bp, Homo sapiens
gactggggctctagccaggcct

SEQ ID NO: 8139494 - DNA, 22 bp, Homo sapiens
gactggggctctagccaggcct

SEQ ID NO: 8139495 - DNA, 22 bp, Homo sapiens
gactggggctctagccaggcct

SEQ ID NO: 8139496 - DNA, 22 bp, Homo sapiens
gagacagtgtccatccaggggc

SEQ ID NO: 8139497 - DNA, 22 bp, Homo sapiens
gactgggctccaagagggagag

SEQ ID NO: 8139498 - DNA, 21 bp, Homo sapiens
gactgggctgacttgtgctgg

SEQ ID NO: 8139499 - DNA, 22 bp, Homo sapiens
gactgggctccaagagggagag

SEQ ID NO: 8139500 - DNA, 22 bp, Homo sapiens
gactggggaaggacccgagacc

SEQ ID NO: 8139501 - DNA, 22 bp, Homo sapiens
gactggggctctagccaggcct

SEQ ID NO: 8139502 - DNA, 22 bp, Homo sapiens
atggaggatgtgcagcatgggc

SEQ ID NO: 8139503 - DNA, 17 bp, Homo sapiens
atggaggcagacaggtc

SEQ ID NO: 8139504 - DNA, 17 bp, Homo sapiens
atggaggcagacaggtc

SEQ ID NO: 8139505 - DNA, 17 bp, Homo sapiens
atggaggcagacaggtc

SEQ ID NO: 8139506 - DNA, 22 bp, Homo sapiens
atggagggaaaagtggagagcc

SEQ ID NO: 8139507 - DNA, 22 bp, Homo sapiens
atggagggaaaagtggagagcc

SEQ ID NO: 8139508 - DNA, 22 bp, Homo sapiens
atggagggaaaagtggagagcc

SEQ ID NO: 8139509 - DNA, 18 bp, Homo sapiens
atggaggcagagagctga

SEQ ID NO: 8139510 - DNA, 18 bp, Homo sapiens
atggaggcagagagctga

SEQ ID NO: 8139511 - DNA, 18 bp, Homo sapiens
atggaggcagagagctga

SEQ ID NO: 8139512 - DNA, 22 bp, Homo sapiens
atggagggaaaagtggagagcc

SEQ ID NO: 8139513 - DNA, 22 bp, Homo sapiens
atggagggaaaagtggagagcc

SEQ ID NO: 8139514 - DNA, 21 bp, Homo sapiens
atggagggaccagggaagcag

SEQ ID NO: 8139515 - DNA, 21 bp, Homo sapiens
atggagggaccagggaagcag

SEQ ID NO: 8139516 - DNA, 21 bp, Homo sapiens
atggagggaccagggaagcag

SEQ ID NO: 8139517 - DNA, 22 bp, Homo sapiens
atggagggtggtaagacagaga

SEQ ID NO: 8139518 - DNA, 22 bp, Homo sapiens
atggagggtggtaagacagaga

SEQ ID NO: 8139519 - DNA, 22 bp, Homo sapiens
gagatggccagtgccaggacaa

SEQ ID NO: 8139520 - DNA, 17 bp, Homo sapiens
gagatggcattggcagc

SEQ ID NO: 8139521 - DNA, 22 bp, Homo sapiens
gagatggccagtgccaggacaa

SEQ ID NO: 8139522 - DNA, 22 bp, Homo sapiens
atggagggtggtaagacagaga

SEQ ID NO: 8139523 - DNA, 22 bp, Homo sapiens
atggagggtgtcagagagcgaa

SEQ ID NO: 8139524 - DNA, 22 bp, Homo sapiens
gagaggttgaacaacatactct

SEQ ID NO: 8139525 - DNA, 22 bp, Homo sapiens
gagagtattacaaattttacaa

SEQ ID NO: 8139526 - DNA, 21 bp, Homo sapiens
gagatggcccagtagcgggcc

SEQ ID NO: 8139527 - DNA, 21 bp, Homo sapiens
gagatggcccagtagcgggcc

SEQ ID NO: 8139528 - DNA, 22 bp, Homo sapiens
gagatggccctggcatgtagct

SEQ ID NO: 8139529 - DNA, 22 bp, Homo sapiens
gagatggccctggcatgtagct

SEQ ID NO: 8139530 - DNA, 23 bp, Homo sapiens
gagatggctggttgtcctctgaa

SEQ ID NO: 8139531 - DNA, 23 bp, Homo sapiens
gagatggctggttgtcctctgaa

SEQ ID NO: 8139532 - DNA, 20 bp, Homo sapiens
gagatggctaagtgctgaac

SEQ ID NO: 8139533 - DNA, 20 bp, Homo sapiens
gagatggctaagtgctgaac

SEQ ID NO: 8139534 - DNA, 22 bp, Homo sapiens
gagatggccctggcatgtagct

SEQ ID NO: 8139535 - DNA, 22 bp, Homo sapiens
gagatgggcgagaaggtggact

SEQ ID NO: 8139536 - DNA, 22 bp, Homo sapiens
gagatgggcgagaaggtggact

SEQ ID NO: 8139537 - DNA, 22 bp, Homo sapiens
gagatgggcgagaaggtggact

SEQ ID NO: 8139538 - DNA, 22 bp, Homo sapiens
atgggaaagaagccactgccca

SEQ ID NO: 8139539 - DNA, 22 bp, Homo sapiens
atggctttctgtgtttccgtag

SEQ ID NO: 8139540 - DNA, 22 bp, Homo sapiens
atggcttgcagagaaaagaggt

SEQ ID NO: 8139541 - DNA, 22 bp, Homo sapiens
atggctttccggactttggcca

SEQ ID NO: 8139542 - DNA, 22 bp, Homo sapiens
atggcttcatcttttagtcctt

SEQ ID NO: 8139543 - DNA, 22 bp, Homo sapiens
atggcttccaaggccctccgtg

SEQ ID NO: 8139544 - DNA, 22 bp, Homo sapiens
atggcttctcgctggcacctgt

SEQ ID NO: 8139545 - DNA, 22 bp, Homo sapiens
atggcttctcgctggcacctgt

SEQ ID NO: 8139546 - DNA, 21 bp, Homo sapiens
atggcttctcaggtgcactga

SEQ ID NO: 8139547 - DNA, 22 bp, Homo sapiens
atggcttcgagtatatacatag

SEQ ID NO: 8139548 - DNA, 21 bp, Homo sapiens
atggcttctcaggtgcactga

SEQ ID NO: 8139549 - DNA, 22 bp, Homo sapiens
atggccagagagagcacacctg

SEQ ID NO: 8139550 - DNA, 22 bp, Homo sapiens
atggccagagaggccagcctgg

SEQ ID NO: 8139551 - DNA, 21 bp, Homo sapiens
atggccagatctattaggtgg

SEQ ID NO: 8139552 - DNA, 21 bp, Homo sapiens
atggccagatctattaggtgg

SEQ ID NO: 8139553 - DNA, 22 bp, Homo sapiens
atggctggcatccaggtgggct

SEQ ID NO: 8139554 - DNA, 22 bp, Homo sapiens
atggctggcatccaggtgggct

SEQ ID NO: 8139555 - DNA, 22 bp, Homo sapiens
atggctggcatccaggtgggct

SEQ ID NO: 8139556 - DNA, 22 bp, Homo sapiens
atggctgtgttgttcctctgaa

SEQ ID NO: 8139557 - DNA, 22 bp, Homo sapiens
atggctggcatccaggtgggct

SEQ ID NO: 8139558 - DNA, 21 bp, Homo sapiens
atggccactatggtgcagcag

SEQ ID NO: 8139559 - DNA, 22 bp, Homo sapiens
atggccaagcatatacagattg

SEQ ID NO: 8139560 - DNA, 22 bp, Homo sapiens
atggccagagagagcacacctg

SEQ ID NO: 8139561 - DNA, 22 bp, Homo sapiens
atggccagagaaggcagggtca

SEQ ID NO: 8139562 - DNA, 22 bp, Homo sapiens
atggccagagaaggcagggtca

SEQ ID NO: 8139563 - DNA, 22 bp, Homo sapiens
atggccagagaaggcagggtca

SEQ ID NO: 8139564 - DNA, 22 bp, Homo sapiens
atggccagagaaggcagggtca

SEQ ID NO: 8139565 - DNA, 22 bp, Homo sapiens
gagatggtagcctcagaagagt

SEQ ID NO: 8139566 - DNA, 22 bp, Homo sapiens
atggcattcacatttccagaga

SEQ ID NO: 8139567 - DNA, 22 bp, Homo sapiens
atggcattgcaagggcaggagg

SEQ ID NO: 8139568 - DNA, 17 bp, Homo sapiens
gagatgggtggatcacc

SEQ ID NO: 8139569 - DNA, 17 bp, Homo sapiens
gagatgggtggatcacc

SEQ ID NO: 8139570 - DNA, 17 bp, Homo sapiens
gagatgggtggatcacc

SEQ ID NO: 8139571 - DNA, 17 bp, Homo sapiens
gagatgggtggatcacc

SEQ ID NO: 8139572 - DNA, 17 bp, Homo sapiens
gagatgggtggatcacc

SEQ ID NO: 8139573 - DNA, 22 bp, Homo sapiens
gagatggggtcttgctatgttg

SEQ ID NO: 8139574 - DNA, 22 bp, Homo sapiens
gagatggggtcttgctatgttg

SEQ ID NO: 8139575 - DNA, 22 bp, Homo sapiens
gagatggggtcttgctatgttg

SEQ ID NO: 8139576 - DNA, 22 bp, Homo sapiens
gagatggggaataggagcaagc

SEQ ID NO: 8139577 - DNA, 22 bp, Homo sapiens
gagatggggtcagctgggacat

SEQ ID NO: 8139578 - DNA, 22 bp, Homo sapiens
gagatggggaataggagcaagc

SEQ ID NO: 8139579 - DNA, 22 bp, Homo sapiens
gagatggggtcttgctatgttg

SEQ ID NO: 8139580 - DNA, 22 bp, Homo sapiens
gagatggggtcagctgggacat

SEQ ID NO: 8139581 - DNA, 22 bp, Homo sapiens
atgggctgaaagagtaagctgt

SEQ ID NO: 8139582 - DNA, 22 bp, Homo sapiens
atgggctgacaagacatgcata

SEQ ID NO: 8139583 - DNA, 22 bp, Homo sapiens
atgggagaaacatcatgaggca

SEQ ID NO: 8139584 - DNA, 22 bp, Homo sapiens
atgggagaaacatcatgaggca

SEQ ID NO: 8139585 - DNA, 22 bp, Homo sapiens
atgggagaaacatcatgaggca

SEQ ID NO: 8139586 - DNA, 22 bp, Homo sapiens
atgggagaaacatcatgaggca

SEQ ID NO: 8139587 - DNA, 22 bp, Homo sapiens
atgggctgacccagtcgtggca

SEQ ID NO: 8139588 - DNA, 22 bp, Homo sapiens
atgggctgaggaagctcctgag

SEQ ID NO: 8139589 - DNA, 22 bp, Homo sapiens
atgggctgacccagtcgtggca

SEQ ID NO: 8139590 - DNA, 22 bp, Homo sapiens
atgggctgacccagtcgtggca

SEQ ID NO: 8139591 - DNA, 22 bp, Homo sapiens
atgggctgaggaagctcctgag

SEQ ID NO: 8139592 - DNA, 22 bp, Homo sapiens
atgggctgaggtgggatagaag

SEQ ID NO: 8139593 - DNA, 22 bp, Homo sapiens
atgggaaggttttgagagcggg

SEQ ID NO: 8139594 - DNA, 22 bp, Homo sapiens
atgggaagtgttagaagatttt

SEQ ID NO: 8139595 - DNA, 22 bp, Homo sapiens
atgggaagtgaagtcagggagg

SEQ ID NO: 8139596 - DNA, 19 bp, Homo sapiens
atgggaagcggccagcgga

SEQ ID NO: 8139597 - DNA, 22 bp, Homo sapiens
atgggaagctgacctgcatgga

SEQ ID NO: 8139598 - DNA, 22 bp, Homo sapiens
atgggacacagtccgccctcta

SEQ ID NO: 8139599 - DNA, 22 bp, Homo sapiens
atgggacagggctggctggtcc

SEQ ID NO: 8139600 - DNA, 22 bp, Homo sapiens
atgggacaggtactagaaaggg

SEQ ID NO: 8139601 - DNA, 22 bp, Homo sapiens
atgggacatagatccttgaggt

SEQ ID NO: 8139602 - DNA, 22 bp, Homo sapiens
atgggagaaacatcatgaggca

SEQ ID NO: 8139603 - DNA, 22 bp, Homo sapiens
atggggagagaagggctgagct

SEQ ID NO: 8139604 - DNA, 22 bp, Homo sapiens
atggggagagaagggctgagct

SEQ ID NO: 8139605 - DNA, 22 bp, Homo sapiens
atggggagagaagggctgagct

SEQ ID NO: 8139606 - DNA, 22 bp, Homo sapiens
atgggcttggcgacaatttgaa

SEQ ID NO: 8139607 - DNA, 22 bp, Homo sapiens
atgggcttgaccctacagaaag

SEQ ID NO: 8139608 - DNA, 22 bp, Homo sapiens
atggggaagagccagtgagctg

SEQ ID NO: 8139609 - DNA, 23 bp, Homo sapiens
atgggcttagaaagcaagtggga

SEQ ID NO: 8139610 - DNA, 23 bp, Homo sapiens
atgggcttagaaagcaagtggga

SEQ ID NO: 8139611 - DNA, 23 bp, Homo sapiens
atgggcttagaaagcaagtggga

SEQ ID NO: 8139612 - DNA, 22 bp, Homo sapiens
atggggagagcctctgtcccca

SEQ ID NO: 8139613 - DNA, 22 bp, Homo sapiens
atggggagctcaccacctgttt

SEQ ID NO: 8139614 - DNA, 22 bp, Homo sapiens
atggggagctcaccacctgttt

SEQ ID NO: 8139615 - DNA, 22 bp, Homo sapiens
atggggcagaggttaaaggtgg

SEQ ID NO: 8139616 - DNA, 22 bp, Homo sapiens
atggggctagacaaccagtgcc

SEQ ID NO: 8139617 - DNA, 22 bp, Homo sapiens
atgggctgtccattgctggctg

SEQ ID NO: 8139618 - DNA, 22 bp, Homo sapiens
atgggctggggaagctcactcc

SEQ ID NO: 8139619 - DNA, 20 bp, Homo sapiens
atgggctggttaggaagtgt

SEQ ID NO: 8139620 - DNA, 22 bp, Homo sapiens
atgggctgtcctagtccagccc

SEQ ID NO: 8139621 - DNA, 22 bp, Homo sapiens
atgggctgtcctagtccagccc

SEQ ID NO: 8139622 - DNA, 22 bp, Homo sapiens
atgggctgcttctccagcacct

SEQ ID NO: 8139623 - DNA, 22 bp, Homo sapiens
atgggctgggaatacacagggg

SEQ ID NO: 8139624 - DNA, 22 bp, Homo sapiens
atgggctgggatctgagtgtca

SEQ ID NO: 8139625 - DNA, 22 bp, Homo sapiens
atgggctggggaagctcactcc

SEQ ID NO: 8139626 - DNA, 22 bp, Homo sapiens
atgggctgggatctgagtgtca

SEQ ID NO: 8139627 - DNA, 22 bp, Homo sapiens
atgggctgggatctgagtgtca

SEQ ID NO: 8139628 - DNA, 22 bp, Homo sapiens
gaggagaagctaagaaacacag

SEQ ID NO: 8139629 - DNA, 22 bp, Homo sapiens
gaggagaaatttggggacctga

SEQ ID NO: 8139630 - DNA, 22 bp, Homo sapiens
gaggaaggctaaggggcttaga

SEQ ID NO: 8139631 - DNA, 22 bp, Homo sapiens
gaggaaggctaaggggcttaga

SEQ ID NO: 8139632 - DNA, 22 bp, Homo sapiens
atggggctagacaaccagtgcc

SEQ ID NO: 8139633 - DNA, 22 bp, Homo sapiens
gaggagaaattatccttggtgt

SEQ ID NO: 8139634 - DNA, 22 bp, Homo sapiens
gaggagaagctattggaaggac

SEQ ID NO: 8139635 - DNA, 22 bp, Homo sapiens
gaggagaagctattggaaggac

SEQ ID NO: 8139636 - DNA, 22 bp, Homo sapiens
gaggagaagctattggaaggac

SEQ ID NO: 8139637 - DNA, 22 bp, Homo sapiens
gaggagaagctaagaaacacag

SEQ ID NO: 8139638 - DNA, 22 bp, Homo sapiens
gaggagaagctaagaaacacag

SEQ ID NO: 8139639 - DNA, 22 bp, Homo sapiens
gaggagaagctaagaaacacag

SEQ ID NO: 8139640 - DNA, 22 bp, Homo sapiens
atggtctgctgagtcatgaggc

SEQ ID NO: 8139641 - DNA, 22 bp, Homo sapiens
atggtctgttaggagctacttt

SEQ ID NO: 8139642 - DNA, 22 bp, Homo sapiens
atggtctgttaggagctacttt

SEQ ID NO: 8139643 - DNA, 22 bp, Homo sapiens
atggtctgaatgtgtgctccaa

SEQ ID NO: 8139644 - DNA, 21 bp, Homo sapiens
atggtctgaggatagcaaaaa

SEQ ID NO: 8139645 - DNA, 22 bp, Homo sapiens
atggtctgatgtcccatggctt

SEQ ID NO: 8139646 - DNA, 18 bp, Homo sapiens
atggtctcatactgggag

SEQ ID NO: 8139647 - DNA, 18 bp, Homo sapiens
atggtctcatactgggag

SEQ ID NO: 8139648 - DNA, 21 bp, Homo sapiens
atggtgagatactgggtgtgg

SEQ ID NO: 8139649 - DNA, 22 bp, Homo sapiens
atggtgaagcttcatgggtgtt

SEQ ID NO: 8139650 - DNA, 21 bp, Homo sapiens
atggtgagatactgggtgtgg

SEQ ID NO: 8139651 - DNA, 22 bp, Homo sapiens
gaggagaagggcacggagaaaa

SEQ ID NO: 8139652 - DNA, 18 bp, Homo sapiens
atggtctcatactgggag

SEQ ID NO: 8139653 - DNA, 18 bp, Homo sapiens
atggtctcatactgggag

SEQ ID NO: 8139654 - DNA, 22 bp, Homo sapiens
gaggcagcctcagtggacctcg

SEQ ID NO: 8139655 - DNA, 22 bp, Homo sapiens
gaggcagcctcagtggacctcg

SEQ ID NO: 8139656 - DNA, 22 bp, Homo sapiens
gaggcagccagaggttctcatt

SEQ ID NO: 8139657 - DNA, 22 bp, Homo sapiens
gaggcagcctcagtggacctcg

SEQ ID NO: 8139658 - DNA, 22 bp, Homo sapiens
gaggcagcctcagtggacctcg

SEQ ID NO: 8139659 - DNA, 22 bp, Homo sapiens
gaggcagcattcgcatagacag

SEQ ID NO: 8139660 - DNA, 22 bp, Homo sapiens
gaggcagcattcgcatagacag

SEQ ID NO: 8139661 - DNA, 22 bp, Homo sapiens
gaggcagcatggtaccttggag

SEQ ID NO: 8139662 - DNA, 22 bp, Homo sapiens
gaggcagcatggtaccttggag

SEQ ID NO: 8139663 - DNA, 22 bp, Homo sapiens
gaggcagcatctatggtgggaa

SEQ ID NO: 8139664 - DNA, 22 bp, Homo sapiens
atggttaaattggttatttatg

SEQ ID NO: 8139665 - DNA, 22 bp, Homo sapiens
gaggcacatatatacagagccc

SEQ ID NO: 8139666 - DNA, 22 bp, Homo sapiens
gaggcagcagggctggttcctt

SEQ ID NO: 8139667 - DNA, 22 bp, Homo sapiens
gaggcagcatctatggtgggaa

SEQ ID NO: 8139668 - DNA, 21 bp, Homo sapiens
atggtggcacaaatttgatct

SEQ ID NO: 8139669 - DNA, 22 bp, Homo sapiens
atggtggaggtgtattctggat

SEQ ID NO: 8139670 - DNA, 22 bp, Homo sapiens
atggtgtacagccagatgtaga

SEQ ID NO: 8139671 - DNA, 22 bp, Homo sapiens
cacactgtctttcagaatggtt

SEQ ID NO: 8139672 - DNA, 22 bp, Homo sapiens
cacactgtctttatgagctgta

SEQ ID NO: 8139673 - DNA, 22 bp, Homo sapiens
ggaaggggccttgagcaaactg

SEQ ID NO: 8139674 - DNA, 22 bp, Homo sapiens
cacactgtccccttctccccag

SEQ ID NO: 8139675 - DNA, 22 bp, Homo sapiens
cacagaactggttaatagcaga

SEQ ID NO: 8139676 - DNA, 22 bp, Homo sapiens
cacagaagaatcatgctgtgtt

SEQ ID NO: 8139677 - DNA, 22 bp, Homo sapiens
cacagaagaatcatgctgtgtt

SEQ ID NO: 8139678 - DNA, 22 bp, Homo sapiens
cacagaagaatcatgctgtgtt

SEQ ID NO: 8139679 - DNA, 22 bp, Homo sapiens
cacagaagtgtgtataactctt

SEQ ID NO: 8139680 - DNA, 22 bp, Homo sapiens
cacagaagtttcatagtctcga

SEQ ID NO: 8139681 - DNA, 22 bp, Homo sapiens
cacagaagtttcatagtctcga

SEQ ID NO: 8139682 - DNA, 22 bp, Homo sapiens
cacagaataattcacatggctc

SEQ ID NO: 8139683 - DNA, 21 bp, Homo sapiens
cacagaatatacattttagtt

SEQ ID NO: 8139684 - DNA, 22 bp, Homo sapiens
cacagaatcatattgtcagttt

SEQ ID NO: 8139685 - DNA, 21 bp, Homo sapiens
ggaagggctctgaggacggct

SEQ ID NO: 8139686 - DNA, 21 bp, Homo sapiens
ggaagggctctgaggacggct

SEQ ID NO: 8139687 - DNA, 21 bp, Homo sapiens
ggaagggctctgaggacggct

SEQ ID NO: 8139688 - DNA, 22 bp, Homo sapiens
ggaaggggagctggaaagggta

SEQ ID NO: 8139689 - DNA, 22 bp, Homo sapiens
ggaaggggagctggaaagggta

SEQ ID NO: 8139690 - DNA, 20 bp, Homo sapiens
ggaaggggcaaagtgtgtga

SEQ ID NO: 8139691 - DNA, 20 bp, Homo sapiens
ggaaggggcaaagtgtgtga

SEQ ID NO: 8139692 - DNA, 20 bp, Homo sapiens
ggaaggggcaaagtgtgtga

SEQ ID NO: 8139693 - DNA, 22 bp, Homo sapiens
ggaaggggagctggaaagggta

SEQ ID NO: 8139694 - DNA, 22 bp, Homo sapiens
ggaaggggagctggaaagggta

SEQ ID NO: 8139695 - DNA, 22 bp, Homo sapiens
ggaaggggagctggaaagggta

SEQ ID NO: 8139696 - DNA, 22 bp, Homo sapiens
ggaaggggagctggaaagggta

SEQ ID NO: 8139697 - DNA, 22 bp, Homo sapiens
cacacagatggtaagggaggga

SEQ ID NO: 8139698 - DNA, 22 bp, Homo sapiens
cacacagatggtaagggaggga

SEQ ID NO: 8139699 - DNA, 15 bp, Homo sapiens
cacacagacagcttg

SEQ ID NO: 8139700 - DNA, 22 bp, Homo sapiens
cacacagacagctctctgaaga

SEQ ID NO: 8139701 - DNA, 22 bp, Homo sapiens
cacacagacagctctctgaaga

SEQ ID NO: 8139702 - DNA, 22 bp, Homo sapiens
cacacagacagctctctgaaga

SEQ ID NO: 8139703 - DNA, 22 bp, Homo sapiens
caatgtttgtgatctactgact

SEQ ID NO: 8139704 - DNA, 22 bp, Homo sapiens
caatgtttgttagagctctaga

SEQ ID NO: 8139705 - DNA, 22 bp, Homo sapiens
caatgttttcaactgacaagta

SEQ ID NO: 8139706 - DNA, 18 bp, Homo sapiens
caatgttttagatctcta

SEQ ID NO: 8139707 - DNA, 22 bp, Homo sapiens
caatgttttcaactgacaagta

SEQ ID NO: 8139708 - DNA, 22 bp, Homo sapiens
cacaattttaatacacagtcaa

SEQ ID NO: 8139709 - DNA, 22 bp, Homo sapiens
cacaattttaatacacagtcaa

SEQ ID NO: 8139710 - DNA, 22 bp, Homo sapiens
cacacagacagctctctgaaga

SEQ ID NO: 8139711 - DNA, 22 bp, Homo sapiens
cacacagacagctctctgaaga

SEQ ID NO: 8139712 - DNA, 22 bp, Homo sapiens
cacacagctagtgacaggagaa

SEQ ID NO: 8139713 - DNA, 22 bp, Homo sapiens
cacacagctagtgacaggagaa

SEQ ID NO: 8139714 - DNA, 22 bp, Homo sapiens
cacacagctagtgacaggagaa

SEQ ID NO: 8139715 - DNA, 22 bp, Homo sapiens
ggaagggcctcgggcgtgggac

SEQ ID NO: 8139716 - DNA, 22 bp, Homo sapiens
ggaagggcctcgggcgtgggac

SEQ ID NO: 8139717 - DNA, 22 bp, Homo sapiens
ggaagggcctcgggcgtgggac

SEQ ID NO: 8139718 - DNA, 21 bp, Homo sapiens
cacacagctgcccttaggtag

SEQ ID NO: 8139719 - DNA, 22 bp, Homo sapiens
cacacaggagagtgctggaggt

SEQ ID NO: 8139720 - DNA, 22 bp, Homo sapiens
cacagagaccccttctggggcc

SEQ ID NO: 8139721 - DNA, 22 bp, Homo sapiens
ggactggggccaacacctccct

SEQ ID NO: 8139722 - DNA, 17 bp, Homo sapiens
ggactgggcggggcagg

SEQ ID NO: 8139723 - DNA, 22 bp, Homo sapiens
ggactgggccaggggttggact

SEQ ID NO: 8139724 - DNA, 22 bp, Homo sapiens
ggactgggccaggggttggact

SEQ ID NO: 8139725 - DNA, 22 bp, Homo sapiens
ggactgggccaggggttggact

SEQ ID NO: 8139726 - DNA, 22 bp, Homo sapiens
ggactgggcatgggtgctctgc

SEQ ID NO: 8139727 - DNA, 22 bp, Homo sapiens
ggactgggcatgggtgctctgc

SEQ ID NO: 8139728 - DNA, 22 bp, Homo sapiens
ggactgggattctggatctgct

SEQ ID NO: 8139729 - DNA, 22 bp, Homo sapiens
ggactgggattctggatctgct

SEQ ID NO: 8139730 - DNA, 22 bp, Homo sapiens
ggactgggattctggatctgct

SEQ ID NO: 8139731 - DNA, 22 bp, Homo sapiens
cacagacccagaagggatgaag

SEQ ID NO: 8139732 - DNA, 22 bp, Homo sapiens
cacagaatggaccagttttaga

SEQ ID NO: 8139733 - DNA, 22 bp, Homo sapiens
cacagaattttctctttacaat

SEQ ID NO: 8139734 - DNA, 22 bp, Homo sapiens
cacagacagtgtccctttgttg

SEQ ID NO: 8139735 - DNA, 22 bp, Homo sapiens
ggactgggagaatggaggcaag

SEQ ID NO: 8139736 - DNA, 22 bp, Homo sapiens
ggactgggagaatggaggcaag

SEQ ID NO: 8139737 - DNA, 22 bp, Homo sapiens
cacagagaaaatgttggtgctt

SEQ ID NO: 8139738 - DNA, 22 bp, Homo sapiens
ggactgggagaatggaggcaag

SEQ ID NO: 8139739 - DNA, 22 bp, Homo sapiens
ggactgggagaatggaggcaag

SEQ ID NO: 8139740 - DNA, 22 bp, Homo sapiens
ggactgggagaatggaggcaag

SEQ ID NO: 8139741 - DNA, 22 bp, Homo sapiens
ggactgggagaatggaggcaag

SEQ ID NO: 8139742 - DNA, 22 bp, Homo sapiens
ggactgggagaatggaggcaag

SEQ ID NO: 8139743 - DNA, 22 bp, Homo sapiens
ggactgggagaatggaggcaag

SEQ ID NO: 8139744 - DNA, 22 bp, Homo sapiens
cacagaggctcaaagccaggtg

SEQ ID NO: 8139745 - DNA, 22 bp, Homo sapiens
cacagaggctcaaagccaggtg

SEQ ID NO: 8139746 - DNA, 21 bp, Homo sapiens
cacagaggcgctgtatggctg

SEQ ID NO: 8139747 - DNA, 22 bp, Homo sapiens
cacagaggatgcccaagcgatc

SEQ ID NO: 8139748 - DNA, 22 bp, Homo sapiens
cacagaggactgtagcggggag

SEQ ID NO: 8139749 - DNA, 22 bp, Homo sapiens
cacagaggaatgcatcagcaga

SEQ ID NO: 8139750 - DNA, 22 bp, Homo sapiens
cacagaggaaaggcagttggta

SEQ ID NO: 8139751 - DNA, 22 bp, Homo sapiens
cacagaggaaatgactttctta

SEQ ID NO: 8139752 - DNA, 22 bp, Homo sapiens
cacagaggaaaggcagttggta

SEQ ID NO: 8139753 - DNA, 22 bp, Homo sapiens
cacagagctgaacctgggtcat

SEQ ID NO: 8139754 - DNA, 22 bp, Homo sapiens
cacagagctgaacctgggtcat

SEQ ID NO: 8139755 - DNA, 22 bp, Homo sapiens
cacagagctgaacctgggtcat

SEQ ID NO: 8139756 - DNA, 22 bp, Homo sapiens
ggagcccttggcacctagtagg

SEQ ID NO: 8139757 - DNA, 22 bp, Homo sapiens
ggagccggagggccactggcag

SEQ ID NO: 8139758 - DNA, 19 bp, Homo sapiens
ggagccgccgcccttcatt

SEQ ID NO: 8139759 - DNA, 22 bp, Homo sapiens
ggagccctgctgacatgggtgt

SEQ ID NO: 8139760 - DNA, 22 bp, Homo sapiens
ggagccctgctgacatgggtgt

SEQ ID NO: 8139761 - DNA, 22 bp, Homo sapiens
ggagccctgccctaggcagctc

SEQ ID NO: 8139762 - DNA, 23 bp, Homo sapiens
ggagccctgagctgtccccatgc

SEQ ID NO: 8139763 - DNA, 22 bp, Homo sapiens
ggagcccttctattccatggag

SEQ ID NO: 8139764 - DNA, 22 bp, Homo sapiens
ggagcccttctattccatggag

SEQ ID NO: 8139765 - DNA, 22 bp, Homo sapiens
cacagattatgagacgagatac

SEQ ID NO: 8139766 - DNA, 22 bp, Homo sapiens
cacagatttctggtcttcaccc

SEQ ID NO: 8139767 - DNA, 22 bp, Homo sapiens
ggagcaggcagggccgtgtctg

SEQ ID NO: 8139768 - DNA, 22 bp, Homo sapiens
ggagcaggcagggccgtgtctg

SEQ ID NO: 8139769 - DNA, 22 bp, Homo sapiens
ggagccctgccctaggcagctc

SEQ ID NO: 8139770 - DNA, 22 bp, Homo sapiens
ggagccctccatcccttgcggc

SEQ ID NO: 8139771 - DNA, 22 bp, Homo sapiens
ggagccctgccctaggcagctc

SEQ ID NO: 8139772 - DNA, 22 bp, Homo sapiens
ggagcaggcagggccgtgtctg

SEQ ID NO: 8139773 - DNA, 22 bp, Homo sapiens
ggagcaggcagggccgtgtctg

SEQ ID NO: 8139774 - DNA, 19 bp, Homo sapiens
cacagatgattgacacata

SEQ ID NO: 8139775 - DNA, 20 bp, Homo sapiens
cacagatgggacaggaaagg

SEQ ID NO: 8139776 - DNA, 22 bp, Homo sapiens
cacagaggtgatagtggtcaag

SEQ ID NO: 8139777 - DNA, 22 bp, Homo sapiens
cacagaggtctgggcccagcag

SEQ ID NO: 8139778 - DNA, 22 bp, Homo sapiens
cacagagtggaggcttggcctg

SEQ ID NO: 8139779 - DNA, 23 bp, Homo sapiens
ggagctgctgttgggggagctgc

SEQ ID NO: 8139780 - DNA, 23 bp, Homo sapiens
ggagctgctgttgggggagctgc

SEQ ID NO: 8139781 - DNA, 22 bp, Homo sapiens
ggagctggaatatattgaaacc

SEQ ID NO: 8139782 - DNA, 22 bp, Homo sapiens
ggagctgctttgatctgaagaa

SEQ ID NO: 8139783 - DNA, 23 bp, Homo sapiens
ggagctggacccttacacctttc

SEQ ID NO: 8139784 - DNA, 23 bp, Homo sapiens
ggagctggacccttacacctttc

SEQ ID NO: 8139785 - DNA, 22 bp, Homo sapiens
ggagctggagagctagcctagg

SEQ ID NO: 8139786 - DNA, 22 bp, Homo sapiens
ggagctggagagctagcctagg

SEQ ID NO: 8139787 - DNA, 22 bp, Homo sapiens
ggagctggagagctagcctagg

SEQ ID NO: 8139788 - DNA, 20 bp, Homo sapiens
ggagctggcatccagcctct

SEQ ID NO: 8139789 - DNA, 20 bp, Homo sapiens
ggagctggcatccagcctct

SEQ ID NO: 8139790 - DNA, 20 bp, Homo sapiens
ggagctggcatccagcctct

SEQ ID NO: 8139791 - DNA, 22 bp, Homo sapiens
ggagctggcagcgcaacccaga

SEQ ID NO: 8139792 - DNA, 22 bp, Homo sapiens
ggagctggcagcgcaacccaga

SEQ ID NO: 8139793 - DNA, 22 bp, Homo sapiens
ggagctggagagtacagagttt

SEQ ID NO: 8139794 - DNA, 22 bp, Homo sapiens
ggagctggagagtacagagttt

SEQ ID NO: 8139795 - DNA, 23 bp, Homo sapiens
ggagctgctgttgggggagctgc

SEQ ID NO: 8139796 - DNA, 23 bp, Homo sapiens
ggagctgctgttgggggagctgc

SEQ ID NO: 8139797 - DNA, 23 bp, Homo sapiens
ggagctgctgttgggggagctgc

SEQ ID NO: 8139798 - DNA, 19 bp, Homo sapiens
ggagcctggagcacgtgcc

SEQ ID NO: 8139799 - DNA, 22 bp, Homo sapiens
ggagctgctcagagccagtccc

SEQ ID NO: 8139800 - DNA, 22 bp, Homo sapiens
ggagctgctccttcagccaagt

SEQ ID NO: 8139801 - DNA, 22 bp, Homo sapiens
ggagctgctccttcagccaagt

SEQ ID NO: 8139802 - DNA, 19 bp, Homo sapiens
ggagcctggagcacgtgcc

SEQ ID NO: 8139803 - DNA, 22 bp, Homo sapiens
ggagcctgcgggagctcccatt

SEQ ID NO: 8139804 - DNA, 22 bp, Homo sapiens
ggagcctgcgggagctcccatt

SEQ ID NO: 8139805 - DNA, 22 bp, Homo sapiens
ggagcctgaaaagtctgcattt

SEQ ID NO: 8139806 - DNA, 22 bp, Homo sapiens
ggagcctgaaaagtctgcattt

SEQ ID NO: 8139807 - DNA, 22 bp, Homo sapiens
ggagcctgacagtgcccagcat

SEQ ID NO: 8139808 - DNA, 22 bp, Homo sapiens
ggagcctgacagtgcccagcat

SEQ ID NO: 8139809 - DNA, 22 bp, Homo sapiens
ggagcctgagcggcccagggcc

SEQ ID NO: 8139810 - DNA, 22 bp, Homo sapiens
ggagcctgagcggcccagggcc

SEQ ID NO: 8139811 - DNA, 22 bp, Homo sapiens
ggaggcaggaaagacaggttca

SEQ ID NO: 8139812 - DNA, 22 bp, Homo sapiens
ggaggcaggaaagacaggttca

SEQ ID NO: 8139813 - DNA, 22 bp, Homo sapiens
ggaggcagaatagagtgtgggt

SEQ ID NO: 8139814 - DNA, 22 bp, Homo sapiens
cacaggagaaaggggaagctcg

SEQ ID NO: 8139815 - DNA, 22 bp, Homo sapiens
cacaggagaaaggggaagctcg

SEQ ID NO: 8139816 - DNA, 22 bp, Homo sapiens
ggaggcagaatagagtgtgggt

SEQ ID NO: 8139817 - DNA, 22 bp, Homo sapiens
ggaggcagaatagagtgtgggt

SEQ ID NO: 8139818 - DNA, 22 bp, Homo sapiens
ggaggcagaatagagtgtgggt

SEQ ID NO: 8139819 - DNA, 22 bp, Homo sapiens
cacaggactcgactgcagacag

SEQ ID NO: 8139820 - DNA, 22 bp, Homo sapiens
cacaggaccaattcacattcca

SEQ ID NO: 8139821 - DNA, 22 bp, Homo sapiens
cacaggaattagcagcctaaaa

SEQ ID NO: 8139822 - DNA, 22 bp, Homo sapiens
cacaggaatgaacagggaaaga

SEQ ID NO: 8139823 - DNA, 22 bp, Homo sapiens
cacaggaattagcagcctaaaa

SEQ ID NO: 8139824 - DNA, 22 bp, Homo sapiens
cacaggaatgaacagggaaaga

SEQ ID NO: 8139825 - DNA, 22 bp, Homo sapiens
cacagctttgctttccttaata

SEQ ID NO: 8139826 - DNA, 22 bp, Homo sapiens
cacaggaagtggtcagtgccag

SEQ ID NO: 8139827 - DNA, 22 bp, Homo sapiens
cacaggaagtggtcagtgccag

SEQ ID NO: 8139828 - DNA, 22 bp, Homo sapiens
cacaggaatataagtttgagtt

SEQ ID NO: 8139829 - DNA, 22 bp, Homo sapiens
cacaggaagtggtcagtgccag

SEQ ID NO: 8139830 - DNA, 22 bp, Homo sapiens
cacaggaataagtcaaacttca

SEQ ID NO: 8139831 - DNA, 22 bp, Homo sapiens
cacaggaatcagcattaatggc

SEQ ID NO: 8139832 - DNA, 22 bp, Homo sapiens
cacaggctgggaagcctaggcc

SEQ ID NO: 8139833 - DNA, 20 bp, Homo sapiens
cacaggctatatgagagcca

SEQ ID NO: 8139834 - DNA, 23 bp, Homo sapiens
cacaggctgcgcataagcttctc

SEQ ID NO: 8139835 - DNA, 22 bp, Homo sapiens
cacaggcttccagtccccagct

SEQ ID NO: 8139836 - DNA, 20 bp, Homo sapiens
cacaggcttacagtttagat

SEQ ID NO: 8139837 - DNA, 22 bp, Homo sapiens
cacaggcttccagtccccagct

SEQ ID NO: 8139838 - DNA, 22 bp, Homo sapiens
cacaggcttccagtccccagct

SEQ ID NO: 8139839 - DNA, 22 bp, Homo sapiens
cacaggcttgtcagcatgaggc

SEQ ID NO: 8139840 - DNA, 22 bp, Homo sapiens
cacaggcttgtcagcatgaggc

SEQ ID NO: 8139841 - DNA, 22 bp, Homo sapiens
cacaggcttgtcagcatgaggc

SEQ ID NO: 8139842 - DNA, 22 bp, Homo sapiens
cacaggcttttctgacataggc

SEQ ID NO: 8139843 - DNA, 22 bp, Homo sapiens
cacaggcttttctgacataggc

SEQ ID NO: 8139844 - DNA, 22 bp, Homo sapiens
cacaggcttgtcagcatgaggc

SEQ ID NO: 8139845 - DNA, 22 bp, Homo sapiens
cacaggcttgtcagcatgaggc

SEQ ID NO: 8139846 - DNA, 22 bp, Homo sapiens
ggaggccaaagtgtgggcggct

SEQ ID NO: 8139847 - DNA, 22 bp, Homo sapiens
ggaggccaaagtgtgggcggct

SEQ ID NO: 8139848 - DNA, 22 bp, Homo sapiens
ggaggccaaagtgtgggcggct

SEQ ID NO: 8139849 - DNA, 22 bp, Homo sapiens
ggaggccaaggaggagcttgcc

SEQ ID NO: 8139850 - DNA, 22 bp, Homo sapiens
ggaggcatctctgtggctgtct

SEQ ID NO: 8139851 - DNA, 22 bp, Homo sapiens
ggaggccaaggagggcggatca

SEQ ID NO: 8139852 - DNA, 22 bp, Homo sapiens
ggaggccaaggaggagcttgcc

SEQ ID NO: 8139853 - DNA, 22 bp, Homo sapiens
ggaggccaaggaggagcttgcc

SEQ ID NO: 8139854 - DNA, 22 bp, Homo sapiens
ggaggccaaggaggagcttgcc

SEQ ID NO: 8139855 - DNA, 22 bp, Homo sapiens
ggaggccaaggcaggtggatca

SEQ ID NO: 8139856 - DNA, 22 bp, Homo sapiens
ggaggccaaggcaggcggatca

SEQ ID NO: 8139857 - DNA, 20 bp, Homo sapiens
cacaggctatatgagagcca

SEQ ID NO: 8139858 - DNA, 20 bp, Homo sapiens
cacaggctatatgagagcca

SEQ ID NO: 8139859 - DNA, 22 bp, Homo sapiens
ggaggccaaggcaggtggatca

SEQ ID NO: 8139860 - DNA, 22 bp, Homo sapiens
caagtttaaggcactgataagt

SEQ ID NO: 8139861 - DNA, 21 bp, Homo sapiens
gctgttgcccgccgcctcttc

SEQ ID NO: 8139862 - DNA, 22 bp, Homo sapiens
caagtttaaggcactgataagt

SEQ ID NO: 8139863 - DNA, 22 bp, Homo sapiens
gctgttctttgcatctctggtg

SEQ ID NO: 8139864 - DNA, 22 bp, Homo sapiens
gctgttctgcaccagacttcag

SEQ ID NO: 8139865 - DNA, 22 bp, Homo sapiens
gctgttctgtccccatgggtaa

SEQ ID NO: 8139866 - DNA, 22 bp, Homo sapiens
gctgttctgcgtcccaggctgg

SEQ ID NO: 8139867 - DNA, 22 bp, Homo sapiens
gctgttctccgatgaccccgtg

SEQ ID NO: 8139868 - DNA, 21 bp, Homo sapiens
gctgttcggcggccctcgcgc

SEQ ID NO: 8139869 - DNA, 22 bp, Homo sapiens
caagtcaactcaaattgttatc

SEQ ID NO: 8139870 - DNA, 22 bp, Homo sapiens
caagtatttgcggagttccacg

SEQ ID NO: 8139871 - DNA, 22 bp, Homo sapiens
caagtattttaaggactagtgg

SEQ ID NO: 8139872 - DNA, 22 bp, Homo sapiens
caagtcaagcatgcccttattt

SEQ ID NO: 8139873 - DNA, 22 bp, Homo sapiens
gctgtggcctggcgcagagctg

SEQ ID NO: 8139874 - DNA, 22 bp, Homo sapiens
gctgtggcggcagcagctggtg

SEQ ID NO: 8139875 - DNA, 22 bp, Homo sapiens
gctgtggcctggcgcagagctg

SEQ ID NO: 8139876 - DNA, 22 bp, Homo sapiens
gctgttcaaaagccacagttac

SEQ ID NO: 8139877 - DNA, 21 bp, Homo sapiens
gctgttcccaatcctgggctg

SEQ ID NO: 8139878 - DNA, 22 bp, Homo sapiens
gctgttcccatgtggggctcag

SEQ ID NO: 8139879 - DNA, 22 bp, Homo sapiens
gctgttcctgcttagaggtcgg

SEQ ID NO: 8139880 - DNA, 22 bp, Homo sapiens
gctgttcattagaaatagaatg

SEQ ID NO: 8139881 - DNA, 22 bp, Homo sapiens
caagtattctgtaaaaagtcaa

SEQ ID NO: 8139882 - DNA, 22 bp, Homo sapiens
caagtagagattacagtgtgca

SEQ ID NO: 8139883 - DNA, 22 bp, Homo sapiens
caagtaatggttttataatagt

SEQ ID NO: 8139884 - DNA, 22 bp, Homo sapiens
caagtaattctgcaagaaacca

SEQ ID NO: 8139885 - DNA, 22 bp, Homo sapiens
caaggttttgcttgtaagggaa

SEQ ID NO: 8139886 - DNA, 22 bp, Homo sapiens
caaggttttggaagattttcgt

SEQ ID NO: 8139887 - DNA, 22 bp, Homo sapiens
caagtaaacaatatgtgattca

SEQ ID NO: 8139888 - DNA, 22 bp, Homo sapiens
caaggttattatgtgcatctgt

SEQ ID NO: 8139889 - DNA, 22 bp, Homo sapiens
caaggtttacattgggctatca

SEQ ID NO: 8139890 - DNA, 22 bp, Homo sapiens
caaggtgccatgctgggcgggg

SEQ ID NO: 8139891 - DNA, 22 bp, Homo sapiens
caaggtgccatgctgggcgggg

SEQ ID NO: 8139892 - DNA, 22 bp, Homo sapiens
caaggtgccatgctgggcgggg

SEQ ID NO: 8139893 - DNA, 22 bp, Homo sapiens
caaggtgccatgctgggcgggg

SEQ ID NO: 8139894 - DNA, 22 bp, Homo sapiens
caaggtttacattgggctatca

SEQ ID NO: 8139895 - DNA, 22 bp, Homo sapiens
caaggtttactttatgatccag

SEQ ID NO: 8139896 - DNA, 22 bp, Homo sapiens
caaggtttactttatgatccag

SEQ ID NO: 8139897 - DNA, 22 bp, Homo sapiens
caaggtttctatgctcaaagga

SEQ ID NO: 8139898 - DNA, 22 bp, Homo sapiens
caaggtttcgagttcccaacca

SEQ ID NO: 8139899 - DNA, 22 bp, Homo sapiens
caaggttttggaagattttcgt

SEQ ID NO: 8139900 - DNA, 22 bp, Homo sapiens
caaggttttgcttgtaagggaa

SEQ ID NO: 8139901 - DNA, 22 bp, Homo sapiens
caaggtttgaaaacgccatggc

SEQ ID NO: 8139902 - DNA, 22 bp, Homo sapiens
caaggtttctatgctcaaagga

SEQ ID NO: 8139903 - DNA, 22 bp, Homo sapiens
caaggtttcgagttcccaacca

SEQ ID NO: 8139904 - DNA, 22 bp, Homo sapiens
caaggtttgaaaacgccatggc

SEQ ID NO: 8139905 - DNA, 22 bp, Homo sapiens
caaggtgatacttacattagtg

SEQ ID NO: 8139906 - DNA, 22 bp, Homo sapiens
caaggtgaacttgctgtacagc

SEQ ID NO: 8139907 - DNA, 22 bp, Homo sapiens
caaggtgaacttgctgtacagc

SEQ ID NO: 8139908 - DNA, 22 bp, Homo sapiens
caaggtgccatgctgggcgggg

SEQ ID NO: 8139909 - DNA, 22 bp, Homo sapiens
caaggtgccatgctgggcgggg

SEQ ID NO: 8139910 - DNA, 22 bp, Homo sapiens
caaggtctggttcctctgggtg

SEQ ID NO: 8139911 - DNA, 22 bp, Homo sapiens
caaggtaagcgagagatgaggt

SEQ ID NO: 8139912 - DNA, 20 bp, Homo sapiens
caagggtttgcattggcttt

SEQ ID NO: 8139913 - DNA, 22 bp, Homo sapiens
gctttgattcttggcttatcag

SEQ ID NO: 8139914 - DNA, 22 bp, Homo sapiens
gctttgaagtctgtgtcttttg

SEQ ID NO: 8139915 - DNA, 22 bp, Homo sapiens
gctttgaagacttttccagggt

SEQ ID NO: 8139916 - DNA, 22 bp, Homo sapiens
gctttgaagtctgtgtcttttg

SEQ ID NO: 8139917 - DNA, 22 bp, Homo sapiens
gctttcttcatactcaagcatc

SEQ ID NO: 8139918 - DNA, 22 bp, Homo sapiens
gctttcttgctgcatggtggct

SEQ ID NO: 8139919 - DNA, 22 bp, Homo sapiens
gctttcttcatactcaagcatc

SEQ ID NO: 8139920 - DNA, 22 bp, Homo sapiens
gctttgaagacttttccagggt

SEQ ID NO: 8139921 - DNA, 22 bp, Homo sapiens
caatgtttcttgtaaccagtga

SEQ ID NO: 8139922 - DNA, 22 bp, Homo sapiens
caatgtttgagtaggagcataa

SEQ ID NO: 8139923 - DNA, 22 bp, Homo sapiens
caatgtttgagtaggagcataa

SEQ ID NO: 8139924 - DNA, 22 bp, Homo sapiens
caatgtttactggggacccaga

SEQ ID NO: 8139925 - DNA, 22 bp, Homo sapiens
caatgtgtttgcatattaaaat

SEQ ID NO: 8139926 - DNA, 22 bp, Homo sapiens
caataactgctgaggagaagca

SEQ ID NO: 8139927 - DNA, 22 bp, Homo sapiens
gctttctggttctcaaagcact

SEQ ID NO: 8139928 - DNA, 22 bp, Homo sapiens
gctttctgtaggtagttactgt

SEQ ID NO: 8139929 - DNA, 22 bp, Homo sapiens
gctttcttagtgtgttaattgg

SEQ ID NO: 8139930 - DNA, 21 bp, Homo sapiens
gctttctgtggactctgcacc

SEQ ID NO: 8139931 - DNA, 22 bp, Homo sapiens
caagttttgcatagttctgtat

SEQ ID NO: 8139932 - DNA, 22 bp, Homo sapiens
caagttttgattttgcagtaaa

SEQ ID NO: 8139933 - DNA, 22 bp, Homo sapiens
caataactagtaattattccgg

SEQ ID NO: 8139934 - DNA, 22 bp, Homo sapiens
caataactagtaattattccgg

SEQ ID NO: 8139935 - DNA, 22 bp, Homo sapiens
caataactagtaattattccgg

SEQ ID NO: 8139936 - DNA, 22 bp, Homo sapiens
caataactgctaaattccctgt

SEQ ID NO: 8139937 - DNA, 22 bp, Homo sapiens
caataactgctaaattccctgt

SEQ ID NO: 8139938 - DNA, 22 bp, Homo sapiens
caagtttgtgttctatcattct

SEQ ID NO: 8139939 - DNA, 22 bp, Homo sapiens
caagtttacaatgtgtatgtgt

SEQ ID NO: 8139940 - DNA, 22 bp, Homo sapiens
caagtttactactacctgtgtg

SEQ ID NO: 8139941 - DNA, 22 bp, Homo sapiens
caagttttagcaagtggaaagg

SEQ ID NO: 8139942 - DNA, 22 bp, Homo sapiens
caagttttagaaatatctggat

SEQ ID NO: 8139943 - DNA, 22 bp, Homo sapiens
gctggaggatggactggaagaa

SEQ ID NO: 8139944 - DNA, 22 bp, Homo sapiens
gctggaggatggactggaagaa

SEQ ID NO: 8139945 - DNA, 22 bp, Homo sapiens
gctggaggatggactggaagaa

SEQ ID NO: 8139946 - DNA, 22 bp, Homo sapiens
gctggaggatggactggaagaa

SEQ ID NO: 8139947 - DNA, 22 bp, Homo sapiens
gctggaggatggactggaagaa

SEQ ID NO: 8139948 - DNA, 22 bp, Homo sapiens
gctggaggatggactggaagaa

SEQ ID NO: 8139949 - DNA, 22 bp, Homo sapiens
gctggaggatggactggaagaa

SEQ ID NO: 8139950 - DNA, 22 bp, Homo sapiens
gctggaggatggactggaagaa

SEQ ID NO: 8139951 - DNA, 22 bp, Homo sapiens
gctggaggatcacttgagccca

SEQ ID NO: 8139952 - DNA, 22 bp, Homo sapiens
gctggaggatggactggaagaa

SEQ ID NO: 8139953 - DNA, 22 bp, Homo sapiens
gctggaggatcacttgagccca

SEQ ID NO: 8139954 - DNA, 22 bp, Homo sapiens
gctggaggaggaagtgtgaggg

SEQ ID NO: 8139955 - DNA, 22 bp, Homo sapiens
gctggaggaggaagtgtgaggg

SEQ ID NO: 8139956 - DNA, 22 bp, Homo sapiens
gctggaggaggaagtgtgaggg

SEQ ID NO: 8139957 - DNA, 22 bp, Homo sapiens
gctggaggaggaagtgtgaggg

SEQ ID NO: 8139958 - DNA, 22 bp, Homo sapiens
caagccagtgacagccagggaa

SEQ ID NO: 8139959 - DNA, 22 bp, Homo sapiens
caagccagtgacagccagggaa

SEQ ID NO: 8139960 - DNA, 22 bp, Homo sapiens
caagccagctcctgccacagag

SEQ ID NO: 8139961 - DNA, 22 bp, Homo sapiens
caagccagcttgatgacctgtc

SEQ ID NO: 8139962 - DNA, 22 bp, Homo sapiens
caagccagcttgatgacctgtc

SEQ ID NO: 8139963 - DNA, 22 bp, Homo sapiens
caagccaggaaggatccagcac

SEQ ID NO: 8139964 - DNA, 22 bp, Homo sapiens
caagccagctcctgccacagag

SEQ ID NO: 8139965 - DNA, 22 bp, Homo sapiens
caagccagctcctgccacagag

SEQ ID NO: 8139966 - DNA, 22 bp, Homo sapiens
caagccagtgacagccagggaa

SEQ ID NO: 8139967 - DNA, 20 bp, Homo sapiens
caagccaggccctgctgctg

SEQ ID NO: 8139968 - DNA, 22 bp, Homo sapiens
caagccaggtgaacataacaag

SEQ ID NO: 8139969 - DNA, 22 bp, Homo sapiens
caagcagggatactgcagggag

SEQ ID NO: 8139970 - DNA, 22 bp, Homo sapiens
caagcagggagcatcaagggag

SEQ ID NO: 8139971 - DNA, 22 bp, Homo sapiens
caagcagggtttatgcatggag

SEQ ID NO: 8139972 - DNA, 22 bp, Homo sapiens
caagcagggtttatgcatggag

SEQ ID NO: 8139973 - DNA, 22 bp, Homo sapiens
caagcagggtttatgcatggag

SEQ ID NO: 8139974 - DNA, 21 bp, Homo sapiens
caagccagaccaatagcagcc

SEQ ID NO: 8139975 - DNA, 21 bp, Homo sapiens
caagccagaccaatagcagcc

SEQ ID NO: 8139976 - DNA, 22 bp, Homo sapiens
caagcatactgtgagagtttta

SEQ ID NO: 8139977 - DNA, 22 bp, Homo sapiens
caagcatgtcttcttaagcaat

SEQ ID NO: 8139978 - DNA, 22 bp, Homo sapiens
caagcagggagcatcaagggag

SEQ ID NO: 8139979 - DNA, 22 bp, Homo sapiens
caagcagggatactgcagggag

SEQ ID NO: 8139980 - DNA, 22 bp, Homo sapiens
caagcaggatgaagcccaggga

SEQ ID NO: 8139981 - DNA, 22 bp, Homo sapiens
caagcagccccaacatgaggat

SEQ ID NO: 8139982 - DNA, 22 bp, Homo sapiens
caagcagccccaacatgaggat

SEQ ID NO: 8139983 - DNA, 22 bp, Homo sapiens
caagcagccccaacatgaggat

SEQ ID NO: 8139984 - DNA, 22 bp, Homo sapiens
caagatttaagagtcagccttg

SEQ ID NO: 8139985 - DNA, 22 bp, Homo sapiens
caaatgtattctcacttcaggg

SEQ ID NO: 8139986 - DNA, 22 bp, Homo sapiens
caaatgtattctcacttcaggg

SEQ ID NO: 8139987 - DNA, 22 bp, Homo sapiens
caaatgtgacttttgggcttct

SEQ ID NO: 8139988 - DNA, 22 bp, Homo sapiens
caagattatcttcttcttgtta

SEQ ID NO: 8139989 - DNA, 22 bp, Homo sapiens
caaatgtgtaaggaagtgttag

SEQ ID NO: 8139990 - DNA, 22 bp, Homo sapiens
caaatgtaataaggagtttccc

SEQ ID NO: 8139991 - DNA, 22 bp, Homo sapiens
caaatgtaatggcaggttttgc

SEQ ID NO: 8139992 - DNA, 22 bp, Homo sapiens
caaatgtaatggcaggttttgc

SEQ ID NO: 8139993 - DNA, 22 bp, Homo sapiens
caaatgtaataaggagtttccc

SEQ ID NO: 8139994 - DNA, 22 bp, Homo sapiens
caaatgtaaattcttttgaagc

SEQ ID NO: 8139995 - DNA, 22 bp, Homo sapiens
caaatgtaaattcttttgaagc

SEQ ID NO: 8139996 - DNA, 23 bp, Homo sapiens
caaatgtagtgtgtccacccctg

SEQ ID NO: 8139997 - DNA, 22 bp, Homo sapiens
caaatgtaattgcggtttttgc

SEQ ID NO: 8139998 - DNA, 22 bp, Homo sapiens
caaatgtatcagcccagggatt

SEQ ID NO: 8139999 - DNA, 22 bp, Homo sapiens
caaatgtatgttttcctatgta

SEQ ID NO: 8140000 - DNA, 22 bp, Homo sapiens
caaatgtataaatgtactttct

SEQ ID NO: 8140001 - DNA, 22 bp, Homo sapiens
gctggaggcagttcagacacca

SEQ ID NO: 8140002 - DNA, 22 bp, Homo sapiens
gctggaggcagttcagacacca

SEQ ID NO: 8140003 - DNA, 22 bp, Homo sapiens
gctggaggctggagtgcagtgg

SEQ ID NO: 8140004 - DNA, 22 bp, Homo sapiens
gctggaggctggagtgcagtgg

SEQ ID NO: 8140005 - DNA, 22 bp, Homo sapiens
gctggaggctggagtgcagtgg

SEQ ID NO: 8140006 - DNA, 22 bp, Homo sapiens
gctggaggctggagtgcagtgg

SEQ ID NO: 8140007 - DNA, 22 bp, Homo sapiens
caaggcaggaagcctgtcttat

SEQ ID NO: 8140008 - DNA, 22 bp, Homo sapiens
caaggccaaggttttgtgaact

SEQ ID NO: 8140009 - DNA, 22 bp, Homo sapiens
caaggccaaggttttgtgaact

SEQ ID NO: 8140010 - DNA, 22 bp, Homo sapiens
caaggccaagtctctgtgaaga

SEQ ID NO: 8140011 - DNA, 22 bp, Homo sapiens
caaggccaagtctctgtgaaga

SEQ ID NO: 8140012 - DNA, 22 bp, Homo sapiens
caaggccaagtctctgtgaaga

SEQ ID NO: 8140013 - DNA, 19 bp, Homo sapiens
caaggccaccatttctccg

SEQ ID NO: 8140014 - DNA, 22 bp, Homo sapiens
caaggccactccagagactggt

SEQ ID NO: 8140015 - DNA, 22 bp, Homo sapiens
caaggccacgttctgcatgcgg

SEQ ID NO: 8140016 - DNA, 22 bp, Homo sapiens
caaggccacgttctgcatgcgg

SEQ ID NO: 8140017 - DNA, 19 bp, Homo sapiens
caaggccaccatttctccg

SEQ ID NO: 8140018 - DNA, 22 bp, Homo sapiens
caaggccacgttctgcatgcgg

SEQ ID NO: 8140019 - DNA, 22 bp, Homo sapiens
caaggccactgctcaggtttcc

SEQ ID NO: 8140020 - DNA, 22 bp, Homo sapiens
caaggccactgctcaggtttcc

SEQ ID NO: 8140021 - DNA, 22 bp, Homo sapiens
caaggccactccagagactggt

SEQ ID NO: 8140022 - DNA, 22 bp, Homo sapiens
caaggccactccagagactggt

SEQ ID NO: 8140023 - DNA, 22 bp, Homo sapiens
caaggccagagccagcgataag

SEQ ID NO: 8140024 - DNA, 17 bp, Homo sapiens
caaggccagcatcttca

SEQ ID NO: 8140025 - DNA, 22 bp, Homo sapiens
caaggccagagccagcgataag

SEQ ID NO: 8140026 - DNA, 22 bp, Homo sapiens
caaggccagggaatttttctgg

SEQ ID NO: 8140027 - DNA, 17 bp, Homo sapiens
caaggccagcatcttca

SEQ ID NO: 8140028 - DNA, 22 bp, Homo sapiens
caaggccagggaatttttctgg

SEQ ID NO: 8140029 - DNA, 22 bp, Homo sapiens
caaggccagtccattttggaag

SEQ ID NO: 8140030 - DNA, 22 bp, Homo sapiens
caaggccagtccattttggaag

SEQ ID NO: 8140031 - DNA, 22 bp, Homo sapiens
caaggccataagagatacaaaa

SEQ ID NO: 8140032 - DNA, 22 bp, Homo sapiens
caaggccataagagatacaaaa

SEQ ID NO: 8140033 - DNA, 22 bp, Homo sapiens
caaggccataagagatacaaaa

SEQ ID NO: 8140034 - DNA, 22 bp, Homo sapiens
caaggccagtttctcctagtca

SEQ ID NO: 8140035 - DNA, 22 bp, Homo sapiens
caaggccagtttctcctagtca

SEQ ID NO: 8140036 - DNA, 22 bp, Homo sapiens
caaggccagttcaccaagggca

SEQ ID NO: 8140037 - DNA, 22 bp, Homo sapiens
caaggccagttcaccaagggca

SEQ ID NO: 8140038 - DNA, 22 bp, Homo sapiens
caaggccagttcaccaagggca

SEQ ID NO: 8140039 - DNA, 22 bp, Homo sapiens
caaggccagttcaccaagggca

SEQ ID NO: 8140040 - DNA, 22 bp, Homo sapiens
caaggcctatgcacacctagga

SEQ ID NO: 8140041 - DNA, 22 bp, Homo sapiens
caaggcctgcctctggcagaaa

SEQ ID NO: 8140042 - DNA, 22 bp, Homo sapiens
caaggcctgcctctggcagaaa

SEQ ID NO: 8140043 - DNA, 22 bp, Homo sapiens
caaggccatgagcagcgagtgt

SEQ ID NO: 8140044 - DNA, 22 bp, Homo sapiens
caaggccatgagcagcgagtgt

SEQ ID NO: 8140045 - DNA, 22 bp, Homo sapiens
caaggccatattgcctgtatgt

SEQ ID NO: 8140046 - DNA, 22 bp, Homo sapiens
caaggccatattgcctgtatgt

SEQ ID NO: 8140047 - DNA, 22 bp, Homo sapiens
caaggcctaatcatactgctaa

SEQ ID NO: 8140048 - DNA, 22 bp, Homo sapiens
caagggtgaaggcagaggacat

SEQ ID NO: 8140049 - DNA, 22 bp, Homo sapiens
caaggggttcagaaagaggtga

SEQ ID NO: 8140050 - DNA, 20 bp, Homo sapiens
caagggtttgcattggcttt

SEQ ID NO: 8140051 - DNA, 22 bp, Homo sapiens
caagggtggtattgggagcata

SEQ ID NO: 8140052 - DNA, 22 bp, Homo sapiens
caagggtggtattgggagcata

SEQ ID NO: 8140053 - DNA, 22 bp, Homo sapiens
gctggctgtatcacctggccag

SEQ ID NO: 8140054 - DNA, 21 bp, Homo sapiens
gctggctgtcccagggaagca

SEQ ID NO: 8140055 - DNA, 21 bp, Homo sapiens
gctggctgtcccagggaagca

SEQ ID NO: 8140056 - DNA, 22 bp, Homo sapiens
gctggctgtatcacctggccag

SEQ ID NO: 8140057 - DNA, 22 bp, Homo sapiens
gctggctgtatcacctggccag

SEQ ID NO: 8140058 - DNA, 22 bp, Homo sapiens
gctggctgtatcacctggccag

SEQ ID NO: 8140059 - DNA, 21 bp, Homo sapiens
gctggctgtcccagggaagca

SEQ ID NO: 8140060 - DNA, 22 bp, Homo sapiens
gctggctgggtccctgagaggc

SEQ ID NO: 8140061 - DNA, 22 bp, Homo sapiens
gctggctggtccagcaggggct

SEQ ID NO: 8140062 - DNA, 22 bp, Homo sapiens
gctggctggtccagcaggggct

SEQ ID NO: 8140063 - DNA, 22 bp, Homo sapiens
gctggctgggtccctgagaggc

SEQ ID NO: 8140064 - DNA, 22 bp, Homo sapiens
gctggctgggtccctgagaggc

SEQ ID NO: 8140065 - DNA, 22 bp, Homo sapiens
gctggctgtatcacctggccag

SEQ ID NO: 8140066 - DNA, 22 bp, Homo sapiens
gctggctggtccagcaggggct

SEQ ID NO: 8140067 - DNA, 22 bp, Homo sapiens
gctggctggtccagcaggggct

SEQ ID NO: 8140068 - DNA, 22 bp, Homo sapiens
gctggctggtccagcaggggct

SEQ ID NO: 8140069 - DNA, 22 bp, Homo sapiens
gctggctggctgtgcaaaggca

SEQ ID NO: 8140070 - DNA, 22 bp, Homo sapiens
caaggccttcgtctcctagctt

SEQ ID NO: 8140071 - DNA, 22 bp, Homo sapiens
gctggctggctgtgcaaaggca

SEQ ID NO: 8140072 - DNA, 22 bp, Homo sapiens
gctggctggctgtgcaaaggca

SEQ ID NO: 8140073 - DNA, 22 bp, Homo sapiens
gctggctggctgtgcaaaggca

SEQ ID NO: 8140074 - DNA, 22 bp, Homo sapiens
gctggctgggtccctgagaggc

SEQ ID NO: 8140075 - DNA, 22 bp, Homo sapiens
gctggctgggacagattccatt

SEQ ID NO: 8140076 - DNA, 22 bp, Homo sapiens
gctggctgggtccctgagaggc

SEQ ID NO: 8140077 - DNA, 22 bp, Homo sapiens
gctggctgggacagattccatt

SEQ ID NO: 8140078 - DNA, 22 bp, Homo sapiens
gctggctggctgtgcaaaggca

SEQ ID NO: 8140079 - DNA, 22 bp, Homo sapiens
gctggctgggacagattccatt

SEQ ID NO: 8140080 - DNA, 22 bp, Homo sapiens
gctggctgggacagattccatt

SEQ ID NO: 8140081 - DNA, 22 bp, Homo sapiens
ggctcaggctggagtgcagtgg

SEQ ID NO: 8140082 - DNA, 22 bp, Homo sapiens
ggctcaggctggagtgcagtgg

SEQ ID NO: 8140083 - DNA, 22 bp, Homo sapiens
ggctcaggctggagtgcagtgg

SEQ ID NO: 8140084 - DNA, 18 bp, Homo sapiens
ggctcaggctatcctaac

SEQ ID NO: 8140085 - DNA, 18 bp, Homo sapiens
ggctcaggctatcctaac

SEQ ID NO: 8140086 - DNA, 22 bp, Homo sapiens
ggctcaggctggagtgcagtgg

SEQ ID NO: 8140087 - DNA, 22 bp, Homo sapiens
ggctcagggaatgaggaagaat

SEQ ID NO: 8140088 - DNA, 22 bp, Homo sapiens
ggctcaggctggagtgcagtgg

SEQ ID NO: 8140089 - DNA, 22 bp, Homo sapiens
ggctcaggctggagtgcagtgg

SEQ ID NO: 8140090 - DNA, 22 bp, Homo sapiens
ggctcaggctggagtgcagtgg

SEQ ID NO: 8140091 - DNA, 19 bp, Homo sapiens
ggctcagggcgctgccgcc

SEQ ID NO: 8140092 - DNA, 19 bp, Homo sapiens
ggctcagggcgctgccgcc

SEQ ID NO: 8140093 - DNA, 22 bp, Homo sapiens
ggctcaggggccaggcctgtcc

SEQ ID NO: 8140094 - DNA, 22 bp, Homo sapiens
ggctcaggggccaggcctgtcc

SEQ ID NO: 8140095 - DNA, 22 bp, Homo sapiens
ggctcaggggccaggcctgtcc

SEQ ID NO: 8140096 - DNA, 19 bp, Homo sapiens
ggctcagggcgctgccgcc

SEQ ID NO: 8140097 - DNA, 19 bp, Homo sapiens
ggctcagggcgctgccgcc

SEQ ID NO: 8140098 - DNA, 19 bp, Homo sapiens
ggctcagggcgctgccgcc

SEQ ID NO: 8140099 - DNA, 22 bp, Homo sapiens
ggctcagggaatgaggaagaat

SEQ ID NO: 8140100 - DNA, 22 bp, Homo sapiens
ggctcagggaatgaggaagaat

SEQ ID NO: 8140101 - DNA, 22 bp, Homo sapiens
ggctcagggaatgaggaagaat

SEQ ID NO: 8140102 - DNA, 22 bp, Homo sapiens
ggctcagggaatgaggaagaat

SEQ ID NO: 8140103 - DNA, 22 bp, Homo sapiens
ggctcagggaatgaggaagaat

SEQ ID NO: 8140104 - DNA, 19 bp, Homo sapiens
ggcctgtgcagagcccgtc

SEQ ID NO: 8140105 - DNA, 22 bp, Homo sapiens
ggcctgtgctgagaacctggct

SEQ ID NO: 8140106 - DNA, 22 bp, Homo sapiens
ggcctgtgctgtcagccctagt

SEQ ID NO: 8140107 - DNA, 22 bp, Homo sapiens
ggcctgtgtcctccttgccctg

SEQ ID NO: 8140108 - DNA, 22 bp, Homo sapiens
ggcctgtgtctgtgcctgtcct

SEQ ID NO: 8140109 - DNA, 22 bp, Homo sapiens
ggctcaatgcaacttctgcctc

SEQ ID NO: 8140110 - DNA, 22 bp, Homo sapiens
ggcctgtgtctgtgcctgtcct

SEQ ID NO: 8140111 - DNA, 17 bp, Homo sapiens
ggcctgtgtggctgcag

SEQ ID NO: 8140112 - DNA, 22 bp, Homo sapiens
ggcctgaggcgtcccagctgtg

SEQ ID NO: 8140113 - DNA, 22 bp, Homo sapiens
ggcctgaggcgtcccagctgtg

SEQ ID NO: 8140114 - DNA, 22 bp, Homo sapiens
ggcctgaggcgtcccagctgtg

SEQ ID NO: 8140115 - DNA, 22 bp, Homo sapiens
ggcctgggctccgggagttact

SEQ ID NO: 8140116 - DNA, 22 bp, Homo sapiens
ggcctgggctccgggagttact

SEQ ID NO: 8140117 - DNA, 22 bp, Homo sapiens
ggcctgggctccgggagttact

SEQ ID NO: 8140118 - DNA, 22 bp, Homo sapiens
ggcctgaggccaccagcagccc

SEQ ID NO: 8140119 - DNA, 22 bp, Homo sapiens
ggcctgaggccaccagcagccc

SEQ ID NO: 8140120 - DNA, 19 bp, Homo sapiens
ggcctgaggccacagatcc

SEQ ID NO: 8140121 - DNA, 22 bp, Homo sapiens
ggcctgaggccaccagcagccc

SEQ ID NO: 8140122 - DNA, 22 bp, Homo sapiens
ggcctgtaatcccagctactca

SEQ ID NO: 8140123 - DNA, 22 bp, Homo sapiens
ggcctgtccagcctgcctggct

SEQ ID NO: 8140124 - DNA, 22 bp, Homo sapiens
ggcctgtccagcctgcctggct

SEQ ID NO: 8140125 - DNA, 22 bp, Homo sapiens
ggcctgtgagaatcaaggaaaa

SEQ ID NO: 8140126 - DNA, 22 bp, Homo sapiens
ggcctgtctcacccccgggtgc

SEQ ID NO: 8140127 - DNA, 22 bp, Homo sapiens
ggcctgtgcacatgtgcaggaa

SEQ ID NO: 8140128 - DNA, 22 bp, Homo sapiens
ggcctgtgcacatgtgcaggaa

SEQ ID NO: 8140129 - DNA, 22 bp, Homo sapiens
ggcctgtgagcccttgcatgta

SEQ ID NO: 8140130 - DNA, 22 bp, Homo sapiens
ggcctctctccttggcttgcag

SEQ ID NO: 8140131 - DNA, 22 bp, Homo sapiens
ggcctctctccctggcttgcag

SEQ ID NO: 8140132 - DNA, 22 bp, Homo sapiens
ggcctgagcagacagcatgatg

SEQ ID NO: 8140133 - DNA, 22 bp, Homo sapiens
ggcctgagcagacagcatgatg

SEQ ID NO: 8140134 - DNA, 22 bp, Homo sapiens
ggcctgagcagacagcatgatg

SEQ ID NO: 8140135 - DNA, 22 bp, Homo sapiens
ggcctgagcagacagcatgatg

SEQ ID NO: 8140136 - DNA, 20 bp, Homo sapiens
ggcctgagcatggctggcag

SEQ ID NO: 8140137 - DNA, 20 bp, Homo sapiens
ggcctgagcatggctggcag

SEQ ID NO: 8140138 - DNA, 20 bp, Homo sapiens
ggcctgagcatggctggcag

SEQ ID NO: 8140139 - DNA, 20 bp, Homo sapiens
ggcctgagcatggctggcag

SEQ ID NO: 8140140 - DNA, 20 bp, Homo sapiens
ggcctgagcatggctggcag

SEQ ID NO: 8140141 - DNA, 22 bp, Homo sapiens
ggcctgagcttgggcagcgtat

SEQ ID NO: 8140142 - DNA, 22 bp, Homo sapiens
ggcctgagcttgggcagcgtat

SEQ ID NO: 8140143 - DNA, 22 bp, Homo sapiens
ggcctgagcttgggcagcgtat

SEQ ID NO: 8140144 - DNA, 22 bp, Homo sapiens
ggcctgagctctggggaggcaa

SEQ ID NO: 8140145 - DNA, 22 bp, Homo sapiens
ggcctgagctctggggaggcaa

SEQ ID NO: 8140146 - DNA, 22 bp, Homo sapiens
ggcctgaggcaatagtcagaca

SEQ ID NO: 8140147 - DNA, 22 bp, Homo sapiens
ggcctgagcttgggcagcgtat

SEQ ID NO: 8140148 - DNA, 19 bp, Homo sapiens
ggcctgaggccacagatcc

SEQ ID NO: 8140149 - DNA, 22 bp, Homo sapiens
ggcctgaggcaatagtcagaca

SEQ ID NO: 8140150 - DNA, 22 bp, Homo sapiens
ggcctgaggcaatagtcagaca

SEQ ID NO: 8140151 - DNA, 22 bp, Homo sapiens
ggctcaggttgggtcacatgac

SEQ ID NO: 8140152 - DNA, 22 bp, Homo sapiens
ggctcaggttaccagtccctcc

SEQ ID NO: 8140153 - DNA, 22 bp, Homo sapiens
ggctcaggttgggtcacatgac

SEQ ID NO: 8140154 - DNA, 22 bp, Homo sapiens
ggctcaggttaccagtccctcc

SEQ ID NO: 8140155 - DNA, 22 bp, Homo sapiens
ggctcaggttaccagtccctcc

SEQ ID NO: 8140156 - DNA, 22 bp, Homo sapiens
ggctcaggtttaaagtgcttta

SEQ ID NO: 8140157 - DNA, 22 bp, Homo sapiens
ggctcaggttgggtcacatgac

SEQ ID NO: 8140158 - DNA, 22 bp, Homo sapiens
ggctccagggtacccctggatg

SEQ ID NO: 8140159 - DNA, 22 bp, Homo sapiens
ggctccagggtacccctggatg

SEQ ID NO: 8140160 - DNA, 22 bp, Homo sapiens
ggctccagggtacccctggatg

SEQ ID NO: 8140161 - DNA, 22 bp, Homo sapiens
ggctccagggtctctccttgtg

SEQ ID NO: 8140162 - DNA, 22 bp, Homo sapiens
ggctccagggtctctccttgtg

SEQ ID NO: 8140163 - DNA, 22 bp, Homo sapiens
ggctccaggtacgtatgggagg

SEQ ID NO: 8140164 - DNA, 22 bp, Homo sapiens
ggctccaggtgcatgccaggct

SEQ ID NO: 8140165 - DNA, 22 bp, Homo sapiens
ggctccaggtacgtatgggagg

SEQ ID NO: 8140166 - DNA, 22 bp, Homo sapiens
ggctccaggtgcatgccaggct

SEQ ID NO: 8140167 - DNA, 22 bp, Homo sapiens
ggctctggtgagggtaggagat

SEQ ID NO: 8140168 - DNA, 22 bp, Homo sapiens
ggctctggtcagtgaggggcct

SEQ ID NO: 8140169 - DNA, 22 bp, Homo sapiens
ggctctggtcagtgaggggcct

SEQ ID NO: 8140170 - DNA, 22 bp, Homo sapiens
ggctctggaatgtgtagtcagg

SEQ ID NO: 8140171 - DNA, 22 bp, Homo sapiens
ggctctggaatgtgtagtcagg

SEQ ID NO: 8140172 - DNA, 22 bp, Homo sapiens
ggctctggtcagtgaggggcct

SEQ ID NO: 8140173 - DNA, 22 bp, Homo sapiens
ggctctgggttctgcaatgcgt

SEQ ID NO: 8140174 - DNA, 22 bp, Homo sapiens
ggctccaggtgcatgccaggct

SEQ ID NO: 8140175 - DNA, 22 bp, Homo sapiens
ggctccaggtttaagggtatgt

SEQ ID NO: 8140176 - DNA, 22 bp, Homo sapiens
ggctccaggtgcatgccaggct

SEQ ID NO: 8140177 - DNA, 22 bp, Homo sapiens
ggctccaggtgcatgccaggct

SEQ ID NO: 8140178 - DNA, 22 bp, Homo sapiens
ggctccaggtgcatgccaggct

SEQ ID NO: 8140179 - DNA, 22 bp, Homo sapiens
ggctccaggtgcatgccaggct

SEQ ID NO: 8140180 - DNA, 22 bp, Homo sapiens
ggctccagtttccccttggggc

SEQ ID NO: 8140181 - DNA, 20 bp, Homo sapiens
ggctctggaatctggtgggc

SEQ ID NO: 8140182 - DNA, 18 bp, Homo sapiens
ggctccagtcttcagtgg

SEQ ID NO: 8140183 - DNA, 18 bp, Homo sapiens
ggctccagtcttcagtgg

SEQ ID NO: 8140184 - DNA, 18 bp, Homo sapiens
ggctccagtcttcagtgg

SEQ ID NO: 8140185 - DNA, 22 bp, Homo sapiens
ggctctggtgggaaggttagat

SEQ ID NO: 8140186 - DNA, 22 bp, Homo sapiens
ggctctggtgggaaggttagat

SEQ ID NO: 8140187 - DNA, 22 bp, Homo sapiens
ggctctggtgggaaggttagat

SEQ ID NO: 8140188 - DNA, 22 bp, Homo sapiens
ggctctggtggcaattgactgg

SEQ ID NO: 8140189 - DNA, 22 bp, Homo sapiens
ggctgagccccctctgcgtagg

SEQ ID NO: 8140190 - DNA, 22 bp, Homo sapiens
ggctgagccccctctgcgtagg

SEQ ID NO: 8140191 - DNA, 22 bp, Homo sapiens
ggctgagccccctctgcgtagg

SEQ ID NO: 8140192 - DNA, 22 bp, Homo sapiens
ggctgagccccctctgcgtagg

SEQ ID NO: 8140193 - DNA, 22 bp, Homo sapiens
ggctctggtgtgaagcagcctc

SEQ ID NO: 8140194 - DNA, 22 bp, Homo sapiens
ggctctggtgtgaagcagcctc

SEQ ID NO: 8140195 - DNA, 22 bp, Homo sapiens
ggctctggtgggaaggttagat

SEQ ID NO: 8140196 - DNA, 22 bp, Homo sapiens
ggctctggtgagggtaggagat

SEQ ID NO: 8140197 - DNA, 22 bp, Homo sapiens
ggctctggtgagggtaggagat

SEQ ID NO: 8140198 - DNA, 22 bp, Homo sapiens
ggctctggtgagggtaggagat

SEQ ID NO: 8140199 - DNA, 22 bp, Homo sapiens
ggctctggtgagggtaggagat

SEQ ID NO: 8140200 - DNA, 22 bp, Homo sapiens
ggctctggtgagggtaggagat

SEQ ID NO: 8140201 - DNA, 22 bp, Homo sapiens
ggctctggtgagggtaggagat

SEQ ID NO: 8140202 - DNA, 22 bp, Homo sapiens
ggctctggtgccctggctccca

SEQ ID NO: 8140203 - DNA, 22 bp, Homo sapiens
ggctctggtgccctggctccca

SEQ ID NO: 8140204 - DNA, 22 bp, Homo sapiens
ggctctggtgccctggctccca

SEQ ID NO: 8140205 - DNA, 22 bp, Homo sapiens
ggctctggtgccctggctccca

SEQ ID NO: 8140206 - DNA, 22 bp, Homo sapiens
ggctctggtgccctggctccca

SEQ ID NO: 8140207 - DNA, 22 bp, Homo sapiens
ggctgaggctcatgccatcttg

SEQ ID NO: 8140208 - DNA, 22 bp, Homo sapiens
ggctgaggcggcgatgcccttg

SEQ ID NO: 8140209 - DNA, 22 bp, Homo sapiens
ggctgaggcggcgatgcccttg

SEQ ID NO: 8140210 - DNA, 22 bp, Homo sapiens
ggctgaggcggcgatgcccttg

SEQ ID NO: 8140211 - DNA, 22 bp, Homo sapiens
ggctgaggcggcgatgcccttg

SEQ ID NO: 8140212 - DNA, 22 bp, Homo sapiens
ggctgagcttttcatgatggtt

SEQ ID NO: 8140213 - DNA, 22 bp, Homo sapiens
ggctgaggcggcgatgcccttg

SEQ ID NO: 8140214 - DNA, 22 bp, Homo sapiens
ggctgagcttatatatgtgctg

SEQ ID NO: 8140215 - DNA, 22 bp, Homo sapiens
ggctgagctccaagtattccat

SEQ ID NO: 8140216 - DNA, 22 bp, Homo sapiens
ggctgagcttatatatgtgctg

SEQ ID NO: 8140217 - DNA, 22 bp, Homo sapiens
ggctgagcgtggctgccgtggg

SEQ ID NO: 8140218 - DNA, 22 bp, Homo sapiens
ggctgagcggactggggtccct

SEQ ID NO: 8140219 - DNA, 22 bp, Homo sapiens
ggctgagcgtggctgccgtggg

SEQ ID NO: 8140220 - DNA, 19 bp, Homo sapiens
ggctgagcgccttggctgc

SEQ ID NO: 8140221 - DNA, 19 bp, Homo sapiens
ggctgagcgccttggctgc

SEQ ID NO: 8140222 - DNA, 22 bp, Homo sapiens
ggctgagctcaggggcagcagg

SEQ ID NO: 8140223 - DNA, 22 bp, Homo sapiens
ggctgagctcaggggcagcagg

SEQ ID NO: 8140224 - DNA, 22 bp, Homo sapiens
ggctgagctcaggggcagcagg

SEQ ID NO: 8140225 - DNA, 22 bp, Homo sapiens
ggctgagcctggagcatctggt

SEQ ID NO: 8140226 - DNA, 22 bp, Homo sapiens
ggctgagcctggagcatctggt

SEQ ID NO: 8140227 - DNA, 22 bp, Homo sapiens
ggctgagcctggagcatctggt

SEQ ID NO: 8140228 - DNA, 19 bp, Homo sapiens
ggctgagcgccttggctgc

SEQ ID NO: 8140229 - DNA, 22 bp, Homo sapiens
ggctgagcctggagcatctggt

SEQ ID NO: 8140230 - DNA, 23 bp, Homo sapiens
cagaaataaactggtttgtagat

SEQ ID NO: 8140231 - DNA, 23 bp, Homo sapiens
cagaaataaactggtttgtagat

SEQ ID NO: 8140232 - DNA, 22 bp, Homo sapiens
cagaaataaacttctcacatcg

SEQ ID NO: 8140233 - DNA, 22 bp, Homo sapiens
ggctgggaggatgacttgctac

SEQ ID NO: 8140234 - DNA, 22 bp, Homo sapiens
ggctgggaggatgacttgctac

SEQ ID NO: 8140235 - DNA, 22 bp, Homo sapiens
ggctgggaggatgacttgctac

SEQ ID NO: 8140236 - DNA, 22 bp, Homo sapiens
cagaaatacccagcatttggag

SEQ ID NO: 8140237 - DNA, 22 bp, Homo sapiens
ggctgggaggatgacttgctac

SEQ ID NO: 8140238 - DNA, 22 bp, Homo sapiens
cagaaataaagtggacagagta

SEQ ID NO: 8140239 - DNA, 18 bp, Homo sapiens
cagaaagttatttactct

SEQ ID NO: 8140240 - DNA, 23 bp, Homo sapiens
cagaaagtttgagaagatacatc

SEQ ID NO: 8140241 - DNA, 22 bp, Homo sapiens
cagaaagtgatttgctattcca

SEQ ID NO: 8140242 - DNA, 18 bp, Homo sapiens
cagaaagttatttactct

SEQ ID NO: 8140243 - DNA, 22 bp, Homo sapiens
ggctgtccttggccaaggcact

SEQ ID NO: 8140244 - DNA, 22 bp, Homo sapiens
ggctgtaggttggtgctggaca

SEQ ID NO: 8140245 - DNA, 22 bp, Homo sapiens
ggctgtaggttggtgctggaca

SEQ ID NO: 8140246 - DNA, 22 bp, Homo sapiens
ggctgtagttacctgatgaaat

SEQ ID NO: 8140247 - DNA, 22 bp, Homo sapiens
ggctgtagtcagtgacatggta

SEQ ID NO: 8140248 - DNA, 21 bp, Homo sapiens
ggctggtgtttagctgtgata

SEQ ID NO: 8140249 - DNA, 21 bp, Homo sapiens
ggctggtgtttagctgtgata

SEQ ID NO: 8140250 - DNA, 21 bp, Homo sapiens
ggctggtgtttagctgtgata

SEQ ID NO: 8140251 - DNA, 22 bp, Homo sapiens
ggctggttttcagttactgagt

SEQ ID NO: 8140252 - DNA, 22 bp, Homo sapiens
ggctggtgttgagtgcctgtag

SEQ ID NO: 8140253 - DNA, 22 bp, Homo sapiens
ggctggtgttgagtgcctgtag

SEQ ID NO: 8140254 - DNA, 22 bp, Homo sapiens
ggctggtgttgagtgcctgtag

SEQ ID NO: 8140255 - DNA, 22 bp, Homo sapiens
ggctggtgttacagtcggcagc

SEQ ID NO: 8140256 - DNA, 22 bp, Homo sapiens
ggctggtgttacagtcggcagc

SEQ ID NO: 8140257 - DNA, 22 bp, Homo sapiens
ggctgtgaaccctggcagtgtg

SEQ ID NO: 8140258 - DNA, 22 bp, Homo sapiens
ggctgtgaaccctggcagtgtg

SEQ ID NO: 8140259 - DNA, 22 bp, Homo sapiens
ggctgtgaaccctggcagtgtg

SEQ ID NO: 8140260 - DNA, 22 bp, Homo sapiens
ggctgtgaagtagcaggggcag

SEQ ID NO: 8140261 - DNA, 22 bp, Homo sapiens
ggctgtgttccaagtgtcagga

SEQ ID NO: 8140262 - DNA, 22 bp, Homo sapiens
ggctgtgaagtagcaggggcag

SEQ ID NO: 8140263 - DNA, 22 bp, Homo sapiens
ggctgtctctgtgactgccacc

SEQ ID NO: 8140264 - DNA, 22 bp, Homo sapiens
ggctgtctctgtgactgccacc

SEQ ID NO: 8140265 - DNA, 22 bp, Homo sapiens
ggctgttcctctaacattgcag

SEQ ID NO: 8140266 - DNA, 22 bp, Homo sapiens
ggctgttcctctgagagctgat

SEQ ID NO: 8140267 - DNA, 22 bp, Homo sapiens
cagaaaagggtgtttgttcagg

SEQ ID NO: 8140268 - DNA, 22 bp, Homo sapiens
cagaaaataaagtttctacgca

SEQ ID NO: 8140269 - DNA, 20 bp, Homo sapiens
ggctgcccactccagagtac

SEQ ID NO: 8140270 - DNA, 20 bp, Homo sapiens
ggctgcccactccagagtac

SEQ ID NO: 8140271 - DNA, 22 bp, Homo sapiens
ggctgccataacagagtaccac

SEQ ID NO: 8140272 - DNA, 22 bp, Homo sapiens
ggctgccataacagagtaccac

SEQ ID NO: 8140273 - DNA, 22 bp, Homo sapiens
ggctgccataactgataccata

SEQ ID NO: 8140274 - DNA, 22 bp, Homo sapiens
ggctgccataactgataccata

SEQ ID NO: 8140275 - DNA, 22 bp, Homo sapiens
ggctgccccagtgctcatggct

SEQ ID NO: 8140276 - DNA, 22 bp, Homo sapiens
ggctgccccagtgctcatggct

SEQ ID NO: 8140277 - DNA, 22 bp, Homo sapiens
cactttgtgtgggatcaggggt

SEQ ID NO: 8140278 - DNA, 22 bp, Homo sapiens
cactttggttcacctgagtttc

SEQ ID NO: 8140279 - DNA, 22 bp, Homo sapiens
cactttggtagctgttttggga

SEQ ID NO: 8140280 - DNA, 17 bp, Homo sapiens
cactttgttgctgtggg

SEQ ID NO: 8140281 - DNA, 22 bp, Homo sapiens
cacttttaacaggagaattccc

SEQ ID NO: 8140282 - DNA, 22 bp, Homo sapiens
cacttttaaatgggtccgtgtt

SEQ ID NO: 8140283 - DNA, 21 bp, Homo sapiens
cactttaatggatatttgttt

SEQ ID NO: 8140284 - DNA, 21 bp, Homo sapiens
cactttaatggatatttgttt

SEQ ID NO: 8140285 - DNA, 21 bp, Homo sapiens
cactttaatggatatttgttt

SEQ ID NO: 8140286 - DNA, 21 bp, Homo sapiens
cactttaatggatatttgttt

SEQ ID NO: 8140287 - DNA, 22 bp, Homo sapiens
cactttgggtttatgtcaatca

SEQ ID NO: 8140288 - DNA, 22 bp, Homo sapiens
cactttggggtatgacaagttt

SEQ ID NO: 8140289 - DNA, 23 bp, Homo sapiens
cagaaaacccagagctcagtccc

SEQ ID NO: 8140290 - DNA, 22 bp, Homo sapiens
cagaaaacaaacctatcctgag

SEQ ID NO: 8140291 - DNA, 22 bp, Homo sapiens
cagaaaacaaacctatcctgag

SEQ ID NO: 8140292 - DNA, 22 bp, Homo sapiens
ggctgccctgggaggcaagggt

SEQ ID NO: 8140293 - DNA, 22 bp, Homo sapiens
ggctgccctgggaggcaagggt

SEQ ID NO: 8140294 - DNA, 22 bp, Homo sapiens
ggctgcctactttcccagagtt

SEQ ID NO: 8140295 - DNA, 22 bp, Homo sapiens
ggctgccctcgtctactgccca

SEQ ID NO: 8140296 - DNA, 22 bp, Homo sapiens
ggctgccctagagctggcaagg

SEQ ID NO: 8140297 - DNA, 22 bp, Homo sapiens
ggctgccctcggggtcgcaggc

SEQ ID NO: 8140298 - DNA, 22 bp, Homo sapiens
cagaaacatgtataaagttgta

SEQ ID NO: 8140299 - DNA, 22 bp, Homo sapiens
cagaaacatgtataaagttgta

SEQ ID NO: 8140300 - DNA, 22 bp, Homo sapiens
ggctgcctactttcccagagtt

SEQ ID NO: 8140301 - DNA, 22 bp, Homo sapiens
ggctgcctcaaagctcaagctc

SEQ ID NO: 8140302 - DNA, 22 bp, Homo sapiens
ggctgcctcaaagctcaagctc

SEQ ID NO: 8140303 - DNA, 22 bp, Homo sapiens
cagaaagcgggatgcagcatgt

SEQ ID NO: 8140304 - DNA, 22 bp, Homo sapiens
cagaaagcgggatgcagcatgt

SEQ ID NO: 8140305 - DNA, 22 bp, Homo sapiens
cagaaagccgacttacaatgga

SEQ ID NO: 8140306 - DNA, 22 bp, Homo sapiens
cagaaagcagttgtcaatgggc

SEQ ID NO: 8140307 - DNA, 22 bp, Homo sapiens
cacatacatgcacacctaaata

SEQ ID NO: 8140308 - DNA, 22 bp, Homo sapiens
cacatacatgcacacctaaata

SEQ ID NO: 8140309 - DNA, 22 bp, Homo sapiens
cacatactgagaatcacaccca

SEQ ID NO: 8140310 - DNA, 22 bp, Homo sapiens
cacatacttgtgtgtacatatg

SEQ ID NO: 8140311 - DNA, 22 bp, Homo sapiens
cacatacatacgtatgtataca

SEQ ID NO: 8140312 - DNA, 19 bp, Homo sapiens
cacatacagaaaagagtaa

SEQ ID NO: 8140313 - DNA, 22 bp, Homo sapiens
cacatacaatggtgttatttgg

SEQ ID NO: 8140314 - DNA, 22 bp, Homo sapiens
cacatacatacgtatgtataca

SEQ ID NO: 8140315 - DNA, 22 bp, Homo sapiens
cacatacatacgtatgtataca

SEQ ID NO: 8140316 - DNA, 22 bp, Homo sapiens
cacatacaaggcacactggagg

SEQ ID NO: 8140317 - DNA, 22 bp, Homo sapiens
cacatacaaggcacactggagg

SEQ ID NO: 8140318 - DNA, 22 bp, Homo sapiens
cacataatacatgttccactta

SEQ ID NO: 8140319 - DNA, 22 bp, Homo sapiens
cacataattgaacgtgatgagt

SEQ ID NO: 8140320 - DNA, 22 bp, Homo sapiens
cacataagaaatgaatatgaga

SEQ ID NO: 8140321 - DNA, 22 bp, Homo sapiens
cacataaatggtgccatgtttt

SEQ ID NO: 8140322 - DNA, 22 bp, Homo sapiens
cacagttttgcccagggcttct

SEQ ID NO: 8140323 - DNA, 22 bp, Homo sapiens
cacagttttgtcttggtttcca

SEQ ID NO: 8140324 - DNA, 22 bp, Homo sapiens
cacagttttgtcttggtttcca

SEQ ID NO: 8140325 - DNA, 22 bp, Homo sapiens
cacagttttatcttatactgat

SEQ ID NO: 8140326 - DNA, 22 bp, Homo sapiens
cacagtgttccagagcagtggt

SEQ ID NO: 8140327 - DNA, 22 bp, Homo sapiens
ggaggtggaggttgcagtgagc

SEQ ID NO: 8140328 - DNA, 22 bp, Homo sapiens
cacagtgtgggcatggtgcctg

SEQ ID NO: 8140329 - DNA, 22 bp, Homo sapiens
cacagtgtgggcatggtgcctg

SEQ ID NO: 8140330 - DNA, 22 bp, Homo sapiens
ggaggtgctggcggccagctct

SEQ ID NO: 8140331 - DNA, 22 bp, Homo sapiens
ggaggtgctggcggccagctct

SEQ ID NO: 8140332 - DNA, 22 bp, Homo sapiens
ggaggtggagctggaagttcca

SEQ ID NO: 8140333 - DNA, 22 bp, Homo sapiens
ggaggtggagctggaagttcca

SEQ ID NO: 8140334 - DNA, 22 bp, Homo sapiens
ggaggtggaggttgcaatgagc

SEQ ID NO: 8140335 - DNA, 22 bp, Homo sapiens
ggaggtggaggttgcaatgagc

SEQ ID NO: 8140336 - DNA, 22 bp, Homo sapiens
ggaggtggaggttgcaatgagc

SEQ ID NO: 8140337 - DNA, 22 bp, Homo sapiens
ggaggtggaggttgcaatgagc

SEQ ID NO: 8140338 - DNA, 22 bp, Homo sapiens
ggaggtggaggttgcaatgagc

SEQ ID NO: 8140339 - DNA, 22 bp, Homo sapiens
cacagggaaccaaggctgggcc

SEQ ID NO: 8140340 - DNA, 22 bp, Homo sapiens
cacagggaaccaaggctgggcc

SEQ ID NO: 8140341 - DNA, 22 bp, Homo sapiens
ggaggtgacgaaaagaaattgt

SEQ ID NO: 8140342 - DNA, 22 bp, Homo sapiens
ggaggtgactggatcatgggca

SEQ ID NO: 8140343 - DNA, 22 bp, Homo sapiens
ggaggtgaggccgtagggtgtg

SEQ ID NO: 8140344 - DNA, 22 bp, Homo sapiens
ggaggtgatcagagttttgagg

SEQ ID NO: 8140345 - DNA, 22 bp, Homo sapiens
ggaggtgcagagtagggttggt

SEQ ID NO: 8140346 - DNA, 22 bp, Homo sapiens
ggaggtgcagagtagggttggt

SEQ ID NO: 8140347 - DNA, 22 bp, Homo sapiens
ggaggtgctggcggccagctct

SEQ ID NO: 8140348 - DNA, 22 bp, Homo sapiens
ggaggtgctgatcccagtcaac

SEQ ID NO: 8140349 - DNA, 22 bp, Homo sapiens
ggaggtgctgatcccagtcaac

SEQ ID NO: 8140350 - DNA, 22 bp, Homo sapiens
cacatttacttttatcccttgg

SEQ ID NO: 8140351 - DNA, 22 bp, Homo sapiens
cacatttacttttatcccttgg

SEQ ID NO: 8140352 - DNA, 22 bp, Homo sapiens
cacatttagaggttagcatggt

SEQ ID NO: 8140353 - DNA, 22 bp, Homo sapiens
cacatttagaggttagcatggt

SEQ ID NO: 8140354 - DNA, 22 bp, Homo sapiens
cacatttagaggttagcatggt

SEQ ID NO: 8140355 - DNA, 22 bp, Homo sapiens
cacatttaggaggtggggaagc

SEQ ID NO: 8140356 - DNA, 22 bp, Homo sapiens
cacatttagaggttagcatggt

SEQ ID NO: 8140357 - DNA, 22 bp, Homo sapiens
cacatttaggttcctatagcca

SEQ ID NO: 8140358 - DNA, 22 bp, Homo sapiens
cacatttaggttcctatagcca

SEQ ID NO: 8140359 - DNA, 22 bp, Homo sapiens
cacatttaggaggtggggaagc

SEQ ID NO: 8140360 - DNA, 22 bp, Homo sapiens
cacatttaggttcctatagcca

SEQ ID NO: 8140361 - DNA, 22 bp, Homo sapiens
cacatttatctctctccggtga

SEQ ID NO: 8140362 - DNA, 22 bp, Homo sapiens
cacatttatctgttctttctag

SEQ ID NO: 8140363 - DNA, 22 bp, Homo sapiens
cacatttatctgttctttctag

SEQ ID NO: 8140364 - DNA, 22 bp, Homo sapiens
cacatttatctgttctttctag

SEQ ID NO: 8140365 - DNA, 22 bp, Homo sapiens
cacatttatctgttctttctag

SEQ ID NO: 8140366 - DNA, 22 bp, Homo sapiens
cacatttatttgaggctaattg

SEQ ID NO: 8140367 - DNA, 22 bp, Homo sapiens
cacatttatgggctgggaggca

SEQ ID NO: 8140368 - DNA, 22 bp, Homo sapiens
cacatttaattggtttagggtg

SEQ ID NO: 8140369 - DNA, 22 bp, Homo sapiens
cacatttacatataaaactttc

SEQ ID NO: 8140370 - DNA, 22 bp, Homo sapiens
cacatttacatataaaactttc

SEQ ID NO: 8140371 - DNA, 18 bp, Homo sapiens
cacatttacctggctccc

SEQ ID NO: 8140372 - DNA, 18 bp, Homo sapiens
cacatttacctggctccc

SEQ ID NO: 8140373 - DNA, 22 bp, Homo sapiens
cacatataacctagacaaggcc

SEQ ID NO: 8140374 - DNA, 22 bp, Homo sapiens
cacatataccagccgcggtacg

SEQ ID NO: 8140375 - DNA, 22 bp, Homo sapiens
cacatatacctcttcttgagtt

SEQ ID NO: 8140376 - DNA, 22 bp, Homo sapiens
cacatatatgaaatgaggaatt

SEQ ID NO: 8140377 - DNA, 23 bp, Homo sapiens
cacatatagcagccactaaggtc

SEQ ID NO: 8140378 - DNA, 22 bp, Homo sapiens
cacatatatgaaatgaggaatt

SEQ ID NO: 8140379 - DNA, 23 bp, Homo sapiens
cacatatagcagccactaaggtc

SEQ ID NO: 8140380 - DNA, 22 bp, Homo sapiens
ggcaggcatggggtctgccatt

SEQ ID NO: 8140381 - DNA, 22 bp, Homo sapiens
ggcaggcatggggtctgccatt

SEQ ID NO: 8140382 - DNA, 20 bp, Homo sapiens
ggcagggagggatactgagg

SEQ ID NO: 8140383 - DNA, 22 bp, Homo sapiens
ggcaggcatggggtctgccatt

SEQ ID NO: 8140384 - DNA, 22 bp, Homo sapiens
ggcaggcatggggtctgccatt

SEQ ID NO: 8140385 - DNA, 22 bp, Homo sapiens
ggcaggcatggccactccctag

SEQ ID NO: 8140386 - DNA, 22 bp, Homo sapiens
ggcaggcatggggtctgccatt

SEQ ID NO: 8140387 - DNA, 22 bp, Homo sapiens
ggcaggcatcatgtggtcatta

SEQ ID NO: 8140388 - DNA, 22 bp, Homo sapiens
ggcaggcatcatgtggtcatta

SEQ ID NO: 8140389 - DNA, 22 bp, Homo sapiens
ggcaggcatcatgtggtcatta

SEQ ID NO: 8140390 - DNA, 22 bp, Homo sapiens
ggcaggcatcatgtggtcatta

SEQ ID NO: 8140391 - DNA, 22 bp, Homo sapiens
ggcaggcagtgtggtgtgaaac

SEQ ID NO: 8140392 - DNA, 22 bp, Homo sapiens
ggcaggcatcatcagttgatca

SEQ ID NO: 8140393 - DNA, 22 bp, Homo sapiens
ggcaggcaggtcttcatggccc

SEQ ID NO: 8140394 - DNA, 22 bp, Homo sapiens
ggcaggcaggtcttcatggccc

SEQ ID NO: 8140395 - DNA, 22 bp, Homo sapiens
ggcaggcaggtcttcatggccc

SEQ ID NO: 8140396 - DNA, 22 bp, Homo sapiens
ggcaggcaggtcttcatggccc

SEQ ID NO: 8140397 - DNA, 22 bp, Homo sapiens
ggcaggcaggtcttcatggccc

SEQ ID NO: 8140398 - DNA, 20 bp, Homo sapiens
ggcaggcaggaggtttccag

SEQ ID NO: 8140399 - DNA, 22 bp, Homo sapiens
ggcaggcaggagctctgtctcc

SEQ ID NO: 8140400 - DNA, 22 bp, Homo sapiens
ggcaggcaggagcgtgcttggg

SEQ ID NO: 8140401 - DNA, 22 bp, Homo sapiens
cacatttccttggcctttaatt

SEQ ID NO: 8140402 - DNA, 22 bp, Homo sapiens
cacatttctaggaaattaaatg

SEQ ID NO: 8140403 - DNA, 22 bp, Homo sapiens
ggcaggcaggagcgtgcttggg

SEQ ID NO: 8140404 - DNA, 22 bp, Homo sapiens
cacatttcattggcttacgtaa

SEQ ID NO: 8140405 - DNA, 22 bp, Homo sapiens
cacatttatttgaggctaattg

SEQ ID NO: 8140406 - DNA, 22 bp, Homo sapiens
cacgcacgctgggtggaggcgc

SEQ ID NO: 8140407 - DNA, 22 bp, Homo sapiens
cacgcatttattcacgtattcg

SEQ ID NO: 8140408 - DNA, 22 bp, Homo sapiens
ggcctctctccctggcttgcag

SEQ ID NO: 8140409 - DNA, 22 bp, Homo sapiens
ggcctctctccagtcagtgcag

SEQ ID NO: 8140410 - DNA, 22 bp, Homo sapiens
cacgcatttattcacgtattcg

SEQ ID NO: 8140411 - DNA, 22 bp, Homo sapiens
ggcctctctccagtcagtgcag

SEQ ID NO: 8140412 - DNA, 22 bp, Homo sapiens
cacgaggccatctccttctgga

SEQ ID NO: 8140413 - DNA, 22 bp, Homo sapiens
cacgaatggaagggtcttggct

SEQ ID NO: 8140414 - DNA, 19 bp, Homo sapiens
cacgagttctcttagcaaa

SEQ ID NO: 8140415 - DNA, 22 bp, Homo sapiens
caccttactccctctggatgcc

SEQ ID NO: 8140416 - DNA, 22 bp, Homo sapiens
caccttccatctccttggctag

SEQ ID NO: 8140417 - DNA, 22 bp, Homo sapiens
caccttccatctccttggctag

SEQ ID NO: 8140418 - DNA, 22 bp, Homo sapiens
caccttcagaatgctccaggca

SEQ ID NO: 8140419 - DNA, 22 bp, Homo sapiens
cacctttgaccttgcagcgcac

SEQ ID NO: 8140420 - DNA, 22 bp, Homo sapiens
cacctttgcaaaccaaatctga

SEQ ID NO: 8140421 - DNA, 22 bp, Homo sapiens
ggccgctctccggtgtggatct

SEQ ID NO: 8140422 - DNA, 21 bp, Homo sapiens
ggccgccgccttgtgctctgc

SEQ ID NO: 8140423 - DNA, 22 bp, Homo sapiens
ggccgggcaggtctcagccagc

SEQ ID NO: 8140424 - DNA, 22 bp, Homo sapiens
ggccgtgctccaaagtcatcgt

SEQ ID NO: 8140425 - DNA, 22 bp, Homo sapiens
cacctgtccacgcagtctgcct

SEQ ID NO: 8140426 - DNA, 22 bp, Homo sapiens
cacctgtacagggccgggctgg

SEQ ID NO: 8140427 - DNA, 22 bp, Homo sapiens
ggccactgctctccagcctggg

SEQ ID NO: 8140428 - DNA, 22 bp, Homo sapiens
ggccactgctctccagcctggg

SEQ ID NO: 8140429 - DNA, 22 bp, Homo sapiens
ggccactgctctccagcctggg

SEQ ID NO: 8140430 - DNA, 22 bp, Homo sapiens
ggccactgctgctctggtggag

SEQ ID NO: 8140431 - DNA, 22 bp, Homo sapiens
ggccactgctgctctggtggag

SEQ ID NO: 8140432 - DNA, 22 bp, Homo sapiens
ggccactgcctccgccatggct

SEQ ID NO: 8140433 - DNA, 22 bp, Homo sapiens
ggccctgttagagctcccacaa

SEQ ID NO: 8140434 - DNA, 22 bp, Homo sapiens
ggccctgtggttttgcaaagtc

SEQ ID NO: 8140435 - DNA, 22 bp, Homo sapiens
ggccctgtggttttgcaaagtc

SEQ ID NO: 8140436 - DNA, 22 bp, Homo sapiens
ggcccttgcagcaggcgctggc

SEQ ID NO: 8140437 - DNA, 22 bp, Homo sapiens
ggcccttggagcctccacagtg

SEQ ID NO: 8140438 - DNA, 22 bp, Homo sapiens
ggccgccctttccacggtttct

SEQ ID NO: 8140439 - DNA, 22 bp, Homo sapiens
ggccgccctttccacggtttct

SEQ ID NO: 8140440 - DNA, 22 bp, Homo sapiens
ggccgccctttccacggtttct

SEQ ID NO: 8140441 - DNA, 22 bp, Homo sapiens
ggccctgtcctggctgtctccg

SEQ ID NO: 8140442 - DNA, 22 bp, Homo sapiens
ggccctgtgatggatgtattag

SEQ ID NO: 8140443 - DNA, 22 bp, Homo sapiens
ggcaggtgcccagagagcacga

SEQ ID NO: 8140444 - DNA, 22 bp, Homo sapiens
ggcaggtgccagttggcttggg

SEQ ID NO: 8140445 - DNA, 22 bp, Homo sapiens
ggcaggtgccagttggcttggg

SEQ ID NO: 8140446 - DNA, 22 bp, Homo sapiens
ggcaggtgccagttggcttggg

SEQ ID NO: 8140447 - DNA, 22 bp, Homo sapiens
ggcaggtgccagttggcttggg

SEQ ID NO: 8140448 - DNA, 22 bp, Homo sapiens
ggcaggtgccagttggcttggg

SEQ ID NO: 8140449 - DNA, 22 bp, Homo sapiens
ggcaggtgccagttggcttggg

SEQ ID NO: 8140450 - DNA, 22 bp, Homo sapiens
ggcaggtgccttctgtgctagc

SEQ ID NO: 8140451 - DNA, 22 bp, Homo sapiens
ggcaggtgcccagagagcacga

SEQ ID NO: 8140452 - DNA, 22 bp, Homo sapiens
ggcaggtgcccagagagcacga

SEQ ID NO: 8140453 - DNA, 22 bp, Homo sapiens
ggcaggtgcccagagagcacga

SEQ ID NO: 8140454 - DNA, 22 bp, Homo sapiens
ggcaggtgcccagagagcacga

SEQ ID NO: 8140455 - DNA, 22 bp, Homo sapiens
ggcaggtgcacctgagccatct

SEQ ID NO: 8140456 - DNA, 22 bp, Homo sapiens
ggcaggtgcacctgagccatct

SEQ ID NO: 8140457 - DNA, 22 bp, Homo sapiens
ggcaggtgcacctgagccatct

SEQ ID NO: 8140458 - DNA, 22 bp, Homo sapiens
ggcaggtgcacctgagccatct

SEQ ID NO: 8140459 - DNA, 22 bp, Homo sapiens
ggcaggtgcacctgagccatct

SEQ ID NO: 8140460 - DNA, 22 bp, Homo sapiens
ggcaggtgatctagagtcaata

SEQ ID NO: 8140461 - DNA, 22 bp, Homo sapiens
ggcaggtgatctagagtcaata

SEQ ID NO: 8140462 - DNA, 22 bp, Homo sapiens
ggcaggtgatctagagtcaata

SEQ ID NO: 8140463 - DNA, 22 bp, Homo sapiens
ggcaggtgatctagagtcaata

SEQ ID NO: 8140464 - DNA, 22 bp, Homo sapiens
ggcaggtgcacctgagccatct

SEQ ID NO: 8140465 - DNA, 22 bp, Homo sapiens
ggcagggcaggaaagtcaggaa

SEQ ID NO: 8140466 - DNA, 22 bp, Homo sapiens
ggcagggcaggaaagtcaggaa

SEQ ID NO: 8140467 - DNA, 22 bp, Homo sapiens
ggcagggcaggaaagtcaggaa

SEQ ID NO: 8140468 - DNA, 22 bp, Homo sapiens
ggcagggcaggaaagtcaggaa

SEQ ID NO: 8140469 - DNA, 22 bp, Homo sapiens
ggcagggcaggaaagtcaggaa

SEQ ID NO: 8140470 - DNA, 22 bp, Homo sapiens
ggcagggcaggaaagtcaggaa

SEQ ID NO: 8140471 - DNA, 22 bp, Homo sapiens
ggcagggcaggaaagtcaggaa

SEQ ID NO: 8140472 - DNA, 22 bp, Homo sapiens
ggcagggcaggaaagtcaggaa

SEQ ID NO: 8140473 - DNA, 22 bp, Homo sapiens
ggcagggcaggaaagtcaggaa

SEQ ID NO: 8140474 - DNA, 22 bp, Homo sapiens
ggcagggcaggaaagtcaggaa

SEQ ID NO: 8140475 - DNA, 22 bp, Homo sapiens
ggcagggcaggaaagtcaggaa

SEQ ID NO: 8140476 - DNA, 22 bp, Homo sapiens
ggcagggagtggagactcccta

SEQ ID NO: 8140477 - DNA, 22 bp, Homo sapiens
ggcagggagtggagactcccta

SEQ ID NO: 8140478 - DNA, 20 bp, Homo sapiens
ggcagggagggatactgagg

SEQ ID NO: 8140479 - DNA, 22 bp, Homo sapiens
ggcagggcagcgctgattaggg

SEQ ID NO: 8140480 - DNA, 22 bp, Homo sapiens
ggcagggcagcgctgattaggg

SEQ ID NO: 8140481 - DNA, 22 bp, Homo sapiens
ggcagggcagcgctgattaggg

SEQ ID NO: 8140482 - DNA, 22 bp, Homo sapiens
ggcagggcagcgctgattaggg

SEQ ID NO: 8140483 - DNA, 22 bp, Homo sapiens
ggccacgtgacctctggctcct

SEQ ID NO: 8140484 - DNA, 22 bp, Homo sapiens
ggccaaggatggtggctctggt

SEQ ID NO: 8140485 - DNA, 19 bp, Homo sapiens
ggccactcctggtgactgg

SEQ ID NO: 8140486 - DNA, 19 bp, Homo sapiens
ggccactcctggtgactgg

SEQ ID NO: 8140487 - DNA, 23 bp, Homo sapiens
ggccactgaattttctgcatctt

SEQ ID NO: 8140488 - DNA, 23 bp, Homo sapiens
ggccactgaattttctgcatctt

SEQ ID NO: 8140489 - DNA, 22 bp, Homo sapiens
ggccaaaagcataatcctcaca

SEQ ID NO: 8140490 - DNA, 21 bp, Homo sapiens
ggcatttgccaaagtgatcct

SEQ ID NO: 8140491 - DNA, 22 bp, Homo sapiens
ggccaagaatgataggctcagt

SEQ ID NO: 8140492 - DNA, 22 bp, Homo sapiens
ggcatttgactcagtgactggg

SEQ ID NO: 8140493 - DNA, 22 bp, Homo sapiens
ggcatttatttgtctcattctt

SEQ ID NO: 8140494 - DNA, 22 bp, Homo sapiens
ggcatttgaaactattcggaga

SEQ ID NO: 8140495 - DNA, 22 bp, Homo sapiens
ggcatttagttttcatattctg

SEQ ID NO: 8140496 - DNA, 22 bp, Homo sapiens
ggcatttagttttcatattctg

SEQ ID NO: 8140497 - DNA, 22 bp, Homo sapiens
ggcatttagttttcatattctg

SEQ ID NO: 8140498 - DNA, 22 bp, Homo sapiens
ggcatttatctaatatagttta

SEQ ID NO: 8140499 - DNA, 22 bp, Homo sapiens
ggcatttatctaatatagttta

SEQ ID NO: 8140500 - DNA, 22 bp, Homo sapiens
ggcatttatctaatatagttta

SEQ ID NO: 8140501 - DNA, 20 bp, Homo sapiens
ggcatttatgaaccaagcct

SEQ ID NO: 8140502 - DNA, 22 bp, Homo sapiens
ggcatttacataatcttattta

SEQ ID NO: 8140503 - DNA, 22 bp, Homo sapiens
ggcatttacataatcttattta

SEQ ID NO: 8140504 - DNA, 22 bp, Homo sapiens
ggcatttaatccatctgattga

SEQ ID NO: 8140505 - DNA, 22 bp, Homo sapiens
ggcatttacgatactgcatagg

SEQ ID NO: 8140506 - DNA, 22 bp, Homo sapiens
ggcatttacgatactgcatagg

SEQ ID NO: 8140507 - DNA, 22 bp, Homo sapiens
ggcatttactagagccacattt

SEQ ID NO: 8140508 - DNA, 22 bp, Homo sapiens
ggcatttagagggcttttctga

SEQ ID NO: 8140509 - DNA, 22 bp, Homo sapiens
ggcatttaggatctttagttga

SEQ ID NO: 8140510 - DNA, 22 bp, Homo sapiens
ggcatttaggcagataacagac

SEQ ID NO: 8140511 - DNA, 22 bp, Homo sapiens
ggcatttaggcagataacagac

SEQ ID NO: 8140512 - DNA, 22 bp, Homo sapiens
ggcatttagagggcttttctga

SEQ ID NO: 8140513 - DNA, 22 bp, Homo sapiens
ggcatttagattgaatttctgt

SEQ ID NO: 8140514 - DNA, 22 bp, Homo sapiens
ggcatttagattgaatttctgt

SEQ ID NO: 8140515 - DNA, 22 bp, Homo sapiens
ggcatttaggatctttagttga

SEQ ID NO: 8140516 - DNA, 22 bp, Homo sapiens
ggcatcaggagcttcttcaggt

SEQ ID NO: 8140517 - DNA, 22 bp, Homo sapiens
ggcatcaggagcttcttcaggt

SEQ ID NO: 8140518 - DNA, 22 bp, Homo sapiens
ggcaggtgccttctgtgctagc

SEQ ID NO: 8140519 - DNA, 22 bp, Homo sapiens
ggcattataattggcaggctgt

SEQ ID NO: 8140520 - DNA, 22 bp, Homo sapiens
ggcattatctgagcacgtaata

SEQ ID NO: 8140521 - DNA, 22 bp, Homo sapiens
ggcattatttaaaagcctcact

SEQ ID NO: 8140522 - DNA, 22 bp, Homo sapiens
ggcattgtaaaggattcataga

SEQ ID NO: 8140523 - DNA, 22 bp, Homo sapiens
cagagacagcaagttgatttcc

SEQ ID NO: 8140524 - DNA, 22 bp, Homo sapiens
gggcagcccagaactgctgcag

SEQ ID NO: 8140525 - DNA, 22 bp, Homo sapiens
cagagacagaaaatggatctag

SEQ ID NO: 8140526 - DNA, 22 bp, Homo sapiens
cagagacaggaatcagctgcag

SEQ ID NO: 8140527 - DNA, 22 bp, Homo sapiens
cagagacagcctgggagggaca

SEQ ID NO: 8140528 - DNA, 22 bp, Homo sapiens
cagagacaggaatcagctgcag

SEQ ID NO: 8140529 - DNA, 22 bp, Homo sapiens
cagagacaggaatcagctgcag

SEQ ID NO: 8140530 - DNA, 22 bp, Homo sapiens
gggcagcattctgtgggcaggt

SEQ ID NO: 8140531 - DNA, 22 bp, Homo sapiens
gggcagcattctgtgggcaggt

SEQ ID NO: 8140532 - DNA, 22 bp, Homo sapiens
gggcagcagcaggaggtctctg

SEQ ID NO: 8140533 - DNA, 22 bp, Homo sapiens
gggcagcagagccctgccgagt

SEQ ID NO: 8140534 - DNA, 22 bp, Homo sapiens
cagagacagggcagggagtgtg

SEQ ID NO: 8140535 - DNA, 22 bp, Homo sapiens
cagagacaggcttgccctccac

SEQ ID NO: 8140536 - DNA, 22 bp, Homo sapiens
cagagacagtttcacagggtct

SEQ ID NO: 8140537 - DNA, 21 bp, Homo sapiens
gggcaggtctctgatgtcaac

SEQ ID NO: 8140538 - DNA, 22 bp, Homo sapiens
gggcaggtatttatcttctatt

SEQ ID NO: 8140539 - DNA, 22 bp, Homo sapiens
gggcaggtatttatcttctatt

SEQ ID NO: 8140540 - DNA, 22 bp, Homo sapiens
cagagacaggatctcgaagact

SEQ ID NO: 8140541 - DNA, 22 bp, Homo sapiens
cagagacaggatctcgaagact

SEQ ID NO: 8140542 - DNA, 22 bp, Homo sapiens
cagagacaggaatcagctgcag

SEQ ID NO: 8140543 - DNA, 22 bp, Homo sapiens
cagagacaggagtgctcccagt

SEQ ID NO: 8140544 - DNA, 22 bp, Homo sapiens
gggcagtggttacacagctgag

SEQ ID NO: 8140545 - DNA, 20 bp, Homo sapiens
gggcagtggcgctatctcag

SEQ ID NO: 8140546 - DNA, 22 bp, Homo sapiens
gggcagtgggaccaggcaccag

SEQ ID NO: 8140547 - DNA, 22 bp, Homo sapiens
gggcagtgggtggctgcagcct

SEQ ID NO: 8140548 - DNA, 22 bp, Homo sapiens
gggcagtgggaccaggcaccag

SEQ ID NO: 8140549 - DNA, 22 bp, Homo sapiens
gggcagtgggtggctgcagcct

SEQ ID NO: 8140550 - DNA, 22 bp, Homo sapiens
gggcagtgggtggctgcagcct

SEQ ID NO: 8140551 - DNA, 22 bp, Homo sapiens
gggcagtgggtggctgcagcct

SEQ ID NO: 8140552 - DNA, 22 bp, Homo sapiens
gggcagtgggtggctgcagcct

SEQ ID NO: 8140553 - DNA, 22 bp, Homo sapiens
cagaccctcgggtgagttggcc

SEQ ID NO: 8140554 - DNA, 21 bp, Homo sapiens
cagaccattgcatgagcaggt

SEQ ID NO: 8140555 - DNA, 22 bp, Homo sapiens
cagaccagaaggaagccgacaa

SEQ ID NO: 8140556 - DNA, 22 bp, Homo sapiens
cagacccttttctgagaggacc

SEQ ID NO: 8140557 - DNA, 23 bp, Homo sapiens
cagaccctcaatccacttgtttt

SEQ ID NO: 8140558 - DNA, 21 bp, Homo sapiens
cagaccctctagaggccacct

SEQ ID NO: 8140559 - DNA, 22 bp, Homo sapiens
ggcttcaccaggtgcatgcatg

SEQ ID NO: 8140560 - DNA, 22 bp, Homo sapiens
ggcttagattgacactgatctc

SEQ ID NO: 8140561 - DNA, 20 bp, Homo sapiens
ggcttagactgagttctcac

SEQ ID NO: 8140562 - DNA, 22 bp, Homo sapiens
ggcttcagaggggaggtagtgc

SEQ ID NO: 8140563 - DNA, 22 bp, Homo sapiens
ggcttcagaagactggacaggt

SEQ ID NO: 8140564 - DNA, 22 bp, Homo sapiens
ggcttcagaagactggacaggt

SEQ ID NO: 8140565 - DNA, 22 bp, Homo sapiens
ggcttcagaagactggacaggt

SEQ ID NO: 8140566 - DNA, 17 bp, Homo sapiens
ggcttcagggagctggg

SEQ ID NO: 8140567 - DNA, 22 bp, Homo sapiens
cagacagggtcctgtccgtcac

SEQ ID NO: 8140568 - DNA, 22 bp, Homo sapiens
ggcttcagaggggaggtagtgc

SEQ ID NO: 8140569 - DNA, 22 bp, Homo sapiens
gggcagagactcagaaacagaa

SEQ ID NO: 8140570 - DNA, 22 bp, Homo sapiens
gggcagagaaatggacagttgg

SEQ ID NO: 8140571 - DNA, 22 bp, Homo sapiens
gggcagagaaatggacagttgg

SEQ ID NO: 8140572 - DNA, 22 bp, Homo sapiens
gggcagcagagccctgccgagt

SEQ ID NO: 8140573 - DNA, 22 bp, Homo sapiens
gggcagcagagccctgccgagt

SEQ ID NO: 8140574 - DNA, 22 bp, Homo sapiens
cagactgggctggtggaaagct

SEQ ID NO: 8140575 - DNA, 22 bp, Homo sapiens
cagactgtagagtttgagaagt

SEQ ID NO: 8140576 - DNA, 22 bp, Homo sapiens
cagactgggctggtggaaagct

SEQ ID NO: 8140577 - DNA, 22 bp, Homo sapiens
cagactgggagtcaggaagaag

SEQ ID NO: 8140578 - DNA, 22 bp, Homo sapiens
cagactggccacatctgcactg

SEQ ID NO: 8140579 - DNA, 22 bp, Homo sapiens
cagactggctgaaggccgagtg

SEQ ID NO: 8140580 - DNA, 22 bp, Homo sapiens
cagactggccacatctgcactg

SEQ ID NO: 8140581 - DNA, 22 bp, Homo sapiens
cagactggccacatctgcactg

SEQ ID NO: 8140582 - DNA, 22 bp, Homo sapiens
cagactcttgagctgattgtat

SEQ ID NO: 8140583 - DNA, 22 bp, Homo sapiens
cagactctgatgcagccttgtg

SEQ ID NO: 8140584 - DNA, 23 bp, Homo sapiens
cagacctttctgtatcagttatc

SEQ ID NO: 8140585 - DNA, 19 bp, Homo sapiens
cagacctgtccagcctgtg

SEQ ID NO: 8140586 - DNA, 19 bp, Homo sapiens
cagacctgtccagcctgtg

SEQ ID NO: 8140587 - DNA, 22 bp, Homo sapiens
cagacctgggtccctggcctgt

SEQ ID NO: 8140588 - DNA, 22 bp, Homo sapiens
cagacctggggcctgggagccc

SEQ ID NO: 8140589 - DNA, 19 bp, Homo sapiens
cagacctgtccagcctgtg

SEQ ID NO: 8140590 - DNA, 22 bp, Homo sapiens
cagacctgggtccctggcctgt

SEQ ID NO: 8140591 - DNA, 17 bp, Homo sapiens
cagacctctgtgaagcc

SEQ ID NO: 8140592 - DNA, 22 bp, Homo sapiens
cagacctgaggagcactgagcc

SEQ ID NO: 8140593 - DNA, 22 bp, Homo sapiens
cagacctgaggagcactgagcc

SEQ ID NO: 8140594 - DNA, 22 bp, Homo sapiens
cagacctgaggttgagtaccag

SEQ ID NO: 8140595 - DNA, 22 bp, Homo sapiens
cagacctgaggttgagtaccag

SEQ ID NO: 8140596 - DNA, 20 bp, Homo sapiens
cagacctgcacccacttcga

SEQ ID NO: 8140597 - DNA, 20 bp, Homo sapiens
cagacctgcacccacttcga

SEQ ID NO: 8140598 - DNA, 22 bp, Homo sapiens
cagacctggaaaacaggcttgc

SEQ ID NO: 8140599 - DNA, 20 bp, Homo sapiens
cagacctgcacccacttcga

SEQ ID NO: 8140600 - DNA, 23 bp, Homo sapiens
cagacctggcagtcatcctcaac

SEQ ID NO: 8140601 - DNA, 22 bp, Homo sapiens
gggctgaccccacccctcactc

SEQ ID NO: 8140602 - DNA, 17 bp, Homo sapiens
gggctgacagtggcctc

SEQ ID NO: 8140603 - DNA, 22 bp, Homo sapiens
gggctgacagtttcccctgaaa

SEQ ID NO: 8140604 - DNA, 22 bp, Homo sapiens
gggctgacagtttcccctgaaa

SEQ ID NO: 8140605 - DNA, 22 bp, Homo sapiens
gggctgacagtttcccctgaaa

SEQ ID NO: 8140606 - DNA, 22 bp, Homo sapiens
gggctgacaccacccaggcgca

SEQ ID NO: 8140607 - DNA, 22 bp, Homo sapiens
gggctgacagcacgccttctgt

SEQ ID NO: 8140608 - DNA, 22 bp, Homo sapiens
gggctgacaccacccaggcgca

SEQ ID NO: 8140609 - DNA, 22 bp, Homo sapiens
gggctgacaaccatctgacaag

SEQ ID NO: 8140610 - DNA, 22 bp, Homo sapiens
gggctgacaaccatctgacaag

SEQ ID NO: 8140611 - DNA, 22 bp, Homo sapiens
gggctgaaaggccgcctcagat

SEQ ID NO: 8140612 - DNA, 20 bp, Homo sapiens
gggctcttaggtagcagggg

SEQ ID NO: 8140613 - DNA, 20 bp, Homo sapiens
gggctcttaggtagcagggg

SEQ ID NO: 8140614 - DNA, 22 bp, Homo sapiens
gggctctgtttagatcagagat

SEQ ID NO: 8140615 - DNA, 22 bp, Homo sapiens
gggctctgtttagatcagagat

SEQ ID NO: 8140616 - DNA, 22 bp, Homo sapiens
gggctctgtttagatcagagat

SEQ ID NO: 8140617 - DNA, 22 bp, Homo sapiens
gggctctgtttagaccagagat

SEQ ID NO: 8140618 - DNA, 22 bp, Homo sapiens
gggctctgtttagaccagagat

SEQ ID NO: 8140619 - DNA, 22 bp, Homo sapiens
gggctctgtttagaccagagat

SEQ ID NO: 8140620 - DNA, 22 bp, Homo sapiens
gggctgagaagttgatcccaag

SEQ ID NO: 8140621 - DNA, 22 bp, Homo sapiens
gggctgactcaaccttgcaaag

SEQ ID NO: 8140622 - DNA, 22 bp, Homo sapiens
gggctgacgaaggccatgtgtg

SEQ ID NO: 8140623 - DNA, 22 bp, Homo sapiens
cagagcctaaaacgactccact

SEQ ID NO: 8140624 - DNA, 22 bp, Homo sapiens
cagagcccttggctggagccca

SEQ ID NO: 8140625 - DNA, 22 bp, Homo sapiens
cagagcccttggctggagccca

SEQ ID NO: 8140626 - DNA, 22 bp, Homo sapiens
cagagcctaaaacgactccact

SEQ ID NO: 8140627 - DNA, 22 bp, Homo sapiens
cagagcctaaaacgactccact

SEQ ID NO: 8140628 - DNA, 22 bp, Homo sapiens
cagagcctaaaacgactccact

SEQ ID NO: 8140629 - DNA, 19 bp, Homo sapiens
cagagcctcagagctagaa

SEQ ID NO: 8140630 - DNA, 19 bp, Homo sapiens
cagagcctcagagctagaa

SEQ ID NO: 8140631 - DNA, 22 bp, Homo sapiens
cagagcctcagaatcctgtgga

SEQ ID NO: 8140632 - DNA, 22 bp, Homo sapiens
cagagcctcagaatcctgtgga

SEQ ID NO: 8140633 - DNA, 22 bp, Homo sapiens
cagagcctcagaatcctgtgga

SEQ ID NO: 8140634 - DNA, 22 bp, Homo sapiens
cagagcctccctcctctgccat

SEQ ID NO: 8140635 - DNA, 22 bp, Homo sapiens
cagagcctccctcctctgccat

SEQ ID NO: 8140636 - DNA, 19 bp, Homo sapiens
cagagcctcagagctagaa

SEQ ID NO: 8140637 - DNA, 22 bp, Homo sapiens
cagagcctcatcatccactcca

SEQ ID NO: 8140638 - DNA, 22 bp, Homo sapiens
cagagcctcatcatccactcca

SEQ ID NO: 8140639 - DNA, 22 bp, Homo sapiens
gggcagtgtcggggcccaggga

SEQ ID NO: 8140640 - DNA, 22 bp, Homo sapiens
gggccacttctagtgcctcaga

SEQ ID NO: 8140641 - DNA, 22 bp, Homo sapiens
gggccactgggtcctgctggcc

SEQ ID NO: 8140642 - DNA, 22 bp, Homo sapiens
gggccagacccttggcgatctg

SEQ ID NO: 8140643 - DNA, 22 bp, Homo sapiens
gggccagacccttggcgatctg

SEQ ID NO: 8140644 - DNA, 22 bp, Homo sapiens
gggccagacccttggcgatctg

SEQ ID NO: 8140645 - DNA, 20 bp, Homo sapiens
gggctctgcttggcagaagt

SEQ ID NO: 8140646 - DNA, 20 bp, Homo sapiens
gggctctgcttggcagaagt

SEQ ID NO: 8140647 - DNA, 20 bp, Homo sapiens
gggctctgcttggcagaagt

SEQ ID NO: 8140648 - DNA, 20 bp, Homo sapiens
gggctctgcttggcagaagt

SEQ ID NO: 8140649 - DNA, 22 bp, Homo sapiens
gggccagctctgtgatgtaggg

SEQ ID NO: 8140650 - DNA, 22 bp, Homo sapiens
gggctctgcgggcccggactcc

SEQ ID NO: 8140651 - DNA, 22 bp, Homo sapiens
gggctctgcgggcccggactcc

SEQ ID NO: 8140652 - DNA, 22 bp, Homo sapiens
gggccagcagtatcggaggcat

SEQ ID NO: 8140653 - DNA, 22 bp, Homo sapiens
gggccagcagtatcggaggcat

SEQ ID NO: 8140654 - DNA, 22 bp, Homo sapiens
gggccagcctactgctagaccc

SEQ ID NO: 8140655 - DNA, 22 bp, Homo sapiens
gggccagcctactgctagaccc

SEQ ID NO: 8140656 - DNA, 22 bp, Homo sapiens
gggccagcctactgctagaccc

SEQ ID NO: 8140657 - DNA, 22 bp, Homo sapiens
gggccagagcacagaggatgtt

SEQ ID NO: 8140658 - DNA, 22 bp, Homo sapiens
gggccagagcttggcagctggg

SEQ ID NO: 8140659 - DNA, 22 bp, Homo sapiens
gggccagagcttggcagctggg

SEQ ID NO: 8140660 - DNA, 22 bp, Homo sapiens
gggccagagcttggcagctggg

SEQ ID NO: 8140661 - DNA, 22 bp, Homo sapiens
gggccagagcttggcagctggg

SEQ ID NO: 8140662 - DNA, 22 bp, Homo sapiens
gggctgagtgggcctcttactt

SEQ ID NO: 8140663 - DNA, 22 bp, Homo sapiens
cagaggagaattgcgggatcat

SEQ ID NO: 8140664 - DNA, 22 bp, Homo sapiens
cagaggcaaaagaggtggaggt

SEQ ID NO: 8140665 - DNA, 22 bp, Homo sapiens
cagaggcaaaagaggtggaggt

SEQ ID NO: 8140666 - DNA, 20 bp, Homo sapiens
cagaggcaaggagacttgga

SEQ ID NO: 8140667 - DNA, 22 bp, Homo sapiens
cagaggcaaaagaggtggaggt

SEQ ID NO: 8140668 - DNA, 20 bp, Homo sapiens
cagaggcaaggagacttgga

SEQ ID NO: 8140669 - DNA, 20 bp, Homo sapiens
cagaggcaaggagacttgga

SEQ ID NO: 8140670 - DNA, 22 bp, Homo sapiens
cagaggcacaagaaagcaaggc

SEQ ID NO: 8140671 - DNA, 22 bp, Homo sapiens
gggctgagtcatctggggcctc

SEQ ID NO: 8140672 - DNA, 22 bp, Homo sapiens
gggctgaggggtatctcatggg

SEQ ID NO: 8140673 - DNA, 22 bp, Homo sapiens
gggctgaggggtatctcatggg

SEQ ID NO: 8140674 - DNA, 22 bp, Homo sapiens
gggctgagtcatctggggcctc

SEQ ID NO: 8140675 - DNA, 22 bp, Homo sapiens
gggctgagtcatctggggcctc

SEQ ID NO: 8140676 - DNA, 22 bp, Homo sapiens
gggctgagtcatctggggcctc

SEQ ID NO: 8140677 - DNA, 22 bp, Homo sapiens
gggctgaggggtatctcatggg

SEQ ID NO: 8140678 - DNA, 22 bp, Homo sapiens
gggctgaggggtatctcatggg

SEQ ID NO: 8140679 - DNA, 22 bp, Homo sapiens
gggctgaggggtatctcatggg

SEQ ID NO: 8140680 - DNA, 22 bp, Homo sapiens
gggctgaggggtatctcatggg

SEQ ID NO: 8140681 - DNA, 22 bp, Homo sapiens
gggctgagtgacctcaggccaa

SEQ ID NO: 8140682 - DNA, 22 bp, Homo sapiens
gggctgagtgacctcaggccaa

SEQ ID NO: 8140683 - DNA, 22 bp, Homo sapiens
gggctgagtgacctcaggccaa

SEQ ID NO: 8140684 - DNA, 22 bp, Homo sapiens
gggctgagtgacctcaggccaa

SEQ ID NO: 8140685 - DNA, 22 bp, Homo sapiens
gggctgagtctgctgcctgtca

SEQ ID NO: 8140686 - DNA, 22 bp, Homo sapiens
gggctgagtctgctgcctgtca

SEQ ID NO: 8140687 - DNA, 22 bp, Homo sapiens
gggctgagtctgctgcctgtca

SEQ ID NO: 8140688 - DNA, 22 bp, Homo sapiens
gggctgagtctgctgcctgtca

SEQ ID NO: 8140689 - DNA, 22 bp, Homo sapiens
gggctgagtctgctgcctgtca

SEQ ID NO: 8140690 - DNA, 22 bp, Homo sapiens
gggctgagtctgctgcctgtca

SEQ ID NO: 8140691 - DNA, 22 bp, Homo sapiens
cagagctgcttcccagtttgtg

SEQ ID NO: 8140692 - DNA, 22 bp, Homo sapiens
cagagctgcttcccagtttgtg

SEQ ID NO: 8140693 - DNA, 19 bp, Homo sapiens
cagagctgctggcctcgtc

SEQ ID NO: 8140694 - DNA, 22 bp, Homo sapiens
cagagcctctcagccccttggg

SEQ ID NO: 8140695 - DNA, 22 bp, Homo sapiens
cagagcctccctcctctgccat

SEQ ID NO: 8140696 - DNA, 22 bp, Homo sapiens
cagagcctccctcctctgccat

SEQ ID NO: 8140697 - DNA, 22 bp, Homo sapiens
cagagcctctgccctgggcact

SEQ ID NO: 8140698 - DNA, 22 bp, Homo sapiens
cagagcctctcagccccttggg

SEQ ID NO: 8140699 - DNA, 22 bp, Homo sapiens
cagagcctctgccctgggcact

SEQ ID NO: 8140700 - DNA, 22 bp, Homo sapiens
cagagcctctgccctgggcact

SEQ ID NO: 8140701 - DNA, 22 bp, Homo sapiens
cagagctggggactgttggatg

SEQ ID NO: 8140702 - DNA, 22 bp, Homo sapiens
cagagctggggactgttggatg

SEQ ID NO: 8140703 - DNA, 22 bp, Homo sapiens
cagagctgggtttgggaaacct

SEQ ID NO: 8140704 - DNA, 22 bp, Homo sapiens
cagagctggggactgttggatg

SEQ ID NO: 8140705 - DNA, 22 bp, Homo sapiens
cagagctgggtttgggaaacct

SEQ ID NO: 8140706 - DNA, 22 bp, Homo sapiens
cagagctgggcatggtgaaagg

SEQ ID NO: 8140707 - DNA, 22 bp, Homo sapiens
cagagctgggcatggtgaaagg

SEQ ID NO: 8140708 - DNA, 22 bp, Homo sapiens
cagagctgggcatggtgaaagg

SEQ ID NO: 8140709 - DNA, 20 bp, Homo sapiens
cagagctgggatttgaacac

SEQ ID NO: 8140710 - DNA, 22 bp, Homo sapiens
cagagctgggatcccatgggcg

SEQ ID NO: 8140711 - DNA, 23 bp, Homo sapiens
cagagctggcttcatgggtgtgc

SEQ ID NO: 8140712 - DNA, 22 bp, Homo sapiens
cagagctggctctgcatgtaca

SEQ ID NO: 8140713 - DNA, 23 bp, Homo sapiens
cagagctggcttcatgggtgtgc

SEQ ID NO: 8140714 - DNA, 23 bp, Homo sapiens
cagagctggcttcatgggtgtgc

SEQ ID NO: 8140715 - DNA, 22 bp, Homo sapiens
cagagctgggatcccatgggcg

SEQ ID NO: 8140716 - DNA, 22 bp, Homo sapiens
cagagctgggatcccatgggcg

SEQ ID NO: 8140717 - DNA, 22 bp, Homo sapiens
cagagctgggatcccatgggcg

SEQ ID NO: 8140718 - DNA, 22 bp, Homo sapiens
cagagctgggatcccatgggcg

SEQ ID NO: 8140719 - DNA, 22 bp, Homo sapiens
cagcaagacttcagggcttggt

SEQ ID NO: 8140720 - DNA, 22 bp, Homo sapiens
cagcaagagaggcagggcaaat

SEQ ID NO: 8140721 - DNA, 21 bp, Homo sapiens
cagcaaggaagtcgagtaggt

SEQ ID NO: 8140722 - DNA, 21 bp, Homo sapiens
cagcaaggaagtcgagtaggt

SEQ ID NO: 8140723 - DNA, 22 bp, Homo sapiens
ggtgactcccagctgctctctt

SEQ ID NO: 8140724 - DNA, 22 bp, Homo sapiens
ggtgactcccagctgctctctt

SEQ ID NO: 8140725 - DNA, 22 bp, Homo sapiens
ggtgacggggcccaggtttcct

SEQ ID NO: 8140726 - DNA, 22 bp, Homo sapiens
ggtgacggggcccaggtttcct

SEQ ID NO: 8140727 - DNA, 17 bp, Homo sapiens
ggtgagacctcccactc

SEQ ID NO: 8140728 - DNA, 22 bp, Homo sapiens
cagcaagacagtttcctaagtg

SEQ ID NO: 8140729 - DNA, 22 bp, Homo sapiens
cagcaaagtaagctgacatgta

SEQ ID NO: 8140730 - DNA, 22 bp, Homo sapiens
cagcaaagtaagctgacatgta

SEQ ID NO: 8140731 - DNA, 21 bp, Homo sapiens
ggtctgctgtgtctagcctca

SEQ ID NO: 8140732 - DNA, 22 bp, Homo sapiens
ggtctgcgatggcaagggtctt

SEQ ID NO: 8140733 - DNA, 22 bp, Homo sapiens
ggtctgctttccttgccactgt

SEQ ID NO: 8140734 - DNA, 22 bp, Homo sapiens
ggtctggaacccctcaagtgac

SEQ ID NO: 8140735 - DNA, 23 bp, Homo sapiens
ggtctgcttcctagtttgcagat

SEQ ID NO: 8140736 - DNA, 22 bp, Homo sapiens
ggtctgcccactactctccatt

SEQ ID NO: 8140737 - DNA, 22 bp, Homo sapiens
ggtctgagtggtgctgactcag

SEQ ID NO: 8140738 - DNA, 22 bp, Homo sapiens
ggtctgagtggggcctgagatt

SEQ ID NO: 8140739 - DNA, 22 bp, Homo sapiens
ggtctgagtgggcaggggccgg

SEQ ID NO: 8140740 - DNA, 22 bp, Homo sapiens
ggtctgagtagagggctggcga

SEQ ID NO: 8140741 - DNA, 22 bp, Homo sapiens
ggtctgagcttgagcccatgct

SEQ ID NO: 8140742 - DNA, 22 bp, Homo sapiens
ggtctgagatatttgttcagct

SEQ ID NO: 8140743 - DNA, 22 bp, Homo sapiens
ggtctgaggtgggacccaggaa

SEQ ID NO: 8140744 - DNA, 22 bp, Homo sapiens
ggtctgaggtttgggattcact

SEQ ID NO: 8140745 - DNA, 22 bp, Homo sapiens
ggtctgagtagagggctggcga

SEQ ID NO: 8140746 - DNA, 22 bp, Homo sapiens
ggtctggaacgaggtctaagcc

SEQ ID NO: 8140747 - DNA, 22 bp, Homo sapiens
ggtctggaagcgcagtaggctg

SEQ ID NO: 8140748 - DNA, 22 bp, Homo sapiens
ggtctggaagcgcagtaggctg

SEQ ID NO: 8140749 - DNA, 22 bp, Homo sapiens
ggtctggaagcgtcccaaaggt

SEQ ID NO: 8140750 - DNA, 22 bp, Homo sapiens
ggtgacagtggttaaaatttgt

SEQ ID NO: 8140751 - DNA, 22 bp, Homo sapiens
ggtctggaataaggtccaggaa

SEQ ID NO: 8140752 - DNA, 22 bp, Homo sapiens
ggtgacagtggttaaaatttgt

SEQ ID NO: 8140753 - DNA, 19 bp, Homo sapiens
ggtgaccacctggtcagtg

SEQ ID NO: 8140754 - DNA, 19 bp, Homo sapiens
ggtgaccacctggtcagtg

SEQ ID NO: 8140755 - DNA, 22 bp, Homo sapiens
ggtgaccagggtcagtagcttt

SEQ ID NO: 8140756 - DNA, 22 bp, Homo sapiens
ggtgaccagggtcagtagcttt

SEQ ID NO: 8140757 - DNA, 22 bp, Homo sapiens
ggtgacctcacctggtcccacc

SEQ ID NO: 8140758 - DNA, 22 bp, Homo sapiens
cagcacagtttgcttggcagag

SEQ ID NO: 8140759 - DNA, 22 bp, Homo sapiens
cagcacataagccgaagactgt

SEQ ID NO: 8140760 - DNA, 22 bp, Homo sapiens
cagcacatgctcatcagggaag

SEQ ID NO: 8140761 - DNA, 22 bp, Homo sapiens
cagcacatctgattatatgact

SEQ ID NO: 8140762 - DNA, 22 bp, Homo sapiens
cagcacatctgattatatgact

SEQ ID NO: 8140763 - DNA, 22 bp, Homo sapiens
cagcaccattttcctggtcagc

SEQ ID NO: 8140764 - DNA, 22 bp, Homo sapiens
cagcaccatttgcagcctcttt

SEQ ID NO: 8140765 - DNA, 22 bp, Homo sapiens
cagcaccatttgcagcctcttt

SEQ ID NO: 8140766 - DNA, 22 bp, Homo sapiens
cagcacagtagagtagttgtaa

SEQ ID NO: 8140767 - DNA, 22 bp, Homo sapiens
cagcacagtgaccagacccact

SEQ ID NO: 8140768 - DNA, 22 bp, Homo sapiens
cagcacagtttcccccatgagc

SEQ ID NO: 8140769 - DNA, 22 bp, Homo sapiens
cagcacagtgcagatgctgact

SEQ ID NO: 8140770 - DNA, 22 bp, Homo sapiens
cagcacagtttcccccatgagc

SEQ ID NO: 8140771 - DNA, 22 bp, Homo sapiens
cagcacagtttcccccatgagc

SEQ ID NO: 8140772 - DNA, 22 bp, Homo sapiens
ggtgctgactgaggatggcttg

SEQ ID NO: 8140773 - DNA, 22 bp, Homo sapiens
ggtgctgacttcacagtcttac

SEQ ID NO: 8140774 - DNA, 22 bp, Homo sapiens
ggtgctgagagcctaggagggc

SEQ ID NO: 8140775 - DNA, 22 bp, Homo sapiens
ggtgctgagagcctaggagggc

SEQ ID NO: 8140776 - DNA, 22 bp, Homo sapiens
ggtgctgaggccttggcaggga

SEQ ID NO: 8140777 - DNA, 22 bp, Homo sapiens
ggtgctgatctaaatttaggac

SEQ ID NO: 8140778 - DNA, 22 bp, Homo sapiens
ggtgctgatagtaacaataata

SEQ ID NO: 8140779 - DNA, 22 bp, Homo sapiens
ggtgctgatattgttttggtga

SEQ ID NO: 8140780 - DNA, 22 bp, Homo sapiens
ggtgctgagtgagctagaggct

SEQ ID NO: 8140781 - DNA, 20 bp, Homo sapiens
ggtgctgataagaaagaagt

SEQ ID NO: 8140782 - DNA, 22 bp, Homo sapiens
cagcaaggactgggcatgtgaa

SEQ ID NO: 8140783 - DNA, 22 bp, Homo sapiens
cagcaaggactgggcatgtgaa

SEQ ID NO: 8140784 - DNA, 22 bp, Homo sapiens
cagcaaggactgggcatgtgaa

SEQ ID NO: 8140785 - DNA, 21 bp, Homo sapiens
cagcaaggaagtcgagtaggt

SEQ ID NO: 8140786 - DNA, 19 bp, Homo sapiens
ggtgctgacatcatgcttt

SEQ ID NO: 8140787 - DNA, 22 bp, Homo sapiens
ggtgctgaataaatactagtta

SEQ ID NO: 8140788 - DNA, 22 bp, Homo sapiens
ggtgctgaattctggaggaggc

SEQ ID NO: 8140789 - DNA, 22 bp, Homo sapiens
ggtgctgactctgtcgtgagca

SEQ ID NO: 8140790 - DNA, 22 bp, Homo sapiens
ggtgctgacattcagagtctgg

SEQ ID NO: 8140791 - DNA, 22 bp, Homo sapiens
ggtgctgattaagaactgtata

SEQ ID NO: 8140792 - DNA, 22 bp, Homo sapiens
ggtgctgattcactgacttctg

SEQ ID NO: 8140793 - DNA, 22 bp, Homo sapiens
ggtgctgatttgttgctgagat

SEQ ID NO: 8140794 - DNA, 22 bp, Homo sapiens
ggtgctgatgttattgatgctg

SEQ ID NO: 8140795 - DNA, 22 bp, Homo sapiens
ggtgctgatgagttaggagagg

SEQ ID NO: 8140796 - DNA, 22 bp, Homo sapiens
ggtgctgatgaagatgtagcct

SEQ ID NO: 8140797 - DNA, 23 bp, Homo sapiens
cagcacagtacatttcctgtctc

SEQ ID NO: 8140798 - DNA, 22 bp, Homo sapiens
ggtgctggttcagggtggctgt

SEQ ID NO: 8140799 - DNA, 22 bp, Homo sapiens
cagcacagtacaaggcacggat

SEQ ID NO: 8140800 - DNA, 22 bp, Homo sapiens
cagcacacagtgactcgcacct

SEQ ID NO: 8140801 - DNA, 22 bp, Homo sapiens
cagcacacagtgactcgcacct

SEQ ID NO: 8140802 - DNA, 22 bp, Homo sapiens
cagcacacagtgactcgcacct

SEQ ID NO: 8140803 - DNA, 22 bp, Homo sapiens
cagagtccaattgctcagagcg

SEQ ID NO: 8140804 - DNA, 22 bp, Homo sapiens
cagagtcatgggccgtcaggca

SEQ ID NO: 8140805 - DNA, 22 bp, Homo sapiens
cagagtcccagatgcccctcct

SEQ ID NO: 8140806 - DNA, 22 bp, Homo sapiens
cagagtcccagatgcccctcct

SEQ ID NO: 8140807 - DNA, 22 bp, Homo sapiens
cagagtcagtattgaattgaaa

SEQ ID NO: 8140808 - DNA, 23 bp, Homo sapiens
cagagtcagggggccccacctct

SEQ ID NO: 8140809 - DNA, 22 bp, Homo sapiens
cagagtcatatcagagaatatg

SEQ ID NO: 8140810 - DNA, 22 bp, Homo sapiens
cagagtcatatcagagaatatg

SEQ ID NO: 8140811 - DNA, 22 bp, Homo sapiens
cagagtcatgggccgtcaggca

SEQ ID NO: 8140812 - DNA, 23 bp, Homo sapiens
ggtccacccgagcctgcagcttc

SEQ ID NO: 8140813 - DNA, 22 bp, Homo sapiens
ggtccacctccaagctggggac

SEQ ID NO: 8140814 - DNA, 22 bp, Homo sapiens
ggtcatgagggagcagtgcagg

SEQ ID NO: 8140815 - DNA, 22 bp, Homo sapiens
ggtcatgaggagggagaaggtt

SEQ ID NO: 8140816 - DNA, 22 bp, Homo sapiens
ggtcatggatagctggagcctt

SEQ ID NO: 8140817 - DNA, 22 bp, Homo sapiens
ggtcatggatagctggagcctt

SEQ ID NO: 8140818 - DNA, 22 bp, Homo sapiens
ggtcatgtgtccaggaggtagc

SEQ ID NO: 8140819 - DNA, 22 bp, Homo sapiens
ggtcatgttttaaaaatattgt

SEQ ID NO: 8140820 - DNA, 22 bp, Homo sapiens
cagagtctgcgagcagaggggc

SEQ ID NO: 8140821 - DNA, 22 bp, Homo sapiens
cagagtctggactgcaggctcc

SEQ ID NO: 8140822 - DNA, 22 bp, Homo sapiens
cagagtctgcgagcagaggggc

SEQ ID NO: 8140823 - DNA, 22 bp, Homo sapiens
cagagtctctgggaggctgggt

SEQ ID NO: 8140824 - DNA, 22 bp, Homo sapiens
cagagtctctgggaggctgggt

SEQ ID NO: 8140825 - DNA, 22 bp, Homo sapiens
cagagtcctgcaccagctccag

SEQ ID NO: 8140826 - DNA, 22 bp, Homo sapiens
cagagtcctggacacagagaca

SEQ ID NO: 8140827 - DNA, 22 bp, Homo sapiens
cagagtcctgcaccagctccag

SEQ ID NO: 8140828 - DNA, 17 bp, Homo sapiens
cagagtctgtctgcatc

SEQ ID NO: 8140829 - DNA, 18 bp, Homo sapiens
ggtcctgggcctggctca

SEQ ID NO: 8140830 - DNA, 18 bp, Homo sapiens
ggtcctgggcctggctca

SEQ ID NO: 8140831 - DNA, 22 bp, Homo sapiens
ggtcctgggaagatgctcatga

SEQ ID NO: 8140832 - DNA, 22 bp, Homo sapiens
ggtctgagagccactgaatccc

SEQ ID NO: 8140833 - DNA, 18 bp, Homo sapiens
ggtcctgggcctggctca

SEQ ID NO: 8140834 - DNA, 22 bp, Homo sapiens
ggtcctgggaagatgctcatga

SEQ ID NO: 8140835 - DNA, 22 bp, Homo sapiens
cagaggtagcatgctgtggctt

SEQ ID NO: 8140836 - DNA, 22 bp, Homo sapiens
cagaggtagaaggcatgcagtg

SEQ ID NO: 8140837 - DNA, 22 bp, Homo sapiens
cagaggtagaactggccctcac

SEQ ID NO: 8140838 - DNA, 22 bp, Homo sapiens
cagaggtagaaggcatgcagtg

SEQ ID NO: 8140839 - DNA, 22 bp, Homo sapiens
ggtcaggtagctctgacaggcc

SEQ ID NO: 8140840 - DNA, 22 bp, Homo sapiens
ggtcaggtagctctgacaggcc

SEQ ID NO: 8140841 - DNA, 22 bp, Homo sapiens
ggtcaggtagctctgacaggcc

SEQ ID NO: 8140842 - DNA, 22 bp, Homo sapiens
ggtcaggtaggaagttaactat

SEQ ID NO: 8140843 - DNA, 22 bp, Homo sapiens
ggtcaggtagctctgacaggcc

SEQ ID NO: 8140844 - DNA, 22 bp, Homo sapiens
ggtcaggtggcttctgtcctct

SEQ ID NO: 8140845 - DNA, 22 bp, Homo sapiens
ggtcaggtaggaagttaactat

SEQ ID NO: 8140846 - DNA, 22 bp, Homo sapiens
ggtcagggttccaggtatcttc

SEQ ID NO: 8140847 - DNA, 22 bp, Homo sapiens
ggtcacaggggagaagagtgat

SEQ ID NO: 8140848 - DNA, 22 bp, Homo sapiens
ggtcacagggaagggctctcaa

SEQ ID NO: 8140849 - DNA, 22 bp, Homo sapiens
ggtcacagggaagggctctcaa

SEQ ID NO: 8140850 - DNA, 22 bp, Homo sapiens
cagagggttgatgtgaggctta

SEQ ID NO: 8140851 - DNA, 22 bp, Homo sapiens
cagagggttgatgtgaggctta

SEQ ID NO: 8140852 - DNA, 21 bp, Homo sapiens
cagagggtttctcaggtgttt

SEQ ID NO: 8140853 - DNA, 22 bp, Homo sapiens
cagaggtacaagctaagttggg

SEQ ID NO: 8140854 - DNA, 22 bp, Homo sapiens
cagaggtacagccattgaagat

SEQ ID NO: 8140855 - DNA, 22 bp, Homo sapiens
cagaggtaccagcagcctctgg

SEQ ID NO: 8140856 - DNA, 22 bp, Homo sapiens
ggtcagtgcgatttcccactcc

SEQ ID NO: 8140857 - DNA, 22 bp, Homo sapiens
ggtcagtgcctatcatgtgggc

SEQ ID NO: 8140858 - DNA, 22 bp, Homo sapiens
ggtcagtgagcaaacaaccacg

SEQ ID NO: 8140859 - DNA, 22 bp, Homo sapiens
ggtcagtgcctatcatgtgggc

SEQ ID NO: 8140860 - DNA, 22 bp, Homo sapiens
ggtcaggtggcttctgtcctct

SEQ ID NO: 8140861 - DNA, 22 bp, Homo sapiens
ggtcaggtttttaggagtgacc

SEQ ID NO: 8140862 - DNA, 22 bp, Homo sapiens
ggtcaggtttttaggagtgacc

SEQ ID NO: 8140863 - DNA, 22 bp, Homo sapiens
ggtcagtctctcccgagtgttg

SEQ ID NO: 8140864 - DNA, 22 bp, Homo sapiens
ggtcagtggacaaaggagtttc

SEQ ID NO: 8140865 - DNA, 22 bp, Homo sapiens
ggtcagtgctgccagagtgacc

SEQ ID NO: 8140866 - DNA, 22 bp, Homo sapiens
ggtcagtggcagggggtacttc

SEQ ID NO: 8140867 - DNA, 22 bp, Homo sapiens
ggtcagtggccaggaagcagtc

SEQ ID NO: 8140868 - DNA, 22 bp, Homo sapiens
ggtcatagagctggaaattggc

SEQ ID NO: 8140869 - DNA, 22 bp, Homo sapiens
ggtcatctgcctccaaagcact

SEQ ID NO: 8140870 - DNA, 22 bp, Homo sapiens
ggtcatatctttctgattgttc

SEQ ID NO: 8140871 - DNA, 22 bp, Homo sapiens
ggggagagtattttattcaagt

SEQ ID NO: 8140872 - DNA, 22 bp, Homo sapiens
ggggagagtattttattcaagt

SEQ ID NO: 8140873 - DNA, 22 bp, Homo sapiens
ggggagagtcctttccagttcc

SEQ ID NO: 8140874 - DNA, 22 bp, Homo sapiens
ggggagagtcctttccagttcc

SEQ ID NO: 8140875 - DNA, 22 bp, Homo sapiens
ggggagagtcctttccagttcc

SEQ ID NO: 8140876 - DNA, 22 bp, Homo sapiens
ggggagagtcctttccagttcc

SEQ ID NO: 8140877 - DNA, 19 bp, Homo sapiens
cagaggcaccaggtataga

SEQ ID NO: 8140878 - DNA, 19 bp, Homo sapiens
cagaggcaccaggtataga

SEQ ID NO: 8140879 - DNA, 19 bp, Homo sapiens
cagaggcaccaggtataga

SEQ ID NO: 8140880 - DNA, 22 bp, Homo sapiens
cagaggcacagtgcgggccact

SEQ ID NO: 8140881 - DNA, 22 bp, Homo sapiens
cagaggcacagtgcgggccact

SEQ ID NO: 8140882 - DNA, 22 bp, Homo sapiens
cagaggcacagcttcttttaat

SEQ ID NO: 8140883 - DNA, 22 bp, Homo sapiens
cagaggcacaagaaagcaaggc

SEQ ID NO: 8140884 - DNA, 22 bp, Homo sapiens
ggggagcaatagttgaggtgtg

SEQ ID NO: 8140885 - DNA, 22 bp, Homo sapiens
ggggagcagaagcagcaacaac

SEQ ID NO: 8140886 - DNA, 22 bp, Homo sapiens
ggggagctgggaggtgagttac

SEQ ID NO: 8140887 - DNA, 22 bp, Homo sapiens
ggggagcttggttattcatgca

SEQ ID NO: 8140888 - DNA, 22 bp, Homo sapiens
ggggagcttcaggtggcttaca

SEQ ID NO: 8140889 - DNA, 22 bp, Homo sapiens
cagagggctgccctgagttcgt

SEQ ID NO: 8140890 - DNA, 22 bp, Homo sapiens
cagagggctcttggctgcctgc

SEQ ID NO: 8140891 - DNA, 21 bp, Homo sapiens
cagagggccggcatgtggtct

SEQ ID NO: 8140892 - DNA, 22 bp, Homo sapiens
cagagggctcttggctgcctgc

SEQ ID NO: 8140893 - DNA, 22 bp, Homo sapiens
cagagggctcagtcctgctgga

SEQ ID NO: 8140894 - DNA, 21 bp, Homo sapiens
cagagggcttttctctgttct

SEQ ID NO: 8140895 - DNA, 22 bp, Homo sapiens
cagagggtggaggccaggctct

SEQ ID NO: 8140896 - DNA, 22 bp, Homo sapiens
cagagggtcaccaggaagtgca

SEQ ID NO: 8140897 - DNA, 23 bp, Homo sapiens
cagagggttccatggagcatggt

SEQ ID NO: 8140898 - DNA, 22 bp, Homo sapiens
cagcctgggctccagagtccct

SEQ ID NO: 8140899 - DNA, 22 bp, Homo sapiens
cagcctggtccccggctcaccc

SEQ ID NO: 8140900 - DNA, 22 bp, Homo sapiens
cagcctgggctccagagtccct

SEQ ID NO: 8140901 - DNA, 22 bp, Homo sapiens
cagcctgggctccagagtccct

SEQ ID NO: 8140902 - DNA, 22 bp, Homo sapiens
cagcctggtccccggctcaccc

SEQ ID NO: 8140903 - DNA, 22 bp, Homo sapiens
cagcctgggctccagagtccct

SEQ ID NO: 8140904 - DNA, 22 bp, Homo sapiens
cagcctggcctgggactgctga

SEQ ID NO: 8140905 - DNA, 22 bp, Homo sapiens
cagcctggcctgggactgctga

SEQ ID NO: 8140906 - DNA, 22 bp, Homo sapiens
cagcctgtctgggcagagtgga

SEQ ID NO: 8140907 - DNA, 22 bp, Homo sapiens
cagcctgtctgggcagagtgga

SEQ ID NO: 8140908 - DNA, 22 bp, Homo sapiens
cagcctgtagtctggtccaggt

SEQ ID NO: 8140909 - DNA, 22 bp, Homo sapiens
cagcctgtcggctccttcattc

SEQ ID NO: 8140910 - DNA, 22 bp, Homo sapiens
cagcctggtccccggctcaccc

SEQ ID NO: 8140911 - DNA, 22 bp, Homo sapiens
cagcctgtagtctggtccaggt

SEQ ID NO: 8140912 - DNA, 22 bp, Homo sapiens
cagcctgtagaatacagtaaat

SEQ ID NO: 8140913 - DNA, 21 bp, Homo sapiens
cagcctgctgctccagggcca

SEQ ID NO: 8140914 - DNA, 22 bp, Homo sapiens
cagcctgctagggcaatgcctt

SEQ ID NO: 8140915 - DNA, 22 bp, Homo sapiens
cagcctggacagcgaccagagt

SEQ ID NO: 8140916 - DNA, 22 bp, Homo sapiens
cagcctggacagcgaccagagt

SEQ ID NO: 8140917 - DNA, 22 bp, Homo sapiens
cagcctggacagcgaccagagt

SEQ ID NO: 8140918 - DNA, 21 bp, Homo sapiens
cagcctgctgctccagggcca

SEQ ID NO: 8140919 - DNA, 21 bp, Homo sapiens
cagcctgctgctccagggcca

SEQ ID NO: 8140920 - DNA, 22 bp, Homo sapiens
cagcctggagccacagcccagg

SEQ ID NO: 8140921 - DNA, 22 bp, Homo sapiens
cagcctggagccacagcccagg

SEQ ID NO: 8140922 - DNA, 22 bp, Homo sapiens
cagcctggattgcagaatgcta

SEQ ID NO: 8140923 - DNA, 22 bp, Homo sapiens
cagcctggattgcagaatgcta

SEQ ID NO: 8140924 - DNA, 22 bp, Homo sapiens
cagcctggattgcagaatgcta

SEQ ID NO: 8140925 - DNA, 22 bp, Homo sapiens
cagcctggattgcagaatgcta

SEQ ID NO: 8140926 - DNA, 22 bp, Homo sapiens
cagcctggattgcagaatgcta

SEQ ID NO: 8140927 - DNA, 22 bp, Homo sapiens
cagccttcaaggcttagctcag

SEQ ID NO: 8140928 - DNA, 22 bp, Homo sapiens
cagctacagaggccacatggct

SEQ ID NO: 8140929 - DNA, 22 bp, Homo sapiens
cagctacagttccactgagcat

SEQ ID NO: 8140930 - DNA, 22 bp, Homo sapiens
cagctactcctcccatgacttc

SEQ ID NO: 8140931 - DNA, 22 bp, Homo sapiens
cagctagctaagaaggccagag

SEQ ID NO: 8140932 - DNA, 22 bp, Homo sapiens
cagctagcttccctgcagtgct

SEQ ID NO: 8140933 - DNA, 22 bp, Homo sapiens
cagctagctaagaaggccagag

SEQ ID NO: 8140934 - DNA, 22 bp, Homo sapiens
cagctagcggtgctggcggctc

SEQ ID NO: 8140935 - DNA, 22 bp, Homo sapiens
gtgcccagtcctgccttgacag

SEQ ID NO: 8140936 - DNA, 22 bp, Homo sapiens
cagctattaatgtttttgctga

SEQ ID NO: 8140937 - DNA, 22 bp, Homo sapiens
cagctatagatggactgaagag

SEQ ID NO: 8140938 - DNA, 22 bp, Homo sapiens
cagctagggagtggcagagctt

SEQ ID NO: 8140939 - DNA, 22 bp, Homo sapiens
cagctaggaaaccagagggcag

SEQ ID NO: 8140940 - DNA, 22 bp, Homo sapiens
cagctagggagtggcagagctt

SEQ ID NO: 8140941 - DNA, 17 bp, Homo sapiens
cagccctgccgttccca

SEQ ID NO: 8140942 - DNA, 17 bp, Homo sapiens
cagccctgccgttccca

SEQ ID NO: 8140943 - DNA, 17 bp, Homo sapiens
cagccctgccgttccca

SEQ ID NO: 8140944 - DNA, 22 bp, Homo sapiens
cagccctgcggaggtgtatact

SEQ ID NO: 8140945 - DNA, 22 bp, Homo sapiens
cagccctgccatggagcctcct

SEQ ID NO: 8140946 - DNA, 22 bp, Homo sapiens
cagccctgccatggagcctcct

SEQ ID NO: 8140947 - DNA, 22 bp, Homo sapiens
cagccctgccatggagcctcct

SEQ ID NO: 8140948 - DNA, 22 bp, Homo sapiens
cagccctgcagccatggcctgt

SEQ ID NO: 8140949 - DNA, 23 bp, Homo sapiens
cagccctgaaatcgaggtgacac

SEQ ID NO: 8140950 - DNA, 22 bp, Homo sapiens
cagccctgcagccatggcctgt

SEQ ID NO: 8140951 - DNA, 22 bp, Homo sapiens
cagccctgcagccatggcctgt

SEQ ID NO: 8140952 - DNA, 22 bp, Homo sapiens
cagccctgcagctggatctcac

SEQ ID NO: 8140953 - DNA, 22 bp, Homo sapiens
cagccctgcagctggatctcac

SEQ ID NO: 8140954 - DNA, 22 bp, Homo sapiens
cagccctgctgacactgtctga

SEQ ID NO: 8140955 - DNA, 22 bp, Homo sapiens
cagccctgctgacactgtctga

SEQ ID NO: 8140956 - DNA, 22 bp, Homo sapiens
cagccctgctgccttagtgcct

SEQ ID NO: 8140957 - DNA, 22 bp, Homo sapiens
cagccctgctcttagtgtctcc

SEQ ID NO: 8140958 - DNA, 22 bp, Homo sapiens
cagccctgctcttagtgtctcc

SEQ ID NO: 8140959 - DNA, 22 bp, Homo sapiens
cagccctgctcttagtgtctcc

SEQ ID NO: 8140960 - DNA, 22 bp, Homo sapiens
cagccctgctggttttgggcaa

SEQ ID NO: 8140961 - DNA, 22 bp, Homo sapiens
cagccctgctggcaatgatgag

SEQ ID NO: 8140962 - DNA, 22 bp, Homo sapiens
cagccctgctggcaatgatgag

SEQ ID NO: 8140963 - DNA, 22 bp, Homo sapiens
cagccctgctggttttgggcaa

SEQ ID NO: 8140964 - DNA, 22 bp, Homo sapiens
cagccctgctggttttgggcaa

SEQ ID NO: 8140965 - DNA, 22 bp, Homo sapiens
cagccctgcttccccgctagtt

SEQ ID NO: 8140966 - DNA, 22 bp, Homo sapiens
cagccctgcttccccgctagtt

SEQ ID NO: 8140967 - DNA, 22 bp, Homo sapiens
cagccctgcttccccgctagtt

SEQ ID NO: 8140968 - DNA, 22 bp, Homo sapiens
cagccctggcccaggtgcctta

SEQ ID NO: 8140969 - DNA, 20 bp, Homo sapiens
cagcctccactcactcagct

SEQ ID NO: 8140970 - DNA, 20 bp, Homo sapiens
cagcctccactcactcagct

SEQ ID NO: 8140971 - DNA, 22 bp, Homo sapiens
cagccctggcagctttcagggt

SEQ ID NO: 8140972 - DNA, 22 bp, Homo sapiens
cagccctggcagctttcagggt

SEQ ID NO: 8140973 - DNA, 22 bp, Homo sapiens
cagccctggcccaggtgcctta

SEQ ID NO: 8140974 - DNA, 22 bp, Homo sapiens
cagccctggcccaggtgcctta

SEQ ID NO: 8140975 - DNA, 22 bp, Homo sapiens
cagccctggcccaggtgcctta

SEQ ID NO: 8140976 - DNA, 22 bp, Homo sapiens
cagccctggcccaggtgcctta

SEQ ID NO: 8140977 - DNA, 22 bp, Homo sapiens
cagccctggaacagctgactca

SEQ ID NO: 8140978 - DNA, 22 bp, Homo sapiens
cagccctggaacagctgactca

SEQ ID NO: 8140979 - DNA, 22 bp, Homo sapiens
cagccctggaacagctgactca

SEQ ID NO: 8140980 - DNA, 22 bp, Homo sapiens
cagccctggaacagctgactca

SEQ ID NO: 8140981 - DNA, 23 bp, Homo sapiens
cagccctggagatgtgggaggca

SEQ ID NO: 8140982 - DNA, 23 bp, Homo sapiens
cagccctggagatgtgggaggca

SEQ ID NO: 8140983 - DNA, 23 bp, Homo sapiens
cagccctggagatgtgggaggca

SEQ ID NO: 8140984 - DNA, 22 bp, Homo sapiens
cagcctgcagggctgcctgttg

SEQ ID NO: 8140985 - DNA, 22 bp, Homo sapiens
cagcctgactatggctgcaggt

SEQ ID NO: 8140986 - DNA, 22 bp, Homo sapiens
cagcctgactatggctgcaggt

SEQ ID NO: 8140987 - DNA, 22 bp, Homo sapiens
cagcctgagccttctgtagcaa

SEQ ID NO: 8140988 - DNA, 22 bp, Homo sapiens
cagcctctttccacatcaggca

SEQ ID NO: 8140989 - DNA, 22 bp, Homo sapiens
cagcctgacaccagctttgggc

SEQ ID NO: 8140990 - DNA, 22 bp, Homo sapiens
cagcctctttccacatcaggca

SEQ ID NO: 8140991 - DNA, 22 bp, Homo sapiens
cagcctctttccacatcaggca

SEQ ID NO: 8140992 - DNA, 22 bp, Homo sapiens
cagcctgccctggaagcccagc

SEQ ID NO: 8140993 - DNA, 22 bp, Homo sapiens
cagcctgctagggcaatgcctt

SEQ ID NO: 8140994 - DNA, 22 bp, Homo sapiens
cagcctgccgtcagccaggtag

SEQ ID NO: 8140995 - DNA, 20 bp, Homo sapiens
cagcctgcatcatctgcagc

SEQ ID NO: 8140996 - DNA, 22 bp, Homo sapiens
cagcctgcagggctgcctgttg

SEQ ID NO: 8140997 - DNA, 22 bp, Homo sapiens
gtgccccagacacgcatgtggg

SEQ ID NO: 8140998 - DNA, 22 bp, Homo sapiens
gtgccccagacacgcatgtggg

SEQ ID NO: 8140999 - DNA, 22 bp, Homo sapiens
gtgcccagttgaggccaggact

SEQ ID NO: 8141000 - DNA, 22 bp, Homo sapiens
gtgctgagtagaatgaatgcct

SEQ ID NO: 8141001 - DNA, 22 bp, Homo sapiens
gtgctgagtagaatgaatgcct

SEQ ID NO: 8141002 - DNA, 22 bp, Homo sapiens
gtgctgtgcgctttttctgtat

SEQ ID NO: 8141003 - DNA, 22 bp, Homo sapiens
gtgccctccgtgttcatagagc

SEQ ID NO: 8141004 - DNA, 22 bp, Homo sapiens
gtgctgtgtctatcaggaataa

SEQ ID NO: 8141005 - DNA, 22 bp, Homo sapiens
gtgctgtgtgatccatgctggc

SEQ ID NO: 8141006 - DNA, 22 bp, Homo sapiens
gtgctgtgtgatccatgctggc

SEQ ID NO: 8141007 - DNA, 18 bp, Homo sapiens
gtgctgtgggcagtggcc

SEQ ID NO: 8141008 - DNA, 22 bp, Homo sapiens
gtgctgtgcgctttttctgtat

SEQ ID NO: 8141009 - DNA, 18 bp, Homo sapiens
gtgctgtgggcagtggcc

SEQ ID NO: 8141010 - DNA, 22 bp, Homo sapiens
gtccctgggggtttaggactca

SEQ ID NO: 8141011 - DNA, 22 bp, Homo sapiens
gtccctgggtctaaggcagtaa

SEQ ID NO: 8141012 - DNA, 22 bp, Homo sapiens
gtccctgggtctaaggcagtaa

SEQ ID NO: 8141013 - DNA, 22 bp, Homo sapiens
gtccctggtctaccgtggcttc

SEQ ID NO: 8141014 - DNA, 22 bp, Homo sapiens
gtccctgggtagctcagtggct

SEQ ID NO: 8141015 - DNA, 22 bp, Homo sapiens
gtccctgggtctaaggcagtaa

SEQ ID NO: 8141016 - DNA, 22 bp, Homo sapiens
gtctcttttatggtgagttgat

SEQ ID NO: 8141017 - DNA, 22 bp, Homo sapiens
gtctcttgttatcatttctgag

SEQ ID NO: 8141018 - DNA, 22 bp, Homo sapiens
gtctcttgttatcatttctgag

SEQ ID NO: 8141019 - DNA, 22 bp, Homo sapiens
gtctcttgtggatgttgggaag

SEQ ID NO: 8141020 - DNA, 22 bp, Homo sapiens
gtcccttggctcacaaacagct

SEQ ID NO: 8141021 - DNA, 22 bp, Homo sapiens
gtctcttctttgccggtcctgc

SEQ ID NO: 8141022 - DNA, 22 bp, Homo sapiens
gtctcttctttgccggtcctgc

SEQ ID NO: 8141023 - DNA, 22 bp, Homo sapiens
gtctggaaagagctgaggttca

SEQ ID NO: 8141024 - DNA, 19 bp, Homo sapiens
gtcccttcactcctgctgg

SEQ ID NO: 8141025 - DNA, 22 bp, Homo sapiens
gtccctggggaatcagctggag

SEQ ID NO: 8141026 - DNA, 19 bp, Homo sapiens
gtccctgggcagaggcacc

SEQ ID NO: 8141027 - DNA, 19 bp, Homo sapiens
gtccctgggcagaggcacc

SEQ ID NO: 8141028 - DNA, 22 bp, Homo sapiens
gtccctgggatgcccttctggg

SEQ ID NO: 8141029 - DNA, 22 bp, Homo sapiens
gtccctggcgctttcgagcctt

SEQ ID NO: 8141030 - DNA, 22 bp, Homo sapiens
gtccctgggaaaggagagggca

SEQ ID NO: 8141031 - DNA, 22 bp, Homo sapiens
gtccctggcgctttcgagcctt

SEQ ID NO: 8141032 - DNA, 22 bp, Homo sapiens
gtccctggatctgggacagctg

SEQ ID NO: 8141033 - DNA, 22 bp, Homo sapiens
gtcccagggaagaaggcagcac

SEQ ID NO: 8141034 - DNA, 22 bp, Homo sapiens
gtcccagggaagaaggcagcac

SEQ ID NO: 8141035 - DNA, 22 bp, Homo sapiens
gtcccagggaagaaggcagcac

SEQ ID NO: 8141036 - DNA, 22 bp, Homo sapiens
gtcccaggcttatgtggagctt

SEQ ID NO: 8141037 - DNA, 22 bp, Homo sapiens
gtctggaaccaagacgtgtagc

SEQ ID NO: 8141038 - DNA, 22 bp, Homo sapiens
gtctggaaatttaaggtatgag

SEQ ID NO: 8141039 - DNA, 22 bp, Homo sapiens
gtctggaaatttaaggtatgag

SEQ ID NO: 8141040 - DNA, 22 bp, Homo sapiens
gtctggaagaacctgtgccagt

SEQ ID NO: 8141041 - DNA, 22 bp, Homo sapiens
gtctggaaccaatatttgaggg

SEQ ID NO: 8141042 - DNA, 22 bp, Homo sapiens
gtctggaaaggggcttttatct

SEQ ID NO: 8141043 - DNA, 22 bp, Homo sapiens
gtctggaaaggtatttgtctca

SEQ ID NO: 8141044 - DNA, 22 bp, Homo sapiens
gtctggaaattcaatttaatgc

SEQ ID NO: 8141045 - DNA, 22 bp, Homo sapiens
gtctggaaatattgacttcaga

SEQ ID NO: 8141046 - DNA, 22 bp, Homo sapiens
gtctggaaattaagaggaggtt

SEQ ID NO: 8141047 - DNA, 22 bp, Homo sapiens
gtctggaagtgtcttgttaagt

SEQ ID NO: 8141048 - DNA, 22 bp, Homo sapiens
gtctggaagggagtgcattttc

SEQ ID NO: 8141049 - DNA, 22 bp, Homo sapiens
gtctggaatatagcaagctctt

SEQ ID NO: 8141050 - DNA, 22 bp, Homo sapiens
gtctggaagctctaggggagaa

SEQ ID NO: 8141051 - DNA, 22 bp, Homo sapiens
gtctggaagagcaggaataaac

SEQ ID NO: 8141052 - DNA, 22 bp, Homo sapiens
gtctggaagaactagggatgtt

SEQ ID NO: 8141053 - DNA, 22 bp, Homo sapiens
gtctggaagaactagggatgtt

SEQ ID NO: 8141054 - DNA, 22 bp, Homo sapiens
gtctggaaggaggagatggagc

SEQ ID NO: 8141055 - DNA, 22 bp, Homo sapiens
gtctggaaggaggagatggagc

SEQ ID NO: 8141056 - DNA, 22 bp, Homo sapiens
gtctggagcctgggtccctgct

SEQ ID NO: 8141057 - DNA, 22 bp, Homo sapiens
gtctggagccccagtcaatgag

SEQ ID NO: 8141058 - DNA, 22 bp, Homo sapiens
gtctggagccactgctgctgct

SEQ ID NO: 8141059 - DNA, 22 bp, Homo sapiens
gtctggagccaccctaagcatt

SEQ ID NO: 8141060 - DNA, 22 bp, Homo sapiens
gtctggagagctgagcagagtt

SEQ ID NO: 8141061 - DNA, 22 bp, Homo sapiens
gtctggagccaccctaagcatt

SEQ ID NO: 8141062 - DNA, 22 bp, Homo sapiens
cagccagggagcaaagagttga

SEQ ID NO: 8141063 - DNA, 22 bp, Homo sapiens
cagccagggagcaaagagttga

SEQ ID NO: 8141064 - DNA, 22 bp, Homo sapiens
cagccagggagggcaaatgaga

SEQ ID NO: 8141065 - DNA, 22 bp, Homo sapiens
cagccaggcctggtgaccaaag

SEQ ID NO: 8141066 - DNA, 22 bp, Homo sapiens
cagccaggcccccgagtcgttg

SEQ ID NO: 8141067 - DNA, 22 bp, Homo sapiens
cagccaggcccccgagtcgttg

SEQ ID NO: 8141068 - DNA, 22 bp, Homo sapiens
cagccaggcctggtgaccaaag

SEQ ID NO: 8141069 - DNA, 22 bp, Homo sapiens
cagccccttgtccggtagccac

SEQ ID NO: 8141070 - DNA, 22 bp, Homo sapiens
cagccccttcctggcatctgga

SEQ ID NO: 8141071 - DNA, 22 bp, Homo sapiens
cagccccttcctggcatctgga

SEQ ID NO: 8141072 - DNA, 22 bp, Homo sapiens
cagccctcaaaccacttccagg

SEQ ID NO: 8141073 - DNA, 22 bp, Homo sapiens
cagccctcaaaccacttccagg

SEQ ID NO: 8141074 - DNA, 22 bp, Homo sapiens
cagccccttgtccggtagccac

SEQ ID NO: 8141075 - DNA, 22 bp, Homo sapiens
cagcccgccctgaactttcggg

SEQ ID NO: 8141076 - DNA, 22 bp, Homo sapiens
cagcccctcacagagctgtcct

SEQ ID NO: 8141077 - DNA, 22 bp, Homo sapiens
cagcccctcacagagctgtcct

SEQ ID NO: 8141078 - DNA, 22 bp, Homo sapiens
cagcccctccctcaggcaggtg

SEQ ID NO: 8141079 - DNA, 22 bp, Homo sapiens
cagccaggttagtgctaattgt

SEQ ID NO: 8141080 - DNA, 22 bp, Homo sapiens
cagccaggtatgggcgtgcggg

SEQ ID NO: 8141081 - DNA, 22 bp, Homo sapiens
cagccaggttcaagtccttata

SEQ ID NO: 8141082 - DNA, 22 bp, Homo sapiens
cagccccatggtgtgctccagc

SEQ ID NO: 8141083 - DNA, 22 bp, Homo sapiens
cagccagggtcaggcagcttct

SEQ ID NO: 8141084 - DNA, 22 bp, Homo sapiens
cagccaggggctggcgtgttga

SEQ ID NO: 8141085 - DNA, 22 bp, Homo sapiens
cagccagggagggcaaatgaga

SEQ ID NO: 8141086 - DNA, 22 bp, Homo sapiens
cagccaggggctggcgtgttga

SEQ ID NO: 8141087 - DNA, 22 bp, Homo sapiens
cagccaggtatgggcgtgcggg

SEQ ID NO: 8141088 - DNA, 22 bp, Homo sapiens
cagccagggtcaggcagcttct

SEQ ID NO: 8141089 - DNA, 22 bp, Homo sapiens
cagccagggtcaggcagcttct

SEQ ID NO: 8141090 - DNA, 22 bp, Homo sapiens
cagccagggtcaggcagcttct

SEQ ID NO: 8141091 - DNA, 22 bp, Homo sapiens
cagccagggtcaggcagcttct

SEQ ID NO: 8141092 - DNA, 22 bp, Homo sapiens
gtctgtgttttcaggcctttgt

SEQ ID NO: 8141093 - DNA, 18 bp, Homo sapiens
gtctgtgtggcttgggga

SEQ ID NO: 8141094 - DNA, 22 bp, Homo sapiens
gtctgtgtgcacagcgagtgcc

SEQ ID NO: 8141095 - DNA, 22 bp, Homo sapiens
gtctgtgtgcacagagctttgg

SEQ ID NO: 8141096 - DNA, 22 bp, Homo sapiens
gtctgtgggccaaatacagccc

SEQ ID NO: 8141097 - DNA, 22 bp, Homo sapiens
gtctgtggtagacaggaaggca

SEQ ID NO: 8141098 - DNA, 22 bp, Homo sapiens
gtctgtggtccctgctggggac

SEQ ID NO: 8141099 - DNA, 22 bp, Homo sapiens
gtctgtggtccctgctggggac

SEQ ID NO: 8141100 - DNA, 22 bp, Homo sapiens
gtctgtctcctgggtgcgcacc

SEQ ID NO: 8141101 - DNA, 22 bp, Homo sapiens
gtctgtctctctccagagtgca

SEQ ID NO: 8141102 - DNA, 22 bp, Homo sapiens
gtctgtcatctgagatggagtg

SEQ ID NO: 8141103 - DNA, 22 bp, Homo sapiens
gtctgtccttttcatctcccaa

SEQ ID NO: 8141104 - DNA, 22 bp, Homo sapiens
cagccctcatcccgcctgcgtt

SEQ ID NO: 8141105 - DNA, 22 bp, Homo sapiens
cagccctcatcccgcctgcgtt

SEQ ID NO: 8141106 - DNA, 22 bp, Homo sapiens
cagccctcatcccgcctgcgtt

SEQ ID NO: 8141107 - DNA, 22 bp, Homo sapiens
cagccctcaggtcctcagcagc

SEQ ID NO: 8141108 - DNA, 22 bp, Homo sapiens
cagccctcaggtcctcagcagc

SEQ ID NO: 8141109 - DNA, 22 bp, Homo sapiens
cagccctcaggtcctcagcagc

SEQ ID NO: 8141110 - DNA, 22 bp, Homo sapiens
gtcataaagcttgttgcattta

SEQ ID NO: 8141111 - DNA, 22 bp, Homo sapiens
gtcatatacactgcatgtaatc

SEQ ID NO: 8141112 - DNA, 23 bp, Homo sapiens
gtcatctctcctgggccagcgcc

SEQ ID NO: 8141113 - DNA, 22 bp, Homo sapiens
gtcatctcacagcagggctagt

SEQ ID NO: 8141114 - DNA, 22 bp, Homo sapiens
gtcatctctgggcccgcactgc

SEQ ID NO: 8141115 - DNA, 22 bp, Homo sapiens
gtcatctctgggcccgcactgc

SEQ ID NO: 8141116 - DNA, 22 bp, Homo sapiens
gtcatctctgtgaatgaggcag

SEQ ID NO: 8141117 - DNA, 22 bp, Homo sapiens
gtcatctcaagtaagtgaacaa

SEQ ID NO: 8141118 - DNA, 23 bp, Homo sapiens
gtcatcattaaagtcacagagac

SEQ ID NO: 8141119 - DNA, 22 bp, Homo sapiens
gtcatcatcaggcagatgctgc

SEQ ID NO: 8141120 - DNA, 21 bp, Homo sapiens
gtcatccacctctcgggctct

SEQ ID NO: 8141121 - DNA, 22 bp, Homo sapiens
gtcatctgtttacttttctgct

SEQ ID NO: 8141122 - DNA, 22 bp, Homo sapiens
gtcatctctttacttttgctga

SEQ ID NO: 8141123 - DNA, 22 bp, Homo sapiens
gtcatctcttatcactgacttc

SEQ ID NO: 8141124 - DNA, 22 bp, Homo sapiens
gtcatcttaaggactgctatag

SEQ ID NO: 8141125 - DNA, 22 bp, Homo sapiens
gtcatcttaaggactgctatag

SEQ ID NO: 8141126 - DNA, 22 bp, Homo sapiens
gtcatgagaaatctttgaaggt

SEQ ID NO: 8141127 - DNA, 22 bp, Homo sapiens
gtcatgtcagcaaatatcatag

SEQ ID NO: 8141128 - DNA, 22 bp, Homo sapiens
gtcatggtgctagcgggaatgt

SEQ ID NO: 8141129 - DNA, 22 bp, Homo sapiens
cagcaggcgttgggagaaagac

SEQ ID NO: 8141130 - DNA, 22 bp, Homo sapiens
cagcaggcgttgggagaaagac

SEQ ID NO: 8141131 - DNA, 22 bp, Homo sapiens
cagcaggcgttgggagaaagac

SEQ ID NO: 8141132 - DNA, 22 bp, Homo sapiens
cagcaggcgttgggagaaagac

SEQ ID NO: 8141133 - DNA, 20 bp, Homo sapiens
cagcaggctatggggcaccc

SEQ ID NO: 8141134 - DNA, 20 bp, Homo sapiens
cagcaggctatggggcaccc

SEQ ID NO: 8141135 - DNA, 20 bp, Homo sapiens
cagcaggctatggggcaccc

SEQ ID NO: 8141136 - DNA, 22 bp, Homo sapiens
cagcaggctctgagtggctgcc

SEQ ID NO: 8141137 - DNA, 22 bp, Homo sapiens
cagcaggctgcgattgctcatt

SEQ ID NO: 8141138 - DNA, 22 bp, Homo sapiens
cagcaggctgcgattgctcatt

SEQ ID NO: 8141139 - DNA, 22 bp, Homo sapiens
cagcaggctctgagtggctgcc

SEQ ID NO: 8141140 - DNA, 22 bp, Homo sapiens
cagcaggctctgagtggctgcc

SEQ ID NO: 8141141 - DNA, 22 bp, Homo sapiens
cagcaggctctgagtggctgcc

SEQ ID NO: 8141142 - DNA, 22 bp, Homo sapiens
cagcaggctctgagtggctgcc

SEQ ID NO: 8141143 - DNA, 22 bp, Homo sapiens
cagcaggctctgagtggctgcc

SEQ ID NO: 8141144 - DNA, 22 bp, Homo sapiens
cagcaggctctgagtggctgcc

SEQ ID NO: 8141145 - DNA, 22 bp, Homo sapiens
cagcaggctgcgattgctcatt

SEQ ID NO: 8141146 - DNA, 22 bp, Homo sapiens
cagcaggctggacttcagtccc

SEQ ID NO: 8141147 - DNA, 22 bp, Homo sapiens
cagcaggctgtggaaatcctgg

SEQ ID NO: 8141148 - DNA, 22 bp, Homo sapiens
gtcccagaggctttggccacag

SEQ ID NO: 8141149 - DNA, 22 bp, Homo sapiens
gtcccagcttcccactagcagc

SEQ ID NO: 8141150 - DNA, 22 bp, Homo sapiens
gtcccaggaacattctggctag

SEQ ID NO: 8141151 - DNA, 22 bp, Homo sapiens
gtcccagcttcccactagcagc

SEQ ID NO: 8141152 - DNA, 22 bp, Homo sapiens
gtcccaggaacattctggctag

SEQ ID NO: 8141153 - DNA, 22 bp, Homo sapiens
gtcccaggaacattctggctag

SEQ ID NO: 8141154 - DNA, 22 bp, Homo sapiens
gtcccaggcaggccactggcag

SEQ ID NO: 8141155 - DNA, 22 bp, Homo sapiens
gtcccaggcaggccactggcag

SEQ ID NO: 8141156 - DNA, 22 bp, Homo sapiens
gtcccaggcagagtcaggaggg

SEQ ID NO: 8141157 - DNA, 22 bp, Homo sapiens
gtcccaggcagagtcaggaggg

SEQ ID NO: 8141158 - DNA, 22 bp, Homo sapiens
gtcccaggagttgctgggcctt

SEQ ID NO: 8141159 - DNA, 22 bp, Homo sapiens
cagcagctggtgagacacagcc

SEQ ID NO: 8141160 - DNA, 22 bp, Homo sapiens
cagcagctgggaaggaggctga

SEQ ID NO: 8141161 - DNA, 22 bp, Homo sapiens
cagcagctgggaaggaggctga

SEQ ID NO: 8141162 - DNA, 22 bp, Homo sapiens
cagcagctgggaaggaggctga

SEQ ID NO: 8141163 - DNA, 22 bp, Homo sapiens
cagcagctgggaaggaggctga

SEQ ID NO: 8141164 - DNA, 22 bp, Homo sapiens
cagcagctgggaaggaggctga

SEQ ID NO: 8141165 - DNA, 22 bp, Homo sapiens
cagcagctgcgtgcccaggccg

SEQ ID NO: 8141166 - DNA, 22 bp, Homo sapiens
cagcagctgcgtgcccaggccg

SEQ ID NO: 8141167 - DNA, 22 bp, Homo sapiens
cagcagctgggaaggaggctga

SEQ ID NO: 8141168 - DNA, 22 bp, Homo sapiens
cagcagctgcgtgcccaggccg

SEQ ID NO: 8141169 - DNA, 22 bp, Homo sapiens
cagcagctgcaaatggaaacag

SEQ ID NO: 8141170 - DNA, 22 bp, Homo sapiens
cagcagctgcctcagctgggga

SEQ ID NO: 8141171 - DNA, 22 bp, Homo sapiens
cagcagctgcgtgcccaggccg

SEQ ID NO: 8141172 - DNA, 22 bp, Homo sapiens
cagcagctgcaaatggaaacag

SEQ ID NO: 8141173 - DNA, 22 bp, Homo sapiens
cagcagctgatggggaagtgat

SEQ ID NO: 8141174 - DNA, 22 bp, Homo sapiens
cagcagctgatggggaagtgat

SEQ ID NO: 8141175 - DNA, 22 bp, Homo sapiens
cagcagctgatggggaagtgat

SEQ ID NO: 8141176 - DNA, 22 bp, Homo sapiens
cagcagctagaggaagggcaga

SEQ ID NO: 8141177 - DNA, 22 bp, Homo sapiens
cagcacctggcacaggagggcc

SEQ ID NO: 8141178 - DNA, 22 bp, Homo sapiens
cagcaccttcctatccaggaga

SEQ ID NO: 8141179 - DNA, 22 bp, Homo sapiens
cagcacctctgggtcttgtctt

SEQ ID NO: 8141180 - DNA, 22 bp, Homo sapiens
cagcacctctgggtcttgtctt

SEQ ID NO: 8141181 - DNA, 22 bp, Homo sapiens
cagcaccctcggaggctgccgt

SEQ ID NO: 8141182 - DNA, 22 bp, Homo sapiens
cagcaccattttcctggtcagc

SEQ ID NO: 8141183 - DNA, 22 bp, Homo sapiens
cagcaccattttcctggtcagc

SEQ ID NO: 8141184 - DNA, 22 bp, Homo sapiens
cagcacccctcctggctatgaa

SEQ ID NO: 8141185 - DNA, 22 bp, Homo sapiens
cagcaggaaagacatctgagca

SEQ ID NO: 8141186 - DNA, 22 bp, Homo sapiens
gtcataaagacagaaacattcc

SEQ ID NO: 8141187 - DNA, 22 bp, Homo sapiens
gtcagcattttacatgtgtcat

SEQ ID NO: 8141188 - DNA, 22 bp, Homo sapiens
gtcagcatgagcaagggctgac

SEQ ID NO: 8141189 - DNA, 22 bp, Homo sapiens
gtcagcattagcaatgactggt

SEQ ID NO: 8141190 - DNA, 22 bp, Homo sapiens
cagcagcttctgttgatcagaa

SEQ ID NO: 8141191 - DNA, 22 bp, Homo sapiens
cagcagcttctgttgatcagaa

SEQ ID NO: 8141192 - DNA, 22 bp, Homo sapiens
cagcagcttctgttgatcagaa

SEQ ID NO: 8141193 - DNA, 22 bp, Homo sapiens
cagcagctttgccaagtcagcc

SEQ ID NO: 8141194 - DNA, 20 bp, Homo sapiens
cagcaggaaaagtgcctcag

SEQ ID NO: 8141195 - DNA, 22 bp, Homo sapiens
cagcagcttttgcattctcatt

SEQ ID NO: 8141196 - DNA, 22 bp, Homo sapiens
cagcagctgtttacggaacacc

SEQ ID NO: 8141197 - DNA, 22 bp, Homo sapiens
cagcagctggttatacctgtgg

SEQ ID NO: 8141198 - DNA, 22 bp, Homo sapiens
cagcagctggtgagacacagcc

SEQ ID NO: 8141199 - DNA, 22 bp, Homo sapiens
cagcagctggtgagacacagcc

SEQ ID NO: 8141200 - DNA, 22 bp, Homo sapiens
cagcagctggtgagacacagcc

SEQ ID NO: 8141201 - DNA, 22 bp, Homo sapiens
cagcagctggttatacctgtgg

SEQ ID NO: 8141202 - DNA, 22 bp, Homo sapiens
cagcagctggttatacctgtgg

SEQ ID NO: 8141203 - DNA, 22 bp, Homo sapiens
cagcagctggtgagacacagcc

SEQ ID NO: 8141204 - DNA, 22 bp, Homo sapiens
agtacacagagttattttgtgt

SEQ ID NO: 8141205 - DNA, 22 bp, Homo sapiens
agtacacaagacacatttaaaa

SEQ ID NO: 8141206 - DNA, 22 bp, Homo sapiens
agtacacaagacacatttaaaa

SEQ ID NO: 8141207 - DNA, 22 bp, Homo sapiens
agtacaatttaatgaagatagc

SEQ ID NO: 8141208 - DNA, 22 bp, Homo sapiens
agtacagggagtttgttgtgtt

SEQ ID NO: 8141209 - DNA, 22 bp, Homo sapiens
agtacactggcaaatgtggtgg

SEQ ID NO: 8141210 - DNA, 22 bp, Homo sapiens
agtacagacctgtctcttcctg

SEQ ID NO: 8141211 - DNA, 22 bp, Homo sapiens
ctaagatagattttttcacttt

SEQ ID NO: 8141212 - DNA, 21 bp, Homo sapiens
ctaagcaaggagcaggggtag

SEQ ID NO: 8141213 - DNA, 22 bp, Homo sapiens
ctaagcaagttccactctacaa

SEQ ID NO: 8141214 - DNA, 20 bp, Homo sapiens
ctaagaggtccttccacatc

SEQ ID NO: 8141215 - DNA, 20 bp, Homo sapiens
ctaagaggtccttccacatc

SEQ ID NO: 8141216 - DNA, 18 bp, Homo sapiens
ctaagaggtcgtttctca

SEQ ID NO: 8141217 - DNA, 22 bp, Homo sapiens
ctaagaggaagtactctgttat

SEQ ID NO: 8141218 - DNA, 22 bp, Homo sapiens
ctaagaggaagtactctgttat

SEQ ID NO: 8141219 - DNA, 20 bp, Homo sapiens
ctaagaggaggactaggttt

SEQ ID NO: 8141220 - DNA, 22 bp, Homo sapiens
ctaagacatgccctgcatgata

SEQ ID NO: 8141221 - DNA, 22 bp, Homo sapiens
ctaagaaatgttgtgaatgcca

SEQ ID NO: 8141222 - DNA, 22 bp, Homo sapiens
ctaaacttcttggcaattttat

SEQ ID NO: 8141223 - DNA, 22 bp, Homo sapiens
ctaaactttgtttatactctga

SEQ ID NO: 8141224 - DNA, 21 bp, Homo sapiens
cgggctggccgggccctcacc

SEQ ID NO: 8141225 - DNA, 22 bp, Homo sapiens
cgggcgcactccgggcagctgt

SEQ ID NO: 8141226 - DNA, 22 bp, Homo sapiens
cgggcgcactccgggcagctgt

SEQ ID NO: 8141227 - DNA, 22 bp, Homo sapiens
agtacaagtagaatgctacaag

SEQ ID NO: 8141228 - DNA, 22 bp, Homo sapiens
agtacaagtagaatgctacaag

SEQ ID NO: 8141229 - DNA, 22 bp, Homo sapiens
agtacaacattagagtatctta

SEQ ID NO: 8141230 - DNA, 22 bp, Homo sapiens
agtacaagtagaatgctacaag

SEQ ID NO: 8141231 - DNA, 22 bp, Homo sapiens
agtacaactagaaataggtgta

SEQ ID NO: 8141232 - DNA, 22 bp, Homo sapiens
agtacaaattatagcgcttgga

SEQ ID NO: 8141233 - DNA, 22 bp, Homo sapiens
agtacaaattatagcgcttgga

SEQ ID NO: 8141234 - DNA, 22 bp, Homo sapiens
agtacaatgtctgacacagtag

SEQ ID NO: 8141235 - DNA, 20 bp, Homo sapiens
agtacaatgtatgattcaga

SEQ ID NO: 8141236 - DNA, 22 bp, Homo sapiens
cggctcaggccacaggacggca

SEQ ID NO: 8141237 - DNA, 22 bp, Homo sapiens
cgggcaaggcgagactaggccc

SEQ ID NO: 8141238 - DNA, 22 bp, Homo sapiens
cgggcagtgtggctccagagtc

SEQ ID NO: 8141239 - DNA, 22 bp, Homo sapiens
cgggcagcggcgtggccatggt

SEQ ID NO: 8141240 - DNA, 22 bp, Homo sapiens
cgggccctttaaggatgtgtcg

SEQ ID NO: 8141241 - DNA, 17 bp, Homo sapiens
cgggcatggagggcagg

SEQ ID NO: 8141242 - DNA, 22 bp, Homo sapiens
cgggcagtgtggctccagagtc

SEQ ID NO: 8141243 - DNA, 20 bp, Homo sapiens
cggctcagcctctccctccc

SEQ ID NO: 8141244 - DNA, 22 bp, Homo sapiens
cggctcagctagcttggcccca

SEQ ID NO: 8141245 - DNA, 22 bp, Homo sapiens
agtaaaaatatgcttgtggcta

SEQ ID NO: 8141246 - DNA, 22 bp, Homo sapiens
agtaaaaagttcagaatggttg

SEQ ID NO: 8141247 - DNA, 22 bp, Homo sapiens
aggtttctggatttattatggc

SEQ ID NO: 8141248 - DNA, 22 bp, Homo sapiens
aggtttctggaaaggttttgct

SEQ ID NO: 8141249 - DNA, 22 bp, Homo sapiens
aggtttctttatgctgctagaa

SEQ ID NO: 8141250 - DNA, 22 bp, Homo sapiens
aggtttcttcttaggaatatgt

SEQ ID NO: 8141251 - DNA, 19 bp, Homo sapiens
cgcaggcttcgggtcgctc

SEQ ID NO: 8141252 - DNA, 22 bp, Homo sapiens
cgcagggccgcgagcgggacca

SEQ ID NO: 8141253 - DNA, 22 bp, Homo sapiens
cgcaggctgcagccaagaagag

SEQ ID NO: 8141254 - DNA, 22 bp, Homo sapiens
cgcaggctggcgcggagtggca

SEQ ID NO: 8141255 - DNA, 22 bp, Homo sapiens
cgcaggctcggttcacagagca

SEQ ID NO: 8141256 - DNA, 22 bp, Homo sapiens
cgcaggtgaaagaggctgggca

SEQ ID NO: 8141257 - DNA, 22 bp, Homo sapiens
cgcaggtgaaagaggctgggca

SEQ ID NO: 8141258 - DNA, 22 bp, Homo sapiens
cgcaggtgaaagaggctgggca

SEQ ID NO: 8141259 - DNA, 22 bp, Homo sapiens
cgcaggtgaaagaggctgggca

SEQ ID NO: 8141260 - DNA, 22 bp, Homo sapiens
cgcagggccgcgagcgggacca

SEQ ID NO: 8141261 - DNA, 22 bp, Homo sapiens
cgcaggtgaactgttctgcagt

SEQ ID NO: 8141262 - DNA, 22 bp, Homo sapiens
cgcaggtgaactgttctgcagt

SEQ ID NO: 8141263 - DNA, 22 bp, Homo sapiens
cgcaggtgaactgttctgcagt

SEQ ID NO: 8141264 - DNA, 22 bp, Homo sapiens
aggtttctgcaatgtgtgtaca

SEQ ID NO: 8141265 - DNA, 22 bp, Homo sapiens
aggtttctgctgtcctccttct

SEQ ID NO: 8141266 - DNA, 22 bp, Homo sapiens
cctgttctaatcttggggcaga

SEQ ID NO: 8141267 - DNA, 22 bp, Homo sapiens
cctgttgctctgcatgagttta

SEQ ID NO: 8141268 - DNA, 22 bp, Homo sapiens
cgaggcctcaagacagtgtttg

SEQ ID NO: 8141269 - DNA, 22 bp, Homo sapiens
cgaggccatgcatgctgaggac

SEQ ID NO: 8141270 - DNA, 22 bp, Homo sapiens
cgaggccatgcatgctgaggac

SEQ ID NO: 8141271 - DNA, 22 bp, Homo sapiens
cgaggccatgcatgctgaggac

SEQ ID NO: 8141272 - DNA, 22 bp, Homo sapiens
cgcaggaagacaagggtggaaa

SEQ ID NO: 8141273 - DNA, 19 bp, Homo sapiens
cgcaggagccgaggtgacc

SEQ ID NO: 8141274 - DNA, 19 bp, Homo sapiens
cgcaggagccgaggtgacc

SEQ ID NO: 8141275 - DNA, 19 bp, Homo sapiens
cgcaggagccgaggtgacc

SEQ ID NO: 8141276 - DNA, 22 bp, Homo sapiens
cgcaggcacagagtggacagcg

SEQ ID NO: 8141277 - DNA, 22 bp, Homo sapiens
cgcaggctccggggtgccctgg

SEQ ID NO: 8141278 - DNA, 22 bp, Homo sapiens
cgcaggcaagagagtacagtta

SEQ ID NO: 8141279 - DNA, 22 bp, Homo sapiens
cctgttccattcatatcctatt

SEQ ID NO: 8141280 - DNA, 17 bp, Homo sapiens
cctgtgtttgctccttc

SEQ ID NO: 8141281 - DNA, 18 bp, Homo sapiens
cctgtgtgtgttgcaggc

SEQ ID NO: 8141282 - DNA, 22 bp, Homo sapiens
ctaccagcttctttgtctggga

SEQ ID NO: 8141283 - DNA, 22 bp, Homo sapiens
ctacatttttcaccgagcctct

SEQ ID NO: 8141284 - DNA, 22 bp, Homo sapiens
ctacatttttcaccgagcctct

SEQ ID NO: 8141285 - DNA, 22 bp, Homo sapiens
ctagaaatctctgtttacatca

SEQ ID NO: 8141286 - DNA, 22 bp, Homo sapiens
ctacatttggagagtataggaa

SEQ ID NO: 8141287 - DNA, 22 bp, Homo sapiens
ctacatttggagagtataggaa

SEQ ID NO: 8141288 - DNA, 22 bp, Homo sapiens
ctacatttgttcaaataagctg

SEQ ID NO: 8141289 - DNA, 22 bp, Homo sapiens
ctacatttcccagctgccttcc

SEQ ID NO: 8141290 - DNA, 22 bp, Homo sapiens
ctacatttgttctatagctttt

SEQ ID NO: 8141291 - DNA, 22 bp, Homo sapiens
ctacattttaataagctgctta

SEQ ID NO: 8141292 - DNA, 22 bp, Homo sapiens
ctacattttgtgattatgaaat

SEQ ID NO: 8141293 - DNA, 22 bp, Homo sapiens
ctacattttaataagctgctta

SEQ ID NO: 8141294 - DNA, 23 bp, Homo sapiens
agtattcaaaaggcaagctatat

SEQ ID NO: 8141295 - DNA, 22 bp, Homo sapiens
agtattgtgactcaagtattct

SEQ ID NO: 8141296 - DNA, 22 bp, Homo sapiens
agtatttagagacacaagacgg

SEQ ID NO: 8141297 - DNA, 22 bp, Homo sapiens
agtatttagagacacaagacgg

SEQ ID NO: 8141298 - DNA, 22 bp, Homo sapiens
agtatttagagacacaagacgg

SEQ ID NO: 8141299 - DNA, 22 bp, Homo sapiens
agtatttcctggcttatctgct

SEQ ID NO: 8141300 - DNA, 22 bp, Homo sapiens
agtatttagagacacaagatgg

SEQ ID NO: 8141301 - DNA, 22 bp, Homo sapiens
agtatttagagacacaagatgg

SEQ ID NO: 8141302 - DNA, 22 bp, Homo sapiens
agtatttagagacacaagatgg

SEQ ID NO: 8141303 - DNA, 22 bp, Homo sapiens
agtatttagctgactcgctaca

SEQ ID NO: 8141304 - DNA, 22 bp, Homo sapiens
agtatttagcatagtggttagt

SEQ ID NO: 8141305 - DNA, 23 bp, Homo sapiens
agtatgggggatcacgtggccct

SEQ ID NO: 8141306 - DNA, 22 bp, Homo sapiens
agtatgcatatttcaaagtaag

SEQ ID NO: 8141307 - DNA, 22 bp, Homo sapiens
ctaaggaattggagcatgtgtt

SEQ ID NO: 8141308 - DNA, 22 bp, Homo sapiens
agtatgtggcacagaatttctt

SEQ ID NO: 8141309 - DNA, 22 bp, Homo sapiens
agtatgtagtgcaatcagtcag

SEQ ID NO: 8141310 - DNA, 22 bp, Homo sapiens
agtatgtaattttcaatgtgtt

SEQ ID NO: 8141311 - DNA, 22 bp, Homo sapiens
agtatgtaattttcaatgtgtt

SEQ ID NO: 8141312 - DNA, 23 bp, Homo sapiens
agtatgggggatcacgtggccct

SEQ ID NO: 8141313 - DNA, 22 bp, Homo sapiens
ctaaggaaatatgtcacttgct

SEQ ID NO: 8141314 - DNA, 22 bp, Homo sapiens
ctaaggaagtgacagtgggatt

SEQ ID NO: 8141315 - DNA, 22 bp, Homo sapiens
ctaaggaagtgacagtgggatt

SEQ ID NO: 8141316 - DNA, 22 bp, Homo sapiens
ctaagcacactgccttgctgtg

SEQ ID NO: 8141317 - DNA, 22 bp, Homo sapiens
ctaagccagaactagtgattgg

SEQ ID NO: 8141318 - DNA, 22 bp, Homo sapiens
ctaaggaaaggaaatacagtaa

SEQ ID NO: 8141319 - DNA, 22 bp, Homo sapiens
agtccacagagtctctcctgaa

SEQ ID NO: 8141320 - DNA, 22 bp, Homo sapiens
agtccaggctcttcctgaagaa

SEQ ID NO: 8141321 - DNA, 22 bp, Homo sapiens
ctagaatatcatatgaagagac

SEQ ID NO: 8141322 - DNA, 22 bp, Homo sapiens
agtccaaggttcatggcacaga

SEQ ID NO: 8141323 - DNA, 22 bp, Homo sapiens
agtccaaggttcatggcacaga

SEQ ID NO: 8141324 - DNA, 20 bp, Homo sapiens
ctagaagcagaattgctgat

SEQ ID NO: 8141325 - DNA, 22 bp, Homo sapiens
ctagaatactcgtattattccc

SEQ ID NO: 8141326 - DNA, 22 bp, Homo sapiens
ctagaacagaaagtacaggaaa

SEQ ID NO: 8141327 - DNA, 22 bp, Homo sapiens
ctagaagcaactagatctgttt

SEQ ID NO: 8141328 - DNA, 22 bp, Homo sapiens
ctagaagcaactagatctgttt

SEQ ID NO: 8141329 - DNA, 22 bp, Homo sapiens
agtccaggtggaccttggccag

SEQ ID NO: 8141330 - DNA, 22 bp, Homo sapiens
agtccaggtggaccttggccag

SEQ ID NO: 8141331 - DNA, 22 bp, Homo sapiens
agtccaggtctctgagtcacaa

SEQ ID NO: 8141332 - DNA, 22 bp, Homo sapiens
agtccataacttcagagtgtca

SEQ ID NO: 8141333 - DNA, 22 bp, Homo sapiens
agtccagggagcccaggctttg

SEQ ID NO: 8141334 - DNA, 22 bp, Homo sapiens
agtccagggctctctgtgggat

SEQ ID NO: 8141335 - DNA, 22 bp, Homo sapiens
agtccagggagcccaggctttg

SEQ ID NO: 8141336 - DNA, 22 bp, Homo sapiens
agtccagggctctctgtgggat

SEQ ID NO: 8141337 - DNA, 22 bp, Homo sapiens
agtccagggcttagtcagcggg

SEQ ID NO: 8141338 - DNA, 22 bp, Homo sapiens
agtccaggtctctgagtcacaa

SEQ ID NO: 8141339 - DNA, 22 bp, Homo sapiens
ctagtcacgtctttcagttacc

SEQ ID NO: 8141340 - DNA, 22 bp, Homo sapiens
ctagtattacatttttgtgtgt

SEQ ID NO: 8141341 - DNA, 22 bp, Homo sapiens
ctagtacaattttagcaagatg

SEQ ID NO: 8141342 - DNA, 22 bp, Homo sapiens
ctaggtgatccactgctctctt

SEQ ID NO: 8141343 - DNA, 22 bp, Homo sapiens
ctaggtgatccactgctctctt

SEQ ID NO: 8141344 - DNA, 22 bp, Homo sapiens
ctaggttaaagcggttttatgt

SEQ ID NO: 8141345 - DNA, 22 bp, Homo sapiens
ctaggtggtggtgggttgacat

SEQ ID NO: 8141346 - DNA, 22 bp, Homo sapiens
ctagtaaagctatgattctgcc

SEQ ID NO: 8141347 - DNA, 22 bp, Homo sapiens
ctagtcactcagcactgacaaa

SEQ ID NO: 8141348 - DNA, 22 bp, Homo sapiens
agtcccagctactcaagaggct

SEQ ID NO: 8141349 - DNA, 22 bp, Homo sapiens
agtcccagctactcaagaggct

SEQ ID NO: 8141350 - DNA, 22 bp, Homo sapiens
agtcccagctactcaagaggct

SEQ ID NO: 8141351 - DNA, 22 bp, Homo sapiens
agtccatgctgtctacagaatc

SEQ ID NO: 8141352 - DNA, 22 bp, Homo sapiens
agtccatggttgtagttctctc

SEQ ID NO: 8141353 - DNA, 22 bp, Homo sapiens
agtccatggttctgactcatct

SEQ ID NO: 8141354 - DNA, 19 bp, Homo sapiens
agtccatgaatggaggatg

SEQ ID NO: 8141355 - DNA, 18 bp, Homo sapiens
agtccatgcatggctata

SEQ ID NO: 8141356 - DNA, 22 bp, Homo sapiens
ctagggtgtgcagattttgcct

SEQ ID NO: 8141357 - DNA, 22 bp, Homo sapiens
ctagggtgtgcagattttgcct

SEQ ID NO: 8141358 - DNA, 22 bp, Homo sapiens
ctagggtgtgcagattttgcct

SEQ ID NO: 8141359 - DNA, 22 bp, Homo sapiens
ctagggtcaggggcctgcgtcg

SEQ ID NO: 8141360 - DNA, 19 bp, Homo sapiens
ctagggcttggcagcaggc

SEQ ID NO: 8141361 - DNA, 22 bp, Homo sapiens
ctagggtcaggggcctgcgtcg

SEQ ID NO: 8141362 - DNA, 22 bp, Homo sapiens
aggtacagcaatataagaggtc

SEQ ID NO: 8141363 - DNA, 21 bp, Homo sapiens
aggtacaggtcttgtgagtct

SEQ ID NO: 8141364 - DNA, 22 bp, Homo sapiens
cctgccagctgtgggccagcct

SEQ ID NO: 8141365 - DNA, 22 bp, Homo sapiens
cctgccagctgtgggccagcct

SEQ ID NO: 8141366 - DNA, 21 bp, Homo sapiens
cctgccaggaaactgagtgtc

SEQ ID NO: 8141367 - DNA, 21 bp, Homo sapiens
cctgccaggaaactgagtgtc

SEQ ID NO: 8141368 - DNA, 21 bp, Homo sapiens
cctgccaggaaactgagtgtc

SEQ ID NO: 8141369 - DNA, 22 bp, Homo sapiens
cctgccagcgcttatctctcgg

SEQ ID NO: 8141370 - DNA, 22 bp, Homo sapiens
cctgccagcgcttatctctcgg

SEQ ID NO: 8141371 - DNA, 22 bp, Homo sapiens
cctgccagctgtgggccagcct

SEQ ID NO: 8141372 - DNA, 22 bp, Homo sapiens
cctgccagctgtgggccagcct

SEQ ID NO: 8141373 - DNA, 22 bp, Homo sapiens
cctgccagctgtgggccagcct

SEQ ID NO: 8141374 - DNA, 22 bp, Homo sapiens
cctgccagctgtgggccagcct

SEQ ID NO: 8141375 - DNA, 22 bp, Homo sapiens
aggtagggctaggctgcgtctg

SEQ ID NO: 8141376 - DNA, 22 bp, Homo sapiens
aggtagggggtttgggaactgc

SEQ ID NO: 8141377 - DNA, 22 bp, Homo sapiens
aggtagggggtttgggaactgc

SEQ ID NO: 8141378 - DNA, 22 bp, Homo sapiens
aggtagggggtttgggaactgc

SEQ ID NO: 8141379 - DNA, 23 bp, Homo sapiens
aggtaggttattgctgctacctg

SEQ ID NO: 8141380 - DNA, 23 bp, Homo sapiens
aggtaggttattgctgctacctg

SEQ ID NO: 8141381 - DNA, 22 bp, Homo sapiens
aggtagggttaatggagatata

SEQ ID NO: 8141382 - DNA, 22 bp, Homo sapiens
aggtagggttaatggagatata

SEQ ID NO: 8141383 - DNA, 22 bp, Homo sapiens
aggtagggaagaaggcatgaaa

SEQ ID NO: 8141384 - DNA, 22 bp, Homo sapiens
aggtagggaagaaggcatgaaa

SEQ ID NO: 8141385 - DNA, 22 bp, Homo sapiens
aggtagggaagaaggcatgaaa

SEQ ID NO: 8141386 - DNA, 19 bp, Homo sapiens
aggtaggcagtggcatgga

SEQ ID NO: 8141387 - DNA, 19 bp, Homo sapiens
aggtaggcagtggcatgga

SEQ ID NO: 8141388 - DNA, 22 bp, Homo sapiens
aggtaggccctgagtgctgttg

SEQ ID NO: 8141389 - DNA, 19 bp, Homo sapiens
aggtaggcagtggcatgga

SEQ ID NO: 8141390 - DNA, 22 bp, Homo sapiens
aggtaggcctgaaagtgacagc

SEQ ID NO: 8141391 - DNA, 22 bp, Homo sapiens
aggtaggcctgaaagtgacagc

SEQ ID NO: 8141392 - DNA, 22 bp, Homo sapiens
aggtaggccctgagtgctgttg

SEQ ID NO: 8141393 - DNA, 22 bp, Homo sapiens
aggtagggaagaaggcatgaaa

SEQ ID NO: 8141394 - DNA, 22 bp, Homo sapiens
aggtaggcctgacgctggggtg

SEQ ID NO: 8141395 - DNA, 23 bp, Homo sapiens
cctgcagctgctggggctccacc

SEQ ID NO: 8141396 - DNA, 23 bp, Homo sapiens
cctgcagctgccacgccctgctc

SEQ ID NO: 8141397 - DNA, 23 bp, Homo sapiens
cctgcagctgccacgccctgctc

SEQ ID NO: 8141398 - DNA, 22 bp, Homo sapiens
cctgcagcctcttctgaaaatc

SEQ ID NO: 8141399 - DNA, 23 bp, Homo sapiens
cctgcagctgctggggctccacc

SEQ ID NO: 8141400 - DNA, 23 bp, Homo sapiens
cctgcagctgctggggctccacc

SEQ ID NO: 8141401 - DNA, 23 bp, Homo sapiens
cctgcagctgctggggctccacc

SEQ ID NO: 8141402 - DNA, 23 bp, Homo sapiens
cctgcagctgctggggctccacc

SEQ ID NO: 8141403 - DNA, 22 bp, Homo sapiens
cctgccagatcccctgagctga

SEQ ID NO: 8141404 - DNA, 22 bp, Homo sapiens
cctgccagatcccctgagctga

SEQ ID NO: 8141405 - DNA, 22 bp, Homo sapiens
cctgccagatcccctgagctga

SEQ ID NO: 8141406 - DNA, 22 bp, Homo sapiens
cctgccagcatcttcagcccct

SEQ ID NO: 8141407 - DNA, 22 bp, Homo sapiens
cctgccagcatcttcagcccct

SEQ ID NO: 8141408 - DNA, 22 bp, Homo sapiens
cctgccagcatcttcagcccct

SEQ ID NO: 8141409 - DNA, 22 bp, Homo sapiens
cctgccagcatcttcagcccct

SEQ ID NO: 8141410 - DNA, 22 bp, Homo sapiens
cctgccagatcccctgagctga

SEQ ID NO: 8141411 - DNA, 22 bp, Homo sapiens
cctgccagccagatcactcgcc

SEQ ID NO: 8141412 - DNA, 22 bp, Homo sapiens
cctgccagccagatcactcgcc

SEQ ID NO: 8141413 - DNA, 22 bp, Homo sapiens
cctgccagccagatcactcgcc

SEQ ID NO: 8141414 - DNA, 22 bp, Homo sapiens
cctgccagcccccatagagaca

SEQ ID NO: 8141415 - DNA, 22 bp, Homo sapiens
cctgccagcccccatagagaca

SEQ ID NO: 8141416 - DNA, 22 bp, Homo sapiens
cctgccagcccgcgttcatgcc

SEQ ID NO: 8141417 - DNA, 22 bp, Homo sapiens
cctgccagcccgcgttcatgcc

SEQ ID NO: 8141418 - DNA, 22 bp, Homo sapiens
cctgcagagggactggcaggaa

SEQ ID NO: 8141419 - DNA, 22 bp, Homo sapiens
cctgcagagggactggcaggaa

SEQ ID NO: 8141420 - DNA, 22 bp, Homo sapiens
cctgcagagccacgtgccagcg

SEQ ID NO: 8141421 - DNA, 22 bp, Homo sapiens
cctgcagagcaggagaggcatc

SEQ ID NO: 8141422 - DNA, 22 bp, Homo sapiens
cctgcagagcaggagaggcatc

SEQ ID NO: 8141423 - DNA, 22 bp, Homo sapiens
cctgcagagccacgtgccagcg

SEQ ID NO: 8141424 - DNA, 22 bp, Homo sapiens
cctgcagagcaggagaggcatc

SEQ ID NO: 8141425 - DNA, 22 bp, Homo sapiens
cctgcagagcaggagaggcatc

SEQ ID NO: 8141426 - DNA, 22 bp, Homo sapiens
cctgagtcttcccaaaactcct

SEQ ID NO: 8141427 - DNA, 22 bp, Homo sapiens
cctgcagagtccctttgttcag

SEQ ID NO: 8141428 - DNA, 22 bp, Homo sapiens
cctgcagatgtgggacagctgt

SEQ ID NO: 8141429 - DNA, 22 bp, Homo sapiens
cctgcagatgtgggacagctgt

SEQ ID NO: 8141430 - DNA, 22 bp, Homo sapiens
cctgcagatgtgggacagctgt

SEQ ID NO: 8141431 - DNA, 18 bp, Homo sapiens
cctgcagcccaggaggcc

SEQ ID NO: 8141432 - DNA, 18 bp, Homo sapiens
cctgcagcccaggaggcc

SEQ ID NO: 8141433 - DNA, 22 bp, Homo sapiens
aggtccctaatcatttcacttt

SEQ ID NO: 8141434 - DNA, 21 bp, Homo sapiens
aggtccctaattaattgacct

SEQ ID NO: 8141435 - DNA, 22 bp, Homo sapiens
aggtccctacttatctgaaggc

SEQ ID NO: 8141436 - DNA, 21 bp, Homo sapiens
aggtcccaggtttgggcagca

SEQ ID NO: 8141437 - DNA, 22 bp, Homo sapiens
aggtcccaggcatagctggtct

SEQ ID NO: 8141438 - DNA, 22 bp, Homo sapiens
aggtcccaggcatagctggtct

SEQ ID NO: 8141439 - DNA, 22 bp, Homo sapiens
aggtccagttttctgacaaggg

SEQ ID NO: 8141440 - DNA, 22 bp, Homo sapiens
aggtccctgcagcagactgcca

SEQ ID NO: 8141441 - DNA, 23 bp, Homo sapiens
aggtccctgagtcttcaaaggat

SEQ ID NO: 8141442 - DNA, 22 bp, Homo sapiens
aggtccctgcaaagctattcag

SEQ ID NO: 8141443 - DNA, 22 bp, Homo sapiens
aggtccctggctagcactggaa

SEQ ID NO: 8141444 - DNA, 22 bp, Homo sapiens
aggtccctgggacagggcgatt

SEQ ID NO: 8141445 - DNA, 22 bp, Homo sapiens
aggtccctggtaattgacacac

SEQ ID NO: 8141446 - DNA, 22 bp, Homo sapiens
aggtccctcgcacatgcagggt

SEQ ID NO: 8141447 - DNA, 22 bp, Homo sapiens
aggtccctgagtcagcggcgct

SEQ ID NO: 8141448 - DNA, 22 bp, Homo sapiens
aggtccctgagtcagcggcgct

SEQ ID NO: 8141449 - DNA, 22 bp, Homo sapiens
aggtccctcgcacatgcagggt

SEQ ID NO: 8141450 - DNA, 22 bp, Homo sapiens
aggtccctcagaggcctcaccg

SEQ ID NO: 8141451 - DNA, 22 bp, Homo sapiens
aggtccctaggagagtaggaag

SEQ ID NO: 8141452 - DNA, 19 bp, Homo sapiens
aggtccctccctcgaggct

SEQ ID NO: 8141453 - DNA, 22 bp, Homo sapiens
cctggctctgcagccactccag

SEQ ID NO: 8141454 - DNA, 22 bp, Homo sapiens
cctggctctgaggtatgcctgg

SEQ ID NO: 8141455 - DNA, 22 bp, Homo sapiens
aggtcctgagggttcgtctgca

SEQ ID NO: 8141456 - DNA, 22 bp, Homo sapiens
aggtcctgagggttcgtctgca

SEQ ID NO: 8141457 - DNA, 22 bp, Homo sapiens
aggtcctctgtgcctgctggcg

SEQ ID NO: 8141458 - DNA, 21 bp, Homo sapiens
aggtcctctatccaagttaag

SEQ ID NO: 8141459 - DNA, 19 bp, Homo sapiens
aggtccctgtcacctctca

SEQ ID NO: 8141460 - DNA, 22 bp, Homo sapiens
cctggaggtggaggttgcagtg

SEQ ID NO: 8141461 - DNA, 22 bp, Homo sapiens
aggtagtgtagctgagtgggat

SEQ ID NO: 8141462 - DNA, 22 bp, Homo sapiens
aggtagtattcatgattaaatt

SEQ ID NO: 8141463 - DNA, 23 bp, Homo sapiens
aggtaggttattgctgctacctg

SEQ ID NO: 8141464 - DNA, 22 bp, Homo sapiens
cctggagtaccgtggccatcca

SEQ ID NO: 8141465 - DNA, 23 bp, Homo sapiens
cctggagtactaaggggatggaa

SEQ ID NO: 8141466 - DNA, 23 bp, Homo sapiens
cctggagtactaaggggatggaa

SEQ ID NO: 8141467 - DNA, 22 bp, Homo sapiens
cctggagtgacaggtgtagcct

SEQ ID NO: 8141468 - DNA, 22 bp, Homo sapiens
cctggagtgacaggtgtagcct

SEQ ID NO: 8141469 - DNA, 22 bp, Homo sapiens
cctggagtctgtgactttcctc

SEQ ID NO: 8141470 - DNA, 19 bp, Homo sapiens
cctggagtcgcgctgcctc

SEQ ID NO: 8141471 - DNA, 22 bp, Homo sapiens
cctggagtgacaggtgtagcct

SEQ ID NO: 8141472 - DNA, 22 bp, Homo sapiens
cctggagtgacaggtgtagcct

SEQ ID NO: 8141473 - DNA, 22 bp, Homo sapiens
cctggagtggggtccgtgcatg

SEQ ID NO: 8141474 - DNA, 18 bp, Homo sapiens
cctggagtgtgttaggct

SEQ ID NO: 8141475 - DNA, 22 bp, Homo sapiens
cctggagttgaaggaaggtggg

SEQ ID NO: 8141476 - DNA, 22 bp, Homo sapiens
cctggagttgaaggaaggtggg

SEQ ID NO: 8141477 - DNA, 22 bp, Homo sapiens
cctggagttgaaggaaggtggg

SEQ ID NO: 8141478 - DNA, 22 bp, Homo sapiens
cctggagttgaaggaaggtggg

SEQ ID NO: 8141479 - DNA, 22 bp, Homo sapiens
cctggatgatccatgtcatgga

SEQ ID NO: 8141480 - DNA, 22 bp, Homo sapiens
cctggagttttttggttgactc

SEQ ID NO: 8141481 - DNA, 22 bp, Homo sapiens
cctggcacacggtggcattcaa

SEQ ID NO: 8141482 - DNA, 22 bp, Homo sapiens
cctggcacagagcggtggtcac

SEQ ID NO: 8141483 - DNA, 22 bp, Homo sapiens
aggtcatagagatgctgtttca

SEQ ID NO: 8141484 - DNA, 22 bp, Homo sapiens
aggtcatgatccattggtgagt

SEQ ID NO: 8141485 - DNA, 22 bp, Homo sapiens
cctggcacagagcggtggtcac

SEQ ID NO: 8141486 - DNA, 22 bp, Homo sapiens
aggtcattacaattatcatttt

SEQ ID NO: 8141487 - DNA, 22 bp, Homo sapiens
aggtcattccttgtcttcttgc

SEQ ID NO: 8141488 - DNA, 22 bp, Homo sapiens
cctggcacaagagcagcattgg

SEQ ID NO: 8141489 - DNA, 23 bp, Homo sapiens
cctggcacacagttgacatggaa

SEQ ID NO: 8141490 - DNA, 23 bp, Homo sapiens
cctggcacacaaggggtgctgca

SEQ ID NO: 8141491 - DNA, 22 bp, Homo sapiens
cctggatgatccatgtcatgga

SEQ ID NO: 8141492 - DNA, 22 bp, Homo sapiens
cctggcaacatttcaaggtctt

SEQ ID NO: 8141493 - DNA, 22 bp, Homo sapiens
cctgggctccactccaagagca

SEQ ID NO: 8141494 - DNA, 20 bp, Homo sapiens
cctgggctccaggagccccg

SEQ ID NO: 8141495 - DNA, 22 bp, Homo sapiens
cctgggctccactccaagagca

SEQ ID NO: 8141496 - DNA, 22 bp, Homo sapiens
cctgggctcaggcttgggcagc

SEQ ID NO: 8141497 - DNA, 22 bp, Homo sapiens
cctgggctcaccatgccttgga

SEQ ID NO: 8141498 - DNA, 22 bp, Homo sapiens
cctgggctcaggcttgggcagc

SEQ ID NO: 8141499 - DNA, 22 bp, Homo sapiens
cctgggctcaagtgatggtccc

SEQ ID NO: 8141500 - DNA, 22 bp, Homo sapiens
cctgggctcaagtgatggtccc

SEQ ID NO: 8141501 - DNA, 22 bp, Homo sapiens
cctgggctcaagtgatggtccc

SEQ ID NO: 8141502 - DNA, 22 bp, Homo sapiens
cctgggctcaagtgatggtccc

SEQ ID NO: 8141503 - DNA, 22 bp, Homo sapiens
cctgggctcacagccaaggctc

SEQ ID NO: 8141504 - DNA, 22 bp, Homo sapiens
cctgggctcacagccaaggctc

SEQ ID NO: 8141505 - DNA, 22 bp, Homo sapiens
cctgggctcaccatgccttgga

SEQ ID NO: 8141506 - DNA, 22 bp, Homo sapiens
cctgggctcacagccaaggctc

SEQ ID NO: 8141507 - DNA, 22 bp, Homo sapiens
cctggctctgggatcttcgctt

SEQ ID NO: 8141508 - DNA, 22 bp, Homo sapiens
cctggctctgcgtgcagctccg

SEQ ID NO: 8141509 - DNA, 22 bp, Homo sapiens
cctggctctggtgaggagaagt

SEQ ID NO: 8141510 - DNA, 22 bp, Homo sapiens
cctggctctgggatcttcgctt

SEQ ID NO: 8141511 - DNA, 22 bp, Homo sapiens
cctggctctggttccctcagct

SEQ ID NO: 8141512 - DNA, 22 bp, Homo sapiens
cctggctctggttccctcagct

SEQ ID NO: 8141513 - DNA, 22 bp, Homo sapiens
cctggctctgtcctcgcgcaaa

SEQ ID NO: 8141514 - DNA, 22 bp, Homo sapiens
cctgggcataaatcactccaag

SEQ ID NO: 8141515 - DNA, 22 bp, Homo sapiens
cctgggcataaatcactccaag

SEQ ID NO: 8141516 - DNA, 22 bp, Homo sapiens
cctgggcataaatcactccaag

SEQ ID NO: 8141517 - DNA, 22 bp, Homo sapiens
cctgggcataaatcactccaag

SEQ ID NO: 8141518 - DNA, 22 bp, Homo sapiens
cctgggctcaagtgatcctcct

SEQ ID NO: 8141519 - DNA, 22 bp, Homo sapiens
cctgggctcaagtgatggtccc

SEQ ID NO: 8141520 - DNA, 22 bp, Homo sapiens
cctgggctcaagtgatcctcct

SEQ ID NO: 8141521 - DNA, 22 bp, Homo sapiens
cctgggctcaagtgatcctcct

SEQ ID NO: 8141522 - DNA, 22 bp, Homo sapiens
cctgggcttggttgttgagaac

SEQ ID NO: 8141523 - DNA, 22 bp, Homo sapiens
cctgggcttggttgttgagaac

SEQ ID NO: 8141524 - DNA, 22 bp, Homo sapiens
cctgggcttgcatctgtgctgg

SEQ ID NO: 8141525 - DNA, 22 bp, Homo sapiens
cctgggcttgcatctgtgctgg

SEQ ID NO: 8141526 - DNA, 22 bp, Homo sapiens
cctgggcttgcatctgtgctgg

SEQ ID NO: 8141527 - DNA, 22 bp, Homo sapiens
cctgggcttgcatctgtgctgg

SEQ ID NO: 8141528 - DNA, 22 bp, Homo sapiens
cctgggcttgcatctgtgctgg

SEQ ID NO: 8141529 - DNA, 22 bp, Homo sapiens
cctgggcttgcatctgtgctgg

SEQ ID NO: 8141530 - DNA, 22 bp, Homo sapiens
cctgggcttctgtctagatgtt

SEQ ID NO: 8141531 - DNA, 22 bp, Homo sapiens
cctgggcttctgtctagatgtt

SEQ ID NO: 8141532 - DNA, 20 bp, Homo sapiens
cctgggctccaggagccccg

SEQ ID NO: 8141533 - DNA, 20 bp, Homo sapiens
cctgggctccaggagccccg

SEQ ID NO: 8141534 - DNA, 20 bp, Homo sapiens
cctgggctccaggagccccg

SEQ ID NO: 8141535 - DNA, 20 bp, Homo sapiens
cctgggctccaggagccccg

SEQ ID NO: 8141536 - DNA, 20 bp, Homo sapiens
cctgggctccaggagccccg

SEQ ID NO: 8141537 - DNA, 22 bp, Homo sapiens
cctgggcttctgtctagatgtt

SEQ ID NO: 8141538 - DNA, 22 bp, Homo sapiens
cctgggctcgcgcacttcaccc

SEQ ID NO: 8141539 - DNA, 22 bp, Homo sapiens
cctgggcttctgtctagatgtt

SEQ ID NO: 8141540 - DNA, 22 bp, Homo sapiens
cctgggcttctgtctagatgtt

SEQ ID NO: 8141541 - DNA, 22 bp, Homo sapiens
cctgggcttctgtctagatgtt

SEQ ID NO: 8141542 - DNA, 22 bp, Homo sapiens
cctgtcagctgatggctatgta

SEQ ID NO: 8141543 - DNA, 22 bp, Homo sapiens
cctgtcagctgatggctatgta

SEQ ID NO: 8141544 - DNA, 22 bp, Homo sapiens
cctgtcagggtttgcctcagaa

SEQ ID NO: 8141545 - DNA, 22 bp, Homo sapiens
cctggtgccggtagacgcgcag

SEQ ID NO: 8141546 - DNA, 22 bp, Homo sapiens
cctgtcagttgctgtcagggat

SEQ ID NO: 8141547 - DNA, 22 bp, Homo sapiens
cctgtcagttgctgtcagggat

SEQ ID NO: 8141548 - DNA, 22 bp, Homo sapiens
cctgtcagttgctgtcagggat

SEQ ID NO: 8141549 - DNA, 22 bp, Homo sapiens
cctgtcagttgctgtcagggat

SEQ ID NO: 8141550 - DNA, 22 bp, Homo sapiens
cctgtcagggtttgcctcagaa

SEQ ID NO: 8141551 - DNA, 22 bp, Homo sapiens
cctgggctttcggcggcttcct

SEQ ID NO: 8141552 - DNA, 22 bp, Homo sapiens
cctgggctttcaaaaccagcct

SEQ ID NO: 8141553 - DNA, 22 bp, Homo sapiens
cctgggctttcaaaaccagcct

SEQ ID NO: 8141554 - DNA, 22 bp, Homo sapiens
cctgggctttgagggcaggatg

SEQ ID NO: 8141555 - DNA, 22 bp, Homo sapiens
cctgggctttcggcggcttcct

SEQ ID NO: 8141556 - DNA, 22 bp, Homo sapiens
cctgggctttcggcggcttcct

SEQ ID NO: 8141557 - DNA, 22 bp, Homo sapiens
aggtggggagtatatgtaattg

SEQ ID NO: 8141558 - DNA, 22 bp, Homo sapiens
aggtggggagtatatgtaattg

SEQ ID NO: 8141559 - DNA, 22 bp, Homo sapiens
aggtggggccaaatgctacagt

SEQ ID NO: 8141560 - DNA, 22 bp, Homo sapiens
aggtggggccaaatgctacagt

SEQ ID NO: 8141561 - DNA, 22 bp, Homo sapiens
aggtggggccaaatgctacagt

SEQ ID NO: 8141562 - DNA, 22 bp, Homo sapiens
aggtggggcccaccaatttgca

SEQ ID NO: 8141563 - DNA, 22 bp, Homo sapiens
aggtggggcccaccaatttgca

SEQ ID NO: 8141564 - DNA, 21 bp, Homo sapiens
aggtggggctgcacctctgct

SEQ ID NO: 8141565 - DNA, 21 bp, Homo sapiens
aggtggggctgcacctctgct

SEQ ID NO: 8141566 - DNA, 22 bp, Homo sapiens
aggtggggcccaccaatttgca

SEQ ID NO: 8141567 - DNA, 21 bp, Homo sapiens
aggtggggctgcacctctgct

SEQ ID NO: 8141568 - DNA, 22 bp, Homo sapiens
aggtgggcacagatggagaagt

SEQ ID NO: 8141569 - DNA, 22 bp, Homo sapiens
aggtggggaggagtgtctcttt

SEQ ID NO: 8141570 - DNA, 22 bp, Homo sapiens
aggtggggaggagtgtctcttt

SEQ ID NO: 8141571 - DNA, 22 bp, Homo sapiens
aggtggggaggagtgtctcttt

SEQ ID NO: 8141572 - DNA, 22 bp, Homo sapiens
cctgtgccagccccttctgctg

SEQ ID NO: 8141573 - DNA, 22 bp, Homo sapiens
cctgtgcatgccagggtacacc

SEQ ID NO: 8141574 - DNA, 22 bp, Homo sapiens
cctgtgcatgccagggtacacc

SEQ ID NO: 8141575 - DNA, 22 bp, Homo sapiens
cctgtgcatgccagggtacacc

SEQ ID NO: 8141576 - DNA, 22 bp, Homo sapiens
cctgtgcattgaccacactctc

SEQ ID NO: 8141577 - DNA, 22 bp, Homo sapiens
cctgtgccaaaaggctgcttat

SEQ ID NO: 8141578 - DNA, 20 bp, Homo sapiens
cctgtctcctcttacctggc

SEQ ID NO: 8141579 - DNA, 19 bp, Homo sapiens
cctgtgactatctttgtaa

SEQ ID NO: 8141580 - DNA, 19 bp, Homo sapiens
cctgtgagaggacaggtgt

SEQ ID NO: 8141581 - DNA, 22 bp, Homo sapiens
cctgtgacttggcaaacctcca

SEQ ID NO: 8141582 - DNA, 22 bp, Homo sapiens
cctgtgcaggctccataataga

SEQ ID NO: 8141583 - DNA, 22 bp, Homo sapiens
cctgtgcatccggtggtcattg

SEQ ID NO: 8141584 - DNA, 22 bp, Homo sapiens
cctgtgcagcccttgccagttt

SEQ ID NO: 8141585 - DNA, 22 bp, Homo sapiens
cctgtgaggtcttgcatgtgaa

SEQ ID NO: 8141586 - DNA, 22 bp, Homo sapiens
cctgtgatccataggcatccag

SEQ ID NO: 8141587 - DNA, 22 bp, Homo sapiens
cctgtgatattgttcataatat

SEQ ID NO: 8141588 - DNA, 22 bp, Homo sapiens
cctgtcataatgtccgatgtca

SEQ ID NO: 8141589 - DNA, 22 bp, Homo sapiens
cctgtcatactaacgtagtggg

SEQ ID NO: 8141590 - DNA, 22 bp, Homo sapiens
cctgtcccaagcagggctggcc

SEQ ID NO: 8141591 - DNA, 22 bp, Homo sapiens
cctgtcccccaggcctgtacca

SEQ ID NO: 8141592 - DNA, 22 bp, Homo sapiens
cctgtcctccaagagcacatct

SEQ ID NO: 8141593 - DNA, 22 bp, Homo sapiens
cctgtcccctcacaatgccact

SEQ ID NO: 8141594 - DNA, 22 bp, Homo sapiens
cctgtcccctcacaatgccact

SEQ ID NO: 8141595 - DNA, 22 bp, Homo sapiens
cctgtcctccaagagcacatct

SEQ ID NO: 8141596 - DNA, 22 bp, Homo sapiens
cctgtcctccggagcgggctgt

SEQ ID NO: 8141597 - DNA, 22 bp, Homo sapiens
cctgtcctccggagcgggctgt

SEQ ID NO: 8141598 - DNA, 22 bp, Homo sapiens
cctgtctccctggcatggctca

SEQ ID NO: 8141599 - DNA, 20 bp, Homo sapiens
cctgtctcacgttccgcccc

SEQ ID NO: 8141600 - DNA, 20 bp, Homo sapiens
cctgtctcacgttccgcccc

SEQ ID NO: 8141601 - DNA, 22 bp, Homo sapiens
cctgtctccctggcatggctca

SEQ ID NO: 8141602 - DNA, 20 bp, Homo sapiens
cctgtctcctcttacctggc

SEQ ID NO: 8141603 - DNA, 22 bp, Homo sapiens
ctctgcaggcacccagggtggg

SEQ ID NO: 8141604 - DNA, 22 bp, Homo sapiens
ctctgcaggcacccagggtggg

SEQ ID NO: 8141605 - DNA, 22 bp, Homo sapiens
ctctgcaggcctgtgaagggtg

SEQ ID NO: 8141606 - DNA, 22 bp, Homo sapiens
ctctgcaggcctgtgaagggtg

SEQ ID NO: 8141607 - DNA, 21 bp, Homo sapiens
ctctgcagccctgcttccagg

SEQ ID NO: 8141608 - DNA, 21 bp, Homo sapiens
ctctgcagccctgcttccagg

SEQ ID NO: 8141609 - DNA, 23 bp, Homo sapiens
ctctgcaggagagtgggcagggc

SEQ ID NO: 8141610 - DNA, 23 bp, Homo sapiens
ctctgcaggagagtgggcagggc

SEQ ID NO: 8141611 - DNA, 23 bp, Homo sapiens
ctctgcaggagagtgggcagggc

SEQ ID NO: 8141612 - DNA, 23 bp, Homo sapiens
ctctgcaggagagtgggcagggc

SEQ ID NO: 8141613 - DNA, 22 bp, Homo sapiens
ctctgcaggggaggcatgcact

SEQ ID NO: 8141614 - DNA, 22 bp, Homo sapiens
ctctgcaggggaggcatgcact

SEQ ID NO: 8141615 - DNA, 22 bp, Homo sapiens
ctctgcaggccttgagtgtggt

SEQ ID NO: 8141616 - DNA, 17 bp, Homo sapiens
ctctgcagtgcatggct

SEQ ID NO: 8141617 - DNA, 17 bp, Homo sapiens
ctctgcagtgcatggct

SEQ ID NO: 8141618 - DNA, 22 bp, Homo sapiens
ctctgcaggggaggcatgcact

SEQ ID NO: 8141619 - DNA, 22 bp, Homo sapiens
ctctgcagtgtaacagcgcttg

SEQ ID NO: 8141620 - DNA, 21 bp, Homo sapiens
ctctgcagtgcccaccttgcc

SEQ ID NO: 8141621 - DNA, 17 bp, Homo sapiens
ctctgcagtgcatggct

SEQ ID NO: 8141622 - DNA, 17 bp, Homo sapiens
ctctgcagtgcatggct

SEQ ID NO: 8141623 - DNA, 22 bp, Homo sapiens
ctctgagcccgctgcagcccca

SEQ ID NO: 8141624 - DNA, 22 bp, Homo sapiens
ctctccaagttatcaagatgaa

SEQ ID NO: 8141625 - DNA, 19 bp, Homo sapiens
ctctcagcctgtctccttg

SEQ ID NO: 8141626 - DNA, 22 bp, Homo sapiens
ctctgcagtgtaacagcgcttg

SEQ ID NO: 8141627 - DNA, 22 bp, Homo sapiens
ctctgcagtgtaacagcgcttg

SEQ ID NO: 8141628 - DNA, 19 bp, Homo sapiens
ctctgcatatgtgaggata

SEQ ID NO: 8141629 - DNA, 22 bp, Homo sapiens
ctctgcatgccacatgagtgac

SEQ ID NO: 8141630 - DNA, 22 bp, Homo sapiens
ctctgcatgccttgctcagaca

SEQ ID NO: 8141631 - DNA, 22 bp, Homo sapiens
ctctgcctgtctcatcctgcaa

SEQ ID NO: 8141632 - DNA, 22 bp, Homo sapiens
ctctgcctgtctcatcctgcaa

SEQ ID NO: 8141633 - DNA, 22 bp, Homo sapiens
ctctgcctgcccaccgacccat

SEQ ID NO: 8141634 - DNA, 22 bp, Homo sapiens
ctctgcctgcccaccgacccat

SEQ ID NO: 8141635 - DNA, 22 bp, Homo sapiens
ctctgcctgcccaccgacccat

SEQ ID NO: 8141636 - DNA, 22 bp, Homo sapiens
ctctgcctgtgtcgccaccaca

SEQ ID NO: 8141637 - DNA, 22 bp, Homo sapiens
ctctgcctgtgtcgccaccaca

SEQ ID NO: 8141638 - DNA, 22 bp, Homo sapiens
ctctgcctgtgtcgccaccaca

SEQ ID NO: 8141639 - DNA, 22 bp, Homo sapiens
ctctgcctgtgtcgccaccaca

SEQ ID NO: 8141640 - DNA, 20 bp, Homo sapiens
ctctggcaaaggatgcctat

SEQ ID NO: 8141641 - DNA, 22 bp, Homo sapiens
ctctggatctgccctgacgcca

SEQ ID NO: 8141642 - DNA, 23 bp, Homo sapiens
ctctggatcctgtagctcctggc

SEQ ID NO: 8141643 - DNA, 23 bp, Homo sapiens
ctctggatcctgtagctcctggc

SEQ ID NO: 8141644 - DNA, 22 bp, Homo sapiens
ctctggatctgccctgacgcca

SEQ ID NO: 8141645 - DNA, 22 bp, Homo sapiens
ctctggatgaggtcctgtctgt

SEQ ID NO: 8141646 - DNA, 22 bp, Homo sapiens
ctctgctgatctcagctgggct

SEQ ID NO: 8141647 - DNA, 22 bp, Homo sapiens
ctctgctcaccagccatgtgat

SEQ ID NO: 8141648 - DNA, 22 bp, Homo sapiens
ctctgcctgtgtcgccaccaca

SEQ ID NO: 8141649 - DNA, 22 bp, Homo sapiens
ctctgctagggctgaggtgttc

SEQ ID NO: 8141650 - DNA, 22 bp, Homo sapiens
ctctgctcaccagccatgtgat

SEQ ID NO: 8141651 - DNA, 22 bp, Homo sapiens
ctctgctagggctgaggtgttc

SEQ ID NO: 8141652 - DNA, 23 bp, Homo sapiens
ctgaaataccagaaaatcagtgt

SEQ ID NO: 8141653 - DNA, 22 bp, Homo sapiens
ctgaaataaagttgctaaaatt

SEQ ID NO: 8141654 - DNA, 22 bp, Homo sapiens
ctgaaagggttacatagtaagt

SEQ ID NO: 8141655 - DNA, 22 bp, Homo sapiens
ctgaaaggtataaataagactt

SEQ ID NO: 8141656 - DNA, 22 bp, Homo sapiens
ctgaaagggagaacaccaagag

SEQ ID NO: 8141657 - DNA, 22 bp, Homo sapiens
ctgaaaggcagtgggtagtgtg

SEQ ID NO: 8141658 - DNA, 22 bp, Homo sapiens
ctgaaatagtttcatagaactt

SEQ ID NO: 8141659 - DNA, 22 bp, Homo sapiens
ctgaaatatagatgtgaacagt

SEQ ID NO: 8141660 - DNA, 17 bp, Homo sapiens
ctgaaatattatgataa

SEQ ID NO: 8141661 - DNA, 22 bp, Homo sapiens
ctgaaatattttaatctcagga

SEQ ID NO: 8141662 - DNA, 22 bp, Homo sapiens
ctgaaatgacggtttggggcaa

SEQ ID NO: 8141663 - DNA, 22 bp, Homo sapiens
ctgaaatgggcaaaagtagatt

SEQ ID NO: 8141664 - DNA, 22 bp, Homo sapiens
ctctggggtggaggaggctgac

SEQ ID NO: 8141665 - DNA, 22 bp, Homo sapiens
ctctggggtggaggaggctgac

SEQ ID NO: 8141666 - DNA, 22 bp, Homo sapiens
ctctggggtggaggaggctgac

SEQ ID NO: 8141667 - DNA, 22 bp, Homo sapiens
ctctggggttaagcttccatgg

SEQ ID NO: 8141668 - DNA, 22 bp, Homo sapiens
ctctggggttaagcttccatgg

SEQ ID NO: 8141669 - DNA, 22 bp, Homo sapiens
ctctggggaagcagccagctgg

SEQ ID NO: 8141670 - DNA, 22 bp, Homo sapiens
ctctggggaaatggatatgtac

SEQ ID NO: 8141671 - DNA, 21 bp, Homo sapiens
ctctgggacatttcttagcag

SEQ ID NO: 8141672 - DNA, 22 bp, Homo sapiens
ctctgggacatcccttggccta

SEQ ID NO: 8141673 - DNA, 22 bp, Homo sapiens
ctctgggaattctgagcaagca

SEQ ID NO: 8141674 - DNA, 22 bp, Homo sapiens
ctctgggacatcccttggccta

SEQ ID NO: 8141675 - DNA, 22 bp, Homo sapiens
ctctgggagaggacacttggag

SEQ ID NO: 8141676 - DNA, 22 bp, Homo sapiens
ctctgggaccatggcaagtgcg

SEQ ID NO: 8141677 - DNA, 22 bp, Homo sapiens
ctctgggaccatggcaagtgcg

SEQ ID NO: 8141678 - DNA, 22 bp, Homo sapiens
ctctgggcttgttgacctgcac

SEQ ID NO: 8141679 - DNA, 22 bp, Homo sapiens
ctctgggcttcctttgtgggtt

SEQ ID NO: 8141680 - DNA, 22 bp, Homo sapiens
ctctggctttaaggatgccaca

SEQ ID NO: 8141681 - DNA, 22 bp, Homo sapiens
ctctggctttcccagggaggag

SEQ ID NO: 8141682 - DNA, 22 bp, Homo sapiens
ctctgggaaagattgtgcaggc

SEQ ID NO: 8141683 - DNA, 22 bp, Homo sapiens
ctctgggaaagattgtgcaggc

SEQ ID NO: 8141684 - DNA, 22 bp, Homo sapiens
ctctgggaaagattgtgcaggc

SEQ ID NO: 8141685 - DNA, 22 bp, Homo sapiens
ctctgggaaagattgtgcaggc

SEQ ID NO: 8141686 - DNA, 22 bp, Homo sapiens
ctctgggaaagattgtgcaggc

SEQ ID NO: 8141687 - DNA, 22 bp, Homo sapiens
ctctgggaagtggagacttcag

SEQ ID NO: 8141688 - DNA, 22 bp, Homo sapiens
ctctgggaagggctgagcactg

SEQ ID NO: 8141689 - DNA, 22 bp, Homo sapiens
ctgaatgatataagatctttct

SEQ ID NO: 8141690 - DNA, 22 bp, Homo sapiens
ctgaatgctttggttctaaaag

SEQ ID NO: 8141691 - DNA, 22 bp, Homo sapiens
ctgaattaatacacagaatggc

SEQ ID NO: 8141692 - DNA, 22 bp, Homo sapiens
ctgacaaggttgaattgtccca

SEQ ID NO: 8141693 - DNA, 22 bp, Homo sapiens
ctgacaaaggcaaggcaggggg

SEQ ID NO: 8141694 - DNA, 22 bp, Homo sapiens
ctgaattctgccttgaggcctt

SEQ ID NO: 8141695 - DNA, 22 bp, Homo sapiens
ctgaattctatctctggatgtc

SEQ ID NO: 8141696 - DNA, 22 bp, Homo sapiens
ctgacaaaccactgctccagct

SEQ ID NO: 8141697 - DNA, 22 bp, Homo sapiens
ctgacaaacttaattttctgaa

SEQ ID NO: 8141698 - DNA, 20 bp, Homo sapiens
ctgacagaaaatatttcatc

SEQ ID NO: 8141699 - DNA, 22 bp, Homo sapiens
ctgagaaaagctttcttataca

SEQ ID NO: 8141700 - DNA, 22 bp, Homo sapiens
ctgagaaaagctttcttataca

SEQ ID NO: 8141701 - DNA, 22 bp, Homo sapiens
ctgagaaaatttcaggaagtgt

SEQ ID NO: 8141702 - DNA, 22 bp, Homo sapiens
ctgagaaaagtatgagctctgg

SEQ ID NO: 8141703 - DNA, 22 bp, Homo sapiens
ctgagaaaagtatgagctctgg

SEQ ID NO: 8141704 - DNA, 22 bp, Homo sapiens
agtgtctgcgggcagaggagcg

SEQ ID NO: 8141705 - DNA, 22 bp, Homo sapiens
agtgtctgcgggcagaggagcg

SEQ ID NO: 8141706 - DNA, 22 bp, Homo sapiens
agtgtctgctaggttcatcaac

SEQ ID NO: 8141707 - DNA, 22 bp, Homo sapiens
agtgtctgctaggttcatcaac

SEQ ID NO: 8141708 - DNA, 22 bp, Homo sapiens
agtgtctgctcagacagctaca

SEQ ID NO: 8141709 - DNA, 22 bp, Homo sapiens
ctgaaatggttgcctggagaat

SEQ ID NO: 8141710 - DNA, 22 bp, Homo sapiens
ctgaaatgttaaatacttggct

SEQ ID NO: 8141711 - DNA, 22 bp, Homo sapiens
ctgaaattctgcctctgcacaa

SEQ ID NO: 8141712 - DNA, 22 bp, Homo sapiens
agtgtctgcttatcagttcttg

SEQ ID NO: 8141713 - DNA, 22 bp, Homo sapiens
agtgtctgctttgagtcaggtg

SEQ ID NO: 8141714 - DNA, 22 bp, Homo sapiens
agtgtctgcttatcagttcttg

SEQ ID NO: 8141715 - DNA, 22 bp, Homo sapiens
agtgtctgctttgagtcaggtg

SEQ ID NO: 8141716 - DNA, 22 bp, Homo sapiens
agtgtctgctttgagtcaggtg

SEQ ID NO: 8141717 - DNA, 22 bp, Homo sapiens
agtgtctgctttgagtcaggtg

SEQ ID NO: 8141718 - DNA, 18 bp, Homo sapiens
agtgtctggatatttggg

SEQ ID NO: 8141719 - DNA, 22 bp, Homo sapiens
agtgtctggaggcattcttggt

SEQ ID NO: 8141720 - DNA, 18 bp, Homo sapiens
agtgtctggatatttggg

SEQ ID NO: 8141721 - DNA, 20 bp, Homo sapiens
agtgtctggattttgtaacc

SEQ ID NO: 8141722 - DNA, 22 bp, Homo sapiens
ctgaaggaagcaggtggcctgt

SEQ ID NO: 8141723 - DNA, 22 bp, Homo sapiens
ctgaatccacacaaggtgatgg

SEQ ID NO: 8141724 - DNA, 20 bp, Homo sapiens
agtgtctgggcctcaggccc

SEQ ID NO: 8141725 - DNA, 20 bp, Homo sapiens
agtgtctgggcctcaggccc

SEQ ID NO: 8141726 - DNA, 22 bp, Homo sapiens
ctgaatgaaatcaaggactgag

SEQ ID NO: 8141727 - DNA, 22 bp, Homo sapiens
ctgaatgagggattctgagggc

SEQ ID NO: 8141728 - DNA, 22 bp, Homo sapiens
ctgaatgagggattctgagggc

SEQ ID NO: 8141729 - DNA, 22 bp, Homo sapiens
ctgagcagatgaccagccccag

SEQ ID NO: 8141730 - DNA, 22 bp, Homo sapiens
ctgagcagatgaccagccccag

SEQ ID NO: 8141731 - DNA, 19 bp, Homo sapiens
ctgagcagagggaggaact

SEQ ID NO: 8141732 - DNA, 22 bp, Homo sapiens
agttatataactatctagatgc

SEQ ID NO: 8141733 - DNA, 22 bp, Homo sapiens
ctgagcagcaacccagagcctc

SEQ ID NO: 8141734 - DNA, 22 bp, Homo sapiens
ctgagcagcaacccagagcctc

SEQ ID NO: 8141735 - DNA, 22 bp, Homo sapiens
ctgagcagatgttgcccagaag

SEQ ID NO: 8141736 - DNA, 22 bp, Homo sapiens
ctgagcagatgttgcccagaag

SEQ ID NO: 8141737 - DNA, 22 bp, Homo sapiens
ctgagcagatgaccagccccag

SEQ ID NO: 8141738 - DNA, 22 bp, Homo sapiens
ctgagcagcaacccagagcctc

SEQ ID NO: 8141739 - DNA, 22 bp, Homo sapiens
ctgagcagcacagggcgccagg

SEQ ID NO: 8141740 - DNA, 22 bp, Homo sapiens
ctgagcagcaattgctggccca

SEQ ID NO: 8141741 - DNA, 22 bp, Homo sapiens
ctgagcagcaacccagagcctc

SEQ ID NO: 8141742 - DNA, 22 bp, Homo sapiens
ctgagcagcaacccagagcctc

SEQ ID NO: 8141743 - DNA, 22 bp, Homo sapiens
ctgagcagcaattgctggccca

SEQ ID NO: 8141744 - DNA, 22 bp, Homo sapiens
ctgagcagcaattgctggccca

SEQ ID NO: 8141745 - DNA, 22 bp, Homo sapiens
ctgagcagcacagggcgccagg

SEQ ID NO: 8141746 - DNA, 22 bp, Homo sapiens
ctgagcagcaccttcaagaaac

SEQ ID NO: 8141747 - DNA, 22 bp, Homo sapiens
ctgagcagcagggagactggtg

SEQ ID NO: 8141748 - DNA, 22 bp, Homo sapiens
ctgagcagccccaccagccatt

SEQ ID NO: 8141749 - DNA, 22 bp, Homo sapiens
ctgagcagcagggagactggtg

SEQ ID NO: 8141750 - DNA, 22 bp, Homo sapiens
ctgagcagcagggagactggtg

SEQ ID NO: 8141751 - DNA, 22 bp, Homo sapiens
ctgagctgggactcagtagcaa

SEQ ID NO: 8141752 - DNA, 22 bp, Homo sapiens
ctgagctgggactcagtagcaa

SEQ ID NO: 8141753 - DNA, 22 bp, Homo sapiens
ctgagctgggactcagtagcaa

SEQ ID NO: 8141754 - DNA, 22 bp, Homo sapiens
ctgagctgggactcagtagcaa

SEQ ID NO: 8141755 - DNA, 22 bp, Homo sapiens
ctgaggagaacaatgagatcaa

SEQ ID NO: 8141756 - DNA, 22 bp, Homo sapiens
ctgaggagaggtggcctgtgtt

SEQ ID NO: 8141757 - DNA, 22 bp, Homo sapiens
ctgaggagagatcacgtggtgt

SEQ ID NO: 8141758 - DNA, 22 bp, Homo sapiens
ctgagaaacatatttccatcta

SEQ ID NO: 8141759 - DNA, 22 bp, Homo sapiens
ctgagaaaccaggtgctctgat

SEQ ID NO: 8141760 - DNA, 22 bp, Homo sapiens
agttagaaagtaaatcatttga

SEQ ID NO: 8141761 - DNA, 22 bp, Homo sapiens
agttactcactgagggtttatt

SEQ ID NO: 8141762 - DNA, 18 bp, Homo sapiens
agttagaaatgaaggcca

SEQ ID NO: 8141763 - DNA, 22 bp, Homo sapiens
agttagaatagtcagattgtag

SEQ ID NO: 8141764 - DNA, 22 bp, Homo sapiens
agttagaatagtcagattgtag

SEQ ID NO: 8141765 - DNA, 22 bp, Homo sapiens
agttagaatagtcagattgtag

SEQ ID NO: 8141766 - DNA, 22 bp, Homo sapiens
agttagaatataattatgttaa

SEQ ID NO: 8141767 - DNA, 22 bp, Homo sapiens
agttataatctgctactgatat

SEQ ID NO: 8141768 - DNA, 22 bp, Homo sapiens
agttataccttatacacatatg

SEQ ID NO: 8141769 - DNA, 22 bp, Homo sapiens
agttataatctgctactgatat

SEQ ID NO: 8141770 - DNA, 22 bp, Homo sapiens
agttatataactatctagatgc

SEQ ID NO: 8141771 - DNA, 20 bp, Homo sapiens
agttagtgagtaattgagct

SEQ ID NO: 8141772 - DNA, 22 bp, Homo sapiens
agttagtggcaaagtggtttga

SEQ ID NO: 8141773 - DNA, 22 bp, Homo sapiens
agttagttttgtaattccaccc

SEQ ID NO: 8141774 - DNA, 22 bp, Homo sapiens
agttataaaaggagcactgatt

SEQ ID NO: 8141775 - DNA, 18 bp, Homo sapiens
ctccagagctgtgagaca

SEQ ID NO: 8141776 - DNA, 22 bp, Homo sapiens
ctccagagagtccagctctggg

SEQ ID NO: 8141777 - DNA, 22 bp, Homo sapiens
ctccagctcgcgagctctgctc

SEQ ID NO: 8141778 - DNA, 22 bp, Homo sapiens
ctccagctcttaactgcggaag

SEQ ID NO: 8141779 - DNA, 22 bp, Homo sapiens
ctccagctgagtaagaacacta

SEQ ID NO: 8141780 - DNA, 22 bp, Homo sapiens
ctccagctcttaactgcggaag

SEQ ID NO: 8141781 - DNA, 22 bp, Homo sapiens
agtcttctcatttcacatgctt

SEQ ID NO: 8141782 - DNA, 22 bp, Homo sapiens
agtcttctcatttcacatgctt

SEQ ID NO: 8141783 - DNA, 22 bp, Homo sapiens
agtcttcagcagggttaaaccc

SEQ ID NO: 8141784 - DNA, 22 bp, Homo sapiens
agtcttatgtgatttatctttc

SEQ ID NO: 8141785 - DNA, 22 bp, Homo sapiens
agtcttatgtttgtgaagaact

SEQ ID NO: 8141786 - DNA, 22 bp, Homo sapiens
agtcttcactcttcactactat

SEQ ID NO: 8141787 - DNA, 22 bp, Homo sapiens
agtcttatatcactatgctctg

SEQ ID NO: 8141788 - DNA, 22 bp, Homo sapiens
agtcttatggttaaatagatgc

SEQ ID NO: 8141789 - DNA, 22 bp, Homo sapiens
ctcattgcccagatccccacag

SEQ ID NO: 8141790 - DNA, 22 bp, Homo sapiens
ctccagctgctggtctgagact

SEQ ID NO: 8141791 - DNA, 22 bp, Homo sapiens
ctccagctgctggtctgagact

SEQ ID NO: 8141792 - DNA, 22 bp, Homo sapiens
ctccagcttctgcccagagact

SEQ ID NO: 8141793 - DNA, 22 bp, Homo sapiens
ctccagcttccctcagctgtgg

SEQ ID NO: 8141794 - DNA, 22 bp, Homo sapiens
ctccaggaaaatagggaatgag

SEQ ID NO: 8141795 - DNA, 22 bp, Homo sapiens
ctccaggaaagcctgaggcccg

SEQ ID NO: 8141796 - DNA, 22 bp, Homo sapiens
ctccagctttttcccagttggc

SEQ ID NO: 8141797 - DNA, 22 bp, Homo sapiens
ctccagctttttcccagttggc

SEQ ID NO: 8141798 - DNA, 22 bp, Homo sapiens
ctccagctttttcccagttggc

SEQ ID NO: 8141799 - DNA, 22 bp, Homo sapiens
ctccaggaaaatagggaatgag

SEQ ID NO: 8141800 - DNA, 22 bp, Homo sapiens
ctccagctttagctctccaggg

SEQ ID NO: 8141801 - DNA, 22 bp, Homo sapiens
ctccagctttagctctccaggg

SEQ ID NO: 8141802 - DNA, 22 bp, Homo sapiens
ctccaggacactaacccaggct

SEQ ID NO: 8141803 - DNA, 22 bp, Homo sapiens
ctccaggaacagcaccctgctg

SEQ ID NO: 8141804 - DNA, 22 bp, Homo sapiens
ctccaggctcgtccaagatcga

SEQ ID NO: 8141805 - DNA, 22 bp, Homo sapiens
ctccaggctggatccaagtcaa

SEQ ID NO: 8141806 - DNA, 22 bp, Homo sapiens
ctccaggctggggtgcaggttg

SEQ ID NO: 8141807 - DNA, 22 bp, Homo sapiens
ctccaggctggggtgcaggttg

SEQ ID NO: 8141808 - DNA, 22 bp, Homo sapiens
ctccaggctggatccaagtcaa

SEQ ID NO: 8141809 - DNA, 22 bp, Homo sapiens
ctccaggctggatccaagtcaa

SEQ ID NO: 8141810 - DNA, 22 bp, Homo sapiens
ctccaggcttcaagggccggcc

SEQ ID NO: 8141811 - DNA, 22 bp, Homo sapiens
ctccaggctggggtgcaggttg

SEQ ID NO: 8141812 - DNA, 22 bp, Homo sapiens
ctccagggaaaggggcgtccgc

SEQ ID NO: 8141813 - DNA, 22 bp, Homo sapiens
ctccagggaaaggggcgtccgc

SEQ ID NO: 8141814 - DNA, 22 bp, Homo sapiens
agtcctcccttggggccacctt

SEQ ID NO: 8141815 - DNA, 22 bp, Homo sapiens
agtcctctgctgtgcgtctttg

SEQ ID NO: 8141816 - DNA, 22 bp, Homo sapiens
agtcctagacttttctgccact

SEQ ID NO: 8141817 - DNA, 22 bp, Homo sapiens
agtcctggacttggagtcaggg

SEQ ID NO: 8141818 - DNA, 22 bp, Homo sapiens
agtcctggacttggagtcaggg

SEQ ID NO: 8141819 - DNA, 22 bp, Homo sapiens
agtcctgatgctctggcaggag

SEQ ID NO: 8141820 - DNA, 22 bp, Homo sapiens
agtcctggccccaaggaaggat

SEQ ID NO: 8141821 - DNA, 22 bp, Homo sapiens
agtcctggccccaaggaaggat

SEQ ID NO: 8141822 - DNA, 22 bp, Homo sapiens
agtcctggcatggaattgtccc

SEQ ID NO: 8141823 - DNA, 22 bp, Homo sapiens
agtcctggcatggaattgtccc

SEQ ID NO: 8141824 - DNA, 22 bp, Homo sapiens
agtcctggcatataggtcctca

SEQ ID NO: 8141825 - DNA, 18 bp, Homo sapiens
agtcctggagatcaccaa

SEQ ID NO: 8141826 - DNA, 18 bp, Homo sapiens
agtcctggagatcaccaa

SEQ ID NO: 8141827 - DNA, 22 bp, Homo sapiens
agtcctggcatataggtcctca

SEQ ID NO: 8141828 - DNA, 20 bp, Homo sapiens
agtccctttggtcaggtatt

SEQ ID NO: 8141829 - DNA, 22 bp, Homo sapiens
agtccctttagtctggagagct

SEQ ID NO: 8141830 - DNA, 22 bp, Homo sapiens
agtccgcctgctgccgtggcag

SEQ ID NO: 8141831 - DNA, 22 bp, Homo sapiens
agtccggggtctggacacctgg

SEQ ID NO: 8141832 - DNA, 22 bp, Homo sapiens
agtccgtcctgtcaagcagctg

SEQ ID NO: 8141833 - DNA, 22 bp, Homo sapiens
agtccctgtactttccactgcc

SEQ ID NO: 8141834 - DNA, 22 bp, Homo sapiens
agtccctgtactttccactgcc

SEQ ID NO: 8141835 - DNA, 22 bp, Homo sapiens
agtcccttctcaaagtgtgcgg

SEQ ID NO: 8141836 - DNA, 23 bp, Homo sapiens
agtcccctacatagttcctgggg

SEQ ID NO: 8141837 - DNA, 22 bp, Homo sapiens
agtcccctctaacccaacttta

SEQ ID NO: 8141838 - DNA, 23 bp, Homo sapiens
agtcccctacatagttcctgggg

SEQ ID NO: 8141839 - DNA, 23 bp, Homo sapiens
agtcccctacatagttcctgggg

SEQ ID NO: 8141840 - DNA, 22 bp, Homo sapiens
agtcccctggcaggagggacgt

SEQ ID NO: 8141841 - DNA, 22 bp, Homo sapiens
agtcccctctaacccaacttta

SEQ ID NO: 8141842 - DNA, 22 bp, Homo sapiens
agtcccctctcgcttggctgag

SEQ ID NO: 8141843 - DNA, 22 bp, Homo sapiens
agtcccctctcgcttggctgag

SEQ ID NO: 8141844 - DNA, 22 bp, Homo sapiens
agtcccctctaacccaacttta

SEQ ID NO: 8141845 - DNA, 22 bp, Homo sapiens
agtcccctctcgcttggctgag

SEQ ID NO: 8141846 - DNA, 21 bp, Homo sapiens
agtcccctgtccttacttcta

SEQ ID NO: 8141847 - DNA, 22 bp, Homo sapiens
agtcccctggcaggagggacgt

SEQ ID NO: 8141848 - DNA, 21 bp, Homo sapiens
agtcccctgtccttacttcta

SEQ ID NO: 8141849 - DNA, 22 bp, Homo sapiens
agtccctgtactttccactgcc

SEQ ID NO: 8141850 - DNA, 22 bp, Homo sapiens
agtccctggattgtctctgtca

SEQ ID NO: 8141851 - DNA, 22 bp, Homo sapiens
ctcatgcccagagccactgttg

SEQ ID NO: 8141852 - DNA, 22 bp, Homo sapiens
ctcatggagggagtgctcttcc

SEQ ID NO: 8141853 - DNA, 22 bp, Homo sapiens
agtcctgggtccagcaggtcct

SEQ ID NO: 8141854 - DNA, 22 bp, Homo sapiens
agtcctgggtccagcaggtcct

SEQ ID NO: 8141855 - DNA, 22 bp, Homo sapiens
agtcctggccccaaggaaggat

SEQ ID NO: 8141856 - DNA, 22 bp, Homo sapiens
agtcctggccccaaggaaggat

SEQ ID NO: 8141857 - DNA, 19 bp, Homo sapiens
agtcctggcctgggggacc

SEQ ID NO: 8141858 - DNA, 19 bp, Homo sapiens
agtcctggcctgggggacc

SEQ ID NO: 8141859 - DNA, 19 bp, Homo sapiens
agtcctggcctgggggacc

SEQ ID NO: 8141860 - DNA, 19 bp, Homo sapiens
agtcctggcctgggggacc

SEQ ID NO: 8141861 - DNA, 18 bp, Homo sapiens
agtcctggctctaccacc

SEQ ID NO: 8141862 - DNA, 22 bp, Homo sapiens
agtcctggctctacgggcttca

SEQ ID NO: 8141863 - DNA, 18 bp, Homo sapiens
agtcctggctctaccacc

SEQ ID NO: 8141864 - DNA, 22 bp, Homo sapiens
agtcctggctctacgggcttca

SEQ ID NO: 8141865 - DNA, 22 bp, Homo sapiens
ctcatgtcaggggtgtcaatgt

SEQ ID NO: 8141866 - DNA, 18 bp, Homo sapiens
ctcatgtgtggtcccagc

SEQ ID NO: 8141867 - DNA, 20 bp, Homo sapiens
ctcatgtggcaccaggcact

SEQ ID NO: 8141868 - DNA, 22 bp, Homo sapiens
ctcattagacaggtatacttta

SEQ ID NO: 8141869 - DNA, 22 bp, Homo sapiens
ctcattgcccagatccccacag

SEQ ID NO: 8141870 - DNA, 22 bp, Homo sapiens
ctcattgcaacctccgcctccc

SEQ ID NO: 8141871 - DNA, 22 bp, Homo sapiens
ctcattgcaacctccgcctccc

SEQ ID NO: 8141872 - DNA, 22 bp, Homo sapiens
ctcattgcaacctccgcctccc

SEQ ID NO: 8141873 - DNA, 22 bp, Homo sapiens
ctcattgcaacctccgcctccc

SEQ ID NO: 8141874 - DNA, 22 bp, Homo sapiens
ctcattcattcccgcagccacc

SEQ ID NO: 8141875 - DNA, 22 bp, Homo sapiens
ctcctgggggacagcggcaggg

SEQ ID NO: 8141876 - DNA, 22 bp, Homo sapiens
ctcctgggtcattgccagcaaa

SEQ ID NO: 8141877 - DNA, 22 bp, Homo sapiens
ctcctgggtcattgccagcaaa

SEQ ID NO: 8141878 - DNA, 22 bp, Homo sapiens
ctcctgggtcattgccagcaaa

SEQ ID NO: 8141879 - DNA, 22 bp, Homo sapiens
ctcctgggggacagcggcaggg

SEQ ID NO: 8141880 - DNA, 22 bp, Homo sapiens
ctcctgggggacagcggcaggg

SEQ ID NO: 8141881 - DNA, 22 bp, Homo sapiens
ctcctggggccatggaaggaac

SEQ ID NO: 8141882 - DNA, 22 bp, Homo sapiens
ctcctgggggacagcggcaggg

SEQ ID NO: 8141883 - DNA, 22 bp, Homo sapiens
ctcctggggcacttagaagcaa

SEQ ID NO: 8141884 - DNA, 22 bp, Homo sapiens
ctcctggggcacttagaagcaa

SEQ ID NO: 8141885 - DNA, 20 bp, Homo sapiens
ctcctgggactgctggttat

SEQ ID NO: 8141886 - DNA, 22 bp, Homo sapiens
ctcctgggagcagggatggatg

SEQ ID NO: 8141887 - DNA, 22 bp, Homo sapiens
ctcctggggcacttagaagcaa

SEQ ID NO: 8141888 - DNA, 22 bp, Homo sapiens
ctcctggggcacttagaagcaa

SEQ ID NO: 8141889 - DNA, 22 bp, Homo sapiens
ctcctggggccatggaaggaac

SEQ ID NO: 8141890 - DNA, 20 bp, Homo sapiens
ctcctgggactgctggttat

SEQ ID NO: 8141891 - DNA, 20 bp, Homo sapiens
ctcctgggactgctggttat

SEQ ID NO: 8141892 - DNA, 22 bp, Homo sapiens
ctcctgggaatttagttgtgag

SEQ ID NO: 8141893 - DNA, 22 bp, Homo sapiens
ctcctgggaaaggctggacaca

SEQ ID NO: 8141894 - DNA, 22 bp, Homo sapiens
ctcctgggaaatgaaggggcag

SEQ ID NO: 8141895 - DNA, 22 bp, Homo sapiens
ctcctgggaatttagttgtgag

SEQ ID NO: 8141896 - DNA, 22 bp, Homo sapiens
ctcctgggaaaggctggacaca

SEQ ID NO: 8141897 - DNA, 22 bp, Homo sapiens
ctcctgggaaaggctggacaca

SEQ ID NO: 8141898 - DNA, 22 bp, Homo sapiens
ctcctggctttcccagaccagg

SEQ ID NO: 8141899 - DNA, 22 bp, Homo sapiens
ctcctggctttcccagaccagg

SEQ ID NO: 8141900 - DNA, 22 bp, Homo sapiens
ctcctggctttcccagaccagg

SEQ ID NO: 8141901 - DNA, 22 bp, Homo sapiens
ctcctggcttctgaaatcgtgg

SEQ ID NO: 8141902 - DNA, 22 bp, Homo sapiens
ctcctggctttcccagaccagg

SEQ ID NO: 8141903 - DNA, 22 bp, Homo sapiens
ctcctggctttcccagaccagg

SEQ ID NO: 8141904 - DNA, 22 bp, Homo sapiens
ctcctggcttctgaaatcgtgg

SEQ ID NO: 8141905 - DNA, 22 bp, Homo sapiens
ctcctgggtcattgccagcaaa

SEQ ID NO: 8141906 - DNA, 22 bp, Homo sapiens
ctcctgggtcattgccagcaaa

SEQ ID NO: 8141907 - DNA, 22 bp, Homo sapiens
agtggcagaggttgactgcagt

SEQ ID NO: 8141908 - DNA, 22 bp, Homo sapiens
agtggcagaagccaagtctgca

SEQ ID NO: 8141909 - DNA, 22 bp, Homo sapiens
ctcctggtgctggggctgccgc

SEQ ID NO: 8141910 - DNA, 22 bp, Homo sapiens
agtggcagaagccaagtctgca

SEQ ID NO: 8141911 - DNA, 22 bp, Homo sapiens
agtggcagaagccaagtctgca

SEQ ID NO: 8141912 - DNA, 22 bp, Homo sapiens
agtggcagagtgcactcaggca

SEQ ID NO: 8141913 - DNA, 22 bp, Homo sapiens
agtggcagagtcagggtttgga

SEQ ID NO: 8141914 - DNA, 22 bp, Homo sapiens
agtggcagagtgcactcaggca

SEQ ID NO: 8141915 - DNA, 22 bp, Homo sapiens
agtggcagagtgcactcaggca

SEQ ID NO: 8141916 - DNA, 22 bp, Homo sapiens
agtggcagaggttgactgcagt

SEQ ID NO: 8141917 - DNA, 22 bp, Homo sapiens
agtggcagaggttgactgcagt

SEQ ID NO: 8141918 - DNA, 22 bp, Homo sapiens
ctctcagaagtagcacgtgggc

SEQ ID NO: 8141919 - DNA, 19 bp, Homo sapiens
agtggcagatctggaagta

SEQ ID NO: 8141920 - DNA, 22 bp, Homo sapiens
ctctcagaagtagcacgtgggc

SEQ ID NO: 8141921 - DNA, 22 bp, Homo sapiens
ctctcagaagtttatgtcagaa

SEQ ID NO: 8141922 - DNA, 22 bp, Homo sapiens
ctctcagacacccatttggaaa

SEQ ID NO: 8141923 - DNA, 22 bp, Homo sapiens
ctctcagatggagtgtgaatgg

SEQ ID NO: 8141924 - DNA, 22 bp, Homo sapiens
ctctcagcaggaaagcatgcaa

SEQ ID NO: 8141925 - DNA, 22 bp, Homo sapiens
ctctcagcaggaaagcatgcaa

SEQ ID NO: 8141926 - DNA, 22 bp, Homo sapiens
ctctcagcaggaaagcatgcaa

SEQ ID NO: 8141927 - DNA, 22 bp, Homo sapiens
agtggcagatctctggtctgga

SEQ ID NO: 8141928 - DNA, 22 bp, Homo sapiens
agtggcagatctctggtctgga

SEQ ID NO: 8141929 - DNA, 22 bp, Homo sapiens
agtggcagatctctggtctgga

SEQ ID NO: 8141930 - DNA, 22 bp, Homo sapiens
agtggcagagtgcactcaggca

SEQ ID NO: 8141931 - DNA, 19 bp, Homo sapiens
agtggcagatctggaagta

SEQ ID NO: 8141932 - DNA, 19 bp, Homo sapiens
agtggcagatctggaagta

SEQ ID NO: 8141933 - DNA, 19 bp, Homo sapiens
agtggcagatctggaagta

SEQ ID NO: 8141934 - DNA, 22 bp, Homo sapiens
agtggcagatctctggtctgga

SEQ ID NO: 8141935 - DNA, 22 bp, Homo sapiens
agtggcagatctctggtctgga

SEQ ID NO: 8141936 - DNA, 22 bp, Homo sapiens
ctcctcagaagagggtaacaca

SEQ ID NO: 8141937 - DNA, 22 bp, Homo sapiens
ctcctcagaacagccttggctg

SEQ ID NO: 8141938 - DNA, 22 bp, Homo sapiens
ctcctcagaagagggtaacaca

SEQ ID NO: 8141939 - DNA, 22 bp, Homo sapiens
ctcctgccaccgcggtgtcctg

SEQ ID NO: 8141940 - DNA, 22 bp, Homo sapiens
ctcctgcccacgtgctacttct

SEQ ID NO: 8141941 - DNA, 22 bp, Homo sapiens
ctcctgccaccgcggtgtcctg

SEQ ID NO: 8141942 - DNA, 22 bp, Homo sapiens
ctcctcagactttccttgtccg

SEQ ID NO: 8141943 - DNA, 22 bp, Homo sapiens
ctcctcagactttccttgtccg

SEQ ID NO: 8141944 - DNA, 22 bp, Homo sapiens
ctcctcagagagcagcttgggg

SEQ ID NO: 8141945 - DNA, 22 bp, Homo sapiens
ctcctggctctgccacttacta

SEQ ID NO: 8141946 - DNA, 19 bp, Homo sapiens
ctcctggctctgtcatttt

SEQ ID NO: 8141947 - DNA, 19 bp, Homo sapiens
ctcctggctctgtcatttt

SEQ ID NO: 8141948 - DNA, 22 bp, Homo sapiens
ctcctggctctgccacttacta

SEQ ID NO: 8141949 - DNA, 18 bp, Homo sapiens
ctcctggctgatggtgag

SEQ ID NO: 8141950 - DNA, 18 bp, Homo sapiens
ctcctggctgatggtgag

SEQ ID NO: 8141951 - DNA, 22 bp, Homo sapiens
ctcctggctcgcccccagctga

SEQ ID NO: 8141952 - DNA, 22 bp, Homo sapiens
ctcctggctcgcccccagctga

SEQ ID NO: 8141953 - DNA, 22 bp, Homo sapiens
ctcctggctctctgtttagtgt

SEQ ID NO: 8141954 - DNA, 22 bp, Homo sapiens
ctcctggctctctgtttagtgt

SEQ ID NO: 8141955 - DNA, 22 bp, Homo sapiens
ctcctggctctgccacttacta

SEQ ID NO: 8141956 - DNA, 22 bp, Homo sapiens
ctcctggctctgccacttacta

SEQ ID NO: 8141957 - DNA, 22 bp, Homo sapiens
ctccgtgctattttagtatcgc

SEQ ID NO: 8141958 - DNA, 19 bp, Homo sapiens
ctccggccagcaactgcat

SEQ ID NO: 8141959 - DNA, 22 bp, Homo sapiens
ctccctctgtccgaggccggct

SEQ ID NO: 8141960 - DNA, 22 bp, Homo sapiens
ctccctctgtccgaggccggct

SEQ ID NO: 8141961 - DNA, 22 bp, Homo sapiens
ctccctctctaaggcaaagaga

SEQ ID NO: 8141962 - DNA, 22 bp, Homo sapiens
ctccctctgaggctttgagcct

SEQ ID NO: 8141963 - DNA, 22 bp, Homo sapiens
ctcctcagaacagccttggctg

SEQ ID NO: 8141964 - DNA, 22 bp, Homo sapiens
ctcctcactttccagactgggc

SEQ ID NO: 8141965 - DNA, 22 bp, Homo sapiens
ctcctaggacgccgctgctcct

SEQ ID NO: 8141966 - DNA, 22 bp, Homo sapiens
ctcctcaaggtctcaggaataa

SEQ ID NO: 8141967 - DNA, 22 bp, Homo sapiens
ctccctcgagaacgcccctctc

SEQ ID NO: 8141968 - DNA, 22 bp, Homo sapiens
ctccctctcaccggagccctgg

SEQ ID NO: 8141969 - DNA, 22 bp, Homo sapiens
ctccctcgagaacgcccctctc

SEQ ID NO: 8141970 - DNA, 22 bp, Homo sapiens
ctccctccctacgtgagctcac

SEQ ID NO: 8141971 - DNA, 22 bp, Homo sapiens
ctccctcctcaaatatctttgt

SEQ ID NO: 8141972 - DNA, 22 bp, Homo sapiens
ctccctccctacgtgagctcac

SEQ ID NO: 8141973 - DNA, 22 bp, Homo sapiens
ctccctccctacgtgagctcac

SEQ ID NO: 8141974 - DNA, 22 bp, Homo sapiens
ctccctccctacgtgagctcac

SEQ ID NO: 8141975 - DNA, 22 bp, Homo sapiens
ctccctccctacgtgagctcac

SEQ ID NO: 8141976 - DNA, 22 bp, Homo sapiens
ctccctccctacgtgagctcac

SEQ ID NO: 8141977 - DNA, 22 bp, Homo sapiens
ctccctccaaataagactcggg

SEQ ID NO: 8141978 - DNA, 22 bp, Homo sapiens
ctccctccaaataagactcggg

SEQ ID NO: 8141979 - DNA, 22 bp, Homo sapiens
ctccctcaggccttagccctgc

SEQ ID NO: 8141980 - DNA, 22 bp, Homo sapiens
ctccctcaggccttagccctgc

SEQ ID NO: 8141981 - DNA, 22 bp, Homo sapiens
ctccctcaggccttagccctgc

SEQ ID NO: 8141982 - DNA, 22 bp, Homo sapiens
ctccctcaggccttagccctgc

SEQ ID NO: 8141983 - DNA, 22 bp, Homo sapiens
ctccctcatatacccagcgaga

SEQ ID NO: 8141984 - DNA, 22 bp, Homo sapiens
ctccctcagaggagcacctgtt

SEQ ID NO: 8141985 - DNA, 22 bp, Homo sapiens
ctccctcaccatgacccgctgt

SEQ ID NO: 8141986 - DNA, 22 bp, Homo sapiens
ctccctcagaggagcacctgtt

SEQ ID NO: 8141987 - DNA, 18 bp, Homo sapiens
ctccagggaactcagtca

SEQ ID NO: 8141988 - DNA, 22 bp, Homo sapiens
ctcccaggttgattctttccct

SEQ ID NO: 8141989 - DNA, 22 bp, Homo sapiens
ctcccaggttgattctttccct

SEQ ID NO: 8141990 - DNA, 22 bp, Homo sapiens
ctccagggaaaggggcgtccgc

SEQ ID NO: 8141991 - DNA, 20 bp, Homo sapiens
ctccagggaacagactggag

SEQ ID NO: 8141992 - DNA, 20 bp, Homo sapiens
ctccagggaacagactggag

SEQ ID NO: 8141993 - DNA, 18 bp, Homo sapiens
ctccagggaactcagtca

SEQ ID NO: 8141994 - DNA, 18 bp, Homo sapiens
ctccagggaactcagtca

SEQ ID NO: 8141995 - DNA, 20 bp, Homo sapiens
ctccagggaacagactggag

SEQ ID NO: 8141996 - DNA, 22 bp, Homo sapiens
atacaacagaaaatgattattc

SEQ ID NO: 8141997 - DNA, 22 bp, Homo sapiens
atacaacagaaaatgattattc

SEQ ID NO: 8141998 - DNA, 22 bp, Homo sapiens
atacaaatttatagatgcattt

SEQ ID NO: 8141999 - DNA, 22 bp, Homo sapiens
atacaaatttatagatgcattt

SEQ ID NO: 8142000 - DNA, 22 bp, Homo sapiens
atacaacagaaaatgattattc

SEQ ID NO: 8142001 - DNA, 22 bp, Homo sapiens
atacaacagaaaatgattattc

SEQ ID NO: 8142002 - DNA, 22 bp, Homo sapiens
atacaacagaaaatgattattc

SEQ ID NO: 8142003 - DNA, 22 bp, Homo sapiens
atacaaatttatagatgcattt

SEQ ID NO: 8142004 - DNA, 22 bp, Homo sapiens
atacaaatttatagatgcattt

SEQ ID NO: 8142005 - DNA, 22 bp, Homo sapiens
atacaaatttatagatgcattt

SEQ ID NO: 8142006 - DNA, 22 bp, Homo sapiens
ctgctgaggtatactatgtgac

SEQ ID NO: 8142007 - DNA, 22 bp, Homo sapiens
ctgctgaggggaggaaagacgg

SEQ ID NO: 8142008 - DNA, 22 bp, Homo sapiens
ctgctgaggtatactatgtgac

SEQ ID NO: 8142009 - DNA, 22 bp, Homo sapiens
ctgctgaggccttccctgtcct

SEQ ID NO: 8142010 - DNA, 22 bp, Homo sapiens
ctgctgagcctggtgcgggatg

SEQ ID NO: 8142011 - DNA, 22 bp, Homo sapiens
atacaactttatctgtaatgag

SEQ ID NO: 8142012 - DNA, 22 bp, Homo sapiens
atacaactttacatgcaattcc

SEQ ID NO: 8142013 - DNA, 22 bp, Homo sapiens
atacaactgccttagaaggaaa

SEQ ID NO: 8142014 - DNA, 22 bp, Homo sapiens
atacaactgctctcagataagt

SEQ ID NO: 8142015 - DNA, 22 bp, Homo sapiens
ctgctgcaatctggcttccatg

SEQ ID NO: 8142016 - DNA, 22 bp, Homo sapiens
ctgctgaggtggagattgcagt

SEQ ID NO: 8142017 - DNA, 22 bp, Homo sapiens
ctgctgaggtccttgctcagac

SEQ ID NO: 8142018 - DNA, 22 bp, Homo sapiens
ctgctgaggtatactatgtgac

SEQ ID NO: 8142019 - DNA, 22 bp, Homo sapiens
ctgctgaggtccttgctcagac

SEQ ID NO: 8142020 - DNA, 22 bp, Homo sapiens
ctgctgaggtccttgctcagac

SEQ ID NO: 8142021 - DNA, 22 bp, Homo sapiens
atacaaagctaaatatggtttc

SEQ ID NO: 8142022 - DNA, 21 bp, Homo sapiens
ataagcatgctgattacattt

SEQ ID NO: 8142023 - DNA, 22 bp, Homo sapiens
ataagcatgttagaatatttga

SEQ ID NO: 8142024 - DNA, 22 bp, Homo sapiens
ataagcatgttagaatatttga

SEQ ID NO: 8142025 - DNA, 22 bp, Homo sapiens
ataatttactaagctctacctt

SEQ ID NO: 8142026 - DNA, 22 bp, Homo sapiens
ataatttactaagctctacctt

SEQ ID NO: 8142027 - DNA, 21 bp, Homo sapiens
ataagcatgctgattacattt

SEQ ID NO: 8142028 - DNA, 22 bp, Homo sapiens
ataagcacacaaatacatatat

SEQ ID NO: 8142029 - DNA, 22 bp, Homo sapiens
ataagcagggtcaaatgcctac

SEQ ID NO: 8142030 - DNA, 21 bp, Homo sapiens
ataagcatgctgattacattt

SEQ ID NO: 8142031 - DNA, 22 bp, Homo sapiens
ataagcatgattaccgggagca

SEQ ID NO: 8142032 - DNA, 22 bp, Homo sapiens
ataagagctatggtgggagttg

SEQ ID NO: 8142033 - DNA, 22 bp, Homo sapiens
ataagaggaattacagaagagg

SEQ ID NO: 8142034 - DNA, 22 bp, Homo sapiens
ataagaataattaagttagtcc

SEQ ID NO: 8142035 - DNA, 22 bp, Homo sapiens
ataagaaacattattctttcca

SEQ ID NO: 8142036 - DNA, 22 bp, Homo sapiens
ataagacacgccccactcactc

SEQ ID NO: 8142037 - DNA, 23 bp, Homo sapiens
ataagaaaacagtaggctcagag

SEQ ID NO: 8142038 - DNA, 22 bp, Homo sapiens
ataacttcagggctgtgacaga

SEQ ID NO: 8142039 - DNA, 22 bp, Homo sapiens
ataacttgatgttatttgtcca

SEQ ID NO: 8142040 - DNA, 22 bp, Homo sapiens
ataacttcagtttctgtgtcct

SEQ ID NO: 8142041 - DNA, 22 bp, Homo sapiens
ataacttaatgggtcatgctct

SEQ ID NO: 8142042 - DNA, 22 bp, Homo sapiens
ataacttaatgggtcatgctct

SEQ ID NO: 8142043 - DNA, 22 bp, Homo sapiens
ataacttagagtaggcaaaagt

SEQ ID NO: 8142044 - DNA, 22 bp, Homo sapiens
ataacttattagattggagctg

SEQ ID NO: 8142045 - DNA, 22 bp, Homo sapiens
ataaatgattcagcaggaaata

SEQ ID NO: 8142046 - DNA, 22 bp, Homo sapiens
ataaatgaacattcacagagct

SEQ ID NO: 8142047 - DNA, 22 bp, Homo sapiens
ataaatgaacattcacagagct

SEQ ID NO: 8142048 - DNA, 22 bp, Homo sapiens
ataaatgcctcagaatcatccc

SEQ ID NO: 8142049 - DNA, 22 bp, Homo sapiens
ataaatgattcagcaggaaata

SEQ ID NO: 8142050 - DNA, 22 bp, Homo sapiens
ataaatgcctcagaatcatccc

SEQ ID NO: 8142051 - DNA, 22 bp, Homo sapiens
ctgcctctgcgtcccacagagt

SEQ ID NO: 8142052 - DNA, 22 bp, Homo sapiens
ctgcctctccccagagtggccc

SEQ ID NO: 8142053 - DNA, 22 bp, Homo sapiens
ctgcctctgcgtcccacagagt

SEQ ID NO: 8142054 - DNA, 22 bp, Homo sapiens
ctgcctctgcgtcccacagagt

SEQ ID NO: 8142055 - DNA, 22 bp, Homo sapiens
ctgcctctgcgtcccacagagt

SEQ ID NO: 8142056 - DNA, 22 bp, Homo sapiens
ctgcctctgcgtcccacagagt

SEQ ID NO: 8142057 - DNA, 22 bp, Homo sapiens
ataaatctcttaagactcaaca

SEQ ID NO: 8142058 - DNA, 22 bp, Homo sapiens
ataaatgaacattcacagagct

SEQ ID NO: 8142059 - DNA, 22 bp, Homo sapiens
ataaatgaacattcacagagct

SEQ ID NO: 8142060 - DNA, 22 bp, Homo sapiens
ctgcatttcacatttaaacttt

SEQ ID NO: 8142061 - DNA, 23 bp, Homo sapiens
ctgcattgtctcctgggagcatg

SEQ ID NO: 8142062 - DNA, 22 bp, Homo sapiens
ctgcctctattcactgaggcag

SEQ ID NO: 8142063 - DNA, 22 bp, Homo sapiens
ctgcctctcagcctgaccgcca

SEQ ID NO: 8142064 - DNA, 22 bp, Homo sapiens
ctgcctctcagcctgaccgcca

SEQ ID NO: 8142065 - DNA, 22 bp, Homo sapiens
ctgcctctcaggtccctgagat

SEQ ID NO: 8142066 - DNA, 22 bp, Homo sapiens
ctgcctctccccagagtggccc

SEQ ID NO: 8142067 - DNA, 22 bp, Homo sapiens
ctgcctctcagcctgaccgcca

SEQ ID NO: 8142068 - DNA, 22 bp, Homo sapiens
ctgcctctcaggtccctgagat

SEQ ID NO: 8142069 - DNA, 22 bp, Homo sapiens
ctgcctctcaggtccctgagat

SEQ ID NO: 8142070 - DNA, 22 bp, Homo sapiens
ctgcctctcaggtccctgagat

SEQ ID NO: 8142071 - DNA, 22 bp, Homo sapiens
ctgcctctcaggtccctgagat

SEQ ID NO: 8142072 - DNA, 22 bp, Homo sapiens
ctgcctctcaggtccctgagat

SEQ ID NO: 8142073 - DNA, 22 bp, Homo sapiens
ctgcctctcaggtccctgagat

SEQ ID NO: 8142074 - DNA, 22 bp, Homo sapiens
ataaatgtttgttgaatgaata

SEQ ID NO: 8142075 - DNA, 23 bp, Homo sapiens
ataaattactatctccctagagc

SEQ ID NO: 8142076 - DNA, 22 bp, Homo sapiens
ataaatgtgaattagagctttg

SEQ ID NO: 8142077 - DNA, 22 bp, Homo sapiens
ataaatgtgaattagagctttg

SEQ ID NO: 8142078 - DNA, 22 bp, Homo sapiens
ataaatgtgaaatgagcagtta

SEQ ID NO: 8142079 - DNA, 22 bp, Homo sapiens
ataaatgtgaattagagctttg

SEQ ID NO: 8142080 - DNA, 22 bp, Homo sapiens
ataaatgtgaattagagctttg

SEQ ID NO: 8142081 - DNA, 22 bp, Homo sapiens
ataacagagttgggaagtgaaa

SEQ ID NO: 8142082 - DNA, 22 bp, Homo sapiens
ataaattaggatctggggttcc

SEQ ID NO: 8142083 - DNA, 23 bp, Homo sapiens
ataaattactatctccctagagc

SEQ ID NO: 8142084 - DNA, 22 bp, Homo sapiens
ataaattaggatctggggttcc

SEQ ID NO: 8142085 - DNA, 22 bp, Homo sapiens
ataacccattggccaggcttca

SEQ ID NO: 8142086 - DNA, 22 bp, Homo sapiens
ataaccatgattaatctaagaa

SEQ ID NO: 8142087 - DNA, 22 bp, Homo sapiens
ataacattttgacaactggtga

SEQ ID NO: 8142088 - DNA, 22 bp, Homo sapiens
ataactctgtttttttcatgca

SEQ ID NO: 8142089 - DNA, 19 bp, Homo sapiens
ataactacattggctcagt

SEQ ID NO: 8142090 - DNA, 22 bp, Homo sapiens
ataactctgtttttttcatgca

SEQ ID NO: 8142091 - DNA, 22 bp, Homo sapiens
ataacctggtagtattaaatgt

SEQ ID NO: 8142092 - DNA, 22 bp, Homo sapiens
ataacagctcttaaacaccata

SEQ ID NO: 8142093 - DNA, 22 bp, Homo sapiens
ataacagatgcttcagcataaa

SEQ ID NO: 8142094 - DNA, 22 bp, Homo sapiens
ataacatgacctgtgcttcaca

SEQ ID NO: 8142095 - DNA, 22 bp, Homo sapiens
ctgatcatgtgggaggatatgt

SEQ ID NO: 8142096 - DNA, 22 bp, Homo sapiens
ctgatcattgttgttgctgtaa

SEQ ID NO: 8142097 - DNA, 21 bp, Homo sapiens
ctgatcccaaacctctgccct

SEQ ID NO: 8142098 - DNA, 22 bp, Homo sapiens
ctgcaaatcaagttcttataat

SEQ ID NO: 8142099 - DNA, 22 bp, Homo sapiens
ctgcaaataggggtgtgaataa

SEQ ID NO: 8142100 - DNA, 22 bp, Homo sapiens
ctgcaagccaagctgagagcct

SEQ ID NO: 8142101 - DNA, 22 bp, Homo sapiens
ctgcaagccagggagagatgcc

SEQ ID NO: 8142102 - DNA, 22 bp, Homo sapiens
ctgcaagccagggagagatgcc

SEQ ID NO: 8142103 - DNA, 22 bp, Homo sapiens
ctgcaaggagttgacattgtct

SEQ ID NO: 8142104 - DNA, 22 bp, Homo sapiens
ctgcaagctacccctagcatca

SEQ ID NO: 8142105 - DNA, 22 bp, Homo sapiens
ctgcaaggctgaattcagctga

SEQ ID NO: 8142106 - DNA, 22 bp, Homo sapiens
ctgcaaggctgaattcagctga

SEQ ID NO: 8142107 - DNA, 22 bp, Homo sapiens
ctgcaagattggaagatgcaat

SEQ ID NO: 8142108 - DNA, 22 bp, Homo sapiens
ctgcaactctctccagaggctg

SEQ ID NO: 8142109 - DNA, 22 bp, Homo sapiens
ctgcaagggatcttcaggtagc

SEQ ID NO: 8142110 - DNA, 22 bp, Homo sapiens
ctgcaaggctggggtgagctgg

SEQ ID NO: 8142111 - DNA, 22 bp, Homo sapiens
ctgcaaggtcatgactctctgg

SEQ ID NO: 8142112 - DNA, 22 bp, Homo sapiens
ctgcaaggtatatgttatcata

SEQ ID NO: 8142113 - DNA, 22 bp, Homo sapiens
ctgcaaggtcatgactctctgg

SEQ ID NO: 8142114 - DNA, 22 bp, Homo sapiens
ctgcaaggtatatgttatcata

SEQ ID NO: 8142115 - DNA, 23 bp, Homo sapiens
ctgcaaggtacaagatgctggat

SEQ ID NO: 8142116 - DNA, 22 bp, Homo sapiens
ctgcaatatgatgtctgagaaa

SEQ ID NO: 8142117 - DNA, 22 bp, Homo sapiens
ctgcaatgatgtatttgtcctg

SEQ ID NO: 8142118 - DNA, 22 bp, Homo sapiens
ctgcaaggtccacctgctacat

SEQ ID NO: 8142119 - DNA, 22 bp, Homo sapiens
ctgcaaggtccacctgctacat

SEQ ID NO: 8142120 - DNA, 22 bp, Homo sapiens
ctgcaagtatctaccattctct

SEQ ID NO: 8142121 - DNA, 22 bp, Homo sapiens
ctgaggagatccccccagaagt

SEQ ID NO: 8142122 - DNA, 22 bp, Homo sapiens
ctgaggagcagctggcccgcta

SEQ ID NO: 8142123 - DNA, 22 bp, Homo sapiens
ctgaggagcagctggcccgcta

SEQ ID NO: 8142124 - DNA, 22 bp, Homo sapiens
agttatatgtgaaaacacgtat

SEQ ID NO: 8142125 - DNA, 22 bp, Homo sapiens
ctgaggagccccctctcagcat

SEQ ID NO: 8142126 - DNA, 22 bp, Homo sapiens
ctgaggagctgaaggccctcca

SEQ ID NO: 8142127 - DNA, 22 bp, Homo sapiens
agttattgttcagtacaatgtc

SEQ ID NO: 8142128 - DNA, 22 bp, Homo sapiens
agttatttactcctttgtctct

SEQ ID NO: 8142129 - DNA, 22 bp, Homo sapiens
agttatttactcctttgtctct

SEQ ID NO: 8142130 - DNA, 19 bp, Homo sapiens
agttattgatctattcagg

SEQ ID NO: 8142131 - DNA, 22 bp, Homo sapiens
agttattgggttaaaattgcat

SEQ ID NO: 8142132 - DNA, 22 bp, Homo sapiens
agttattgagtgcagagcaggg

SEQ ID NO: 8142133 - DNA, 22 bp, Homo sapiens
agttattactctttaacatatt

SEQ ID NO: 8142134 - DNA, 22 bp, Homo sapiens
agttattactctttaacatatt

SEQ ID NO: 8142135 - DNA, 22 bp, Homo sapiens
agttattactctttaacatatt

SEQ ID NO: 8142136 - DNA, 22 bp, Homo sapiens
agttattaagtcctgttttgag

SEQ ID NO: 8142137 - DNA, 22 bp, Homo sapiens
agttatctgttagtattccagg

SEQ ID NO: 8142138 - DNA, 22 bp, Homo sapiens
agttatcatcccttacactttg

SEQ ID NO: 8142139 - DNA, 22 bp, Homo sapiens
agttatcatcccttacactttg

SEQ ID NO: 8142140 - DNA, 22 bp, Homo sapiens
agttatcaggtgttttcatgga

SEQ ID NO: 8142141 - DNA, 22 bp, Homo sapiens
agttatcaagacagtgtggtac

SEQ ID NO: 8142142 - DNA, 20 bp, Homo sapiens
ctgcagggttagaggctcca

SEQ ID NO: 8142143 - DNA, 22 bp, Homo sapiens
ctgcagggttcggagagttccc

SEQ ID NO: 8142144 - DNA, 22 bp, Homo sapiens
ctgcagggttcggagagttccc

SEQ ID NO: 8142145 - DNA, 22 bp, Homo sapiens
ctgcagggtttcgccagttgtg

SEQ ID NO: 8142146 - DNA, 22 bp, Homo sapiens
ctgcagggtttcgccagttgtg

SEQ ID NO: 8142147 - DNA, 22 bp, Homo sapiens
ctgcagggttcggagagttccc

SEQ ID NO: 8142148 - DNA, 22 bp, Homo sapiens
ctgcatcctaacctccatgcag

SEQ ID NO: 8142149 - DNA, 22 bp, Homo sapiens
ctgcatccatgttgctgcaaag

SEQ ID NO: 8142150 - DNA, 22 bp, Homo sapiens
ctgcatcctggaaatagctaag

SEQ ID NO: 8142151 - DNA, 21 bp, Homo sapiens
ctgcatctcatagaacatgtc

SEQ ID NO: 8142152 - DNA, 22 bp, Homo sapiens
ctgcagggttttaacaatggac

SEQ ID NO: 8142153 - DNA, 22 bp, Homo sapiens
ctgcagggttttaacaatggac

SEQ ID NO: 8142154 - DNA, 22 bp, Homo sapiens
ctgcagggtttttcaaggacaa

SEQ ID NO: 8142155 - DNA, 22 bp, Homo sapiens
ctgcagggtttttcaaggacaa

SEQ ID NO: 8142156 - DNA, 22 bp, Homo sapiens
ctgcattgatcaggcagaatct

SEQ ID NO: 8142157 - DNA, 22 bp, Homo sapiens
ctgcattaagttgcctgtaaga

SEQ ID NO: 8142158 - DNA, 22 bp, Homo sapiens
ctgcatggttcaaatgagctaa

SEQ ID NO: 8142159 - DNA, 22 bp, Homo sapiens
ctgcatctctgtgccagagggc

SEQ ID NO: 8142160 - DNA, 22 bp, Homo sapiens
ctgcatggtagggataagatgg

SEQ ID NO: 8142161 - DNA, 23 bp, Homo sapiens
ctgcatgcttgaggtcaggtgtg

SEQ ID NO: 8142162 - DNA, 20 bp, Homo sapiens
ctgcagggttagaggctcca

SEQ ID NO: 8142163 - DNA, 20 bp, Homo sapiens
ctgcagggttagaggctcca

SEQ ID NO: 8142164 - DNA, 20 bp, Homo sapiens
ctgcagggttagaggctcca

SEQ ID NO: 8142165 - DNA, 20 bp, Homo sapiens
ctgcagggtgagtgggcgat

SEQ ID NO: 8142166 - DNA, 20 bp, Homo sapiens
ctgcagggtgagtgggcgat

SEQ ID NO: 8142167 - DNA, 22 bp, Homo sapiens
ctgcagggtgacgttgcccacc

SEQ ID NO: 8142168 - DNA, 22 bp, Homo sapiens
ctgcagggtgacgttgcccacc

SEQ ID NO: 8142169 - DNA, 22 bp, Homo sapiens
ctgcagagatgaagaaggtggc

SEQ ID NO: 8142170 - DNA, 22 bp, Homo sapiens
ctgcagagcaagtaacatcctc

SEQ ID NO: 8142171 - DNA, 22 bp, Homo sapiens
ctgcagggagaggggacagcct

SEQ ID NO: 8142172 - DNA, 22 bp, Homo sapiens
ctgcagggagaggggacagcct

SEQ ID NO: 8142173 - DNA, 22 bp, Homo sapiens
ctgcagggagaggggacagcct

SEQ ID NO: 8142174 - DNA, 22 bp, Homo sapiens
ctgcagggagaggggacagcct

SEQ ID NO: 8142175 - DNA, 22 bp, Homo sapiens
ctgcaggggtgtcctgtattgg

SEQ ID NO: 8142176 - DNA, 22 bp, Homo sapiens
ctgcagagatgaagaaggtggc

SEQ ID NO: 8142177 - DNA, 22 bp, Homo sapiens
ctgcagagagtgccgggcagcc

SEQ ID NO: 8142178 - DNA, 22 bp, Homo sapiens
ctgcagagagtaactgaaatat

SEQ ID NO: 8142179 - DNA, 22 bp, Homo sapiens
ctgcagagagtgccgggcagcc

SEQ ID NO: 8142180 - DNA, 23 bp, Homo sapiens
ctgcagagaactgagggacagcc

SEQ ID NO: 8142181 - DNA, 23 bp, Homo sapiens
ctgcagagaactgagggacagcc

SEQ ID NO: 8142182 - DNA, 22 bp, Homo sapiens
ctgcacacatatggcttctctc

SEQ ID NO: 8142183 - DNA, 22 bp, Homo sapiens
ctgcagagacctaggtcaggtt

SEQ ID NO: 8142184 - DNA, 22 bp, Homo sapiens
ctgcagagaattgtggggcttc

SEQ ID NO: 8142185 - DNA, 22 bp, Homo sapiens
ctgcagagaattgtggggcttc

SEQ ID NO: 8142186 - DNA, 22 bp, Homo sapiens
ctgcagagaattgtggggcttc

SEQ ID NO: 8142187 - DNA, 22 bp, Homo sapiens
ataccaaagcacatactgtttg

SEQ ID NO: 8142188 - DNA, 22 bp, Homo sapiens
atacattgagttttgatgttct

SEQ ID NO: 8142189 - DNA, 17 bp, Homo sapiens
atacattgttaaagtat

SEQ ID NO: 8142190 - DNA, 21 bp, Homo sapiens
atacattctattaagcattta

SEQ ID NO: 8142191 - DNA, 22 bp, Homo sapiens
atacatgtgtgtgcatacatgt

SEQ ID NO: 8142192 - DNA, 22 bp, Homo sapiens
atacatgtgtgtgcatacatgt

SEQ ID NO: 8142193 - DNA, 22 bp, Homo sapiens
atacatagttctgtgaaaagta

SEQ ID NO: 8142194 - DNA, 22 bp, Homo sapiens
atacatatatggtacttcctgg

SEQ ID NO: 8142195 - DNA, 22 bp, Homo sapiens
atacataggagaataacttcag

SEQ ID NO: 8142196 - DNA, 22 bp, Homo sapiens
atacatagctgaaaacttgtag

SEQ ID NO: 8142197 - DNA, 22 bp, Homo sapiens
atacctgtgtatccacaagcgt

SEQ ID NO: 8142198 - DNA, 22 bp, Homo sapiens
atacctgtgtatccacaagcgt

SEQ ID NO: 8142199 - DNA, 22 bp, Homo sapiens
atacctgatcaaggcaaaaatg

SEQ ID NO: 8142200 - DNA, 22 bp, Homo sapiens
atacctatgtgacagtattatt

SEQ ID NO: 8142201 - DNA, 22 bp, Homo sapiens
ataccttttagacatgtagttg

SEQ ID NO: 8142202 - DNA, 22 bp, Homo sapiens
atacctgtgtatccacaagcgt

SEQ ID NO: 8142203 - DNA, 22 bp, Homo sapiens
ataccatggcagtttattcacg

SEQ ID NO: 8142204 - DNA, 20 bp, Homo sapiens
ataccagagtacagtttatg

SEQ ID NO: 8142205 - DNA, 22 bp, Homo sapiens
ataccataggaaaggatcagcc

SEQ ID NO: 8142206 - DNA, 22 bp, Homo sapiens
atacatacatgtatgcacatac

SEQ ID NO: 8142207 - DNA, 22 bp, Homo sapiens
atacatacgtacatacgtatgt

SEQ ID NO: 8142208 - DNA, 22 bp, Homo sapiens
atacatacatgtatgcacatac

SEQ ID NO: 8142209 - DNA, 22 bp, Homo sapiens
atacatacatgtatgcacatac

SEQ ID NO: 8142210 - DNA, 22 bp, Homo sapiens
atacatacatgtatgcacatac

SEQ ID NO: 8142211 - DNA, 22 bp, Homo sapiens
atacatacgtacatacgtatgt

SEQ ID NO: 8142212 - DNA, 22 bp, Homo sapiens
atacatacatgtacacataaat

SEQ ID NO: 8142213 - DNA, 22 bp, Homo sapiens
atacatacatgtacacataaat

SEQ ID NO: 8142214 - DNA, 22 bp, Homo sapiens
atacatacatgtacacataaat

SEQ ID NO: 8142215 - DNA, 22 bp, Homo sapiens
atacagttatagtcagggctaa

SEQ ID NO: 8142216 - DNA, 22 bp, Homo sapiens
atacataattacttccgatgtt

SEQ ID NO: 8142217 - DNA, 22 bp, Homo sapiens
atacataattacttccgatgtt

SEQ ID NO: 8142218 - DNA, 17 bp, Homo sapiens
atacagtttattttaca

SEQ ID NO: 8142219 - DNA, 22 bp, Homo sapiens
atacagtggctgtgagctgggc

SEQ ID NO: 8142220 - DNA, 22 bp, Homo sapiens
atacagtgtactatttagcagt

SEQ ID NO: 8142221 - DNA, 22 bp, Homo sapiens
atacagtgaatacttacagtgt

SEQ ID NO: 8142222 - DNA, 22 bp, Homo sapiens
atacagtgccccttttcacatg

SEQ ID NO: 8142223 - DNA, 22 bp, Homo sapiens
atacagtataactaataaaccc

SEQ ID NO: 8142224 - DNA, 20 bp, Homo sapiens
atacagtaggtgctcaatat

SEQ ID NO: 8142225 - DNA, 22 bp, Homo sapiens
ctggagagaatgttcattgcag

SEQ ID NO: 8142226 - DNA, 22 bp, Homo sapiens
ctggagagaatgtggaatgatt

SEQ ID NO: 8142227 - DNA, 22 bp, Homo sapiens
ctggagagaatgttcattgcag

SEQ ID NO: 8142228 - DNA, 22 bp, Homo sapiens
ctggagagaatgttcattgcag

SEQ ID NO: 8142229 - DNA, 22 bp, Homo sapiens
ctggagagaccgaaagaggctg

SEQ ID NO: 8142230 - DNA, 22 bp, Homo sapiens
ctggagagaatgttcattgcag

SEQ ID NO: 8142231 - DNA, 20 bp, Homo sapiens
atacagatggttccagctgg

SEQ ID NO: 8142232 - DNA, 22 bp, Homo sapiens
atacagatgttaaagcaatttc

SEQ ID NO: 8142233 - DNA, 22 bp, Homo sapiens
atacagatgttaaagcaatttc

SEQ ID NO: 8142234 - DNA, 19 bp, Homo sapiens
atacagatgtatccatgat

SEQ ID NO: 8142235 - DNA, 22 bp, Homo sapiens
atacagtaaccacattctatag

SEQ ID NO: 8142236 - DNA, 22 bp, Homo sapiens
atacagtaaccacattctatag

SEQ ID NO: 8142237 - DNA, 22 bp, Homo sapiens
ctggagagaatgtggaatgatt

SEQ ID NO: 8142238 - DNA, 22 bp, Homo sapiens
ctggagagaaatgacaaagcta

SEQ ID NO: 8142239 - DNA, 22 bp, Homo sapiens
ctggagagaaatgacaaagcta

SEQ ID NO: 8142240 - DNA, 22 bp, Homo sapiens
ctggagagaatgtggaatgatt

SEQ ID NO: 8142241 - DNA, 22 bp, Homo sapiens
ctggagagaatgtggaatgatt

SEQ ID NO: 8142242 - DNA, 22 bp, Homo sapiens
ctggagagaatgtggaatgatt

SEQ ID NO: 8142243 - DNA, 22 bp, Homo sapiens
ctggagagaaatgacaaagcta

SEQ ID NO: 8142244 - DNA, 22 bp, Homo sapiens
ctggagacctctcctgagagtg

SEQ ID NO: 8142245 - DNA, 22 bp, Homo sapiens
ctggagacctctcctgagagtg

SEQ ID NO: 8142246 - DNA, 17 bp, Homo sapiens
ctggagaagcctgtgga

SEQ ID NO: 8142247 - DNA, 22 bp, Homo sapiens
ctggagaagtactgagacattt

SEQ ID NO: 8142248 - DNA, 17 bp, Homo sapiens
ctggagaagcctgtgga

SEQ ID NO: 8142249 - DNA, 22 bp, Homo sapiens
ctggagaagtactgagacattt

SEQ ID NO: 8142250 - DNA, 18 bp, Homo sapiens
ctgctgcaggcactcagg

SEQ ID NO: 8142251 - DNA, 22 bp, Homo sapiens
ctgctgccaagggtgccacagg

SEQ ID NO: 8142252 - DNA, 22 bp, Homo sapiens
ctgctgccaagggtgccacagg

SEQ ID NO: 8142253 - DNA, 22 bp, Homo sapiens
ctgctgccaagggtgccacagg

SEQ ID NO: 8142254 - DNA, 22 bp, Homo sapiens
ctgctgcattactcttctcaag

SEQ ID NO: 8142255 - DNA, 18 bp, Homo sapiens
ctgctgcaggcactcagg

SEQ ID NO: 8142256 - DNA, 22 bp, Homo sapiens
ctgctgcattcctctttatgag

SEQ ID NO: 8142257 - DNA, 22 bp, Homo sapiens
ctggaataaacgatcttcagca

SEQ ID NO: 8142258 - DNA, 22 bp, Homo sapiens
ctggaagtttccttcctggtca

SEQ ID NO: 8142259 - DNA, 22 bp, Homo sapiens
ctggaagtggggttggcttgaa

SEQ ID NO: 8142260 - DNA, 22 bp, Homo sapiens
ctggaagtggggttggcttgaa

SEQ ID NO: 8142261 - DNA, 22 bp, Homo sapiens
ctggaagagcatttgcataggg

SEQ ID NO: 8142262 - DNA, 22 bp, Homo sapiens
ctgctgccattagggcacagac

SEQ ID NO: 8142263 - DNA, 22 bp, Homo sapiens
ctggaagagcatttgcataggg

SEQ ID NO: 8142264 - DNA, 22 bp, Homo sapiens
ctggaagagcatttgcataggg

SEQ ID NO: 8142265 - DNA, 22 bp, Homo sapiens
ctggaagtggggttggcttgaa

SEQ ID NO: 8142266 - DNA, 20 bp, Homo sapiens
ctggaatgggtgtgggttag

SEQ ID NO: 8142267 - DNA, 20 bp, Homo sapiens
ctggaatgggtgtgggttag

SEQ ID NO: 8142268 - DNA, 22 bp, Homo sapiens
ctggaatgtatgggaacccaaa

SEQ ID NO: 8142269 - DNA, 22 bp, Homo sapiens
ctggaatggcaatgggaagtcc

SEQ ID NO: 8142270 - DNA, 22 bp, Homo sapiens
ctggaatgggaatcaggaaaga

SEQ ID NO: 8142271 - DNA, 22 bp, Homo sapiens
ctggaatgggccatttgaggcc

SEQ ID NO: 8142272 - DNA, 19 bp, Homo sapiens
ctggaatgagaacatgccc

SEQ ID NO: 8142273 - DNA, 19 bp, Homo sapiens
ctggaatgagaacatgccc

SEQ ID NO: 8142274 - DNA, 22 bp, Homo sapiens
ctggaatgagcagggcttatgg

SEQ ID NO: 8142275 - DNA, 19 bp, Homo sapiens
ctggaatgatagagacctc

SEQ ID NO: 8142276 - DNA, 22 bp, Homo sapiens
ctggaatgcctccctgtcagag

SEQ ID NO: 8142277 - DNA, 22 bp, Homo sapiens
ctggctggcagatgctcttgct

SEQ ID NO: 8142278 - DNA, 22 bp, Homo sapiens
ctggctggcagatgctcttgct

SEQ ID NO: 8142279 - DNA, 22 bp, Homo sapiens
ctggctggccatgcagcgccag

SEQ ID NO: 8142280 - DNA, 22 bp, Homo sapiens
ctggctggccatgcagcgccag

SEQ ID NO: 8142281 - DNA, 22 bp, Homo sapiens
ctggctggccatgcagcgccag

SEQ ID NO: 8142282 - DNA, 22 bp, Homo sapiens
ctggctggccatgtagagatga

SEQ ID NO: 8142283 - DNA, 22 bp, Homo sapiens
ctggctggccatgcagcgccag

SEQ ID NO: 8142284 - DNA, 22 bp, Homo sapiens
ctggctggccatgcagcgccag

SEQ ID NO: 8142285 - DNA, 22 bp, Homo sapiens
ctggctggccggagcgaggcgg

SEQ ID NO: 8142286 - DNA, 22 bp, Homo sapiens
ctggctgcaggaaggagtgggc

SEQ ID NO: 8142287 - DNA, 22 bp, Homo sapiens
ctggctggcaagtagaacacaa

SEQ ID NO: 8142288 - DNA, 22 bp, Homo sapiens
ctggctggagtgcaggtgagtg

SEQ ID NO: 8142289 - DNA, 22 bp, Homo sapiens
ctggctggcaagtagaacacaa

SEQ ID NO: 8142290 - DNA, 22 bp, Homo sapiens
ctggctgcagctccgaggaaga

SEQ ID NO: 8142291 - DNA, 22 bp, Homo sapiens
ctggctgcagctccgaggaaga

SEQ ID NO: 8142292 - DNA, 19 bp, Homo sapiens
atagcagctatacccagat

SEQ ID NO: 8142293 - DNA, 22 bp, Homo sapiens
atagcagggatgtcagcaagta

SEQ ID NO: 8142294 - DNA, 22 bp, Homo sapiens
atagcaaatattttaatgagca

SEQ ID NO: 8142295 - DNA, 22 bp, Homo sapiens
atagcacaatattacctttatg

SEQ ID NO: 8142296 - DNA, 22 bp, Homo sapiens
atagcacaatgacttgggtatc

SEQ ID NO: 8142297 - DNA, 22 bp, Homo sapiens
atagcacttattgtatgctgag

SEQ ID NO: 8142298 - DNA, 22 bp, Homo sapiens
ctggcccggctgcctggtcatt

SEQ ID NO: 8142299 - DNA, 22 bp, Homo sapiens
ctggctcacctccgctccagca

SEQ ID NO: 8142300 - DNA, 22 bp, Homo sapiens
ctggctccatctttgcttcctg

SEQ ID NO: 8142301 - DNA, 22 bp, Homo sapiens
ctggctccattactcagcatct

SEQ ID NO: 8142302 - DNA, 22 bp, Homo sapiens
ctggctcccgaagccctcagtg

SEQ ID NO: 8142303 - DNA, 22 bp, Homo sapiens
ctggctccctcgctgaggtgct

SEQ ID NO: 8142304 - DNA, 22 bp, Homo sapiens
ctggctcccgaagccctcagtg

SEQ ID NO: 8142305 - DNA, 22 bp, Homo sapiens
ctggctcccgaagccctcagtg

SEQ ID NO: 8142306 - DNA, 22 bp, Homo sapiens
ctggctcccatgagctctcacg

SEQ ID NO: 8142307 - DNA, 22 bp, Homo sapiens
atagatttgaatttaagacttg

SEQ ID NO: 8142308 - DNA, 22 bp, Homo sapiens
atagattcattctatttctccg

SEQ ID NO: 8142309 - DNA, 22 bp, Homo sapiens
atagattatttgctcattactt

SEQ ID NO: 8142310 - DNA, 22 bp, Homo sapiens
atagattatttgctcattactt

SEQ ID NO: 8142311 - DNA, 22 bp, Homo sapiens
atagattagccctatagtttta

SEQ ID NO: 8142312 - DNA, 22 bp, Homo sapiens
atactatattaccttctcaact

SEQ ID NO: 8142313 - DNA, 22 bp, Homo sapiens
atagagatgggtttagttataa

SEQ ID NO: 8142314 - DNA, 22 bp, Homo sapiens
atagagactatagagcacttac

SEQ ID NO: 8142315 - DNA, 22 bp, Homo sapiens
atactacatactatgtaaacat

SEQ ID NO: 8142316 - DNA, 22 bp, Homo sapiens
atactacatactatgtaaacat

SEQ ID NO: 8142317 - DNA, 22 bp, Homo sapiens
atactacacattgactatattt

SEQ ID NO: 8142318 - DNA, 22 bp, Homo sapiens
atactacacattgactatattt

SEQ ID NO: 8142319 - DNA, 22 bp, Homo sapiens
atactacactatgcatggatgt

SEQ ID NO: 8142320 - DNA, 22 bp, Homo sapiens
atactacatactatgtaaacat

SEQ ID NO: 8142321 - DNA, 22 bp, Homo sapiens
atactacactatgcatggatgt

SEQ ID NO: 8142322 - DNA, 22 bp, Homo sapiens
atactacactatgcatggatgt

SEQ ID NO: 8142323 - DNA, 22 bp, Homo sapiens
atactacaaggtatgtgctaaa

SEQ ID NO: 8142324 - DNA, 22 bp, Homo sapiens
atactaaagtatagaacttagt

SEQ ID NO: 8142325 - DNA, 22 bp, Homo sapiens
atactacacattgactatattt

SEQ ID NO: 8142326 - DNA, 22 bp, Homo sapiens
atactacaatcataattgtaca

SEQ ID NO: 8142327 - DNA, 22 bp, Homo sapiens
atactacaatcataattgtaca

SEQ ID NO: 8142328 - DNA, 22 bp, Homo sapiens
ctggccccaggcagcctgctgg

SEQ ID NO: 8142329 - DNA, 22 bp, Homo sapiens
ctggcccatggtgagctctggg

SEQ ID NO: 8142330 - DNA, 22 bp, Homo sapiens
ctggccccaggcagcctgctgg

SEQ ID NO: 8142331 - DNA, 22 bp, Homo sapiens
ctggccccaggcagcctgctgg

SEQ ID NO: 8142332 - DNA, 22 bp, Homo sapiens
ctggccccatctggagtctgag

SEQ ID NO: 8142333 - DNA, 22 bp, Homo sapiens
ctggccccaggcagcctgctgg

SEQ ID NO: 8142334 - DNA, 22 bp, Homo sapiens
ctggccccaggcagcctgctgg

SEQ ID NO: 8142335 - DNA, 22 bp, Homo sapiens
ctggcccccacacctgtcaggg

SEQ ID NO: 8142336 - DNA, 22 bp, Homo sapiens
ctggccccatctggagtctgag

SEQ ID NO: 8142337 - DNA, 22 bp, Homo sapiens
ctggcccccacacctgtcaggg

SEQ ID NO: 8142338 - DNA, 22 bp, Homo sapiens
ctggcccccacacctgtcaggg

SEQ ID NO: 8142339 - DNA, 22 bp, Homo sapiens
atagcaaaaggcaccagagtga

SEQ ID NO: 8142340 - DNA, 22 bp, Homo sapiens
atagcaaactggcagcttgtgg

SEQ ID NO: 8142341 - DNA, 22 bp, Homo sapiens
atagcaaaggacaatagtcagt

SEQ ID NO: 8142342 - DNA, 22 bp, Homo sapiens
atcaaagtggaagtttactagg

SEQ ID NO: 8142343 - DNA, 23 bp, Homo sapiens
atcaaagtggaaatcaattatct

SEQ ID NO: 8142344 - DNA, 22 bp, Homo sapiens
atcaaagatgtttcagggtgta

SEQ ID NO: 8142345 - DNA, 22 bp, Homo sapiens
atcaaagagcttgacaatccta

SEQ ID NO: 8142346 - DNA, 22 bp, Homo sapiens
atcaaagagcttgacaatccta

SEQ ID NO: 8142347 - DNA, 22 bp, Homo sapiens
atcaaagagtgagatttttact

SEQ ID NO: 8142348 - DNA, 19 bp, Homo sapiens
atcaaagactgcaggattt

SEQ ID NO: 8142349 - DNA, 22 bp, Homo sapiens
atcaaagaatgtgactgaaata

SEQ ID NO: 8142350 - DNA, 22 bp, Homo sapiens
atcaaagaaggagaggttcctg

SEQ ID NO: 8142351 - DNA, 22 bp, Homo sapiens
atcaaaatggaagaatttggct

SEQ ID NO: 8142352 - DNA, 22 bp, Homo sapiens
atattttggggtgatgtgcatc

SEQ ID NO: 8142353 - DNA, 22 bp, Homo sapiens
atatttaactggtcccaatata

SEQ ID NO: 8142354 - DNA, 22 bp, Homo sapiens
atatttaactggtcccaatata

SEQ ID NO: 8142355 - DNA, 22 bp, Homo sapiens
atatttaaacagggtaccaata

SEQ ID NO: 8142356 - DNA, 22 bp, Homo sapiens
atatttaaacagggtaccaata

SEQ ID NO: 8142357 - DNA, 22 bp, Homo sapiens
atatttaactggtcccaatata

SEQ ID NO: 8142358 - DNA, 22 bp, Homo sapiens
atatttaactggtcccaatata

SEQ ID NO: 8142359 - DNA, 22 bp, Homo sapiens
atatttaactggtcccaatata

SEQ ID NO: 8142360 - DNA, 22 bp, Homo sapiens
atatttaactggtcccaatata

SEQ ID NO: 8142361 - DNA, 22 bp, Homo sapiens
atattgagatgaggatattaac

SEQ ID NO: 8142362 - DNA, 22 bp, Homo sapiens
atattgagataagaactgacat

SEQ ID NO: 8142363 - DNA, 22 bp, Homo sapiens
atattgaaccctacagactgta

SEQ ID NO: 8142364 - DNA, 22 bp, Homo sapiens
atattcttgtgattataaagta

SEQ ID NO: 8142365 - DNA, 22 bp, Homo sapiens
atattcttgtgattataaagta

SEQ ID NO: 8142366 - DNA, 22 bp, Homo sapiens
atattcttgtgattataaagta

SEQ ID NO: 8142367 - DNA, 22 bp, Homo sapiens
atattcttgtgattataaagta

SEQ ID NO: 8142368 - DNA, 22 bp, Homo sapiens
atattcttgaagggagattata

SEQ ID NO: 8142369 - DNA, 22 bp, Homo sapiens
atattcttgtgattataaagta

SEQ ID NO: 8142370 - DNA, 22 bp, Homo sapiens
atattcttgtgattataaagta

SEQ ID NO: 8142371 - DNA, 22 bp, Homo sapiens
atattgatggaggtgttagaca

SEQ ID NO: 8142372 - DNA, 22 bp, Homo sapiens
atattgcaatagatgcatcatt

SEQ ID NO: 8142373 - DNA, 22 bp, Homo sapiens
atattgcctaggtgaatagaat

SEQ ID NO: 8142374 - DNA, 22 bp, Homo sapiens
atattgcagtgtgtttatgtga

SEQ ID NO: 8142375 - DNA, 22 bp, Homo sapiens
atattgtactagggttacatgt

SEQ ID NO: 8142376 - DNA, 22 bp, Homo sapiens
atattgtactagggttacatgt

SEQ ID NO: 8142377 - DNA, 22 bp, Homo sapiens
atattgtactagggttacatgt

SEQ ID NO: 8142378 - DNA, 22 bp, Homo sapiens
atattgtactagggttacatgt

SEQ ID NO: 8142379 - DNA, 22 bp, Homo sapiens
atattggtaaagtggattaaca

SEQ ID NO: 8142380 - DNA, 21 bp, Homo sapiens
atattggtatctttttaaatc

SEQ ID NO: 8142381 - DNA, 22 bp, Homo sapiens
atattggtgaaatgctagcaaa

SEQ ID NO: 8142382 - DNA, 22 bp, Homo sapiens
atattggtgattagccaatgct

SEQ ID NO: 8142383 - DNA, 22 bp, Homo sapiens
atatttaaacagggtaccaata

SEQ ID NO: 8142384 - DNA, 22 bp, Homo sapiens
atatttaaacagggtaccaata

SEQ ID NO: 8142385 - DNA, 22 bp, Homo sapiens
atatttaaacagggtaccaata

SEQ ID NO: 8142386 - DNA, 22 bp, Homo sapiens
atattgttgactataagagtaa

SEQ ID NO: 8142387 - DNA, 22 bp, Homo sapiens
atattgttgactataagagtaa

SEQ ID NO: 8142388 - DNA, 22 bp, Homo sapiens
atatttaaacagggtaccaata

SEQ ID NO: 8142389 - DNA, 22 bp, Homo sapiens
atattgttagtaatatttcgaa

SEQ ID NO: 8142390 - DNA, 22 bp, Homo sapiens
atcaaatataataattttcgct

SEQ ID NO: 8142391 - DNA, 22 bp, Homo sapiens
atcaaattatgtgctacaagaa

SEQ ID NO: 8142392 - DNA, 22 bp, Homo sapiens
atcaaagttcgtaactgataac

SEQ ID NO: 8142393 - DNA, 22 bp, Homo sapiens
atcaaataaaggtacctagctt

SEQ ID NO: 8142394 - DNA, 22 bp, Homo sapiens
atcaaatacaaagggcataagg

SEQ ID NO: 8142395 - DNA, 22 bp, Homo sapiens
atcaaatacaaagggcataagg

SEQ ID NO: 8142396 - DNA, 22 bp, Homo sapiens
atcaaatacaaagggcataagg

SEQ ID NO: 8142397 - DNA, 22 bp, Homo sapiens
atcagaaaaacataatgttatt

SEQ ID NO: 8142398 - DNA, 22 bp, Homo sapiens
atcagaaaaacataatgttatt

SEQ ID NO: 8142399 - DNA, 22 bp, Homo sapiens
atcactttggtaccaattcagc

SEQ ID NO: 8142400 - DNA, 22 bp, Homo sapiens
atcacattctttcaaagcagtc

SEQ ID NO: 8142401 - DNA, 22 bp, Homo sapiens
atcaacatagccactccttaga

SEQ ID NO: 8142402 - DNA, 22 bp, Homo sapiens
atcaacataaagaagtcctcag

SEQ ID NO: 8142403 - DNA, 22 bp, Homo sapiens
atcaacatgaatttctctgaag

SEQ ID NO: 8142404 - DNA, 22 bp, Homo sapiens
atcaacatgaatttctctgaag

SEQ ID NO: 8142405 - DNA, 22 bp, Homo sapiens
atcaacatttgcatccttccac

SEQ ID NO: 8142406 - DNA, 22 bp, Homo sapiens
atcaacttaaagaaaagatact

SEQ ID NO: 8142407 - DNA, 21 bp, Homo sapiens
atcagaaaatgtaatggagca

SEQ ID NO: 8142408 - DNA, 22 bp, Homo sapiens
atcagaaattgcccagctgttt

SEQ ID NO: 8142409 - DNA, 22 bp, Homo sapiens
atcagaaaggtgggcaagcaga

SEQ ID NO: 8142410 - DNA, 22 bp, Homo sapiens
atcagaagaaatggatgtgact

SEQ ID NO: 8142411 - DNA, 22 bp, Homo sapiens
atcagaaattgctaccagtgga

SEQ ID NO: 8142412 - DNA, 22 bp, Homo sapiens
atcagaagcttgtagtctctct

SEQ ID NO: 8142413 - DNA, 21 bp, Homo sapiens
atcagaagttttggtcagtag

SEQ ID NO: 8142414 - DNA, 22 bp, Homo sapiens
atattcttgaagggagattata

SEQ ID NO: 8142415 - DNA, 22 bp, Homo sapiens
atattcttgaaagatcctggta

SEQ ID NO: 8142416 - DNA, 22 bp, Homo sapiens
atattcttcttgttcagactat

SEQ ID NO: 8142417 - DNA, 22 bp, Homo sapiens
atattcttcttgttcagactat

SEQ ID NO: 8142418 - DNA, 22 bp, Homo sapiens
atattcatcgtgtagaaatact

SEQ ID NO: 8142419 - DNA, 19 bp, Homo sapiens
ctgggctgaggtctgcctt

SEQ ID NO: 8142420 - DNA, 19 bp, Homo sapiens
ctgggctgaggtctgcctt

SEQ ID NO: 8142421 - DNA, 22 bp, Homo sapiens
ctgggctgatttagtcacgttt

SEQ ID NO: 8142422 - DNA, 22 bp, Homo sapiens
atattcactgagcataaagcca

SEQ ID NO: 8142423 - DNA, 19 bp, Homo sapiens
ctgggctgaggtctgcctt

SEQ ID NO: 8142424 - DNA, 19 bp, Homo sapiens
ctgggctgaggtctgcctt

SEQ ID NO: 8142425 - DNA, 22 bp, Homo sapiens
ctgggctgagctgtggaaactc

SEQ ID NO: 8142426 - DNA, 19 bp, Homo sapiens
ctgggctgaggtctgcctt

SEQ ID NO: 8142427 - DNA, 22 bp, Homo sapiens
ctgggctgaaggctccccacac

SEQ ID NO: 8142428 - DNA, 22 bp, Homo sapiens
ctgggctgagcctgggctgtgt

SEQ ID NO: 8142429 - DNA, 22 bp, Homo sapiens
ctgggctgagcctgggctgtgt

SEQ ID NO: 8142430 - DNA, 22 bp, Homo sapiens
ctgggctgagcctgggctgtgt

SEQ ID NO: 8142431 - DNA, 22 bp, Homo sapiens
atattatgctaagggaaataag

SEQ ID NO: 8142432 - DNA, 22 bp, Homo sapiens
ctgggctctgcggtgtcgctct

SEQ ID NO: 8142433 - DNA, 22 bp, Homo sapiens
ctgggctctggggtcccggtgc

SEQ ID NO: 8142434 - DNA, 22 bp, Homo sapiens
ctgggctctgcggtgtcgctct

SEQ ID NO: 8142435 - DNA, 22 bp, Homo sapiens
atattataagttatttcaagtt

SEQ ID NO: 8142436 - DNA, 22 bp, Homo sapiens
atattataagttatttcaagtt

SEQ ID NO: 8142437 - DNA, 22 bp, Homo sapiens
atattatagacagagtcttctg

SEQ ID NO: 8142438 - DNA, 22 bp, Homo sapiens
atattatagacagagtcttctg

SEQ ID NO: 8142439 - DNA, 22 bp, Homo sapiens
ctgggctcttctcaccctgttt

SEQ ID NO: 8142440 - DNA, 22 bp, Homo sapiens
ctgggctgaaagtgttccttga

SEQ ID NO: 8142441 - DNA, 22 bp, Homo sapiens
ctgggctgaaagtgttccttga

SEQ ID NO: 8142442 - DNA, 22 bp, Homo sapiens
ctgggctgaaggctccccacac

SEQ ID NO: 8142443 - DNA, 22 bp, Homo sapiens
ctgggctctgtgtttcagtttc

SEQ ID NO: 8142444 - DNA, 22 bp, Homo sapiens
ctgggctctgtgtttcagtttc

SEQ ID NO: 8142445 - DNA, 22 bp, Homo sapiens
ctgggctctgcggtgtcgctct

SEQ ID NO: 8142446 - DNA, 22 bp, Homo sapiens
ctgggctctgtgtttcagtttc

SEQ ID NO: 8142447 - DNA, 22 bp, Homo sapiens
atatgccattagctagaaataa

SEQ ID NO: 8142448 - DNA, 22 bp, Homo sapiens
atattaaaactatggttttcag

SEQ ID NO: 8142449 - DNA, 22 bp, Homo sapiens
atatgtttttggaaagaacaca

SEQ ID NO: 8142450 - DNA, 22 bp, Homo sapiens
atatgcattaacattgtaggag

SEQ ID NO: 8142451 - DNA, 22 bp, Homo sapiens
atatgcatgcatgcttgtgaga

SEQ ID NO: 8142452 - DNA, 22 bp, Homo sapiens
atatgcattaacattgtaggag

SEQ ID NO: 8142453 - DNA, 22 bp, Homo sapiens
atatgcatgcatgcttgtgaga

SEQ ID NO: 8142454 - DNA, 22 bp, Homo sapiens
atattataagttatttcaagtt

SEQ ID NO: 8142455 - DNA, 22 bp, Homo sapiens
atattataagttatttcaagtt

SEQ ID NO: 8142456 - DNA, 22 bp, Homo sapiens
atattataagttatttcaagtt

SEQ ID NO: 8142457 - DNA, 22 bp, Homo sapiens
atattaggttggtgcaaaagta

SEQ ID NO: 8142458 - DNA, 22 bp, Homo sapiens
atattactctgatttagtaaat

SEQ ID NO: 8142459 - DNA, 22 bp, Homo sapiens
atattactctgatttagtaaat

SEQ ID NO: 8142460 - DNA, 22 bp, Homo sapiens
atattacttcctggtataaaat

SEQ ID NO: 8142461 - DNA, 22 bp, Homo sapiens
atattacataaacatgagtgaa

SEQ ID NO: 8142462 - DNA, 22 bp, Homo sapiens
atattacataaacatgagtgaa

SEQ ID NO: 8142463 - DNA, 22 bp, Homo sapiens
atattacataaacatgagtgaa

SEQ ID NO: 8142464 - DNA, 22 bp, Homo sapiens
atattacataaacatgagtgaa

SEQ ID NO: 8142465 - DNA, 22 bp, Homo sapiens
atattactctgatttagtaaat

SEQ ID NO: 8142466 - DNA, 22 bp, Homo sapiens
atattacataaacatgagtgaa

SEQ ID NO: 8142467 - DNA, 22 bp, Homo sapiens
ctgggctcacctgtggctggca

SEQ ID NO: 8142468 - DNA, 22 bp, Homo sapiens
ctgggctcacctgtggctggca

SEQ ID NO: 8142469 - DNA, 22 bp, Homo sapiens
ctgggctcagaaccttgttaag

SEQ ID NO: 8142470 - DNA, 22 bp, Homo sapiens
ctgggctcagaaccttgttaag

SEQ ID NO: 8142471 - DNA, 22 bp, Homo sapiens
ctgggctcagatgagaggaagg

SEQ ID NO: 8142472 - DNA, 22 bp, Homo sapiens
ctgggctcagaaccttgttaag

SEQ ID NO: 8142473 - DNA, 22 bp, Homo sapiens
ctgggctcagatgagaggaagg

SEQ ID NO: 8142474 - DNA, 22 bp, Homo sapiens
atatgcacatacatacataggt

SEQ ID NO: 8142475 - DNA, 20 bp, Homo sapiens
ctgggctcaagtgatcctcc

SEQ ID NO: 8142476 - DNA, 20 bp, Homo sapiens
ctgggctcaagtgatcctcc

SEQ ID NO: 8142477 - DNA, 22 bp, Homo sapiens
ctgggctcaagtgatccaccca

SEQ ID NO: 8142478 - DNA, 20 bp, Homo sapiens
ctgggctcaagtgagcctcc

SEQ ID NO: 8142479 - DNA, 21 bp, Homo sapiens
ctgggctcaagcaatcctttc

SEQ ID NO: 8142480 - DNA, 20 bp, Homo sapiens
ctgggctcaagtgagcctcc

SEQ ID NO: 8142481 - DNA, 20 bp, Homo sapiens
ctgggctcaagtgagcctcc

SEQ ID NO: 8142482 - DNA, 20 bp, Homo sapiens
ctgggctcaagtgagcctcc

SEQ ID NO: 8142483 - DNA, 20 bp, Homo sapiens
ctgggctcaagtgagcctcc

SEQ ID NO: 8142484 - DNA, 21 bp, Homo sapiens
ctgggctcaagcaatcctttc

SEQ ID NO: 8142485 - DNA, 21 bp, Homo sapiens
ctgggctcaagcaatcctttc

SEQ ID NO: 8142486 - DNA, 21 bp, Homo sapiens
ctgggctcaagcaatcctttc

SEQ ID NO: 8142487 - DNA, 22 bp, Homo sapiens
ctgggctcaagaagtcttccct

SEQ ID NO: 8142488 - DNA, 22 bp, Homo sapiens
ctgggcctggtagggcttgaaa

SEQ ID NO: 8142489 - DNA, 22 bp, Homo sapiens
ctggcttctgggccagggcaga

SEQ ID NO: 8142490 - DNA, 22 bp, Homo sapiens
ctggcttctgggccagggcaga

SEQ ID NO: 8142491 - DNA, 20 bp, Homo sapiens
ctggcttcgggaactagttt

SEQ ID NO: 8142492 - DNA, 22 bp, Homo sapiens
ctggcttccctgtcttatggaa

SEQ ID NO: 8142493 - DNA, 22 bp, Homo sapiens
ctggcttccctgtcttatggaa

SEQ ID NO: 8142494 - DNA, 22 bp, Homo sapiens
ctggcttccatgctgtagtggc

SEQ ID NO: 8142495 - DNA, 22 bp, Homo sapiens
ctggcttccatgctgtagtggc

SEQ ID NO: 8142496 - DNA, 22 bp, Homo sapiens
ctggcttccaccatggcccctg

SEQ ID NO: 8142497 - DNA, 19 bp, Homo sapiens
ctggcttcaagcagtcctc

SEQ ID NO: 8142498 - DNA, 19 bp, Homo sapiens
ctggcttcaagcagtcctc

SEQ ID NO: 8142499 - DNA, 19 bp, Homo sapiens
ctggcttcaagcagtcctc

SEQ ID NO: 8142500 - DNA, 22 bp, Homo sapiens
ctggctgttttcaatgttgatg

SEQ ID NO: 8142501 - DNA, 22 bp, Homo sapiens
ctggctgtttctcctttgtcta

SEQ ID NO: 8142502 - DNA, 22 bp, Homo sapiens
ctggctgttttcaatgttgatg

SEQ ID NO: 8142503 - DNA, 22 bp, Homo sapiens
ctggctgtttcaaatgtataga

SEQ ID NO: 8142504 - DNA, 22 bp, Homo sapiens
ctggctgtgtcttggaggagct

SEQ ID NO: 8142505 - DNA, 22 bp, Homo sapiens
ctggctgtgtcttggaggagct

SEQ ID NO: 8142506 - DNA, 22 bp, Homo sapiens
ctggctgtggtcacaggtaact

SEQ ID NO: 8142507 - DNA, 22 bp, Homo sapiens
ctggctgtgtccacagagtaag

SEQ ID NO: 8142508 - DNA, 22 bp, Homo sapiens
ctggctgggagcgagctgctca

SEQ ID NO: 8142509 - DNA, 22 bp, Homo sapiens
ctggctgggagcgagctgctca

SEQ ID NO: 8142510 - DNA, 22 bp, Homo sapiens
ctggctgggagcgagctgctca

SEQ ID NO: 8142511 - DNA, 22 bp, Homo sapiens
ctggctgggagcgagctgctca

SEQ ID NO: 8142512 - DNA, 22 bp, Homo sapiens
ctggctgggagcgagctgctca

SEQ ID NO: 8142513 - DNA, 22 bp, Homo sapiens
ctggctgggagcgagctgctca

SEQ ID NO: 8142514 - DNA, 22 bp, Homo sapiens
ctggctgggaagtagagtaggt

SEQ ID NO: 8142515 - DNA, 22 bp, Homo sapiens
ctggctgggaagtagagtaggt

SEQ ID NO: 8142516 - DNA, 22 bp, Homo sapiens
ctggctgggaagtagagtaggt

SEQ ID NO: 8142517 - DNA, 22 bp, Homo sapiens
ctggctggctgtgcccctgccg

SEQ ID NO: 8142518 - DNA, 22 bp, Homo sapiens
ctggctggctcatttttcattg

SEQ ID NO: 8142519 - DNA, 22 bp, Homo sapiens
ctggctggcgttttccaaaagc

SEQ ID NO: 8142520 - DNA, 22 bp, Homo sapiens
ctggctggctcatttttcattg

SEQ ID NO: 8142521 - DNA, 22 bp, Homo sapiens
ctggctggccggaggcatccct

SEQ ID NO: 8142522 - DNA, 22 bp, Homo sapiens
ctggctggccggagcgaggcgg

SEQ ID NO: 8142523 - DNA, 22 bp, Homo sapiens
ctggctggccggaggcatccct

SEQ ID NO: 8142524 - DNA, 22 bp, Homo sapiens
ctggctggccggaggcatccct

SEQ ID NO: 8142525 - DNA, 22 bp, Homo sapiens
ctggctggccggaggcatccct

SEQ ID NO: 8142526 - DNA, 22 bp, Homo sapiens
ctggctggccggagcgaggcgg

SEQ ID NO: 8142527 - DNA, 22 bp, Homo sapiens
ctggctggccggagcgaggcgg

SEQ ID NO: 8142528 - DNA, 22 bp, Homo sapiens
ctggctggccggagcgaggcgg

SEQ ID NO: 8142529 - DNA, 22 bp, Homo sapiens
ctggctggccggagcgaggcgg

SEQ ID NO: 8142530 - DNA, 22 bp, Homo sapiens
cttcttatctgaaagtaatatt

SEQ ID NO: 8142531 - DNA, 22 bp, Homo sapiens
cttcttggaagtcgtccttcca

SEQ ID NO: 8142532 - DNA, 22 bp, Homo sapiens
atctgcagtttgttttctcttg

SEQ ID NO: 8142533 - DNA, 22 bp, Homo sapiens
atctgcaggatgttaggatgat

SEQ ID NO: 8142534 - DNA, 22 bp, Homo sapiens
atctgcagtttgttttctcttg

SEQ ID NO: 8142535 - DNA, 22 bp, Homo sapiens
cttcttggactactcactagag

SEQ ID NO: 8142536 - DNA, 20 bp, Homo sapiens
cttcttggagatggtgtttt

SEQ ID NO: 8142537 - DNA, 21 bp, Homo sapiens
cttcttggggagcagctagac

SEQ ID NO: 8142538 - DNA, 22 bp, Homo sapiens
cttcttggctgcaagtctctgt

SEQ ID NO: 8142539 - DNA, 22 bp, Homo sapiens
cttcttggctgcaagtctctgt

SEQ ID NO: 8142540 - DNA, 22 bp, Homo sapiens
cttcttggctgcaagtctctgt

SEQ ID NO: 8142541 - DNA, 22 bp, Homo sapiens
cttcttggtgatggcttacctg

SEQ ID NO: 8142542 - DNA, 22 bp, Homo sapiens
cttcttgggtcagagaatcatt

SEQ ID NO: 8142543 - DNA, 22 bp, Homo sapiens
cttcttgggttctgagattaca

SEQ ID NO: 8142544 - DNA, 21 bp, Homo sapiens
cttcttggggagcagctagac

SEQ ID NO: 8142545 - DNA, 22 bp, Homo sapiens
atctgagatgcaggtgggtgga

SEQ ID NO: 8142546 - DNA, 22 bp, Homo sapiens
atctgagaagattttggcataa

SEQ ID NO: 8142547 - DNA, 22 bp, Homo sapiens
atctgacatctactagaacaga

SEQ ID NO: 8142548 - DNA, 22 bp, Homo sapiens
atctgacaagttgtgtgtatag

SEQ ID NO: 8142549 - DNA, 22 bp, Homo sapiens
atctgacaaggccacatattct

SEQ ID NO: 8142550 - DNA, 22 bp, Homo sapiens
atctgacaaggccacatattct

SEQ ID NO: 8142551 - DNA, 22 bp, Homo sapiens
atctgacaaggccacatattct

SEQ ID NO: 8142552 - DNA, 22 bp, Homo sapiens
atctgcagaggacaggcgagga

SEQ ID NO: 8142553 - DNA, 22 bp, Homo sapiens
atctgcaggaatgtgtgcagag

SEQ ID NO: 8142554 - DNA, 22 bp, Homo sapiens
atctgaggtatatgactggcta

SEQ ID NO: 8142555 - DNA, 20 bp, Homo sapiens
atctgaggctgtcgctggaa

SEQ ID NO: 8142556 - DNA, 22 bp, Homo sapiens
atctgagggtttgggcatcagc

SEQ ID NO: 8142557 - DNA, 21 bp, Homo sapiens
atctgaaatgtcaaagcagat

SEQ ID NO: 8142558 - DNA, 22 bp, Homo sapiens
atctgaagaatgaatggaatta

SEQ ID NO: 8142559 - DNA, 22 bp, Homo sapiens
atctgaaagctaggagttctca

SEQ ID NO: 8142560 - DNA, 21 bp, Homo sapiens
atctgaaaggttagtgttgag

SEQ ID NO: 8142561 - DNA, 22 bp, Homo sapiens
atctgaaatagtcttatctgag

SEQ ID NO: 8142562 - DNA, 19 bp, Homo sapiens
atctgaagtaggtgcagct

SEQ ID NO: 8142563 - DNA, 22 bp, Homo sapiens
atctgaagggaagtggaaggca

SEQ ID NO: 8142564 - DNA, 22 bp, Homo sapiens
atctgaagaggtcatggctgac

SEQ ID NO: 8142565 - DNA, 21 bp, Homo sapiens
atctgaagtttgagaggaaag

SEQ ID NO: 8142566 - DNA, 22 bp, Homo sapiens
atctgaataaatttcttttagt

SEQ ID NO: 8142567 - DNA, 22 bp, Homo sapiens
atctgaaactctgacattgtct

SEQ ID NO: 8142568 - DNA, 22 bp, Homo sapiens
atctgaaactctgacattgtct

SEQ ID NO: 8142569 - DNA, 22 bp, Homo sapiens
atctgaaaagctttaatgagct

SEQ ID NO: 8142570 - DNA, 22 bp, Homo sapiens
atctgaaaaatctcctttgtca

SEQ ID NO: 8142571 - DNA, 22 bp, Homo sapiens
cttcctccgaagaagttgctgg

SEQ ID NO: 8142572 - DNA, 22 bp, Homo sapiens
atctctgatttacagcatctct

SEQ ID NO: 8142573 - DNA, 22 bp, Homo sapiens
cttcctctagcctagtaatgcc

SEQ ID NO: 8142574 - DNA, 22 bp, Homo sapiens
cttcccacagaattcaatcagt

SEQ ID NO: 8142575 - DNA, 22 bp, Homo sapiens
cttcccaagctttagttatttt

SEQ ID NO: 8142576 - DNA, 22 bp, Homo sapiens
cttcccaagactgtattgcaag

SEQ ID NO: 8142577 - DNA, 17 bp, Homo sapiens
cttcccaccatctcctg

SEQ ID NO: 8142578 - DNA, 22 bp, Homo sapiens
cttcccaagtaaatttgtattt

SEQ ID NO: 8142579 - DNA, 22 bp, Homo sapiens
cttccagtcttttcagtggagt

SEQ ID NO: 8142580 - DNA, 22 bp, Homo sapiens
cttcccaagactgtattgcaag

SEQ ID NO: 8142581 - DNA, 22 bp, Homo sapiens
cttccatacagacaatgcaatg

SEQ ID NO: 8142582 - DNA, 22 bp, Homo sapiens
cttccagtagtatcattctcat

SEQ ID NO: 8142583 - DNA, 22 bp, Homo sapiens
cttccaggttctggttgggaag

SEQ ID NO: 8142584 - DNA, 22 bp, Homo sapiens
cttcccactagtatcacagagc

SEQ ID NO: 8142585 - DNA, 22 bp, Homo sapiens
cttcccactagtatcacagagc

SEQ ID NO: 8142586 - DNA, 22 bp, Homo sapiens
cttcccagaacaatgtaggctt

SEQ ID NO: 8142587 - DNA, 22 bp, Homo sapiens
cttcccagaacaatgtaggctt

SEQ ID NO: 8142588 - DNA, 22 bp, Homo sapiens
cttcctaaaagcttcaagagaa

SEQ ID NO: 8142589 - DNA, 22 bp, Homo sapiens
cttcctaaaagcttcaagagaa

SEQ ID NO: 8142590 - DNA, 18 bp, Homo sapiens
cttcctcatcgctctccc

SEQ ID NO: 8142591 - DNA, 22 bp, Homo sapiens
cttcctcccccacacactcact

SEQ ID NO: 8142592 - DNA, 22 bp, Homo sapiens
cttcctcccggcccatgctctg

SEQ ID NO: 8142593 - DNA, 22 bp, Homo sapiens
cttcctcccggcccatgctctg

SEQ ID NO: 8142594 - DNA, 22 bp, Homo sapiens
cttcctcccggcccatgctctg

SEQ ID NO: 8142595 - DNA, 22 bp, Homo sapiens
cttagagatgggttttacttag

SEQ ID NO: 8142596 - DNA, 22 bp, Homo sapiens
cttagagatgggttttacttag

SEQ ID NO: 8142597 - DNA, 22 bp, Homo sapiens
cttagagatgggttttacttag

SEQ ID NO: 8142598 - DNA, 22 bp, Homo sapiens
cttagagccttactcttcttgt

SEQ ID NO: 8142599 - DNA, 22 bp, Homo sapiens
cttagagatgggttttacttag

SEQ ID NO: 8142600 - DNA, 22 bp, Homo sapiens
cttagaagtgggctataattag

SEQ ID NO: 8142601 - DNA, 22 bp, Homo sapiens
cttagaagtaatttaccttctc

SEQ ID NO: 8142602 - DNA, 22 bp, Homo sapiens
cttagatgaagtcacagaaccc

SEQ ID NO: 8142603 - DNA, 22 bp, Homo sapiens
cttagatgaagtcacagaaccc

SEQ ID NO: 8142604 - DNA, 22 bp, Homo sapiens
cttcattaaccaaaatgcaata

SEQ ID NO: 8142605 - DNA, 22 bp, Homo sapiens
cttccaggtgctggcctggcct

SEQ ID NO: 8142606 - DNA, 22 bp, Homo sapiens
cttcattaatgtctataagttt

SEQ ID NO: 8142607 - DNA, 22 bp, Homo sapiens
cttagaaggatgtttgctgttt

SEQ ID NO: 8142608 - DNA, 20 bp, Homo sapiens
cttagaagggacatcctggg

SEQ ID NO: 8142609 - DNA, 22 bp, Homo sapiens
cttagaaggatgtttgctgttt

SEQ ID NO: 8142610 - DNA, 22 bp, Homo sapiens
cttagaaggaacagtttagtgc

SEQ ID NO: 8142611 - DNA, 22 bp, Homo sapiens
cttagaaggaacagtttagtgc

SEQ ID NO: 8142612 - DNA, 22 bp, Homo sapiens
cttagaagaatgcctaggacag

SEQ ID NO: 8142613 - DNA, 22 bp, Homo sapiens
atcctgtggctccagggagccg

SEQ ID NO: 8142614 - DNA, 22 bp, Homo sapiens
atcctgtggccctgcctctgct

SEQ ID NO: 8142615 - DNA, 22 bp, Homo sapiens
atcctgtggggcggctgcaggg

SEQ ID NO: 8142616 - DNA, 22 bp, Homo sapiens
ctgtggccttggaccagcatct

SEQ ID NO: 8142617 - DNA, 22 bp, Homo sapiens
ctgtggcctgtgccagaactgg

SEQ ID NO: 8142618 - DNA, 21 bp, Homo sapiens
ctgtggcctggctagcaccgt

SEQ ID NO: 8142619 - DNA, 23 bp, Homo sapiens
ctgtggccctgcttcatgcagcc

SEQ ID NO: 8142620 - DNA, 23 bp, Homo sapiens
ctgtggccctgcttcatgcagcc

SEQ ID NO: 8142621 - DNA, 22 bp, Homo sapiens
ctgtggagtgtagatgctgggt

SEQ ID NO: 8142622 - DNA, 22 bp, Homo sapiens
ctgtggagtgtagatgctgggt

SEQ ID NO: 8142623 - DNA, 22 bp, Homo sapiens
ctgtggagttccatcaggggag

SEQ ID NO: 8142624 - DNA, 19 bp, Homo sapiens
ctgtggcctccaggaggga

SEQ ID NO: 8142625 - DNA, 23 bp, Homo sapiens
ctgtggccctgcttcatgcagcc

SEQ ID NO: 8142626 - DNA, 22 bp, Homo sapiens
atcagacactagtggactagaa

SEQ ID NO: 8142627 - DNA, 22 bp, Homo sapiens
atcagacaattgttgagtactg

SEQ ID NO: 8142628 - DNA, 22 bp, Homo sapiens
ctgtggagtggggagtactggt

SEQ ID NO: 8142629 - DNA, 22 bp, Homo sapiens
ctgtggagtgtagatgctgggt

SEQ ID NO: 8142630 - DNA, 22 bp, Homo sapiens
ctgtggagtgtagatgctgggt

SEQ ID NO: 8142631 - DNA, 22 bp, Homo sapiens
atcagagcactgagcaggacac

SEQ ID NO: 8142632 - DNA, 22 bp, Homo sapiens
atcagagcaatggataaaatca

SEQ ID NO: 8142633 - DNA, 22 bp, Homo sapiens
ctgtgggagaagctagcacagg

SEQ ID NO: 8142634 - DNA, 22 bp, Homo sapiens
ctgtgggagaagttgctggagt

SEQ ID NO: 8142635 - DNA, 22 bp, Homo sapiens
ctgtgggagaagttgctggagt

SEQ ID NO: 8142636 - DNA, 22 bp, Homo sapiens
ctgtgggagaagttgctggagt

SEQ ID NO: 8142637 - DNA, 21 bp, Homo sapiens
ctgtgggaccaagcactggga

SEQ ID NO: 8142638 - DNA, 21 bp, Homo sapiens
ctgtgggaccaagcactggga

SEQ ID NO: 8142639 - DNA, 22 bp, Homo sapiens
ctgtgggaatactgcgagtgta

SEQ ID NO: 8142640 - DNA, 22 bp, Homo sapiens
ctgtgggaatactgcgagtgta

SEQ ID NO: 8142641 - DNA, 23 bp, Homo sapiens
ctgtgggaagtcggggagcgcgc

SEQ ID NO: 8142642 - DNA, 23 bp, Homo sapiens
ctgtgggaagtcggggagcgcgc

SEQ ID NO: 8142643 - DNA, 22 bp, Homo sapiens
ctgtgggaacactgaggacttc

SEQ ID NO: 8142644 - DNA, 22 bp, Homo sapiens
ctgtgggaacactgaggacttc

SEQ ID NO: 8142645 - DNA, 22 bp, Homo sapiens
ctgtgggaaaggatgagattgc

SEQ ID NO: 8142646 - DNA, 18 bp, Homo sapiens
ctgtgggaagagtttggg

SEQ ID NO: 8142647 - DNA, 22 bp, Homo sapiens
ctgtggctcaaaatcccatgat

SEQ ID NO: 8142648 - DNA, 22 bp, Homo sapiens
ctgtggctaggaagctgtggga

SEQ ID NO: 8142649 - DNA, 22 bp, Homo sapiens
ctgtggctaggaagctgtggga

SEQ ID NO: 8142650 - DNA, 22 bp, Homo sapiens
ctgtggctcaggcctgtaagcc

SEQ ID NO: 8142651 - DNA, 22 bp, Homo sapiens
ctgtggctttggggcggaggac

SEQ ID NO: 8142652 - DNA, 22 bp, Homo sapiens
ctgtggctttgtgtctattgta

SEQ ID NO: 8142653 - DNA, 22 bp, Homo sapiens
ctgtggcttttccggggagcct

SEQ ID NO: 8142654 - DNA, 22 bp, Homo sapiens
ctgtgtgtcatttgtcaatcct

SEQ ID NO: 8142655 - DNA, 22 bp, Homo sapiens
ctgtgtgtcatttgtcaatcct

SEQ ID NO: 8142656 - DNA, 22 bp, Homo sapiens
ctgtgtgtcctcggacgagttt

SEQ ID NO: 8142657 - DNA, 22 bp, Homo sapiens
atcctgaaaacttacgaagtgg

SEQ ID NO: 8142658 - DNA, 22 bp, Homo sapiens
ctgtgtgctgaaatgcagtgag

SEQ ID NO: 8142659 - DNA, 22 bp, Homo sapiens
ctgtgtggactggttgaggccc

SEQ ID NO: 8142660 - DNA, 22 bp, Homo sapiens
ctgtgtggcctcaagccagcct

SEQ ID NO: 8142661 - DNA, 22 bp, Homo sapiens
ctgtgtggactggttgaggccc

SEQ ID NO: 8142662 - DNA, 22 bp, Homo sapiens
atcctgaaaacttacgaagtgg

SEQ ID NO: 8142663 - DNA, 22 bp, Homo sapiens
atcctgggcaaagtatgctgtc

SEQ ID NO: 8142664 - DNA, 22 bp, Homo sapiens
atcctgggcaagtcaatgtccc

SEQ ID NO: 8142665 - DNA, 22 bp, Homo sapiens
atcctgggcaagtcaatgtccc

SEQ ID NO: 8142666 - DNA, 22 bp, Homo sapiens
atcctgggcagtgtgtcactct

SEQ ID NO: 8142667 - DNA, 18 bp, Homo sapiens
atcctgggccagtctttc

SEQ ID NO: 8142668 - DNA, 18 bp, Homo sapiens
atcctgggccagtctttc

SEQ ID NO: 8142669 - DNA, 22 bp, Homo sapiens
atcctgggcagttttgagtgct

SEQ ID NO: 8142670 - DNA, 22 bp, Homo sapiens
atcctgggcagttttgagtgct

SEQ ID NO: 8142671 - DNA, 22 bp, Homo sapiens
atcctgggcagtgtgtcactct

SEQ ID NO: 8142672 - DNA, 22 bp, Homo sapiens
atcctgggcagtgtgtcactct

SEQ ID NO: 8142673 - DNA, 22 bp, Homo sapiens
atcctgggcagtgtgtcactct

SEQ ID NO: 8142674 - DNA, 22 bp, Homo sapiens
atcctgggtttgtgagtttatg

SEQ ID NO: 8142675 - DNA, 22 bp, Homo sapiens
atcctgtgaggataagcccttg

SEQ ID NO: 8142676 - DNA, 19 bp, Homo sapiens
atcctgggtcctccagctg

SEQ ID NO: 8142677 - DNA, 22 bp, Homo sapiens
atcctgggtaagttccttttaa

SEQ ID NO: 8142678 - DNA, 22 bp, Homo sapiens
atcctgggggcagctggaaaca

SEQ ID NO: 8142679 - DNA, 22 bp, Homo sapiens
atcctgggctgcaccctcagcc

SEQ ID NO: 8142680 - DNA, 22 bp, Homo sapiens
atcctgggcctcagaggtgtgt

SEQ ID NO: 8142681 - DNA, 22 bp, Homo sapiens
atccagtcaaaattagtaaggt

SEQ ID NO: 8142682 - DNA, 22 bp, Homo sapiens
atccagtctggggtgctgcatg

SEQ ID NO: 8142683 - DNA, 22 bp, Homo sapiens
atccagtgagtgcagctgttgt

SEQ ID NO: 8142684 - DNA, 22 bp, Homo sapiens
atccagggtgtggagagagctc

SEQ ID NO: 8142685 - DNA, 22 bp, Homo sapiens
atccagtagtgacttttacatt

SEQ ID NO: 8142686 - DNA, 22 bp, Homo sapiens
atccagtatgaggtagggcttg

SEQ ID NO: 8142687 - DNA, 22 bp, Homo sapiens
atccatataggcagatggcaca

SEQ ID NO: 8142688 - DNA, 22 bp, Homo sapiens
atccagggataaaagtaaggtt

SEQ ID NO: 8142689 - DNA, 22 bp, Homo sapiens
atccagggataaaagtaaggtt

SEQ ID NO: 8142690 - DNA, 22 bp, Homo sapiens
atccaggcttaatgggagccac

SEQ ID NO: 8142691 - DNA, 22 bp, Homo sapiens
atccactccctaacaccatgtt

SEQ ID NO: 8142692 - DNA, 22 bp, Homo sapiens
atccaccctgtggtggctttct

SEQ ID NO: 8142693 - DNA, 22 bp, Homo sapiens
atccaccctgtggtggctttct

SEQ ID NO: 8142694 - DNA, 22 bp, Homo sapiens
ctgtgggagaggtgcctggatt

SEQ ID NO: 8142695 - DNA, 22 bp, Homo sapiens
atccaggcgaatgcagaaggcc

SEQ ID NO: 8142696 - DNA, 22 bp, Homo sapiens
aggatttgtttataggtcttaa

SEQ ID NO: 8142697 - DNA, 22 bp, Homo sapiens
aggatttgtggctctgagtctg

SEQ ID NO: 8142698 - DNA, 22 bp, Homo sapiens
aggatttggggaagaaaacact

SEQ ID NO: 8142699 - DNA, 22 bp, Homo sapiens
catgaggtcagggggagccggt

SEQ ID NO: 8142700 - DNA, 22 bp, Homo sapiens
catgaggatgggcagctgggga

SEQ ID NO: 8142701 - DNA, 19 bp, Homo sapiens
catgaggcagctgcacccc

SEQ ID NO: 8142702 - DNA, 18 bp, Homo sapiens
catgagctgcccctagac

SEQ ID NO: 8142703 - DNA, 22 bp, Homo sapiens
catgagcataaatcagtcacga

SEQ ID NO: 8142704 - DNA, 22 bp, Homo sapiens
catgagatttgggaggggccag

SEQ ID NO: 8142705 - DNA, 22 bp, Homo sapiens
catgagatttgggaggggccag

SEQ ID NO: 8142706 - DNA, 22 bp, Homo sapiens
catgagatttgggaggggccag

SEQ ID NO: 8142707 - DNA, 22 bp, Homo sapiens
catgagagacattctgtgtgaa

SEQ ID NO: 8142708 - DNA, 22 bp, Homo sapiens
catgagataatttttctccagt

SEQ ID NO: 8142709 - DNA, 22 bp, Homo sapiens
catgagagatccttcatgagag

SEQ ID NO: 8142710 - DNA, 22 bp, Homo sapiens
aggatgtcagcattggctagag

SEQ ID NO: 8142711 - DNA, 22 bp, Homo sapiens
aggatgtcagtcagcttggatt

SEQ ID NO: 8142712 - DNA, 22 bp, Homo sapiens
aggatgtcagcattggctagag

SEQ ID NO: 8142713 - DNA, 22 bp, Homo sapiens
aggatgtcagcattggctagag

SEQ ID NO: 8142714 - DNA, 20 bp, Homo sapiens
aggatgtccccgagggcctg

SEQ ID NO: 8142715 - DNA, 20 bp, Homo sapiens
aggatgtccccgagggcctg

SEQ ID NO: 8142716 - DNA, 22 bp, Homo sapiens
aggatgtccacccagaccttgc

SEQ ID NO: 8142717 - DNA, 22 bp, Homo sapiens
aggatgtgccaccagctttgca

SEQ ID NO: 8142718 - DNA, 22 bp, Homo sapiens
aggatgtctgctgctgtgggct

SEQ ID NO: 8142719 - DNA, 22 bp, Homo sapiens
aggatgtctgctgctgtgggct

SEQ ID NO: 8142720 - DNA, 22 bp, Homo sapiens
aggatgtctctggaccaggatg

SEQ ID NO: 8142721 - DNA, 23 bp, Homo sapiens
aggatgtcgaatgttagagtgag

SEQ ID NO: 8142722 - DNA, 22 bp, Homo sapiens
aggatgtctctccagcctggag

SEQ ID NO: 8142723 - DNA, 22 bp, Homo sapiens
aggatgtctctccagcctggag

SEQ ID NO: 8142724 - DNA, 22 bp, Homo sapiens
aggatgggtcagctagagtcca

SEQ ID NO: 8142725 - DNA, 22 bp, Homo sapiens
aggatggggtctgcagcctggt

SEQ ID NO: 8142726 - DNA, 22 bp, Homo sapiens
aggatggggtctgcagcctggt

SEQ ID NO: 8142727 - DNA, 22 bp, Homo sapiens
aggatggggtctgcagcctggt

SEQ ID NO: 8142728 - DNA, 22 bp, Homo sapiens
aggatggggtctgcagcctggt

SEQ ID NO: 8142729 - DNA, 23 bp, Homo sapiens
aggatgtaggatgtatggcagag

SEQ ID NO: 8142730 - DNA, 23 bp, Homo sapiens
aggatgtaggatgtatggcagag

SEQ ID NO: 8142731 - DNA, 22 bp, Homo sapiens
aggatgagagatacatggagca

SEQ ID NO: 8142732 - DNA, 22 bp, Homo sapiens
aggatggcttgcaggaggctgt

SEQ ID NO: 8142733 - DNA, 22 bp, Homo sapiens
aggatggggtctgcagcctggt

SEQ ID NO: 8142734 - DNA, 22 bp, Homo sapiens
aggatgggcctgggatatgctt

SEQ ID NO: 8142735 - DNA, 22 bp, Homo sapiens
aggatgggcctgggatatgctt

SEQ ID NO: 8142736 - DNA, 22 bp, Homo sapiens
aggatggcttgcaggaggctgt

SEQ ID NO: 8142737 - DNA, 22 bp, Homo sapiens
aggatggcttgcaggaggctgt

SEQ ID NO: 8142738 - DNA, 22 bp, Homo sapiens
aggatggcttgcaggaggctgt

SEQ ID NO: 8142739 - DNA, 22 bp, Homo sapiens
catcttcattttgtccagtact

SEQ ID NO: 8142740 - DNA, 22 bp, Homo sapiens
catcttcaggtgttttccatca

SEQ ID NO: 8142741 - DNA, 22 bp, Homo sapiens
catcttcaggggctacatctgt

SEQ ID NO: 8142742 - DNA, 22 bp, Homo sapiens
catcttcaggggctacatctgt

SEQ ID NO: 8142743 - DNA, 22 bp, Homo sapiens
catcttcattttgtccagtact

SEQ ID NO: 8142744 - DNA, 22 bp, Homo sapiens
catcttgcctgctattctgttg

SEQ ID NO: 8142745 - DNA, 22 bp, Homo sapiens
catcttgcttcatctgctgtgt

SEQ ID NO: 8142746 - DNA, 22 bp, Homo sapiens
catcttgtgaatttctgattct

SEQ ID NO: 8142747 - DNA, 22 bp, Homo sapiens
aggaggctgaactagggtctgg

SEQ ID NO: 8142748 - DNA, 22 bp, Homo sapiens
aggaggctgaactagggtctgg

SEQ ID NO: 8142749 - DNA, 22 bp, Homo sapiens
catacaaatgtgtccaggctct

SEQ ID NO: 8142750 - DNA, 22 bp, Homo sapiens
catacaaatgtgtccaggctct

SEQ ID NO: 8142751 - DNA, 23 bp, Homo sapiens
aggaggcctgaaactgaggctga

SEQ ID NO: 8142752 - DNA, 22 bp, Homo sapiens
aggaggcctgcagctgccattc

SEQ ID NO: 8142753 - DNA, 22 bp, Homo sapiens
aggaggcctggctggggagatc

SEQ ID NO: 8142754 - DNA, 22 bp, Homo sapiens
aggaggctctcaggtcctcccc

SEQ ID NO: 8142755 - DNA, 22 bp, Homo sapiens
aggaggctctcaggtcctcccc

SEQ ID NO: 8142756 - DNA, 22 bp, Homo sapiens
aggaggccttggggcttagagc

SEQ ID NO: 8142757 - DNA, 22 bp, Homo sapiens
aggaggcctgttttctcctgga

SEQ ID NO: 8142758 - DNA, 22 bp, Homo sapiens
catacagaaaatatattttgat

SEQ ID NO: 8142759 - DNA, 22 bp, Homo sapiens
catacagtgtggcatgtagtct

SEQ ID NO: 8142760 - DNA, 22 bp, Homo sapiens
catacagatggccaggcctcac

SEQ ID NO: 8142761 - DNA, 22 bp, Homo sapiens
catacatactgagtggactgat

SEQ ID NO: 8142762 - DNA, 22 bp, Homo sapiens
catacataccactgctgtcttt

SEQ ID NO: 8142763 - DNA, 22 bp, Homo sapiens
catacaatcaagttctttatta

SEQ ID NO: 8142764 - DNA, 22 bp, Homo sapiens
catacaatcaagttctttatta

SEQ ID NO: 8142765 - DNA, 22 bp, Homo sapiens
catctcccacttccttgggggt

SEQ ID NO: 8142766 - DNA, 22 bp, Homo sapiens
catctccaggagttctactcat

SEQ ID NO: 8142767 - DNA, 22 bp, Homo sapiens
catctcatttattccaactcag

SEQ ID NO: 8142768 - DNA, 22 bp, Homo sapiens
catctcatcctgccctaaaaca

SEQ ID NO: 8142769 - DNA, 22 bp, Homo sapiens
catctcctttggtctacttcca

SEQ ID NO: 8142770 - DNA, 22 bp, Homo sapiens
catctcctttggtctacttcca

SEQ ID NO: 8142771 - DNA, 22 bp, Homo sapiens
catctctccacggcagctctcg

SEQ ID NO: 8142772 - DNA, 20 bp, Homo sapiens
catctcctgcctccatgttc

SEQ ID NO: 8142773 - DNA, 20 bp, Homo sapiens
catctcctgcctccatgttc

SEQ ID NO: 8142774 - DNA, 22 bp, Homo sapiens
catacatatgtggatgtcatat

SEQ ID NO: 8142775 - DNA, 22 bp, Homo sapiens
catacatatgtggatgtcatat

SEQ ID NO: 8142776 - DNA, 22 bp, Homo sapiens
catacatatgtggatgtcatat

SEQ ID NO: 8142777 - DNA, 22 bp, Homo sapiens
catacatatgcatgtgtgtata

SEQ ID NO: 8142778 - DNA, 22 bp, Homo sapiens
catccaaactctcattatctgt

SEQ ID NO: 8142779 - DNA, 22 bp, Homo sapiens
catctcatagtgcagtgctgta

SEQ ID NO: 8142780 - DNA, 22 bp, Homo sapiens
catctcatagtgcagtgctgta

SEQ ID NO: 8142781 - DNA, 22 bp, Homo sapiens
catctcatcagtgagagtcagc

SEQ ID NO: 8142782 - DNA, 22 bp, Homo sapiens
catctcatcctgccctaaaaca

SEQ ID NO: 8142783 - DNA, 22 bp, Homo sapiens
catctctgtgtccccagagctt

SEQ ID NO: 8142784 - DNA, 21 bp, Homo sapiens
catcttaggttgtacatatat

SEQ ID NO: 8142785 - DNA, 22 bp, Homo sapiens
catcttcaccagagacaagcaa

SEQ ID NO: 8142786 - DNA, 22 bp, Homo sapiens
catcttataggcagagttcagt

SEQ ID NO: 8142787 - DNA, 22 bp, Homo sapiens
catcttcacatatttccaatga

SEQ ID NO: 8142788 - DNA, 22 bp, Homo sapiens
catctctgagacctcagctggg

SEQ ID NO: 8142789 - DNA, 22 bp, Homo sapiens
catctctgagacctcagctggg

SEQ ID NO: 8142790 - DNA, 22 bp, Homo sapiens
catctctccacggcagctctcg

SEQ ID NO: 8142791 - DNA, 22 bp, Homo sapiens
catctctccacggcagctctcg

SEQ ID NO: 8142792 - DNA, 22 bp, Homo sapiens
catctctgagacctcagctggg

SEQ ID NO: 8142793 - DNA, 22 bp, Homo sapiens
catctctccacggcagctctcg

SEQ ID NO: 8142794 - DNA, 22 bp, Homo sapiens
catctctgtgtccccagagctt

SEQ ID NO: 8142795 - DNA, 22 bp, Homo sapiens
catctctgtgtccccagagctt

SEQ ID NO: 8142796 - DNA, 22 bp, Homo sapiens
catctctgtgtccccagagctt

SEQ ID NO: 8142797 - DNA, 22 bp, Homo sapiens
aggagccacttaggtgagataa

SEQ ID NO: 8142798 - DNA, 22 bp, Homo sapiens
aggagccacctaggagctgttt

SEQ ID NO: 8142799 - DNA, 22 bp, Homo sapiens
cagtgttgctaagttctgaact

SEQ ID NO: 8142800 - DNA, 22 bp, Homo sapiens
cagtgtgtttcatgtaggtcct

SEQ ID NO: 8142801 - DNA, 22 bp, Homo sapiens
cagtgtggtgagattccaggtg

SEQ ID NO: 8142802 - DNA, 22 bp, Homo sapiens
cagtgtgtctcttgtcctggct

SEQ ID NO: 8142803 - DNA, 22 bp, Homo sapiens
cagtgtgtctcttgtcctggct

SEQ ID NO: 8142804 - DNA, 22 bp, Homo sapiens
cagtgtgtggatcctcccagga

SEQ ID NO: 8142805 - DNA, 22 bp, Homo sapiens
aggagccacttaggtgagataa

SEQ ID NO: 8142806 - DNA, 21 bp, Homo sapiens
aggagccagcctgtcagtcta

SEQ ID NO: 8142807 - DNA, 21 bp, Homo sapiens
aggagccagcctgtcagtcta

SEQ ID NO: 8142808 - DNA, 22 bp, Homo sapiens
aggagccagattctctcacttt

SEQ ID NO: 8142809 - DNA, 22 bp, Homo sapiens
aggagccaggaaacctgctctg

SEQ ID NO: 8142810 - DNA, 22 bp, Homo sapiens
aggagccaggaaacctgctctg

SEQ ID NO: 8142811 - DNA, 22 bp, Homo sapiens
aggagccaggaaacctgctctg

SEQ ID NO: 8142812 - DNA, 22 bp, Homo sapiens
aggagccaggaaacctgctctg

SEQ ID NO: 8142813 - DNA, 22 bp, Homo sapiens
aggagccaggccccatggggct

SEQ ID NO: 8142814 - DNA, 23 bp, Homo sapiens
aggagccaggaaccagcttcccc

SEQ ID NO: 8142815 - DNA, 23 bp, Homo sapiens
aggagccaggtgcagcccttgtg

SEQ ID NO: 8142816 - DNA, 23 bp, Homo sapiens
aggagccaggtgcagcccttgtg

SEQ ID NO: 8142817 - DNA, 22 bp, Homo sapiens
aggagccagggaagctgctttc

SEQ ID NO: 8142818 - DNA, 22 bp, Homo sapiens
cagtccagagcccaccagagga

SEQ ID NO: 8142819 - DNA, 22 bp, Homo sapiens
cagtccagagcccaccagagga

SEQ ID NO: 8142820 - DNA, 22 bp, Homo sapiens
cagtccaggcctggaggagcca

SEQ ID NO: 8142821 - DNA, 22 bp, Homo sapiens
cagtccagctcatcagtggcac

SEQ ID NO: 8142822 - DNA, 22 bp, Homo sapiens
cagtccagctcatcagtggcac

SEQ ID NO: 8142823 - DNA, 22 bp, Homo sapiens
cagtccagctcatcagtggcac

SEQ ID NO: 8142824 - DNA, 22 bp, Homo sapiens
cagtccaggcctggaggagcca

SEQ ID NO: 8142825 - DNA, 22 bp, Homo sapiens
cagtccaggcctggaggagcca

SEQ ID NO: 8142826 - DNA, 22 bp, Homo sapiens
cagtccaggcctggaggagcca

SEQ ID NO: 8142827 - DNA, 22 bp, Homo sapiens
cagtgtgggtttgggaggagta

SEQ ID NO: 8142828 - DNA, 21 bp, Homo sapiens
cagtgtggtgaccagggtctc

SEQ ID NO: 8142829 - DNA, 22 bp, Homo sapiens
cagtgtggagggagagagcctg

SEQ ID NO: 8142830 - DNA, 20 bp, Homo sapiens
cagtccaggctgcagcatct

SEQ ID NO: 8142831 - DNA, 22 bp, Homo sapiens
cagtggttctcaatcaggaatg

SEQ ID NO: 8142832 - DNA, 22 bp, Homo sapiens
cagtggttcctgttcttctggg

SEQ ID NO: 8142833 - DNA, 22 bp, Homo sapiens
cagtgtgcctgaatcaagtgtt

SEQ ID NO: 8142834 - DNA, 22 bp, Homo sapiens
cagtgtgctgcagagaacattt

SEQ ID NO: 8142835 - DNA, 22 bp, Homo sapiens
aggaggccgggattctggagat

SEQ ID NO: 8142836 - DNA, 22 bp, Homo sapiens
aggaggccgggattctggagat

SEQ ID NO: 8142837 - DNA, 22 bp, Homo sapiens
aggaggcctctatccagagaga

SEQ ID NO: 8142838 - DNA, 23 bp, Homo sapiens
aggaggcctgaaactgaggctga

SEQ ID NO: 8142839 - DNA, 22 bp, Homo sapiens
aggaggcagatgcttggctgta

SEQ ID NO: 8142840 - DNA, 22 bp, Homo sapiens
aggaggcagatgcttggctgta

SEQ ID NO: 8142841 - DNA, 22 bp, Homo sapiens
aggagctgtgaatgggaggggt

SEQ ID NO: 8142842 - DNA, 22 bp, Homo sapiens
aggagctgtgaatgggaggggt

SEQ ID NO: 8142843 - DNA, 22 bp, Homo sapiens
aggaggcaggaagtctatggga

SEQ ID NO: 8142844 - DNA, 22 bp, Homo sapiens
aggaggcaggaagtctatggga

SEQ ID NO: 8142845 - DNA, 22 bp, Homo sapiens
aggaggcagatgcttggctgta

SEQ ID NO: 8142846 - DNA, 22 bp, Homo sapiens
aggaggcagatgcttggctgta

SEQ ID NO: 8142847 - DNA, 22 bp, Homo sapiens
aggaggcagatgcttggctgta

SEQ ID NO: 8142848 - DNA, 22 bp, Homo sapiens
aggagctgtcagagtgccagag

SEQ ID NO: 8142849 - DNA, 22 bp, Homo sapiens
aggagctgtcagagtgccagag

SEQ ID NO: 8142850 - DNA, 22 bp, Homo sapiens
aggagctgtcagagtgccagag

SEQ ID NO: 8142851 - DNA, 22 bp, Homo sapiens
aggagctgtcagagtgccagag

SEQ ID NO: 8142852 - DNA, 22 bp, Homo sapiens
aggagctgtcagagtgccagag

SEQ ID NO: 8142853 - DNA, 22 bp, Homo sapiens
aggagctgtgaatgggaggggt

SEQ ID NO: 8142854 - DNA, 22 bp, Homo sapiens
aggagctgtgaatgggaggggt

SEQ ID NO: 8142855 - DNA, 22 bp, Homo sapiens
aggagctgtcatttgattcaca

SEQ ID NO: 8142856 - DNA, 22 bp, Homo sapiens
aggagctgtcagagtgccagag

SEQ ID NO: 8142857 - DNA, 22 bp, Homo sapiens
aggagctgtcagagtgccagag

SEQ ID NO: 8142858 - DNA, 17 bp, Homo sapiens
aggagctgggggtggtg

SEQ ID NO: 8142859 - DNA, 17 bp, Homo sapiens
aggagctgggggtggtg

SEQ ID NO: 8142860 - DNA, 16 bp, Homo sapiens
aggagctgggtaggag

SEQ ID NO: 8142861 - DNA, 22 bp, Homo sapiens
aggagctgggttcctttggtgg

SEQ ID NO: 8142862 - DNA, 22 bp, Homo sapiens
aggagctgggttcctttggtgg

SEQ ID NO: 8142863 - DNA, 16 bp, Homo sapiens
aggagctgggtaggag

SEQ ID NO: 8142864 - DNA, 22 bp, Homo sapiens
aggagctggtagtctcattggg

SEQ ID NO: 8142865 - DNA, 22 bp, Homo sapiens
aggagctggtagtctcattggg

SEQ ID NO: 8142866 - DNA, 22 bp, Homo sapiens
aggagctgtcagagtgccagag

SEQ ID NO: 8142867 - DNA, 22 bp, Homo sapiens
aggagctgggttcctttggtgg

SEQ ID NO: 8142868 - DNA, 22 bp, Homo sapiens
aggagctgggttcctttggtgg

SEQ ID NO: 8142869 - DNA, 22 bp, Homo sapiens
aggagctggtagtctcattggg

SEQ ID NO: 8142870 - DNA, 22 bp, Homo sapiens
cataacattattttctgaagat

SEQ ID NO: 8142871 - DNA, 22 bp, Homo sapiens
cataacattaagcctctatttc

SEQ ID NO: 8142872 - DNA, 22 bp, Homo sapiens
cataacattaagcctctatttc

SEQ ID NO: 8142873 - DNA, 22 bp, Homo sapiens
cataacatgtacatataaatgc

SEQ ID NO: 8142874 - DNA, 22 bp, Homo sapiens
cataacatgtacatataaatgc

SEQ ID NO: 8142875 - DNA, 22 bp, Homo sapiens
cataacatgtacatataaatgc

SEQ ID NO: 8142876 - DNA, 22 bp, Homo sapiens
cataacatctgtgaagcaggaa

SEQ ID NO: 8142877 - DNA, 22 bp, Homo sapiens
aggagccagtggagttcctgcc

SEQ ID NO: 8142878 - DNA, 22 bp, Homo sapiens
aggagccatccccatgagaggt

SEQ ID NO: 8142879 - DNA, 22 bp, Homo sapiens
aggagccatccccatgagaggt

SEQ ID NO: 8142880 - DNA, 22 bp, Homo sapiens
cataactgggagatccaagggt

SEQ ID NO: 8142881 - DNA, 22 bp, Homo sapiens
cataactagagtgaaatgttga

SEQ ID NO: 8142882 - DNA, 22 bp, Homo sapiens
cataactggggacacttctcta

SEQ ID NO: 8142883 - DNA, 22 bp, Homo sapiens
cataactggggacacttctcta

SEQ ID NO: 8142884 - DNA, 22 bp, Homo sapiens
cataactgggagatccaagggt

SEQ ID NO: 8142885 - DNA, 22 bp, Homo sapiens
cataatatctccgattacttgc

SEQ ID NO: 8142886 - DNA, 22 bp, Homo sapiens
cataagaatcttccagggcatg

SEQ ID NO: 8142887 - DNA, 22 bp, Homo sapiens
ccaatgagacagaaagagcctc

SEQ ID NO: 8142888 - DNA, 22 bp, Homo sapiens
catttgaaacctggaatctacc

SEQ ID NO: 8142889 - DNA, 23 bp, Homo sapiens
catttctgggagatttataaaat

SEQ ID NO: 8142890 - DNA, 22 bp, Homo sapiens
catttctgtgacacttccatct

SEQ ID NO: 8142891 - DNA, 22 bp, Homo sapiens
catttctgttctcttcctgtac

SEQ ID NO: 8142892 - DNA, 22 bp, Homo sapiens
catttctgtcacgttcttttat

SEQ ID NO: 8142893 - DNA, 22 bp, Homo sapiens
ccacagagacagagcccagggt

SEQ ID NO: 8142894 - DNA, 22 bp, Homo sapiens
ccacagagacagagcccagggt

SEQ ID NO: 8142895 - DNA, 22 bp, Homo sapiens
ccacagagacagggtccttgct

SEQ ID NO: 8142896 - DNA, 22 bp, Homo sapiens
ccacagagacagggtccttgct

SEQ ID NO: 8142897 - DNA, 22 bp, Homo sapiens
ccacagagacagggtccttgct

SEQ ID NO: 8142898 - DNA, 22 bp, Homo sapiens
ccacagagacagagcccagggt

SEQ ID NO: 8142899 - DNA, 22 bp, Homo sapiens
ccacagagagtgtcagcctttg

SEQ ID NO: 8142900 - DNA, 22 bp, Homo sapiens
ccacagagagtgtcagcctttg

SEQ ID NO: 8142901 - DNA, 22 bp, Homo sapiens
ccacagagactctgcaggactg

SEQ ID NO: 8142902 - DNA, 19 bp, Homo sapiens
ccacagagactagaagaca

SEQ ID NO: 8142903 - DNA, 22 bp, Homo sapiens
ccacagagactctgcaggactg

SEQ ID NO: 8142904 - DNA, 17 bp, Homo sapiens
aggcaggagattggaga

SEQ ID NO: 8142905 - DNA, 17 bp, Homo sapiens
aggcaggagattggaga

SEQ ID NO: 8142906 - DNA, 22 bp, Homo sapiens
aggcaggaaccctgtgtgcgcc

SEQ ID NO: 8142907 - DNA, 22 bp, Homo sapiens
aggcaggagcaagccctacaag

SEQ ID NO: 8142908 - DNA, 22 bp, Homo sapiens
aggcaggaggatcatggatgca

SEQ ID NO: 8142909 - DNA, 19 bp, Homo sapiens
ccacagagcatgctgaggc

SEQ ID NO: 8142910 - DNA, 22 bp, Homo sapiens
ccacagagcattagatttcaga

SEQ ID NO: 8142911 - DNA, 22 bp, Homo sapiens
aggcaggaaaatcgcttgaacc

SEQ ID NO: 8142912 - DNA, 23 bp, Homo sapiens
ccacagagctgccaattcctgtg

SEQ ID NO: 8142913 - DNA, 23 bp, Homo sapiens
ccacagagctgccaattcctgtg

SEQ ID NO: 8142914 - DNA, 23 bp, Homo sapiens
ccacagagctgccaattcctgtg

SEQ ID NO: 8142915 - DNA, 22 bp, Homo sapiens
aggcaggaaaatcgcttgaacc

SEQ ID NO: 8142916 - DNA, 18 bp, Homo sapiens
aggcaggatcctggcctc

SEQ ID NO: 8142917 - DNA, 18 bp, Homo sapiens
aggcaggatcctggcctc

SEQ ID NO: 8142918 - DNA, 18 bp, Homo sapiens
aggcaggatcctggcctc

SEQ ID NO: 8142919 - DNA, 23 bp, Homo sapiens
ccacaggcacagaggcttgcatc

SEQ ID NO: 8142920 - DNA, 23 bp, Homo sapiens
ccacaggcacagaggcttgcatc

SEQ ID NO: 8142921 - DNA, 22 bp, Homo sapiens
ccacaggcggagtggcgggcag

SEQ ID NO: 8142922 - DNA, 20 bp, Homo sapiens
ccacagtggagactggagac

SEQ ID NO: 8142923 - DNA, 22 bp, Homo sapiens
aggcaggaggatcatggatgca

SEQ ID NO: 8142924 - DNA, 22 bp, Homo sapiens
aggcaggaggatcatggatgca

SEQ ID NO: 8142925 - DNA, 22 bp, Homo sapiens
aggcaggagtgaccctgacagg

SEQ ID NO: 8142926 - DNA, 22 bp, Homo sapiens
ccacccagcagaggaggcaaga

SEQ ID NO: 8142927 - DNA, 22 bp, Homo sapiens
ccacccagcagaggaggcaaga

SEQ ID NO: 8142928 - DNA, 22 bp, Homo sapiens
ccacccagaccagggatctggg

SEQ ID NO: 8142929 - DNA, 20 bp, Homo sapiens
ccacccacgcgggctctgcc

SEQ ID NO: 8142930 - DNA, 23 bp, Homo sapiens
ccacctggactctgggcaggtgc

SEQ ID NO: 8142931 - DNA, 22 bp, Homo sapiens
ccacccagccagatgcaggaag

SEQ ID NO: 8142932 - DNA, 20 bp, Homo sapiens
ccacctggccaaggctgtgc

SEQ ID NO: 8142933 - DNA, 22 bp, Homo sapiens
ccacctgtgcttggtactccat

SEQ ID NO: 8142934 - DNA, 22 bp, Homo sapiens
ccacctggggctgtggcccctt

SEQ ID NO: 8142935 - DNA, 22 bp, Homo sapiens
ccaccttgggactgctcacccc

SEQ ID NO: 8142936 - DNA, 22 bp, Homo sapiens
ccacgtccagctaattttcgta

SEQ ID NO: 8142937 - DNA, 22 bp, Homo sapiens
ccacggccacccgctcatgggc

SEQ ID NO: 8142938 - DNA, 22 bp, Homo sapiens
ccacgctccctgatccctgctt

SEQ ID NO: 8142939 - DNA, 22 bp, Homo sapiens
ccacgaggctatcctgctaggg

SEQ ID NO: 8142940 - DNA, 22 bp, Homo sapiens
ccacgaggctatcctgctaggg

SEQ ID NO: 8142941 - DNA, 22 bp, Homo sapiens
ccacgagggaaccaggtggggt

SEQ ID NO: 8142942 - DNA, 20 bp, Homo sapiens
ccactcagctgtattctcag

SEQ ID NO: 8142943 - DNA, 22 bp, Homo sapiens
ccactcagcacagtggatgcag

SEQ ID NO: 8142944 - DNA, 22 bp, Homo sapiens
ccactcaggagcttatctatgc

SEQ ID NO: 8142945 - DNA, 22 bp, Homo sapiens
ccactcaggcctcctgctctcc

SEQ ID NO: 8142946 - DNA, 17 bp, Homo sapiens
ccactcagtaatttctc

SEQ ID NO: 8142947 - DNA, 22 bp, Homo sapiens
ccactcagttgctctctgtttt

SEQ ID NO: 8142948 - DNA, 22 bp, Homo sapiens
ccacagttattcatttgtgaca

SEQ ID NO: 8142949 - DNA, 22 bp, Homo sapiens
ccacagtttcttcatctataaa

SEQ ID NO: 8142950 - DNA, 22 bp, Homo sapiens
ccacagtggttgtggcatgtgg

SEQ ID NO: 8142951 - DNA, 22 bp, Homo sapiens
ccacagtggttctcaaccaggg

SEQ ID NO: 8142952 - DNA, 22 bp, Homo sapiens
ccacagtggttgtggcatgtgg

SEQ ID NO: 8142953 - DNA, 22 bp, Homo sapiens
ccacagtgtggcataaactgta

SEQ ID NO: 8142954 - DNA, 22 bp, Homo sapiens
ccacagtgttctttttaaaatt

SEQ ID NO: 8142955 - DNA, 22 bp, Homo sapiens
ccacagtggttgtggcatgtgg

SEQ ID NO: 8142956 - DNA, 20 bp, Homo sapiens
ccacagtggagactggagac

SEQ ID NO: 8142957 - DNA, 20 bp, Homo sapiens
ccacagtggagactggagac

SEQ ID NO: 8142958 - DNA, 22 bp, Homo sapiens
ccacagtgggcacagcaggact

SEQ ID NO: 8142959 - DNA, 22 bp, Homo sapiens
ccacagtgggcacagcaggact

SEQ ID NO: 8142960 - DNA, 21 bp, Homo sapiens
ccaccaggtcttctgctcggg

SEQ ID NO: 8142961 - DNA, 21 bp, Homo sapiens
ccaccaggtcttctgctcggg

SEQ ID NO: 8142962 - DNA, 22 bp, Homo sapiens
ccacccacaaccagctggctgt

SEQ ID NO: 8142963 - DNA, 22 bp, Homo sapiens
ccacccacaaccagctggctgt

SEQ ID NO: 8142964 - DNA, 20 bp, Homo sapiens
ccacccacgcgggctctgcc

SEQ ID NO: 8142965 - DNA, 20 bp, Homo sapiens
ccacccacgcgggctctgcc

SEQ ID NO: 8142966 - DNA, 22 bp, Homo sapiens
ccacatctaagccttcatgata

SEQ ID NO: 8142967 - DNA, 22 bp, Homo sapiens
ccacatcagaaatgtttactca

SEQ ID NO: 8142968 - DNA, 22 bp, Homo sapiens
ccacatcatggatacagttatg

SEQ ID NO: 8142969 - DNA, 22 bp, Homo sapiens
ccacatctatctttagtatgaa

SEQ ID NO: 8142970 - DNA, 22 bp, Homo sapiens
ccacatctcggtcccctctttg

SEQ ID NO: 8142971 - DNA, 22 bp, Homo sapiens
ccacatctcggtcccctctttg

SEQ ID NO: 8142972 - DNA, 22 bp, Homo sapiens
ccacatctccctattgctcttt

SEQ ID NO: 8142973 - DNA, 22 bp, Homo sapiens
ccaccaggcactcacagggaag

SEQ ID NO: 8142974 - DNA, 22 bp, Homo sapiens
ccaccaggcactcacagggaag

SEQ ID NO: 8142975 - DNA, 21 bp, Homo sapiens
ccaccaggtcttctgctcggg

SEQ ID NO: 8142976 - DNA, 22 bp, Homo sapiens
ccaccaggctctgtccgagcgg

SEQ ID NO: 8142977 - DNA, 22 bp, Homo sapiens
ccaccaggcactcacagggaag

SEQ ID NO: 8142978 - DNA, 22 bp, Homo sapiens
catttcaatacagtttgtaaat

SEQ ID NO: 8142979 - DNA, 22 bp, Homo sapiens
catttcaatactatctgagaat

SEQ ID NO: 8142980 - DNA, 22 bp, Homo sapiens
catttcaatgccttcaacatag

SEQ ID NO: 8142981 - DNA, 22 bp, Homo sapiens
catttcaatgccttcaacatag

SEQ ID NO: 8142982 - DNA, 22 bp, Homo sapiens
catttcaatgccttcaacatag

SEQ ID NO: 8142983 - DNA, 22 bp, Homo sapiens
catttctcctgggtgataaatt

SEQ ID NO: 8142984 - DNA, 22 bp, Homo sapiens
catttctcctgggtgataaatt

SEQ ID NO: 8142985 - DNA, 22 bp, Homo sapiens
catttctccgccgagatcactg

SEQ ID NO: 8142986 - DNA, 22 bp, Homo sapiens
catttcacaaatggccacatca

SEQ ID NO: 8142987 - DNA, 22 bp, Homo sapiens
catttctccgccgagatcactg

SEQ ID NO: 8142988 - DNA, 22 bp, Homo sapiens
catttcacagtaaagtgatttc

SEQ ID NO: 8142989 - DNA, 22 bp, Homo sapiens
catttcaaacagttacagctgc

SEQ ID NO: 8142990 - DNA, 22 bp, Homo sapiens
catttcaaaagaattgccagaa

SEQ ID NO: 8142991 - DNA, 22 bp, Homo sapiens
catttattggttaggccagcag

SEQ ID NO: 8142992 - DNA, 22 bp, Homo sapiens
catttattggttaggccagcag

SEQ ID NO: 8142993 - DNA, 22 bp, Homo sapiens
catttattggttaggccagcag

SEQ ID NO: 8142994 - DNA, 22 bp, Homo sapiens
catttattggttaggccagcag

SEQ ID NO: 8142995 - DNA, 22 bp, Homo sapiens
catttattggttaggccagcag

SEQ ID NO: 8142996 - DNA, 22 bp, Homo sapiens
catttattggcatgtagtaggt

SEQ ID NO: 8142997 - DNA, 22 bp, Homo sapiens
catttcaagcattgacttctat

SEQ ID NO: 8142998 - DNA, 22 bp, Homo sapiens
catttcaagcattgacttctat

SEQ ID NO: 8142999 - DNA, 23 bp, Homo sapiens
catttcaacgaattttccttctg

SEQ ID NO: 8143000 - DNA, 21 bp, Homo sapiens
catttcaaagagctggaaatc

SEQ ID NO: 8143001 - DNA, 21 bp, Homo sapiens
catttcaaagagctggaaatc

SEQ ID NO: 8143002 - DNA, 23 bp, Homo sapiens
catttcaacgaattttccttctg

SEQ ID NO: 8143003 - DNA, 22 bp, Homo sapiens
catttcaagtaacagattgctt

SEQ ID NO: 8143004 - DNA, 22 bp, Homo sapiens
catttcaaggaccaccctggga

SEQ ID NO: 8143005 - DNA, 22 bp, Homo sapiens
catttcaagtaacagattgctt

SEQ ID NO: 8143006 - DNA, 22 bp, Homo sapiens
catttcaagtaacagattgctt

SEQ ID NO: 8143007 - DNA, 22 bp, Homo sapiens
cattgtaagctgttgaatcctc

SEQ ID NO: 8143008 - DNA, 22 bp, Homo sapiens
cattggtttgatattgccatgg

SEQ ID NO: 8143009 - DNA, 22 bp, Homo sapiens
cattggtttgatattgccatgg

SEQ ID NO: 8143010 - DNA, 22 bp, Homo sapiens
cattggaatgatcgttttgctg

SEQ ID NO: 8143011 - DNA, 22 bp, Homo sapiens
cattggaagacatatcatgcta

SEQ ID NO: 8143012 - DNA, 21 bp, Homo sapiens
aggcacttaaccaatgttagc

SEQ ID NO: 8143013 - DNA, 21 bp, Homo sapiens
aggcactgtttgtggtttggg

SEQ ID NO: 8143014 - DNA, 21 bp, Homo sapiens
aggcactgtttgtggtttggg

SEQ ID NO: 8143015 - DNA, 21 bp, Homo sapiens
aggcactgtttgtggtttggg

SEQ ID NO: 8143016 - DNA, 20 bp, Homo sapiens
aggcactgttgtctgtatcc

SEQ ID NO: 8143017 - DNA, 22 bp, Homo sapiens
aggcactgttcccagttatcct

SEQ ID NO: 8143018 - DNA, 22 bp, Homo sapiens
aggcacttaacctactaactga

SEQ ID NO: 8143019 - DNA, 22 bp, Homo sapiens
aggcacttcatgggttcaagga

SEQ ID NO: 8143020 - DNA, 22 bp, Homo sapiens
aggcacttcatgggttcaagga

SEQ ID NO: 8143021 - DNA, 22 bp, Homo sapiens
aggcacttctcaaattcatgcc

SEQ ID NO: 8143022 - DNA, 22 bp, Homo sapiens
aggcacttctcaaattcatgcc

SEQ ID NO: 8143023 - DNA, 22 bp, Homo sapiens
aggcacttaataaggattcaat

SEQ ID NO: 8143024 - DNA, 22 bp, Homo sapiens
aggcacttgcattgatgaggtc

SEQ ID NO: 8143025 - DNA, 22 bp, Homo sapiens
aggcacttgcattgatgaggtc

SEQ ID NO: 8143026 - DNA, 22 bp, Homo sapiens
aggcacttgcattgatgaggtc

SEQ ID NO: 8143027 - DNA, 22 bp, Homo sapiens
aggcacttgattaatgtgaatt

SEQ ID NO: 8143028 - DNA, 22 bp, Homo sapiens
aggcacttgattaatgtgaatt

SEQ ID NO: 8143029 - DNA, 22 bp, Homo sapiens
aggcacttgaattgatgatgtt

SEQ ID NO: 8143030 - DNA, 22 bp, Homo sapiens
aggcacttgaattgatgatgtt

SEQ ID NO: 8143031 - DNA, 22 bp, Homo sapiens
aggcactttacaatgtgtgaca

SEQ ID NO: 8143032 - DNA, 22 bp, Homo sapiens
aggcacttgtgactgtctgcat

SEQ ID NO: 8143033 - DNA, 22 bp, Homo sapiens
aggcacttgtgactgtctgcat

SEQ ID NO: 8143034 - DNA, 22 bp, Homo sapiens
aggcacttggaggtctctgccc

SEQ ID NO: 8143035 - DNA, 22 bp, Homo sapiens
aggcacttgtaattgcagtcat

SEQ ID NO: 8143036 - DNA, 22 bp, Homo sapiens
aggcacttggagttctttgccc

SEQ ID NO: 8143037 - DNA, 22 bp, Homo sapiens
catttattggcatgtagtaggt

SEQ ID NO: 8143038 - DNA, 22 bp, Homo sapiens
cattgcacttctgcttttcctc

SEQ ID NO: 8143039 - DNA, 22 bp, Homo sapiens
cattcggaggtagttgaggtta

SEQ ID NO: 8143040 - DNA, 20 bp, Homo sapiens
cattgcaggcagagtaagtg

SEQ ID NO: 8143041 - DNA, 22 bp, Homo sapiens
cattgcattggattgtacttgt

SEQ ID NO: 8143042 - DNA, 22 bp, Homo sapiens
cattgcattggattgtacttgt

SEQ ID NO: 8143043 - DNA, 20 bp, Homo sapiens
cattgcatatttcattgagg

SEQ ID NO: 8143044 - DNA, 22 bp, Homo sapiens
cattgctgtagtccagatgagg

SEQ ID NO: 8143045 - DNA, 22 bp, Homo sapiens
cattgctgcttccaggcacagg

SEQ ID NO: 8143046 - DNA, 22 bp, Homo sapiens
cattgctgttaattgtctctag

SEQ ID NO: 8143047 - DNA, 22 bp, Homo sapiens
cattgcttatttcagctaaagt

SEQ ID NO: 8143048 - DNA, 22 bp, Homo sapiens
cattgcttgatagctgaaaatt

SEQ ID NO: 8143049 - DNA, 22 bp, Homo sapiens
cattggaaaatgcatgcttttt

SEQ ID NO: 8143050 - DNA, 22 bp, Homo sapiens
cattgcttgatagctgaaaatt

SEQ ID NO: 8143051 - DNA, 22 bp, Homo sapiens
cattgcttcctatgtcccttct

SEQ ID NO: 8143052 - DNA, 22 bp, Homo sapiens
aggcaaggtgctacagacagtg

SEQ ID NO: 8143053 - DNA, 22 bp, Homo sapiens
aggcaaggtgctacagacagtg

SEQ ID NO: 8143054 - DNA, 22 bp, Homo sapiens
aggcaaggtgctacagacagtg

SEQ ID NO: 8143055 - DNA, 22 bp, Homo sapiens
aggcaaggtgctacagacagtg

SEQ ID NO: 8143056 - DNA, 21 bp, Homo sapiens
aggcaataaagttttgtctac

SEQ ID NO: 8143057 - DNA, 22 bp, Homo sapiens
aggcaaggtgctcttgctctat

SEQ ID NO: 8143058 - DNA, 22 bp, Homo sapiens
aggcaatacacagcatttcaca

SEQ ID NO: 8143059 - DNA, 23 bp, Homo sapiens
aggcaatacaaggcatctctgga

SEQ ID NO: 8143060 - DNA, 22 bp, Homo sapiens
aggcaataagcctcaactgtct

SEQ ID NO: 8143061 - DNA, 17 bp, Homo sapiens
aggcaatgactgtggtt

SEQ ID NO: 8143062 - DNA, 22 bp, Homo sapiens
cattccttaacgtggggagtct

SEQ ID NO: 8143063 - DNA, 22 bp, Homo sapiens
aggcaagattaggaccagaaga

SEQ ID NO: 8143064 - DNA, 22 bp, Homo sapiens
aggcaagattaggaccagaaga

SEQ ID NO: 8143065 - DNA, 22 bp, Homo sapiens
aggcaagcgcagaagcggagga

SEQ ID NO: 8143066 - DNA, 22 bp, Homo sapiens
aggcaagcattgggaacagggc

SEQ ID NO: 8143067 - DNA, 22 bp, Homo sapiens
aggcaagggggcgccaccttcc

SEQ ID NO: 8143068 - DNA, 22 bp, Homo sapiens
aggcaagggggcgccaccttcc

SEQ ID NO: 8143069 - DNA, 22 bp, Homo sapiens
aggcaaggtgctacagacagtg

SEQ ID NO: 8143070 - DNA, 22 bp, Homo sapiens
aggcaaggtgctacagacagtg

SEQ ID NO: 8143071 - DNA, 20 bp, Homo sapiens
aggcaaggtagatgtctgct

SEQ ID NO: 8143072 - DNA, 20 bp, Homo sapiens
aggcaaggtagatgtctgct

SEQ ID NO: 8143073 - DNA, 23 bp, Homo sapiens
aggcaagggtgtaaaggaaatga

SEQ ID NO: 8143074 - DNA, 22 bp, Homo sapiens
aggcaacttttggggatgatgg

SEQ ID NO: 8143075 - DNA, 22 bp, Homo sapiens
aggcaagaaactttctgggaga

SEQ ID NO: 8143076 - DNA, 22 bp, Homo sapiens
aggcaacttgcatctcggcaag

SEQ ID NO: 8143077 - DNA, 22 bp, Homo sapiens
aggcaacttgaccaggctttct

SEQ ID NO: 8143078 - DNA, 22 bp, Homo sapiens
aggcaactgagaggcccgtgtt

SEQ ID NO: 8143079 - DNA, 22 bp, Homo sapiens
aggcaactgtttgataatgttg

SEQ ID NO: 8143080 - DNA, 22 bp, Homo sapiens
aggcaactggttaagtaaattg

SEQ ID NO: 8143081 - DNA, 20 bp, Homo sapiens
aggcaactcaagtttttgcc

SEQ ID NO: 8143082 - DNA, 17 bp, Homo sapiens
aggcaactagttccctc

SEQ ID NO: 8143083 - DNA, 22 bp, Homo sapiens
aggcaactgacagtttctgctt

SEQ ID NO: 8143084 - DNA, 22 bp, Homo sapiens
aggcaactgacagcatatcctg

SEQ ID NO: 8143085 - DNA, 22 bp, Homo sapiens
aggcaactcatcatgaaagact

SEQ ID NO: 8143086 - DNA, 22 bp, Homo sapiens
aggcaactctgaccttatgaag

SEQ ID NO: 8143087 - DNA, 22 bp, Homo sapiens
aggcaagaacagacatgggagt

SEQ ID NO: 8143088 - DNA, 22 bp, Homo sapiens
aggcaagaacagacatgggagt

SEQ ID NO: 8143089 - DNA, 22 bp, Homo sapiens
aggcaagaacagacatgggagt

SEQ ID NO: 8143090 - DNA, 22 bp, Homo sapiens
aggcaagaacagacatgggagt

SEQ ID NO: 8143091 - DNA, 22 bp, Homo sapiens
aggcaagaacagacatgggagt

SEQ ID NO: 8143092 - DNA, 22 bp, Homo sapiens
aggcaagaaactttctgggaga

SEQ ID NO: 8143093 - DNA, 23 bp, Homo sapiens
aggcaagaacgggttgttcaccc

SEQ ID NO: 8143094 - DNA, 23 bp, Homo sapiens
aggcaagaacgggttgttcaccc

SEQ ID NO: 8143095 - DNA, 22 bp, Homo sapiens
aggcaagagtgactacgtgaaa

SEQ ID NO: 8143096 - DNA, 22 bp, Homo sapiens
aggcaagagtgactacgtgaaa

SEQ ID NO: 8143097 - DNA, 22 bp, Homo sapiens
aggcaagaccagaaagggctga

SEQ ID NO: 8143098 - DNA, 22 bp, Homo sapiens
aggcaagaccagaaagggctga

SEQ ID NO: 8143099 - DNA, 22 bp, Homo sapiens
cagggcagggatgttgcggcag

SEQ ID NO: 8143100 - DNA, 22 bp, Homo sapiens
cagggcagggatgttgcggcag

SEQ ID NO: 8143101 - DNA, 22 bp, Homo sapiens
cagggcagggccacaccccctg

SEQ ID NO: 8143102 - DNA, 22 bp, Homo sapiens
cagggcagggatgttgcggcag

SEQ ID NO: 8143103 - DNA, 22 bp, Homo sapiens
cagggcagggagcttagaatga

SEQ ID NO: 8143104 - DNA, 22 bp, Homo sapiens
cagggcagggatgttgcggcag

SEQ ID NO: 8143105 - DNA, 22 bp, Homo sapiens
cagggcagggagcttagaatga

SEQ ID NO: 8143106 - DNA, 22 bp, Homo sapiens
cagggcagggagcttagaatga

SEQ ID NO: 8143107 - DNA, 22 bp, Homo sapiens
cagggcagggagcttagaatga

SEQ ID NO: 8143108 - DNA, 22 bp, Homo sapiens
cagggcagggagcttagaatga

SEQ ID NO: 8143109 - DNA, 22 bp, Homo sapiens
cagggcagggccacaccccctg

SEQ ID NO: 8143110 - DNA, 22 bp, Homo sapiens
cagggcagggccacaccccctg

SEQ ID NO: 8143111 - DNA, 22 bp, Homo sapiens
cagggcagggccacaccccctg

SEQ ID NO: 8143112 - DNA, 22 bp, Homo sapiens
cagggcagtaacgggaacatct

SEQ ID NO: 8143113 - DNA, 22 bp, Homo sapiens
cagggcagtaacgggaacatct

SEQ ID NO: 8143114 - DNA, 22 bp, Homo sapiens
cagggcagtaacgggaacatct

SEQ ID NO: 8143115 - DNA, 22 bp, Homo sapiens
caggctcttttggtggcaagga

SEQ ID NO: 8143116 - DNA, 22 bp, Homo sapiens
caggctgaagtgcagtggtgtg

SEQ ID NO: 8143117 - DNA, 22 bp, Homo sapiens
caggctgaagtgcagtggtgtg

SEQ ID NO: 8143118 - DNA, 22 bp, Homo sapiens
caggctcttttggtggcaagga

SEQ ID NO: 8143119 - DNA, 22 bp, Homo sapiens
caggctcttttggtggcaagga

SEQ ID NO: 8143120 - DNA, 22 bp, Homo sapiens
caggctcttccatcctgctgag

SEQ ID NO: 8143121 - DNA, 22 bp, Homo sapiens
cagggatgtgatgagctgagcc

SEQ ID NO: 8143122 - DNA, 22 bp, Homo sapiens
caggctgagctctggcctgggc

SEQ ID NO: 8143123 - DNA, 22 bp, Homo sapiens
caggctgacaactgagcatttt

SEQ ID NO: 8143124 - DNA, 22 bp, Homo sapiens
caggctgagctctggcctgggc

SEQ ID NO: 8143125 - DNA, 22 bp, Homo sapiens
cagggcaggatgctgtgattat

SEQ ID NO: 8143126 - DNA, 22 bp, Homo sapiens
cagggcaggatgctgtgattat

SEQ ID NO: 8143127 - DNA, 22 bp, Homo sapiens
cagggcaggatgctgtgattat

SEQ ID NO: 8143128 - DNA, 22 bp, Homo sapiens
cagggcaggatgctgtgattat

SEQ ID NO: 8143129 - DNA, 22 bp, Homo sapiens
cagggcaggatgctgtgattat

SEQ ID NO: 8143130 - DNA, 22 bp, Homo sapiens
agctttgaatgagtgcattgca

SEQ ID NO: 8143131 - DNA, 22 bp, Homo sapiens
agctttgaatgagtgcattgca

SEQ ID NO: 8143132 - DNA, 22 bp, Homo sapiens
cagggcagtaacgggaacatct

SEQ ID NO: 8143133 - DNA, 22 bp, Homo sapiens
cagggcagtaacgggaacatct

SEQ ID NO: 8143134 - DNA, 22 bp, Homo sapiens
agctttgaaattatgtttcaga

SEQ ID NO: 8143135 - DNA, 22 bp, Homo sapiens
agctttgaatctggtgtttgca

SEQ ID NO: 8143136 - DNA, 22 bp, Homo sapiens
agctttgaagtatttggtctcc

SEQ ID NO: 8143137 - DNA, 22 bp, Homo sapiens
cagggctctgccttgagggatg

SEQ ID NO: 8143138 - DNA, 22 bp, Homo sapiens
cagggctctgccttgagggatg

SEQ ID NO: 8143139 - DNA, 22 bp, Homo sapiens
cagggctctgccttgagggatg

SEQ ID NO: 8143140 - DNA, 22 bp, Homo sapiens
cagggctctgccttgagggatg

SEQ ID NO: 8143141 - DNA, 22 bp, Homo sapiens
agctttggccctggaggttact

SEQ ID NO: 8143142 - DNA, 22 bp, Homo sapiens
agctttgggattcaggcaggaa

SEQ ID NO: 8143143 - DNA, 22 bp, Homo sapiens
cagggctggctcatgaaaagtt

SEQ ID NO: 8143144 - DNA, 22 bp, Homo sapiens
cagggctggatttcatttctag

SEQ ID NO: 8143145 - DNA, 20 bp, Homo sapiens
cagggctctgggcctggcct

SEQ ID NO: 8143146 - DNA, 22 bp, Homo sapiens
cagggctggctcatgaaaagtt

SEQ ID NO: 8143147 - DNA, 22 bp, Homo sapiens
cagggctggctcatgaaaagtt

SEQ ID NO: 8143148 - DNA, 22 bp, Homo sapiens
cagggctggctgtggcaatctc

SEQ ID NO: 8143149 - DNA, 22 bp, Homo sapiens
cagggctggctcatgaaaagtt

SEQ ID NO: 8143150 - DNA, 22 bp, Homo sapiens
cagggctggctgtggcaatctc

SEQ ID NO: 8143151 - DNA, 22 bp, Homo sapiens
cagggctggcttccaagttgtt

SEQ ID NO: 8143152 - DNA, 22 bp, Homo sapiens
cagggctggctgtggcaatctc

SEQ ID NO: 8143153 - DNA, 22 bp, Homo sapiens
cagggctggcttccaagttgtt

SEQ ID NO: 8143154 - DNA, 22 bp, Homo sapiens
cagggctggcttccaagttgtt

SEQ ID NO: 8143155 - DNA, 22 bp, Homo sapiens
cagggctggcttccaagttgtt

SEQ ID NO: 8143156 - DNA, 22 bp, Homo sapiens
cagggctggcttccaagttgtt

SEQ ID NO: 8143157 - DNA, 22 bp, Homo sapiens
cagggctgggttaaaagcaggg

SEQ ID NO: 8143158 - DNA, 23 bp, Homo sapiens
cagggctgggcttggtgttaggc

SEQ ID NO: 8143159 - DNA, 23 bp, Homo sapiens
cagggctgggcttggtgttaggc

SEQ ID NO: 8143160 - DNA, 22 bp, Homo sapiens
cagggctgggttaaaagcaggg

SEQ ID NO: 8143161 - DNA, 21 bp, Homo sapiens
aggaaaggaagtccccagggt

SEQ ID NO: 8143162 - DNA, 19 bp, Homo sapiens
aggaaaggatcaaaatagc

SEQ ID NO: 8143163 - DNA, 22 bp, Homo sapiens
cagggctgggttaaaagcaggg

SEQ ID NO: 8143164 - DNA, 22 bp, Homo sapiens
cagggctgggttaaaagcaggg

SEQ ID NO: 8143165 - DNA, 22 bp, Homo sapiens
aggaaaggattggcttctctgt

SEQ ID NO: 8143166 - DNA, 22 bp, Homo sapiens
aggaaaggattggcttctctgt

SEQ ID NO: 8143167 - DNA, 19 bp, Homo sapiens
aggaaaggatcaaaatagc

SEQ ID NO: 8143168 - DNA, 22 bp, Homo sapiens
aggaaaggattggcttctctgt

SEQ ID NO: 8143169 - DNA, 22 bp, Homo sapiens
aggaaaggcctcagcagaaacc

SEQ ID NO: 8143170 - DNA, 22 bp, Homo sapiens
aggaaaggcctcagcagaaacc

SEQ ID NO: 8143171 - DNA, 22 bp, Homo sapiens
aggaaaggcctcagcagaaacc

SEQ ID NO: 8143172 - DNA, 21 bp, Homo sapiens
aggaaaggccagcacgtaggg

SEQ ID NO: 8143173 - DNA, 21 bp, Homo sapiens
aggaaaggccagcacgtaggg

SEQ ID NO: 8143174 - DNA, 21 bp, Homo sapiens
aggaaaggccagcacgtaggg

SEQ ID NO: 8143175 - DNA, 21 bp, Homo sapiens
aggaaaggccagcacgtaggg

SEQ ID NO: 8143176 - DNA, 21 bp, Homo sapiens
aggaaaggccagcacgtaggg

SEQ ID NO: 8143177 - DNA, 22 bp, Homo sapiens
aggaaaggcctcagcagaaacc

SEQ ID NO: 8143178 - DNA, 22 bp, Homo sapiens
aggaaaggcctcagcagaaacc

SEQ ID NO: 8143179 - DNA, 22 bp, Homo sapiens
aggaaaggcctttgcatttggt

SEQ ID NO: 8143180 - DNA, 22 bp, Homo sapiens
aggaaaggcctttgcatttggt

SEQ ID NO: 8143181 - DNA, 22 bp, Homo sapiens
aggaaaggcctttgcatttggt

SEQ ID NO: 8143182 - DNA, 22 bp, Homo sapiens
aggaaaggcctttgcatttggt

SEQ ID NO: 8143183 - DNA, 22 bp, Homo sapiens
aggaagagctggaccagaggac

SEQ ID NO: 8143184 - DNA, 22 bp, Homo sapiens
aggaagagctggaccagaggac

SEQ ID NO: 8143185 - DNA, 22 bp, Homo sapiens
aggaagagctggaccagaggac

SEQ ID NO: 8143186 - DNA, 23 bp, Homo sapiens
aggaagaggcaatttctcttaga

SEQ ID NO: 8143187 - DNA, 18 bp, Homo sapiens
cagggctgtggggtcact

SEQ ID NO: 8143188 - DNA, 18 bp, Homo sapiens
cagggctgtggggtcact

SEQ ID NO: 8143189 - DNA, 22 bp, Homo sapiens
cagggctgttagctgctgctct

SEQ ID NO: 8143190 - DNA, 22 bp, Homo sapiens
cagggctgttagctgctgctct

SEQ ID NO: 8143191 - DNA, 22 bp, Homo sapiens
cagggctgttagctgctgctct

SEQ ID NO: 8143192 - DNA, 18 bp, Homo sapiens
cagggctgtggggtcact

SEQ ID NO: 8143193 - DNA, 18 bp, Homo sapiens
cagggctgtggggtcact

SEQ ID NO: 8143194 - DNA, 18 bp, Homo sapiens
cagggctgtggggtcact

SEQ ID NO: 8143195 - DNA, 18 bp, Homo sapiens
cagggctgtggggtcact

SEQ ID NO: 8143196 - DNA, 18 bp, Homo sapiens
cagggctgtggggtcact

SEQ ID NO: 8143197 - DNA, 22 bp, Homo sapiens
aggaagagcattcacatggtag

SEQ ID NO: 8143198 - DNA, 22 bp, Homo sapiens
aggaagagcattcacatggtag

SEQ ID NO: 8143199 - DNA, 22 bp, Homo sapiens
aggaagagctggaccagaggac

SEQ ID NO: 8143200 - DNA, 22 bp, Homo sapiens
aggaagagctggaccagaggac

SEQ ID NO: 8143201 - DNA, 22 bp, Homo sapiens
aggaagagcccgggtgacataa

SEQ ID NO: 8143202 - DNA, 22 bp, Homo sapiens
aggaagagcccgggtgacataa

SEQ ID NO: 8143203 - DNA, 22 bp, Homo sapiens
aggaagagctggaccagaggac

SEQ ID NO: 8143204 - DNA, 22 bp, Homo sapiens
aggaagagctggaccagaggac

SEQ ID NO: 8143205 - DNA, 22 bp, Homo sapiens
aggaagagctggaccagaggac

SEQ ID NO: 8143206 - DNA, 22 bp, Homo sapiens
cagtatttggaatatagctaag

SEQ ID NO: 8143207 - DNA, 22 bp, Homo sapiens
cagtatttggaatatagctaag

SEQ ID NO: 8143208 - DNA, 22 bp, Homo sapiens
cagtatttgttccctatcaatg

SEQ ID NO: 8143209 - DNA, 22 bp, Homo sapiens
cagtatttgttacagcattagc

SEQ ID NO: 8143210 - DNA, 22 bp, Homo sapiens
cagtatttgttacagcattagc

SEQ ID NO: 8143211 - DNA, 22 bp, Homo sapiens
cagtatttgttacagcattagc

SEQ ID NO: 8143212 - DNA, 22 bp, Homo sapiens
cagtatttcattcagaattgtt

SEQ ID NO: 8143213 - DNA, 22 bp, Homo sapiens
cagtatttatggcttgagtatt

SEQ ID NO: 8143214 - DNA, 22 bp, Homo sapiens
cagtatttatggcttgagtatt

SEQ ID NO: 8143215 - DNA, 22 bp, Homo sapiens
cagtatgtttgggagacatgac

SEQ ID NO: 8143216 - DNA, 22 bp, Homo sapiens
cagtatcttgcttatagacaca

SEQ ID NO: 8143217 - DNA, 22 bp, Homo sapiens
cagtatctgtcagtaatcaggt

SEQ ID NO: 8143218 - DNA, 18 bp, Homo sapiens
cagtaactatgttgttac

SEQ ID NO: 8143219 - DNA, 22 bp, Homo sapiens
cagtaagagttgacaatggcca

SEQ ID NO: 8143220 - DNA, 22 bp, Homo sapiens
cagtaagaatatgaatcaggat

SEQ ID NO: 8143221 - DNA, 22 bp, Homo sapiens
cagtaaggatgcacataactag

SEQ ID NO: 8143222 - DNA, 22 bp, Homo sapiens
cagtaaacaatgcctttttggg

SEQ ID NO: 8143223 - DNA, 22 bp, Homo sapiens
cagtaaacactagcattcttgg

SEQ ID NO: 8143224 - DNA, 22 bp, Homo sapiens
cagtaaacactagcattcttgg

SEQ ID NO: 8143225 - DNA, 22 bp, Homo sapiens
cagtaaagagccttcattaaat

SEQ ID NO: 8143226 - DNA, 22 bp, Homo sapiens
cagtaaagcatgtatgtcttca

SEQ ID NO: 8143227 - DNA, 22 bp, Homo sapiens
cagtaaacagttactaagaaga

SEQ ID NO: 8143228 - DNA, 22 bp, Homo sapiens
aggacagagggaccagagccca

SEQ ID NO: 8143229 - DNA, 22 bp, Homo sapiens
aggacagagggaccagagccca

SEQ ID NO: 8143230 - DNA, 22 bp, Homo sapiens
aggacagagggaccagagccca

SEQ ID NO: 8143231 - DNA, 22 bp, Homo sapiens
aggacagatttttggccaccag

SEQ ID NO: 8143232 - DNA, 21 bp, Homo sapiens
aggacagatgtaggaataaag

SEQ ID NO: 8143233 - DNA, 22 bp, Homo sapiens
aggacagagggaccagagccca

SEQ ID NO: 8143234 - DNA, 22 bp, Homo sapiens
aggacagagggaccagagccca

SEQ ID NO: 8143235 - DNA, 22 bp, Homo sapiens
cagtaacacaaccactccgtga

SEQ ID NO: 8143236 - DNA, 22 bp, Homo sapiens
cagtaacaggctctgtggtata

SEQ ID NO: 8143237 - DNA, 22 bp, Homo sapiens
cagtaaatgtgatttttcttgt

SEQ ID NO: 8143238 - DNA, 22 bp, Homo sapiens
cagtaaatggtacgtatatttt

SEQ ID NO: 8143239 - DNA, 22 bp, Homo sapiens
cagtaaatgagaagctagtaat

SEQ ID NO: 8143240 - DNA, 22 bp, Homo sapiens
cagtaaatgagaagctagtaat

SEQ ID NO: 8143241 - DNA, 22 bp, Homo sapiens
cagtaaatggtacgtatatttt

SEQ ID NO: 8143242 - DNA, 22 bp, Homo sapiens
cagtaaatgcagatatagatac

SEQ ID NO: 8143243 - DNA, 22 bp, Homo sapiens
cagtaacagtgatcacctgtgg

SEQ ID NO: 8143244 - DNA, 22 bp, Homo sapiens
cagtaacagtgatcacctgtgg

SEQ ID NO: 8143245 - DNA, 22 bp, Homo sapiens
cagtaacatttcaaggtagagg

SEQ ID NO: 8143246 - DNA, 22 bp, Homo sapiens
cagtaacatttcaaggtagagg

SEQ ID NO: 8143247 - DNA, 22 bp, Homo sapiens
caggtggtgcctccaggctggt

SEQ ID NO: 8143248 - DNA, 22 bp, Homo sapiens
caggtgggccatgaaaaatgac

SEQ ID NO: 8143249 - DNA, 22 bp, Homo sapiens
caggtgggattttgctgcttga

SEQ ID NO: 8143250 - DNA, 22 bp, Homo sapiens
caggtggtgcctccaggctggt

SEQ ID NO: 8143251 - DNA, 22 bp, Homo sapiens
caggtggtgcctcctcccttcc

SEQ ID NO: 8143252 - DNA, 22 bp, Homo sapiens
caggtggtgcctcctcccttcc

SEQ ID NO: 8143253 - DNA, 22 bp, Homo sapiens
caggtggttatgaggaaggtga

SEQ ID NO: 8143254 - DNA, 22 bp, Homo sapiens
caggtggttatgaggaaggtga

SEQ ID NO: 8143255 - DNA, 22 bp, Homo sapiens
caggtggttccatgtttcatga

SEQ ID NO: 8143256 - DNA, 22 bp, Homo sapiens
cagggcttcgtgtctcagtgct

SEQ ID NO: 8143257 - DNA, 22 bp, Homo sapiens
cagggcttctataccaattcat

SEQ ID NO: 8143258 - DNA, 22 bp, Homo sapiens
cagggcttgaatcaaggaagtc

SEQ ID NO: 8143259 - DNA, 22 bp, Homo sapiens
cagggcttcgtgtctcagtgct

SEQ ID NO: 8143260 - DNA, 22 bp, Homo sapiens
cagggcttcgctcctggtgcac

SEQ ID NO: 8143261 - DNA, 22 bp, Homo sapiens
cagggcttcgctcctggtgcac

SEQ ID NO: 8143262 - DNA, 22 bp, Homo sapiens
cagggcttcgctcctggtgcac

SEQ ID NO: 8143263 - DNA, 22 bp, Homo sapiens
cagggcttcgctcctggtgcac

SEQ ID NO: 8143264 - DNA, 22 bp, Homo sapiens
cagggcttactggaggctgctt

SEQ ID NO: 8143265 - DNA, 22 bp, Homo sapiens
cagggcttactggaggctgctt

SEQ ID NO: 8143266 - DNA, 22 bp, Homo sapiens
cagggctgttagctgctgctct

SEQ ID NO: 8143267 - DNA, 22 bp, Homo sapiens
cagggctgttagctgctgctct

SEQ ID NO: 8143268 - DNA, 22 bp, Homo sapiens
caggtgtcaaaatactaagtgg

SEQ ID NO: 8143269 - DNA, 22 bp, Homo sapiens
caggtgtcaaaatactaagtgg

SEQ ID NO: 8143270 - DNA, 20 bp, Homo sapiens
caggtgtacagtgagctgag

SEQ ID NO: 8143271 - DNA, 22 bp, Homo sapiens
caggtgtcagcagcactgtact

SEQ ID NO: 8143272 - DNA, 22 bp, Homo sapiens
caggtgtcaaaatactaagtgg

SEQ ID NO: 8143273 - DNA, 16 bp, Homo sapiens
caggtgtcagtcacct

SEQ ID NO: 8143274 - DNA, 22 bp, Homo sapiens
caggtgtcaaaatactaagtgg

SEQ ID NO: 8143275 - DNA, 22 bp, Homo sapiens
caggtgtcagcagcactgtact

SEQ ID NO: 8143276 - DNA, 22 bp, Homo sapiens
caggtggtttgataggataact

SEQ ID NO: 8143277 - DNA, 22 bp, Homo sapiens
caggtggtttgataggataact

SEQ ID NO: 8143278 - DNA, 22 bp, Homo sapiens
caggtggttgtttggattctaa

SEQ ID NO: 8143279 - DNA, 22 bp, Homo sapiens
caggtggtttgataggataact

SEQ ID NO: 8143280 - DNA, 22 bp, Homo sapiens
caggtggttgtttggattctaa

SEQ ID NO: 8143281 - DNA, 22 bp, Homo sapiens
caggtggttgtttggattctaa

SEQ ID NO: 8143282 - DNA, 22 bp, Homo sapiens
caggtggttgagagctgtaggc

SEQ ID NO: 8143283 - DNA, 22 bp, Homo sapiens
caggtggttgagagctgtaggc

SEQ ID NO: 8143284 - DNA, 22 bp, Homo sapiens
caggtggttgagagctgtaggc

SEQ ID NO: 8143285 - DNA, 22 bp, Homo sapiens
caggtggttatgaggaaggtga

SEQ ID NO: 8143286 - DNA, 22 bp, Homo sapiens
caggtggttccatgtttcatga

SEQ ID NO: 8143287 - DNA, 16 bp, Homo sapiens
caggtgtcagtcacct

SEQ ID NO: 8143288 - DNA, 22 bp, Homo sapiens
caggtgtcggtcaggcggtttt

SEQ ID NO: 8143289 - DNA, 22 bp, Homo sapiens
caggtgtctaattctcaccccc

SEQ ID NO: 8143290 - DNA, 22 bp, Homo sapiens
caggtgtcggtcaggcggtttt

SEQ ID NO: 8143291 - DNA, 22 bp, Homo sapiens
caggtgtctaattctcaccccc

SEQ ID NO: 8143292 - DNA, 22 bp, Homo sapiens
aggaagtgaaagggaaggagtt

SEQ ID NO: 8143293 - DNA, 22 bp, Homo sapiens
aggaagtgctaagagaacatca

SEQ ID NO: 8143294 - DNA, 22 bp, Homo sapiens
aggaagtggataaaatagcttt

SEQ ID NO: 8143295 - DNA, 21 bp, Homo sapiens
aggaagtggccagattgggaa

SEQ ID NO: 8143296 - DNA, 21 bp, Homo sapiens
aggaagtggccagattgggaa

SEQ ID NO: 8143297 - DNA, 22 bp, Homo sapiens
aggacagacctaggactggagc

SEQ ID NO: 8143298 - DNA, 22 bp, Homo sapiens
aggacacagtggtggggaaaag

SEQ ID NO: 8143299 - DNA, 22 bp, Homo sapiens
aggacacatgcacaccctgcgt

SEQ ID NO: 8143300 - DNA, 22 bp, Homo sapiens
aggacagagcctgtgcagaccg

SEQ ID NO: 8143301 - DNA, 22 bp, Homo sapiens
aggacagagcctgtgcagaccg

SEQ ID NO: 8143302 - DNA, 22 bp, Homo sapiens
aggacagacctaggactggagc

SEQ ID NO: 8143303 - DNA, 22 bp, Homo sapiens
aggacagacctaggactggagc

SEQ ID NO: 8143304 - DNA, 22 bp, Homo sapiens
aggacagacctaggactggagc

SEQ ID NO: 8143305 - DNA, 22 bp, Homo sapiens
aggacagagccctagtttcata

SEQ ID NO: 8143306 - DNA, 22 bp, Homo sapiens
aggacaagacaaggaccagaga

SEQ ID NO: 8143307 - DNA, 22 bp, Homo sapiens
aggacaagacaaggaccagaga

SEQ ID NO: 8143308 - DNA, 22 bp, Homo sapiens
aggacaagctaaaggacttcct

SEQ ID NO: 8143309 - DNA, 22 bp, Homo sapiens
aggaatgaactcgagtgatctg

SEQ ID NO: 8143310 - DNA, 22 bp, Homo sapiens
aggaatctgggcccaactgtgc

SEQ ID NO: 8143311 - DNA, 18 bp, Homo sapiens
aggaatattcaaggtgct

SEQ ID NO: 8143312 - DNA, 22 bp, Homo sapiens
aggaatatggatttgctcagct

SEQ ID NO: 8143313 - DNA, 22 bp, Homo sapiens
aggaatattctcaagtggtcgt

SEQ ID NO: 8143314 - DNA, 23 bp, Homo sapiens
aggaagttaaggcagacagacag

SEQ ID NO: 8143315 - DNA, 23 bp, Homo sapiens
aggaagttatgaagggagaatag

SEQ ID NO: 8143316 - DNA, 22 bp, Homo sapiens
aggaagtggggttctctcactg

SEQ ID NO: 8143317 - DNA, 22 bp, Homo sapiens
aggaatatagttggaatgtagg

SEQ ID NO: 8143318 - DNA, 22 bp, Homo sapiens
aggaatatgagctgctgcagtg

SEQ ID NO: 8143319 - DNA, 22 bp, Homo sapiens
aggaatatgagctgctgcagtg

SEQ ID NO: 8143320 - DNA, 22 bp, Homo sapiens
aggaatagaccacttcactgag

SEQ ID NO: 8143321 - DNA, 22 bp, Homo sapiens
cagctgggtttagtggggtgtg

SEQ ID NO: 8143322 - DNA, 22 bp, Homo sapiens
cagctgggtttagtggggtgtg

SEQ ID NO: 8143323 - DNA, 22 bp, Homo sapiens
cagctgggtttagtggggtgtg

SEQ ID NO: 8143324 - DNA, 22 bp, Homo sapiens
cagctggtggctgatgaccgtc

SEQ ID NO: 8143325 - DNA, 22 bp, Homo sapiens
cagctggtgaactagtttttca

SEQ ID NO: 8143326 - DNA, 22 bp, Homo sapiens
cagctggtgagcttagtagggt

SEQ ID NO: 8143327 - DNA, 22 bp, Homo sapiens
cagctggtgagcttagtagggt

SEQ ID NO: 8143328 - DNA, 22 bp, Homo sapiens
cagctggtactcagttcttgtc

SEQ ID NO: 8143329 - DNA, 22 bp, Homo sapiens
cagctggtactcagttcttgtc

SEQ ID NO: 8143330 - DNA, 22 bp, Homo sapiens
cagctggtcaactgaatgaaca

SEQ ID NO: 8143331 - DNA, 22 bp, Homo sapiens
cagctggttggaagggagctga

SEQ ID NO: 8143332 - DNA, 23 bp, Homo sapiens
cagctggttgtgggagtggctgc

SEQ ID NO: 8143333 - DNA, 22 bp, Homo sapiens
cagctgtcacttctaagttttg

SEQ ID NO: 8143334 - DNA, 22 bp, Homo sapiens
cagctggttgaagaggagctgg

SEQ ID NO: 8143335 - DNA, 22 bp, Homo sapiens
cagctggttggaagggagctga

SEQ ID NO: 8143336 - DNA, 22 bp, Homo sapiens
cagctggttcagtgtctggtga

SEQ ID NO: 8143337 - DNA, 22 bp, Homo sapiens
cagctggttatcagagaggcct

SEQ ID NO: 8143338 - DNA, 22 bp, Homo sapiens
cagctggttatcagagaggcct

SEQ ID NO: 8143339 - DNA, 22 bp, Homo sapiens
cagctggttatcagagaggcct

SEQ ID NO: 8143340 - DNA, 22 bp, Homo sapiens
cagctggtgtccagggaagtgg

SEQ ID NO: 8143341 - DNA, 22 bp, Homo sapiens
cagctggtgtcaggcactgcag

SEQ ID NO: 8143342 - DNA, 22 bp, Homo sapiens
cagctggtgtcaggcactgcag

SEQ ID NO: 8143343 - DNA, 22 bp, Homo sapiens
cagctgtccaaacacattaact

SEQ ID NO: 8143344 - DNA, 22 bp, Homo sapiens
cagctgtcagccggtgcaggct

SEQ ID NO: 8143345 - DNA, 22 bp, Homo sapiens
cagctgtccttcctggtgggcg

SEQ ID NO: 8143346 - DNA, 22 bp, Homo sapiens
cagctgtgtctaattatggctg

SEQ ID NO: 8143347 - DNA, 22 bp, Homo sapiens
cagctgttactctgagtaaatg

SEQ ID NO: 8143348 - DNA, 22 bp, Homo sapiens
cagctgtgtctaattatggctg

SEQ ID NO: 8143349 - DNA, 22 bp, Homo sapiens
cagctgttcggggctggcatgt

SEQ ID NO: 8143350 - DNA, 22 bp, Homo sapiens
cagctgttcacatttccaaaac

SEQ ID NO: 8143351 - DNA, 22 bp, Homo sapiens
cagctgttcttgggacagacag

SEQ ID NO: 8143352 - DNA, 22 bp, Homo sapiens
caggacctaactcacctgtctc

SEQ ID NO: 8143353 - DNA, 22 bp, Homo sapiens
caggacagctcaacacctcctc

SEQ ID NO: 8143354 - DNA, 22 bp, Homo sapiens
caggactcacttctcacatccc

SEQ ID NO: 8143355 - DNA, 22 bp, Homo sapiens
caggactcacttctcacatccc

SEQ ID NO: 8143356 - DNA, 22 bp, Homo sapiens
caggactcttgtcatcatcagt

SEQ ID NO: 8143357 - DNA, 22 bp, Homo sapiens
caggacctggaatgcttgtgaa

SEQ ID NO: 8143358 - DNA, 22 bp, Homo sapiens
caggacgggcaaacaggatggt

SEQ ID NO: 8143359 - DNA, 22 bp, Homo sapiens
caggagaaacataattttctgg

SEQ ID NO: 8143360 - DNA, 22 bp, Homo sapiens
caggagaaacataattttctgg

SEQ ID NO: 8143361 - DNA, 22 bp, Homo sapiens
caggacttattatagcattata

SEQ ID NO: 8143362 - DNA, 21 bp, Homo sapiens
caggactttcctccaaagtta

SEQ ID NO: 8143363 - DNA, 22 bp, Homo sapiens
caggactggctcgcagtgggtg

SEQ ID NO: 8143364 - DNA, 22 bp, Homo sapiens
caggactgtatccttggagaaa

SEQ ID NO: 8143365 - DNA, 22 bp, Homo sapiens
caggagcaaggagcagtgggat

SEQ ID NO: 8143366 - DNA, 22 bp, Homo sapiens
caggagaaatgtggctgctacc

SEQ ID NO: 8143367 - DNA, 22 bp, Homo sapiens
caggagaaggtttggagtgcag

SEQ ID NO: 8143368 - DNA, 22 bp, Homo sapiens
caggactgaagggcacagggaa

SEQ ID NO: 8143369 - DNA, 22 bp, Homo sapiens
caggactgaagggcacagggaa

SEQ ID NO: 8143370 - DNA, 22 bp, Homo sapiens
caggactgatgttcctccagcc

SEQ ID NO: 8143371 - DNA, 22 bp, Homo sapiens
caggactgatgttcctccagcc

SEQ ID NO: 8143372 - DNA, 22 bp, Homo sapiens
caggactgatgttcctccagcc

SEQ ID NO: 8143373 - DNA, 22 bp, Homo sapiens
caggactgaagggcacagggaa

SEQ ID NO: 8143374 - DNA, 22 bp, Homo sapiens
caggactggctcgcagtgggtg

SEQ ID NO: 8143375 - DNA, 22 bp, Homo sapiens
caggactggaagtctcaagaga

SEQ ID NO: 8143376 - DNA, 22 bp, Homo sapiens
caggactggctcgcagtgggtg

SEQ ID NO: 8143377 - DNA, 22 bp, Homo sapiens
caggactggctcgcagtgggtg

SEQ ID NO: 8143378 - DNA, 22 bp, Homo sapiens
caggatgggatgtagtgggccc

SEQ ID NO: 8143379 - DNA, 22 bp, Homo sapiens
caggatgggatgtagtgggccc

SEQ ID NO: 8143380 - DNA, 22 bp, Homo sapiens
caggatgggtgtcggccagcac

SEQ ID NO: 8143381 - DNA, 22 bp, Homo sapiens
caggatgggtgtcggccagcac

SEQ ID NO: 8143382 - DNA, 22 bp, Homo sapiens
caggatgggatgtagtgggccc

SEQ ID NO: 8143383 - DNA, 22 bp, Homo sapiens
caggatgggatgtagtgggccc

SEQ ID NO: 8143384 - DNA, 22 bp, Homo sapiens
caggatgggatgtagtgggccc

SEQ ID NO: 8143385 - DNA, 22 bp, Homo sapiens
caggatggccccggggctgtgc

SEQ ID NO: 8143386 - DNA, 22 bp, Homo sapiens
caggcacaattatttccctttc

SEQ ID NO: 8143387 - DNA, 22 bp, Homo sapiens
caggcacaattatttccctttc

SEQ ID NO: 8143388 - DNA, 22 bp, Homo sapiens
caggcacacagcacatggcctg

SEQ ID NO: 8143389 - DNA, 22 bp, Homo sapiens
caggcacacagcacatggcctg

SEQ ID NO: 8143390 - DNA, 22 bp, Homo sapiens
caggcacacagcacatggcctg

SEQ ID NO: 8143391 - DNA, 22 bp, Homo sapiens
caggatggtcagatgcattgtc

SEQ ID NO: 8143392 - DNA, 22 bp, Homo sapiens
caggatggtcagatgcattgtc

SEQ ID NO: 8143393 - DNA, 22 bp, Homo sapiens
caggatggtcagatgcattgtc

SEQ ID NO: 8143394 - DNA, 22 bp, Homo sapiens
caggatgggtgtcggccagcac

SEQ ID NO: 8143395 - DNA, 22 bp, Homo sapiens
caggatgggtgtcggccagcac

SEQ ID NO: 8143396 - DNA, 22 bp, Homo sapiens
caggatgggtgtcggccagcac

SEQ ID NO: 8143397 - DNA, 22 bp, Homo sapiens
caggatgggtgtcggccagcac

SEQ ID NO: 8143398 - DNA, 20 bp, Homo sapiens
caggcacactcattcctgct

SEQ ID NO: 8143399 - DNA, 22 bp, Homo sapiens
caggcagagtgaggtggtctaa

SEQ ID NO: 8143400 - DNA, 20 bp, Homo sapiens
caggcacactcattcctgct

SEQ ID NO: 8143401 - DNA, 22 bp, Homo sapiens
caggcacacccactggtgcaga

SEQ ID NO: 8143402 - DNA, 22 bp, Homo sapiens
caggcacacccactggtgcaga

SEQ ID NO: 8143403 - DNA, 22 bp, Homo sapiens
caggcacacccactggtgcaga

SEQ ID NO: 8143404 - DNA, 22 bp, Homo sapiens
caggcacacaggctccctgggc

SEQ ID NO: 8143405 - DNA, 22 bp, Homo sapiens
caggcacacaggctccctgggc

SEQ ID NO: 8143406 - DNA, 22 bp, Homo sapiens
caggcacacaggctccctgggc

SEQ ID NO: 8143407 - DNA, 22 bp, Homo sapiens
caggcacacagcacatggcctg

SEQ ID NO: 8143408 - DNA, 22 bp, Homo sapiens
caggcacacatccgtgagagat

SEQ ID NO: 8143409 - DNA, 22 bp, Homo sapiens
caggcacacatccgtgagagat

SEQ ID NO: 8143410 - DNA, 22 bp, Homo sapiens
caggcacacatccgtgagagat

SEQ ID NO: 8143411 - DNA, 22 bp, Homo sapiens
caggcacacatccgtgagagat

SEQ ID NO: 8143412 - DNA, 22 bp, Homo sapiens
caggcacacatccgtgagagat

SEQ ID NO: 8143413 - DNA, 22 bp, Homo sapiens
caggagcagagggtggtcagca

SEQ ID NO: 8143414 - DNA, 22 bp, Homo sapiens
caggagcaaggagcagtgggat

SEQ ID NO: 8143415 - DNA, 22 bp, Homo sapiens
caggagcagagggtggtcagca

SEQ ID NO: 8143416 - DNA, 22 bp, Homo sapiens
caggagcagagggtggtcagca

SEQ ID NO: 8143417 - DNA, 22 bp, Homo sapiens
caggagcagagggtggtcagca

SEQ ID NO: 8143418 - DNA, 18 bp, Homo sapiens
caggagcaggagttgaac

SEQ ID NO: 8143419 - DNA, 22 bp, Homo sapiens
caggagcaggcccaaggacaca

SEQ ID NO: 8143420 - DNA, 22 bp, Homo sapiens
caggagcaggcccaaggacaca

SEQ ID NO: 8143421 - DNA, 18 bp, Homo sapiens
caggagcaggagttgaac

SEQ ID NO: 8143422 - DNA, 22 bp, Homo sapiens
caggagccacattccaccttga

SEQ ID NO: 8143423 - DNA, 22 bp, Homo sapiens
caggagccacattccaccttga

SEQ ID NO: 8143424 - DNA, 22 bp, Homo sapiens
caggagcaggcccaaggacaca

SEQ ID NO: 8143425 - DNA, 22 bp, Homo sapiens
caggagcaggcccaaggacaca

SEQ ID NO: 8143426 - DNA, 22 bp, Homo sapiens
caggagcatgctgatgccagaa

SEQ ID NO: 8143427 - DNA, 22 bp, Homo sapiens
caggagcatgctgatgccagaa

SEQ ID NO: 8143428 - DNA, 22 bp, Homo sapiens
caggatggagagtgaggggtca

SEQ ID NO: 8143429 - DNA, 22 bp, Homo sapiens
caggagtctgttcctcatttgt

SEQ ID NO: 8143430 - DNA, 22 bp, Homo sapiens
caggagtgaaatgaggcccagg

SEQ ID NO: 8143431 - DNA, 22 bp, Homo sapiens
caggagccagctgtcccaacca

SEQ ID NO: 8143432 - DNA, 22 bp, Homo sapiens
caggagcccagagtcctcagct

SEQ ID NO: 8143433 - DNA, 22 bp, Homo sapiens
caggagcccagagtcctcagct

SEQ ID NO: 8143434 - DNA, 22 bp, Homo sapiens
caggagcccagagtcctcagct

SEQ ID NO: 8143435 - DNA, 22 bp, Homo sapiens
caggatggccccggggctgtgc

SEQ ID NO: 8143436 - DNA, 22 bp, Homo sapiens
caggatggccccggggctgtgc

SEQ ID NO: 8143437 - DNA, 22 bp, Homo sapiens
caggatggccccggggctgtgc

SEQ ID NO: 8143438 - DNA, 22 bp, Homo sapiens
caggatggcagagaaaagggtg

SEQ ID NO: 8143439 - DNA, 22 bp, Homo sapiens
caggatggcagagaaaagggtg

SEQ ID NO: 8143440 - DNA, 22 bp, Homo sapiens
caggatggagagttgttggttg

SEQ ID NO: 8143441 - DNA, 22 bp, Homo sapiens
caggatggagagttgttggttg

SEQ ID NO: 8143442 - DNA, 22 bp, Homo sapiens
caggatggagggagggctgtta

SEQ ID NO: 8143443 - DNA, 22 bp, Homo sapiens
caggatggagggagggctgtta

SEQ ID NO: 8143444 - DNA, 22 bp, Homo sapiens
caggatggagggagggctgtta

SEQ ID NO: 8143445 - DNA, 22 bp, Homo sapiens
caggatggagggagggctgtta

SEQ ID NO: 8143446 - DNA, 22 bp, Homo sapiens
caggcaggtcagtgaagaagga

SEQ ID NO: 8143447 - DNA, 22 bp, Homo sapiens
caggcagggagctggaaaggat

SEQ ID NO: 8143448 - DNA, 22 bp, Homo sapiens
caggcagggagctggaaaggat

SEQ ID NO: 8143449 - DNA, 22 bp, Homo sapiens
caggcaggtcagtgaagaagga

SEQ ID NO: 8143450 - DNA, 22 bp, Homo sapiens
caggcaggtcagtgaagaagga

SEQ ID NO: 8143451 - DNA, 22 bp, Homo sapiens
caggcaggtcagtgaagaagga

SEQ ID NO: 8143452 - DNA, 22 bp, Homo sapiens
caggcaggtcagtgaagaagga

SEQ ID NO: 8143453 - DNA, 22 bp, Homo sapiens
caggcagctcaaccttgggagc

SEQ ID NO: 8143454 - DNA, 22 bp, Homo sapiens
caggcagctagatttataacaa

SEQ ID NO: 8143455 - DNA, 22 bp, Homo sapiens
caggcagctcaaccttgggagc

SEQ ID NO: 8143456 - DNA, 22 bp, Homo sapiens
caggcagctcaaccttgggagc

SEQ ID NO: 8143457 - DNA, 22 bp, Homo sapiens
caggcagctcaaccttgggagc

SEQ ID NO: 8143458 - DNA, 22 bp, Homo sapiens
caggcagctcgatgccttgttg

SEQ ID NO: 8143459 - DNA, 22 bp, Homo sapiens
caggcagctcgatgccttgttg

SEQ ID NO: 8143460 - DNA, 22 bp, Homo sapiens
caggcagggagctggaaaggat

SEQ ID NO: 8143461 - DNA, 22 bp, Homo sapiens
caggcagctcgatgccttgttg

SEQ ID NO: 8143462 - DNA, 22 bp, Homo sapiens
caggcagcgtcctgcttcctgt

SEQ ID NO: 8143463 - DNA, 22 bp, Homo sapiens
caggcagcgctcgtggcctggc

SEQ ID NO: 8143464 - DNA, 22 bp, Homo sapiens
caggcagcgctcgtggcctggc

SEQ ID NO: 8143465 - DNA, 22 bp, Homo sapiens
caggcagcgctcgtggcctggc

SEQ ID NO: 8143466 - DNA, 22 bp, Homo sapiens
caggcagcgctcgtggcctggc

SEQ ID NO: 8143467 - DNA, 22 bp, Homo sapiens
caggcagcgtcctgcttcctgt

SEQ ID NO: 8143468 - DNA, 22 bp, Homo sapiens
caggcagcgtcctgcttcctgt

SEQ ID NO: 8143469 - DNA, 22 bp, Homo sapiens
caggcagcgtcctgcttcctgt

SEQ ID NO: 8143470 - DNA, 22 bp, Homo sapiens
caggcagcgtcctgcttcctgt

SEQ ID NO: 8143471 - DNA, 22 bp, Homo sapiens
caggcagcgtcctgcttcctgt

SEQ ID NO: 8143472 - DNA, 22 bp, Homo sapiens
caggcagcgctcgtggcctggc

SEQ ID NO: 8143473 - DNA, 22 bp, Homo sapiens
caggcagcgctcgtggcctggc

SEQ ID NO: 8143474 - DNA, 22 bp, Homo sapiens
caggcagagtgaggtggtctaa

SEQ ID NO: 8143475 - DNA, 22 bp, Homo sapiens
caggcagcctgcggtctgcaca

SEQ ID NO: 8143476 - DNA, 22 bp, Homo sapiens
caggcagcctgcggtctgcaca

SEQ ID NO: 8143477 - DNA, 22 bp, Homo sapiens
caggcaggtgcagattcctctt

SEQ ID NO: 8143478 - DNA, 22 bp, Homo sapiens
caggcaggtgcagattcctctt

SEQ ID NO: 8143479 - DNA, 22 bp, Homo sapiens
caggcaggtgcagattcctctt

SEQ ID NO: 8143480 - DNA, 22 bp, Homo sapiens
caggcagtggctcacagcaacc

SEQ ID NO: 8143481 - DNA, 22 bp, Homo sapiens
caggcaggtgcagattcctctt

SEQ ID NO: 8143482 - DNA, 22 bp, Homo sapiens
caggcaggtgcagattcctctt

SEQ ID NO: 8143483 - DNA, 22 bp, Homo sapiens
caggcaggtgcagattcctctt

SEQ ID NO: 8143484 - DNA, 22 bp, Homo sapiens
caggcaggtcagtgaagaagga

SEQ ID NO: 8143485 - DNA, 22 bp, Homo sapiens
caggcaggtgcagattcctctt

SEQ ID NO: 8143486 - DNA, 22 bp, Homo sapiens
caggcaggtcagtgaagaagga

SEQ ID NO: 8143487 - DNA, 22 bp, Homo sapiens
caggcagtgtcccaggaagcca

SEQ ID NO: 8143488 - DNA, 22 bp, Homo sapiens
caggcagtgtcccaggaagcca

SEQ ID NO: 8143489 - DNA, 22 bp, Homo sapiens
caggcagtgtcccaggaagcca

SEQ ID NO: 8143490 - DNA, 22 bp, Homo sapiens
caggcagtgtgacgctagggtt

SEQ ID NO: 8143491 - DNA, 22 bp, Homo sapiens
agctggtggaagggagcccaaa

SEQ ID NO: 8143492 - DNA, 22 bp, Homo sapiens
agctggttcatggactgcctgg

SEQ ID NO: 8143493 - DNA, 20 bp, Homo sapiens
caggcagtttgtggttaggg

SEQ ID NO: 8143494 - DNA, 22 bp, Homo sapiens
agctgtctctctggtgtccata

SEQ ID NO: 8143495 - DNA, 22 bp, Homo sapiens
agctgtctccagatacaggatt

SEQ ID NO: 8143496 - DNA, 22 bp, Homo sapiens
agctgtctacctgcagagtcct

SEQ ID NO: 8143497 - DNA, 22 bp, Homo sapiens
agctgtctacctgcagagtcct

SEQ ID NO: 8143498 - DNA, 22 bp, Homo sapiens
agctgtcctggctcaggctgtg

SEQ ID NO: 8143499 - DNA, 22 bp, Homo sapiens
agctgtcaggcagaactgagct

SEQ ID NO: 8143500 - DNA, 22 bp, Homo sapiens
agctgtcaggcagaactgagct

SEQ ID NO: 8143501 - DNA, 22 bp, Homo sapiens
agctgtcagtgctgtgcctgta

SEQ ID NO: 8143502 - DNA, 22 bp, Homo sapiens
agctgtcctggctcaggctgtg

SEQ ID NO: 8143503 - DNA, 22 bp, Homo sapiens
agctgtcaggcagaactgagct

SEQ ID NO: 8143504 - DNA, 22 bp, Homo sapiens
agctggtttggggtagaggaca

SEQ ID NO: 8143505 - DNA, 22 bp, Homo sapiens
agctggtttgcaagtataatca

SEQ ID NO: 8143506 - DNA, 22 bp, Homo sapiens
agctggtttaggaaaaggtagg

SEQ ID NO: 8143507 - DNA, 23 bp, Homo sapiens
agctggtttcaatgtgttatttc

SEQ ID NO: 8143508 - DNA, 22 bp, Homo sapiens
caggcccatgagggcagccaca

SEQ ID NO: 8143509 - DNA, 22 bp, Homo sapiens
caggcccatctgctcccaggct

SEQ ID NO: 8143510 - DNA, 22 bp, Homo sapiens
caggcccatctgctcccaggct

SEQ ID NO: 8143511 - DNA, 22 bp, Homo sapiens
caggcccatctgctcccaggct

SEQ ID NO: 8143512 - DNA, 22 bp, Homo sapiens
caggcccatgagggcagccaca

SEQ ID NO: 8143513 - DNA, 22 bp, Homo sapiens
caggcccatgagggcagccaca

SEQ ID NO: 8143514 - DNA, 22 bp, Homo sapiens
caggcccatgagggcagccaca

SEQ ID NO: 8143515 - DNA, 22 bp, Homo sapiens
caggcccattctaggcttgcta

SEQ ID NO: 8143516 - DNA, 22 bp, Homo sapiens
caggcccattctaggcttgcta

SEQ ID NO: 8143517 - DNA, 22 bp, Homo sapiens
agcttccattaactgctacact

SEQ ID NO: 8143518 - DNA, 22 bp, Homo sapiens
caggcccatttgtagccacttt

SEQ ID NO: 8143519 - DNA, 22 bp, Homo sapiens
caggcccatttgtagccacttt

SEQ ID NO: 8143520 - DNA, 22 bp, Homo sapiens
caggcccatttgtagccacttt

SEQ ID NO: 8143521 - DNA, 22 bp, Homo sapiens
caggcccagtgatcagggctct

SEQ ID NO: 8143522 - DNA, 22 bp, Homo sapiens
caggcccataatgcaaatattt

SEQ ID NO: 8143523 - DNA, 22 bp, Homo sapiens
caggcccatctgctcccaggct

SEQ ID NO: 8143524 - DNA, 22 bp, Homo sapiens
caggcccataatgcaaatattt

SEQ ID NO: 8143525 - DNA, 22 bp, Homo sapiens
caggcccagtgatcagggctct

SEQ ID NO: 8143526 - DNA, 22 bp, Homo sapiens
caggcccagtgatcagggctct

SEQ ID NO: 8143527 - DNA, 22 bp, Homo sapiens
caggcccagggttattgggaaa

SEQ ID NO: 8143528 - DNA, 22 bp, Homo sapiens
caggcccagggttattgggaaa

SEQ ID NO: 8143529 - DNA, 22 bp, Homo sapiens
caggcccaggtgtcgatgttcc

SEQ ID NO: 8143530 - DNA, 22 bp, Homo sapiens
agctgtctgtctcctgaggaga

SEQ ID NO: 8143531 - DNA, 22 bp, Homo sapiens
agctgtctgtctcctgaggaga

SEQ ID NO: 8143532 - DNA, 22 bp, Homo sapiens
agctgtctgtctcctgaggaga

SEQ ID NO: 8143533 - DNA, 22 bp, Homo sapiens
agctgtctggaagttcctcatg

SEQ ID NO: 8143534 - DNA, 22 bp, Homo sapiens
agctgtctttaagtgagctttg

SEQ ID NO: 8143535 - DNA, 22 bp, Homo sapiens
agcttctagcccatccagcagg

SEQ ID NO: 8143536 - DNA, 22 bp, Homo sapiens
agcttctcagatggactgttag

SEQ ID NO: 8143537 - DNA, 22 bp, Homo sapiens
agcttctcagaagagtcctgta

SEQ ID NO: 8143538 - DNA, 21 bp, Homo sapiens
caggctctgctagaggagcct

SEQ ID NO: 8143539 - DNA, 21 bp, Homo sapiens
caggctctgctagaggagcct

SEQ ID NO: 8143540 - DNA, 21 bp, Homo sapiens
caggctctgctagaggagcct

SEQ ID NO: 8143541 - DNA, 22 bp, Homo sapiens
caggctctgctgctacagctgt

SEQ ID NO: 8143542 - DNA, 21 bp, Homo sapiens
caggctctgctgggtgctggg

SEQ ID NO: 8143543 - DNA, 22 bp, Homo sapiens
caggctctgctgctacagctgt

SEQ ID NO: 8143544 - DNA, 21 bp, Homo sapiens
caggctctgctgggtgctggg

SEQ ID NO: 8143545 - DNA, 21 bp, Homo sapiens
caggctctgctgggtgctggg

SEQ ID NO: 8143546 - DNA, 22 bp, Homo sapiens
caggctctgctgctacagctgt

SEQ ID NO: 8143547 - DNA, 21 bp, Homo sapiens
caggctctgctgggtgctggg

SEQ ID NO: 8143548 - DNA, 22 bp, Homo sapiens
caggctcttccatcctgctgag

SEQ ID NO: 8143549 - DNA, 22 bp, Homo sapiens
caggctcttccatcctgctgag

SEQ ID NO: 8143550 - DNA, 22 bp, Homo sapiens
agcttcctgtcttctgcacaaa

SEQ ID NO: 8143551 - DNA, 22 bp, Homo sapiens
agcttcctgatgcaagagggct

SEQ ID NO: 8143552 - DNA, 22 bp, Homo sapiens
agcttcctgttgagagagggag

SEQ ID NO: 8143553 - DNA, 22 bp, Homo sapiens
agcttcccaggagaatcaggga

SEQ ID NO: 8143554 - DNA, 22 bp, Homo sapiens
agcttcccaggagaatcaggga

SEQ ID NO: 8143555 - DNA, 22 bp, Homo sapiens
agcttcccaggagaatcaggga

SEQ ID NO: 8143556 - DNA, 18 bp, Homo sapiens
agcttccctctgagaggg

SEQ ID NO: 8143557 - DNA, 22 bp, Homo sapiens
agcttcctacaaccatctcaga

SEQ ID NO: 8143558 - DNA, 22 bp, Homo sapiens
agggactatttacccatctcac

SEQ ID NO: 8143559 - DNA, 22 bp, Homo sapiens
agggacccatagagagaccagt

SEQ ID NO: 8143560 - DNA, 22 bp, Homo sapiens
agggacccatagagagaccagt

SEQ ID NO: 8143561 - DNA, 22 bp, Homo sapiens
cccaggccagaacttggttgct

SEQ ID NO: 8143562 - DNA, 22 bp, Homo sapiens
cccaggccagaacttggttgct

SEQ ID NO: 8143563 - DNA, 22 bp, Homo sapiens
cccaggccagaacttggttgct

SEQ ID NO: 8143564 - DNA, 22 bp, Homo sapiens
cccaggcattttcaactttagt

SEQ ID NO: 8143565 - DNA, 22 bp, Homo sapiens
agggactccctgggccgacacg

SEQ ID NO: 8143566 - DNA, 22 bp, Homo sapiens
agggactccgtgcacagtggtt

SEQ ID NO: 8143567 - DNA, 22 bp, Homo sapiens
cccaggccagaacttggttgct

SEQ ID NO: 8143568 - DNA, 22 bp, Homo sapiens
cccaggccagaacttggttgct

SEQ ID NO: 8143569 - DNA, 22 bp, Homo sapiens
cccaggccccagggcttgtcag

SEQ ID NO: 8143570 - DNA, 22 bp, Homo sapiens
cccaggccccagggcttgtcag

SEQ ID NO: 8143571 - DNA, 22 bp, Homo sapiens
cccaggccccagggcttgtcag

SEQ ID NO: 8143572 - DNA, 22 bp, Homo sapiens
cccaggccccagggcttgtcag

SEQ ID NO: 8143573 - DNA, 22 bp, Homo sapiens
agggacagttacatcatcagac

SEQ ID NO: 8143574 - DNA, 22 bp, Homo sapiens
agggacagttacatcatcagac

SEQ ID NO: 8143575 - DNA, 22 bp, Homo sapiens
agggacagttacatcatcagac

SEQ ID NO: 8143576 - DNA, 22 bp, Homo sapiens
agggaccacatcccctctgtgg

SEQ ID NO: 8143577 - DNA, 22 bp, Homo sapiens
agggacatgaggatgatctaga

SEQ ID NO: 8143578 - DNA, 22 bp, Homo sapiens
agggaatggatgatggcaggtt

SEQ ID NO: 8143579 - DNA, 22 bp, Homo sapiens
agggacagtctactgttcactg

SEQ ID NO: 8143580 - DNA, 22 bp, Homo sapiens
agggaatggatgatggcaggtt

SEQ ID NO: 8143581 - DNA, 22 bp, Homo sapiens
agggaatggatgatggcaggtt

SEQ ID NO: 8143582 - DNA, 22 bp, Homo sapiens
agggaatggatgatggcaggtt

SEQ ID NO: 8143583 - DNA, 22 bp, Homo sapiens
cccaggaatgagcaggcagggg

SEQ ID NO: 8143584 - DNA, 22 bp, Homo sapiens
agggacagtctactgttcactg

SEQ ID NO: 8143585 - DNA, 22 bp, Homo sapiens
agggacagttacatcatcagac

SEQ ID NO: 8143586 - DNA, 22 bp, Homo sapiens
agggacagtctactgttcactg

SEQ ID NO: 8143587 - DNA, 22 bp, Homo sapiens
agggagccttcctggctgtggt

SEQ ID NO: 8143588 - DNA, 22 bp, Homo sapiens
agggagccctgaaccagagggt

SEQ ID NO: 8143589 - DNA, 22 bp, Homo sapiens
agggagctgagctgtgagcagc

SEQ ID NO: 8143590 - DNA, 22 bp, Homo sapiens
agggagctgagagctactattt

SEQ ID NO: 8143591 - DNA, 22 bp, Homo sapiens
cccaggcctggtctgggccagt

SEQ ID NO: 8143592 - DNA, 22 bp, Homo sapiens
cccaggcctggtctgggccagt

SEQ ID NO: 8143593 - DNA, 22 bp, Homo sapiens
cccaggcctggtctgggccagt

SEQ ID NO: 8143594 - DNA, 22 bp, Homo sapiens
cccaggccctggcagagcttgt

SEQ ID NO: 8143595 - DNA, 22 bp, Homo sapiens
cccaggccctggcagagcttgt

SEQ ID NO: 8143596 - DNA, 22 bp, Homo sapiens
cccaggccccagggcttgtcag

SEQ ID NO: 8143597 - DNA, 22 bp, Homo sapiens
cccaggccctggcagagcttgt

SEQ ID NO: 8143598 - DNA, 22 bp, Homo sapiens
cccaggccctggcagagcttgt

SEQ ID NO: 8143599 - DNA, 17 bp, Homo sapiens
cccaggccgccgggagc

SEQ ID NO: 8143600 - DNA, 17 bp, Homo sapiens
cccaggccgccgggagc

SEQ ID NO: 8143601 - DNA, 17 bp, Homo sapiens
cccaggccgccgggagc

SEQ ID NO: 8143602 - DNA, 21 bp, Homo sapiens
agggagctggccacacagcct

SEQ ID NO: 8143603 - DNA, 22 bp, Homo sapiens
agggagctgctctgcttccgtg

SEQ ID NO: 8143604 - DNA, 22 bp, Homo sapiens
agggagctgagctgtgagcagc

SEQ ID NO: 8143605 - DNA, 21 bp, Homo sapiens
agggagctgcgtcttgaaaga

SEQ ID NO: 8143606 - DNA, 21 bp, Homo sapiens
agggagctggccacacagcct

SEQ ID NO: 8143607 - DNA, 22 bp, Homo sapiens
agggagctggtatttataatga

SEQ ID NO: 8143608 - DNA, 22 bp, Homo sapiens
agggagctgggccacactgatc

SEQ ID NO: 8143609 - DNA, 22 bp, Homo sapiens
agggagcttccgaactacagct

SEQ ID NO: 8143610 - DNA, 22 bp, Homo sapiens
agggagcttctacttcaaggca

SEQ ID NO: 8143611 - DNA, 22 bp, Homo sapiens
agggagcttctggcctcagcct

SEQ ID NO: 8143612 - DNA, 22 bp, Homo sapiens
agggagcttctggcctcagcct

SEQ ID NO: 8143613 - DNA, 22 bp, Homo sapiens
agggagcttctggcctcagcct

SEQ ID NO: 8143614 - DNA, 22 bp, Homo sapiens
agggagcttctggcctcagcct

SEQ ID NO: 8143615 - DNA, 22 bp, Homo sapiens
agggagctgtggtcagctcagt

SEQ ID NO: 8143616 - DNA, 22 bp, Homo sapiens
agggagctgtggtcagctcagt

SEQ ID NO: 8143617 - DNA, 22 bp, Homo sapiens
agggagctgtggtcagctcagt

SEQ ID NO: 8143618 - DNA, 22 bp, Homo sapiens
agggagcttccgaactacagct

SEQ ID NO: 8143619 - DNA, 22 bp, Homo sapiens
agggagcttccgaactacagct

SEQ ID NO: 8143620 - DNA, 22 bp, Homo sapiens
agggagctgtggtcagctcagt

SEQ ID NO: 8143621 - DNA, 22 bp, Homo sapiens
agggaaataatctattctgagg

SEQ ID NO: 8143622 - DNA, 23 bp, Homo sapiens
agggaaagtagtaatggcctttg

SEQ ID NO: 8143623 - DNA, 23 bp, Homo sapiens
agggaaagtagtaatggcctttg

SEQ ID NO: 8143624 - DNA, 22 bp, Homo sapiens
agggaaagtaagcatttcatta

SEQ ID NO: 8143625 - DNA, 22 bp, Homo sapiens
agggaaagtaagcatttcatta

SEQ ID NO: 8143626 - DNA, 22 bp, Homo sapiens
cccaggaacagggctcagaccc

SEQ ID NO: 8143627 - DNA, 19 bp, Homo sapiens
cccaggaagcggaggttgc

SEQ ID NO: 8143628 - DNA, 19 bp, Homo sapiens
cccaggaagcggaggttgc

SEQ ID NO: 8143629 - DNA, 22 bp, Homo sapiens
cccaggaagggatgccaaggaa

SEQ ID NO: 8143630 - DNA, 22 bp, Homo sapiens
cccaggaagttgagactgcagt

SEQ ID NO: 8143631 - DNA, 22 bp, Homo sapiens
cccaggaagttgatgcagagga

SEQ ID NO: 8143632 - DNA, 22 bp, Homo sapiens
cccaggaagggatgccaaggaa

SEQ ID NO: 8143633 - DNA, 22 bp, Homo sapiens
cccaggaagggatgccaaggaa

SEQ ID NO: 8143634 - DNA, 22 bp, Homo sapiens
aggcttttgctctggctcctct

SEQ ID NO: 8143635 - DNA, 22 bp, Homo sapiens
agggaaaggtagtgaggtcaca

SEQ ID NO: 8143636 - DNA, 22 bp, Homo sapiens
agggaaaggtagtgaggtcaca

SEQ ID NO: 8143637 - DNA, 22 bp, Homo sapiens
agggaaaggtagtgaggtcaca

SEQ ID NO: 8143638 - DNA, 22 bp, Homo sapiens
agggaaaggctgatgctgtggg

SEQ ID NO: 8143639 - DNA, 21 bp, Homo sapiens
agggaaagaaaatgagctaat

SEQ ID NO: 8143640 - DNA, 21 bp, Homo sapiens
agggaaagaaaatgagctaat

SEQ ID NO: 8143641 - DNA, 22 bp, Homo sapiens
agggaaaggctgatgctgtggg

SEQ ID NO: 8143642 - DNA, 22 bp, Homo sapiens
cccagagttcaaaccctgcgtc

SEQ ID NO: 8143643 - DNA, 22 bp, Homo sapiens
cccagagtggagggtgcagaat

SEQ ID NO: 8143644 - DNA, 22 bp, Homo sapiens
aggcttggctggcagccctggg

SEQ ID NO: 8143645 - DNA, 22 bp, Homo sapiens
agggcagaaatattgatactgt

SEQ ID NO: 8143646 - DNA, 19 bp, Homo sapiens
cccaggtgtttgaggctgc

SEQ ID NO: 8143647 - DNA, 22 bp, Homo sapiens
cccaggtgtttgtggcagaggt

SEQ ID NO: 8143648 - DNA, 22 bp, Homo sapiens
cccagtaagaagctggcaccag

SEQ ID NO: 8143649 - DNA, 18 bp, Homo sapiens
cccaggttggcctacaga

SEQ ID NO: 8143650 - DNA, 18 bp, Homo sapiens
cccaggttggcctacaga

SEQ ID NO: 8143651 - DNA, 19 bp, Homo sapiens
cccaggtgtttgaggctgc

SEQ ID NO: 8143652 - DNA, 19 bp, Homo sapiens
cccaggtgtttgaggctgc

SEQ ID NO: 8143653 - DNA, 23 bp, Homo sapiens
cccaggtgtggaggcggtggcag

SEQ ID NO: 8143654 - DNA, 20 bp, Homo sapiens
cccaggtgtctgaagctctg

SEQ ID NO: 8143655 - DNA, 20 bp, Homo sapiens
cccaggtgtctgaagctctg

SEQ ID NO: 8143656 - DNA, 22 bp, Homo sapiens
cccaggtgggcacctcgaggaa

SEQ ID NO: 8143657 - DNA, 22 bp, Homo sapiens
cccaggtgggcacctcgaggaa

SEQ ID NO: 8143658 - DNA, 22 bp, Homo sapiens
cccaggtgggttggcctctgtc

SEQ ID NO: 8143659 - DNA, 22 bp, Homo sapiens
cccaggtgggttggcctctgtc

SEQ ID NO: 8143660 - DNA, 22 bp, Homo sapiens
cccaggtgggttggcctctgtc

SEQ ID NO: 8143661 - DNA, 22 bp, Homo sapiens
cccaggtgggcacctcgaggaa

SEQ ID NO: 8143662 - DNA, 22 bp, Homo sapiens
cccaggtgctgcgtgaagcctc

SEQ ID NO: 8143663 - DNA, 22 bp, Homo sapiens
cccaggtggcagaagctgcagt

SEQ ID NO: 8143664 - DNA, 21 bp, Homo sapiens
cccaggtgggatggttgcctc

SEQ ID NO: 8143665 - DNA, 22 bp, Homo sapiens
cccaggtggcagaagctgcagt

SEQ ID NO: 8143666 - DNA, 22 bp, Homo sapiens
cccaggtggcagaagctgcagt

SEQ ID NO: 8143667 - DNA, 22 bp, Homo sapiens
cccaggtggcagaagctgcagt

SEQ ID NO: 8143668 - DNA, 22 bp, Homo sapiens
cccaggtgctgcgtgaagcctc

SEQ ID NO: 8143669 - DNA, 22 bp, Homo sapiens
cccaggtgctgaaggaggccgc

SEQ ID NO: 8143670 - DNA, 22 bp, Homo sapiens
cccaggtgctgaaggaggccgc

SEQ ID NO: 8143671 - DNA, 22 bp, Homo sapiens
agggagctttcaggtagcttaa

SEQ ID NO: 8143672 - DNA, 22 bp, Homo sapiens
cccaggtctgtgccagctctga

SEQ ID NO: 8143673 - DNA, 22 bp, Homo sapiens
agggagctttaccccagatcac

SEQ ID NO: 8143674 - DNA, 22 bp, Homo sapiens
agggagctttaccccagatcac

SEQ ID NO: 8143675 - DNA, 22 bp, Homo sapiens
agggagctttaccccagatcac

SEQ ID NO: 8143676 - DNA, 22 bp, Homo sapiens
agggagcttgtgtttcttttag

SEQ ID NO: 8143677 - DNA, 21 bp, Homo sapiens
agggagctttaggtagaagtt

SEQ ID NO: 8143678 - DNA, 22 bp, Homo sapiens
cccctgctggcctgctggtttc

SEQ ID NO: 8143679 - DNA, 21 bp, Homo sapiens
cccctgggagccctgtcagta

SEQ ID NO: 8143680 - DNA, 22 bp, Homo sapiens
cccctgctggtcgaaacaattt

SEQ ID NO: 8143681 - DNA, 21 bp, Homo sapiens
cccctgggagccctgtcagta

SEQ ID NO: 8143682 - DNA, 21 bp, Homo sapiens
cccctgggagccctgtcagta

SEQ ID NO: 8143683 - DNA, 21 bp, Homo sapiens
cccctgggagccctgtcagta

SEQ ID NO: 8143684 - DNA, 21 bp, Homo sapiens
cccctgggagccctgtcagta

SEQ ID NO: 8143685 - DNA, 22 bp, Homo sapiens
agggcagagaaatgtagttgag

SEQ ID NO: 8143686 - DNA, 22 bp, Homo sapiens
agggcagagaaatgtagttgag

SEQ ID NO: 8143687 - DNA, 22 bp, Homo sapiens
cccctgccagctatccctgaac

SEQ ID NO: 8143688 - DNA, 22 bp, Homo sapiens
cccctgccagctatccctgaac

SEQ ID NO: 8143689 - DNA, 22 bp, Homo sapiens
agggcagaagtacagacactta

SEQ ID NO: 8143690 - DNA, 22 bp, Homo sapiens
agggcagaccacgtgcaaggat

SEQ ID NO: 8143691 - DNA, 22 bp, Homo sapiens
agggcagactaggatggaagtg

SEQ ID NO: 8143692 - DNA, 22 bp, Homo sapiens
cccctgggtccaggcttctctg

SEQ ID NO: 8143693 - DNA, 22 bp, Homo sapiens
cccctgggtccaggcttctctg

SEQ ID NO: 8143694 - DNA, 22 bp, Homo sapiens
cccctggggatcagctggaatt

SEQ ID NO: 8143695 - DNA, 22 bp, Homo sapiens
cccctggggatcagctggaatt

SEQ ID NO: 8143696 - DNA, 22 bp, Homo sapiens
agggcagctgtgagccactgtg

SEQ ID NO: 8143697 - DNA, 22 bp, Homo sapiens
agggcatgctggaggagagaca

SEQ ID NO: 8143698 - DNA, 22 bp, Homo sapiens
agggcatgtgggagaggagcct

SEQ ID NO: 8143699 - DNA, 22 bp, Homo sapiens
agggcatgtgggagaggagcct

SEQ ID NO: 8143700 - DNA, 22 bp, Homo sapiens
agggcatggggttaacctggga

SEQ ID NO: 8143701 - DNA, 22 bp, Homo sapiens
agggcatgtgggagaggagcct

SEQ ID NO: 8143702 - DNA, 22 bp, Homo sapiens
agggcatgtgggagaggagcct

SEQ ID NO: 8143703 - DNA, 22 bp, Homo sapiens
ccctgaggatagggcaggaccc

SEQ ID NO: 8143704 - DNA, 22 bp, Homo sapiens
ccctgaggatagggcaggaccc

SEQ ID NO: 8143705 - DNA, 22 bp, Homo sapiens
agggccacctctctgggttccc

SEQ ID NO: 8143706 - DNA, 22 bp, Homo sapiens
agggccaccagggagtctcagg

SEQ ID NO: 8143707 - DNA, 23 bp, Homo sapiens
agggccactgggaaggattactg

SEQ ID NO: 8143708 - DNA, 19 bp, Homo sapiens
agggccacggggaggtatt

SEQ ID NO: 8143709 - DNA, 22 bp, Homo sapiens
agggccacagtggggcctgaga

SEQ ID NO: 8143710 - DNA, 22 bp, Homo sapiens
agggccaccagagcagggcagt

SEQ ID NO: 8143711 - DNA, 22 bp, Homo sapiens
agggccaccagagcagggcagt

SEQ ID NO: 8143712 - DNA, 22 bp, Homo sapiens
agggccaccagagcagggcagt

SEQ ID NO: 8143713 - DNA, 22 bp, Homo sapiens
agggccaccagagcagggcagt

SEQ ID NO: 8143714 - DNA, 22 bp, Homo sapiens
agggccaccagggagtctcagg

SEQ ID NO: 8143715 - DNA, 23 bp, Homo sapiens
agggcccaagcctggacagcagg

SEQ ID NO: 8143716 - DNA, 22 bp, Homo sapiens
agggcccacagttcctatggcc

SEQ ID NO: 8143717 - DNA, 22 bp, Homo sapiens
agggccagggaagctgtatttt

SEQ ID NO: 8143718 - DNA, 23 bp, Homo sapiens
agggccaggtgcggaaacagctc

SEQ ID NO: 8143719 - DNA, 23 bp, Homo sapiens
agggccaggtgcggaaacagctc

SEQ ID NO: 8143720 - DNA, 22 bp, Homo sapiens
agggcccagcccttgctggtct

SEQ ID NO: 8143721 - DNA, 22 bp, Homo sapiens
agggcccaggacagcatcaggg

SEQ ID NO: 8143722 - DNA, 22 bp, Homo sapiens
agggcccaccttggtgctgagg

SEQ ID NO: 8143723 - DNA, 22 bp, Homo sapiens
ccctgaggcagtaggagctttt

SEQ ID NO: 8143724 - DNA, 22 bp, Homo sapiens
ccctgagtcatcattgcggaag

SEQ ID NO: 8143725 - DNA, 22 bp, Homo sapiens
ccctgagtcatcattgcggaag

SEQ ID NO: 8143726 - DNA, 22 bp, Homo sapiens
ccctgagttagtacagttgagt

SEQ ID NO: 8143727 - DNA, 22 bp, Homo sapiens
ccctgaggggagtggtgaggtg

SEQ ID NO: 8143728 - DNA, 22 bp, Homo sapiens
ccctgaggctgaggataggtgg

SEQ ID NO: 8143729 - DNA, 22 bp, Homo sapiens
agggcctgtgctgagtagacga

SEQ ID NO: 8143730 - DNA, 21 bp, Homo sapiens
agggcctgtgctctccaggtc

SEQ ID NO: 8143731 - DNA, 21 bp, Homo sapiens
agggcctgtgctctccaggtc

SEQ ID NO: 8143732 - DNA, 21 bp, Homo sapiens
agggcctgtgctctccaggtc

SEQ ID NO: 8143733 - DNA, 21 bp, Homo sapiens
agggcctgtgctctccaggtc

SEQ ID NO: 8143734 - DNA, 21 bp, Homo sapiens
agggcctgtgctctccaggtc

SEQ ID NO: 8143735 - DNA, 22 bp, Homo sapiens
agggcctgtgaattctccctgc

SEQ ID NO: 8143736 - DNA, 22 bp, Homo sapiens
agggcctgtgaattctccctgc

SEQ ID NO: 8143737 - DNA, 22 bp, Homo sapiens
agggcctgtgaattctccctgc

SEQ ID NO: 8143738 - DNA, 22 bp, Homo sapiens
agggcctgtctgtagaactgaa

SEQ ID NO: 8143739 - DNA, 21 bp, Homo sapiens
agggcctgtgctctccaggtc

SEQ ID NO: 8143740 - DNA, 22 bp, Homo sapiens
agggcctgtctgtagaactgaa

SEQ ID NO: 8143741 - DNA, 22 bp, Homo sapiens
agggcctgtccgctcccgcccg

SEQ ID NO: 8143742 - DNA, 22 bp, Homo sapiens
agggcctgtctgtagaactgaa

SEQ ID NO: 8143743 - DNA, 22 bp, Homo sapiens
agggcctgtctgtagaactgaa

SEQ ID NO: 8143744 - DNA, 22 bp, Homo sapiens
agggcctgtctgtagaactgaa

SEQ ID NO: 8143745 - DNA, 22 bp, Homo sapiens
agggcctgggaagaggaaccct

SEQ ID NO: 8143746 - DNA, 22 bp, Homo sapiens
agggcctgtcagcggtgtcctg

SEQ ID NO: 8143747 - DNA, 22 bp, Homo sapiens
cctaagtaagttgactttcaga

SEQ ID NO: 8143748 - DNA, 22 bp, Homo sapiens
cctaatttgattttaaatagcc

SEQ ID NO: 8143749 - DNA, 22 bp, Homo sapiens
cctacacatgaatgcgagaaat

SEQ ID NO: 8143750 - DNA, 22 bp, Homo sapiens
cctacaggaaattgtatcaaaa

SEQ ID NO: 8143751 - DNA, 22 bp, Homo sapiens
cctacagttatattcttgattg

SEQ ID NO: 8143752 - DNA, 22 bp, Homo sapiens
agggcctgtgcttcctgagata

SEQ ID NO: 8143753 - DNA, 22 bp, Homo sapiens
agggcctgtgctgagtagacga

SEQ ID NO: 8143754 - DNA, 22 bp, Homo sapiens
agggcctgtgcttcctgagata

SEQ ID NO: 8143755 - DNA, 22 bp, Homo sapiens
agggcctgtgctgagtagacga

SEQ ID NO: 8143756 - DNA, 22 bp, Homo sapiens
agggcctgtgctgagtagacga

SEQ ID NO: 8143757 - DNA, 20 bp, Homo sapiens
agggcctgttgcaagcgttt

SEQ ID NO: 8143758 - DNA, 20 bp, Homo sapiens
agggcctgttgcaagcgttt

SEQ ID NO: 8143759 - DNA, 20 bp, Homo sapiens
agggcctgttgcaagcgttt

SEQ ID NO: 8143760 - DNA, 22 bp, Homo sapiens
cctaaggaaagccaaagaggcc

SEQ ID NO: 8143761 - DNA, 22 bp, Homo sapiens
cctaaggtctcatgcagctttt

SEQ ID NO: 8143762 - DNA, 20 bp, Homo sapiens
agggcctgttgcaagcgttt

SEQ ID NO: 8143763 - DNA, 20 bp, Homo sapiens
agggcctgttgcaagcgttt

SEQ ID NO: 8143764 - DNA, 22 bp, Homo sapiens
agggccccatagtcactgcccg

SEQ ID NO: 8143765 - DNA, 17 bp, Homo sapiens
ccctggcaaagaatggc

SEQ ID NO: 8143766 - DNA, 22 bp, Homo sapiens
agggcccatgtgggagcacttg

SEQ ID NO: 8143767 - DNA, 22 bp, Homo sapiens
ccctggcaagtgctgtgtagct

SEQ ID NO: 8143768 - DNA, 22 bp, Homo sapiens
ccctggcacatgcgctgtgtgg

SEQ ID NO: 8143769 - DNA, 22 bp, Homo sapiens
ccctggcactagcgacggccat

SEQ ID NO: 8143770 - DNA, 22 bp, Homo sapiens
ccctggcactagcgacggccat

SEQ ID NO: 8143771 - DNA, 22 bp, Homo sapiens
ccctggcactagcgacggccat

SEQ ID NO: 8143772 - DNA, 22 bp, Homo sapiens
ccctggcagaaggtgtagaagc

SEQ ID NO: 8143773 - DNA, 22 bp, Homo sapiens
ccctggcagaaggtgtagaagc

SEQ ID NO: 8143774 - DNA, 22 bp, Homo sapiens
agggcccagtggagagctgagc

SEQ ID NO: 8143775 - DNA, 22 bp, Homo sapiens
agggcccatagatcgtcagctt

SEQ ID NO: 8143776 - DNA, 22 bp, Homo sapiens
agggcccatgtgggagcacttg

SEQ ID NO: 8143777 - DNA, 19 bp, Homo sapiens
ccctggcaggcaagcctgg

SEQ ID NO: 8143778 - DNA, 19 bp, Homo sapiens
ccctggcaggcaagcctgg

SEQ ID NO: 8143779 - DNA, 19 bp, Homo sapiens
ccctggcaggcaagcctgg

SEQ ID NO: 8143780 - DNA, 22 bp, Homo sapiens
ccctggcagcaatcactggtgt

SEQ ID NO: 8143781 - DNA, 22 bp, Homo sapiens
ccctggcagtgctcctttagac

SEQ ID NO: 8143782 - DNA, 22 bp, Homo sapiens
ccctggcataaaacttctccag

SEQ ID NO: 8143783 - DNA, 22 bp, Homo sapiens
ccctggcagtgctcctttagac

SEQ ID NO: 8143784 - DNA, 22 bp, Homo sapiens
ccctggcagcaatcactggtgt

SEQ ID NO: 8143785 - DNA, 22 bp, Homo sapiens
ccctggcagagggggcaggtgc

SEQ ID NO: 8143786 - DNA, 22 bp, Homo sapiens
ccctggcagagggggcaggtgc

SEQ ID NO: 8143787 - DNA, 22 bp, Homo sapiens
ccctggcagagggggcaggtgc

SEQ ID NO: 8143788 - DNA, 22 bp, Homo sapiens
ccctggcagagggggcaggtgc

SEQ ID NO: 8143789 - DNA, 22 bp, Homo sapiens
ccctggcagaatgtctctgggc

SEQ ID NO: 8143790 - DNA, 22 bp, Homo sapiens
ccctggccagctcatgtctgag

SEQ ID NO: 8143791 - DNA, 22 bp, Homo sapiens
ccctggcatgcatgtccctggc

SEQ ID NO: 8143792 - DNA, 22 bp, Homo sapiens
ccctggcatgcatgtccctggc

SEQ ID NO: 8143793 - DNA, 22 bp, Homo sapiens
ccctggcatgcatgtccctggc

SEQ ID NO: 8143794 - DNA, 22 bp, Homo sapiens
ccctggccagctcatgtctgag

SEQ ID NO: 8143795 - DNA, 22 bp, Homo sapiens
ccctggccagggcacagggagg

SEQ ID NO: 8143796 - DNA, 22 bp, Homo sapiens
ccctggccagggcacagggagg

SEQ ID NO: 8143797 - DNA, 22 bp, Homo sapiens
agggcctggcttcactttctca

SEQ ID NO: 8143798 - DNA, 22 bp, Homo sapiens
ccctggccagggcacagggagg

SEQ ID NO: 8143799 - DNA, 18 bp, Homo sapiens
cctacatcattgtgagag

SEQ ID NO: 8143800 - DNA, 19 bp, Homo sapiens
cctacatgagtaagcttgg

SEQ ID NO: 8143801 - DNA, 22 bp, Homo sapiens
cctactctgagcgcctccgcat

SEQ ID NO: 8143802 - DNA, 22 bp, Homo sapiens
cctactctgagcgcctccgcat

SEQ ID NO: 8143803 - DNA, 22 bp, Homo sapiens
cctactctgagcgcctccgcat

SEQ ID NO: 8143804 - DNA, 22 bp, Homo sapiens
cctacggaggacaggttagcca

SEQ ID NO: 8143805 - DNA, 22 bp, Homo sapiens
cctacggaggacaggttagcca

SEQ ID NO: 8143806 - DNA, 22 bp, Homo sapiens
cctactcactcttttcatgctt

SEQ ID NO: 8143807 - DNA, 22 bp, Homo sapiens
cctactcactcttttcatgctt

SEQ ID NO: 8143808 - DNA, 22 bp, Homo sapiens
cctaccagtaggaggccagaga

SEQ ID NO: 8143809 - DNA, 22 bp, Homo sapiens
cctaccagtaggaggccagaga

SEQ ID NO: 8143810 - DNA, 22 bp, Homo sapiens
cctactctgagcgcctccgcat

SEQ ID NO: 8143811 - DNA, 22 bp, Homo sapiens
agggctcttcctttgcctctca

SEQ ID NO: 8143812 - DNA, 22 bp, Homo sapiens
agggctcttcctttgcctctca

SEQ ID NO: 8143813 - DNA, 22 bp, Homo sapiens
agggctgacagtggcgtggcgt

SEQ ID NO: 8143814 - DNA, 22 bp, Homo sapiens
agggctgacagtggcgtggcgt

SEQ ID NO: 8143815 - DNA, 22 bp, Homo sapiens
agggctctttaggccgaggcca

SEQ ID NO: 8143816 - DNA, 22 bp, Homo sapiens
agggctgacctaagctccactt

SEQ ID NO: 8143817 - DNA, 22 bp, Homo sapiens
agggctgacagtggcgtggcgt

SEQ ID NO: 8143818 - DNA, 22 bp, Homo sapiens
agggctgagactaaggccagat

SEQ ID NO: 8143819 - DNA, 22 bp, Homo sapiens
agggctgagaatgacagggccg

SEQ ID NO: 8143820 - DNA, 22 bp, Homo sapiens
agggctgagactaaggccagat

SEQ ID NO: 8143821 - DNA, 22 bp, Homo sapiens
agggctgagactaaggccagat

SEQ ID NO: 8143822 - DNA, 20 bp, Homo sapiens
agggctgagaagggactagc

SEQ ID NO: 8143823 - DNA, 22 bp, Homo sapiens
agggctgacctaagctccactt

SEQ ID NO: 8143824 - DNA, 22 bp, Homo sapiens
agggctgacctaagctccactt

SEQ ID NO: 8143825 - DNA, 20 bp, Homo sapiens
agggctgagaagggactagc

SEQ ID NO: 8143826 - DNA, 20 bp, Homo sapiens
agggctgagaagggactagc

SEQ ID NO: 8143827 - DNA, 22 bp, Homo sapiens
agggctgagaatgacagggccg

SEQ ID NO: 8143828 - DNA, 20 bp, Homo sapiens
agggctgagaagggactagc

SEQ ID NO: 8143829 - DNA, 22 bp, Homo sapiens
agggctgagcccaggcatgtag

SEQ ID NO: 8143830 - DNA, 22 bp, Homo sapiens
agggctgagcccaggcatgtag

SEQ ID NO: 8143831 - DNA, 22 bp, Homo sapiens
agggctgagactaaggccagat

SEQ ID NO: 8143832 - DNA, 22 bp, Homo sapiens
agggctgagactaaggccagat

SEQ ID NO: 8143833 - DNA, 22 bp, Homo sapiens
agggctgagcccaggcatgtag

SEQ ID NO: 8143834 - DNA, 22 bp, Homo sapiens
agggctgagcccaggcatgtag

SEQ ID NO: 8143835 - DNA, 18 bp, Homo sapiens
cctcagggagatccagtg

SEQ ID NO: 8143836 - DNA, 22 bp, Homo sapiens
cctcagggaggcctctgtggct

SEQ ID NO: 8143837 - DNA, 18 bp, Homo sapiens
cctcagggagatccagtg

SEQ ID NO: 8143838 - DNA, 22 bp, Homo sapiens
agggctgaggcgagggagatgc

SEQ ID NO: 8143839 - DNA, 22 bp, Homo sapiens
agggctgaggcgagggagatgc

SEQ ID NO: 8143840 - DNA, 22 bp, Homo sapiens
aggggaaagaacagtcttcagg

SEQ ID NO: 8143841 - DNA, 22 bp, Homo sapiens
aggggaaagaacagtcttcagg

SEQ ID NO: 8143842 - DNA, 22 bp, Homo sapiens
aggggaaaatgagttagtgtgt

SEQ ID NO: 8143843 - DNA, 22 bp, Homo sapiens
aggggaaaagtgttgtctctag

SEQ ID NO: 8143844 - DNA, 22 bp, Homo sapiens
agggctggtatgtccatgaaag

SEQ ID NO: 8143845 - DNA, 22 bp, Homo sapiens
cctcagtcattggcctacactt

SEQ ID NO: 8143846 - DNA, 22 bp, Homo sapiens
agggctgggctgcttgttgtca

SEQ ID NO: 8143847 - DNA, 22 bp, Homo sapiens
cctcaggtgtgggccagctgtc

SEQ ID NO: 8143848 - DNA, 22 bp, Homo sapiens
cctcaggtgtgggccagctgtc

SEQ ID NO: 8143849 - DNA, 22 bp, Homo sapiens
cctcagggtctgaggagaccgt

SEQ ID NO: 8143850 - DNA, 22 bp, Homo sapiens
cctcagggtctgaggagaccgt

SEQ ID NO: 8143851 - DNA, 22 bp, Homo sapiens
cctcagggtctgaggagaccgt

SEQ ID NO: 8143852 - DNA, 22 bp, Homo sapiens
cctcagggtctctcacagcacc

SEQ ID NO: 8143853 - DNA, 22 bp, Homo sapiens
cctcaggggtgcccacagctgc

SEQ ID NO: 8143854 - DNA, 22 bp, Homo sapiens
cctcagggaggcctctgtggct

SEQ ID NO: 8143855 - DNA, 18 bp, Homo sapiens
cctcaggggacctggcag

SEQ ID NO: 8143856 - DNA, 23 bp, Homo sapiens
cctcaggggacctgtgagcctga

SEQ ID NO: 8143857 - DNA, 23 bp, Homo sapiens
cctcaggggacctgtgagcctga

SEQ ID NO: 8143858 - DNA, 22 bp, Homo sapiens
cctcaggggtcactgtgaggag

SEQ ID NO: 8143859 - DNA, 22 bp, Homo sapiens
cctcaggggtgcccacagctgc

SEQ ID NO: 8143860 - DNA, 22 bp, Homo sapiens
agggggagcttggctactcctg

SEQ ID NO: 8143861 - DNA, 22 bp, Homo sapiens
agggggagcttggctactcctg

SEQ ID NO: 8143862 - DNA, 22 bp, Homo sapiens
agggggagcttggctactcctg

SEQ ID NO: 8143863 - DNA, 22 bp, Homo sapiens
agggggagacatgtgtgtgttt

SEQ ID NO: 8143864 - DNA, 22 bp, Homo sapiens
cctcttcacctcgggcacactg

SEQ ID NO: 8143865 - DNA, 22 bp, Homo sapiens
cctcttcagcaaagttcggccc

SEQ ID NO: 8143866 - DNA, 22 bp, Homo sapiens
agggggctccttggtgtgcaga

SEQ ID NO: 8143867 - DNA, 22 bp, Homo sapiens
agggggctccttggtgtgcaga

SEQ ID NO: 8143868 - DNA, 22 bp, Homo sapiens
agggggctggagacacctcctc

SEQ ID NO: 8143869 - DNA, 22 bp, Homo sapiens
agggggtgaatgtctgtctaca

SEQ ID NO: 8143870 - DNA, 22 bp, Homo sapiens
agggggtgaatgtctgtctaca

SEQ ID NO: 8143871 - DNA, 22 bp, Homo sapiens
agggggtgaatgtctgtctaca

SEQ ID NO: 8143872 - DNA, 22 bp, Homo sapiens
cctctgtgtcagggaagagact

SEQ ID NO: 8143873 - DNA, 22 bp, Homo sapiens
cctctgtgtcctggtcattgaa

SEQ ID NO: 8143874 - DNA, 22 bp, Homo sapiens
cctctgtggtctgtctaatgca

SEQ ID NO: 8143875 - DNA, 22 bp, Homo sapiens
cctctgtgtcctggtcattgaa

SEQ ID NO: 8143876 - DNA, 22 bp, Homo sapiens
cctctgtgtcctggtcattgaa

SEQ ID NO: 8143877 - DNA, 20 bp, Homo sapiens
cctctgtgtcctgtgtcata

SEQ ID NO: 8143878 - DNA, 20 bp, Homo sapiens
cctctgtgtcctgtgtcata

SEQ ID NO: 8143879 - DNA, 20 bp, Homo sapiens
cctctgtgtcctgtgtcata

SEQ ID NO: 8143880 - DNA, 20 bp, Homo sapiens
cctctgtgtcctgtgtcata

SEQ ID NO: 8143881 - DNA, 22 bp, Homo sapiens
cctctgttgaaaattacaaaca

SEQ ID NO: 8143882 - DNA, 20 bp, Homo sapiens
cctctgtttacaacacaccc

SEQ ID NO: 8143883 - DNA, 22 bp, Homo sapiens
cctctgtgtgtgcatgcatgcg

SEQ ID NO: 8143884 - DNA, 22 bp, Homo sapiens
cctctgtgtgatgcgcaaagta

SEQ ID NO: 8143885 - DNA, 22 bp, Homo sapiens
cctctgtgtgtgcatgcatgcg

SEQ ID NO: 8143886 - DNA, 22 bp, Homo sapiens
cctctgtgtgtgcatgcatgcg

SEQ ID NO: 8143887 - DNA, 22 bp, Homo sapiens
cctctgtgtctccaagaggcct

SEQ ID NO: 8143888 - DNA, 22 bp, Homo sapiens
cctctgtgtctccaagaggcct

SEQ ID NO: 8143889 - DNA, 22 bp, Homo sapiens
cctctgtgtgatgcgcaaagta

SEQ ID NO: 8143890 - DNA, 22 bp, Homo sapiens
aggggtcagtgaccattgagga

SEQ ID NO: 8143891 - DNA, 22 bp, Homo sapiens
aggggtcagtgaccattgagga

SEQ ID NO: 8143892 - DNA, 22 bp, Homo sapiens
aggggtctatcctgagatggtc

SEQ ID NO: 8143893 - DNA, 22 bp, Homo sapiens
aggggtctatcctgagatggtc

SEQ ID NO: 8143894 - DNA, 20 bp, Homo sapiens
aggggtctagcagcagtgct

SEQ ID NO: 8143895 - DNA, 22 bp, Homo sapiens
aggggtgaaagagggccctcaa

SEQ ID NO: 8143896 - DNA, 22 bp, Homo sapiens
aggggtcttgggagtcctggct

SEQ ID NO: 8143897 - DNA, 22 bp, Homo sapiens
cctgagtcccataatgttgcca

SEQ ID NO: 8143898 - DNA, 21 bp, Homo sapiens
cctgagtccctgttacagaca

SEQ ID NO: 8143899 - DNA, 22 bp, Homo sapiens
cctgagtctgtgttttcctaag

SEQ ID NO: 8143900 - DNA, 22 bp, Homo sapiens
cctgagtcccctcattcactct

SEQ ID NO: 8143901 - DNA, 22 bp, Homo sapiens
agggggtgcatttgtgaatgaa

SEQ ID NO: 8143902 - DNA, 22 bp, Homo sapiens
agggggtgcatttgtgaatgaa

SEQ ID NO: 8143903 - DNA, 22 bp, Homo sapiens
agggggtgcatttgtgaatgaa

SEQ ID NO: 8143904 - DNA, 22 bp, Homo sapiens
agggggtgatcaaggtgcggcg

SEQ ID NO: 8143905 - DNA, 22 bp, Homo sapiens
agggggtgatcaaggtgcggcg

SEQ ID NO: 8143906 - DNA, 22 bp, Homo sapiens
agggggtgcatttgtgaatgaa

SEQ ID NO: 8143907 - DNA, 22 bp, Homo sapiens
agggggtgcccagatgaaggat

SEQ ID NO: 8143908 - DNA, 22 bp, Homo sapiens
agggggtgtctctgattgggtt

SEQ ID NO: 8143909 - DNA, 22 bp, Homo sapiens
agggggtgtctctgattgggtt

SEQ ID NO: 8143910 - DNA, 22 bp, Homo sapiens
agggggtgtctctgattgggtt

SEQ ID NO: 8143911 - DNA, 22 bp, Homo sapiens
aggggctgactggaaagtgcca

SEQ ID NO: 8143912 - DNA, 22 bp, Homo sapiens
aggggctctgagtgggccagga

SEQ ID NO: 8143913 - DNA, 22 bp, Homo sapiens
aggggctgcctggcttggcact

SEQ ID NO: 8143914 - DNA, 22 bp, Homo sapiens
aggggctgcctggcttggcact

SEQ ID NO: 8143915 - DNA, 22 bp, Homo sapiens
aggggctgcctggcttggcact

SEQ ID NO: 8143916 - DNA, 22 bp, Homo sapiens
aggggctgcctggcttggcact

SEQ ID NO: 8143917 - DNA, 22 bp, Homo sapiens
cctctgtgggccgggcctgctg

SEQ ID NO: 8143918 - DNA, 22 bp, Homo sapiens
aggggctctaaagatcatggaa

SEQ ID NO: 8143919 - DNA, 22 bp, Homo sapiens
aggggctctaaagatcatggaa

SEQ ID NO: 8143920 - DNA, 22 bp, Homo sapiens
aggggctcctttgtgctgcgtc

SEQ ID NO: 8143921 - DNA, 22 bp, Homo sapiens
aggggctcctggcctggagagc

SEQ ID NO: 8143922 - DNA, 22 bp, Homo sapiens
aggggctcctggcctggagagc

SEQ ID NO: 8143923 - DNA, 22 bp, Homo sapiens
aggggctcctctctgagagtag

SEQ ID NO: 8143924 - DNA, 22 bp, Homo sapiens
aggggctcagttactttggcag

SEQ ID NO: 8143925 - DNA, 22 bp, Homo sapiens
aggggaaggccagcctgtagag

SEQ ID NO: 8143926 - DNA, 22 bp, Homo sapiens
aggggaagattatacttttgaa

SEQ ID NO: 8143927 - DNA, 22 bp, Homo sapiens
aggggaaatgccttggtggtac

SEQ ID NO: 8143928 - DNA, 22 bp, Homo sapiens
aggggaagattatacttttgaa

SEQ ID NO: 8143929 - DNA, 22 bp, Homo sapiens
aggggaaatctctcgccatctg

SEQ ID NO: 8143930 - DNA, 22 bp, Homo sapiens
aggggaaatgccttggtggtac

SEQ ID NO: 8143931 - DNA, 22 bp, Homo sapiens
cctcctggtgacaaggcaaagc

SEQ ID NO: 8143932 - DNA, 22 bp, Homo sapiens
cctcctggtgacaaggcaaagc

SEQ ID NO: 8143933 - DNA, 22 bp, Homo sapiens
cctcctggtgacaaggcaaagc

SEQ ID NO: 8143934 - DNA, 22 bp, Homo sapiens
aggggaatgggtagactgttga

SEQ ID NO: 8143935 - DNA, 22 bp, Homo sapiens
aggggaatgggtagactgttga

SEQ ID NO: 8143936 - DNA, 22 bp, Homo sapiens
aggggaatgggtagactgttga

SEQ ID NO: 8143937 - DNA, 22 bp, Homo sapiens
aggggaatgggtagactgttga

SEQ ID NO: 8143938 - DNA, 21 bp, Homo sapiens
aggggaagtagagttttgatt

SEQ ID NO: 8143939 - DNA, 22 bp, Homo sapiens
cctccttctggggccttctgct

SEQ ID NO: 8143940 - DNA, 22 bp, Homo sapiens
cctcgacctccccaggctcagg

SEQ ID NO: 8143941 - DNA, 18 bp, Homo sapiens
aggggcagcttgtgtgga

SEQ ID NO: 8143942 - DNA, 22 bp, Homo sapiens
cctcgacctccccaggctcagg

SEQ ID NO: 8143943 - DNA, 22 bp, Homo sapiens
cctccttcctgggacagagctg

SEQ ID NO: 8143944 - DNA, 22 bp, Homo sapiens
cctcctgttgtcctgctggggc

SEQ ID NO: 8143945 - DNA, 22 bp, Homo sapiens
cctccttctggggccttctgct

SEQ ID NO: 8143946 - DNA, 22 bp, Homo sapiens
cctcctggttgcaatgaaatgg

SEQ ID NO: 8143947 - DNA, 22 bp, Homo sapiens
cctcctgtctccttcctatatt

SEQ ID NO: 8143948 - DNA, 22 bp, Homo sapiens
cctcctgttgtcctgctggggc

SEQ ID NO: 8143949 - DNA, 22 bp, Homo sapiens
cctcctgttgtcaccaggcgtg

SEQ ID NO: 8143950 - DNA, 22 bp, Homo sapiens
cctcctggttgcaatgaaatgg

SEQ ID NO: 8143951 - DNA, 19 bp, Homo sapiens
cctcctgtggcgggtgggg

SEQ ID NO: 8143952 - DNA, 22 bp, Homo sapiens
cctcctggtgggcgcttctggc

SEQ ID NO: 8143953 - DNA, 22 bp, Homo sapiens
cctcctggtgggcgcttctggc

SEQ ID NO: 8143954 - DNA, 22 bp, Homo sapiens
cctcctggtgggcgcttctggc

SEQ ID NO: 8143955 - DNA, 22 bp, Homo sapiens
cctcctggtgggcgcttctggc

SEQ ID NO: 8143956 - DNA, 22 bp, Homo sapiens
cctcctggtgggcgcttctggc

SEQ ID NO: 8143957 - DNA, 22 bp, Homo sapiens
cctcctggtgggcgcttctggc

SEQ ID NO: 8143958 - DNA, 22 bp, Homo sapiens
aggctcagcccaaggtggagag

SEQ ID NO: 8143959 - DNA, 22 bp, Homo sapiens
aggctcagcccaaggtggagag

SEQ ID NO: 8143960 - DNA, 22 bp, Homo sapiens
aggctcagcccaaggtggagag

SEQ ID NO: 8143961 - DNA, 22 bp, Homo sapiens
aggctcagcccaaggtggagag

SEQ ID NO: 8143962 - DNA, 22 bp, Homo sapiens
aggctcagcccaaggtggagag

SEQ ID NO: 8143963 - DNA, 21 bp, Homo sapiens
aggctcagcaggtgtataaag

SEQ ID NO: 8143964 - DNA, 21 bp, Homo sapiens
aggctcagcaggtgtataaag

SEQ ID NO: 8143965 - DNA, 22 bp, Homo sapiens
aggctcagcatctgattcatat

SEQ ID NO: 8143966 - DNA, 21 bp, Homo sapiens
aggctcagcaggtgtataaag

SEQ ID NO: 8143967 - DNA, 22 bp, Homo sapiens
aggctcagcatctgattcatat

SEQ ID NO: 8143968 - DNA, 22 bp, Homo sapiens
aggctcagcctgggcctagagc

SEQ ID NO: 8143969 - DNA, 22 bp, Homo sapiens
aggctcagcctgggcctagagc

SEQ ID NO: 8143970 - DNA, 22 bp, Homo sapiens
aggctcagcctgggcctagagc

SEQ ID NO: 8143971 - DNA, 20 bp, Homo sapiens
aggctctgcctgcaggccca

SEQ ID NO: 8143972 - DNA, 22 bp, Homo sapiens
aggctcagcccctgggaggaga

SEQ ID NO: 8143973 - DNA, 22 bp, Homo sapiens
aggctcagcccctgggaggaga

SEQ ID NO: 8143974 - DNA, 22 bp, Homo sapiens
aggctcagcccctgggaggaga

SEQ ID NO: 8143975 - DNA, 22 bp, Homo sapiens
aggctcagcccctgggaggaga

SEQ ID NO: 8143976 - DNA, 22 bp, Homo sapiens
aggctcagcccctgggaggaga

SEQ ID NO: 8143977 - DNA, 22 bp, Homo sapiens
aggctctgggaagcagtgagtt

SEQ ID NO: 8143978 - DNA, 22 bp, Homo sapiens
aggctctgggaagcagtgagtt

SEQ ID NO: 8143979 - DNA, 22 bp, Homo sapiens
aggctctgggaagcagtgagtt

SEQ ID NO: 8143980 - DNA, 22 bp, Homo sapiens
aggctctgggaagcagtgagtt

SEQ ID NO: 8143981 - DNA, 22 bp, Homo sapiens
aggctctgggaagcagtgagtt

SEQ ID NO: 8143982 - DNA, 22 bp, Homo sapiens
aggctctgggaacagacgggtg

SEQ ID NO: 8143983 - DNA, 22 bp, Homo sapiens
aggctctgcttttctggatata

SEQ ID NO: 8143984 - DNA, 22 bp, Homo sapiens
aggctctgcttttctggatata

SEQ ID NO: 8143985 - DNA, 22 bp, Homo sapiens
aggctctgggaacagacgggtg

SEQ ID NO: 8143986 - DNA, 22 bp, Homo sapiens
aggctctgggaacagacgggtg

SEQ ID NO: 8143987 - DNA, 22 bp, Homo sapiens
aggctctgggaacagacgggtg

SEQ ID NO: 8143988 - DNA, 22 bp, Homo sapiens
aggctctgggaacagacgggtg

SEQ ID NO: 8143989 - DNA, 22 bp, Homo sapiens
aggctctgggaagcagtgagtt

SEQ ID NO: 8143990 - DNA, 22 bp, Homo sapiens
aggctctgggaagcagtgagtt

SEQ ID NO: 8143991 - DNA, 22 bp, Homo sapiens
aggctctgggaacagacgggtg

SEQ ID NO: 8143992 - DNA, 22 bp, Homo sapiens
aggctctggttcatcatgatgg

SEQ ID NO: 8143993 - DNA, 22 bp, Homo sapiens
aggctctggttcatcatgatgg

SEQ ID NO: 8143994 - DNA, 22 bp, Homo sapiens
aggctctggttggcaagtaaag

SEQ ID NO: 8143995 - DNA, 22 bp, Homo sapiens
aggctctggttcatcatgatgg

SEQ ID NO: 8143996 - DNA, 22 bp, Homo sapiens
aggctctggttggcaagtaaag

SEQ ID NO: 8143997 - DNA, 22 bp, Homo sapiens
aggctctggttggcaagtaaag

SEQ ID NO: 8143998 - DNA, 22 bp, Homo sapiens
aggctctggttggcaagtaaag

SEQ ID NO: 8143999 - DNA, 19 bp, Homo sapiens
aggctctgtaggagagggc

SEQ ID NO: 8144000 - DNA, 22 bp, Homo sapiens
aggctctggttggcaagtaaag

SEQ ID NO: 8144001 - DNA, 22 bp, Homo sapiens
aggctctgggctctagattttg

SEQ ID NO: 8144002 - DNA, 22 bp, Homo sapiens
aggctctggtgcagctgtaact

SEQ ID NO: 8144003 - DNA, 22 bp, Homo sapiens
aggctctggtgcagctgtaact

SEQ ID NO: 8144004 - DNA, 22 bp, Homo sapiens
aggctcagatccttgtgtcctg

SEQ ID NO: 8144005 - DNA, 22 bp, Homo sapiens
ccaggcgtggcttcagcagccc

SEQ ID NO: 8144006 - DNA, 22 bp, Homo sapiens
ccaggcctttcttcttggtctg

SEQ ID NO: 8144007 - DNA, 22 bp, Homo sapiens
ccaggcctttcttcttggtctg

SEQ ID NO: 8144008 - DNA, 22 bp, Homo sapiens
aggctcagatccttgtgtcctg

SEQ ID NO: 8144009 - DNA, 22 bp, Homo sapiens
aggctcagattcacatttggtt

SEQ ID NO: 8144010 - DNA, 22 bp, Homo sapiens
aggctcagattcacatttggtt

SEQ ID NO: 8144011 - DNA, 22 bp, Homo sapiens
ccaggcctttcttcttggtctg

SEQ ID NO: 8144012 - DNA, 22 bp, Homo sapiens
ccaggcctttcttcttggtctg

SEQ ID NO: 8144013 - DNA, 22 bp, Homo sapiens
ccaggcctttcttcttggtctg

SEQ ID NO: 8144014 - DNA, 22 bp, Homo sapiens
ccaggccttctgaggacactct

SEQ ID NO: 8144015 - DNA, 22 bp, Homo sapiens
ccaggccttctgaggacactct

SEQ ID NO: 8144016 - DNA, 22 bp, Homo sapiens
ccaggccttctgaggacactct

SEQ ID NO: 8144017 - DNA, 22 bp, Homo sapiens
ccaggccttctgaggacactct

SEQ ID NO: 8144018 - DNA, 22 bp, Homo sapiens
ccaggccttccagtacgcagaa

SEQ ID NO: 8144019 - DNA, 22 bp, Homo sapiens
ccaggccttctgaggacactct

SEQ ID NO: 8144020 - DNA, 22 bp, Homo sapiens
ccaggccttctgaggacactct

SEQ ID NO: 8144021 - DNA, 22 bp, Homo sapiens
ccaggcctgtgcaaggagggag

SEQ ID NO: 8144022 - DNA, 22 bp, Homo sapiens
ccaggcctgtgcaaggagggag

SEQ ID NO: 8144023 - DNA, 22 bp, Homo sapiens
ccaggcctgtgcaaggagggag

SEQ ID NO: 8144024 - DNA, 22 bp, Homo sapiens
ccaggcctgtgttgtgtggagg

SEQ ID NO: 8144025 - DNA, 22 bp, Homo sapiens
ccaggccttccagtacgcagaa

SEQ ID NO: 8144026 - DNA, 22 bp, Homo sapiens
ccaggcctgtgttgtgtggagg

SEQ ID NO: 8144027 - DNA, 22 bp, Homo sapiens
ccaggcctgtgttgtgtggagg

SEQ ID NO: 8144028 - DNA, 22 bp, Homo sapiens
ccaggcctgtgttgtgtggagg

SEQ ID NO: 8144029 - DNA, 20 bp, Homo sapiens
ccaggcctgggcctgctcta

SEQ ID NO: 8144030 - DNA, 22 bp, Homo sapiens
ccaggcctcccttttccagcca

SEQ ID NO: 8144031 - DNA, 22 bp, Homo sapiens
ccaggcctcccttttccagcca

SEQ ID NO: 8144032 - DNA, 22 bp, Homo sapiens
ccaggcctcacctgcccaccta

SEQ ID NO: 8144033 - DNA, 20 bp, Homo sapiens
ccaggcctgggcctgctcta

SEQ ID NO: 8144034 - DNA, 20 bp, Homo sapiens
ccaggcctgggcctgctcta

SEQ ID NO: 8144035 - DNA, 20 bp, Homo sapiens
ccaggcctgggcctgctcta

SEQ ID NO: 8144036 - DNA, 22 bp, Homo sapiens
ccagggcagaaaaagagggaat

SEQ ID NO: 8144037 - DNA, 22 bp, Homo sapiens
ccagggcagcagaattggggca

SEQ ID NO: 8144038 - DNA, 22 bp, Homo sapiens
ccagggcagaaaaagagggaat

SEQ ID NO: 8144039 - DNA, 22 bp, Homo sapiens
ccagggcagaaaaagagggaat

SEQ ID NO: 8144040 - DNA, 22 bp, Homo sapiens
ccagggcagaaaaagagggaat

SEQ ID NO: 8144041 - DNA, 22 bp, Homo sapiens
ccagggcagaaaaagagggaat

SEQ ID NO: 8144042 - DNA, 22 bp, Homo sapiens
ccagggcacttaggcccagccc

SEQ ID NO: 8144043 - DNA, 22 bp, Homo sapiens
ccagggcacttaggcccagccc

SEQ ID NO: 8144044 - DNA, 22 bp, Homo sapiens
ccagggcacttaggcccagccc

SEQ ID NO: 8144045 - DNA, 22 bp, Homo sapiens
ccagggcacttaggcccagccc

SEQ ID NO: 8144046 - DNA, 22 bp, Homo sapiens
aggctctgtcaggcggagcagc

SEQ ID NO: 8144047 - DNA, 22 bp, Homo sapiens
aggctctgtcaggcggagcagc

SEQ ID NO: 8144048 - DNA, 22 bp, Homo sapiens
aggctctgtcaggcggagcagc

SEQ ID NO: 8144049 - DNA, 22 bp, Homo sapiens
aggctctgtcaggcggagcagc

SEQ ID NO: 8144050 - DNA, 22 bp, Homo sapiens
aggctctgtcaggcggagcagc

SEQ ID NO: 8144051 - DNA, 22 bp, Homo sapiens
aggctctgtcaggcggagcagc

SEQ ID NO: 8144052 - DNA, 22 bp, Homo sapiens
aggctctgtatgaaggtttggg

SEQ ID NO: 8144053 - DNA, 22 bp, Homo sapiens
aggctctgtatgaaggtttggg

SEQ ID NO: 8144054 - DNA, 19 bp, Homo sapiens
aggctctgtaggagagggc

SEQ ID NO: 8144055 - DNA, 19 bp, Homo sapiens
aggctctgtaggagagggc

SEQ ID NO: 8144056 - DNA, 19 bp, Homo sapiens
aggctctgtaggagagggc

SEQ ID NO: 8144057 - DNA, 19 bp, Homo sapiens
aggctctgtaggagagggc

SEQ ID NO: 8144058 - DNA, 19 bp, Homo sapiens
aggctctgtaggagagggc

SEQ ID NO: 8144059 - DNA, 16 bp, Homo sapiens
ccaggtggggctgtga

SEQ ID NO: 8144060 - DNA, 22 bp, Homo sapiens
ccaggtggtgaaagtgggccct

SEQ ID NO: 8144061 - DNA, 22 bp, Homo sapiens
ccaggtggtgaaagtgggccct

SEQ ID NO: 8144062 - DNA, 22 bp, Homo sapiens
ccaggtggtgaaagtgggccct

SEQ ID NO: 8144063 - DNA, 22 bp, Homo sapiens
ccaggtggtgaaagtgggccct

SEQ ID NO: 8144064 - DNA, 16 bp, Homo sapiens
ccaggtggggctgtga

SEQ ID NO: 8144065 - DNA, 16 bp, Homo sapiens
ccaggtggggctgtga

SEQ ID NO: 8144066 - DNA, 22 bp, Homo sapiens
ccaggtggtgaaagtgggccct

SEQ ID NO: 8144067 - DNA, 22 bp, Homo sapiens
ccaggtgcactcaagacctgct

SEQ ID NO: 8144068 - DNA, 22 bp, Homo sapiens
ccaggtgcctccagtcacagtg

SEQ ID NO: 8144069 - DNA, 22 bp, Homo sapiens
ccaggtgctagcaatcactgtc

SEQ ID NO: 8144070 - DNA, 22 bp, Homo sapiens
ccaggtgcctccagtcacagtg

SEQ ID NO: 8144071 - DNA, 22 bp, Homo sapiens
ccagggcagcgcccctccacgc

SEQ ID NO: 8144072 - DNA, 22 bp, Homo sapiens
ccagggcagcgcccctccacgc

SEQ ID NO: 8144073 - DNA, 22 bp, Homo sapiens
ccagggcagccaacccagatgc

SEQ ID NO: 8144074 - DNA, 22 bp, Homo sapiens
ccagggcagccaacccagatgc

SEQ ID NO: 8144075 - DNA, 22 bp, Homo sapiens
ccagggcagccaacccagatgc

SEQ ID NO: 8144076 - DNA, 22 bp, Homo sapiens
ccagggcagccaacccagatgc

SEQ ID NO: 8144077 - DNA, 22 bp, Homo sapiens
ccagggcagcagaattggggca

SEQ ID NO: 8144078 - DNA, 22 bp, Homo sapiens
ccagggcagcagaattggggca

SEQ ID NO: 8144079 - DNA, 22 bp, Homo sapiens
ccagggcagcagaattggggca

SEQ ID NO: 8144080 - DNA, 22 bp, Homo sapiens
ccaggtgtttggcctgcatgat

SEQ ID NO: 8144081 - DNA, 22 bp, Homo sapiens
ccaggtgtttggcctgcatgat

SEQ ID NO: 8144082 - DNA, 22 bp, Homo sapiens
ccaggtgttctttgtccctgtt

SEQ ID NO: 8144083 - DNA, 22 bp, Homo sapiens
ccaggtgttacacgagtgttaa

SEQ ID NO: 8144084 - DNA, 22 bp, Homo sapiens
ccaggtgtgtctggccccgaag

SEQ ID NO: 8144085 - DNA, 22 bp, Homo sapiens
ccaggtgttacacgagtgttaa

SEQ ID NO: 8144086 - DNA, 22 bp, Homo sapiens
ccaggtgttctttgtccctgtt

SEQ ID NO: 8144087 - DNA, 22 bp, Homo sapiens
ccaggtgttctttgtccctgtt

SEQ ID NO: 8144088 - DNA, 22 bp, Homo sapiens
ccaggtggttcaggtcaccata

SEQ ID NO: 8144089 - DNA, 20 bp, Homo sapiens
ccaggtggtgcctggagagg

SEQ ID NO: 8144090 - DNA, 20 bp, Homo sapiens
ccaggtggtgcctggagagg

SEQ ID NO: 8144091 - DNA, 22 bp, Homo sapiens
ccaggtggttcaggtcaccata

SEQ ID NO: 8144092 - DNA, 22 bp, Homo sapiens
ccaggtgtgtctggccccgaag

SEQ ID NO: 8144093 - DNA, 22 bp, Homo sapiens
ccaggtggttcaggtcaccata

SEQ ID NO: 8144094 - DNA, 22 bp, Homo sapiens
ccaggtggtgaaagtgggccct

SEQ ID NO: 8144095 - DNA, 18 bp, Homo sapiens
ccaggtggtgacagagat

SEQ ID NO: 8144096 - DNA, 18 bp, Homo sapiens
ccaggtggtgacagagat

SEQ ID NO: 8144097 - DNA, 18 bp, Homo sapiens
ccaggtggtgacagagat

SEQ ID NO: 8144098 - DNA, 18 bp, Homo sapiens
ccaggtggtgacagagat

SEQ ID NO: 8144099 - DNA, 18 bp, Homo sapiens
ccaggtggtgacagagat

SEQ ID NO: 8144100 - DNA, 18 bp, Homo sapiens
ccaggtggtgacagagat

SEQ ID NO: 8144101 - DNA, 20 bp, Homo sapiens
ccaggtggtgcctggagagg

SEQ ID NO: 8144102 - DNA, 22 bp, Homo sapiens
ccaggtggtgcctctgttcgca

SEQ ID NO: 8144103 - DNA, 20 bp, Homo sapiens
ccaggtggtgcctggagagg

SEQ ID NO: 8144104 - DNA, 22 bp, Homo sapiens
ccaggtggtgcctctgttcgca

SEQ ID NO: 8144105 - DNA, 20 bp, Homo sapiens
ccaggtggtgcctggagagg

SEQ ID NO: 8144106 - DNA, 20 bp, Homo sapiens
ccaggtggtgcctggagagg

SEQ ID NO: 8144107 - DNA, 20 bp, Homo sapiens
ccaggtggtgcctggagagg

SEQ ID NO: 8144108 - DNA, 22 bp, Homo sapiens
aggctgagtgctcccctagatg

SEQ ID NO: 8144109 - DNA, 22 bp, Homo sapiens
ccagtcacaggtgtgtttatat

SEQ ID NO: 8144110 - DNA, 22 bp, Homo sapiens
aggctgagtcgggaggatcact

SEQ ID NO: 8144111 - DNA, 22 bp, Homo sapiens
aggctgagtcgggaggatcact

SEQ ID NO: 8144112 - DNA, 17 bp, Homo sapiens
ccagtcacaccaccctt

SEQ ID NO: 8144113 - DNA, 21 bp, Homo sapiens
ccagtattatttctctatgta

SEQ ID NO: 8144114 - DNA, 17 bp, Homo sapiens
ccagtcacaccaccctt

SEQ ID NO: 8144115 - DNA, 17 bp, Homo sapiens
ccagtagcctgagatgt

SEQ ID NO: 8144116 - DNA, 17 bp, Homo sapiens
ccagtagcctgagatgt

SEQ ID NO: 8144117 - DNA, 19 bp, Homo sapiens
ccagtagagacagctgcag

SEQ ID NO: 8144118 - DNA, 23 bp, Homo sapiens
ccagtaaacccttcctcagtgtc

SEQ ID NO: 8144119 - DNA, 22 bp, Homo sapiens
ccagtaaaccaagtgtttacta

SEQ ID NO: 8144120 - DNA, 22 bp, Homo sapiens
ccaggttggagttcagtggcgc

SEQ ID NO: 8144121 - DNA, 22 bp, Homo sapiens
ccaggttggagttcagtggcgc

SEQ ID NO: 8144122 - DNA, 22 bp, Homo sapiens
ccagtaaattacttgatgtcat

SEQ ID NO: 8144123 - DNA, 20 bp, Homo sapiens
aggctgccaggtctcacatc

SEQ ID NO: 8144124 - DNA, 20 bp, Homo sapiens
aggctgccaggtctcacatc

SEQ ID NO: 8144125 - DNA, 20 bp, Homo sapiens
aggctgccaggtctcacatc

SEQ ID NO: 8144126 - DNA, 22 bp, Homo sapiens
aggctgccagaagccttcagga

SEQ ID NO: 8144127 - DNA, 22 bp, Homo sapiens
aggctgccagaagccttcagga

SEQ ID NO: 8144128 - DNA, 22 bp, Homo sapiens
aggctgccagaagccttcagga

SEQ ID NO: 8144129 - DNA, 22 bp, Homo sapiens
aggctgcagtgcaggtaggatt

SEQ ID NO: 8144130 - DNA, 22 bp, Homo sapiens
aggctgcatcccactttgtgta

SEQ ID NO: 8144131 - DNA, 21 bp, Homo sapiens
aggctgcatttatatggtgtg

SEQ ID NO: 8144132 - DNA, 22 bp, Homo sapiens
aggctgccaaagcttctgtctc

SEQ ID NO: 8144133 - DNA, 22 bp, Homo sapiens
aggctgccaaagcttctgtctc

SEQ ID NO: 8144134 - DNA, 23 bp, Homo sapiens
aggctgcagaagaatagggtcat

SEQ ID NO: 8144135 - DNA, 22 bp, Homo sapiens
aggctgcagtgcaggtaggatt

SEQ ID NO: 8144136 - DNA, 22 bp, Homo sapiens
aggctgcagtgcaggtaggatt

SEQ ID NO: 8144137 - DNA, 22 bp, Homo sapiens
aggctgcagtgcaggtaggatt

SEQ ID NO: 8144138 - DNA, 22 bp, Homo sapiens
aggctgcaggtctgggtcatgt

SEQ ID NO: 8144139 - DNA, 22 bp, Homo sapiens
aggctgcaggtctgggtcatgt

SEQ ID NO: 8144140 - DNA, 22 bp, Homo sapiens
aggctgccctgccgccagtggg

SEQ ID NO: 8144141 - DNA, 22 bp, Homo sapiens
aggctgccgcagccaatggttg

SEQ ID NO: 8144142 - DNA, 22 bp, Homo sapiens
aggctgccgcagccaatggttg

SEQ ID NO: 8144143 - DNA, 22 bp, Homo sapiens
aggctgccctgccgccagtggg

SEQ ID NO: 8144144 - DNA, 22 bp, Homo sapiens
aggctgccctgccgccagtggg

SEQ ID NO: 8144145 - DNA, 20 bp, Homo sapiens
aggctgccaggtctcacatc

SEQ ID NO: 8144146 - DNA, 19 bp, Homo sapiens
aggctgcccagtctctgcc

SEQ ID NO: 8144147 - DNA, 19 bp, Homo sapiens
aggctgcccagtctctgcc

SEQ ID NO: 8144148 - DNA, 19 bp, Homo sapiens
aggctgcccagtctctgcc

SEQ ID NO: 8144149 - DNA, 19 bp, Homo sapiens
aggctgcccagtctctgcc

SEQ ID NO: 8144150 - DNA, 22 bp, Homo sapiens
ccagtgtattatttgagaaatt

SEQ ID NO: 8144151 - DNA, 22 bp, Homo sapiens
ccagtgggtgctgggctctgcc

SEQ ID NO: 8144152 - DNA, 22 bp, Homo sapiens
ccagtgggtgctgggctctgcc

SEQ ID NO: 8144153 - DNA, 22 bp, Homo sapiens
ccagtgggtaggccatggtgag

SEQ ID NO: 8144154 - DNA, 22 bp, Homo sapiens
ccagtgggtaggccatggtgag

SEQ ID NO: 8144155 - DNA, 22 bp, Homo sapiens
ccagtgggagggagctaggcca

SEQ ID NO: 8144156 - DNA, 22 bp, Homo sapiens
cccacacactggctgctgccaa

SEQ ID NO: 8144157 - DNA, 22 bp, Homo sapiens
cccacacaaatcatggggagaa

SEQ ID NO: 8144158 - DNA, 22 bp, Homo sapiens
cccacacacatttatgatagga

SEQ ID NO: 8144159 - DNA, 22 bp, Homo sapiens
cccaataaaattcattttcatt

SEQ ID NO: 8144160 - DNA, 22 bp, Homo sapiens
cccaattaagcctttccagaat

SEQ ID NO: 8144161 - DNA, 22 bp, Homo sapiens
cccacacaaatcatggggagaa

SEQ ID NO: 8144162 - DNA, 22 bp, Homo sapiens
cccacacatttttcacttaccg

SEQ ID NO: 8144163 - DNA, 18 bp, Homo sapiens
cccacacagcagtagctc

SEQ ID NO: 8144164 - DNA, 18 bp, Homo sapiens
cccacacagcagtagctc

SEQ ID NO: 8144165 - DNA, 20 bp, Homo sapiens
cccacacccttcccacttgg

SEQ ID NO: 8144166 - DNA, 22 bp, Homo sapiens
cccacacatttttcacttaccg

SEQ ID NO: 8144167 - DNA, 22 bp, Homo sapiens
cccacacatttttcacttaccg

SEQ ID NO: 8144168 - DNA, 18 bp, Homo sapiens
cccacacagcagtagctc

SEQ ID NO: 8144169 - DNA, 22 bp, Homo sapiens
ccattttgtctcctgaaatcta

SEQ ID NO: 8144170 - DNA, 22 bp, Homo sapiens
ccattttgtctcctgaaatcta

SEQ ID NO: 8144171 - DNA, 22 bp, Homo sapiens
ccattttgtctgacttcttgct

SEQ ID NO: 8144172 - DNA, 22 bp, Homo sapiens
ccattttgtctgacttcttgct

SEQ ID NO: 8144173 - DNA, 22 bp, Homo sapiens
ccattttgtctgacttcttgct

SEQ ID NO: 8144174 - DNA, 22 bp, Homo sapiens
ccagtgtgcaatctctggctta

SEQ ID NO: 8144175 - DNA, 22 bp, Homo sapiens
ccagtgtctagcagatgacagg

SEQ ID NO: 8144176 - DNA, 22 bp, Homo sapiens
ccagtgtctactgtggcatatc

SEQ ID NO: 8144177 - DNA, 22 bp, Homo sapiens
ccagtgtccttcctttccatgg

SEQ ID NO: 8144178 - DNA, 22 bp, Homo sapiens
ccagtgtcagaaagattatcct

SEQ ID NO: 8144179 - DNA, 19 bp, Homo sapiens
ccagtgtctagcgcacagc

SEQ ID NO: 8144180 - DNA, 22 bp, Homo sapiens
ccagtgtctgtggtatagaaag

SEQ ID NO: 8144181 - DNA, 22 bp, Homo sapiens
ccagtgtctagtcacaggtact

SEQ ID NO: 8144182 - DNA, 22 bp, Homo sapiens
ccagtgtcttcagagtaaatct

SEQ ID NO: 8144183 - DNA, 22 bp, Homo sapiens
ccagtgtgaaaggtcatttatc

SEQ ID NO: 8144184 - DNA, 22 bp, Homo sapiens
ccagtgtgaacctcaccaccct

SEQ ID NO: 8144185 - DNA, 22 bp, Homo sapiens
cccacgtcgaacttgctccaga

SEQ ID NO: 8144186 - DNA, 22 bp, Homo sapiens
cccacgtcgaacttgctccaga

SEQ ID NO: 8144187 - DNA, 22 bp, Homo sapiens
cccactccctgcacgcctgccg

SEQ ID NO: 8144188 - DNA, 22 bp, Homo sapiens
cccaccctgggctacacatcca

SEQ ID NO: 8144189 - DNA, 22 bp, Homo sapiens
cccaccctgggctacacatcca

SEQ ID NO: 8144190 - DNA, 18 bp, Homo sapiens
cccaccctggctcttagt

SEQ ID NO: 8144191 - DNA, 22 bp, Homo sapiens
cccacactcagttccccttggg

SEQ ID NO: 8144192 - DNA, 18 bp, Homo sapiens
cccaccctggctcttagt

SEQ ID NO: 8144193 - DNA, 18 bp, Homo sapiens
cccaccctggctcttagt

SEQ ID NO: 8144194 - DNA, 22 bp, Homo sapiens
cccactcctggagctagggctc

SEQ ID NO: 8144195 - DNA, 22 bp, Homo sapiens
cccactctggctcccttctagt

SEQ ID NO: 8144196 - DNA, 22 bp, Homo sapiens
cccactgctgctctccatggca

SEQ ID NO: 8144197 - DNA, 22 bp, Homo sapiens
aggctgtgcacagggcacctgc

SEQ ID NO: 8144198 - DNA, 22 bp, Homo sapiens
aggctgtgcattttggagggcc

SEQ ID NO: 8144199 - DNA, 22 bp, Homo sapiens
cccagaggtgcttcagaggtgc

SEQ ID NO: 8144200 - DNA, 22 bp, Homo sapiens
cccagaggttccttagggacca

SEQ ID NO: 8144201 - DNA, 22 bp, Homo sapiens
cccagaggttccttagggacca

SEQ ID NO: 8144202 - DNA, 20 bp, Homo sapiens
cccagaggttgcggcaggag

SEQ ID NO: 8144203 - DNA, 22 bp, Homo sapiens
cccagaggtgacatcccattct

SEQ ID NO: 8144204 - DNA, 22 bp, Homo sapiens
cccagaggtgcttcagaggtgc

SEQ ID NO: 8144205 - DNA, 22 bp, Homo sapiens
cccagaggtgacatcccattct

SEQ ID NO: 8144206 - DNA, 22 bp, Homo sapiens
aggctgtgcgaggtctcagagt

SEQ ID NO: 8144207 - DNA, 22 bp, Homo sapiens
aggctgtgcgaggtctcagagt

SEQ ID NO: 8144208 - DNA, 22 bp, Homo sapiens
aggctgtggccctggtctagca

SEQ ID NO: 8144209 - DNA, 22 bp, Homo sapiens
aggctgtggccctggtctagca

SEQ ID NO: 8144210 - DNA, 22 bp, Homo sapiens
aggctgtgggagttgagagtct

SEQ ID NO: 8144211 - DNA, 22 bp, Homo sapiens
aggctgtggccctggtctagca

SEQ ID NO: 8144212 - DNA, 22 bp, Homo sapiens
aggctgtgggaatggctgcttg

SEQ ID NO: 8144213 - DNA, 22 bp, Homo sapiens
aggctgtgggaatggctgcttg

SEQ ID NO: 8144214 - DNA, 22 bp, Homo sapiens
aggctcagagatgagtaagcac

SEQ ID NO: 8144215 - DNA, 22 bp, Homo sapiens
aggctcagagatgagtaagcac

SEQ ID NO: 8144216 - DNA, 22 bp, Homo sapiens
aggctcagagatgagtaagcac

SEQ ID NO: 8144217 - DNA, 22 bp, Homo sapiens
aggctcagagatgagtaagcac

SEQ ID NO: 8144218 - DNA, 22 bp, Homo sapiens
aggctcagagatgagtaagcac

SEQ ID NO: 8144219 - DNA, 21 bp, Homo sapiens
aggctcagagatcaaacagta

SEQ ID NO: 8144220 - DNA, 21 bp, Homo sapiens
aggctcagagatcaaacagta

SEQ ID NO: 8144221 - DNA, 21 bp, Homo sapiens
aggctcagagatcaaacagta

SEQ ID NO: 8144222 - DNA, 22 bp, Homo sapiens
aggctcagagagctgtgtccat

SEQ ID NO: 8144223 - DNA, 22 bp, Homo sapiens
aggctcagagagctgtgtccat

SEQ ID NO: 8144224 - DNA, 21 bp, Homo sapiens
aggctcagagagaaactcttg

SEQ ID NO: 8144225 - DNA, 22 bp, Homo sapiens
aggctagatagagggtcatctt

SEQ ID NO: 8144226 - DNA, 22 bp, Homo sapiens
aggctagaggcttctggcttca

SEQ ID NO: 8144227 - DNA, 22 bp, Homo sapiens
aggctagaggcttctggcttca

SEQ ID NO: 8144228 - DNA, 22 bp, Homo sapiens
aggctagaggcttctggcttca

SEQ ID NO: 8144229 - DNA, 22 bp, Homo sapiens
aggctagaggcttctggcttca

SEQ ID NO: 8144230 - DNA, 22 bp, Homo sapiens
aggcctggtgtgccggatgcag

SEQ ID NO: 8144231 - DNA, 22 bp, Homo sapiens
aggcctggtgtgccggatgcag

SEQ ID NO: 8144232 - DNA, 22 bp, Homo sapiens
aggcctggtgtgccggatgcag

SEQ ID NO: 8144233 - DNA, 22 bp, Homo sapiens
aggcctgggtctcgtgcctacc

SEQ ID NO: 8144234 - DNA, 22 bp, Homo sapiens
aggcctgggtgttcaccagaag

SEQ ID NO: 8144235 - DNA, 22 bp, Homo sapiens
aggcctgggtgttcaccagaag

SEQ ID NO: 8144236 - DNA, 22 bp, Homo sapiens
aggcctggtgaatgaagtatct

SEQ ID NO: 8144237 - DNA, 22 bp, Homo sapiens
aggcctggtgaatgaagtatct

SEQ ID NO: 8144238 - DNA, 22 bp, Homo sapiens
aggcctggtgaatgaagtatct

SEQ ID NO: 8144239 - DNA, 22 bp, Homo sapiens
aggcctggtgtgccggatgcag

SEQ ID NO: 8144240 - DNA, 19 bp, Homo sapiens
aggcctggggttttgcact

SEQ ID NO: 8144241 - DNA, 22 bp, Homo sapiens
aggcctgggcaagaaggggcgt

SEQ ID NO: 8144242 - DNA, 22 bp, Homo sapiens
aggcctgggcaagaaggggcgt

SEQ ID NO: 8144243 - DNA, 22 bp, Homo sapiens
aggcctgggcaagaaggggcgt

SEQ ID NO: 8144244 - DNA, 22 bp, Homo sapiens
aggcctgggcaagaaggggcgt

SEQ ID NO: 8144245 - DNA, 22 bp, Homo sapiens
aggcctgggtctcgtgcctacc

SEQ ID NO: 8144246 - DNA, 22 bp, Homo sapiens
aggcctgggtctcgtgcctacc

SEQ ID NO: 8144247 - DNA, 22 bp, Homo sapiens
aggcctgggtctcgtgcctacc

SEQ ID NO: 8144248 - DNA, 19 bp, Homo sapiens
aggcctggggttttgcact

SEQ ID NO: 8144249 - DNA, 22 bp, Homo sapiens
aggctcagaggtgagcatctgc

SEQ ID NO: 8144250 - DNA, 22 bp, Homo sapiens
aggctcagaggtgagcatctgc

SEQ ID NO: 8144251 - DNA, 16 bp, Homo sapiens
aggctcagaggctgga

SEQ ID NO: 8144252 - DNA, 16 bp, Homo sapiens
aggctcagaggctgga

SEQ ID NO: 8144253 - DNA, 16 bp, Homo sapiens
aggctcagaggctgga

SEQ ID NO: 8144254 - DNA, 16 bp, Homo sapiens
aggctcagaggctgga

SEQ ID NO: 8144255 - DNA, 20 bp, Homo sapiens
aggctcagagcagtagtaca

SEQ ID NO: 8144256 - DNA, 20 bp, Homo sapiens
aggctcagagcagtagtaca

SEQ ID NO: 8144257 - DNA, 20 bp, Homo sapiens
aggctcagagcagtagtaca

SEQ ID NO: 8144258 - DNA, 20 bp, Homo sapiens
aggctcagatacccagggaa

SEQ ID NO: 8144259 - DNA, 20 bp, Homo sapiens
aggctcagatacccagggaa

SEQ ID NO: 8144260 - DNA, 20 bp, Homo sapiens
aggctcagatacccagggaa

SEQ ID NO: 8144261 - DNA, 22 bp, Homo sapiens
ccaggcacaggtgggcctcaga

SEQ ID NO: 8144262 - DNA, 22 bp, Homo sapiens
ccaggcacaggtgggcctcaga

SEQ ID NO: 8144263 - DNA, 20 bp, Homo sapiens
aggctcagatacccagggaa

SEQ ID NO: 8144264 - DNA, 20 bp, Homo sapiens
aggctcagatacccagggaa

SEQ ID NO: 8144265 - DNA, 22 bp, Homo sapiens
ccaggcacggtggctcatgcct

SEQ ID NO: 8144266 - DNA, 22 bp, Homo sapiens
ccaggcacggtggctcatgcct

SEQ ID NO: 8144267 - DNA, 22 bp, Homo sapiens
ccaggcactcacggggcactgg

SEQ ID NO: 8144268 - DNA, 18 bp, Homo sapiens
ccaggcacctttaaatat

SEQ ID NO: 8144269 - DNA, 22 bp, Homo sapiens
ccaggcaccatgttcttaggac

SEQ ID NO: 8144270 - DNA, 22 bp, Homo sapiens
ccaggcaccatgttcttaggac

SEQ ID NO: 8144271 - DNA, 22 bp, Homo sapiens
ccaggcaccaaagtatgcttta

SEQ ID NO: 8144272 - DNA, 22 bp, Homo sapiens
ccaggcaccatgttcttaggac

SEQ ID NO: 8144273 - DNA, 22 bp, Homo sapiens
ccaggcactgctcgaggtgcta

SEQ ID NO: 8144274 - DNA, 22 bp, Homo sapiens
ccaggcactgctcgaggtgcta

SEQ ID NO: 8144275 - DNA, 22 bp, Homo sapiens
ccaggcactgctcgaggtgcta

SEQ ID NO: 8144276 - DNA, 22 bp, Homo sapiens
ccaggcactcagagactgggac

SEQ ID NO: 8144277 - DNA, 22 bp, Homo sapiens
ccaggcactcagagactgggac

SEQ ID NO: 8144278 - DNA, 20 bp, Homo sapiens
ccaggcactgtcccatgcag

SEQ ID NO: 8144279 - DNA, 22 bp, Homo sapiens
ccaggcactggctgggttcttt

SEQ ID NO: 8144280 - DNA, 22 bp, Homo sapiens
aggccctggacactcaagccgg

SEQ ID NO: 8144281 - DNA, 22 bp, Homo sapiens
aggccctgctttccagagctca

SEQ ID NO: 8144282 - DNA, 22 bp, Homo sapiens
aggccctgctttccagagctca

SEQ ID NO: 8144283 - DNA, 22 bp, Homo sapiens
aggccctgctttccagagctca

SEQ ID NO: 8144284 - DNA, 22 bp, Homo sapiens
aggccctgctgaggcctccctc

SEQ ID NO: 8144285 - DNA, 22 bp, Homo sapiens
aggccctgctgaggcctccctc

SEQ ID NO: 8144286 - DNA, 22 bp, Homo sapiens
aggccctgctttccagagctca

SEQ ID NO: 8144287 - DNA, 22 bp, Homo sapiens
aggccctggcactgcctgggag

SEQ ID NO: 8144288 - DNA, 21 bp, Homo sapiens
aggccctggaggtcagagaaa

SEQ ID NO: 8144289 - DNA, 22 bp, Homo sapiens
ccagctccaggtagatgggcag

SEQ ID NO: 8144290 - DNA, 21 bp, Homo sapiens
aggccctggaggtcagagaaa

SEQ ID NO: 8144291 - DNA, 22 bp, Homo sapiens
ccagctccgggagttgctgctg

SEQ ID NO: 8144292 - DNA, 22 bp, Homo sapiens
ccagctcccgcaggctgcacag

SEQ ID NO: 8144293 - DNA, 22 bp, Homo sapiens
ccagctcccgcaggctgcacag

SEQ ID NO: 8144294 - DNA, 22 bp, Homo sapiens
ccagctccctgaagcctggtct

SEQ ID NO: 8144295 - DNA, 22 bp, Homo sapiens
ccagctccctgaagcctggtct

SEQ ID NO: 8144296 - DNA, 23 bp, Homo sapiens
ccagctcccaggtctgaggactg

SEQ ID NO: 8144297 - DNA, 23 bp, Homo sapiens
ccagctcccaggtctgaggactg

SEQ ID NO: 8144298 - DNA, 22 bp, Homo sapiens
ccagctcccattcttcacctgt

SEQ ID NO: 8144299 - DNA, 23 bp, Homo sapiens
ccagctcccaggtctgaggactg

SEQ ID NO: 8144300 - DNA, 23 bp, Homo sapiens
ccagctcccaggtctgaggactg

SEQ ID NO: 8144301 - DNA, 22 bp, Homo sapiens
ccagctcccctcagcaggtaat

SEQ ID NO: 8144302 - DNA, 22 bp, Homo sapiens
ccagctcccgcaggctgcacag

SEQ ID NO: 8144303 - DNA, 22 bp, Homo sapiens
ccaggaggttgaggctgcagtg

SEQ ID NO: 8144304 - DNA, 22 bp, Homo sapiens
ccaggaggttgaggctgcagtg

SEQ ID NO: 8144305 - DNA, 22 bp, Homo sapiens
aggcctgggcaagaaggggcgt

SEQ ID NO: 8144306 - DNA, 22 bp, Homo sapiens
aggcctgggacgggagccgtga

SEQ ID NO: 8144307 - DNA, 22 bp, Homo sapiens
ccaggaggtggcaggacttgcc

SEQ ID NO: 8144308 - DNA, 22 bp, Homo sapiens
ccaggaggtggcaggacttgcc

SEQ ID NO: 8144309 - DNA, 22 bp, Homo sapiens
ccaggaggtggaggttgcggtg

SEQ ID NO: 8144310 - DNA, 22 bp, Homo sapiens
ccaggaggtggaggttgcggtg

SEQ ID NO: 8144311 - DNA, 22 bp, Homo sapiens
ccaggaggtggagattgcagtg

SEQ ID NO: 8144312 - DNA, 22 bp, Homo sapiens
ccaggaggtggagattgcagtg

SEQ ID NO: 8144313 - DNA, 22 bp, Homo sapiens
ccaggaggtggagattgcagtg

SEQ ID NO: 8144314 - DNA, 22 bp, Homo sapiens
ccaggaggggtctctgtctccc

SEQ ID NO: 8144315 - DNA, 22 bp, Homo sapiens
ccaggaggggtctctgtctccc

SEQ ID NO: 8144316 - DNA, 22 bp, Homo sapiens
ccaggaggatgaggggcataga

SEQ ID NO: 8144317 - DNA, 22 bp, Homo sapiens
ccaggaggtgaaacttcaccag

SEQ ID NO: 8144318 - DNA, 22 bp, Homo sapiens
ccaggaggtctgagtgtggaca

SEQ ID NO: 8144319 - DNA, 22 bp, Homo sapiens
ccagaggcagacttacactcca

SEQ ID NO: 8144320 - DNA, 22 bp, Homo sapiens
ccagaggatgctggtcagcctc

SEQ ID NO: 8144321 - DNA, 22 bp, Homo sapiens
ccagaggcagacttacactcca

SEQ ID NO: 8144322 - DNA, 18 bp, Homo sapiens
ccagaggcccgggcaggc

SEQ ID NO: 8144323 - DNA, 18 bp, Homo sapiens
ccagaggcccgggcaggc

SEQ ID NO: 8144324 - DNA, 22 bp, Homo sapiens
ccagaggcatgttcaaagcaat

SEQ ID NO: 8144325 - DNA, 22 bp, Homo sapiens
ccagaggcatgttcaaagcaat

SEQ ID NO: 8144326 - DNA, 20 bp, Homo sapiens
ccagagctgatggctgcccg

SEQ ID NO: 8144327 - DNA, 20 bp, Homo sapiens
ccagagctgatggctgcccg

SEQ ID NO: 8144328 - DNA, 22 bp, Homo sapiens
ccagaggatgctggtcagcctc

SEQ ID NO: 8144329 - DNA, 19 bp, Homo sapiens
aggcaggtgcagaggtccc

SEQ ID NO: 8144330 - DNA, 19 bp, Homo sapiens
aggcaggtgcagaggtccc

SEQ ID NO: 8144331 - DNA, 22 bp, Homo sapiens
aggcaggtgagtcaaaacagac

SEQ ID NO: 8144332 - DNA, 19 bp, Homo sapiens
aggcaggtgcagaggtccc

SEQ ID NO: 8144333 - DNA, 19 bp, Homo sapiens
aggcaggtgcagaggtccc

SEQ ID NO: 8144334 - DNA, 19 bp, Homo sapiens
aggcaggtgcagaggtccc

SEQ ID NO: 8144335 - DNA, 20 bp, Homo sapiens
ccagagctgatggctgcccg

SEQ ID NO: 8144336 - DNA, 22 bp, Homo sapiens
aggcaggtagaaggatctttat

SEQ ID NO: 8144337 - DNA, 22 bp, Homo sapiens
aggcaggtagaaggatctttat

SEQ ID NO: 8144338 - DNA, 22 bp, Homo sapiens
aggcaggtcacatgcttggcga

SEQ ID NO: 8144339 - DNA, 22 bp, Homo sapiens
aggcaggtcacatgcttggcga

SEQ ID NO: 8144340 - DNA, 22 bp, Homo sapiens
aggcaggtcacatgcttggcga

SEQ ID NO: 8144341 - DNA, 22 bp, Homo sapiens
aggcaggtcacatgcttggcga

SEQ ID NO: 8144342 - DNA, 20 bp, Homo sapiens
ccactccaggtgattctgat

SEQ ID NO: 8144343 - DNA, 22 bp, Homo sapiens
ccactcccttccggtccagggc

SEQ ID NO: 8144344 - DNA, 22 bp, Homo sapiens
ccactcccttccggtccagggc

SEQ ID NO: 8144345 - DNA, 22 bp, Homo sapiens
aggcaggtcccctggaaggcac

SEQ ID NO: 8144346 - DNA, 22 bp, Homo sapiens
aggcaggtcccctggaaggcac

SEQ ID NO: 8144347 - DNA, 22 bp, Homo sapiens
aggcaggtcccctggaaggcac

SEQ ID NO: 8144348 - DNA, 22 bp, Homo sapiens
aggcaggtcccctggaaggcac

SEQ ID NO: 8144349 - DNA, 22 bp, Homo sapiens
aggcaggtgagtcaaaacagac

SEQ ID NO: 8144350 - DNA, 22 bp, Homo sapiens
aggcaggtctgtatctagtctc

SEQ ID NO: 8144351 - DNA, 22 bp, Homo sapiens
aggcaggtctgtatctagtctc

SEQ ID NO: 8144352 - DNA, 22 bp, Homo sapiens
aggcaggtctgtatctagtctc

SEQ ID NO: 8144353 - DNA, 22 bp, Homo sapiens
aggcaggtcccctggaaggcac

SEQ ID NO: 8144354 - DNA, 22 bp, Homo sapiens
ccagaggtggtggtgtctagaa

SEQ ID NO: 8144355 - DNA, 22 bp, Homo sapiens
ccagaggtggtgggtgctacag

SEQ ID NO: 8144356 - DNA, 22 bp, Homo sapiens
ccagaggtgggagtgatctggt

SEQ ID NO: 8144357 - DNA, 22 bp, Homo sapiens
ccagaggtgggagtgatctggt

SEQ ID NO: 8144358 - DNA, 22 bp, Homo sapiens
ccagaggtgggagtgatctggt

SEQ ID NO: 8144359 - DNA, 22 bp, Homo sapiens
ccagaggtggtggtgtctagaa

SEQ ID NO: 8144360 - DNA, 22 bp, Homo sapiens
ccagagtcaggagctcatgtga

SEQ ID NO: 8144361 - DNA, 22 bp, Homo sapiens
ccagagtagctgccctgcacct

SEQ ID NO: 8144362 - DNA, 22 bp, Homo sapiens
ccagagtcattttgagtcataa

SEQ ID NO: 8144363 - DNA, 21 bp, Homo sapiens
ccagaggttctgggcctccct

SEQ ID NO: 8144364 - DNA, 22 bp, Homo sapiens
ccagaggctggcaagggctcct

SEQ ID NO: 8144365 - DNA, 20 bp, Homo sapiens
ccagaggctgacagactttg

SEQ ID NO: 8144366 - DNA, 20 bp, Homo sapiens
ccagaggctgacagactttg

SEQ ID NO: 8144367 - DNA, 22 bp, Homo sapiens
ccagaggctggcaagggctcct

SEQ ID NO: 8144368 - DNA, 21 bp, Homo sapiens
ccagaggcctctcttggccac

SEQ ID NO: 8144369 - DNA, 22 bp, Homo sapiens
ccagaggcggaggtttgcagtg

SEQ ID NO: 8144370 - DNA, 22 bp, Homo sapiens
ccagaggcggaggtttgcagtg

SEQ ID NO: 8144371 - DNA, 21 bp, Homo sapiens
ccagaggcctctcttggccac

SEQ ID NO: 8144372 - DNA, 21 bp, Homo sapiens
ccagaggcctctcttggccac

SEQ ID NO: 8144373 - DNA, 23 bp, Homo sapiens
aggccctgcctgtccctcttttt

SEQ ID NO: 8144374 - DNA, 23 bp, Homo sapiens
aggccctgcctgtccctcttttt

SEQ ID NO: 8144375 - DNA, 22 bp, Homo sapiens
aggccctgcccagtgccacaag

SEQ ID NO: 8144376 - DNA, 22 bp, Homo sapiens
aggccctgcccagtgccacaag

SEQ ID NO: 8144377 - DNA, 22 bp, Homo sapiens
aggccctgcccagtgccacaag

SEQ ID NO: 8144378 - DNA, 22 bp, Homo sapiens
ccagccctgccagagagagctg

SEQ ID NO: 8144379 - DNA, 22 bp, Homo sapiens
aggccctgacctgggagatcta

SEQ ID NO: 8144380 - DNA, 18 bp, Homo sapiens
ccagccctgcagcacctg

SEQ ID NO: 8144381 - DNA, 18 bp, Homo sapiens
ccagccctgcagcacctg

SEQ ID NO: 8144382 - DNA, 18 bp, Homo sapiens
ccagccctgcagcacctg

SEQ ID NO: 8144383 - DNA, 18 bp, Homo sapiens
ccagccctgcagcacctg

SEQ ID NO: 8144384 - DNA, 17 bp, Homo sapiens
ccagccctcgcgctttt

SEQ ID NO: 8144385 - DNA, 17 bp, Homo sapiens
ccagccctcgcgctttt

SEQ ID NO: 8144386 - DNA, 22 bp, Homo sapiens
ccagccctcctccatcagagga

SEQ ID NO: 8144387 - DNA, 23 bp, Homo sapiens
ccagccctccaccagctctaggc

SEQ ID NO: 8144388 - DNA, 23 bp, Homo sapiens
ccagccctccaccagctctaggc

SEQ ID NO: 8144389 - DNA, 23 bp, Homo sapiens
ccagccctccaccagctctaggc

SEQ ID NO: 8144390 - DNA, 23 bp, Homo sapiens
ccagccctccaccagctctaggc

SEQ ID NO: 8144391 - DNA, 22 bp, Homo sapiens
ccagccctgaaccctgctgcat

SEQ ID NO: 8144392 - DNA, 22 bp, Homo sapiens
ccagccctgaaccctgctgcat

SEQ ID NO: 8144393 - DNA, 22 bp, Homo sapiens
ccagccctcggtagtcccatag

SEQ ID NO: 8144394 - DNA, 22 bp, Homo sapiens
ccagccctcggtagtcccatag

SEQ ID NO: 8144395 - DNA, 22 bp, Homo sapiens
ccagccctcggtagtcccatag

SEQ ID NO: 8144396 - DNA, 22 bp, Homo sapiens
ccagccctgattagagaatgtc

SEQ ID NO: 8144397 - DNA, 22 bp, Homo sapiens
ccagccctgattagagaatgtc

SEQ ID NO: 8144398 - DNA, 22 bp, Homo sapiens
ccagccctgaaccctgctgcat

SEQ ID NO: 8144399 - DNA, 22 bp, Homo sapiens
ccagccctgaaccctgctgcat

SEQ ID NO: 8144400 - DNA, 22 bp, Homo sapiens
ccagccagcaagctcccagttc

SEQ ID NO: 8144401 - DNA, 22 bp, Homo sapiens
ccagcagggaaaaacccaccaa

SEQ ID NO: 8144402 - DNA, 22 bp, Homo sapiens
ccagccagatgataagctctat

SEQ ID NO: 8144403 - DNA, 22 bp, Homo sapiens
ccagccagaagtccgggcttct

SEQ ID NO: 8144404 - DNA, 22 bp, Homo sapiens
ccagcaggcagtcatatccttt

SEQ ID NO: 8144405 - DNA, 22 bp, Homo sapiens
ccagagtctgtgtgtgtcatcc

SEQ ID NO: 8144406 - DNA, 22 bp, Homo sapiens
ccagagtctgtgtgtgtcatcc

SEQ ID NO: 8144407 - DNA, 22 bp, Homo sapiens
ccagagtctatgagtcctcatt

SEQ ID NO: 8144408 - DNA, 22 bp, Homo sapiens
ccagagtcattttgagtcataa

SEQ ID NO: 8144409 - DNA, 22 bp, Homo sapiens
ccagccaggcattgcaaactga

SEQ ID NO: 8144410 - DNA, 22 bp, Homo sapiens
ccagccaggcattgcaaactga

SEQ ID NO: 8144411 - DNA, 22 bp, Homo sapiens
ccagccaggctggctgtggagg

SEQ ID NO: 8144412 - DNA, 22 bp, Homo sapiens
ccagccaggctggctgtggagg

SEQ ID NO: 8144413 - DNA, 22 bp, Homo sapiens
ccagccaggctggctgtggagg

SEQ ID NO: 8144414 - DNA, 22 bp, Homo sapiens
ccagccaggctggctgtggagg

SEQ ID NO: 8144415 - DNA, 22 bp, Homo sapiens
ccagccagtatattccaaagcc

SEQ ID NO: 8144416 - DNA, 22 bp, Homo sapiens
ccagccagggaaactttttctt

SEQ ID NO: 8144417 - DNA, 22 bp, Homo sapiens
ccagccagctggttggacgcct

SEQ ID NO: 8144418 - DNA, 22 bp, Homo sapiens
ccagccagctggttggacgcct

SEQ ID NO: 8144419 - DNA, 22 bp, Homo sapiens
ccagccagctggttggacgcct

SEQ ID NO: 8144420 - DNA, 22 bp, Homo sapiens
ccagccagctgcccttggggcc

SEQ ID NO: 8144421 - DNA, 22 bp, Homo sapiens
ccagccagctggttggacgcct

SEQ ID NO: 8144422 - DNA, 22 bp, Homo sapiens
ccagccagccttgatctgagta

SEQ ID NO: 8144423 - DNA, 22 bp, Homo sapiens
ccagccagccttgatctgagta

SEQ ID NO: 8144424 - DNA, 22 bp, Homo sapiens
ccagccagctgcccttggggcc

SEQ ID NO: 8144425 - DNA, 22 bp, Homo sapiens
ccagccagccttgatctgagta

SEQ ID NO: 8144426 - DNA, 22 bp, Homo sapiens
agggctcaagggcatgctacgt

SEQ ID NO: 8144427 - DNA, 22 bp, Homo sapiens
agggctcaatggtgggcatgta

SEQ ID NO: 8144428 - DNA, 22 bp, Homo sapiens
agggctcaccactgtgcactcc

SEQ ID NO: 8144429 - DNA, 22 bp, Homo sapiens
agggctcaccactgtgcactcc

SEQ ID NO: 8144430 - DNA, 22 bp, Homo sapiens
agggctcaatggtgggcatgta

SEQ ID NO: 8144431 - DNA, 22 bp, Homo sapiens
agggccagttcagaggacatgg

SEQ ID NO: 8144432 - DNA, 22 bp, Homo sapiens
agggccagttcagaggacatgg

SEQ ID NO: 8144433 - DNA, 22 bp, Homo sapiens
agggccagttcagaggacatgg

SEQ ID NO: 8144434 - DNA, 22 bp, Homo sapiens
agggccagttctacctctgaat

SEQ ID NO: 8144435 - DNA, 22 bp, Homo sapiens
agggccagttctacctctgaat

SEQ ID NO: 8144436 - DNA, 22 bp, Homo sapiens
agggccagttctacctctgaat

SEQ ID NO: 8144437 - DNA, 22 bp, Homo sapiens
agggcctgtcagcggtgtcctg

SEQ ID NO: 8144438 - DNA, 22 bp, Homo sapiens
agggcctgtcagcggtgtcctg

SEQ ID NO: 8144439 - DNA, 22 bp, Homo sapiens
agggccagttctacctctgaat

SEQ ID NO: 8144440 - DNA, 22 bp, Homo sapiens
agggccagtaccaggtgggtgg

SEQ ID NO: 8144441 - DNA, 22 bp, Homo sapiens
agggccagcccataatgccaaa

SEQ ID NO: 8144442 - DNA, 22 bp, Homo sapiens
agggccagtaaatgtttcctca

SEQ ID NO: 8144443 - DNA, 22 bp, Homo sapiens
agggccagtaaatgtttcctca

SEQ ID NO: 8144444 - DNA, 22 bp, Homo sapiens
agggccagtattaaggtaatta

SEQ ID NO: 8144445 - DNA, 22 bp, Homo sapiens
agggccagtaccaggtgggtgg

SEQ ID NO: 8144446 - DNA, 22 bp, Homo sapiens
agggccagtaccaggtgggtgg

SEQ ID NO: 8144447 - DNA, 22 bp, Homo sapiens
agggccagtaccaggtgggtgg

SEQ ID NO: 8144448 - DNA, 22 bp, Homo sapiens
agggccagtgggttgaaaggca

SEQ ID NO: 8144449 - DNA, 22 bp, Homo sapiens
agggccagttcagaggacatgg

SEQ ID NO: 8144450 - DNA, 22 bp, Homo sapiens
agggccagtcgtgtattactgt

SEQ ID NO: 8144451 - DNA, 22 bp, Homo sapiens
agggccagtgggttgaaaggca

SEQ ID NO: 8144452 - DNA, 22 bp, Homo sapiens
agggccagcactcctggcagga

SEQ ID NO: 8144453 - DNA, 22 bp, Homo sapiens
agggccagcactcctggcagga

SEQ ID NO: 8144454 - DNA, 22 bp, Homo sapiens
agggccagcagcttggccaacc

SEQ ID NO: 8144455 - DNA, 22 bp, Homo sapiens
agggccagcactcctggcagga

SEQ ID NO: 8144456 - DNA, 22 bp, Homo sapiens
agggccagcactcctggcagga

SEQ ID NO: 8144457 - DNA, 22 bp, Homo sapiens
agggccagcactcctggcagga

SEQ ID NO: 8144458 - DNA, 22 bp, Homo sapiens
agggccagcactcctggcagga

SEQ ID NO: 8144459 - DNA, 22 bp, Homo sapiens
agggccagcactcctggcagga

SEQ ID NO: 8144460 - DNA, 22 bp, Homo sapiens
agggccagcccataatgccaaa

SEQ ID NO: 8144461 - DNA, 22 bp, Homo sapiens
agggccagccaggccctacaaa

SEQ ID NO: 8144462 - DNA, 22 bp, Homo sapiens
agggcatgctggaggagagaca

SEQ ID NO: 8144463 - DNA, 22 bp, Homo sapiens
agggcactgcaagggttgaagg

SEQ ID NO: 8144464 - DNA, 22 bp, Homo sapiens
agggcactgaacagctgtagca

SEQ ID NO: 8144465 - DNA, 22 bp, Homo sapiens
agggccagcactcctggcagga

SEQ ID NO: 8144466 - DNA, 22 bp, Homo sapiens
agggccagatgaagccacaagc

SEQ ID NO: 8144467 - DNA, 22 bp, Homo sapiens
agggccagcactcctggcagga

SEQ ID NO: 8144468 - DNA, 22 bp, Homo sapiens
agggccagatgaagccacaagc

SEQ ID NO: 8144469 - DNA, 22 bp, Homo sapiens
agggccagatgaagccacaagc

SEQ ID NO: 8144470 - DNA, 22 bp, Homo sapiens
agggcatgctggaggagagaca

SEQ ID NO: 8144471 - DNA, 21 bp, Homo sapiens
agggccagatcaccaaggagc

SEQ ID NO: 8144472 - DNA, 22 bp, Homo sapiens
accagagaaaacacagcaggct

SEQ ID NO: 8144473 - DNA, 20 bp, Homo sapiens
accagagacctgaatcagtt

SEQ ID NO: 8144474 - DNA, 22 bp, Homo sapiens
accagagaatttagccaagaaa

SEQ ID NO: 8144475 - DNA, 22 bp, Homo sapiens
accagagcagactactggaggt

SEQ ID NO: 8144476 - DNA, 22 bp, Homo sapiens
accagagcagactactggaggt

SEQ ID NO: 8144477 - DNA, 22 bp, Homo sapiens
accagagagcctaggctgggca

SEQ ID NO: 8144478 - DNA, 22 bp, Homo sapiens
accagagagagacagggttgtg

SEQ ID NO: 8144479 - DNA, 22 bp, Homo sapiens
agggaggcaggaaagttgtctg

SEQ ID NO: 8144480 - DNA, 22 bp, Homo sapiens
agggaggatctgctccttgtct

SEQ ID NO: 8144481 - DNA, 22 bp, Homo sapiens
agggaggatctgctccttgtct

SEQ ID NO: 8144482 - DNA, 22 bp, Homo sapiens
agggaggatagtagtcagttta

SEQ ID NO: 8144483 - DNA, 22 bp, Homo sapiens
agggaggatctgctccttgtct

SEQ ID NO: 8144484 - DNA, 22 bp, Homo sapiens
agggaggatagtagtcagttta

SEQ ID NO: 8144485 - DNA, 22 bp, Homo sapiens
agggaggatagtagtcagttta

SEQ ID NO: 8144486 - DNA, 22 bp, Homo sapiens
agggagctgactggctgccatt

SEQ ID NO: 8144487 - DNA, 22 bp, Homo sapiens
agggaggatagtagtcagttta

SEQ ID NO: 8144488 - DNA, 22 bp, Homo sapiens
accagagctcttcagcacagga

SEQ ID NO: 8144489 - DNA, 20 bp, Homo sapiens
accagagctctcagtatgtg

SEQ ID NO: 8144490 - DNA, 22 bp, Homo sapiens
agggagctgactggctgccatt

SEQ ID NO: 8144491 - DNA, 22 bp, Homo sapiens
agggagctgactggctgccatt

SEQ ID NO: 8144492 - DNA, 22 bp, Homo sapiens
agggagctgactggctgccatt

SEQ ID NO: 8144493 - DNA, 22 bp, Homo sapiens
accagagcccatctgctcctag

SEQ ID NO: 8144494 - DNA, 22 bp, Homo sapiens
accagagcagactactggaggt

SEQ ID NO: 8144495 - DNA, 22 bp, Homo sapiens
accagagcgctcaagccttccc

SEQ ID NO: 8144496 - DNA, 19 bp, Homo sapiens
agggaggtagcattggaaa

SEQ ID NO: 8144497 - DNA, 22 bp, Homo sapiens
agggaggcattagctactgcga

SEQ ID NO: 8144498 - DNA, 22 bp, Homo sapiens
agggaggcattagctactgcga

SEQ ID NO: 8144499 - DNA, 22 bp, Homo sapiens
agggaggcattagctactgcga

SEQ ID NO: 8144500 - DNA, 22 bp, Homo sapiens
agggaggtaggagcttctagct

SEQ ID NO: 8144501 - DNA, 22 bp, Homo sapiens
agggaggtccatccctgcagag

SEQ ID NO: 8144502 - DNA, 22 bp, Homo sapiens
agggaggtaggagcttctagct

SEQ ID NO: 8144503 - DNA, 22 bp, Homo sapiens
agggaggtccatccctgcagag

SEQ ID NO: 8144504 - DNA, 22 bp, Homo sapiens
agggaggtctggctgccctgag

SEQ ID NO: 8144505 - DNA, 22 bp, Homo sapiens
agggaggtctggctgccctgag

SEQ ID NO: 8144506 - DNA, 22 bp, Homo sapiens
agggaggtctggctgccctgag

SEQ ID NO: 8144507 - DNA, 20 bp, Homo sapiens
agggaggtgctgggcctgag

SEQ ID NO: 8144508 - DNA, 18 bp, Homo sapiens
agggatgtatgctggtgg

SEQ ID NO: 8144509 - DNA, 17 bp, Homo sapiens
agggagtcagaggatcg

SEQ ID NO: 8144510 - DNA, 22 bp, Homo sapiens
agggatgtgacattacagaagc

SEQ ID NO: 8144511 - DNA, 22 bp, Homo sapiens
agggaggtggttccccagtgga

SEQ ID NO: 8144512 - DNA, 19 bp, Homo sapiens
agggcacagggacagaagg

SEQ ID NO: 8144513 - DNA, 22 bp, Homo sapiens
agggcacatctgctgggaatgg

SEQ ID NO: 8144514 - DNA, 21 bp, Homo sapiens
agggcacccccgctgcctacc

SEQ ID NO: 8144515 - DNA, 22 bp, Homo sapiens
agggcacagcctaaagcctatg

SEQ ID NO: 8144516 - DNA, 22 bp, Homo sapiens
agggcacagcctaaagcctatg

SEQ ID NO: 8144517 - DNA, 22 bp, Homo sapiens
agggcacaagactctgagcccc

SEQ ID NO: 8144518 - DNA, 22 bp, Homo sapiens
agggcaagggttgaagataaga

SEQ ID NO: 8144519 - DNA, 22 bp, Homo sapiens
agggatgttgtcaaggatgtgg

SEQ ID NO: 8144520 - DNA, 22 bp, Homo sapiens
agggatgttcattttgtggctg

SEQ ID NO: 8144521 - DNA, 22 bp, Homo sapiens
agggatgttagttgtgagctca

SEQ ID NO: 8144522 - DNA, 22 bp, Homo sapiens
agggatgtgggaactgcaggtt

SEQ ID NO: 8144523 - DNA, 22 bp, Homo sapiens
agggctcagaaatgtctacggg

SEQ ID NO: 8144524 - DNA, 22 bp, Homo sapiens
agggctcagaaagcaggttttc

SEQ ID NO: 8144525 - DNA, 22 bp, Homo sapiens
agggctcactgggaggctataa

SEQ ID NO: 8144526 - DNA, 22 bp, Homo sapiens
agggctcagccagcctgtgtgc

SEQ ID NO: 8144527 - DNA, 22 bp, Homo sapiens
agggctcagcatctcattctgt

SEQ ID NO: 8144528 - DNA, 22 bp, Homo sapiens
agggctcagcctcctcctcagc

SEQ ID NO: 8144529 - DNA, 22 bp, Homo sapiens
agggctcagcctcctcctcagc

SEQ ID NO: 8144530 - DNA, 22 bp, Homo sapiens
agggctcagggcacgtcatcca

SEQ ID NO: 8144531 - DNA, 22 bp, Homo sapiens
agggctcagggcacgtcatcca

SEQ ID NO: 8144532 - DNA, 22 bp, Homo sapiens
agggctcaggggccccaagctg

SEQ ID NO: 8144533 - DNA, 22 bp, Homo sapiens
agggctcagggtcaccatctgt

SEQ ID NO: 8144534 - DNA, 22 bp, Homo sapiens
agggctcagttgcctggagccc

SEQ ID NO: 8144535 - DNA, 22 bp, Homo sapiens
agggctgaagggaggtgctcat

SEQ ID NO: 8144536 - DNA, 22 bp, Homo sapiens
agggctgaaacataatccttct

SEQ ID NO: 8144537 - DNA, 22 bp, Homo sapiens
agggctgaagggaggtgctcat

SEQ ID NO: 8144538 - DNA, 22 bp, Homo sapiens
agggctgaaacataatccttct

SEQ ID NO: 8144539 - DNA, 22 bp, Homo sapiens
agggctgaagttatggctgagc

SEQ ID NO: 8144540 - DNA, 22 bp, Homo sapiens
agggctgaagttatggctgagc

SEQ ID NO: 8144541 - DNA, 22 bp, Homo sapiens
agggctgacagtgaggagtcaa

SEQ ID NO: 8144542 - DNA, 22 bp, Homo sapiens
agggctgacagtaaaagtatga

SEQ ID NO: 8144543 - DNA, 22 bp, Homo sapiens
agggctgacacaccttatcctc

SEQ ID NO: 8144544 - DNA, 22 bp, Homo sapiens
agggctgacacaccttatcctc

SEQ ID NO: 8144545 - DNA, 22 bp, Homo sapiens
agggctgacaaatggcagtgac

SEQ ID NO: 8144546 - DNA, 22 bp, Homo sapiens
agggctgacaaatggcagtgac

SEQ ID NO: 8144547 - DNA, 22 bp, Homo sapiens
agggctgacaaatggcagtgac

SEQ ID NO: 8144548 - DNA, 23 bp, Homo sapiens
agggctgaatgcagagaagcaga

SEQ ID NO: 8144549 - DNA, 22 bp, Homo sapiens
agggctgaagttatggctgagc

SEQ ID NO: 8144550 - DNA, 23 bp, Homo sapiens
agggctgaatgcagagaagcaga

SEQ ID NO: 8144551 - DNA, 23 bp, Homo sapiens
agggctgaatgcagagaagcaga

SEQ ID NO: 8144552 - DNA, 22 bp, Homo sapiens
agggctgacaaatggcagtgac

SEQ ID NO: 8144553 - DNA, 22 bp, Homo sapiens
agggctgacaaatggcagtgac

SEQ ID NO: 8144554 - DNA, 22 bp, Homo sapiens
agggctttctttgtaaaagaag

SEQ ID NO: 8144555 - DNA, 22 bp, Homo sapiens
aggggagcatctgtgatggtta

SEQ ID NO: 8144556 - DNA, 22 bp, Homo sapiens
aggggagccgaggggcatctgt

SEQ ID NO: 8144557 - DNA, 22 bp, Homo sapiens
aggggcagttccaagttttgtg

SEQ ID NO: 8144558 - DNA, 22 bp, Homo sapiens
aggggcagttccaagttttgtg

SEQ ID NO: 8144559 - DNA, 22 bp, Homo sapiens
aggggcagttccaagttttgtg

SEQ ID NO: 8144560 - DNA, 22 bp, Homo sapiens
aggggaggagcttttcttgcct

SEQ ID NO: 8144561 - DNA, 22 bp, Homo sapiens
aggggcaggtgctgcacttaga

SEQ ID NO: 8144562 - DNA, 22 bp, Homo sapiens
aggggcaggtgctgcacttaga

SEQ ID NO: 8144563 - DNA, 22 bp, Homo sapiens
aggggagctaacaccagagccc

SEQ ID NO: 8144564 - DNA, 23 bp, Homo sapiens
aggggtggtcagtacccgcagtg

SEQ ID NO: 8144565 - DNA, 22 bp, Homo sapiens
aggggttggacataagacagaa

SEQ ID NO: 8144566 - DNA, 22 bp, Homo sapiens
aggggttggatttggcctagag

SEQ ID NO: 8144567 - DNA, 22 bp, Homo sapiens
aggggtgtgcatcctggaggat

SEQ ID NO: 8144568 - DNA, 20 bp, Homo sapiens
agggtcagtagcacagagct

SEQ ID NO: 8144569 - DNA, 20 bp, Homo sapiens
agggtcagtagcacagagct

SEQ ID NO: 8144570 - DNA, 20 bp, Homo sapiens
agggtcagtagcacagagct

SEQ ID NO: 8144571 - DNA, 22 bp, Homo sapiens
agggtcagtagtgatgcgtgaa

SEQ ID NO: 8144572 - DNA, 22 bp, Homo sapiens
agggtcagtgatgagggagccc

SEQ ID NO: 8144573 - DNA, 22 bp, Homo sapiens
aggggtggcctgccttactccc

SEQ ID NO: 8144574 - DNA, 22 bp, Homo sapiens
aggggtgatttgggacaggaca

SEQ ID NO: 8144575 - DNA, 22 bp, Homo sapiens
aggggtggagagtgttgccagt

SEQ ID NO: 8144576 - DNA, 22 bp, Homo sapiens
aggggtggagagtgttgccagt

SEQ ID NO: 8144577 - DNA, 22 bp, Homo sapiens
aggggtgatttgggacaggaca

SEQ ID NO: 8144578 - DNA, 20 bp, Homo sapiens
aggggtgatcgggtgacact

SEQ ID NO: 8144579 - DNA, 20 bp, Homo sapiens
aggggtgatcgggtgacact

SEQ ID NO: 8144580 - DNA, 22 bp, Homo sapiens
acctccatggctcagtttcaga

SEQ ID NO: 8144581 - DNA, 22 bp, Homo sapiens
acctccatggctcagtttcaga

SEQ ID NO: 8144582 - DNA, 22 bp, Homo sapiens
aggggccattgttctgcccgct

SEQ ID NO: 8144583 - DNA, 22 bp, Homo sapiens
aggggccaccaccaaggaaggt

SEQ ID NO: 8144584 - DNA, 22 bp, Homo sapiens
aggggccacctgtggcaccctg

SEQ ID NO: 8144585 - DNA, 22 bp, Homo sapiens
aggggccacctgtggcaccctg

SEQ ID NO: 8144586 - DNA, 20 bp, Homo sapiens
aggggcctggaacaggcctt

SEQ ID NO: 8144587 - DNA, 20 bp, Homo sapiens
aggggcctggaacaggcctt

SEQ ID NO: 8144588 - DNA, 22 bp, Homo sapiens
aggggcctcgcaggaccgctcc

SEQ ID NO: 8144589 - DNA, 22 bp, Homo sapiens
aggggcctggacatggacgcgc

SEQ ID NO: 8144590 - DNA, 20 bp, Homo sapiens
aggggcctggaacaggcctt

SEQ ID NO: 8144591 - DNA, 22 bp, Homo sapiens
acctccaggaagctcttggtac

SEQ ID NO: 8144592 - DNA, 22 bp, Homo sapiens
acctcagaggccagggatctag

SEQ ID NO: 8144593 - DNA, 22 bp, Homo sapiens
acctcagagggatgttacaggc

SEQ ID NO: 8144594 - DNA, 22 bp, Homo sapiens
acctcagattgtggctccgctg

SEQ ID NO: 8144595 - DNA, 22 bp, Homo sapiens
acctcagagacctctcaggtgc

SEQ ID NO: 8144596 - DNA, 22 bp, Homo sapiens
acctcagaacggcgttcttgaa

SEQ ID NO: 8144597 - DNA, 22 bp, Homo sapiens
acctcacaagtctctgtcagct

SEQ ID NO: 8144598 - DNA, 22 bp, Homo sapiens
acctcagaggaggctcctggct

SEQ ID NO: 8144599 - DNA, 22 bp, Homo sapiens
acctcagagatacaaaccatgg

SEQ ID NO: 8144600 - DNA, 22 bp, Homo sapiens
acctcacaagtctctgtcagct

SEQ ID NO: 8144601 - DNA, 22 bp, Homo sapiens
acctcaaggaaaatctagacag

SEQ ID NO: 8144602 - DNA, 22 bp, Homo sapiens
acctcaagtgatccactcacct

SEQ ID NO: 8144603 - DNA, 21 bp, Homo sapiens
acctcaagcaacaaccaaggt

SEQ ID NO: 8144604 - DNA, 22 bp, Homo sapiens
acatgtattgacattatattct

SEQ ID NO: 8144605 - DNA, 22 bp, Homo sapiens
acatgtatgctttatgaagtag

SEQ ID NO: 8144606 - DNA, 22 bp, Homo sapiens
acatgtatgctttatgaagtag

SEQ ID NO: 8144607 - DNA, 22 bp, Homo sapiens
acatgtatgctttatgaagtag

SEQ ID NO: 8144608 - DNA, 22 bp, Homo sapiens
acatgtcaatttagtactctta

SEQ ID NO: 8144609 - DNA, 22 bp, Homo sapiens
acatgtcaatttagtactctta

SEQ ID NO: 8144610 - DNA, 22 bp, Homo sapiens
acatgtcaatttagtactctta

SEQ ID NO: 8144611 - DNA, 22 bp, Homo sapiens
acatgtctacacattctgcaat

SEQ ID NO: 8144612 - DNA, 22 bp, Homo sapiens
acatgtacatacacatatgtaa

SEQ ID NO: 8144613 - DNA, 22 bp, Homo sapiens
acatgtacatacacatatgtaa

SEQ ID NO: 8144614 - DNA, 20 bp, Homo sapiens
acatgtactaatgaatacag

SEQ ID NO: 8144615 - DNA, 22 bp, Homo sapiens
acatgtacatacacatatgtaa

SEQ ID NO: 8144616 - DNA, 22 bp, Homo sapiens
acatgtactgttggtgaagagg

SEQ ID NO: 8144617 - DNA, 19 bp, Homo sapiens
acatgtagtagagagagaa

SEQ ID NO: 8144618 - DNA, 22 bp, Homo sapiens
acatgtatacaatgtgtaatga

SEQ ID NO: 8144619 - DNA, 22 bp, Homo sapiens
acatgtatacaatgtgtaatga

SEQ ID NO: 8144620 - DNA, 22 bp, Homo sapiens
acatgtatctgatctgcaattg

SEQ ID NO: 8144621 - DNA, 22 bp, Homo sapiens
acatggctcagtctcatgacag

SEQ ID NO: 8144622 - DNA, 22 bp, Homo sapiens
acatgtaaaagataaattaaca

SEQ ID NO: 8144623 - DNA, 22 bp, Homo sapiens
acatggctaaagcaagtctaga

SEQ ID NO: 8144624 - DNA, 22 bp, Homo sapiens
aggcagtgttcttctaagggca

SEQ ID NO: 8144625 - DNA, 22 bp, Homo sapiens
acatgtaaacatttacagtatt

SEQ ID NO: 8144626 - DNA, 22 bp, Homo sapiens
acatgtaaaaggaacatgcatg

SEQ ID NO: 8144627 - DNA, 22 bp, Homo sapiens
acatgtaaaaggaacatgcatg

SEQ ID NO: 8144628 - DNA, 22 bp, Homo sapiens
acatgtaagactagcttaaagt

SEQ ID NO: 8144629 - DNA, 22 bp, Homo sapiens
acatgtaacatatatgtagcat

SEQ ID NO: 8144630 - DNA, 21 bp, Homo sapiens
acatgtaagagagtttcaaga

SEQ ID NO: 8144631 - DNA, 22 bp, Homo sapiens
acatgtaagactagcttaaagt

SEQ ID NO: 8144632 - DNA, 20 bp, Homo sapiens
aggctcagctgagctcttgg

SEQ ID NO: 8144633 - DNA, 20 bp, Homo sapiens
aggctcagctgagctcttgg

SEQ ID NO: 8144634 - DNA, 20 bp, Homo sapiens
aggctcagctgagctcttgg

SEQ ID NO: 8144635 - DNA, 20 bp, Homo sapiens
aggctcagctgagctcttgg

SEQ ID NO: 8144636 - DNA, 22 bp, Homo sapiens
aggctcagctggtggtgatcgc

SEQ ID NO: 8144637 - DNA, 22 bp, Homo sapiens
aggctcagctggtggtgatcgc

SEQ ID NO: 8144638 - DNA, 22 bp, Homo sapiens
aggctcagctggtggtgatcgc

SEQ ID NO: 8144639 - DNA, 22 bp, Homo sapiens
aggctcaggaggagctgccgga

SEQ ID NO: 8144640 - DNA, 22 bp, Homo sapiens
aggctcaggaggagctgccgga

SEQ ID NO: 8144641 - DNA, 22 bp, Homo sapiens
aggctcaggaggagctgccgga

SEQ ID NO: 8144642 - DNA, 22 bp, Homo sapiens
aggctcaggcaggaatggcgga

SEQ ID NO: 8144643 - DNA, 22 bp, Homo sapiens
aggctcaggcaggaatggcgga

SEQ ID NO: 8144644 - DNA, 22 bp, Homo sapiens
aggctcaggcaggaatggcgga

SEQ ID NO: 8144645 - DNA, 22 bp, Homo sapiens
aggctcaggaggagctgccgga

SEQ ID NO: 8144646 - DNA, 22 bp, Homo sapiens
aggctcaggaggagctgccgga

SEQ ID NO: 8144647 - DNA, 22 bp, Homo sapiens
aggctcagggactccctccctc

SEQ ID NO: 8144648 - DNA, 22 bp, Homo sapiens
aggctcagggacggggcccctt

SEQ ID NO: 8144649 - DNA, 22 bp, Homo sapiens
aggctcagggacggggcccctt

SEQ ID NO: 8144650 - DNA, 22 bp, Homo sapiens
acatgtggaggaggcgagggta

SEQ ID NO: 8144651 - DNA, 22 bp, Homo sapiens
acatgtgagtaaatttaatgtt

SEQ ID NO: 8144652 - DNA, 22 bp, Homo sapiens
acatgtgtaaaagtggataaaa

SEQ ID NO: 8144653 - DNA, 22 bp, Homo sapiens
acatgtgtaaaagtggataaaa

SEQ ID NO: 8144654 - DNA, 22 bp, Homo sapiens
acatgtgtaaaagtggataaaa

SEQ ID NO: 8144655 - DNA, 22 bp, Homo sapiens
aggctcagacaggaaaagtaac

SEQ ID NO: 8144656 - DNA, 21 bp, Homo sapiens
acatgtctggtcatttttagc

SEQ ID NO: 8144657 - DNA, 21 bp, Homo sapiens
acatgtctctaatctcagtga

SEQ ID NO: 8144658 - DNA, 22 bp, Homo sapiens
acatgtctcttgtggttttcaa

SEQ ID NO: 8144659 - DNA, 21 bp, Homo sapiens
acatgtctctaatctcagtga

SEQ ID NO: 8144660 - DNA, 22 bp, Homo sapiens
acatgtctgtaattattttagg

SEQ ID NO: 8144661 - DNA, 22 bp, Homo sapiens
acatgtcttgtggctttgatct

SEQ ID NO: 8144662 - DNA, 22 bp, Homo sapiens
acatgtcttttaaagtctaata

SEQ ID NO: 8144663 - DNA, 22 bp, Homo sapiens
acatgtcttgtggctttgatct

SEQ ID NO: 8144664 - DNA, 22 bp, Homo sapiens
acatgtcttttaaagtctaata

SEQ ID NO: 8144665 - DNA, 22 bp, Homo sapiens
acatgtcttttaaagtctaata

SEQ ID NO: 8144666 - DNA, 22 bp, Homo sapiens
aggctcaggtctcaggtctggc

SEQ ID NO: 8144667 - DNA, 22 bp, Homo sapiens
aggctcaggtctcaggtctggc

SEQ ID NO: 8144668 - DNA, 22 bp, Homo sapiens
aggctcaggtctcaggtctggc

SEQ ID NO: 8144669 - DNA, 22 bp, Homo sapiens
aggctcaggtctcaggtctggc

SEQ ID NO: 8144670 - DNA, 19 bp, Homo sapiens
acatgttttgcagaacagc

SEQ ID NO: 8144671 - DNA, 22 bp, Homo sapiens
aggctcaggtctcaggtctggc

SEQ ID NO: 8144672 - DNA, 20 bp, Homo sapiens
aggctcagggtgtttaggaa

SEQ ID NO: 8144673 - DNA, 20 bp, Homo sapiens
aggctcagggtgtttaggaa

SEQ ID NO: 8144674 - DNA, 22 bp, Homo sapiens
aggctcaggtctcaggtctggc

SEQ ID NO: 8144675 - DNA, 22 bp, Homo sapiens
acattaaaaaatgttgcatgaa

SEQ ID NO: 8144676 - DNA, 22 bp, Homo sapiens
acattaaaaaatgttgcatgaa

SEQ ID NO: 8144677 - DNA, 22 bp, Homo sapiens
acattaaaatggagaattttga

SEQ ID NO: 8144678 - DNA, 22 bp, Homo sapiens
acattaaaatggagaattttga

SEQ ID NO: 8144679 - DNA, 22 bp, Homo sapiens
acattaaaattgggtggggtaa

SEQ ID NO: 8144680 - DNA, 22 bp, Homo sapiens
acattaaacttgcttggctgta

SEQ ID NO: 8144681 - DNA, 22 bp, Homo sapiens
acattaaaattgggtggggtaa

SEQ ID NO: 8144682 - DNA, 22 bp, Homo sapiens
acattaaaatggagaattttga

SEQ ID NO: 8144683 - DNA, 22 bp, Homo sapiens
acattaaatttcatagtgatta

SEQ ID NO: 8144684 - DNA, 22 bp, Homo sapiens
acattaaatttcatagtgatta

SEQ ID NO: 8144685 - DNA, 22 bp, Homo sapiens
acattaaatttcatagtgatta

SEQ ID NO: 8144686 - DNA, 22 bp, Homo sapiens
acattaaatttcatagtgatta

SEQ ID NO: 8144687 - DNA, 22 bp, Homo sapiens
acattaaatttcatagtgatta

SEQ ID NO: 8144688 - DNA, 22 bp, Homo sapiens
acattaaacttgcttggctgta

SEQ ID NO: 8144689 - DNA, 22 bp, Homo sapiens
acattaaagagtaaggttagtt

SEQ ID NO: 8144690 - DNA, 22 bp, Homo sapiens
acattaaagagtaaggttagtt

SEQ ID NO: 8144691 - DNA, 22 bp, Homo sapiens
acattaacactggtgctggtgt

SEQ ID NO: 8144692 - DNA, 22 bp, Homo sapiens
aggctccagtctcctctggcag

SEQ ID NO: 8144693 - DNA, 22 bp, Homo sapiens
acattaacaccgtgagtttggt

SEQ ID NO: 8144694 - DNA, 22 bp, Homo sapiens
acattaacaccataagtgtgtt

SEQ ID NO: 8144695 - DNA, 22 bp, Homo sapiens
acattaacaccataagtgtgtt

SEQ ID NO: 8144696 - DNA, 22 bp, Homo sapiens
aggctccttgttcatcatccat

SEQ ID NO: 8144697 - DNA, 22 bp, Homo sapiens
aggctctagatcaaggtgggag

SEQ ID NO: 8144698 - DNA, 22 bp, Homo sapiens
aggctcgcatgccctgcaccac

SEQ ID NO: 8144699 - DNA, 22 bp, Homo sapiens
aggctctaaggagggctgtcta

SEQ ID NO: 8144700 - DNA, 22 bp, Homo sapiens
aggctctggagttagccaggca

SEQ ID NO: 8144701 - DNA, 22 bp, Homo sapiens
aggctctggagtgtggtgctgg

SEQ ID NO: 8144702 - DNA, 22 bp, Homo sapiens
aggctctggagttagccaggca

SEQ ID NO: 8144703 - DNA, 22 bp, Homo sapiens
aggctctggagttagccaggca

SEQ ID NO: 8144704 - DNA, 22 bp, Homo sapiens
aggctctggagttagccaggca

SEQ ID NO: 8144705 - DNA, 22 bp, Homo sapiens
aggctctggagttagccaggca

SEQ ID NO: 8144706 - DNA, 22 bp, Homo sapiens
aggctctggagttagccaggca

SEQ ID NO: 8144707 - DNA, 22 bp, Homo sapiens
aggctctggagttagccaggca

SEQ ID NO: 8144708 - DNA, 22 bp, Homo sapiens
aggctctggacagtgaggagtt

SEQ ID NO: 8144709 - DNA, 22 bp, Homo sapiens
aggctctggagaagaatccgct

SEQ ID NO: 8144710 - DNA, 22 bp, Homo sapiens
aggctctggagtgtggtgctgg

SEQ ID NO: 8144711 - DNA, 22 bp, Homo sapiens
aggctctggagtgtggtgctgg

SEQ ID NO: 8144712 - DNA, 22 bp, Homo sapiens
aggctctggagtgtggtgctgg

SEQ ID NO: 8144713 - DNA, 22 bp, Homo sapiens
aggctctggagtgtggtgctgg

SEQ ID NO: 8144714 - DNA, 22 bp, Homo sapiens
aggctctgacccatgggaccca

SEQ ID NO: 8144715 - DNA, 22 bp, Homo sapiens
aggctctgacgtcacacgtggc

SEQ ID NO: 8144716 - DNA, 22 bp, Homo sapiens
aggctctgacgtcacacgtggc

SEQ ID NO: 8144717 - DNA, 22 bp, Homo sapiens
aggctctggacagtgaggagtt

SEQ ID NO: 8144718 - DNA, 22 bp, Homo sapiens
aggctctggacagtgaggagtt

SEQ ID NO: 8144719 - DNA, 22 bp, Homo sapiens
aggctctggacagtgaggagtt

SEQ ID NO: 8144720 - DNA, 22 bp, Homo sapiens
aggctctggacagtgaggagtt

SEQ ID NO: 8144721 - DNA, 22 bp, Homo sapiens
aggctctggacagtgaggagtt

SEQ ID NO: 8144722 - DNA, 19 bp, Homo sapiens
aggctctgagctcctggag

SEQ ID NO: 8144723 - DNA, 22 bp, Homo sapiens
aggctctggacagtgaggagtt

SEQ ID NO: 8144724 - DNA, 22 bp, Homo sapiens
aggctctggacagtgaggagtt

SEQ ID NO: 8144725 - DNA, 22 bp, Homo sapiens
aggctctctctgcccctgggac

SEQ ID NO: 8144726 - DNA, 22 bp, Homo sapiens
aggctctctctgccagccgtgc

SEQ ID NO: 8144727 - DNA, 22 bp, Homo sapiens
aggctctcctccccaggaccat

SEQ ID NO: 8144728 - DNA, 22 bp, Homo sapiens
aggctctcctccccaggaccat

SEQ ID NO: 8144729 - DNA, 22 bp, Homo sapiens
aggctctgaaggagaacctgtt

SEQ ID NO: 8144730 - DNA, 22 bp, Homo sapiens
aggctctgaagcaaccctttga

SEQ ID NO: 8144731 - DNA, 22 bp, Homo sapiens
aggctctgacccatgggaccca

SEQ ID NO: 8144732 - DNA, 22 bp, Homo sapiens
aggctctgaaggagaacctgtt

SEQ ID NO: 8144733 - DNA, 22 bp, Homo sapiens
aggctctgaaggagaacctgtt

SEQ ID NO: 8144734 - DNA, 22 bp, Homo sapiens
aggctctgaaggagaacctgtt

SEQ ID NO: 8144735 - DNA, 22 bp, Homo sapiens
aggctctcaatatgatccagtc

SEQ ID NO: 8144736 - DNA, 22 bp, Homo sapiens
aggctctcaatatgatccagtc

SEQ ID NO: 8144737 - DNA, 22 bp, Homo sapiens
aggctctataccgctgggagtt

SEQ ID NO: 8144738 - DNA, 22 bp, Homo sapiens
aggctctcactatcctcctagc

SEQ ID NO: 8144739 - DNA, 22 bp, Homo sapiens
aggctctcaccctctgaccaga

SEQ ID NO: 8144740 - DNA, 22 bp, Homo sapiens
aggctctcaccctctgaccaga

SEQ ID NO: 8144741 - DNA, 22 bp, Homo sapiens
aggctctccagagagctgcttt

SEQ ID NO: 8144742 - DNA, 22 bp, Homo sapiens
aggctctccagagagctgcttt

SEQ ID NO: 8144743 - DNA, 22 bp, Homo sapiens
aggctctcagatcagccacatt

SEQ ID NO: 8144744 - DNA, 22 bp, Homo sapiens
aggctctcagatcagccacatt

SEQ ID NO: 8144745 - DNA, 22 bp, Homo sapiens
aggctctcagatcagccacatt

SEQ ID NO: 8144746 - DNA, 22 bp, Homo sapiens
accactgcccatggtgaaaact

SEQ ID NO: 8144747 - DNA, 22 bp, Homo sapiens
accactgcccatggtgaaaact

SEQ ID NO: 8144748 - DNA, 22 bp, Homo sapiens
accactgcccatggtgaaaact

SEQ ID NO: 8144749 - DNA, 22 bp, Homo sapiens
aggctgtgatgagcctcatgga

SEQ ID NO: 8144750 - DNA, 22 bp, Homo sapiens
aggctgtgatgagcctcatgga

SEQ ID NO: 8144751 - DNA, 22 bp, Homo sapiens
aggctgtgatgagcctcatgga

SEQ ID NO: 8144752 - DNA, 22 bp, Homo sapiens
aggctgtgatgagcctcatgga

SEQ ID NO: 8144753 - DNA, 22 bp, Homo sapiens
accacaggacccatgagtcagt

SEQ ID NO: 8144754 - DNA, 22 bp, Homo sapiens
accacaggacccatgagtcagt

SEQ ID NO: 8144755 - DNA, 22 bp, Homo sapiens
aggctgtgattccaccactctc

SEQ ID NO: 8144756 - DNA, 22 bp, Homo sapiens
aggctgtgattccaccactctc

SEQ ID NO: 8144757 - DNA, 22 bp, Homo sapiens
accacaggaattgctctgtggt

SEQ ID NO: 8144758 - DNA, 22 bp, Homo sapiens
accactgtctacacattgactc

SEQ ID NO: 8144759 - DNA, 22 bp, Homo sapiens
accacttatcatcactatctca

SEQ ID NO: 8144760 - DNA, 22 bp, Homo sapiens
accactttggtatttcaatttt

SEQ ID NO: 8144761 - DNA, 22 bp, Homo sapiens
accactgtactatttgagtggc

SEQ ID NO: 8144762 - DNA, 22 bp, Homo sapiens
accactggggcaagtcttcaaa

SEQ ID NO: 8144763 - DNA, 22 bp, Homo sapiens
accactggggcaagtcttcaaa

SEQ ID NO: 8144764 - DNA, 22 bp, Homo sapiens
accactggttttgcagaggcgc

SEQ ID NO: 8144765 - DNA, 22 bp, Homo sapiens
accactgtacagcagatatagt

SEQ ID NO: 8144766 - DNA, 22 bp, Homo sapiens
accagaaaggaataatagaatt

SEQ ID NO: 8144767 - DNA, 22 bp, Homo sapiens
accagaaaggaataatagaatt

SEQ ID NO: 8144768 - DNA, 22 bp, Homo sapiens
accagaaaggaataatagaatt

SEQ ID NO: 8144769 - DNA, 22 bp, Homo sapiens
aggctgggaaacctgaagttgt

SEQ ID NO: 8144770 - DNA, 21 bp, Homo sapiens
aggctgtgacttacactatct

SEQ ID NO: 8144771 - DNA, 22 bp, Homo sapiens
aggctggctttggtagcatggt

SEQ ID NO: 8144772 - DNA, 22 bp, Homo sapiens
aggctggctttggtagcatggt

SEQ ID NO: 8144773 - DNA, 22 bp, Homo sapiens
aggctggctttggtagcatggt

SEQ ID NO: 8144774 - DNA, 22 bp, Homo sapiens
aggctggctttggtagcatggt

SEQ ID NO: 8144775 - DNA, 22 bp, Homo sapiens
aggctggctttggtagcatggt

SEQ ID NO: 8144776 - DNA, 22 bp, Homo sapiens
aggctggcttggctctcctgtg

SEQ ID NO: 8144777 - DNA, 22 bp, Homo sapiens
aggctggctttggtagcatggt

SEQ ID NO: 8144778 - DNA, 22 bp, Homo sapiens
aggctgtgagcaagaacaccta

SEQ ID NO: 8144779 - DNA, 22 bp, Homo sapiens
aggctgtgagcaagaacaccta

SEQ ID NO: 8144780 - DNA, 19 bp, Homo sapiens
aggctgtgagggaggactc

SEQ ID NO: 8144781 - DNA, 19 bp, Homo sapiens
aggctgtgagggaggactc

SEQ ID NO: 8144782 - DNA, 22 bp, Homo sapiens
aggctgtgagaagtccttcagt

SEQ ID NO: 8144783 - DNA, 22 bp, Homo sapiens
aggctgtgagttttgtctcaga

SEQ ID NO: 8144784 - DNA, 19 bp, Homo sapiens
aggctgtgaggggaaggaa

SEQ ID NO: 8144785 - DNA, 19 bp, Homo sapiens
aggctgtgagggaggactc

SEQ ID NO: 8144786 - DNA, 23 bp, Homo sapiens
aggctggcttcaggagcctctcc

SEQ ID NO: 8144787 - DNA, 22 bp, Homo sapiens
aggctggccagtgctgcagtgg

SEQ ID NO: 8144788 - DNA, 22 bp, Homo sapiens
aggctggccagtgctgcagtgg

SEQ ID NO: 8144789 - DNA, 22 bp, Homo sapiens
aggctggccagtgctgcagtgg

SEQ ID NO: 8144790 - DNA, 22 bp, Homo sapiens
aggctggcatacatttgttctt

SEQ ID NO: 8144791 - DNA, 22 bp, Homo sapiens
aggctggcatacatttgttctt

SEQ ID NO: 8144792 - DNA, 18 bp, Homo sapiens
acatttctctctgcgtga

SEQ ID NO: 8144793 - DNA, 22 bp, Homo sapiens
acatttctccttgcaggagtca

SEQ ID NO: 8144794 - DNA, 22 bp, Homo sapiens
acatttctccttgcaggagtca

SEQ ID NO: 8144795 - DNA, 23 bp, Homo sapiens
aggctggcttcaggagcctctcc

SEQ ID NO: 8144796 - DNA, 23 bp, Homo sapiens
aggctggcttcaggagcctctcc

SEQ ID NO: 8144797 - DNA, 23 bp, Homo sapiens
aggctggcttcaggagcctctcc

SEQ ID NO: 8144798 - DNA, 22 bp, Homo sapiens
aggctggcttggctctcctgtg

SEQ ID NO: 8144799 - DNA, 22 bp, Homo sapiens
aggctggcttggctctcctgtg

SEQ ID NO: 8144800 - DNA, 22 bp, Homo sapiens
aggctggcttggctctcctgtg

SEQ ID NO: 8144801 - DNA, 22 bp, Homo sapiens
aggctggcttggctctcctgtg

SEQ ID NO: 8144802 - DNA, 22 bp, Homo sapiens
aggctggcttcccaagcgtcct

SEQ ID NO: 8144803 - DNA, 22 bp, Homo sapiens
aggctggcttcccaagcgtcct

SEQ ID NO: 8144804 - DNA, 22 bp, Homo sapiens
aggctggcttcccaagcgtcct

SEQ ID NO: 8144805 - DNA, 22 bp, Homo sapiens
aggctggcttcccaagcgtcct

SEQ ID NO: 8144806 - DNA, 22 bp, Homo sapiens
acatttctcaggtaagtcattt

SEQ ID NO: 8144807 - DNA, 22 bp, Homo sapiens
acatttctcaggtaagtcattt

SEQ ID NO: 8144808 - DNA, 22 bp, Homo sapiens
acatttctcaggtaagtcattt

SEQ ID NO: 8144809 - DNA, 22 bp, Homo sapiens
acatttctcaggtaagtcattt

SEQ ID NO: 8144810 - DNA, 22 bp, Homo sapiens
acatttctcatctagtagagta

SEQ ID NO: 8144811 - DNA, 22 bp, Homo sapiens
acatttctcataggagagccac

SEQ ID NO: 8144812 - DNA, 22 bp, Homo sapiens
acatttctcattctcccctaac

SEQ ID NO: 8144813 - DNA, 22 bp, Homo sapiens
acatttctccctgcatgcctgc

SEQ ID NO: 8144814 - DNA, 22 bp, Homo sapiens
acatttctccctgcatgcctgc

SEQ ID NO: 8144815 - DNA, 22 bp, Homo sapiens
acatttctcctacttgttattt

SEQ ID NO: 8144816 - DNA, 22 bp, Homo sapiens
acatttctcctacttgttattt

SEQ ID NO: 8144817 - DNA, 22 bp, Homo sapiens
acatttctcctacttgttattt

SEQ ID NO: 8144818 - DNA, 18 bp, Homo sapiens
acatttctccttctgacc

SEQ ID NO: 8144819 - DNA, 18 bp, Homo sapiens
acatttctccttctgacc

SEQ ID NO: 8144820 - DNA, 18 bp, Homo sapiens
acatttctccttctgacc

SEQ ID NO: 8144821 - DNA, 18 bp, Homo sapiens
acatttctccttctgacc

SEQ ID NO: 8144822 - DNA, 18 bp, Homo sapiens
acatttctccttctgacc

SEQ ID NO: 8144823 - DNA, 22 bp, Homo sapiens
aggctctggcaacagctggtgt

SEQ ID NO: 8144824 - DNA, 22 bp, Homo sapiens
aggctctggagttagccaggca

SEQ ID NO: 8144825 - DNA, 22 bp, Homo sapiens
aggctctggcaacagctggtgt

SEQ ID NO: 8144826 - DNA, 22 bp, Homo sapiens
aggctctggcaacagctggtgt

SEQ ID NO: 8144827 - DNA, 22 bp, Homo sapiens
aggctctggcaacagctggtgt

SEQ ID NO: 8144828 - DNA, 22 bp, Homo sapiens
aggctctggcaacagctggtgt

SEQ ID NO: 8144829 - DNA, 22 bp, Homo sapiens
aggctctggctactacagagct

SEQ ID NO: 8144830 - DNA, 22 bp, Homo sapiens
aggctctggcaacagctggtgt

SEQ ID NO: 8144831 - DNA, 22 bp, Homo sapiens
aggctgcagaacagtcaggtgc

SEQ ID NO: 8144832 - DNA, 22 bp, Homo sapiens
aggctctggctactacagagct

SEQ ID NO: 8144833 - DNA, 23 bp, Homo sapiens
aggctgcagaagaatagggtcat

SEQ ID NO: 8144834 - DNA, 23 bp, Homo sapiens
aggctgcagaagaatagggtcat

SEQ ID NO: 8144835 - DNA, 21 bp, Homo sapiens
aggctgctctttcttgtggta

SEQ ID NO: 8144836 - DNA, 21 bp, Homo sapiens
aggctgctctttcttgtggta

SEQ ID NO: 8144837 - DNA, 21 bp, Homo sapiens
aggctgctctttcttgtggta

SEQ ID NO: 8144838 - DNA, 22 bp, Homo sapiens
aggctgctgccttggagagtgt

SEQ ID NO: 8144839 - DNA, 22 bp, Homo sapiens
aggctgctgaggccaccacgct

SEQ ID NO: 8144840 - DNA, 22 bp, Homo sapiens
aggctgctgccttggagagtgt

SEQ ID NO: 8144841 - DNA, 22 bp, Homo sapiens
aggctgctgccttggagagtgt

SEQ ID NO: 8144842 - DNA, 22 bp, Homo sapiens
aggctgctgaggccaccacgct

SEQ ID NO: 8144843 - DNA, 21 bp, Homo sapiens
aggctgctctttcttgtggta

SEQ ID NO: 8144844 - DNA, 21 bp, Homo sapiens
aggctgctctttcttgtggta

SEQ ID NO: 8144845 - DNA, 23 bp, Homo sapiens
aggctgctgagatgggtgtgtca

SEQ ID NO: 8144846 - DNA, 23 bp, Homo sapiens
aggctgctgagatgggtgtgtca

SEQ ID NO: 8144847 - DNA, 22 bp, Homo sapiens
acatttctcagggagttttgct

SEQ ID NO: 8144848 - DNA, 22 bp, Homo sapiens
aggctgcttcagctgcagggag

SEQ ID NO: 8144849 - DNA, 22 bp, Homo sapiens
aggctgcttcaatggataagat

SEQ ID NO: 8144850 - DNA, 22 bp, Homo sapiens
aggctgcttcagctgcagggag

SEQ ID NO: 8144851 - DNA, 17 bp, Homo sapiens
aggctgctgggccaggg

SEQ ID NO: 8144852 - DNA, 17 bp, Homo sapiens
aggctgctgggccaggg

SEQ ID NO: 8144853 - DNA, 23 bp, Homo sapiens
aggctgcttactggtatcagagc

SEQ ID NO: 8144854 - DNA, 22 bp, Homo sapiens
aggctgcttcaatggataagat

SEQ ID NO: 8144855 - DNA, 22 bp, Homo sapiens
aggctgctgccttggagagtgt

SEQ ID NO: 8144856 - DNA, 22 bp, Homo sapiens
aggctgctgccttggagagtgt

SEQ ID NO: 8144857 - DNA, 22 bp, Homo sapiens
aggctgctgccttggagagtgt

SEQ ID NO: 8144858 - DNA, 22 bp, Homo sapiens
aggctgctgctctacagttgct

SEQ ID NO: 8144859 - DNA, 22 bp, Homo sapiens
aggctgctggcaggcgtggacg

SEQ ID NO: 8144860 - DNA, 22 bp, Homo sapiens
aggctgctggcaggcgtggacg

SEQ ID NO: 8144861 - DNA, 22 bp, Homo sapiens
aggctgctggcaggcgtggacg

SEQ ID NO: 8144862 - DNA, 22 bp, Homo sapiens
aggctgctggctaagaataaga

SEQ ID NO: 8144863 - DNA, 21 bp, Homo sapiens
aggctgctggctcagggtcct

SEQ ID NO: 8144864 - DNA, 21 bp, Homo sapiens
aggctgctggctcagggtcct

SEQ ID NO: 8144865 - DNA, 22 bp, Homo sapiens
aggcactgaaaggtggccagag

SEQ ID NO: 8144866 - DNA, 22 bp, Homo sapiens
acagtgttacttgatagtgtat

SEQ ID NO: 8144867 - DNA, 20 bp, Homo sapiens
acagtgttaggtttttcctt

SEQ ID NO: 8144868 - DNA, 20 bp, Homo sapiens
acagtgttaggtttttcctt

SEQ ID NO: 8144869 - DNA, 22 bp, Homo sapiens
aggcaccttgcggtccagtgaa

SEQ ID NO: 8144870 - DNA, 22 bp, Homo sapiens
aggcacgagcaatggccgagga

SEQ ID NO: 8144871 - DNA, 20 bp, Homo sapiens
aggcacctgtcacaggtgag

SEQ ID NO: 8144872 - DNA, 20 bp, Homo sapiens
aggcacctgtcacaggtgag

SEQ ID NO: 8144873 - DNA, 22 bp, Homo sapiens
aggcacctgaggtggccagcct

SEQ ID NO: 8144874 - DNA, 22 bp, Homo sapiens
aggcacctgaggtggccagcct

SEQ ID NO: 8144875 - DNA, 22 bp, Homo sapiens
aggcacctgaggtggccagcct

SEQ ID NO: 8144876 - DNA, 22 bp, Homo sapiens
aggcaccttgcggtccagtgaa

SEQ ID NO: 8144877 - DNA, 22 bp, Homo sapiens
aggcaccttgcggtccagtgaa

SEQ ID NO: 8144878 - DNA, 22 bp, Homo sapiens
aggcaccttgagagcaggagct

SEQ ID NO: 8144879 - DNA, 22 bp, Homo sapiens
acagtgttcctttgttgtgact

SEQ ID NO: 8144880 - DNA, 22 bp, Homo sapiens
acagtgttcctttgttgtgact

SEQ ID NO: 8144881 - DNA, 22 bp, Homo sapiens
acagtgttcacttaacaatgga

SEQ ID NO: 8144882 - DNA, 22 bp, Homo sapiens
acagtgttcactaaggttagct

SEQ ID NO: 8144883 - DNA, 22 bp, Homo sapiens
acagtgttatttctgagtaatg

SEQ ID NO: 8144884 - DNA, 20 bp, Homo sapiens
acagtgttagttatcatctc

SEQ ID NO: 8144885 - DNA, 22 bp, Homo sapiens
acagtgttcaaaccactaggct

SEQ ID NO: 8144886 - DNA, 22 bp, Homo sapiens
acagtgttcactaaggttagct

SEQ ID NO: 8144887 - DNA, 22 bp, Homo sapiens
aggcactggtccattttctgca

SEQ ID NO: 8144888 - DNA, 22 bp, Homo sapiens
acagtgttctgaaagttgaggg

SEQ ID NO: 8144889 - DNA, 22 bp, Homo sapiens
acagtgttctcttcctgtatag

SEQ ID NO: 8144890 - DNA, 22 bp, Homo sapiens
acagtgttctgaaagttgaggg

SEQ ID NO: 8144891 - DNA, 22 bp, Homo sapiens
aggcagaaaatagtcatccaaa

SEQ ID NO: 8144892 - DNA, 22 bp, Homo sapiens
aggcagaaaatagtcatccaaa

SEQ ID NO: 8144893 - DNA, 21 bp, Homo sapiens
aggcagaaagagcccaggctg

SEQ ID NO: 8144894 - DNA, 22 bp, Homo sapiens
aggcactttttgcattttagaa

SEQ ID NO: 8144895 - DNA, 22 bp, Homo sapiens
acagtggagctcagatgaaaat

SEQ ID NO: 8144896 - DNA, 22 bp, Homo sapiens
acagtggaggccatatggtcct

SEQ ID NO: 8144897 - DNA, 22 bp, Homo sapiens
acagtggagttggggtagccct

SEQ ID NO: 8144898 - DNA, 22 bp, Homo sapiens
acagtggaggccatatggtcct

SEQ ID NO: 8144899 - DNA, 22 bp, Homo sapiens
acagtggatatattaaatgaga

SEQ ID NO: 8144900 - DNA, 22 bp, Homo sapiens
acagtggagctcagatgaaaat

SEQ ID NO: 8144901 - DNA, 22 bp, Homo sapiens
acagtggatgacatccttttgc

SEQ ID NO: 8144902 - DNA, 22 bp, Homo sapiens
acagtggatgtgatgtccaggt

SEQ ID NO: 8144903 - DNA, 22 bp, Homo sapiens
acagtggatgtgatgtccaggt

SEQ ID NO: 8144904 - DNA, 22 bp, Homo sapiens
acagtggatgtgatgtccaggt

SEQ ID NO: 8144905 - DNA, 22 bp, Homo sapiens
acagtggaatggtgggcctgca

SEQ ID NO: 8144906 - DNA, 22 bp, Homo sapiens
acagtggaatttgtagatgtgt

SEQ ID NO: 8144907 - DNA, 22 bp, Homo sapiens
acagtggagaagcaaatgcagt

SEQ ID NO: 8144908 - DNA, 22 bp, Homo sapiens
acagtggagaaggcatgaggct

SEQ ID NO: 8144909 - DNA, 22 bp, Homo sapiens
acagtggaagaagcactgaact

SEQ ID NO: 8144910 - DNA, 20 bp, Homo sapiens
acagtggaaattgatgtctg

SEQ ID NO: 8144911 - DNA, 22 bp, Homo sapiens
acagtggaagcatgatgctatc

SEQ ID NO: 8144912 - DNA, 22 bp, Homo sapiens
acagtggaaatgtgggagggga

SEQ ID NO: 8144913 - DNA, 22 bp, Homo sapiens
acagtggaaatgtgggagggga

SEQ ID NO: 8144914 - DNA, 20 bp, Homo sapiens
acagtggaaattgatgtctg

SEQ ID NO: 8144915 - DNA, 20 bp, Homo sapiens
acagtggaaattgatgtctg

SEQ ID NO: 8144916 - DNA, 19 bp, Homo sapiens
aggcaccgagggccactct

SEQ ID NO: 8144917 - DNA, 22 bp, Homo sapiens
aggcaccgctcctcagtccaga

SEQ ID NO: 8144918 - DNA, 22 bp, Homo sapiens
aggcacctcagctgagcctggg

SEQ ID NO: 8144919 - DNA, 22 bp, Homo sapiens
aggcaccgctcctcagtccaga

SEQ ID NO: 8144920 - DNA, 22 bp, Homo sapiens
aggcacctcagctgagcctggg

SEQ ID NO: 8144921 - DNA, 22 bp, Homo sapiens
aggcacctcttaggctgctact

SEQ ID NO: 8144922 - DNA, 17 bp, Homo sapiens
aggcacctcttcctgct

SEQ ID NO: 8144923 - DNA, 22 bp, Homo sapiens
aggcacctcatagccagccccc

SEQ ID NO: 8144924 - DNA, 17 bp, Homo sapiens
aggcacctcttcctgct

SEQ ID NO: 8144925 - DNA, 17 bp, Homo sapiens
aggcacctcttcctgct

SEQ ID NO: 8144926 - DNA, 22 bp, Homo sapiens
aggcacagcacacctggccccc

SEQ ID NO: 8144927 - DNA, 22 bp, Homo sapiens
acagtggcagtattagggcaga

SEQ ID NO: 8144928 - DNA, 22 bp, Homo sapiens
acagtgggacagtgacggggga

SEQ ID NO: 8144929 - DNA, 22 bp, Homo sapiens
acagtggcttttgtgtctgcag

SEQ ID NO: 8144930 - DNA, 22 bp, Homo sapiens
acagtggctcatgcctgtcatc

SEQ ID NO: 8144931 - DNA, 22 bp, Homo sapiens
aggaggccgatttcagaggtcg

SEQ ID NO: 8144932 - DNA, 17 bp, Homo sapiens
aggaggccctggcgttt

SEQ ID NO: 8144933 - DNA, 22 bp, Homo sapiens
acagtggaaagaaacgaattag

SEQ ID NO: 8144934 - DNA, 22 bp, Homo sapiens
acagtggaaagaacatggattt

SEQ ID NO: 8144935 - DNA, 22 bp, Homo sapiens
acagtgcttggcacacagtaat

SEQ ID NO: 8144936 - DNA, 22 bp, Homo sapiens
acagtgcttttgttcctctcct

SEQ ID NO: 8144937 - DNA, 22 bp, Homo sapiens
acagtgcttttgttcctctcct

SEQ ID NO: 8144938 - DNA, 19 bp, Homo sapiens
acagtgcttctgagtgagg

SEQ ID NO: 8144939 - DNA, 19 bp, Homo sapiens
acagtgcttctgagtgagg

SEQ ID NO: 8144940 - DNA, 22 bp, Homo sapiens
acagtgcttagcacagagtaga

SEQ ID NO: 8144941 - DNA, 22 bp, Homo sapiens
acagtgcttagcacagagtaga

SEQ ID NO: 8144942 - DNA, 22 bp, Homo sapiens
acagtgctgtgcagtctgccct

SEQ ID NO: 8144943 - DNA, 22 bp, Homo sapiens
acagtgctgtgcagtctgccct

SEQ ID NO: 8144944 - DNA, 21 bp, Homo sapiens
aggaggccagtactgctgaac

SEQ ID NO: 8144945 - DNA, 20 bp, Homo sapiens
aggaggccaaagtaatgggg

SEQ ID NO: 8144946 - DNA, 22 bp, Homo sapiens
aggaggccaggccctcaagcct

SEQ ID NO: 8144947 - DNA, 22 bp, Homo sapiens
aggaggcagtctgtcccttagc

SEQ ID NO: 8144948 - DNA, 20 bp, Homo sapiens
aggaggcatagtctggaaag

SEQ ID NO: 8144949 - DNA, 20 bp, Homo sapiens
aggaggcatgaggggattta

SEQ ID NO: 8144950 - DNA, 20 bp, Homo sapiens
aggaggcatgaggggattta

SEQ ID NO: 8144951 - DNA, 22 bp, Homo sapiens
aggaggccattctctcagtagc

SEQ ID NO: 8144952 - DNA, 22 bp, Homo sapiens
aggaggccattctctcagtagc

SEQ ID NO: 8144953 - DNA, 22 bp, Homo sapiens
aggaggccatgtactaggttcc

SEQ ID NO: 8144954 - DNA, 22 bp, Homo sapiens
aggaggcccctcctgggttgct

SEQ ID NO: 8144955 - DNA, 22 bp, Homo sapiens
aggaggccctagagctctagag

SEQ ID NO: 8144956 - DNA, 22 bp, Homo sapiens
aggaggcccctcctgggttgct

SEQ ID NO: 8144957 - DNA, 22 bp, Homo sapiens
aggaggccctagagctctagag

SEQ ID NO: 8144958 - DNA, 22 bp, Homo sapiens
aggaggccctagagctctagag

SEQ ID NO: 8144959 - DNA, 22 bp, Homo sapiens
acagtgagatccaagggcaggc

SEQ ID NO: 8144960 - DNA, 22 bp, Homo sapiens
acagtgagatccaagggcaggc

SEQ ID NO: 8144961 - DNA, 22 bp, Homo sapiens
acagtgagcccactccaggaga

SEQ ID NO: 8144962 - DNA, 22 bp, Homo sapiens
acagtgagcccactccaggaga

SEQ ID NO: 8144963 - DNA, 22 bp, Homo sapiens
acagtgagcccactccaggaga

SEQ ID NO: 8144964 - DNA, 22 bp, Homo sapiens
aggaggcagtctgtcccttagc

SEQ ID NO: 8144965 - DNA, 22 bp, Homo sapiens
aggaggcaggaagtctatggga

SEQ ID NO: 8144966 - DNA, 22 bp, Homo sapiens
acagtgaggaagcagctgtgct

SEQ ID NO: 8144967 - DNA, 22 bp, Homo sapiens
acagtgaggaagcagctgtgct

SEQ ID NO: 8144968 - DNA, 22 bp, Homo sapiens
acagtgaggaagcagctgtgct

SEQ ID NO: 8144969 - DNA, 22 bp, Homo sapiens
acagtgacgtttatttgagacg

SEQ ID NO: 8144970 - DNA, 22 bp, Homo sapiens
acagtgagatccaagggcaggc

SEQ ID NO: 8144971 - DNA, 17 bp, Homo sapiens
acagtgagaagtcatct

SEQ ID NO: 8144972 - DNA, 22 bp, Homo sapiens
acagtgaatgcccaagaaaagt

SEQ ID NO: 8144973 - DNA, 22 bp, Homo sapiens
acagtgaatgcccaagaaaagt

SEQ ID NO: 8144974 - DNA, 22 bp, Homo sapiens
acagtgacactcaggtgggatg

SEQ ID NO: 8144975 - DNA, 22 bp, Homo sapiens
aggacttagaacattatgtact

SEQ ID NO: 8144976 - DNA, 22 bp, Homo sapiens
acagtctggaagcagggggcaa

SEQ ID NO: 8144977 - DNA, 22 bp, Homo sapiens
acagtctgtcccccaggtgcta

SEQ ID NO: 8144978 - DNA, 22 bp, Homo sapiens
acagtctggaggctgcttcatt

SEQ ID NO: 8144979 - DNA, 22 bp, Homo sapiens
acagtctggcaggtgttgaaag

SEQ ID NO: 8144980 - DNA, 23 bp, Homo sapiens
acagtgaaacacgcagtaagagt

SEQ ID NO: 8144981 - DNA, 22 bp, Homo sapiens
acatctgttcaaatatgcattt

SEQ ID NO: 8144982 - DNA, 22 bp, Homo sapiens
acatctgtaatctagtcaaccc

SEQ ID NO: 8144983 - DNA, 22 bp, Homo sapiens
acatctgtttgagaaaaagaag

SEQ ID NO: 8144984 - DNA, 22 bp, Homo sapiens
acatctgttcttctcttgtccc

SEQ ID NO: 8144985 - DNA, 22 bp, Homo sapiens
aggcagtggtgtttgctggtgg

SEQ ID NO: 8144986 - DNA, 22 bp, Homo sapiens
aggcagtggtgtttgctggtgg

SEQ ID NO: 8144987 - DNA, 22 bp, Homo sapiens
aggcagtggtgtttgctggtgg

SEQ ID NO: 8144988 - DNA, 20 bp, Homo sapiens
aggcagtgtagagatgagta

SEQ ID NO: 8144989 - DNA, 22 bp, Homo sapiens
acatcttcccacacttgcaaaa

SEQ ID NO: 8144990 - DNA, 22 bp, Homo sapiens
acatctttgctcttatagagct

SEQ ID NO: 8144991 - DNA, 22 bp, Homo sapiens
aggcagtgtgtagctggaagag

SEQ ID NO: 8144992 - DNA, 22 bp, Homo sapiens
aggcagtgtgtagctggaagag

SEQ ID NO: 8144993 - DNA, 22 bp, Homo sapiens
aggcagtgtggagggctgttgc

SEQ ID NO: 8144994 - DNA, 22 bp, Homo sapiens
aggcagtgtggagggctgttgc

SEQ ID NO: 8144995 - DNA, 22 bp, Homo sapiens
aggcagtgtgggccaagcttcc

SEQ ID NO: 8144996 - DNA, 22 bp, Homo sapiens
aggcagtgtgggccaagcttcc

SEQ ID NO: 8144997 - DNA, 22 bp, Homo sapiens
aggcagtgtattgctagcggct

SEQ ID NO: 8144998 - DNA, 22 bp, Homo sapiens
aggcagtgtattgctagcggct

SEQ ID NO: 8144999 - DNA, 22 bp, Homo sapiens
aggcagtgtattgctagcggct

SEQ ID NO: 8145000 - DNA, 23 bp, Homo sapiens
aggcagtgtctcttatcctgtcc

SEQ ID NO: 8145001 - DNA, 23 bp, Homo sapiens
aggcagtgtctcttatcctgtcc

SEQ ID NO: 8145002 - DNA, 22 bp, Homo sapiens
aggcagtgtattgctagcggct

SEQ ID NO: 8145003 - DNA, 22 bp, Homo sapiens
aggcagtgtattgctagcggct

SEQ ID NO: 8145004 - DNA, 20 bp, Homo sapiens
aggcagtgtagagatgagta

SEQ ID NO: 8145005 - DNA, 20 bp, Homo sapiens
aggcagtgtagagatgagta

SEQ ID NO: 8145006 - DNA, 22 bp, Homo sapiens
aggcagtgtattgctagcggct

SEQ ID NO: 8145007 - DNA, 20 bp, Homo sapiens
aggcagtgtagagatgagta

SEQ ID NO: 8145008 - DNA, 22 bp, Homo sapiens
acatctgagcaacagaacacta

SEQ ID NO: 8145009 - DNA, 22 bp, Homo sapiens
acatctgacatgatcttcagta

SEQ ID NO: 8145010 - DNA, 22 bp, Homo sapiens
acatctgaaagggattgcagaa

SEQ ID NO: 8145011 - DNA, 22 bp, Homo sapiens
acatatattactagtaaagaca

SEQ ID NO: 8145012 - DNA, 22 bp, Homo sapiens
acatatattactagtaaagaca

SEQ ID NO: 8145013 - DNA, 23 bp, Homo sapiens
acatccatgaatcatctgctttc

SEQ ID NO: 8145014 - DNA, 22 bp, Homo sapiens
acatatattttcacacatggtt

SEQ ID NO: 8145015 - DNA, 22 bp, Homo sapiens
acatccatgcatgtctgtgcac

SEQ ID NO: 8145016 - DNA, 22 bp, Homo sapiens
acatccatgttgtaatgttcct

SEQ ID NO: 8145017 - DNA, 22 bp, Homo sapiens
acatccatttgctttatttgct

SEQ ID NO: 8145018 - DNA, 22 bp, Homo sapiens
acatctcatgaatgataaatca

SEQ ID NO: 8145019 - DNA, 22 bp, Homo sapiens
acatctcttataaactctctga

SEQ ID NO: 8145020 - DNA, 22 bp, Homo sapiens
acatctctgggtcctccatgca

SEQ ID NO: 8145021 - DNA, 22 bp, Homo sapiens
acatctcttcttaaggctccag

SEQ ID NO: 8145022 - DNA, 22 bp, Homo sapiens
acatatattactagtaaagaca

SEQ ID NO: 8145023 - DNA, 22 bp, Homo sapiens
acatatattactagtaaagaca

SEQ ID NO: 8145024 - DNA, 22 bp, Homo sapiens
acatatattactagtaaagaca

SEQ ID NO: 8145025 - DNA, 22 bp, Homo sapiens
acatatatgtgcacatgtgcag

SEQ ID NO: 8145026 - DNA, 22 bp, Homo sapiens
acatatatgtgcacatgtgcag

SEQ ID NO: 8145027 - DNA, 22 bp, Homo sapiens
acatatattactagtaaagaca

SEQ ID NO: 8145028 - DNA, 22 bp, Homo sapiens
acatatattactagtaaagaca

SEQ ID NO: 8145029 - DNA, 22 bp, Homo sapiens
acatatattactagtaaagaca

SEQ ID NO: 8145030 - DNA, 22 bp, Homo sapiens
acatatatgtaaagtactttgt

SEQ ID NO: 8145031 - DNA, 22 bp, Homo sapiens
acatatatgtgcacatgtgcag

SEQ ID NO: 8145032 - DNA, 22 bp, Homo sapiens
acatatatgtaaagtactttgt

SEQ ID NO: 8145033 - DNA, 22 bp, Homo sapiens
acatatatgtaaagtactttgt

SEQ ID NO: 8145034 - DNA, 22 bp, Homo sapiens
acatatatgtaaagtactttgt

SEQ ID NO: 8145035 - DNA, 22 bp, Homo sapiens
acatatatgtaaagtactttgt

SEQ ID NO: 8145036 - DNA, 22 bp, Homo sapiens
acatatatgctgggactgtgac

SEQ ID NO: 8145037 - DNA, 22 bp, Homo sapiens
acatatatgcgtgggctcatgg

SEQ ID NO: 8145038 - DNA, 22 bp, Homo sapiens
acatatatgctgggactgtgac

SEQ ID NO: 8145039 - DNA, 22 bp, Homo sapiens
acatatatgctgggactgtgac

SEQ ID NO: 8145040 - DNA, 22 bp, Homo sapiens
acatatatgctgggactgtgac

SEQ ID NO: 8145041 - DNA, 22 bp, Homo sapiens
acatatatgtaaagtactttgt

SEQ ID NO: 8145042 - DNA, 22 bp, Homo sapiens
acatatatgtaaagtactttgt

SEQ ID NO: 8145043 - DNA, 22 bp, Homo sapiens
acatatatgtaaagtactttgt

SEQ ID NO: 8145044 - DNA, 22 bp, Homo sapiens
acatatatgcgtgggctcatgg

SEQ ID NO: 8145045 - DNA, 22 bp, Homo sapiens
acatatatgcgtgggctcatgg

SEQ ID NO: 8145046 - DNA, 22 bp, Homo sapiens
acatatatgcgtgggctcatgg

SEQ ID NO: 8145047 - DNA, 22 bp, Homo sapiens
acatatatgcgtgggctcatgg

SEQ ID NO: 8145048 - DNA, 22 bp, Homo sapiens
aggcagagaaaaaccagatatg

SEQ ID NO: 8145049 - DNA, 22 bp, Homo sapiens
aggcagagaaaaaccagatatg

SEQ ID NO: 8145050 - DNA, 22 bp, Homo sapiens
aggcagagaaaaaccagatatg

SEQ ID NO: 8145051 - DNA, 22 bp, Homo sapiens
aggcagatggtaactgtgatat

SEQ ID NO: 8145052 - DNA, 22 bp, Homo sapiens
aggcagatgggagctggaagtt

SEQ ID NO: 8145053 - DNA, 22 bp, Homo sapiens
aggcagatgaacctgggttgag

SEQ ID NO: 8145054 - DNA, 22 bp, Homo sapiens
aggcagaaccagctgggacttt

SEQ ID NO: 8145055 - DNA, 21 bp, Homo sapiens
aggcagaaagagcccaggctg

SEQ ID NO: 8145056 - DNA, 21 bp, Homo sapiens
aggcagaaagagcccaggctg

SEQ ID NO: 8145057 - DNA, 22 bp, Homo sapiens
aggcagaatgttggaaaggaag

SEQ ID NO: 8145058 - DNA, 22 bp, Homo sapiens
aggcagaagccagccagggtcc

SEQ ID NO: 8145059 - DNA, 22 bp, Homo sapiens
aggcagactcaatggctagata

SEQ ID NO: 8145060 - DNA, 22 bp, Homo sapiens
aggcagagaaaaaccagatatg

SEQ ID NO: 8145061 - DNA, 22 bp, Homo sapiens
aggcagagaaaaaccagatatg

SEQ ID NO: 8145062 - DNA, 22 bp, Homo sapiens
aggcagacttcctgcttggatc

SEQ ID NO: 8145063 - DNA, 22 bp, Homo sapiens
aggcaggggagctggaagggta

SEQ ID NO: 8145064 - DNA, 22 bp, Homo sapiens
aggcaggggagctggaagggta

SEQ ID NO: 8145065 - DNA, 22 bp, Homo sapiens
aggcaggggagctggaagggta

SEQ ID NO: 8145066 - DNA, 18 bp, Homo sapiens
aggcaggtgctggaagtc

SEQ ID NO: 8145067 - DNA, 22 bp, Homo sapiens
aggcaggggagctggaagggta

SEQ ID NO: 8145068 - DNA, 22 bp, Homo sapiens
aggcagcaaagaaatgatgctg

SEQ ID NO: 8145069 - DNA, 22 bp, Homo sapiens
aggcagcaagattatttaatcc

SEQ ID NO: 8145070 - DNA, 22 bp, Homo sapiens
aggcagattttctttactcagt

SEQ ID NO: 8145071 - DNA, 22 bp, Homo sapiens
aggcagcaaagaaatgatgctg

SEQ ID NO: 8145072 - DNA, 22 bp, Homo sapiens
aggcaggttggtgagaagactg

SEQ ID NO: 8145073 - DNA, 22 bp, Homo sapiens
aggcaggttggggaaaagcact

SEQ ID NO: 8145074 - DNA, 22 bp, Homo sapiens
aggcaggttggggaaaagcact

SEQ ID NO: 8145075 - DNA, 22 bp, Homo sapiens
aggcaggttacaaaaactttat

SEQ ID NO: 8145076 - DNA, 22 bp, Homo sapiens
aggcaggttacaaaaactttat

SEQ ID NO: 8145077 - DNA, 22 bp, Homo sapiens
aggcaggtgttacctctggttt

SEQ ID NO: 8145078 - DNA, 22 bp, Homo sapiens
aggcaggtgttacctctggttt

SEQ ID NO: 8145079 - DNA, 22 bp, Homo sapiens
aggcaggtgttacctctggttt

SEQ ID NO: 8145080 - DNA, 22 bp, Homo sapiens
aggcaggtgttgggagacacca

SEQ ID NO: 8145081 - DNA, 22 bp, Homo sapiens
aggcaggtgttgggagacacca

SEQ ID NO: 8145082 - DNA, 22 bp, Homo sapiens
aggcaggtgttgggagacacca

SEQ ID NO: 8145083 - DNA, 22 bp, Homo sapiens
aggcaggtgttaaccctctgag

SEQ ID NO: 8145084 - DNA, 22 bp, Homo sapiens
aggcaggtgttaaccctctgag

SEQ ID NO: 8145085 - DNA, 22 bp, Homo sapiens
aggcaggtgttaaccctctgag

SEQ ID NO: 8145086 - DNA, 22 bp, Homo sapiens
aggcaggtgggagtgattcctt

SEQ ID NO: 8145087 - DNA, 22 bp, Homo sapiens
aggcaggtgggtcacttgagtc

SEQ ID NO: 8145088 - DNA, 22 bp, Homo sapiens
aggcaggtgggtcacttgagtc

SEQ ID NO: 8145089 - DNA, 22 bp, Homo sapiens
aggcaggtgggtcacttgagtc

SEQ ID NO: 8145090 - DNA, 22 bp, Homo sapiens
aggcaggtgggtcacttgagtc

SEQ ID NO: 8145091 - DNA, 22 bp, Homo sapiens
aggcaggtgggagtgattcctt

SEQ ID NO: 8145092 - DNA, 22 bp, Homo sapiens
aggcaggtgcttatgacttgct

SEQ ID NO: 8145093 - DNA, 18 bp, Homo sapiens
aggcaggtgctggaagtc

SEQ ID NO: 8145094 - DNA, 22 bp, Homo sapiens
aggcaggtgcttatgacttgct

SEQ ID NO: 8145095 - DNA, 22 bp, Homo sapiens
aggaaataggaccagacaaagc

SEQ ID NO: 8145096 - DNA, 22 bp, Homo sapiens
acaggcctggtgctgctgacag

SEQ ID NO: 8145097 - DNA, 22 bp, Homo sapiens
acaggccttaggagagatgggg

SEQ ID NO: 8145098 - DNA, 22 bp, Homo sapiens
acaggccttggcaggcatgtga

SEQ ID NO: 8145099 - DNA, 22 bp, Homo sapiens
acaggccttaggagagatgggg

SEQ ID NO: 8145100 - DNA, 21 bp, Homo sapiens
acaggctacatgcaggagctg

SEQ ID NO: 8145101 - DNA, 22 bp, Homo sapiens
acaggccttggtcctgacctaa

SEQ ID NO: 8145102 - DNA, 22 bp, Homo sapiens
acaggccttggcaggcatgtga

SEQ ID NO: 8145103 - DNA, 22 bp, Homo sapiens
acaggccttggtcctgacctaa

SEQ ID NO: 8145104 - DNA, 22 bp, Homo sapiens
acaggccttggtcctgacctaa

SEQ ID NO: 8145105 - DNA, 22 bp, Homo sapiens
aggaaaggtgagagcggccgcg

SEQ ID NO: 8145106 - DNA, 22 bp, Homo sapiens
aggaaaggtagcgtgccagcag

SEQ ID NO: 8145107 - DNA, 22 bp, Homo sapiens
aggaaaggtagcgtgccagcag

SEQ ID NO: 8145108 - DNA, 22 bp, Homo sapiens
aggaaaggtagcgtgccagcag

SEQ ID NO: 8145109 - DNA, 22 bp, Homo sapiens
aggaaaggggtaggtgtggacg

SEQ ID NO: 8145110 - DNA, 22 bp, Homo sapiens
aggaaaggggtaggtgtggacg

SEQ ID NO: 8145111 - DNA, 22 bp, Homo sapiens
aggaaaggtagcgtgccagcag

SEQ ID NO: 8145112 - DNA, 22 bp, Homo sapiens
aggaaaggggtaggtgtggacg

SEQ ID NO: 8145113 - DNA, 22 bp, Homo sapiens
aggaaaggtgagagcggccgcg

SEQ ID NO: 8145114 - DNA, 19 bp, Homo sapiens
aggaaaggtggccttagca

SEQ ID NO: 8145115 - DNA, 19 bp, Homo sapiens
aggaaaggtggccttagca

SEQ ID NO: 8145116 - DNA, 19 bp, Homo sapiens
aggaaaggtggccttagca

SEQ ID NO: 8145117 - DNA, 22 bp, Homo sapiens
aggaaaggttcagtgattgaaa

SEQ ID NO: 8145118 - DNA, 17 bp, Homo sapiens
aggaaagtctgctgtcc

SEQ ID NO: 8145119 - DNA, 22 bp, Homo sapiens
aggaaaggttcagtgattgaaa

SEQ ID NO: 8145120 - DNA, 22 bp, Homo sapiens
aggaaaggttcagtgattgaaa

SEQ ID NO: 8145121 - DNA, 22 bp, Homo sapiens
acaggctcagttcactggattt

SEQ ID NO: 8145122 - DNA, 22 bp, Homo sapiens
acaggctcgtgcgcgcacgtgt

SEQ ID NO: 8145123 - DNA, 22 bp, Homo sapiens
acaggctcagttcactggattt

SEQ ID NO: 8145124 - DNA, 21 bp, Homo sapiens
acaggctcacgatccatttct

SEQ ID NO: 8145125 - DNA, 22 bp, Homo sapiens
acaggctcacagtcatttcatt

SEQ ID NO: 8145126 - DNA, 22 bp, Homo sapiens
acaggctctctattgagtgcag

SEQ ID NO: 8145127 - DNA, 22 bp, Homo sapiens
acaggctctcagccagttggca

SEQ ID NO: 8145128 - DNA, 21 bp, Homo sapiens
acaggctctggggatgctggg

SEQ ID NO: 8145129 - DNA, 22 bp, Homo sapiens
acaggctctctattgagtgcag

SEQ ID NO: 8145130 - DNA, 22 bp, Homo sapiens
acaggctctctattgagtgcag

SEQ ID NO: 8145131 - DNA, 22 bp, Homo sapiens
acagggcaggtggctactggtc

SEQ ID NO: 8145132 - DNA, 22 bp, Homo sapiens
acagggcagtgtcttgaaaaat

SEQ ID NO: 8145133 - DNA, 22 bp, Homo sapiens
acagggcagtgtcttgaaaaat

SEQ ID NO: 8145134 - DNA, 22 bp, Homo sapiens
acagggcaggtggctactggtc

SEQ ID NO: 8145135 - DNA, 22 bp, Homo sapiens
acagggcacctgaggtaggaag

SEQ ID NO: 8145136 - DNA, 17 bp, Homo sapiens
acagggcagaaacagct

SEQ ID NO: 8145137 - DNA, 19 bp, Homo sapiens
acagggcagcaataggata

SEQ ID NO: 8145138 - DNA, 22 bp, Homo sapiens
acagggcacctgaggtaggaag

SEQ ID NO: 8145139 - DNA, 21 bp, Homo sapiens
acaggctctggggatgctggg

SEQ ID NO: 8145140 - DNA, 21 bp, Homo sapiens
acagggcatgcagctggctgt

SEQ ID NO: 8145141 - DNA, 21 bp, Homo sapiens
acagggcatgcagctggctgt

SEQ ID NO: 8145142 - DNA, 22 bp, Homo sapiens
acagggcagtgtcttgaaaaat

SEQ ID NO: 8145143 - DNA, 21 bp, Homo sapiens
acagggcatgcagctggctgt

SEQ ID NO: 8145144 - DNA, 21 bp, Homo sapiens
acagggcatgcagctggctgt

SEQ ID NO: 8145145 - DNA, 22 bp, Homo sapiens
acagggcatgtgcaagagacat

SEQ ID NO: 8145146 - DNA, 21 bp, Homo sapiens
acagggcatgcagctggctgt

SEQ ID NO: 8145147 - DNA, 21 bp, Homo sapiens
acagggcatgcagctggctgt

SEQ ID NO: 8145148 - DNA, 22 bp, Homo sapiens
acagggcatgtgcaagagacat

SEQ ID NO: 8145149 - DNA, 22 bp, Homo sapiens
acagggcatttcctctatgtgt

SEQ ID NO: 8145150 - DNA, 23 bp, Homo sapiens
acagggcattgctggcctcgagg

SEQ ID NO: 8145151 - DNA, 23 bp, Homo sapiens
acagggcattgctggcctcgagg

SEQ ID NO: 8145152 - DNA, 22 bp, Homo sapiens
acagggcatttcctctatgtgt

SEQ ID NO: 8145153 - DNA, 22 bp, Homo sapiens
acagggcatttcctctatgtgt

SEQ ID NO: 8145154 - DNA, 22 bp, Homo sapiens
aggactgatgatggtgctgaca

SEQ ID NO: 8145155 - DNA, 22 bp, Homo sapiens
aggacatgtaaatggagaggga

SEQ ID NO: 8145156 - DNA, 22 bp, Homo sapiens
aggactgatgatggtgctgaca

SEQ ID NO: 8145157 - DNA, 22 bp, Homo sapiens
aggactggcagtgtgaggggtc

SEQ ID NO: 8145158 - DNA, 22 bp, Homo sapiens
aggactggcagtgtgaggggtc

SEQ ID NO: 8145159 - DNA, 22 bp, Homo sapiens
aggactggccctgaggggaggc

SEQ ID NO: 8145160 - DNA, 22 bp, Homo sapiens
aggactggccctgaggggaggc

SEQ ID NO: 8145161 - DNA, 22 bp, Homo sapiens
aggactggccctgaggggaggc

SEQ ID NO: 8145162 - DNA, 22 bp, Homo sapiens
aggactggccctgaggggaggc

SEQ ID NO: 8145163 - DNA, 22 bp, Homo sapiens
aggactgggtgcagagggcatc

SEQ ID NO: 8145164 - DNA, 22 bp, Homo sapiens
aggactgggtgcagagggcatc

SEQ ID NO: 8145165 - DNA, 22 bp, Homo sapiens
aggactgggtgcagagggcatc

SEQ ID NO: 8145166 - DNA, 22 bp, Homo sapiens
aggactgggtgcagagggcatc

SEQ ID NO: 8145167 - DNA, 22 bp, Homo sapiens
aggactggcggtcggtggggat

SEQ ID NO: 8145168 - DNA, 22 bp, Homo sapiens
aggactgggtgcagagggcatc

SEQ ID NO: 8145169 - DNA, 22 bp, Homo sapiens
aggactggtgccagacaaggta

SEQ ID NO: 8145170 - DNA, 22 bp, Homo sapiens
aggactggtgccagacaaggta

SEQ ID NO: 8145171 - DNA, 22 bp, Homo sapiens
aggactggtgtgtgatcagcat

SEQ ID NO: 8145172 - DNA, 22 bp, Homo sapiens
aggactggtgtgtgatcagcat

SEQ ID NO: 8145173 - DNA, 22 bp, Homo sapiens
aggacatgaagaaagggcaagg

SEQ ID NO: 8145174 - DNA, 22 bp, Homo sapiens
aggacagttagttaggaagttt

SEQ ID NO: 8145175 - DNA, 22 bp, Homo sapiens
aggacatgaagaaagggcaagg

SEQ ID NO: 8145176 - DNA, 22 bp, Homo sapiens
aggacagtggtgttctggagtg

SEQ ID NO: 8145177 - DNA, 22 bp, Homo sapiens
aggacagtggcaaggcaggaca

SEQ ID NO: 8145178 - DNA, 22 bp, Homo sapiens
aggacagtggacactagtccct

SEQ ID NO: 8145179 - DNA, 22 bp, Homo sapiens
aggacagtggacactagtccct

SEQ ID NO: 8145180 - DNA, 22 bp, Homo sapiens
aggacagtccggggtcctccac

SEQ ID NO: 8145181 - DNA, 22 bp, Homo sapiens
aggacaggtgtagtgggctctg

SEQ ID NO: 8145182 - DNA, 22 bp, Homo sapiens
aggacaggtgtagtgggctctg

SEQ ID NO: 8145183 - DNA, 22 bp, Homo sapiens
aggacagggattcaaactccca

SEQ ID NO: 8145184 - DNA, 22 bp, Homo sapiens
aggacagggattcaaactccca

SEQ ID NO: 8145185 - DNA, 22 bp, Homo sapiens
aggacagggattcaaactccca

SEQ ID NO: 8145186 - DNA, 22 bp, Homo sapiens
aggacaggtgtagtgggctctg

SEQ ID NO: 8145187 - DNA, 23 bp, Homo sapiens
acagggctagctgacagtggtat

SEQ ID NO: 8145188 - DNA, 23 bp, Homo sapiens
acagggctagctgacagtggtat

SEQ ID NO: 8145189 - DNA, 22 bp, Homo sapiens
acagggctatattcctcagagc

SEQ ID NO: 8145190 - DNA, 22 bp, Homo sapiens
acagggctatattcctcagagc

SEQ ID NO: 8145191 - DNA, 22 bp, Homo sapiens
acagggctatattcctcagagc

SEQ ID NO: 8145192 - DNA, 22 bp, Homo sapiens
acagggccctgtgggccccact

SEQ ID NO: 8145193 - DNA, 22 bp, Homo sapiens
acagggccctgtgggccccact

SEQ ID NO: 8145194 - DNA, 22 bp, Homo sapiens
acagggccaggtgagaggtgct

SEQ ID NO: 8145195 - DNA, 22 bp, Homo sapiens
acagggccattatctgttctag

SEQ ID NO: 8145196 - DNA, 22 bp, Homo sapiens
acagggccagcctgggacctgg

SEQ ID NO: 8145197 - DNA, 22 bp, Homo sapiens
acagggcctcagccagggcaga

SEQ ID NO: 8145198 - DNA, 22 bp, Homo sapiens
acagggcctcagctgattctgg

SEQ ID NO: 8145199 - DNA, 22 bp, Homo sapiens
acagggcccttgccagcacaag

SEQ ID NO: 8145200 - DNA, 22 bp, Homo sapiens
acagggccctgtgggccccact

SEQ ID NO: 8145201 - DNA, 22 bp, Homo sapiens
acagggcccttagatcctttta

SEQ ID NO: 8145202 - DNA, 22 bp, Homo sapiens
acaggacaaggggaagaagata

SEQ ID NO: 8145203 - DNA, 22 bp, Homo sapiens
acaggacaactcagcagccagc

SEQ ID NO: 8145204 - DNA, 22 bp, Homo sapiens
acaggacaactcagcagccagc

SEQ ID NO: 8145205 - DNA, 22 bp, Homo sapiens
acaggacaactcagcagccagc

SEQ ID NO: 8145206 - DNA, 22 bp, Homo sapiens
acaggacaactcagcagccagc

SEQ ID NO: 8145207 - DNA, 22 bp, Homo sapiens
acaggacaactcagcagccagc

SEQ ID NO: 8145208 - DNA, 22 bp, Homo sapiens
acaggaagtttggaaagcctca

SEQ ID NO: 8145209 - DNA, 22 bp, Homo sapiens
acaggaagtgggaagaaacagg

SEQ ID NO: 8145210 - DNA, 22 bp, Homo sapiens
acaggaagtgggaagaaacagg

SEQ ID NO: 8145211 - DNA, 22 bp, Homo sapiens
acaggaagtttggaaagcctca

SEQ ID NO: 8145212 - DNA, 22 bp, Homo sapiens
acaggaagtttggaaagcctca

SEQ ID NO: 8145213 - DNA, 22 bp, Homo sapiens
acagcttcttgtttcccaggag

SEQ ID NO: 8145214 - DNA, 22 bp, Homo sapiens
acaggaagaaagtgcagtagat

SEQ ID NO: 8145215 - DNA, 22 bp, Homo sapiens
acaggaagaaagtgcagtagat

SEQ ID NO: 8145216 - DNA, 22 bp, Homo sapiens
acagcttcgaggatctcatccc

SEQ ID NO: 8145217 - DNA, 20 bp, Homo sapiens
acagccagaggaggcagaca

SEQ ID NO: 8145218 - DNA, 22 bp, Homo sapiens
acagcttctatttctctgtact

SEQ ID NO: 8145219 - DNA, 22 bp, Homo sapiens
acaggaagaaagtgcagtagat

SEQ ID NO: 8145220 - DNA, 22 bp, Homo sapiens
acaggaagaaagtgcagtagat

SEQ ID NO: 8145221 - DNA, 22 bp, Homo sapiens
acaggaagctggagacccttga

SEQ ID NO: 8145222 - DNA, 22 bp, Homo sapiens
acaggaagctggagacccttga

SEQ ID NO: 8145223 - DNA, 22 bp, Homo sapiens
acaggaagctggagacccttga

SEQ ID NO: 8145224 - DNA, 22 bp, Homo sapiens
acaggaagtgctggcacttaca

SEQ ID NO: 8145225 - DNA, 22 bp, Homo sapiens
acaggaagtgctggcacttaca

SEQ ID NO: 8145226 - DNA, 22 bp, Homo sapiens
acaggaagtgctggcacttaca

SEQ ID NO: 8145227 - DNA, 22 bp, Homo sapiens
acaggaagtgctggcacttaca

SEQ ID NO: 8145228 - DNA, 22 bp, Homo sapiens
acaggaagtgggaagaaacagg

SEQ ID NO: 8145229 - DNA, 22 bp, Homo sapiens
acaggaagtgggaagaaacagg

SEQ ID NO: 8145230 - DNA, 22 bp, Homo sapiens
acaggaagtgggaagaaacagg

SEQ ID NO: 8145231 - DNA, 22 bp, Homo sapiens
acagcatggataacaaggcact

SEQ ID NO: 8145232 - DNA, 22 bp, Homo sapiens
acagcatggataacaaggcact

SEQ ID NO: 8145233 - DNA, 22 bp, Homo sapiens
acagcatgagagatgaacattc

SEQ ID NO: 8145234 - DNA, 22 bp, Homo sapiens
acagcagtgtctggtactgagt

SEQ ID NO: 8145235 - DNA, 22 bp, Homo sapiens
acagcagtggtgcactgagcca

SEQ ID NO: 8145236 - DNA, 22 bp, Homo sapiens
acagcagttaacgatcagactc

SEQ ID NO: 8145237 - DNA, 22 bp, Homo sapiens
acagcattcaataaataataac

SEQ ID NO: 8145238 - DNA, 22 bp, Homo sapiens
acagccagaggagccaggctgg

SEQ ID NO: 8145239 - DNA, 22 bp, Homo sapiens
acagccagaggagccaggctgg

SEQ ID NO: 8145240 - DNA, 22 bp, Homo sapiens
acagccagaggagccaggctgg

SEQ ID NO: 8145241 - DNA, 22 bp, Homo sapiens
acagccagaggagccaggctgg

SEQ ID NO: 8145242 - DNA, 20 bp, Homo sapiens
acagccagaggaggcagaca

SEQ ID NO: 8145243 - DNA, 22 bp, Homo sapiens
acagccagaagtcagggtggga

SEQ ID NO: 8145244 - DNA, 22 bp, Homo sapiens
acagccactcaaagggccgaag

SEQ ID NO: 8145245 - DNA, 22 bp, Homo sapiens
acagccaaggaattaggaaggg

SEQ ID NO: 8145246 - DNA, 22 bp, Homo sapiens
acaggacaggtaggattcgcag

SEQ ID NO: 8145247 - DNA, 22 bp, Homo sapiens
acaggacaggctgggctagact

SEQ ID NO: 8145248 - DNA, 22 bp, Homo sapiens
acaggacagtctagtaacagta

SEQ ID NO: 8145249 - DNA, 22 bp, Homo sapiens
acaggacagtctagtaacagta

SEQ ID NO: 8145250 - DNA, 22 bp, Homo sapiens
acaggacatgtaccaggtggtc

SEQ ID NO: 8145251 - DNA, 22 bp, Homo sapiens
acaggacatggcttctgtgacg

SEQ ID NO: 8145252 - DNA, 22 bp, Homo sapiens
acaggacatgtaccaggtggtc

SEQ ID NO: 8145253 - DNA, 22 bp, Homo sapiens
acaggagaaatctggtcaaaag

SEQ ID NO: 8145254 - DNA, 22 bp, Homo sapiens
agcttcttccaggcagtgactc

SEQ ID NO: 8145255 - DNA, 22 bp, Homo sapiens
agcttcttcaaagcaggaggcc

SEQ ID NO: 8145256 - DNA, 22 bp, Homo sapiens
agcttcttagttcacttttaat

SEQ ID NO: 8145257 - DNA, 22 bp, Homo sapiens
agcttcttctattttggggcca

SEQ ID NO: 8145258 - DNA, 22 bp, Homo sapiens
agcttcttcccagcctcacccg

SEQ ID NO: 8145259 - DNA, 22 bp, Homo sapiens
agcttccacatctgtcttcagt

SEQ ID NO: 8145260 - DNA, 22 bp, Homo sapiens
agcttccatactaagacaaaag

SEQ ID NO: 8145261 - DNA, 22 bp, Homo sapiens
agcttcttgacggatgttctgg

SEQ ID NO: 8145262 - DNA, 22 bp, Homo sapiens
agcttcttgacggatgttctgg

SEQ ID NO: 8145263 - DNA, 22 bp, Homo sapiens
agcttcttgggctttacacaaa

SEQ ID NO: 8145264 - DNA, 22 bp, Homo sapiens
agcttcttggctcagcacttgg

SEQ ID NO: 8145265 - DNA, 20 bp, Homo sapiens
agcttcttctgtctaatttt

SEQ ID NO: 8145266 - DNA, 22 bp, Homo sapiens
agcttcttctgatttgtcagtc

SEQ ID NO: 8145267 - DNA, 22 bp, Homo sapiens
agcttcttcttggtctttccca

SEQ ID NO: 8145268 - DNA, 22 bp, Homo sapiens
agcttcttgaccaagcctgtaa

SEQ ID NO: 8145269 - DNA, 22 bp, Homo sapiens
acaggatggccagctgatattg

SEQ ID NO: 8145270 - DNA, 22 bp, Homo sapiens
acaggatggccagctgatattg

SEQ ID NO: 8145271 - DNA, 22 bp, Homo sapiens
acaggatgggcgcacagagcta

SEQ ID NO: 8145272 - DNA, 22 bp, Homo sapiens
acaggatgggcgcacagagcta

SEQ ID NO: 8145273 - DNA, 22 bp, Homo sapiens
acaggatgataaaggatggcca

SEQ ID NO: 8145274 - DNA, 22 bp, Homo sapiens
agcttctttgtgggctccagaa

SEQ ID NO: 8145275 - DNA, 22 bp, Homo sapiens
agcttcttgtagaactcaaaag

SEQ ID NO: 8145276 - DNA, 22 bp, Homo sapiens
agcttcttgtatgaagttagag

SEQ ID NO: 8145277 - DNA, 22 bp, Homo sapiens
agcttctttaattcagcatgat

SEQ ID NO: 8145278 - DNA, 19 bp, Homo sapiens
agcttctttggaaacattt

SEQ ID NO: 8145279 - DNA, 19 bp, Homo sapiens
agcttctttggaaacattt

SEQ ID NO: 8145280 - DNA, 22 bp, Homo sapiens
aggaaaggggtaggtgtggacg

SEQ ID NO: 8145281 - DNA, 22 bp, Homo sapiens
acaggcacaccttcctgcaggc

SEQ ID NO: 8145282 - DNA, 21 bp, Homo sapiens
acaggcaatttcatatggttc

SEQ ID NO: 8145283 - DNA, 22 bp, Homo sapiens
acaggcaatatataaattatga

SEQ ID NO: 8145284 - DNA, 23 bp, Homo sapiens
acaggcaataaagggagtctcca

SEQ ID NO: 8145285 - DNA, 22 bp, Homo sapiens
acaggcaagtcacacaacttgt

SEQ ID NO: 8145286 - DNA, 22 bp, Homo sapiens
acaggcaaggccagtgagaaat

SEQ ID NO: 8145287 - DNA, 22 bp, Homo sapiens
acaggcaaggccagtgagaaat

SEQ ID NO: 8145288 - DNA, 22 bp, Homo sapiens
acaggcaaacacagaaagtagg

SEQ ID NO: 8145289 - DNA, 22 bp, Homo sapiens
acaggcaaagggtcagtagcag

SEQ ID NO: 8145290 - DNA, 22 bp, Homo sapiens
acaggcaaagggtcagtagcag

SEQ ID NO: 8145291 - DNA, 22 bp, Homo sapiens
atagcttcagaattgagatatc

SEQ ID NO: 8145292 - DNA, 22 bp, Homo sapiens
atagctttacagaagagtttag

SEQ ID NO: 8145293 - DNA, 22 bp, Homo sapiens
atagctgtagaatgtatacaca

SEQ ID NO: 8145294 - DNA, 22 bp, Homo sapiens
atagccactctaattctcttgt

SEQ ID NO: 8145295 - DNA, 22 bp, Homo sapiens
ataggaaagaaaattatgtagg

SEQ ID NO: 8145296 - DNA, 22 bp, Homo sapiens
ataggaaagaatggagggtggg

SEQ ID NO: 8145297 - DNA, 22 bp, Homo sapiens
atagctttcttaaatatataaa

SEQ ID NO: 8145298 - DNA, 22 bp, Homo sapiens
atagctttttgtcatagagtct

SEQ ID NO: 8145299 - DNA, 22 bp, Homo sapiens
atagtgttacccttcttaaagt

SEQ ID NO: 8145300 - DNA, 22 bp, Homo sapiens
atagtgtgttagtgacataggc

SEQ ID NO: 8145301 - DNA, 22 bp, Homo sapiens
atagtgtgtggtataggtagag

SEQ ID NO: 8145302 - DNA, 22 bp, Homo sapiens
atagtgtgttagtgacataggc

SEQ ID NO: 8145303 - DNA, 22 bp, Homo sapiens
atagttatgctctagacaagaa

SEQ ID NO: 8145304 - DNA, 22 bp, Homo sapiens
ataggaaatcgctattaaccta

SEQ ID NO: 8145305 - DNA, 22 bp, Homo sapiens
ataggaatgtgatttataaatg

SEQ ID NO: 8145306 - DNA, 22 bp, Homo sapiens
ataggagactgttcttggcttc

SEQ ID NO: 8145307 - DNA, 22 bp, Homo sapiens
ataggacagcagacaattagta

SEQ ID NO: 8145308 - DNA, 22 bp, Homo sapiens
atagtgtctttcttcacaggca

SEQ ID NO: 8145309 - DNA, 22 bp, Homo sapiens
atagtgtcagaaaatcataaga

SEQ ID NO: 8145310 - DNA, 22 bp, Homo sapiens
atagtgtgtaaagtgcagtgat

SEQ ID NO: 8145311 - DNA, 22 bp, Homo sapiens
atagtgtgactgaggagttgaa

SEQ ID NO: 8145312 - DNA, 22 bp, Homo sapiens
atagttctggatgtacttatag

SEQ ID NO: 8145313 - DNA, 22 bp, Homo sapiens
atagttgagatcagattcaact

SEQ ID NO: 8145314 - DNA, 22 bp, Homo sapiens
atagttatttctgtcactgtca

SEQ ID NO: 8145315 - DNA, 23 bp, Homo sapiens
atagttatgctgcatgcatgtac

SEQ ID NO: 8145316 - DNA, 22 bp, Homo sapiens
agaaaacttgtcacagctctca

SEQ ID NO: 8145317 - DNA, 22 bp, Homo sapiens
agaaaacttgtcacagctctca

SEQ ID NO: 8145318 - DNA, 22 bp, Homo sapiens
agaaaaggattgatggatcaga

SEQ ID NO: 8145319 - DNA, 22 bp, Homo sapiens
agaaaaggcttgaagaggtttt

SEQ ID NO: 8145320 - DNA, 22 bp, Homo sapiens
agaaaaggattgatggatcaga

SEQ ID NO: 8145321 - DNA, 17 bp, Homo sapiens
agaaaagagaccagcag

SEQ ID NO: 8145322 - DNA, 17 bp, Homo sapiens
agaaaagagaccagcag

SEQ ID NO: 8145323 - DNA, 17 bp, Homo sapiens
agaaaagagaccagcag

SEQ ID NO: 8145324 - DNA, 22 bp, Homo sapiens
agaaaagaggctttctaagcat

SEQ ID NO: 8145325 - DNA, 22 bp, Homo sapiens
agaaaagaggctttctaagcat

SEQ ID NO: 8145326 - DNA, 23 bp, Homo sapiens
agaaaagcttggacacatggcct

SEQ ID NO: 8145327 - DNA, 22 bp, Homo sapiens
atagcatataagttataaaact

SEQ ID NO: 8145328 - DNA, 22 bp, Homo sapiens
atagccacagttatattgagac

SEQ ID NO: 8145329 - DNA, 23 bp, Homo sapiens
actttagataaattatgtgcaca

SEQ ID NO: 8145330 - DNA, 22 bp, Homo sapiens
actttagatattcctctgtaca

SEQ ID NO: 8145331 - DNA, 22 bp, Homo sapiens
atagatgtacgtatgtaaatca

SEQ ID NO: 8145332 - DNA, 22 bp, Homo sapiens
atagatccagaaaatttattat

SEQ ID NO: 8145333 - DNA, 22 bp, Homo sapiens
actttagaaaagcatccataga

SEQ ID NO: 8145334 - DNA, 22 bp, Homo sapiens
actttagaaaagcatccataga

SEQ ID NO: 8145335 - DNA, 22 bp, Homo sapiens
actttactccccaacataaatg

SEQ ID NO: 8145336 - DNA, 22 bp, Homo sapiens
actttactcttcatatgtgaca

SEQ ID NO: 8145337 - DNA, 22 bp, Homo sapiens
actttactccccaacataaatg

SEQ ID NO: 8145338 - DNA, 22 bp, Homo sapiens
actttactccccaacataaatg

SEQ ID NO: 8145339 - DNA, 22 bp, Homo sapiens
actttactccccaacataaatg

SEQ ID NO: 8145340 - DNA, 22 bp, Homo sapiens
actttagagaaatgtagaagta

SEQ ID NO: 8145341 - DNA, 22 bp, Homo sapiens
actttagaccatcttccacagt

SEQ ID NO: 8145342 - DNA, 22 bp, Homo sapiens
actttagaaaaggaacagagga

SEQ ID NO: 8145343 - DNA, 22 bp, Homo sapiens
actttagaagtaaggatgagtt

SEQ ID NO: 8145344 - DNA, 20 bp, Homo sapiens
actttacagagaagactgac

SEQ ID NO: 8145345 - DNA, 22 bp, Homo sapiens
atagaatagcatagaaaattga

SEQ ID NO: 8145346 - DNA, 22 bp, Homo sapiens
atagaatagcatagaaaattga

SEQ ID NO: 8145347 - DNA, 22 bp, Homo sapiens
atagaatagcatagaaaattga

SEQ ID NO: 8145348 - DNA, 22 bp, Homo sapiens
atagaataatggttgtcaggag

SEQ ID NO: 8145349 - DNA, 22 bp, Homo sapiens
atagaataaggcacagattctt

SEQ ID NO: 8145350 - DNA, 22 bp, Homo sapiens
actttactacatccacagatgg

SEQ ID NO: 8145351 - DNA, 22 bp, Homo sapiens
actttacatttgatctctctaa

SEQ ID NO: 8145352 - DNA, 22 bp, Homo sapiens
actttacaggcacttcaagtat

SEQ ID NO: 8145353 - DNA, 22 bp, Homo sapiens
actttactcaacaaatatttat

SEQ ID NO: 8145354 - DNA, 22 bp, Homo sapiens
actttactcaacaaatatttat

SEQ ID NO: 8145355 - DNA, 22 bp, Homo sapiens
actttactccccaacataaatg

SEQ ID NO: 8145356 - DNA, 22 bp, Homo sapiens
actttacagatggtttcctgac

SEQ ID NO: 8145357 - DNA, 22 bp, Homo sapiens
actttacagatggtttcctgac

SEQ ID NO: 8145358 - DNA, 22 bp, Homo sapiens
actttacaggcacttcaagtat

SEQ ID NO: 8145359 - DNA, 22 bp, Homo sapiens
actttacaggcacttcaagtat

SEQ ID NO: 8145360 - DNA, 22 bp, Homo sapiens
atacttaactgtggagtcattg

SEQ ID NO: 8145361 - DNA, 22 bp, Homo sapiens
atacactggtttatgatattgt

SEQ ID NO: 8145362 - DNA, 22 bp, Homo sapiens
atacactggcctttgcagagcc

SEQ ID NO: 8145363 - DNA, 22 bp, Homo sapiens
atacacttccaaatattgatta

SEQ ID NO: 8145364 - DNA, 22 bp, Homo sapiens
atacactgttcactagatcttc

SEQ ID NO: 8145365 - DNA, 21 bp, Homo sapiens
atagaacaccaggcatatata

SEQ ID NO: 8145366 - DNA, 22 bp, Homo sapiens
atagaacaaggtagacagcttt

SEQ ID NO: 8145367 - DNA, 22 bp, Homo sapiens
atagaacagaaacagatgcaca

SEQ ID NO: 8145368 - DNA, 22 bp, Homo sapiens
atagaacagaaacagatgcaca

SEQ ID NO: 8145369 - DNA, 22 bp, Homo sapiens
atagaactcgggctttggaatc

SEQ ID NO: 8145370 - DNA, 22 bp, Homo sapiens
atacaatgaagtatagatgaaa

SEQ ID NO: 8145371 - DNA, 22 bp, Homo sapiens
atacacaattgtgtttttatga

SEQ ID NO: 8145372 - DNA, 22 bp, Homo sapiens
atacacacaatcaggttttgta

SEQ ID NO: 8145373 - DNA, 22 bp, Homo sapiens
atacacacatatgtgagttttg

SEQ ID NO: 8145374 - DNA, 22 bp, Homo sapiens
atacacacaatcaggttttgta

SEQ ID NO: 8145375 - DNA, 22 bp, Homo sapiens
atacacacgtgcacgtgggaaa

SEQ ID NO: 8145376 - DNA, 22 bp, Homo sapiens
atacacacatatgtgagttttg

SEQ ID NO: 8145377 - DNA, 22 bp, Homo sapiens
atacacacgtgcacgtgggaaa

SEQ ID NO: 8145378 - DNA, 22 bp, Homo sapiens
atacaattattctgcagatatt

SEQ ID NO: 8145379 - DNA, 22 bp, Homo sapiens
atacaattattctgcagatatt

SEQ ID NO: 8145380 - DNA, 22 bp, Homo sapiens
atacaattattctgcagatatt

SEQ ID NO: 8145381 - DNA, 22 bp, Homo sapiens
atacaatgggtgcaaagatgtg

SEQ ID NO: 8145382 - DNA, 22 bp, Homo sapiens
atacactactaagcacagattg

SEQ ID NO: 8145383 - DNA, 22 bp, Homo sapiens
atacaccaccttggatctttca

SEQ ID NO: 8145384 - DNA, 22 bp, Homo sapiens
atacacctgtggagtgtctctc

SEQ ID NO: 8145385 - DNA, 19 bp, Homo sapiens
atacacgtgtatacataca

SEQ ID NO: 8145386 - DNA, 22 bp, Homo sapiens
atacacatttgctagagatggg

SEQ ID NO: 8145387 - DNA, 22 bp, Homo sapiens
atacacatttgctagagatggg

SEQ ID NO: 8145388 - DNA, 22 bp, Homo sapiens
atacacactgctatcctttttt

SEQ ID NO: 8145389 - DNA, 22 bp, Homo sapiens
atacacactgctatcctttttt

SEQ ID NO: 8145390 - DNA, 22 bp, Homo sapiens
atacacagccattatgaattag

SEQ ID NO: 8145391 - DNA, 22 bp, Homo sapiens
atacacagcgatgagaggaggc

SEQ ID NO: 8145392 - DNA, 22 bp, Homo sapiens
ataagctgtactctataaatgt

SEQ ID NO: 8145393 - DNA, 22 bp, Homo sapiens
atacaagttgtgataatgtaaa

SEQ ID NO: 8145394 - DNA, 22 bp, Homo sapiens
ataaggcagtcactggaatgtt

SEQ ID NO: 8145395 - DNA, 22 bp, Homo sapiens
agttgcactttctagatactgt

SEQ ID NO: 8145396 - DNA, 22 bp, Homo sapiens
agttgatttttctggctcagcc

SEQ ID NO: 8145397 - DNA, 22 bp, Homo sapiens
agttgcagccttcaggagaccc

SEQ ID NO: 8145398 - DNA, 19 bp, Homo sapiens
ataaataaaaagtgggaga

SEQ ID NO: 8145399 - DNA, 22 bp, Homo sapiens
agttgcagacgcagagatgttg

SEQ ID NO: 8145400 - DNA, 22 bp, Homo sapiens
ataaattatgaatggccctttt

SEQ ID NO: 8145401 - DNA, 19 bp, Homo sapiens
ataaataaaaagtgggaga

SEQ ID NO: 8145402 - DNA, 22 bp, Homo sapiens
ataaattatgaatggccctttt

SEQ ID NO: 8145403 - DNA, 22 bp, Homo sapiens
ataaattctctgatgtatagta

SEQ ID NO: 8145404 - DNA, 21 bp, Homo sapiens
ataaattctgagaggctctgc

SEQ ID NO: 8145405 - DNA, 22 bp, Homo sapiens
ataaattctctgatgtatagta

SEQ ID NO: 8145406 - DNA, 21 bp, Homo sapiens
ataaattctgagaggctctgc

SEQ ID NO: 8145407 - DNA, 22 bp, Homo sapiens
ataacaatagtggtagtgctgg

SEQ ID NO: 8145408 - DNA, 22 bp, Homo sapiens
ataaattttcttgctgtactta

SEQ ID NO: 8145409 - DNA, 22 bp, Homo sapiens
ataaattttcttgctgtactta

SEQ ID NO: 8145410 - DNA, 22 bp, Homo sapiens
ataaattttcttgctgtactta

SEQ ID NO: 8145411 - DNA, 22 bp, Homo sapiens
ataacactaaatgtatgtaaca

SEQ ID NO: 8145412 - DNA, 22 bp, Homo sapiens
agttcacagaatggccagaact

SEQ ID NO: 8145413 - DNA, 22 bp, Homo sapiens
agttcactttctgtagtggaag

SEQ ID NO: 8145414 - DNA, 22 bp, Homo sapiens
agttgaaggttggctgatccat

SEQ ID NO: 8145415 - DNA, 22 bp, Homo sapiens
agttgaaattagagtcctggct

SEQ ID NO: 8145416 - DNA, 22 bp, Homo sapiens
agttgaaattaagagagagttt

SEQ ID NO: 8145417 - DNA, 22 bp, Homo sapiens
agttgaaagccttatttctctg

SEQ ID NO: 8145418 - DNA, 22 bp, Homo sapiens
agttgaaagccttatttctctg

SEQ ID NO: 8145419 - DNA, 23 bp, Homo sapiens
agttcataatttcttatttgtgt

SEQ ID NO: 8145420 - DNA, 22 bp, Homo sapiens
agttctttgtaaaaggtctcta

SEQ ID NO: 8145421 - DNA, 22 bp, Homo sapiens
agttctttgtcatctctggagt

SEQ ID NO: 8145422 - DNA, 22 bp, Homo sapiens
agttctttgtgagtaatacaga

SEQ ID NO: 8145423 - DNA, 22 bp, Homo sapiens
agttcttttctagattctggat

SEQ ID NO: 8145424 - DNA, 22 bp, Homo sapiens
agttcttttgtgaacatatgct

SEQ ID NO: 8145425 - DNA, 22 bp, Homo sapiens
agaaatcacttaatgaacgtag

SEQ ID NO: 8145426 - DNA, 22 bp, Homo sapiens
agaaatcacttagaggaagtga

SEQ ID NO: 8145427 - DNA, 22 bp, Homo sapiens
agaaatcacttaatgaacgtag

SEQ ID NO: 8145428 - DNA, 20 bp, Homo sapiens
agaaatcagcatgtcctctg

SEQ ID NO: 8145429 - DNA, 22 bp, Homo sapiens
agaaatcagaaccctgaagttc

SEQ ID NO: 8145430 - DNA, 20 bp, Homo sapiens
agaaatattgagttcagagg

SEQ ID NO: 8145431 - DNA, 20 bp, Homo sapiens
agaaatattgagttcagagg

SEQ ID NO: 8145432 - DNA, 22 bp, Homo sapiens
atattaattatttacacatgag

SEQ ID NO: 8145433 - DNA, 22 bp, Homo sapiens
agaaagtttgtttttatccata

SEQ ID NO: 8145434 - DNA, 22 bp, Homo sapiens
agaaagttttgtgctatatatg

SEQ ID NO: 8145435 - DNA, 22 bp, Homo sapiens
agaaagtttgtttttatccata

SEQ ID NO: 8145436 - DNA, 22 bp, Homo sapiens
atattacacacggtatcacggg

SEQ ID NO: 8145437 - DNA, 22 bp, Homo sapiens
agaaagttttgtgctatatatg

SEQ ID NO: 8145438 - DNA, 22 bp, Homo sapiens
agaaagttttgtgctatatatg

SEQ ID NO: 8145439 - DNA, 22 bp, Homo sapiens
agaaatagcagagtcaggcggg

SEQ ID NO: 8145440 - DNA, 19 bp, Homo sapiens
agaaatagccttccttgtc

SEQ ID NO: 8145441 - DNA, 19 bp, Homo sapiens
agaaatagccttccttgtc

SEQ ID NO: 8145442 - DNA, 22 bp, Homo sapiens
agaaatagtcacattggaggaa

SEQ ID NO: 8145443 - DNA, 22 bp, Homo sapiens
agaaatagtcacattggaggaa

SEQ ID NO: 8145444 - DNA, 22 bp, Homo sapiens
agaaatatgctgattagatgaa

SEQ ID NO: 8145445 - DNA, 22 bp, Homo sapiens
agaaatatgctgattagatgaa

SEQ ID NO: 8145446 - DNA, 22 bp, Homo sapiens
agaaatatgctgattagatgaa

SEQ ID NO: 8145447 - DNA, 22 bp, Homo sapiens
agaaatatgctgattagatgaa

SEQ ID NO: 8145448 - DNA, 22 bp, Homo sapiens
atcaattcttaggaaaatagct

SEQ ID NO: 8145449 - DNA, 22 bp, Homo sapiens
atcaattttgaggatacaagaa

SEQ ID NO: 8145450 - DNA, 22 bp, Homo sapiens
atcaattttgaggatacaagaa

SEQ ID NO: 8145451 - DNA, 22 bp, Homo sapiens
agaaatcttggagtctgtggta

SEQ ID NO: 8145452 - DNA, 22 bp, Homo sapiens
agaaatgctcttcctgaccaga

SEQ ID NO: 8145453 - DNA, 22 bp, Homo sapiens
agaaatgcattagcacatatag

SEQ ID NO: 8145454 - DNA, 22 bp, Homo sapiens
atcaatgacagttgaattctac

SEQ ID NO: 8145455 - DNA, 22 bp, Homo sapiens
atcaatagtctggaaagttctg

SEQ ID NO: 8145456 - DNA, 18 bp, Homo sapiens
atcaaggaggggaaggtc

SEQ ID NO: 8145457 - DNA, 22 bp, Homo sapiens
atcaagttctgtcacatttgtc

SEQ ID NO: 8145458 - DNA, 22 bp, Homo sapiens
atcaagcatatataaaactgca

SEQ ID NO: 8145459 - DNA, 22 bp, Homo sapiens
agaaagaacgttggttatctta

SEQ ID NO: 8145460 - DNA, 22 bp, Homo sapiens
agaaagaacgttggttatctta

SEQ ID NO: 8145461 - DNA, 22 bp, Homo sapiens
agaaagacgtgatgaagaagta

SEQ ID NO: 8145462 - DNA, 22 bp, Homo sapiens
agaaagacaaaatgcagtggct

SEQ ID NO: 8145463 - DNA, 22 bp, Homo sapiens
agaaagagatgaatgctttaag

SEQ ID NO: 8145464 - DNA, 17 bp, Homo sapiens
agaaagaggatccacag

SEQ ID NO: 8145465 - DNA, 17 bp, Homo sapiens
agaaagaggatccacag

SEQ ID NO: 8145466 - DNA, 22 bp, Homo sapiens
agaaagaggatgcagatctcat

SEQ ID NO: 8145467 - DNA, 22 bp, Homo sapiens
atattaaatggattttgggagc

SEQ ID NO: 8145468 - DNA, 22 bp, Homo sapiens
atattaaatggattttgggagc

SEQ ID NO: 8145469 - DNA, 22 bp, Homo sapiens
atattaaatggattttgggagc

SEQ ID NO: 8145470 - DNA, 22 bp, Homo sapiens
atattaagatgctattggtttt

SEQ ID NO: 8145471 - DNA, 22 bp, Homo sapiens
atattaaaactatggttttcag

SEQ ID NO: 8145472 - DNA, 22 bp, Homo sapiens
atattaaaactatggttttcag

SEQ ID NO: 8145473 - DNA, 22 bp, Homo sapiens
atattaaaactatggttttcag

SEQ ID NO: 8145474 - DNA, 22 bp, Homo sapiens
atattaaaactatggttttcag

SEQ ID NO: 8145475 - DNA, 22 bp, Homo sapiens
atattaaaactatggttttcag

SEQ ID NO: 8145476 - DNA, 22 bp, Homo sapiens
atattaaatggattttgggagc

SEQ ID NO: 8145477 - DNA, 22 bp, Homo sapiens
atattaatgggatttagtcagg

SEQ ID NO: 8145478 - DNA, 22 bp, Homo sapiens
atattaatgagcaagtaagtga

SEQ ID NO: 8145479 - DNA, 22 bp, Homo sapiens
atattaatgggatttagtcagg

SEQ ID NO: 8145480 - DNA, 22 bp, Homo sapiens
atattaatgggatttagtcagg

SEQ ID NO: 8145481 - DNA, 22 bp, Homo sapiens
atatagctgaggggtattataa

SEQ ID NO: 8145482 - DNA, 19 bp, Homo sapiens
atatagcattattcaattt

SEQ ID NO: 8145483 - DNA, 19 bp, Homo sapiens
atatagcattattcaattt

SEQ ID NO: 8145484 - DNA, 22 bp, Homo sapiens
atatagcacttgttttgcatgt

SEQ ID NO: 8145485 - DNA, 22 bp, Homo sapiens
atatagtaagcagtctgtaaat

SEQ ID NO: 8145486 - DNA, 22 bp, Homo sapiens
atatagtaagcagtctgtaaat

SEQ ID NO: 8145487 - DNA, 22 bp, Homo sapiens
atatagtatgtcctccagaatt

SEQ ID NO: 8145488 - DNA, 22 bp, Homo sapiens
atatagtaagcagtctgtaaat

SEQ ID NO: 8145489 - DNA, 22 bp, Homo sapiens
atatagtaagcagtctgtaaat

SEQ ID NO: 8145490 - DNA, 22 bp, Homo sapiens
atatagaaggtgctatttacat

SEQ ID NO: 8145491 - DNA, 22 bp, Homo sapiens
atatagaatacacagggaaagt

SEQ ID NO: 8145492 - DNA, 22 bp, Homo sapiens
agaaaagggcaggagggataca

SEQ ID NO: 8145493 - DNA, 22 bp, Homo sapiens
agaaaagggcaggagggataca

SEQ ID NO: 8145494 - DNA, 22 bp, Homo sapiens
agaaaagggcaggagggataca

SEQ ID NO: 8145495 - DNA, 22 bp, Homo sapiens
atatagaaggtgctatttacat

SEQ ID NO: 8145496 - DNA, 22 bp, Homo sapiens
atatagaaggtgctatttacat

SEQ ID NO: 8145497 - DNA, 22 bp, Homo sapiens
atatagaaggtgctatttacat

SEQ ID NO: 8145498 - DNA, 22 bp, Homo sapiens
agaaagaacgcacttgtgctgc

SEQ ID NO: 8145499 - DNA, 22 bp, Homo sapiens
agaaacttcagctattcttttg

SEQ ID NO: 8145500 - DNA, 22 bp, Homo sapiens
agaaactgcagctcagagaagt

SEQ ID NO: 8145501 - DNA, 17 bp, Homo sapiens
agaaactgaggctcagt

SEQ ID NO: 8145502 - DNA, 21 bp, Homo sapiens
agaaactgactcctagaggca

SEQ ID NO: 8145503 - DNA, 21 bp, Homo sapiens
agaaactgactcctagaggca

SEQ ID NO: 8145504 - DNA, 22 bp, Homo sapiens
agaaactgtgttactagaatgt

SEQ ID NO: 8145505 - DNA, 22 bp, Homo sapiens
agaaactgcagctcagagaagt

SEQ ID NO: 8145506 - DNA, 20 bp, Homo sapiens
agaaacatttcttgagaact

SEQ ID NO: 8145507 - DNA, 22 bp, Homo sapiens
atatataacctggataaggctt

SEQ ID NO: 8145508 - DNA, 22 bp, Homo sapiens
atatagtgaaagtgatgtgtgg

SEQ ID NO: 8145509 - DNA, 22 bp, Homo sapiens
atatagtcaaacatatatgtgt

SEQ ID NO: 8145510 - DNA, 22 bp, Homo sapiens
atatagtttaagaaagtacagt

SEQ ID NO: 8145511 - DNA, 22 bp, Homo sapiens
atatagttgggtttcattctac

SEQ ID NO: 8145512 - DNA, 22 bp, Homo sapiens
agaagccaaaggggccagatat

SEQ ID NO: 8145513 - DNA, 20 bp, Homo sapiens
agaagcattcaaagaaaact

SEQ ID NO: 8145514 - DNA, 20 bp, Homo sapiens
agaagcattcaaagaaaact

SEQ ID NO: 8145515 - DNA, 22 bp, Homo sapiens
agaagccaaaggggccagatat

SEQ ID NO: 8145516 - DNA, 22 bp, Homo sapiens
agaagccaaatgccagtgacct

SEQ ID NO: 8145517 - DNA, 22 bp, Homo sapiens
agaagccaaatgccagtgacct

SEQ ID NO: 8145518 - DNA, 22 bp, Homo sapiens
agaagccaacagggcaggagag

SEQ ID NO: 8145519 - DNA, 22 bp, Homo sapiens
agaagccaaatgccagtgacct

SEQ ID NO: 8145520 - DNA, 18 bp, Homo sapiens
agaagcaggtaaaattct

SEQ ID NO: 8145521 - DNA, 20 bp, Homo sapiens
agaagcatcattctgatgtc

SEQ ID NO: 8145522 - DNA, 22 bp, Homo sapiens
agaagcattataacatgcaagg

SEQ ID NO: 8145523 - DNA, 22 bp, Homo sapiens
agaagcacggttttgtctagca

SEQ ID NO: 8145524 - DNA, 22 bp, Homo sapiens
agaagcactacgataggtggtc

SEQ ID NO: 8145525 - DNA, 22 bp, Homo sapiens
agaagcagggcagggaaaagca

SEQ ID NO: 8145526 - DNA, 22 bp, Homo sapiens
agaagcaggcctcacagatctg

SEQ ID NO: 8145527 - DNA, 22 bp, Homo sapiens
agaaatgttgaatacatcagga

SEQ ID NO: 8145528 - DNA, 22 bp, Homo sapiens
agaaatgtttatggctgcctat

SEQ ID NO: 8145529 - DNA, 22 bp, Homo sapiens
agaagcacggttttgtctagca

SEQ ID NO: 8145530 - DNA, 22 bp, Homo sapiens
agaaatgggccttgggacacaa

SEQ ID NO: 8145531 - DNA, 22 bp, Homo sapiens
agaaatggtgagtgagagcccc

SEQ ID NO: 8145532 - DNA, 20 bp, Homo sapiens
agaaatgtgaaaggctgagt

SEQ ID NO: 8145533 - DNA, 22 bp, Homo sapiens
agaaatgtccagggctaggatc

SEQ ID NO: 8145534 - DNA, 22 bp, Homo sapiens
agaaatgtccagggctaggatc

SEQ ID NO: 8145535 - DNA, 22 bp, Homo sapiens
agaaatgttgaatacacaaaat

SEQ ID NO: 8145536 - DNA, 22 bp, Homo sapiens
agaaatgttacagttgttattt

SEQ ID NO: 8145537 - DNA, 22 bp, Homo sapiens
atctggaaaacacagtgtagac

SEQ ID NO: 8145538 - DNA, 22 bp, Homo sapiens
agaagctgcctacatgaccagc

SEQ ID NO: 8145539 - DNA, 22 bp, Homo sapiens
agaagctgcgtttatttaaatc

SEQ ID NO: 8145540 - DNA, 22 bp, Homo sapiens
agaagctgcctacatgaccagc

SEQ ID NO: 8145541 - DNA, 22 bp, Homo sapiens
agaagctcgggtaagctccatt

SEQ ID NO: 8145542 - DNA, 22 bp, Homo sapiens
agaagctaattcatgtcttatg

SEQ ID NO: 8145543 - DNA, 22 bp, Homo sapiens
agaagcgttccatttgatgggt

SEQ ID NO: 8145544 - DNA, 22 bp, Homo sapiens
agaagctgacagatgcagcagg

SEQ ID NO: 8145545 - DNA, 22 bp, Homo sapiens
agaagctgacagatgcagcagg

SEQ ID NO: 8145546 - DNA, 20 bp, Homo sapiens
agaagctgagactgggtttt

SEQ ID NO: 8145547 - DNA, 20 bp, Homo sapiens
agaagctgatactgatggaa

SEQ ID NO: 8145548 - DNA, 22 bp, Homo sapiens
agaagccattccctgtaggctc

SEQ ID NO: 8145549 - DNA, 22 bp, Homo sapiens
agaagccatgtttagtaggatg

SEQ ID NO: 8145550 - DNA, 21 bp, Homo sapiens
agaagccatgtggtggagaac

SEQ ID NO: 8145551 - DNA, 22 bp, Homo sapiens
agaagccattctcagttcctga

SEQ ID NO: 8145552 - DNA, 22 bp, Homo sapiens
agaagccattccctgtaggctc

SEQ ID NO: 8145553 - DNA, 22 bp, Homo sapiens
agaagccattccctgtaggctc

SEQ ID NO: 8145554 - DNA, 22 bp, Homo sapiens
agaagccattgaagcagacctc

SEQ ID NO: 8145555 - DNA, 22 bp, Homo sapiens
agaagccattctcagttcctga

SEQ ID NO: 8145556 - DNA, 22 bp, Homo sapiens
agaagccattgaagcagacctc

SEQ ID NO: 8145557 - DNA, 21 bp, Homo sapiens
agaagccatttgttaggactt

SEQ ID NO: 8145558 - DNA, 22 bp, Homo sapiens
agaagccattgaagcagacctc

SEQ ID NO: 8145559 - DNA, 19 bp, Homo sapiens
agaagcccagatcccagcc

SEQ ID NO: 8145560 - DNA, 21 bp, Homo sapiens
agaagccatttgttaggactt

SEQ ID NO: 8145561 - DNA, 22 bp, Homo sapiens
agaagcgtgagtggatttaggt

SEQ ID NO: 8145562 - DNA, 21 bp, Homo sapiens
agaagcctgggtggaggtggg

SEQ ID NO: 8145563 - DNA, 21 bp, Homo sapiens
agaagcctgggtggaggtggg

SEQ ID NO: 8145564 - DNA, 22 bp, Homo sapiens
atcctgggaagctgacattgaa

SEQ ID NO: 8145565 - DNA, 22 bp, Homo sapiens
atcctgggaagctgacattgaa

SEQ ID NO: 8145566 - DNA, 22 bp, Homo sapiens
atcctggctttaggtcagaggc

SEQ ID NO: 8145567 - DNA, 22 bp, Homo sapiens
atcctggcgggggaactgccca

SEQ ID NO: 8145568 - DNA, 22 bp, Homo sapiens
atcctggcgccacacggctcta

SEQ ID NO: 8145569 - DNA, 22 bp, Homo sapiens
atcctggcgggggaactgccca

SEQ ID NO: 8145570 - DNA, 22 bp, Homo sapiens
atcctggcgccacacggctcta

SEQ ID NO: 8145571 - DNA, 22 bp, Homo sapiens
atcctggccctcatgacccctt

SEQ ID NO: 8145572 - DNA, 22 bp, Homo sapiens
atcctggcccaggtgtggaggg

SEQ ID NO: 8145573 - DNA, 22 bp, Homo sapiens
atcctggcccaggtgtggaggg

SEQ ID NO: 8145574 - DNA, 22 bp, Homo sapiens
atcctgctgctgtggacttctc

SEQ ID NO: 8145575 - DNA, 20 bp, Homo sapiens
atcctggaatccaaatggag

SEQ ID NO: 8145576 - DNA, 22 bp, Homo sapiens
atcctggcaagcagaggagaac

SEQ ID NO: 8145577 - DNA, 22 bp, Homo sapiens
atcctggaggctggaggcttgc

SEQ ID NO: 8145578 - DNA, 22 bp, Homo sapiens
atcctggacagtttcccctatt

SEQ ID NO: 8145579 - DNA, 23 bp, Homo sapiens
atcctgctgatggccctccagga

SEQ ID NO: 8145580 - DNA, 22 bp, Homo sapiens
atcctgaggaaggtgcagagat

SEQ ID NO: 8145581 - DNA, 22 bp, Homo sapiens
atcctgaggaaggtgcagagat

SEQ ID NO: 8145582 - DNA, 22 bp, Homo sapiens
agaagccaccagctgaggaaga

SEQ ID NO: 8145583 - DNA, 22 bp, Homo sapiens
atcctgggaatgggagggtcat

SEQ ID NO: 8145584 - DNA, 22 bp, Homo sapiens
atcctgggaatgggagggtcat

SEQ ID NO: 8145585 - DNA, 22 bp, Homo sapiens
atcctgggaatgggagggtcat

SEQ ID NO: 8145586 - DNA, 22 bp, Homo sapiens
atcctgggaagctgacattgaa

SEQ ID NO: 8145587 - DNA, 22 bp, Homo sapiens
atcctgggaagctgacattgaa

SEQ ID NO: 8145588 - DNA, 22 bp, Homo sapiens
atcctgggaagtggcctcctcc

SEQ ID NO: 8145589 - DNA, 22 bp, Homo sapiens
agaagccatagtctgggaggca

SEQ ID NO: 8145590 - DNA, 22 bp, Homo sapiens
agaagccatagtatctcagggt

SEQ ID NO: 8145591 - DNA, 22 bp, Homo sapiens
agaagccatagtatctcagggt

SEQ ID NO: 8145592 - DNA, 22 bp, Homo sapiens
agaagccaccagctgaggaaga

SEQ ID NO: 8145593 - DNA, 22 bp, Homo sapiens
agaagccaccagctgaggaaga

SEQ ID NO: 8145594 - DNA, 21 bp, Homo sapiens
agaagccatgtggtggagaac

SEQ ID NO: 8145595 - DNA, 22 bp, Homo sapiens
agaagccatggtatgcaactac

SEQ ID NO: 8145596 - DNA, 22 bp, Homo sapiens
agaagccatggtatgcaactac

SEQ ID NO: 8145597 - DNA, 22 bp, Homo sapiens
agaagccatggtatgcaactac

SEQ ID NO: 8145598 - DNA, 22 bp, Homo sapiens
agaagccatatttagggaggag

SEQ ID NO: 8145599 - DNA, 22 bp, Homo sapiens
agaagccatatttagggaggag

SEQ ID NO: 8145600 - DNA, 22 bp, Homo sapiens
agaagccatagtatctcagggt

SEQ ID NO: 8145601 - DNA, 22 bp, Homo sapiens
agaagccatagtctgggaggca

SEQ ID NO: 8145602 - DNA, 19 bp, Homo sapiens
aggtgcaggtcacagggga

SEQ ID NO: 8145603 - DNA, 19 bp, Homo sapiens
aggtgcaggtcacagggga

SEQ ID NO: 8145604 - DNA, 19 bp, Homo sapiens
aggtgcaggtcacagggga

SEQ ID NO: 8145605 - DNA, 21 bp, Homo sapiens
aggtgcaggcctcaagcccca

SEQ ID NO: 8145606 - DNA, 22 bp, Homo sapiens
aggtgcaggagctgtgcaggga

SEQ ID NO: 8145607 - DNA, 22 bp, Homo sapiens
aggtgcaggagctgtgcaggga

SEQ ID NO: 8145608 - DNA, 22 bp, Homo sapiens
aggtgcaggagctgtgcaggga

SEQ ID NO: 8145609 - DNA, 22 bp, Homo sapiens
agggtgcatgtttgcaagagtg

SEQ ID NO: 8145610 - DNA, 23 bp, Homo sapiens
agggtgcatttcacttacagacc

SEQ ID NO: 8145611 - DNA, 22 bp, Homo sapiens
agggtgcctgctgcaggttcag

SEQ ID NO: 8145612 - DNA, 22 bp, Homo sapiens
agggtgcatgtttgcaagagtg

SEQ ID NO: 8145613 - DNA, 22 bp, Homo sapiens
agggtgcagtcacaggaaatgt

SEQ ID NO: 8145614 - DNA, 22 bp, Homo sapiens
agggtgcagtcacaggaaatgt

SEQ ID NO: 8145615 - DNA, 22 bp, Homo sapiens
aggtgcaggagctgtgcaggga

SEQ ID NO: 8145616 - DNA, 22 bp, Homo sapiens
agggtgcctgctgcaggttcag

SEQ ID NO: 8145617 - DNA, 22 bp, Homo sapiens
aggtgcatgatgcagagtgcag

SEQ ID NO: 8145618 - DNA, 22 bp, Homo sapiens
aggtgccaaagcctgcgggtgt

SEQ ID NO: 8145619 - DNA, 23 bp, Homo sapiens
aggtgccaactgagagctgagag

SEQ ID NO: 8145620 - DNA, 23 bp, Homo sapiens
aggtgccaactgagagctgagag

SEQ ID NO: 8145621 - DNA, 22 bp, Homo sapiens
aggtgccaagatgtcacagaca

SEQ ID NO: 8145622 - DNA, 22 bp, Homo sapiens
aggtgccaagatgtcacagaca

SEQ ID NO: 8145623 - DNA, 21 bp, Homo sapiens
aggtgccaaggagaagcaggc

SEQ ID NO: 8145624 - DNA, 22 bp, Homo sapiens
aggtgcagtgtttaaaagtagc

SEQ ID NO: 8145625 - DNA, 22 bp, Homo sapiens
aggtgcagtggctcatgcctgt

SEQ ID NO: 8145626 - DNA, 22 bp, Homo sapiens
aggtgcagtggctcatgcctgt

SEQ ID NO: 8145627 - DNA, 22 bp, Homo sapiens
aggtgcagtgaaggaaaaggaa

SEQ ID NO: 8145628 - DNA, 22 bp, Homo sapiens
aggtgcagtgaaggaaaaggaa

SEQ ID NO: 8145629 - DNA, 22 bp, Homo sapiens
aggtgccagatgcacagctgaa

SEQ ID NO: 8145630 - DNA, 22 bp, Homo sapiens
aggtgccaattttcagtgaaca

SEQ ID NO: 8145631 - DNA, 22 bp, Homo sapiens
aggtgccaattttcagtgaaca

SEQ ID NO: 8145632 - DNA, 21 bp, Homo sapiens
aggtgccaaggagaagcaggc

SEQ ID NO: 8145633 - DNA, 21 bp, Homo sapiens
aggtgccaaggagaagcaggc

SEQ ID NO: 8145634 - DNA, 22 bp, Homo sapiens
aggtgccagatgcacagctgaa

SEQ ID NO: 8145635 - DNA, 22 bp, Homo sapiens
aggtgccagatgcacagctgaa

SEQ ID NO: 8145636 - DNA, 22 bp, Homo sapiens
aggtggaaatggctttcctagg

SEQ ID NO: 8145637 - DNA, 22 bp, Homo sapiens
aggtggaaatggctttcctagg

SEQ ID NO: 8145638 - DNA, 22 bp, Homo sapiens
agggtcagttctgtgaggtgtt

SEQ ID NO: 8145639 - DNA, 22 bp, Homo sapiens
agggtccacttggacattgatc

SEQ ID NO: 8145640 - DNA, 19 bp, Homo sapiens
agggtccaggccctgtgga

SEQ ID NO: 8145641 - DNA, 18 bp, Homo sapiens
agggtcagtgtcactggc

SEQ ID NO: 8145642 - DNA, 22 bp, Homo sapiens
agggtcagtgatgagggagccc

SEQ ID NO: 8145643 - DNA, 22 bp, Homo sapiens
agggtcagtgatgagggagccc

SEQ ID NO: 8145644 - DNA, 18 bp, Homo sapiens
agggtcagtgtcactggc

SEQ ID NO: 8145645 - DNA, 22 bp, Homo sapiens
agggtccatcaaggactgcaca

SEQ ID NO: 8145646 - DNA, 22 bp, Homo sapiens
agggtgcagggacaggtgtgca

SEQ ID NO: 8145647 - DNA, 22 bp, Homo sapiens
agggtgcagaaggagcctagga

SEQ ID NO: 8145648 - DNA, 22 bp, Homo sapiens
agggtgcagggacaggtgtgca

SEQ ID NO: 8145649 - DNA, 22 bp, Homo sapiens
agggtgcagaaggagcctagga

SEQ ID NO: 8145650 - DNA, 22 bp, Homo sapiens
agggtgcagaaggagcctagga

SEQ ID NO: 8145651 - DNA, 22 bp, Homo sapiens
agggtgcaggtgtggagtctag

SEQ ID NO: 8145652 - DNA, 22 bp, Homo sapiens
agggtgcaggggaagctgccct

SEQ ID NO: 8145653 - DNA, 22 bp, Homo sapiens
agggtgcaggggaagctgccct

SEQ ID NO: 8145654 - DNA, 22 bp, Homo sapiens
agggtgcaggtgtggagtctag

SEQ ID NO: 8145655 - DNA, 22 bp, Homo sapiens
agggtgcaggtgtggagtctag

SEQ ID NO: 8145656 - DNA, 22 bp, Homo sapiens
agggtgcagaaggagcctagga

SEQ ID NO: 8145657 - DNA, 22 bp, Homo sapiens
agggtgcagaacaaattaagac

SEQ ID NO: 8145658 - DNA, 22 bp, Homo sapiens
agggtgcagaacaaattaagac

SEQ ID NO: 8145659 - DNA, 22 bp, Homo sapiens
agggtgcaaaagcaaggacagt

SEQ ID NO: 8145660 - DNA, 22 bp, Homo sapiens
agggtgcaaaagcaaggacagt

SEQ ID NO: 8145661 - DNA, 22 bp, Homo sapiens
agggtgagggtctggccttgag

SEQ ID NO: 8145662 - DNA, 22 bp, Homo sapiens
agggtcctaagcctcagataag

SEQ ID NO: 8145663 - DNA, 21 bp, Homo sapiens
agggtcctacagggctcagga

SEQ ID NO: 8145664 - DNA, 22 bp, Homo sapiens
agggtgagggtctggccttgag

SEQ ID NO: 8145665 - DNA, 23 bp, Homo sapiens
agggtgagcaagctatggagacc

SEQ ID NO: 8145666 - DNA, 22 bp, Homo sapiens
aggtggggaggagtgtctcttt

SEQ ID NO: 8145667 - DNA, 22 bp, Homo sapiens
aggtggggaggagtgtctcttt

SEQ ID NO: 8145668 - DNA, 22 bp, Homo sapiens
aggtggggttcagtctcagccg

SEQ ID NO: 8145669 - DNA, 22 bp, Homo sapiens
aggtgggtgccgtctgtcctct

SEQ ID NO: 8145670 - DNA, 22 bp, Homo sapiens
aggtgggtgccgtctgtcctct

SEQ ID NO: 8145671 - DNA, 22 bp, Homo sapiens
aggtgggtatcatgagagatta

SEQ ID NO: 8145672 - DNA, 17 bp, Homo sapiens
aggtgggtggatcacct

SEQ ID NO: 8145673 - DNA, 22 bp, Homo sapiens
aggtgggttcccgactctggct

SEQ ID NO: 8145674 - DNA, 22 bp, Homo sapiens
aggtggtcactaactgccaaga

SEQ ID NO: 8145675 - DNA, 15 bp, Homo sapiens
aggtggtcagtagca

SEQ ID NO: 8145676 - DNA, 22 bp, Homo sapiens
aggtggtccagagtaggaagtg

SEQ ID NO: 8145677 - DNA, 22 bp, Homo sapiens
aggtggtccctataatgtggga

SEQ ID NO: 8145678 - DNA, 22 bp, Homo sapiens
aggtggtcgaatgaaataattt

SEQ ID NO: 8145679 - DNA, 22 bp, Homo sapiens
aggtggtctagcatcacggtga

SEQ ID NO: 8145680 - DNA, 19 bp, Homo sapiens
aggtggtctaggctggaga

SEQ ID NO: 8145681 - DNA, 19 bp, Homo sapiens
aggtggtctaggctggaga

SEQ ID NO: 8145682 - DNA, 21 bp, Homo sapiens
aggtggtctgcagcagctgaa

SEQ ID NO: 8145683 - DNA, 21 bp, Homo sapiens
aggtggtctgcagcagctgaa

SEQ ID NO: 8145684 - DNA, 23 bp, Homo sapiens
aggtggtcttgtggatgctgcaa

SEQ ID NO: 8145685 - DNA, 22 bp, Homo sapiens
aggtggtcttggcccacccagg

SEQ ID NO: 8145686 - DNA, 22 bp, Homo sapiens
aggtggtcttaaactgctctgg

SEQ ID NO: 8145687 - DNA, 22 bp, Homo sapiens
aggtggtcttaaactgctctgg

SEQ ID NO: 8145688 - DNA, 22 bp, Homo sapiens
aggtggagacccagagaaggcg

SEQ ID NO: 8145689 - DNA, 22 bp, Homo sapiens
aggtggagacccagagaaggcg

SEQ ID NO: 8145690 - DNA, 22 bp, Homo sapiens
aggtggagacccagagaaggcg

SEQ ID NO: 8145691 - DNA, 22 bp, Homo sapiens
aggtggagacccagagaaggcg

SEQ ID NO: 8145692 - DNA, 22 bp, Homo sapiens
aggtggagacccagagaaggcg

SEQ ID NO: 8145693 - DNA, 22 bp, Homo sapiens
aggtggagacccagagaaggcg

SEQ ID NO: 8145694 - DNA, 22 bp, Homo sapiens
aggtggagaagagatgggcagt

SEQ ID NO: 8145695 - DNA, 22 bp, Homo sapiens
aggtggagaagagatgggcagt

SEQ ID NO: 8145696 - DNA, 22 bp, Homo sapiens
aggtggagaagagatgggcagt

SEQ ID NO: 8145697 - DNA, 22 bp, Homo sapiens
aggtggagaagagatgggcagt

SEQ ID NO: 8145698 - DNA, 22 bp, Homo sapiens
aggtgtccaggaagatgctggc

SEQ ID NO: 8145699 - DNA, 22 bp, Homo sapiens
aggtgtcccggcctgcggggct

SEQ ID NO: 8145700 - DNA, 20 bp, Homo sapiens
aggtgtcctgtagcttgagt

SEQ ID NO: 8145701 - DNA, 20 bp, Homo sapiens
aggtgtcctgtagcttgagt

SEQ ID NO: 8145702 - DNA, 22 bp, Homo sapiens
aggtgtctggacttgtgaagca

SEQ ID NO: 8145703 - DNA, 22 bp, Homo sapiens
aggtgtccggctgcataatctt

SEQ ID NO: 8145704 - DNA, 22 bp, Homo sapiens
aggtgtccaggaagatgctggc

SEQ ID NO: 8145705 - DNA, 22 bp, Homo sapiens
aggtgtccaatcctggttggat

SEQ ID NO: 8145706 - DNA, 20 bp, Homo sapiens
aggtgtccacgtggcagggt

SEQ ID NO: 8145707 - DNA, 22 bp, Homo sapiens
aggtgtccaatcctggttggat

SEQ ID NO: 8145708 - DNA, 20 bp, Homo sapiens
aggtgtccacgtggcagggt

SEQ ID NO: 8145709 - DNA, 22 bp, Homo sapiens
aggtgtccaatcctggttggat

SEQ ID NO: 8145710 - DNA, 22 bp, Homo sapiens
aggtgtcactttatgttcagtg

SEQ ID NO: 8145711 - DNA, 22 bp, Homo sapiens
aggtggtcttgtggatgccgca

SEQ ID NO: 8145712 - DNA, 23 bp, Homo sapiens
aggtggtcttgtggatgctgcaa

SEQ ID NO: 8145713 - DNA, 22 bp, Homo sapiens
aggtggtgatgacagaagacag

SEQ ID NO: 8145714 - DNA, 22 bp, Homo sapiens
aggtggtgatgacagaagacag

SEQ ID NO: 8145715 - DNA, 21 bp, Homo sapiens
aggttccagcagccagagaat

SEQ ID NO: 8145716 - DNA, 20 bp, Homo sapiens
aggttccagccacaaccagc

SEQ ID NO: 8145717 - DNA, 22 bp, Homo sapiens
aggttcttggtgtccagatttc

SEQ ID NO: 8145718 - DNA, 22 bp, Homo sapiens
actcacatttcatcaggccaag

SEQ ID NO: 8145719 - DNA, 22 bp, Homo sapiens
actcagagcctcgagggactgc

SEQ ID NO: 8145720 - DNA, 22 bp, Homo sapiens
actcagagcctcgagggactgc

SEQ ID NO: 8145721 - DNA, 22 bp, Homo sapiens
aggttctgatttgttggggagg

SEQ ID NO: 8145722 - DNA, 22 bp, Homo sapiens
aggttctggcattgctcagtaa

SEQ ID NO: 8145723 - DNA, 18 bp, Homo sapiens
aggttctgacagtccaaa

SEQ ID NO: 8145724 - DNA, 23 bp, Homo sapiens
aggttctcttatcatctctgccc

SEQ ID NO: 8145725 - DNA, 22 bp, Homo sapiens
aggttctcacacgtctacaccc

SEQ ID NO: 8145726 - DNA, 22 bp, Homo sapiens
aggttctcacacgtctacaccc

SEQ ID NO: 8145727 - DNA, 22 bp, Homo sapiens
agtcagtgaaggcattgctcaa

SEQ ID NO: 8145728 - DNA, 22 bp, Homo sapiens
agtcagtgaatggtgtatgcta

SEQ ID NO: 8145729 - DNA, 22 bp, Homo sapiens
agtcagtgacttttgctgagag

SEQ ID NO: 8145730 - DNA, 23 bp, Homo sapiens
agtcagtgcgggatggtcagggg

SEQ ID NO: 8145731 - DNA, 22 bp, Homo sapiens
agtcaggttgcattttaagtaa

SEQ ID NO: 8145732 - DNA, 22 bp, Homo sapiens
agtcaggttgcattttaagtaa

SEQ ID NO: 8145733 - DNA, 22 bp, Homo sapiens
agtcagtcaaaatataaattgt

SEQ ID NO: 8145734 - DNA, 22 bp, Homo sapiens
agtcagtgaaaactagaatgtt

SEQ ID NO: 8145735 - DNA, 22 bp, Homo sapiens
agtcagtgaaaactagaatgtt

SEQ ID NO: 8145736 - DNA, 23 bp, Homo sapiens
agtcagtgtaagtttggaatgca

SEQ ID NO: 8145737 - DNA, 22 bp, Homo sapiens
agtcagtgtagaaagcccaggc

SEQ ID NO: 8145738 - DNA, 23 bp, Homo sapiens
agtcagtgtaagtttggaatgca

SEQ ID NO: 8145739 - DNA, 22 bp, Homo sapiens
agtcagtggctccgagcctggt

SEQ ID NO: 8145740 - DNA, 22 bp, Homo sapiens
agtcagtgggagaagtgtgaag

SEQ ID NO: 8145741 - DNA, 22 bp, Homo sapiens
agtcagtggctccgagcctggt

SEQ ID NO: 8145742 - DNA, 22 bp, Homo sapiens
agtcagtggctccgagcctggt

SEQ ID NO: 8145743 - DNA, 22 bp, Homo sapiens
agtcacttgggaagcaaagcct

SEQ ID NO: 8145744 - DNA, 22 bp, Homo sapiens
agtcacttggattagcaattct

SEQ ID NO: 8145745 - DNA, 22 bp, Homo sapiens
agtcaggtaccacattacattg

SEQ ID NO: 8145746 - DNA, 22 bp, Homo sapiens
agtcaggtaccacattacattg

SEQ ID NO: 8145747 - DNA, 22 bp, Homo sapiens
agtcaggtactccgagggcatg

SEQ ID NO: 8145748 - DNA, 22 bp, Homo sapiens
agtcaggtactccgagggcatg

SEQ ID NO: 8145749 - DNA, 19 bp, Homo sapiens
agtcaggtggctggtgcca

SEQ ID NO: 8145750 - DNA, 22 bp, Homo sapiens
agtcaggtgaatgttatacaca

SEQ ID NO: 8145751 - DNA, 22 bp, Homo sapiens
agtcaggtgaatgttatacaca

SEQ ID NO: 8145752 - DNA, 22 bp, Homo sapiens
agtcaggttctcacagctcttc

SEQ ID NO: 8145753 - DNA, 22 bp, Homo sapiens
agtcaggtggttctgctccact

SEQ ID NO: 8145754 - DNA, 22 bp, Homo sapiens
agtcaggtgggggctgcagtgg

SEQ ID NO: 8145755 - DNA, 22 bp, Homo sapiens
agtcacttctattctattaagt

SEQ ID NO: 8145756 - DNA, 22 bp, Homo sapiens
agtcacttctattctattaagt

SEQ ID NO: 8145757 - DNA, 22 bp, Homo sapiens
agtaataatagctgtaaagtgc

SEQ ID NO: 8145758 - DNA, 22 bp, Homo sapiens
agtaataatagctgtaaagtgc

SEQ ID NO: 8145759 - DNA, 22 bp, Homo sapiens
actcagctcaggagctggctgg

SEQ ID NO: 8145760 - DNA, 22 bp, Homo sapiens
actcagctaaactcagtctatg

SEQ ID NO: 8145761 - DNA, 22 bp, Homo sapiens
actcagctgatgaagcacaagt

SEQ ID NO: 8145762 - DNA, 22 bp, Homo sapiens
actcagctgatgaagcacaagt

SEQ ID NO: 8145763 - DNA, 22 bp, Homo sapiens
actcagctcaggagctggctgg

SEQ ID NO: 8145764 - DNA, 22 bp, Homo sapiens
actcagcatatggggccgcttg

SEQ ID NO: 8145765 - DNA, 20 bp, Homo sapiens
actcagatgctcacaacagg

SEQ ID NO: 8145766 - DNA, 22 bp, Homo sapiens
actcagcacagcactgggaacc

SEQ ID NO: 8145767 - DNA, 22 bp, Homo sapiens
actcagagttcctgtgcatagt

SEQ ID NO: 8145768 - DNA, 22 bp, Homo sapiens
actcagagtctgtttggtacct

SEQ ID NO: 8145769 - DNA, 22 bp, Homo sapiens
actcagagtgcatctcctattt

SEQ ID NO: 8145770 - DNA, 22 bp, Homo sapiens
actcagagttttacccagagac

SEQ ID NO: 8145771 - DNA, 22 bp, Homo sapiens
actcagagtttgcgttccatac

SEQ ID NO: 8145772 - DNA, 22 bp, Homo sapiens
actcagagttcctgtgcatagt

SEQ ID NO: 8145773 - DNA, 22 bp, Homo sapiens
actcagaggaaaccctcctagg

SEQ ID NO: 8145774 - DNA, 22 bp, Homo sapiens
actcagagcttggctccttgct

SEQ ID NO: 8145775 - DNA, 22 bp, Homo sapiens
actcagaggaaagttgagattg

SEQ ID NO: 8145776 - DNA, 22 bp, Homo sapiens
actcagaggaccaaaaggaaag

SEQ ID NO: 8145777 - DNA, 22 bp, Homo sapiens
actcagaggaccaaaaggaaag

SEQ ID NO: 8145778 - DNA, 22 bp, Homo sapiens
actcagaggcagctgctcaccc

SEQ ID NO: 8145779 - DNA, 22 bp, Homo sapiens
actcagaggcagctgctcaccc

SEQ ID NO: 8145780 - DNA, 22 bp, Homo sapiens
actcagaggctggaaatcaaag

SEQ ID NO: 8145781 - DNA, 22 bp, Homo sapiens
actcagaggctggaaatcaaag

SEQ ID NO: 8145782 - DNA, 22 bp, Homo sapiens
actcagagtagaaaataggttc

SEQ ID NO: 8145783 - DNA, 22 bp, Homo sapiens
actcagaggggactggtgtggt

SEQ ID NO: 8145784 - DNA, 22 bp, Homo sapiens
actcagagtcaatgttaatggc

SEQ ID NO: 8145785 - DNA, 22 bp, Homo sapiens
actcagagtctgagataaatct

SEQ ID NO: 8145786 - DNA, 23 bp, Homo sapiens
agtaacatgcaaataacagtctg

SEQ ID NO: 8145787 - DNA, 22 bp, Homo sapiens
actcagcttcctacagctagaa

SEQ ID NO: 8145788 - DNA, 22 bp, Homo sapiens
actcagcttcctacagctagaa

SEQ ID NO: 8145789 - DNA, 22 bp, Homo sapiens
actcagcttcctacagctagaa

SEQ ID NO: 8145790 - DNA, 22 bp, Homo sapiens
agtaacttaagcaattgtgtat

SEQ ID NO: 8145791 - DNA, 20 bp, Homo sapiens
agtaacttagcaactctagg

SEQ ID NO: 8145792 - DNA, 22 bp, Homo sapiens
agtaagattcttctgaaaaatt

SEQ ID NO: 8145793 - DNA, 22 bp, Homo sapiens
agtaacttaagcaattgtgtat

SEQ ID NO: 8145794 - DNA, 22 bp, Homo sapiens
agtaagcaccgggatggtcaag

SEQ ID NO: 8145795 - DNA, 22 bp, Homo sapiens
agtcctgtatctgagctgagtc

SEQ ID NO: 8145796 - DNA, 22 bp, Homo sapiens
agtcctgtctctcccagggcca

SEQ ID NO: 8145797 - DNA, 22 bp, Homo sapiens
agtcctgtctctcccagggcca

SEQ ID NO: 8145798 - DNA, 22 bp, Homo sapiens
agtcctggttctgattctgaca

SEQ ID NO: 8145799 - DNA, 22 bp, Homo sapiens
agtcctggttctgattctgaca

SEQ ID NO: 8145800 - DNA, 22 bp, Homo sapiens
agtcctggtgacactcctcttc

SEQ ID NO: 8145801 - DNA, 22 bp, Homo sapiens
agtcctgggttctggtgttttg

SEQ ID NO: 8145802 - DNA, 22 bp, Homo sapiens
agtcctgggttctggtgttttg

SEQ ID NO: 8145803 - DNA, 22 bp, Homo sapiens
agtcctggtgacactcctcttc

SEQ ID NO: 8145804 - DNA, 22 bp, Homo sapiens
agtcctgggtgtgcaaggcaga

SEQ ID NO: 8145805 - DNA, 22 bp, Homo sapiens
agtcctgtatctgagctgagtc

SEQ ID NO: 8145806 - DNA, 22 bp, Homo sapiens
agtcctgtgaggggtgcagctt

SEQ ID NO: 8145807 - DNA, 22 bp, Homo sapiens
agtcctgtgcaaatgcatctga

SEQ ID NO: 8145808 - DNA, 22 bp, Homo sapiens
agtcctgtgggtgggctggcca

SEQ ID NO: 8145809 - DNA, 22 bp, Homo sapiens
agtcctgtgggtgggctggcca

SEQ ID NO: 8145810 - DNA, 22 bp, Homo sapiens
agtccttcacgtcctgcttatt

SEQ ID NO: 8145811 - DNA, 22 bp, Homo sapiens
agtccttcccatctgacaccct

SEQ ID NO: 8145812 - DNA, 22 bp, Homo sapiens
actctgggccccaggtggagct

SEQ ID NO: 8145813 - DNA, 22 bp, Homo sapiens
actctgggccccaggtggagct

SEQ ID NO: 8145814 - DNA, 22 bp, Homo sapiens
actctgggccccaggtggagct

SEQ ID NO: 8145815 - DNA, 22 bp, Homo sapiens
actctgggccccaggtggagct

SEQ ID NO: 8145816 - DNA, 22 bp, Homo sapiens
actctgggctgttaggagctgt

SEQ ID NO: 8145817 - DNA, 22 bp, Homo sapiens
actctgggctttgatttgttac

SEQ ID NO: 8145818 - DNA, 22 bp, Homo sapiens
actctggggcgctactccaact

SEQ ID NO: 8145819 - DNA, 22 bp, Homo sapiens
actctgggctttgatttgttac

SEQ ID NO: 8145820 - DNA, 22 bp, Homo sapiens
actctggggtgatgtctctgag

SEQ ID NO: 8145821 - DNA, 22 bp, Homo sapiens
actctggggtgatgtctctgag

SEQ ID NO: 8145822 - DNA, 22 bp, Homo sapiens
actctggggtgatgtctctgag

SEQ ID NO: 8145823 - DNA, 22 bp, Homo sapiens
actctggggtgatgtctctgag

SEQ ID NO: 8145824 - DNA, 20 bp, Homo sapiens
actctggggctcattagggg

SEQ ID NO: 8145825 - DNA, 20 bp, Homo sapiens
actctggggctcattagggg

SEQ ID NO: 8145826 - DNA, 22 bp, Homo sapiens
actctgtaattctatatgcagt

SEQ ID NO: 8145827 - DNA, 22 bp, Homo sapiens
agtcctgggtgtgcaaggcaga

SEQ ID NO: 8145828 - DNA, 22 bp, Homo sapiens
actctggtagacaaggagaggt

SEQ ID NO: 8145829 - DNA, 22 bp, Homo sapiens
actctggtctttctgaaagcaa

SEQ ID NO: 8145830 - DNA, 22 bp, Homo sapiens
actctgggtcctgccattcact

SEQ ID NO: 8145831 - DNA, 22 bp, Homo sapiens
actctgggttctttcacttgac

SEQ ID NO: 8145832 - DNA, 22 bp, Homo sapiens
agtccaggcctccctctcctgc

SEQ ID NO: 8145833 - DNA, 22 bp, Homo sapiens
agtccaggcctccctctcctgc

SEQ ID NO: 8145834 - DNA, 22 bp, Homo sapiens
agtccaggcctccctctcctgc

SEQ ID NO: 8145835 - DNA, 22 bp, Homo sapiens
actctgctaaatgtgtaggctc

SEQ ID NO: 8145836 - DNA, 21 bp, Homo sapiens
agtccaggcctgcccacttcc

SEQ ID NO: 8145837 - DNA, 22 bp, Homo sapiens
actctgctcaaagtcctgaggc

SEQ ID NO: 8145838 - DNA, 22 bp, Homo sapiens
actctgctccctaagccatgat

SEQ ID NO: 8145839 - DNA, 22 bp, Homo sapiens
actctgctcaaagtcctgaggc

SEQ ID NO: 8145840 - DNA, 22 bp, Homo sapiens
actctgggcccaccctcagagt

SEQ ID NO: 8145841 - DNA, 22 bp, Homo sapiens
actctgggattgtttctggtat

SEQ ID NO: 8145842 - DNA, 22 bp, Homo sapiens
actctgggatgagaaaagggtt

SEQ ID NO: 8145843 - DNA, 18 bp, Homo sapiens
actctgggacctgttatt

SEQ ID NO: 8145844 - DNA, 22 bp, Homo sapiens
actctgctctgtatttcactgt

SEQ ID NO: 8145845 - DNA, 22 bp, Homo sapiens
actctgggagaggacaaacaaa

SEQ ID NO: 8145846 - DNA, 22 bp, Homo sapiens
actctgggatcttgaaaagagt

SEQ ID NO: 8145847 - DNA, 21 bp, Homo sapiens
agtccaggagtcacccaagcc

SEQ ID NO: 8145848 - DNA, 21 bp, Homo sapiens
agtccaggaggaggccaggtt

SEQ ID NO: 8145849 - DNA, 21 bp, Homo sapiens
agtccaggaggaggccaggtt

SEQ ID NO: 8145850 - DNA, 21 bp, Homo sapiens
agtccaggaggaggccaggtt

SEQ ID NO: 8145851 - DNA, 22 bp, Homo sapiens
agtccaggagttgggtgacatt

SEQ ID NO: 8145852 - DNA, 22 bp, Homo sapiens
agtccaggcattccagccattc

SEQ ID NO: 8145853 - DNA, 22 bp, Homo sapiens
agtccaggcaagttgttgtgta

SEQ ID NO: 8145854 - DNA, 22 bp, Homo sapiens
agtccaggaaaataagctaggt

SEQ ID NO: 8145855 - DNA, 22 bp, Homo sapiens
agtccaggaaaataagctaggt

SEQ ID NO: 8145856 - DNA, 21 bp, Homo sapiens
agtccaggaggaggccaggtt

SEQ ID NO: 8145857 - DNA, 22 bp, Homo sapiens
agtccaggaagcatcatggtct

SEQ ID NO: 8145858 - DNA, 22 bp, Homo sapiens
agtccagccttcaatcttagtg

SEQ ID NO: 8145859 - DNA, 22 bp, Homo sapiens
agtgctttccctgaaaccttcc

SEQ ID NO: 8145860 - DNA, 22 bp, Homo sapiens
agtgctttccctgaaaccttcc

SEQ ID NO: 8145861 - DNA, 22 bp, Homo sapiens
agtgctttccttcttgtgacat

SEQ ID NO: 8145862 - DNA, 22 bp, Homo sapiens
agtgctttccttcttgtgacat

SEQ ID NO: 8145863 - DNA, 22 bp, Homo sapiens
agtgctttagagaaatggtgct

SEQ ID NO: 8145864 - DNA, 22 bp, Homo sapiens
agtgctttagcatccaactgtc

SEQ ID NO: 8145865 - DNA, 22 bp, Homo sapiens
agtgctttatgttgttgtgcaa

SEQ ID NO: 8145866 - DNA, 22 bp, Homo sapiens
agtgctttcagtgtgctctttt

SEQ ID NO: 8145867 - DNA, 22 bp, Homo sapiens
agtgctttatgttgttgtgcaa

SEQ ID NO: 8145868 - DNA, 22 bp, Homo sapiens
agtgctgttaggttaatatagt

SEQ ID NO: 8145869 - DNA, 22 bp, Homo sapiens
agtgctgttaggttaatatagt

SEQ ID NO: 8145870 - DNA, 22 bp, Homo sapiens
agtgctgttggataatgctgtc

SEQ ID NO: 8145871 - DNA, 22 bp, Homo sapiens
agtgctttacctagataatgtt

SEQ ID NO: 8145872 - DNA, 22 bp, Homo sapiens
agtggcagagcaggtgctggaa

SEQ ID NO: 8145873 - DNA, 22 bp, Homo sapiens
agtggcagagcaggtgctggaa

SEQ ID NO: 8145874 - DNA, 22 bp, Homo sapiens
agtggcagagcaggtgctggaa

SEQ ID NO: 8145875 - DNA, 22 bp, Homo sapiens
agtggcagagcaggtgctggaa

SEQ ID NO: 8145876 - DNA, 22 bp, Homo sapiens
agtggcagagcaggtgctggaa

SEQ ID NO: 8145877 - DNA, 22 bp, Homo sapiens
agtggcagacacaatgtgggca

SEQ ID NO: 8145878 - DNA, 22 bp, Homo sapiens
agtggcagagaccccagccagc

SEQ ID NO: 8145879 - DNA, 22 bp, Homo sapiens
agtggcagacacaatgtgggca

SEQ ID NO: 8145880 - DNA, 22 bp, Homo sapiens
agtggcagaagtcactgggtag

SEQ ID NO: 8145881 - DNA, 22 bp, Homo sapiens
agtgctttggtatagaactatt

SEQ ID NO: 8145882 - DNA, 22 bp, Homo sapiens
agtgctttggtatagaactatt

SEQ ID NO: 8145883 - DNA, 22 bp, Homo sapiens
agtgctttgagcgtttgaaaag

SEQ ID NO: 8145884 - DNA, 22 bp, Homo sapiens
agtgctttgagcgtttgaaaag

SEQ ID NO: 8145885 - DNA, 22 bp, Homo sapiens
agtgctttcttgctccatcagt

SEQ ID NO: 8145886 - DNA, 22 bp, Homo sapiens
agtgctttgaacgaaaggctga

SEQ ID NO: 8145887 - DNA, 22 bp, Homo sapiens
agtgggaggcggctgacgggcg

SEQ ID NO: 8145888 - DNA, 22 bp, Homo sapiens
agtgggagggccatatggtgaa

SEQ ID NO: 8145889 - DNA, 22 bp, Homo sapiens
agtgggagataacttaacagct

SEQ ID NO: 8145890 - DNA, 22 bp, Homo sapiens
agtgggagccagcagcttgggg

SEQ ID NO: 8145891 - DNA, 22 bp, Homo sapiens
agtgggagcggcagtcggggac

SEQ ID NO: 8145892 - DNA, 22 bp, Homo sapiens
agtgggaggaagtggtgatatt

SEQ ID NO: 8145893 - DNA, 22 bp, Homo sapiens
agtggcagagccaagtagagcc

SEQ ID NO: 8145894 - DNA, 22 bp, Homo sapiens
agtggcagagccaagatatgat

SEQ ID NO: 8145895 - DNA, 22 bp, Homo sapiens
agtggcagagccaagatatgat

SEQ ID NO: 8145896 - DNA, 22 bp, Homo sapiens
agtggcagagccaagatatgat

SEQ ID NO: 8145897 - DNA, 22 bp, Homo sapiens
agtggctggaattgcaggtgcg

SEQ ID NO: 8145898 - DNA, 22 bp, Homo sapiens
agtggctggaattgcaggtgcg

SEQ ID NO: 8145899 - DNA, 22 bp, Homo sapiens
agtggctggaattgcaggtgcg

SEQ ID NO: 8145900 - DNA, 22 bp, Homo sapiens
agtggctggaattgcaggtgcg

SEQ ID NO: 8145901 - DNA, 22 bp, Homo sapiens
agtggctggaattgcaggtgcg

SEQ ID NO: 8145902 - DNA, 22 bp, Homo sapiens
agtggctggaattgcaggtgcg

SEQ ID NO: 8145903 - DNA, 22 bp, Homo sapiens
agtggcagagccaagtagagcc

SEQ ID NO: 8145904 - DNA, 20 bp, Homo sapiens
agtgggagagggcagactgc

SEQ ID NO: 8145905 - DNA, 20 bp, Homo sapiens
agtgggagagggcagactgc

SEQ ID NO: 8145906 - DNA, 20 bp, Homo sapiens
agtgggagagggcagactgc

SEQ ID NO: 8145907 - DNA, 20 bp, Homo sapiens
agtgggagagggcagactgc

SEQ ID NO: 8145908 - DNA, 20 bp, Homo sapiens
agtgggagagggcagactgc

SEQ ID NO: 8145909 - DNA, 23 bp, Homo sapiens
agtgagcagctgtagggcaagga

SEQ ID NO: 8145910 - DNA, 23 bp, Homo sapiens
agtgagcagctgtagggcaagga

SEQ ID NO: 8145911 - DNA, 23 bp, Homo sapiens
agtgagcagctgtagggcaagga

SEQ ID NO: 8145912 - DNA, 22 bp, Homo sapiens
agtgagcaacagaagcgtgggt

SEQ ID NO: 8145913 - DNA, 22 bp, Homo sapiens
agtgagatgaaaatatctgtga

SEQ ID NO: 8145914 - DNA, 22 bp, Homo sapiens
agtgagcattcgtttggaaccc

SEQ ID NO: 8145915 - DNA, 19 bp, Homo sapiens
agtgagcatccagagaggt

SEQ ID NO: 8145916 - DNA, 22 bp, Homo sapiens
agtgaggcaaagtgagaggcag

SEQ ID NO: 8145917 - DNA, 20 bp, Homo sapiens
agtgaggcagttcagtgggc

SEQ ID NO: 8145918 - DNA, 22 bp, Homo sapiens
agtgaggctaataggcaatggt

SEQ ID NO: 8145919 - DNA, 22 bp, Homo sapiens
agtgaatgtccccgcgggtcag

SEQ ID NO: 8145920 - DNA, 22 bp, Homo sapiens
agtcctttgggaaaaatgacta

SEQ ID NO: 8145921 - DNA, 18 bp, Homo sapiens
agtccttcttggttttac

SEQ ID NO: 8145922 - DNA, 22 bp, Homo sapiens
agtccttcttttagttgcttgg

SEQ ID NO: 8145923 - DNA, 21 bp, Homo sapiens
agtccttgaaactctttcttg

SEQ ID NO: 8145924 - DNA, 22 bp, Homo sapiens
agtgagatatgtctcactgtcc

SEQ ID NO: 8145925 - DNA, 22 bp, Homo sapiens
agtgagatgtgtaatcaggggt

SEQ ID NO: 8145926 - DNA, 22 bp, Homo sapiens
agtgagatattagctaatgtgt

SEQ ID NO: 8145927 - DNA, 22 bp, Homo sapiens
agtgagatattagctaatgtgt

SEQ ID NO: 8145928 - DNA, 22 bp, Homo sapiens
agtgagagtattaatgtgaact

SEQ ID NO: 8145929 - DNA, 23 bp, Homo sapiens
agtgaattcagtttaaaacagag

SEQ ID NO: 8145930 - DNA, 17 bp, Homo sapiens
agtgagaatgtcatgta

SEQ ID NO: 8145931 - DNA, 17 bp, Homo sapiens
agtgagaatgtcatgta

SEQ ID NO: 8145932 - DNA, 22 bp, Homo sapiens
agtgattttaacttccagcaat

SEQ ID NO: 8145933 - DNA, 20 bp, Homo sapiens
agtgatttgttagtacattg

SEQ ID NO: 8145934 - DNA, 22 bp, Homo sapiens
agtgattttaacttccagcaat

SEQ ID NO: 8145935 - DNA, 22 bp, Homo sapiens
agtgattttaacttccagcaat

SEQ ID NO: 8145936 - DNA, 20 bp, Homo sapiens
agtgatttgttagtacattg

SEQ ID NO: 8145937 - DNA, 22 bp, Homo sapiens
agtgatttggttcatacttcca

SEQ ID NO: 8145938 - DNA, 22 bp, Homo sapiens
agtgatttggtgggagcgcgta

SEQ ID NO: 8145939 - DNA, 22 bp, Homo sapiens
agtgatttggttcatacttcca

SEQ ID NO: 8145940 - DNA, 22 bp, Homo sapiens
agtgatttggcggcagagttag

SEQ ID NO: 8145941 - DNA, 22 bp, Homo sapiens
agtgatttgggagagccagctg

SEQ ID NO: 8145942 - DNA, 22 bp, Homo sapiens
agtgatttggggatgggaaagg

SEQ ID NO: 8145943 - DNA, 22 bp, Homo sapiens
agtgatttgggtgtcagaaagt

SEQ ID NO: 8145944 - DNA, 22 bp, Homo sapiens
agtgatttggcggcagagttag

SEQ ID NO: 8145945 - DNA, 22 bp, Homo sapiens
agtgcaaaattcagaagcaatt

SEQ ID NO: 8145946 - DNA, 22 bp, Homo sapiens
agtgcaaaaaagtgttgtgaca

SEQ ID NO: 8145947 - DNA, 22 bp, Homo sapiens
agtgatttttgaagccagccat

SEQ ID NO: 8145948 - DNA, 22 bp, Homo sapiens
agtgattttgtcagcttctgca

SEQ ID NO: 8145949 - DNA, 22 bp, Homo sapiens
agtgattttgtcagcttctgca

SEQ ID NO: 8145950 - DNA, 22 bp, Homo sapiens
agtgattttgtagctatgagat

SEQ ID NO: 8145951 - DNA, 22 bp, Homo sapiens
agtgattttgtagctatgagat

SEQ ID NO: 8145952 - DNA, 22 bp, Homo sapiens
agtgattttgtagctatgagat

SEQ ID NO: 8145953 - DNA, 22 bp, Homo sapiens
agtgattttgctttgaagtgac

SEQ ID NO: 8145954 - DNA, 22 bp, Homo sapiens
agtgattttggccgtgccatta

SEQ ID NO: 8145955 - DNA, 15 bp, Homo sapiens
agtgattttggactc

SEQ ID NO: 8145956 - DNA, 22 bp, Homo sapiens
agtgattttggccgtgccatta

SEQ ID NO: 8145957 - DNA, 22 bp, Homo sapiens
agtgattttggcctggcctttt

SEQ ID NO: 8145958 - DNA, 22 bp, Homo sapiens
agtgattttggcctggcctttt

SEQ ID NO: 8145959 - DNA, 22 bp, Homo sapiens
agtgattttctccagctggcag

SEQ ID NO: 8145960 - DNA, 22 bp, Homo sapiens
agtgattttatcaatttactca

SEQ ID NO: 8145961 - DNA, 22 bp, Homo sapiens
agtgattttcaagtggagcaca

SEQ ID NO: 8145962 - DNA, 22 bp, Homo sapiens
agtgattttgctttgaagtgac

SEQ ID NO: 8145963 - DNA, 22 bp, Homo sapiens
agtgattttgctttgaagtgac

SEQ ID NO: 8145964 - DNA, 22 bp, Homo sapiens
agtgattttctccagctggcag

SEQ ID NO: 8145965 - DNA, 20 bp, Homo sapiens
agtgattttgatatggtctt

SEQ ID NO: 8145966 - DNA, 20 bp, Homo sapiens
agtgcaagaaagcacagctg

SEQ ID NO: 8145967 - DNA, 22 bp, Homo sapiens
agtgcaaagccgaggtttcttg

SEQ ID NO: 8145968 - DNA, 22 bp, Homo sapiens
agtgcaaagggatcagattggg

SEQ ID NO: 8145969 - DNA, 23 bp, Homo sapiens
agtgctgaattgaaagctccagg

SEQ ID NO: 8145970 - DNA, 23 bp, Homo sapiens
agtgctgaattgaaagctccagg

SEQ ID NO: 8145971 - DNA, 22 bp, Homo sapiens
agtgctgaagactggctaggga

SEQ ID NO: 8145972 - DNA, 22 bp, Homo sapiens
agtgcaagctccataatcttca

SEQ ID NO: 8145973 - DNA, 22 bp, Homo sapiens
agtgctgtctccttcccccggg

SEQ ID NO: 8145974 - DNA, 20 bp, Homo sapiens
agtgctgtggctgaataaga

SEQ ID NO: 8145975 - DNA, 22 bp, Homo sapiens
agtgctgtctccttcccccggg

SEQ ID NO: 8145976 - DNA, 22 bp, Homo sapiens
agtgctgtccagtttcacaggt

SEQ ID NO: 8145977 - DNA, 22 bp, Homo sapiens
agtgctgtcccgacaactgagg

SEQ ID NO: 8145978 - DNA, 22 bp, Homo sapiens
agttaccatatatcaaacatgg

SEQ ID NO: 8145979 - DNA, 22 bp, Homo sapiens
agttattttggaaaatgagtca

SEQ ID NO: 8145980 - DNA, 22 bp, Homo sapiens
agttcaaactctataagaactt

SEQ ID NO: 8145981 - DNA, 22 bp, Homo sapiens
agttacaactgtttgaatgtca

SEQ ID NO: 8145982 - DNA, 22 bp, Homo sapiens
agttacaactgtttgaatgtca

SEQ ID NO: 8145983 - DNA, 22 bp, Homo sapiens
agttacaagctattttacttaa

SEQ ID NO: 8145984 - DNA, 22 bp, Homo sapiens
agttacaaccatgacacaagca

SEQ ID NO: 8145985 - DNA, 22 bp, Homo sapiens
agttacaaccatgacacaagca

SEQ ID NO: 8145986 - DNA, 22 bp, Homo sapiens
agttacaagtacaggctttgga

SEQ ID NO: 8145987 - DNA, 21 bp, Homo sapiens
agttacaagtttattcagagg

SEQ ID NO: 8145988 - DNA, 22 bp, Homo sapiens
agttacacaacttatcacatct

SEQ ID NO: 8145989 - DNA, 22 bp, Homo sapiens
agttacagtaagccagccagca

SEQ ID NO: 8145990 - DNA, 22 bp, Homo sapiens
agttacagcactcaaagttttc

SEQ ID NO: 8145991 - DNA, 22 bp, Homo sapiens
agttacagaatgtacagaggtt

SEQ ID NO: 8145992 - DNA, 22 bp, Homo sapiens
actggggcaggaaagtatgctg

SEQ ID NO: 8145993 - DNA, 22 bp, Homo sapiens
actggggcagtgggcagtggtt

SEQ ID NO: 8145994 - DNA, 22 bp, Homo sapiens
actggggcagtgggcagtggtt

SEQ ID NO: 8145995 - DNA, 22 bp, Homo sapiens
actggggattagggactcagtg

SEQ ID NO: 8145996 - DNA, 22 bp, Homo sapiens
actggggcaggaaagtatgctg

SEQ ID NO: 8145997 - DNA, 22 bp, Homo sapiens
actggggattagggactcagtg

SEQ ID NO: 8145998 - DNA, 22 bp, Homo sapiens
actggggcctcctccatgctct

SEQ ID NO: 8145999 - DNA, 22 bp, Homo sapiens
actggggctgatgcgttcgtgt

SEQ ID NO: 8146000 - DNA, 22 bp, Homo sapiens
actggggtgaaattggagtgtc

SEQ ID NO: 8146001 - DNA, 22 bp, Homo sapiens
actggggcctcctccatgctct

SEQ ID NO: 8146002 - DNA, 22 bp, Homo sapiens
actggggcctcctccatgctct

SEQ ID NO: 8146003 - DNA, 22 bp, Homo sapiens
actgggtgtaaaggacttaagc

SEQ ID NO: 8146004 - DNA, 22 bp, Homo sapiens
actgggtgtattagtggtgttt

SEQ ID NO: 8146005 - DNA, 22 bp, Homo sapiens
actgggtggctgcctccttctc

SEQ ID NO: 8146006 - DNA, 22 bp, Homo sapiens
actggggtttaggcctgggcaa

SEQ ID NO: 8146007 - DNA, 22 bp, Homo sapiens
actggggtgaaattggagtgtc

SEQ ID NO: 8146008 - DNA, 22 bp, Homo sapiens
actggggtttaggcctgggcaa

SEQ ID NO: 8146009 - DNA, 22 bp, Homo sapiens
actggtttcccggaactacagt

SEQ ID NO: 8146010 - DNA, 22 bp, Homo sapiens
actggtttcctagaataagact

SEQ ID NO: 8146011 - DNA, 22 bp, Homo sapiens
actggttgaagaaaagctagta

SEQ ID NO: 8146012 - DNA, 22 bp, Homo sapiens
actggtcagattttacttccca

SEQ ID NO: 8146013 - DNA, 22 bp, Homo sapiens
agttacaaccatgacacaagca

SEQ ID NO: 8146014 - DNA, 22 bp, Homo sapiens
agttacaaccatgacacaagca

SEQ ID NO: 8146015 - DNA, 22 bp, Homo sapiens
agttacaaacactatcagttct

SEQ ID NO: 8146016 - DNA, 22 bp, Homo sapiens
agttacaaacactatcagttct

SEQ ID NO: 8146017 - DNA, 22 bp, Homo sapiens
agtgtgtgaccttttaatttaa

SEQ ID NO: 8146018 - DNA, 22 bp, Homo sapiens
actgggctcccaggcttgtcat

SEQ ID NO: 8146019 - DNA, 23 bp, Homo sapiens
actgggctgaaattaaaggtgtc

SEQ ID NO: 8146020 - DNA, 23 bp, Homo sapiens
actgggctgaaattaaaggtgtc

SEQ ID NO: 8146021 - DNA, 23 bp, Homo sapiens
actgggctgaaatttttcatggc

SEQ ID NO: 8146022 - DNA, 22 bp, Homo sapiens
agtgtgtcttatcctgggagaa

SEQ ID NO: 8146023 - DNA, 17 bp, Homo sapiens
agtgtgtgaaatggtgg

SEQ ID NO: 8146024 - DNA, 22 bp, Homo sapiens
agtgtgtcgagggagggtccag

SEQ ID NO: 8146025 - DNA, 22 bp, Homo sapiens
agtgtgtccaggaagcagatgg

SEQ ID NO: 8146026 - DNA, 22 bp, Homo sapiens
agtgtgtactcatatacttcca

SEQ ID NO: 8146027 - DNA, 20 bp, Homo sapiens
agtgtggttttcaggaatat

SEQ ID NO: 8146028 - DNA, 22 bp, Homo sapiens
agtgtgggtgagggaggccctc

SEQ ID NO: 8146029 - DNA, 22 bp, Homo sapiens
agtgtgggttttatggagccct

SEQ ID NO: 8146030 - DNA, 22 bp, Homo sapiens
agtgtgggtgagggaggccctc

SEQ ID NO: 8146031 - DNA, 22 bp, Homo sapiens
agtgtggggtcaccggcccagg

SEQ ID NO: 8146032 - DNA, 22 bp, Homo sapiens
agtgtctttagcaagtttagtc

SEQ ID NO: 8146033 - DNA, 22 bp, Homo sapiens
agtgtcttcatgatgtggcagc

SEQ ID NO: 8146034 - DNA, 22 bp, Homo sapiens
agtgtctttcatatcctccatc

SEQ ID NO: 8146035 - DNA, 22 bp, Homo sapiens
agtgtctgttgcttttgcagtg

SEQ ID NO: 8146036 - DNA, 22 bp, Homo sapiens
agtgtctgaaccaccggggcat

SEQ ID NO: 8146037 - DNA, 22 bp, Homo sapiens
agtgtctgaacctgcagtggga

SEQ ID NO: 8146038 - DNA, 22 bp, Homo sapiens
agtgtctgaacctgcagtggga

SEQ ID NO: 8146039 - DNA, 20 bp, Homo sapiens
agtgtctggtgcagggcctc

SEQ ID NO: 8146040 - DNA, 20 bp, Homo sapiens
agtgtctggtgcagggcctc

SEQ ID NO: 8146041 - DNA, 22 bp, Homo sapiens
agtgtctgttacgcttgcagaa

SEQ ID NO: 8146042 - DNA, 22 bp, Homo sapiens
agtgtctgtgttttctattgct

SEQ ID NO: 8146043 - DNA, 22 bp, Homo sapiens
agtgtctgtgttttctattgct

SEQ ID NO: 8146044 - DNA, 22 bp, Homo sapiens
agtgtctgtgatgaggtcagga

SEQ ID NO: 8146045 - DNA, 22 bp, Homo sapiens
agtgtctgtgatgaggtcagga

SEQ ID NO: 8146046 - DNA, 22 bp, Homo sapiens
agtgggggctggctctgtctgt

SEQ ID NO: 8146047 - DNA, 22 bp, Homo sapiens
agtgggggctggctctgtctgt

SEQ ID NO: 8146048 - DNA, 22 bp, Homo sapiens
agtggggtctcctccagccccc

SEQ ID NO: 8146049 - DNA, 22 bp, Homo sapiens
agtggggtcctcagtatggttc

SEQ ID NO: 8146050 - DNA, 22 bp, Homo sapiens
agtggggtcctcagtatggttc

SEQ ID NO: 8146051 - DNA, 22 bp, Homo sapiens
agtgggggccaacgagggcagc

SEQ ID NO: 8146052 - DNA, 22 bp, Homo sapiens
agtgggggccaacgagggcagc

SEQ ID NO: 8146053 - DNA, 22 bp, Homo sapiens
agtgggggccaacgagggcagc

SEQ ID NO: 8146054 - DNA, 22 bp, Homo sapiens
agtgggggcagagcctctctcg

SEQ ID NO: 8146055 - DNA, 22 bp, Homo sapiens
agtggggcggacaggaccagga

SEQ ID NO: 8146056 - DNA, 22 bp, Homo sapiens
agtggggccggtgaggccgagg

SEQ ID NO: 8146057 - DNA, 22 bp, Homo sapiens
agctctgggattctcaggccac

SEQ ID NO: 8146058 - DNA, 22 bp, Homo sapiens
agctctgggattctcaggccac

SEQ ID NO: 8146059 - DNA, 22 bp, Homo sapiens
agctctgggagtagttccacct

SEQ ID NO: 8146060 - DNA, 20 bp, Homo sapiens
agctgaagatctggatgggg

SEQ ID NO: 8146061 - DNA, 20 bp, Homo sapiens
agctgaagatctggatgggg

SEQ ID NO: 8146062 - DNA, 22 bp, Homo sapiens
agctgagccagcagcaacagga

SEQ ID NO: 8146063 - DNA, 22 bp, Homo sapiens
agctctggcactggcgcgggat

SEQ ID NO: 8146064 - DNA, 22 bp, Homo sapiens
agctctggcactggcgcgggat

SEQ ID NO: 8146065 - DNA, 22 bp, Homo sapiens
agctctggcactggcgcgggat

SEQ ID NO: 8146066 - DNA, 22 bp, Homo sapiens
agctctggcactggcgcgggat

SEQ ID NO: 8146067 - DNA, 19 bp, Homo sapiens
agctctggattaaatttct

SEQ ID NO: 8146068 - DNA, 22 bp, Homo sapiens
agctctggcactggcgcgggat

SEQ ID NO: 8146069 - DNA, 22 bp, Homo sapiens
agctctggcactggcgcgggat

SEQ ID NO: 8146070 - DNA, 23 bp, Homo sapiens
agctctggcgttggggaggtagt

SEQ ID NO: 8146071 - DNA, 22 bp, Homo sapiens
agctctgggagtagttccacct

SEQ ID NO: 8146072 - DNA, 23 bp, Homo sapiens
agctctggcgttggggaggtagt

SEQ ID NO: 8146073 - DNA, 23 bp, Homo sapiens
agctctggcgttggggaggtagt

SEQ ID NO: 8146074 - DNA, 23 bp, Homo sapiens
agctctggcgttggggaggtagt

SEQ ID NO: 8146075 - DNA, 17 bp, Homo sapiens
agctgagctggccaggg

SEQ ID NO: 8146076 - DNA, 17 bp, Homo sapiens
agctgagctggccaggg

SEQ ID NO: 8146077 - DNA, 17 bp, Homo sapiens
agctgagctggccaggg

SEQ ID NO: 8146078 - DNA, 22 bp, Homo sapiens
agctgagctgcagatgactgta

SEQ ID NO: 8146079 - DNA, 17 bp, Homo sapiens
agctgagctggccaggg

SEQ ID NO: 8146080 - DNA, 22 bp, Homo sapiens
agctgagctgcagatgactgta

SEQ ID NO: 8146081 - DNA, 22 bp, Homo sapiens
agctgagctagtagttccagtg

SEQ ID NO: 8146082 - DNA, 21 bp, Homo sapiens
agctgagcccagaagactggt

SEQ ID NO: 8146083 - DNA, 21 bp, Homo sapiens
agctgagcccagaagactggt

SEQ ID NO: 8146084 - DNA, 22 bp, Homo sapiens
agctgagctagtagttccagtg

SEQ ID NO: 8146085 - DNA, 22 bp, Homo sapiens
agctgagctcaggctgatgtaa

SEQ ID NO: 8146086 - DNA, 22 bp, Homo sapiens
agctgaggacgtgaagggcggc

SEQ ID NO: 8146087 - DNA, 22 bp, Homo sapiens
agctgaggacgtgaagggcggc

SEQ ID NO: 8146088 - DNA, 22 bp, Homo sapiens
agctgaggaataataacaaggt

SEQ ID NO: 8146089 - DNA, 17 bp, Homo sapiens
agctgagctggccaggg

SEQ ID NO: 8146090 - DNA, 22 bp, Homo sapiens
agctgaggaggaatgatgggta

SEQ ID NO: 8146091 - DNA, 22 bp, Homo sapiens
agctgaggaggaatgatgggta

SEQ ID NO: 8146092 - DNA, 22 bp, Homo sapiens
agctgaggaggaatgatgggta

SEQ ID NO: 8146093 - DNA, 22 bp, Homo sapiens
cagctggcatacctgggcccgg

SEQ ID NO: 8146094 - DNA, 22 bp, Homo sapiens
cagctgggtggctcttctgctc

SEQ ID NO: 8146095 - DNA, 22 bp, Homo sapiens
cagctgggtggctcttctgctc

SEQ ID NO: 8146096 - DNA, 22 bp, Homo sapiens
cagctggcagccctggccctgc

SEQ ID NO: 8146097 - DNA, 22 bp, Homo sapiens
cagctggcatacctgggcccgg

SEQ ID NO: 8146098 - DNA, 22 bp, Homo sapiens
cagctggcatacctgggcccgg

SEQ ID NO: 8146099 - DNA, 22 bp, Homo sapiens
cagctggcagccctggccctgc

SEQ ID NO: 8146100 - DNA, 22 bp, Homo sapiens
cagctggcaagtggagcagggt

SEQ ID NO: 8146101 - DNA, 22 bp, Homo sapiens
cagctggcaagtggagcagggt

SEQ ID NO: 8146102 - DNA, 22 bp, Homo sapiens
cagctggcaagtggagcagggt

SEQ ID NO: 8146103 - DNA, 22 bp, Homo sapiens
cagctggcaagtggagcagggt

SEQ ID NO: 8146104 - DNA, 22 bp, Homo sapiens
cagctggcagaacctgcatcca

SEQ ID NO: 8146105 - DNA, 22 bp, Homo sapiens
cagctggcagaacctgcatcca

SEQ ID NO: 8146106 - DNA, 22 bp, Homo sapiens
cagctggatgggagaccatgtt

SEQ ID NO: 8146107 - DNA, 22 bp, Homo sapiens
cagctggcaagtggagcagggt

SEQ ID NO: 8146108 - DNA, 22 bp, Homo sapiens
cagctggatgggagaccatgtt

SEQ ID NO: 8146109 - DNA, 20 bp, Homo sapiens
agctgaggcacctgaggtta

SEQ ID NO: 8146110 - DNA, 20 bp, Homo sapiens
agctgaggcacctgaggtta

SEQ ID NO: 8146111 - DNA, 20 bp, Homo sapiens
agctgaggcacctgaggtta

SEQ ID NO: 8146112 - DNA, 22 bp, Homo sapiens
cagctgctttcagcaggaggga

SEQ ID NO: 8146113 - DNA, 22 bp, Homo sapiens
cagctgctttagttttccatcc

SEQ ID NO: 8146114 - DNA, 22 bp, Homo sapiens
cagctgctttcagcaggaggga

SEQ ID NO: 8146115 - DNA, 22 bp, Homo sapiens
cagctgctttcagcaggaggga

SEQ ID NO: 8146116 - DNA, 22 bp, Homo sapiens
cagctgctttcagcaggaggga

SEQ ID NO: 8146117 - DNA, 19 bp, Homo sapiens
cagctggaatcatctgagg

SEQ ID NO: 8146118 - DNA, 22 bp, Homo sapiens
cagctggacttttgatagaagt

SEQ ID NO: 8146119 - DNA, 22 bp, Homo sapiens
cagctggatccctgcagaactt

SEQ ID NO: 8146120 - DNA, 22 bp, Homo sapiens
cagcggccggtgaggaagggga

SEQ ID NO: 8146121 - DNA, 22 bp, Homo sapiens
cagctgagagtagaaatggagg

SEQ ID NO: 8146122 - DNA, 22 bp, Homo sapiens
cagcgtctcgttgtgggcctcg

SEQ ID NO: 8146123 - DNA, 22 bp, Homo sapiens
cagcgctgtgggaacagggcta

SEQ ID NO: 8146124 - DNA, 22 bp, Homo sapiens
cagcggaggacagatgggagct

SEQ ID NO: 8146125 - DNA, 22 bp, Homo sapiens
cagccttttcttaaaatgcaag

SEQ ID NO: 8146126 - DNA, 22 bp, Homo sapiens
cagcgcaggcgtgtgaaggcgc

SEQ ID NO: 8146127 - DNA, 22 bp, Homo sapiens
cagcgctggggtaggagcacct

SEQ ID NO: 8146128 - DNA, 22 bp, Homo sapiens
cagcgcctcctggacctcctct

SEQ ID NO: 8146129 - DNA, 22 bp, Homo sapiens
cagcgcctcctggacctcctct

SEQ ID NO: 8146130 - DNA, 22 bp, Homo sapiens
cagcgcagtgtaggtggggggc

SEQ ID NO: 8146131 - DNA, 22 bp, Homo sapiens
cagcctttgggtcagaagattc

SEQ ID NO: 8146132 - DNA, 22 bp, Homo sapiens
cagcctttgaacttcagaggtt

SEQ ID NO: 8146133 - DNA, 22 bp, Homo sapiens
cagccttttccatgtattgttg

SEQ ID NO: 8146134 - DNA, 22 bp, Homo sapiens
cagcctctgtggctgccacacc

SEQ ID NO: 8146135 - DNA, 22 bp, Homo sapiens
cagccttcgacagttggagtag

SEQ ID NO: 8146136 - DNA, 22 bp, Homo sapiens
cagcctttctgtttcctaaggt

SEQ ID NO: 8146137 - DNA, 22 bp, Homo sapiens
cagcctttatggaaaggcctgg

SEQ ID NO: 8146138 - DNA, 22 bp, Homo sapiens
cagcctctctgtatctcaggat

SEQ ID NO: 8146139 - DNA, 22 bp, Homo sapiens
cagcctctgacaccacagtcgt

SEQ ID NO: 8146140 - DNA, 22 bp, Homo sapiens
cagcctctgacaccacagtcgt

SEQ ID NO: 8146141 - DNA, 22 bp, Homo sapiens
cagcctctgacaccacagtcgt

SEQ ID NO: 8146142 - DNA, 22 bp, Homo sapiens
cagcctctgagccttggcagat

SEQ ID NO: 8146143 - DNA, 22 bp, Homo sapiens
cagcctctgtggctgccacacc

SEQ ID NO: 8146144 - DNA, 22 bp, Homo sapiens
agctctggaagccctggtagtt

SEQ ID NO: 8146145 - DNA, 22 bp, Homo sapiens
agctctggaagccctggtagtt

SEQ ID NO: 8146146 - DNA, 22 bp, Homo sapiens
cagctgcccctccagggctggg

SEQ ID NO: 8146147 - DNA, 22 bp, Homo sapiens
cagctgccccgctggctgacca

SEQ ID NO: 8146148 - DNA, 22 bp, Homo sapiens
cagctgccccgctggctgacca

SEQ ID NO: 8146149 - DNA, 22 bp, Homo sapiens
cagctgccccataaatcacagt

SEQ ID NO: 8146150 - DNA, 22 bp, Homo sapiens
cagctgccccgctggctgacca

SEQ ID NO: 8146151 - DNA, 22 bp, Homo sapiens
cagctgccccgctggctgacca

SEQ ID NO: 8146152 - DNA, 22 bp, Homo sapiens
cagctgcccaggccacctggag

SEQ ID NO: 8146153 - DNA, 22 bp, Homo sapiens
cagctgcccatcctgggaaatg

SEQ ID NO: 8146154 - DNA, 22 bp, Homo sapiens
cagctgccccgctggctgacca

SEQ ID NO: 8146155 - DNA, 22 bp, Homo sapiens
cagctgccccataaatcacagt

SEQ ID NO: 8146156 - DNA, 21 bp, Homo sapiens
agctctggagcagcaatcaag

SEQ ID NO: 8146157 - DNA, 22 bp, Homo sapiens
agctctggagccggaggatttc

SEQ ID NO: 8146158 - DNA, 22 bp, Homo sapiens
agctctggagccggaggatttc

SEQ ID NO: 8146159 - DNA, 22 bp, Homo sapiens
agctctggagccggaggatttc

SEQ ID NO: 8146160 - DNA, 22 bp, Homo sapiens
agctctggagccggaggatttc

SEQ ID NO: 8146161 - DNA, 22 bp, Homo sapiens
agctctggagccggaggatttc

SEQ ID NO: 8146162 - DNA, 22 bp, Homo sapiens
agctctggacctgacatctggt

SEQ ID NO: 8146163 - DNA, 21 bp, Homo sapiens
agctctggagcagcaatcaag

SEQ ID NO: 8146164 - DNA, 22 bp, Homo sapiens
agctctggacctgacatctggt

SEQ ID NO: 8146165 - DNA, 22 bp, Homo sapiens
agctctggaataatgatgtgat

SEQ ID NO: 8146166 - DNA, 18 bp, Homo sapiens
cagctgccagctcatgga

SEQ ID NO: 8146167 - DNA, 22 bp, Homo sapiens
cagctgccacttgctctcggct

SEQ ID NO: 8146168 - DNA, 18 bp, Homo sapiens
cagctgccagctcatgga

SEQ ID NO: 8146169 - DNA, 22 bp, Homo sapiens
cagctgagcatcactagtctgg

SEQ ID NO: 8146170 - DNA, 22 bp, Homo sapiens
cagctgccagcttctctccatc

SEQ ID NO: 8146171 - DNA, 18 bp, Homo sapiens
cagctgccagctcatgga

SEQ ID NO: 8146172 - DNA, 18 bp, Homo sapiens
cagctgccagctcatgga

SEQ ID NO: 8146173 - DNA, 22 bp, Homo sapiens
cagctgccagcttctctccatc

SEQ ID NO: 8146174 - DNA, 22 bp, Homo sapiens
cagctgccagcttctctccatc

SEQ ID NO: 8146175 - DNA, 18 bp, Homo sapiens
cagctgccagctcatgga

SEQ ID NO: 8146176 - DNA, 18 bp, Homo sapiens
cagctgccagctcatgga

SEQ ID NO: 8146177 - DNA, 18 bp, Homo sapiens
cagctgccagctcatgga

SEQ ID NO: 8146178 - DNA, 18 bp, Homo sapiens
cagctgccagctcatgga

SEQ ID NO: 8146179 - DNA, 22 bp, Homo sapiens
cagctgccatgacatgtcctgc

SEQ ID NO: 8146180 - DNA, 22 bp, Homo sapiens
cagctgccatgacatgtcctgc

SEQ ID NO: 8146181 - DNA, 22 bp, Homo sapiens
cagctgccatgacatgtcctgc

SEQ ID NO: 8146182 - DNA, 22 bp, Homo sapiens
cagctgccatgacatgtcctgc

SEQ ID NO: 8146183 - DNA, 22 bp, Homo sapiens
cagctgccagcttctctccatc

SEQ ID NO: 8146184 - DNA, 22 bp, Homo sapiens
cagctgccagcttctctccatc

SEQ ID NO: 8146185 - DNA, 22 bp, Homo sapiens
cagctgcccaagccccagatgt

SEQ ID NO: 8146186 - DNA, 22 bp, Homo sapiens
cagctgcccaggccacctggag

SEQ ID NO: 8146187 - DNA, 22 bp, Homo sapiens
cagctgcccaagccccagatgt

SEQ ID NO: 8146188 - DNA, 22 bp, Homo sapiens
cagctgcccaggccacctggag

SEQ ID NO: 8146189 - DNA, 22 bp, Homo sapiens
cagctgcccaggccacctggag

SEQ ID NO: 8146190 - DNA, 22 bp, Homo sapiens
cagctgcccaggccacctggag

SEQ ID NO: 8146191 - DNA, 22 bp, Homo sapiens
cagcagaaaatgtgggtgattt

SEQ ID NO: 8146192 - DNA, 22 bp, Homo sapiens
cagcatggacaggggtggcgtt

SEQ ID NO: 8146193 - DNA, 22 bp, Homo sapiens
cagcatggacccatcgctgagt

SEQ ID NO: 8146194 - DNA, 22 bp, Homo sapiens
cagcatggagacaaagtgggca

SEQ ID NO: 8146195 - DNA, 22 bp, Homo sapiens
cagcatggggatcactgtaggc

SEQ ID NO: 8146196 - DNA, 22 bp, Homo sapiens
cagcatggcttgagtgtttcct

SEQ ID NO: 8146197 - DNA, 22 bp, Homo sapiens
cagcatggagacaaagtgggca

SEQ ID NO: 8146198 - DNA, 22 bp, Homo sapiens
cagcacttcagcattcagattt

SEQ ID NO: 8146199 - DNA, 22 bp, Homo sapiens
cagcacttgagctttcatgtaa

SEQ ID NO: 8146200 - DNA, 22 bp, Homo sapiens
cagcacttgagctttcatgtaa

SEQ ID NO: 8146201 - DNA, 22 bp, Homo sapiens
cagcactttgagggctcttaat

SEQ ID NO: 8146202 - DNA, 22 bp, Homo sapiens
cagcactttgagggctcttaat

SEQ ID NO: 8146203 - DNA, 22 bp, Homo sapiens
cagcacttcagcattcagattt

SEQ ID NO: 8146204 - DNA, 22 bp, Homo sapiens
cagcactgttcccagaccactg

SEQ ID NO: 8146205 - DNA, 22 bp, Homo sapiens
cagcactgcttcgcagccaggg

SEQ ID NO: 8146206 - DNA, 22 bp, Homo sapiens
cagcactgggaccactagaaca

SEQ ID NO: 8146207 - DNA, 22 bp, Homo sapiens
cagcactgggaccactagaaca

SEQ ID NO: 8146208 - DNA, 22 bp, Homo sapiens
cagcactggggccactggagtt

SEQ ID NO: 8146209 - DNA, 22 bp, Homo sapiens
cagcactgtgataactgagcca

SEQ ID NO: 8146210 - DNA, 22 bp, Homo sapiens
cagcactggggccactggagtt

SEQ ID NO: 8146211 - DNA, 22 bp, Homo sapiens
agcgccgcccctgctggtgttg

SEQ ID NO: 8146212 - DNA, 22 bp, Homo sapiens
agcgcctgcaccactctgcggc

SEQ ID NO: 8146213 - DNA, 22 bp, Homo sapiens
agcgcctgcggtgtgagcctgc

SEQ ID NO: 8146214 - DNA, 22 bp, Homo sapiens
agcgcctgcggtgtgagcctgc

SEQ ID NO: 8146215 - DNA, 22 bp, Homo sapiens
agcgctggtgatctctattttg

SEQ ID NO: 8146216 - DNA, 22 bp, Homo sapiens
agcgctggctggcgctccttcc

SEQ ID NO: 8146217 - DNA, 22 bp, Homo sapiens
agcgccactgcactccagcctg

SEQ ID NO: 8146218 - DNA, 22 bp, Homo sapiens
agcgccactgcactccagcctg

SEQ ID NO: 8146219 - DNA, 22 bp, Homo sapiens
agcgagggaggtctgaggacag

SEQ ID NO: 8146220 - DNA, 22 bp, Homo sapiens
agcgaggttttgcagatacagc

SEQ ID NO: 8146221 - DNA, 22 bp, Homo sapiens
agcgcaggaacacgtctgcctt

SEQ ID NO: 8146222 - DNA, 22 bp, Homo sapiens
cagcatgtggattcctcccact

SEQ ID NO: 8146223 - DNA, 22 bp, Homo sapiens
agcgagggaggtctgaggacag

SEQ ID NO: 8146224 - DNA, 22 bp, Homo sapiens
cagcatgtaagccactgccctg

SEQ ID NO: 8146225 - DNA, 22 bp, Homo sapiens
cagcatggtgccagtgagtcca

SEQ ID NO: 8146226 - DNA, 22 bp, Homo sapiens
cagcatggtgccagtgagtcca

SEQ ID NO: 8146227 - DNA, 22 bp, Homo sapiens
cagcatggtgccagtgagtcca

SEQ ID NO: 8146228 - DNA, 22 bp, Homo sapiens
cagcatggtggagctgctcttt

SEQ ID NO: 8146229 - DNA, 22 bp, Homo sapiens
cagcatggtggagctgctcttt

SEQ ID NO: 8146230 - DNA, 22 bp, Homo sapiens
cagcatggtgccagtgagtcca

SEQ ID NO: 8146231 - DNA, 22 bp, Homo sapiens
cagcatgggttccgggggcctg

SEQ ID NO: 8146232 - DNA, 22 bp, Homo sapiens
cagcatgggggcaattcaggtg

SEQ ID NO: 8146233 - DNA, 22 bp, Homo sapiens
cagcatggggcttggagtcagc

SEQ ID NO: 8146234 - DNA, 22 bp, Homo sapiens
cagcatggggcttggagtcagc

SEQ ID NO: 8146235 - DNA, 22 bp, Homo sapiens
cagcatggggcttggagtcagc

SEQ ID NO: 8146236 - DNA, 22 bp, Homo sapiens
cagcatggggatcactgtaggc

SEQ ID NO: 8146237 - DNA, 22 bp, Homo sapiens
cagcctcctgggacactcaccg

SEQ ID NO: 8146238 - DNA, 22 bp, Homo sapiens
cagcctctaagcacagcctctc

SEQ ID NO: 8146239 - DNA, 22 bp, Homo sapiens
cagcctcctgggacactcaccg

SEQ ID NO: 8146240 - DNA, 22 bp, Homo sapiens
cagccccacacggtctagctct

SEQ ID NO: 8146241 - DNA, 22 bp, Homo sapiens
cagcccattcctgccatgccgc

SEQ ID NO: 8146242 - DNA, 22 bp, Homo sapiens
cagcccatttctgggacctgag

SEQ ID NO: 8146243 - DNA, 22 bp, Homo sapiens
cagccctggtgaggttggctat

SEQ ID NO: 8146244 - DNA, 22 bp, Homo sapiens
cagccctggtgaggttggctat

SEQ ID NO: 8146245 - DNA, 22 bp, Homo sapiens
cagccctggtgaggttggctat

SEQ ID NO: 8146246 - DNA, 22 bp, Homo sapiens
cagccctggtgaggttggctat

SEQ ID NO: 8146247 - DNA, 22 bp, Homo sapiens
cagcccaggtctctcttccagt

SEQ ID NO: 8146248 - DNA, 19 bp, Homo sapiens
cagcccagggtgctaccaa

SEQ ID NO: 8146249 - DNA, 22 bp, Homo sapiens
cagcccaggtctctcttccagt

SEQ ID NO: 8146250 - DNA, 22 bp, Homo sapiens
cagcccaggtctctcttccagt

SEQ ID NO: 8146251 - DNA, 22 bp, Homo sapiens
cagcccagtgcacgcccgtttc

SEQ ID NO: 8146252 - DNA, 22 bp, Homo sapiens
cagcccatccaaggcttggcat

SEQ ID NO: 8146253 - DNA, 22 bp, Homo sapiens
cagcccatggtttgtggccagt

SEQ ID NO: 8146254 - DNA, 22 bp, Homo sapiens
cagcccagtgcacgcccgtttc

SEQ ID NO: 8146255 - DNA, 22 bp, Homo sapiens
cagcccagtgcacgcccgtttc

SEQ ID NO: 8146256 - DNA, 22 bp, Homo sapiens
cagcccagtaccaagcagttgg

SEQ ID NO: 8146257 - DNA, 22 bp, Homo sapiens
cagcccagagaaggggcccgtg

SEQ ID NO: 8146258 - DNA, 21 bp, Homo sapiens
cagcccagagcagtggggcca

SEQ ID NO: 8146259 - DNA, 22 bp, Homo sapiens
cagcccagagaaggggcccgtg

SEQ ID NO: 8146260 - DNA, 22 bp, Homo sapiens
cagcccacttcccagcacctac

SEQ ID NO: 8146261 - DNA, 22 bp, Homo sapiens
cagccagtgtgaccgaggagga

SEQ ID NO: 8146262 - DNA, 22 bp, Homo sapiens
cagccagtgtgaccgaggagga

SEQ ID NO: 8146263 - DNA, 22 bp, Homo sapiens
cagccatactgacatcaacaaa

SEQ ID NO: 8146264 - DNA, 22 bp, Homo sapiens
cagccagctggcactgtgagta

SEQ ID NO: 8146265 - DNA, 22 bp, Homo sapiens
cagccagctggcactgtgagta

SEQ ID NO: 8146266 - DNA, 22 bp, Homo sapiens
agcggaaggcctggctgatccg

SEQ ID NO: 8146267 - DNA, 22 bp, Homo sapiens
agcgctgtgggcgtgcgaggag

SEQ ID NO: 8146268 - DNA, 22 bp, Homo sapiens
agcgctgtgggcgtgcgaggag

SEQ ID NO: 8146269 - DNA, 22 bp, Homo sapiens
agcgctgtgggcgtgcgaggag

SEQ ID NO: 8146270 - DNA, 22 bp, Homo sapiens
cagcccacgtcagggccactca

SEQ ID NO: 8146271 - DNA, 22 bp, Homo sapiens
cagccatgagtctaagcagttt

SEQ ID NO: 8146272 - DNA, 22 bp, Homo sapiens
cagccatgagtctaagcagttt

SEQ ID NO: 8146273 - DNA, 22 bp, Homo sapiens
cagcccaaagccccaggctaga

SEQ ID NO: 8146274 - DNA, 22 bp, Homo sapiens
cagcccaaagccccaggctaga

SEQ ID NO: 8146275 - DNA, 22 bp, Homo sapiens
agccaggccttttctcaaggtt

SEQ ID NO: 8146276 - DNA, 22 bp, Homo sapiens
agccaggcgcagtggcttatgc

SEQ ID NO: 8146277 - DNA, 22 bp, Homo sapiens
agccaggctcaaggcctgctcc

SEQ ID NO: 8146278 - DNA, 22 bp, Homo sapiens
agccaagcactcaactcctgga

SEQ ID NO: 8146279 - DNA, 22 bp, Homo sapiens
agccaagcactcaactcctgga

SEQ ID NO: 8146280 - DNA, 22 bp, Homo sapiens
agccaagcaccactggcactcg

SEQ ID NO: 8146281 - DNA, 22 bp, Homo sapiens
agccaagcaccactggcactcg

SEQ ID NO: 8146282 - DNA, 22 bp, Homo sapiens
agccaagagctcacctcgtgtg

SEQ ID NO: 8146283 - DNA, 20 bp, Homo sapiens
agccaagaacaggcagaacc

SEQ ID NO: 8146284 - DNA, 22 bp, Homo sapiens
agccaactaggagattaaggta

SEQ ID NO: 8146285 - DNA, 22 bp, Homo sapiens
agccaactccagcccctgcagc

SEQ ID NO: 8146286 - DNA, 22 bp, Homo sapiens
agccaactccagcccctgcagc

SEQ ID NO: 8146287 - DNA, 22 bp, Homo sapiens
agccaagagatgaggctgcagg

SEQ ID NO: 8146288 - DNA, 22 bp, Homo sapiens
agccaagagatgaggctgcagg

SEQ ID NO: 8146289 - DNA, 22 bp, Homo sapiens
agccaagagatgaggctgcagg

SEQ ID NO: 8146290 - DNA, 22 bp, Homo sapiens
agccaagagacagatgcccacc

SEQ ID NO: 8146291 - DNA, 22 bp, Homo sapiens
agccaagagacagatgcccacc

SEQ ID NO: 8146292 - DNA, 16 bp, Homo sapiens
agccaggctgcctcgg

SEQ ID NO: 8146293 - DNA, 16 bp, Homo sapiens
agccaggctgcctcgg

SEQ ID NO: 8146294 - DNA, 16 bp, Homo sapiens
agccaggctgcctcgg

SEQ ID NO: 8146295 - DNA, 22 bp, Homo sapiens
agccaggctgcagttggctggc

SEQ ID NO: 8146296 - DNA, 22 bp, Homo sapiens
agccaggctgcagttggctggc

SEQ ID NO: 8146297 - DNA, 22 bp, Homo sapiens
agccaggctgcagttggctggc

SEQ ID NO: 8146298 - DNA, 22 bp, Homo sapiens
agccaggctgcagttggctggc

SEQ ID NO: 8146299 - DNA, 22 bp, Homo sapiens
agccagggacgctgcaggctac

SEQ ID NO: 8146300 - DNA, 22 bp, Homo sapiens
agccagggacgctgcaggctac

SEQ ID NO: 8146301 - DNA, 22 bp, Homo sapiens
agccagggacgctgcaggctac

SEQ ID NO: 8146302 - DNA, 22 bp, Homo sapiens
agccagggacgctgcaggctac

SEQ ID NO: 8146303 - DNA, 22 bp, Homo sapiens
agccagggaaggataacaagaa

SEQ ID NO: 8146304 - DNA, 22 bp, Homo sapiens
agccagggaaggataacaagaa

SEQ ID NO: 8146305 - DNA, 22 bp, Homo sapiens
agccagggaaggataacaagaa

SEQ ID NO: 8146306 - DNA, 22 bp, Homo sapiens
agccagggaagaggcctacctc

SEQ ID NO: 8146307 - DNA, 22 bp, Homo sapiens
agccagggaggtggaggttgca

SEQ ID NO: 8146308 - DNA, 22 bp, Homo sapiens
agccagggatgcagcacagtga

SEQ ID NO: 8146309 - DNA, 22 bp, Homo sapiens
agccagggatgcagcacagtga

SEQ ID NO: 8146310 - DNA, 22 bp, Homo sapiens
agccagggaggtggaggttgca

SEQ ID NO: 8146311 - DNA, 22 bp, Homo sapiens
agccagggatggcagtgcccag

SEQ ID NO: 8146312 - DNA, 23 bp, Homo sapiens
agccagggcactggtggagattg

SEQ ID NO: 8146313 - DNA, 23 bp, Homo sapiens
agccagggcactggtggagattg

SEQ ID NO: 8146314 - DNA, 22 bp, Homo sapiens
agccagggctgcgagcagacag

SEQ ID NO: 8146315 - DNA, 22 bp, Homo sapiens
agccagggctgcgagcagacag

SEQ ID NO: 8146316 - DNA, 22 bp, Homo sapiens
agccagggctctccttcgcgtg

SEQ ID NO: 8146317 - DNA, 22 bp, Homo sapiens
agccagggctgcaggttccttg

SEQ ID NO: 8146318 - DNA, 22 bp, Homo sapiens
agccagggctgcgagcagacag

SEQ ID NO: 8146319 - DNA, 22 bp, Homo sapiens
agccagggctgcgagcagacag

SEQ ID NO: 8146320 - DNA, 22 bp, Homo sapiens
agccagggctgcgagcagacag

SEQ ID NO: 8146321 - DNA, 22 bp, Homo sapiens
agccaggggagtcagctgctgg

SEQ ID NO: 8146322 - DNA, 22 bp, Homo sapiens
cagagcagggtgcaccttgggc

SEQ ID NO: 8146323 - DNA, 22 bp, Homo sapiens
cagagcagggtgcaccttgggc

SEQ ID NO: 8146324 - DNA, 22 bp, Homo sapiens
cagagcaggtatctttggtgaa

SEQ ID NO: 8146325 - DNA, 22 bp, Homo sapiens
cagagcagggtgcaccttgggc

SEQ ID NO: 8146326 - DNA, 22 bp, Homo sapiens
agccaggggagtcagctgctgg

SEQ ID NO: 8146327 - DNA, 22 bp, Homo sapiens
cagagcaccagtgggagacaag

SEQ ID NO: 8146328 - DNA, 22 bp, Homo sapiens
cagagcaccagtgggagacaag

SEQ ID NO: 8146329 - DNA, 22 bp, Homo sapiens
cagagcacccaaggagcatttg

SEQ ID NO: 8146330 - DNA, 22 bp, Homo sapiens
cagagcagtaaatctggggcac

SEQ ID NO: 8146331 - DNA, 22 bp, Homo sapiens
cagagcagtaaatctggggcac

SEQ ID NO: 8146332 - DNA, 22 bp, Homo sapiens
cagagcagtaaatctggggcac

SEQ ID NO: 8146333 - DNA, 22 bp, Homo sapiens
cagagcagtagaaaacagcctt

SEQ ID NO: 8146334 - DNA, 22 bp, Homo sapiens
cagagcagtagaaaacagcctt

SEQ ID NO: 8146335 - DNA, 22 bp, Homo sapiens
cagagcagtagaaaacagcctt

SEQ ID NO: 8146336 - DNA, 22 bp, Homo sapiens
cagagcagtagaaaacagcctt

SEQ ID NO: 8146337 - DNA, 22 bp, Homo sapiens
cagagcagtaaatctggggcac

SEQ ID NO: 8146338 - DNA, 22 bp, Homo sapiens
cagagcaggtatctttggtgaa

SEQ ID NO: 8146339 - DNA, 22 bp, Homo sapiens
cagagcaggtatctttggtgaa

SEQ ID NO: 8146340 - DNA, 22 bp, Homo sapiens
cagagcagtaaatctggggcac

SEQ ID NO: 8146341 - DNA, 22 bp, Homo sapiens
cagagcagtaaatctggggcac

SEQ ID NO: 8146342 - DNA, 18 bp, Homo sapiens
cagagcagtatgaatgtt

SEQ ID NO: 8146343 - DNA, 18 bp, Homo sapiens
cagagcagtatgaatgtt

SEQ ID NO: 8146344 - DNA, 22 bp, Homo sapiens
cagagcagtagaaaacagcctt

SEQ ID NO: 8146345 - DNA, 22 bp, Homo sapiens
cagagcagtccttgtcaatcag

SEQ ID NO: 8146346 - DNA, 22 bp, Homo sapiens
cagagcagtccttgtcaatcag

SEQ ID NO: 8146347 - DNA, 22 bp, Homo sapiens
cagagcagtccttgtcaatcag

SEQ ID NO: 8146348 - DNA, 22 bp, Homo sapiens
cagagccaggtcttgaactcag

SEQ ID NO: 8146349 - DNA, 22 bp, Homo sapiens
cagagccaggtctaggagtctc

SEQ ID NO: 8146350 - DNA, 22 bp, Homo sapiens
cagagccaggtcttgaactcag

SEQ ID NO: 8146351 - DNA, 22 bp, Homo sapiens
cagagccaggtctaggagtctc

SEQ ID NO: 8146352 - DNA, 22 bp, Homo sapiens
cagagccagggctaggaactgg

SEQ ID NO: 8146353 - DNA, 22 bp, Homo sapiens
cagagccagggttgcacccctg

SEQ ID NO: 8146354 - DNA, 22 bp, Homo sapiens
cagagcagtctggagatccagc

SEQ ID NO: 8146355 - DNA, 22 bp, Homo sapiens
cagagccaggcctgccctcttt

SEQ ID NO: 8146356 - DNA, 22 bp, Homo sapiens
cagagcagtctggagatccagc

SEQ ID NO: 8146357 - DNA, 22 bp, Homo sapiens
cagagccaggcctgccctcttt

SEQ ID NO: 8146358 - DNA, 20 bp, Homo sapiens
cagagctgttatggatgatg

SEQ ID NO: 8146359 - DNA, 20 bp, Homo sapiens
cagagctgttatggatgatg

SEQ ID NO: 8146360 - DNA, 20 bp, Homo sapiens
cagagctgttatggatgatg

SEQ ID NO: 8146361 - DNA, 22 bp, Homo sapiens
cagagctgttactattcatgaa

SEQ ID NO: 8146362 - DNA, 22 bp, Homo sapiens
cagagctgttgcggggcttggc

SEQ ID NO: 8146363 - DNA, 22 bp, Homo sapiens
cagagctgttgcggggcttggc

SEQ ID NO: 8146364 - DNA, 22 bp, Homo sapiens
cagagctgttgcggggcttggc

SEQ ID NO: 8146365 - DNA, 22 bp, Homo sapiens
cagagctgttgcggggcttggc

SEQ ID NO: 8146366 - DNA, 22 bp, Homo sapiens
cagagcttaaaactccatggaa

SEQ ID NO: 8146367 - DNA, 22 bp, Homo sapiens
cagagctgtgataaatagatat

SEQ ID NO: 8146368 - DNA, 22 bp, Homo sapiens
cagagctgtgataaatagatat

SEQ ID NO: 8146369 - DNA, 22 bp, Homo sapiens
cagagctgtgataaatagatat

SEQ ID NO: 8146370 - DNA, 22 bp, Homo sapiens
cagagctgttactattcatgaa

SEQ ID NO: 8146371 - DNA, 22 bp, Homo sapiens
cagagctgtccaaaccctgaca

SEQ ID NO: 8146372 - DNA, 22 bp, Homo sapiens
cagagctgtccaaaccctgaca

SEQ ID NO: 8146373 - DNA, 22 bp, Homo sapiens
cagagctgtccaaaccctgaca

SEQ ID NO: 8146374 - DNA, 22 bp, Homo sapiens
cagagctgtccaaaccctgaca

SEQ ID NO: 8146375 - DNA, 21 bp, Homo sapiens
cagagctgtccaaaccctgac

SEQ ID NO: 8146376 - DNA, 21 bp, Homo sapiens
cagagctgtccaaaccctgac

SEQ ID NO: 8146377 - DNA, 21 bp, Homo sapiens
cagagctgtccaaaccctgac

SEQ ID NO: 8146378 - DNA, 22 bp, Homo sapiens
cagagccattatggagacttgc

SEQ ID NO: 8146379 - DNA, 22 bp, Homo sapiens
cagagccatggtatgggcttgt

SEQ ID NO: 8146380 - DNA, 23 bp, Homo sapiens
cagagctggctcagagctgcctg

SEQ ID NO: 8146381 - DNA, 23 bp, Homo sapiens
cagagctggctcagagctgcctg

SEQ ID NO: 8146382 - DNA, 23 bp, Homo sapiens
cagagctggctcagagctgcctg

SEQ ID NO: 8146383 - DNA, 22 bp, Homo sapiens
cagagccatcccagcctgtggt

SEQ ID NO: 8146384 - DNA, 22 bp, Homo sapiens
cagagccatcccagcctgtggt

SEQ ID NO: 8146385 - DNA, 22 bp, Homo sapiens
cagagccatccaggtgcctgtt

SEQ ID NO: 8146386 - DNA, 22 bp, Homo sapiens
cagagccatccaggtgcctgtt

SEQ ID NO: 8146387 - DNA, 22 bp, Homo sapiens
cagagccatcccagcctgtggt

SEQ ID NO: 8146388 - DNA, 22 bp, Homo sapiens
cagagccatccaggtgcctgtt

SEQ ID NO: 8146389 - DNA, 22 bp, Homo sapiens
cagagccatcatgatatggagt

SEQ ID NO: 8146390 - DNA, 22 bp, Homo sapiens
cagagccatcatgatatggagt

SEQ ID NO: 8146391 - DNA, 22 bp, Homo sapiens
cagagccataaaggtgaaagag

SEQ ID NO: 8146392 - DNA, 22 bp, Homo sapiens
agcctgagtgcttaggactgtt

SEQ ID NO: 8146393 - DNA, 22 bp, Homo sapiens
agcctgagtgcttaggactgtt

SEQ ID NO: 8146394 - DNA, 22 bp, Homo sapiens
agcctgagtgcttaggactgtt

SEQ ID NO: 8146395 - DNA, 22 bp, Homo sapiens
cagatgaagatcatagaatagt

SEQ ID NO: 8146396 - DNA, 22 bp, Homo sapiens
cagatgaactgtgactgaaaat

SEQ ID NO: 8146397 - DNA, 22 bp, Homo sapiens
agcctggaagaacctgaagtct

SEQ ID NO: 8146398 - DNA, 22 bp, Homo sapiens
agcctgcttggcagccctccca

SEQ ID NO: 8146399 - DNA, 22 bp, Homo sapiens
agcctggaagaacctgaagtct

SEQ ID NO: 8146400 - DNA, 22 bp, Homo sapiens
agcctggaattaaggaaatgca

SEQ ID NO: 8146401 - DNA, 22 bp, Homo sapiens
agcctggaagaacctgaagtct

SEQ ID NO: 8146402 - DNA, 22 bp, Homo sapiens
agcctgcttgagagtcctggct

SEQ ID NO: 8146403 - DNA, 22 bp, Homo sapiens
agcctgcttggcagccctccca

SEQ ID NO: 8146404 - DNA, 22 bp, Homo sapiens
cagatgaactctatcctgtggc

SEQ ID NO: 8146405 - DNA, 22 bp, Homo sapiens
cagatgaactgtgactgaaaat

SEQ ID NO: 8146406 - DNA, 22 bp, Homo sapiens
cagatgaactaggctgcacttg

SEQ ID NO: 8146407 - DNA, 22 bp, Homo sapiens
cagatgaactgtgactgaaaat

SEQ ID NO: 8146408 - DNA, 22 bp, Homo sapiens
cagatctatctgttgatggtgc

SEQ ID NO: 8146409 - DNA, 22 bp, Homo sapiens
agcctggaccaggggcctcaga

SEQ ID NO: 8146410 - DNA, 22 bp, Homo sapiens
agcctggagaagatgtgtattg

SEQ ID NO: 8146411 - DNA, 22 bp, Homo sapiens
agcctggaccaggggcctcaga

SEQ ID NO: 8146412 - DNA, 22 bp, Homo sapiens
agcctggaattaaggaaatgca

SEQ ID NO: 8146413 - DNA, 22 bp, Homo sapiens
agcctggaattaaggaaatgca

SEQ ID NO: 8146414 - DNA, 22 bp, Homo sapiens
agcctggaattaaggaaatgca

SEQ ID NO: 8146415 - DNA, 22 bp, Homo sapiens
agcctggacagctacggagaac

SEQ ID NO: 8146416 - DNA, 22 bp, Homo sapiens
agcctggacagctacggagaac

SEQ ID NO: 8146417 - DNA, 22 bp, Homo sapiens
agcctggagaggcgccatacac

SEQ ID NO: 8146418 - DNA, 22 bp, Homo sapiens
agcctggagaggcgccatacac

SEQ ID NO: 8146419 - DNA, 22 bp, Homo sapiens
agcctggagcttgagttatgag

SEQ ID NO: 8146420 - DNA, 22 bp, Homo sapiens
agcctggagcttgagttatgag

SEQ ID NO: 8146421 - DNA, 22 bp, Homo sapiens
agcctggaggaggagttgagca

SEQ ID NO: 8146422 - DNA, 22 bp, Homo sapiens
agcctggaggaggagttgagca

SEQ ID NO: 8146423 - DNA, 22 bp, Homo sapiens
agcctggaggaggagttgagca

SEQ ID NO: 8146424 - DNA, 18 bp, Homo sapiens
agcctggagggttgaagt

SEQ ID NO: 8146425 - DNA, 18 bp, Homo sapiens
agcctggagggttgaagt

SEQ ID NO: 8146426 - DNA, 18 bp, Homo sapiens
agcctggagggttgaagt

SEQ ID NO: 8146427 - DNA, 22 bp, Homo sapiens
agcctggaggtaatgaggaaac

SEQ ID NO: 8146428 - DNA, 22 bp, Homo sapiens
cagcactgcttcgcagccaggg

SEQ ID NO: 8146429 - DNA, 22 bp, Homo sapiens
agcctggaggccaggagacagt

SEQ ID NO: 8146430 - DNA, 22 bp, Homo sapiens
agcctggaggccaggagacagt

SEQ ID NO: 8146431 - DNA, 22 bp, Homo sapiens
agcctggaggccaggagacagt

SEQ ID NO: 8146432 - DNA, 19 bp, Homo sapiens
agcctggagggctggtcac

SEQ ID NO: 8146433 - DNA, 19 bp, Homo sapiens
agcctggagggctggtcac

SEQ ID NO: 8146434 - DNA, 19 bp, Homo sapiens
agcctggagggctggtcac

SEQ ID NO: 8146435 - DNA, 22 bp, Homo sapiens
agcctagggttctgatgtcact

SEQ ID NO: 8146436 - DNA, 22 bp, Homo sapiens
agcctaggtctgggtctagcag

SEQ ID NO: 8146437 - DNA, 22 bp, Homo sapiens
agcctattccaggatgagctca

SEQ ID NO: 8146438 - DNA, 22 bp, Homo sapiens
cagatcatgggactgtctcagc

SEQ ID NO: 8146439 - DNA, 22 bp, Homo sapiens
cagatccacccttgtagtgaca

SEQ ID NO: 8146440 - DNA, 22 bp, Homo sapiens
cagatcataacagatacataga

SEQ ID NO: 8146441 - DNA, 23 bp, Homo sapiens
cagatcatatatccagctgtaag

SEQ ID NO: 8146442 - DNA, 18 bp, Homo sapiens
cagatccaggcagctatt

SEQ ID NO: 8146443 - DNA, 22 bp, Homo sapiens
cagatcctgccaggctgagttg

SEQ ID NO: 8146444 - DNA, 22 bp, Homo sapiens
agccggccatgtggtcttgtgc

SEQ ID NO: 8146445 - DNA, 22 bp, Homo sapiens
agccggccatgtggtcttgtgc

SEQ ID NO: 8146446 - DNA, 22 bp, Homo sapiens
agccggccatgtggtcttgtgc

SEQ ID NO: 8146447 - DNA, 22 bp, Homo sapiens
agcctaggaggttggggctgca

SEQ ID NO: 8146448 - DNA, 22 bp, Homo sapiens
agcctagggggtcctgggccac

SEQ ID NO: 8146449 - DNA, 22 bp, Homo sapiens
agcctagggggtcctgggccac

SEQ ID NO: 8146450 - DNA, 22 bp, Homo sapiens
agcccttagtacatttctcaag

SEQ ID NO: 8146451 - DNA, 22 bp, Homo sapiens
agcccttagtacatttctcaag

SEQ ID NO: 8146452 - DNA, 22 bp, Homo sapiens
agcccttcaacctgcctactcc

SEQ ID NO: 8146453 - DNA, 22 bp, Homo sapiens
agcccttcaagagctctgtcct

SEQ ID NO: 8146454 - DNA, 22 bp, Homo sapiens
agcccttcaagagctctgtcct

SEQ ID NO: 8146455 - DNA, 22 bp, Homo sapiens
agcccttcaagagctctgtcct

SEQ ID NO: 8146456 - DNA, 22 bp, Homo sapiens
agcccttcaagagctctgtcct

SEQ ID NO: 8146457 - DNA, 22 bp, Homo sapiens
agcccttggtattttccgatcc

SEQ ID NO: 8146458 - DNA, 22 bp, Homo sapiens
agcccttgcagactgtcagcat

SEQ ID NO: 8146459 - DNA, 22 bp, Homo sapiens
agcccttcaagagctctgtcct

SEQ ID NO: 8146460 - DNA, 22 bp, Homo sapiens
agccgagctctgagcagggcct

SEQ ID NO: 8146461 - DNA, 22 bp, Homo sapiens
agccgagctctgagcagggcct

SEQ ID NO: 8146462 - DNA, 17 bp, Homo sapiens
agccgcctgggtcctgt

SEQ ID NO: 8146463 - DNA, 22 bp, Homo sapiens
agccgcgccccatctgagtggg

SEQ ID NO: 8146464 - DNA, 22 bp, Homo sapiens
cagaggaggccaccgcataggc

SEQ ID NO: 8146465 - DNA, 22 bp, Homo sapiens
cagaggaggcggtatacactgc

SEQ ID NO: 8146466 - DNA, 22 bp, Homo sapiens
cagaggaggcggtatacactgc

SEQ ID NO: 8146467 - DNA, 22 bp, Homo sapiens
cagaggaggcggtatacactgc

SEQ ID NO: 8146468 - DNA, 22 bp, Homo sapiens
cagaggaggcggtatacactgc

SEQ ID NO: 8146469 - DNA, 18 bp, Homo sapiens
cagaggagagacattcag

SEQ ID NO: 8146470 - DNA, 18 bp, Homo sapiens
cagaggagagacattcag

SEQ ID NO: 8146471 - DNA, 17 bp, Homo sapiens
cagaggagctttggggg

SEQ ID NO: 8146472 - DNA, 22 bp, Homo sapiens
cagagcttaaaactccatggaa

SEQ ID NO: 8146473 - DNA, 22 bp, Homo sapiens
cagagcttcagggaataagaat

SEQ ID NO: 8146474 - DNA, 22 bp, Homo sapiens
cagaggagaattgcgggatcat

SEQ ID NO: 8146475 - DNA, 22 bp, Homo sapiens
cagaggagtgggccgttatggt

SEQ ID NO: 8146476 - DNA, 20 bp, Homo sapiens
cagaggagtacatatgttca

SEQ ID NO: 8146477 - DNA, 22 bp, Homo sapiens
cagagtgaaataggggatcaag

SEQ ID NO: 8146478 - DNA, 22 bp, Homo sapiens
cagaggtgctggagtgagtcct

SEQ ID NO: 8146479 - DNA, 21 bp, Homo sapiens
cagaggtggcctgacctctga

SEQ ID NO: 8146480 - DNA, 22 bp, Homo sapiens
cagaggtgctggagtgagtcct

SEQ ID NO: 8146481 - DNA, 22 bp, Homo sapiens
cagagtgacattttcccttctc

SEQ ID NO: 8146482 - DNA, 22 bp, Homo sapiens
cagagtgaacagtgggatgtgc

SEQ ID NO: 8146483 - DNA, 22 bp, Homo sapiens
cagagtgaaataggggatcaag

SEQ ID NO: 8146484 - DNA, 22 bp, Homo sapiens
cagagtgaaataggggatcaag

SEQ ID NO: 8146485 - DNA, 22 bp, Homo sapiens
cagagtgaaataggggatcaag

SEQ ID NO: 8146486 - DNA, 22 bp, Homo sapiens
cagagtgaaataggggatcaag

SEQ ID NO: 8146487 - DNA, 22 bp, Homo sapiens
cagagtggagaaagcatttagt

SEQ ID NO: 8146488 - DNA, 22 bp, Homo sapiens
cagagtgataaatatagaaatt

SEQ ID NO: 8146489 - DNA, 22 bp, Homo sapiens
cagagtgatggcacctgctggg

SEQ ID NO: 8146490 - DNA, 22 bp, Homo sapiens
agccctctgagcctgggttgta

SEQ ID NO: 8146491 - DNA, 22 bp, Homo sapiens
agccctctgagctagtcaccat

SEQ ID NO: 8146492 - DNA, 22 bp, Homo sapiens
agccctctgcaaacacctgata

SEQ ID NO: 8146493 - DNA, 20 bp, Homo sapiens
agccctcttccagatgaagg

SEQ ID NO: 8146494 - DNA, 22 bp, Homo sapiens
agccctctgctgttctagtctc

SEQ ID NO: 8146495 - DNA, 22 bp, Homo sapiens
agccctctgctgttctagtctc

SEQ ID NO: 8146496 - DNA, 22 bp, Homo sapiens
agccctctgctgttctagtctc

SEQ ID NO: 8146497 - DNA, 22 bp, Homo sapiens
agccctctgagctagtcaccat

SEQ ID NO: 8146498 - DNA, 22 bp, Homo sapiens
agccctctctttagagatctga

SEQ ID NO: 8146499 - DNA, 22 bp, Homo sapiens
agccctctctttagagatctga

SEQ ID NO: 8146500 - DNA, 22 bp, Homo sapiens
agccctctctatggccctcttg

SEQ ID NO: 8146501 - DNA, 22 bp, Homo sapiens
agccctctccctttcttcttag

SEQ ID NO: 8146502 - DNA, 22 bp, Homo sapiens
agccctctctatggccctcttg

SEQ ID NO: 8146503 - DNA, 22 bp, Homo sapiens
agccctctctatggccctcttg

SEQ ID NO: 8146504 - DNA, 22 bp, Homo sapiens
agccctctctatggccctcttg

SEQ ID NO: 8146505 - DNA, 22 bp, Homo sapiens
agccctctccaccttcgaaaaa

SEQ ID NO: 8146506 - DNA, 22 bp, Homo sapiens
agccctctccctttcttcttag

SEQ ID NO: 8146507 - DNA, 22 bp, Homo sapiens
agccctctaagcaagagaggaa

SEQ ID NO: 8146508 - DNA, 21 bp, Homo sapiens
agccctctccaattccctttt

SEQ ID NO: 8146509 - DNA, 21 bp, Homo sapiens
agccctctccaattccctttt

SEQ ID NO: 8146510 - DNA, 22 bp, Homo sapiens
agccctgggctgtagataagca

SEQ ID NO: 8146511 - DNA, 22 bp, Homo sapiens
agccctgggctgtagataagca

SEQ ID NO: 8146512 - DNA, 22 bp, Homo sapiens
agccctgggctgtagataagca

SEQ ID NO: 8146513 - DNA, 22 bp, Homo sapiens
agccctgagccagcctggtcag

SEQ ID NO: 8146514 - DNA, 22 bp, Homo sapiens
agcccttagtacatttctcaag

SEQ ID NO: 8146515 - DNA, 22 bp, Homo sapiens
agccctgggctgtagataagca

SEQ ID NO: 8146516 - DNA, 22 bp, Homo sapiens
agccctgacctgtcctgttctg

SEQ ID NO: 8146517 - DNA, 20 bp, Homo sapiens
agccctcttgctttagggta

SEQ ID NO: 8146518 - DNA, 22 bp, Homo sapiens
agccctcttcccagatgcctca

SEQ ID NO: 8146519 - DNA, 22 bp, Homo sapiens
agccctcttccagccagcacag

SEQ ID NO: 8146520 - DNA, 22 bp, Homo sapiens
agccctcttccagccagcacag

SEQ ID NO: 8146521 - DNA, 22 bp, Homo sapiens
agccctctaaaaatgataacta

SEQ ID NO: 8146522 - DNA, 22 bp, Homo sapiens
agccctcctttgttcatgctgc

SEQ ID NO: 8146523 - DNA, 22 bp, Homo sapiens
agccctcctttgttcatgctgc

SEQ ID NO: 8146524 - DNA, 22 bp, Homo sapiens
agccctcctttgttcatgctgc

SEQ ID NO: 8146525 - DNA, 22 bp, Homo sapiens
agccctcctttgttcatgctgc

SEQ ID NO: 8146526 - DNA, 22 bp, Homo sapiens
agccctcctggggccacgctgg

SEQ ID NO: 8146527 - DNA, 22 bp, Homo sapiens
agccctcctggggccacgctgg

SEQ ID NO: 8146528 - DNA, 22 bp, Homo sapiens
cagagtggcgaccccctcagct

SEQ ID NO: 8146529 - DNA, 22 bp, Homo sapiens
cagagtggagatgtgtgtggaa

SEQ ID NO: 8146530 - DNA, 22 bp, Homo sapiens
cagagtggagaaagcatttagt

SEQ ID NO: 8146531 - DNA, 22 bp, Homo sapiens
cagagtggcactctgctggatg

SEQ ID NO: 8146532 - DNA, 22 bp, Homo sapiens
cagagtggcactctgctggatg

SEQ ID NO: 8146533 - DNA, 22 bp, Homo sapiens
cagagtggcactctgctggatg

SEQ ID NO: 8146534 - DNA, 22 bp, Homo sapiens
cagagtggcagtcccaggccca

SEQ ID NO: 8146535 - DNA, 22 bp, Homo sapiens
cagagtggcactctgctggatg

SEQ ID NO: 8146536 - DNA, 22 bp, Homo sapiens
cagagtggcagtcccaggccca

SEQ ID NO: 8146537 - DNA, 22 bp, Homo sapiens
caaggaaaaagcgagctcgggg

SEQ ID NO: 8146538 - DNA, 22 bp, Homo sapiens
caagctttccattacacacatt

SEQ ID NO: 8146539 - DNA, 22 bp, Homo sapiens
caagcttgtttctcctgggggt

SEQ ID NO: 8146540 - DNA, 22 bp, Homo sapiens
caaggaaaacagatgatcaaca

SEQ ID NO: 8146541 - DNA, 22 bp, Homo sapiens
caaggaaaagaagtatttcaga

SEQ ID NO: 8146542 - DNA, 22 bp, Homo sapiens
caaggaaacatgaaatgcattg

SEQ ID NO: 8146543 - DNA, 22 bp, Homo sapiens
caaggaaacatgaaatgcattg

SEQ ID NO: 8146544 - DNA, 21 bp, Homo sapiens
agcaatttcatttggtttaac

SEQ ID NO: 8146545 - DNA, 22 bp, Homo sapiens
agcaattttcccttagtctttg

SEQ ID NO: 8146546 - DNA, 22 bp, Homo sapiens
agcaattttcccttagtctttg

SEQ ID NO: 8146547 - DNA, 21 bp, Homo sapiens
agcaatttttcctcctctgca

SEQ ID NO: 8146548 - DNA, 22 bp, Homo sapiens
agcaatttcccatctcttctgc

SEQ ID NO: 8146549 - DNA, 22 bp, Homo sapiens
agcaatttcccatctcttctgc

SEQ ID NO: 8146550 - DNA, 21 bp, Homo sapiens
agcaatttttcctcctctgca

SEQ ID NO: 8146551 - DNA, 22 bp, Homo sapiens
caagcagaggtttatgtattag

SEQ ID NO: 8146552 - DNA, 22 bp, Homo sapiens
caagctggagttcctcagagtg

SEQ ID NO: 8146553 - DNA, 22 bp, Homo sapiens
caagctggctgggagaggcacg

SEQ ID NO: 8146554 - DNA, 22 bp, Homo sapiens
caagctgggtgcgggcagtata

SEQ ID NO: 8146555 - DNA, 22 bp, Homo sapiens
caagctgggtgcgggcagtata

SEQ ID NO: 8146556 - DNA, 22 bp, Homo sapiens
caagggaaggctaagggcaaca

SEQ ID NO: 8146557 - DNA, 22 bp, Homo sapiens
caaggccaaagggccactgtca

SEQ ID NO: 8146558 - DNA, 22 bp, Homo sapiens
caaggccaaagggccactgtca

SEQ ID NO: 8146559 - DNA, 22 bp, Homo sapiens
caaggccaaagggccactgtca

SEQ ID NO: 8146560 - DNA, 22 bp, Homo sapiens
agcagaccaggagtgcacaggt

SEQ ID NO: 8146561 - DNA, 22 bp, Homo sapiens
agcagacatggcttggatgtgg

SEQ ID NO: 8146562 - DNA, 22 bp, Homo sapiens
agcagagacatgaaatatgctt

SEQ ID NO: 8146563 - DNA, 22 bp, Homo sapiens
agcagagacatgaaatatgctt

SEQ ID NO: 8146564 - DNA, 22 bp, Homo sapiens
agcagagaagacacaggcttca

SEQ ID NO: 8146565 - DNA, 22 bp, Homo sapiens
agcagagaagacacaggcttca

SEQ ID NO: 8146566 - DNA, 22 bp, Homo sapiens
agcagacaggtaggaggataaa

SEQ ID NO: 8146567 - DNA, 22 bp, Homo sapiens
agcagacatatctcatgtcaca

SEQ ID NO: 8146568 - DNA, 22 bp, Homo sapiens
agcagacatatctcatgtcaca

SEQ ID NO: 8146569 - DNA, 21 bp, Homo sapiens
agcagacagcccaagaaaatc

SEQ ID NO: 8146570 - DNA, 22 bp, Homo sapiens
agcagacaggtaggaggataaa

SEQ ID NO: 8146571 - DNA, 21 bp, Homo sapiens
agcagacagcccaagaaaatc

SEQ ID NO: 8146572 - DNA, 22 bp, Homo sapiens
caaggaagacccacgcagatat

SEQ ID NO: 8146573 - DNA, 22 bp, Homo sapiens
caaggaaggagagatgatgggt

SEQ ID NO: 8146574 - DNA, 22 bp, Homo sapiens
caaggaaggagagatgatgggt

SEQ ID NO: 8146575 - DNA, 22 bp, Homo sapiens
caaggaagttttaggagaggaa

SEQ ID NO: 8146576 - DNA, 22 bp, Homo sapiens
caaggaaggagagatgatgggt

SEQ ID NO: 8146577 - DNA, 22 bp, Homo sapiens
caatgttttgttgaatgaatag

SEQ ID NO: 8146578 - DNA, 22 bp, Homo sapiens
caatgtttttccttccttaata

SEQ ID NO: 8146579 - DNA, 22 bp, Homo sapiens
caagtctgacctctgggtgaag

SEQ ID NO: 8146580 - DNA, 19 bp, Homo sapiens
caagtgaagcctgggatgg

SEQ ID NO: 8146581 - DNA, 22 bp, Homo sapiens
caagtgaagatatacagaaaat

SEQ ID NO: 8146582 - DNA, 22 bp, Homo sapiens
caatgatagattttacaaatta

SEQ ID NO: 8146583 - DNA, 22 bp, Homo sapiens
caagtctgacctctgggtgaag

SEQ ID NO: 8146584 - DNA, 22 bp, Homo sapiens
caagtcctccatgtgactaggt

SEQ ID NO: 8146585 - DNA, 22 bp, Homo sapiens
caattactggtccacagaaatt

SEQ ID NO: 8146586 - DNA, 22 bp, Homo sapiens
caattacttttgcaccaatata

SEQ ID NO: 8146587 - DNA, 21 bp, Homo sapiens
caattactatgaaccagttga

SEQ ID NO: 8146588 - DNA, 22 bp, Homo sapiens
caatgtttttccttccttaata

SEQ ID NO: 8146589 - DNA, 22 bp, Homo sapiens
caattaaagaagacctgcctca

SEQ ID NO: 8146590 - DNA, 21 bp, Homo sapiens
caattacagatggctcagggg

SEQ ID NO: 8146591 - DNA, 21 bp, Homo sapiens
caattacagatggctcagggg

SEQ ID NO: 8146592 - DNA, 22 bp, Homo sapiens
caattacatttattgagcattc

SEQ ID NO: 8146593 - DNA, 22 bp, Homo sapiens
caattacatttattgagcattc

SEQ ID NO: 8146594 - DNA, 22 bp, Homo sapiens
caattatatttagaatgataca

SEQ ID NO: 8146595 - DNA, 22 bp, Homo sapiens
caattattcagtgacttaagag

SEQ ID NO: 8146596 - DNA, 22 bp, Homo sapiens
caattattcagtgacttaagag

SEQ ID NO: 8146597 - DNA, 22 bp, Homo sapiens
caattatatttagaatgataca

SEQ ID NO: 8146598 - DNA, 22 bp, Homo sapiens
caattatatttagaatgataca

SEQ ID NO: 8146599 - DNA, 22 bp, Homo sapiens
caattatatttagaatgataca

SEQ ID NO: 8146600 - DNA, 22 bp, Homo sapiens
caagggagttgctgcatgcagg

SEQ ID NO: 8146601 - DNA, 22 bp, Homo sapiens
caagggagttgctgcatgcagg

SEQ ID NO: 8146602 - DNA, 22 bp, Homo sapiens
caagggcagaggcagggccccg

SEQ ID NO: 8146603 - DNA, 22 bp, Homo sapiens
caagggcagaggcagggccccg

SEQ ID NO: 8146604 - DNA, 22 bp, Homo sapiens
caagggaaggctaagggcaaca

SEQ ID NO: 8146605 - DNA, 22 bp, Homo sapiens
caagggacctgagatggtctct

SEQ ID NO: 8146606 - DNA, 22 bp, Homo sapiens
caagggacatttctcataggag

SEQ ID NO: 8146607 - DNA, 22 bp, Homo sapiens
caagggccatctgagggcactg

SEQ ID NO: 8146608 - DNA, 22 bp, Homo sapiens
caagggccatctgagggcactg

SEQ ID NO: 8146609 - DNA, 22 bp, Homo sapiens
caagggccatctgagggcactg

SEQ ID NO: 8146610 - DNA, 22 bp, Homo sapiens
caagggccctcggatgatgatg

SEQ ID NO: 8146611 - DNA, 22 bp, Homo sapiens
caagggcctccaccttgctcgt

SEQ ID NO: 8146612 - DNA, 22 bp, Homo sapiens
caagggccatctgagggcactg

SEQ ID NO: 8146613 - DNA, 21 bp, Homo sapiens
caagggccagtgagatgggat

SEQ ID NO: 8146614 - DNA, 21 bp, Homo sapiens
caagggccagtgagatgggat

SEQ ID NO: 8146615 - DNA, 22 bp, Homo sapiens
caagggcaggagaggatggatg

SEQ ID NO: 8146616 - DNA, 22 bp, Homo sapiens
caagggcattgcttgggacctt

SEQ ID NO: 8146617 - DNA, 22 bp, Homo sapiens
caagggcaggagaggatggatg

SEQ ID NO: 8146618 - DNA, 22 bp, Homo sapiens
caagggcagatagctggtccaa

SEQ ID NO: 8146619 - DNA, 22 bp, Homo sapiens
caagggcagatagctggtccaa

SEQ ID NO: 8146620 - DNA, 22 bp, Homo sapiens
caagtcccccaagaacagaacc

SEQ ID NO: 8146621 - DNA, 22 bp, Homo sapiens
caagtccatcagataagcaaga

SEQ ID NO: 8146622 - DNA, 22 bp, Homo sapiens
caagtcattgtttagtcatgtt

SEQ ID NO: 8146623 - DNA, 22 bp, Homo sapiens
caagtcacttatgtgcagatat

SEQ ID NO: 8146624 - DNA, 22 bp, Homo sapiens
caagggggagatttagggtaat

SEQ ID NO: 8146625 - DNA, 20 bp, Homo sapiens
caaggggagtagtatgggcc

SEQ ID NO: 8146626 - DNA, 20 bp, Homo sapiens
caaggggagtagtatgggcc

SEQ ID NO: 8146627 - DNA, 22 bp, Homo sapiens
caagggctgctatcagctactg

SEQ ID NO: 8146628 - DNA, 22 bp, Homo sapiens
caagggcttcaagtggccaaga

SEQ ID NO: 8146629 - DNA, 22 bp, Homo sapiens
caagggctgctatcagctactg

SEQ ID NO: 8146630 - DNA, 22 bp, Homo sapiens
caatttctggaactaattctga

SEQ ID NO: 8146631 - DNA, 22 bp, Homo sapiens
caatttctgggcctcacacaag

SEQ ID NO: 8146632 - DNA, 22 bp, Homo sapiens
caatttcttgttaattctcagg

SEQ ID NO: 8146633 - DNA, 22 bp, Homo sapiens
caatttcttgttaattctcagg

SEQ ID NO: 8146634 - DNA, 22 bp, Homo sapiens
caatttgtctaatgaaactcag

SEQ ID NO: 8146635 - DNA, 22 bp, Homo sapiens
caatttgacttttgaggttgta

SEQ ID NO: 8146636 - DNA, 22 bp, Homo sapiens
caattcaaatgcatagttcaca

SEQ ID NO: 8146637 - DNA, 22 bp, Homo sapiens
caatttctggaactaattctga

SEQ ID NO: 8146638 - DNA, 22 bp, Homo sapiens
caatttctggaactaattctga

SEQ ID NO: 8146639 - DNA, 22 bp, Homo sapiens
cacacatcttatcccagttatt

SEQ ID NO: 8146640 - DNA, 22 bp, Homo sapiens
caatttttgtacttatagtact

SEQ ID NO: 8146641 - DNA, 22 bp, Homo sapiens
cacacagaaccgctcgccactt

SEQ ID NO: 8146642 - DNA, 22 bp, Homo sapiens
caattttattggtccaaataca

SEQ ID NO: 8146643 - DNA, 22 bp, Homo sapiens
cacactgttgaggacgagatgt

SEQ ID NO: 8146644 - DNA, 22 bp, Homo sapiens
cacacatgtgtgcagcttagaa

SEQ ID NO: 8146645 - DNA, 22 bp, Homo sapiens
cacactttcaggtcctctttgc

SEQ ID NO: 8146646 - DNA, 22 bp, Homo sapiens
cacacatgtgggatccgcaggg

SEQ ID NO: 8146647 - DNA, 22 bp, Homo sapiens
cacacatgtgggatccgcaggg

SEQ ID NO: 8146648 - DNA, 22 bp, Homo sapiens
cacacatgtgtgcagcttagaa

SEQ ID NO: 8146649 - DNA, 22 bp, Homo sapiens
cacacatgtgagcagagaggcg

SEQ ID NO: 8146650 - DNA, 22 bp, Homo sapiens
cacacatgtgagcagagaggcg

SEQ ID NO: 8146651 - DNA, 22 bp, Homo sapiens
cacacttttctggctcaggctc

SEQ ID NO: 8146652 - DNA, 22 bp, Homo sapiens
cacactttgtgctaatctattt

SEQ ID NO: 8146653 - DNA, 22 bp, Homo sapiens
cacagaaaaaggcttgaaaatc

SEQ ID NO: 8146654 - DNA, 22 bp, Homo sapiens
cacagaaaaaggcttgaaaatc

SEQ ID NO: 8146655 - DNA, 22 bp, Homo sapiens
cacacatgaatccctagtacct

SEQ ID NO: 8146656 - DNA, 22 bp, Homo sapiens
cacacatgaatccctagtacct

SEQ ID NO: 8146657 - DNA, 22 bp, Homo sapiens
cacacatgaatccctagtacct

SEQ ID NO: 8146658 - DNA, 22 bp, Homo sapiens
cacacatgaagttgctgagcta

SEQ ID NO: 8146659 - DNA, 22 bp, Homo sapiens
cacacatcttatcccagttatt

SEQ ID NO: 8146660 - DNA, 22 bp, Homo sapiens
cacacatgaagttgctgagcta

SEQ ID NO: 8146661 - DNA, 22 bp, Homo sapiens
cacacatggctgccagggaggt

SEQ ID NO: 8146662 - DNA, 22 bp, Homo sapiens
cacacatggctgccagggaggt

SEQ ID NO: 8146663 - DNA, 22 bp, Homo sapiens
cacacatgcatgtaagacctct

SEQ ID NO: 8146664 - DNA, 22 bp, Homo sapiens
cacacatgagtctccccattgg

SEQ ID NO: 8146665 - DNA, 22 bp, Homo sapiens
cacacatgacccacttttaccg

SEQ ID NO: 8146666 - DNA, 22 bp, Homo sapiens
cacacatgacccacttttaccg

SEQ ID NO: 8146667 - DNA, 22 bp, Homo sapiens
cacacatggtagcaggtacaag

SEQ ID NO: 8146668 - DNA, 22 bp, Homo sapiens
cacacatggtagcaggtacaag

SEQ ID NO: 8146669 - DNA, 22 bp, Homo sapiens
cacacatggtagcaggtacaag

SEQ ID NO: 8146670 - DNA, 22 bp, Homo sapiens
cacacatggtagcaggtacaag

SEQ ID NO: 8146671 - DNA, 22 bp, Homo sapiens
cacacatggtagcaggtacaag

SEQ ID NO: 8146672 - DNA, 22 bp, Homo sapiens
cacacatggtagcaggtacaag

SEQ ID NO: 8146673 - DNA, 22 bp, Homo sapiens
cacacatggtagcaggtacaag

SEQ ID NO: 8146674 - DNA, 22 bp, Homo sapiens
cacacatggttccgcaggatgc

SEQ ID NO: 8146675 - DNA, 22 bp, Homo sapiens
cacacatgtctctccatgctct

SEQ ID NO: 8146676 - DNA, 22 bp, Homo sapiens
cacacatgtctctccatgctct

SEQ ID NO: 8146677 - DNA, 22 bp, Homo sapiens
cacacatgtctctccatgctct

SEQ ID NO: 8146678 - DNA, 22 bp, Homo sapiens
cacacatgtctctccatgctct

SEQ ID NO: 8146679 - DNA, 22 bp, Homo sapiens
cacagcagcgttcctccgtgtg

SEQ ID NO: 8146680 - DNA, 22 bp, Homo sapiens
cacagctgaccaccctgctccc

SEQ ID NO: 8146681 - DNA, 22 bp, Homo sapiens
cacagctgaccaccctgctccc

SEQ ID NO: 8146682 - DNA, 22 bp, Homo sapiens
cacagaaatattgtgtcccttg

SEQ ID NO: 8146683 - DNA, 22 bp, Homo sapiens
cacagaaatattgtgtcccttg

SEQ ID NO: 8146684 - DNA, 22 bp, Homo sapiens
cacagaaatattgtgtcccttg

SEQ ID NO: 8146685 - DNA, 22 bp, Homo sapiens
cacagaaatattgtgtcccttg

SEQ ID NO: 8146686 - DNA, 22 bp, Homo sapiens
cacagaaattattaggatgctt

SEQ ID NO: 8146687 - DNA, 20 bp, Homo sapiens
cacagaacaaattgcaggac

SEQ ID NO: 8146688 - DNA, 22 bp, Homo sapiens
cacagctgccatgcagtcagtg

SEQ ID NO: 8146689 - DNA, 22 bp, Homo sapiens
cacagctgcacagaggaggtgc

SEQ ID NO: 8146690 - DNA, 22 bp, Homo sapiens
cacagctgccatggctgcactt

SEQ ID NO: 8146691 - DNA, 22 bp, Homo sapiens
cacagctgccatggctgcactt

SEQ ID NO: 8146692 - DNA, 22 bp, Homo sapiens
cacagctgccctactccatgtg

SEQ ID NO: 8146693 - DNA, 22 bp, Homo sapiens
cacagctgccctactccatgtg

SEQ ID NO: 8146694 - DNA, 22 bp, Homo sapiens
cacagctgccctactccatgtg

SEQ ID NO: 8146695 - DNA, 22 bp, Homo sapiens
cacagctgccctactccatgtg

SEQ ID NO: 8146696 - DNA, 22 bp, Homo sapiens
cacagctgccccctctctaact

SEQ ID NO: 8146697 - DNA, 22 bp, Homo sapiens
cacagctgccccctctctaact

SEQ ID NO: 8146698 - DNA, 22 bp, Homo sapiens
cacagctggggaagctgaggcc

SEQ ID NO: 8146699 - DNA, 22 bp, Homo sapiens
cacaggaaaaatgggtccttta

SEQ ID NO: 8146700 - DNA, 22 bp, Homo sapiens
cacaggaaaaatgggtccttta

SEQ ID NO: 8146701 - DNA, 22 bp, Homo sapiens
cacaggaaaaatgggtccttta

SEQ ID NO: 8146702 - DNA, 19 bp, Homo sapiens
cacagctggcgctgaccgc

SEQ ID NO: 8146703 - DNA, 19 bp, Homo sapiens
cacagctggcgctgaccgc

SEQ ID NO: 8146704 - DNA, 22 bp, Homo sapiens
cacagctggaatggggtacctg

SEQ ID NO: 8146705 - DNA, 20 bp, Homo sapiens
cacaggaaagctactcagtt

SEQ ID NO: 8146706 - DNA, 20 bp, Homo sapiens
cacaggaaagctactcagtt

SEQ ID NO: 8146707 - DNA, 22 bp, Homo sapiens
cacaggaaaataaaagatctaa

SEQ ID NO: 8146708 - DNA, 22 bp, Homo sapiens
cacaggaaaataaaagatctaa

SEQ ID NO: 8146709 - DNA, 22 bp, Homo sapiens
cacaggaaaataaaagatctaa

SEQ ID NO: 8146710 - DNA, 22 bp, Homo sapiens
cacaggaaagtcagccagaaga

SEQ ID NO: 8146711 - DNA, 20 bp, Homo sapiens
cacaggaaagctactcagtt

SEQ ID NO: 8146712 - DNA, 22 bp, Homo sapiens
cacaggaagatctcccagaggt

SEQ ID NO: 8146713 - DNA, 22 bp, Homo sapiens
cacaggaagaggtatacaattc

SEQ ID NO: 8146714 - DNA, 22 bp, Homo sapiens
cacaggaagatctcccagaggt

SEQ ID NO: 8146715 - DNA, 22 bp, Homo sapiens
agcaggcaggcccagcggctgg

SEQ ID NO: 8146716 - DNA, 22 bp, Homo sapiens
agcaggccactgcagctggagc

SEQ ID NO: 8146717 - DNA, 22 bp, Homo sapiens
agcaggccactgcagctggagc

SEQ ID NO: 8146718 - DNA, 22 bp, Homo sapiens
agcaggcaggcccagcggctgg

SEQ ID NO: 8146719 - DNA, 22 bp, Homo sapiens
cacaggaaatattaggagggat

SEQ ID NO: 8146720 - DNA, 22 bp, Homo sapiens
cacaggaaatgattctgcagca

SEQ ID NO: 8146721 - DNA, 22 bp, Homo sapiens
cacaggaaatgattctgcagca

SEQ ID NO: 8146722 - DNA, 22 bp, Homo sapiens
cacaggaaatgattctgcagca

SEQ ID NO: 8146723 - DNA, 22 bp, Homo sapiens
cacaggaacaaagaagacaatt

SEQ ID NO: 8146724 - DNA, 22 bp, Homo sapiens
cacaggaaatgattctgcagca

SEQ ID NO: 8146725 - DNA, 22 bp, Homo sapiens
cacaggaacaaagaagacaatt

SEQ ID NO: 8146726 - DNA, 22 bp, Homo sapiens
cacaggaacaaagaagacaatt

SEQ ID NO: 8146727 - DNA, 22 bp, Homo sapiens
cacaggaacttactggccactt

SEQ ID NO: 8146728 - DNA, 21 bp, Homo sapiens
cacatgtgaattactgaactg

SEQ ID NO: 8146729 - DNA, 22 bp, Homo sapiens
cacatgtagtaagcaggcaatg

SEQ ID NO: 8146730 - DNA, 22 bp, Homo sapiens
cacatgtagtaagcaggcaatg

SEQ ID NO: 8146731 - DNA, 22 bp, Homo sapiens
cacatgtacagaagcaggctgg

SEQ ID NO: 8146732 - DNA, 22 bp, Homo sapiens
cacatgtacagaagcaggctgg

SEQ ID NO: 8146733 - DNA, 22 bp, Homo sapiens
cacatgggtgtgcctggaggaa

SEQ ID NO: 8146734 - DNA, 22 bp, Homo sapiens
cacatgggtgtgcctggaggaa

SEQ ID NO: 8146735 - DNA, 22 bp, Homo sapiens
cacatgggtgtgcctggaggaa

SEQ ID NO: 8146736 - DNA, 22 bp, Homo sapiens
cacatgggtggatggatgcatg

SEQ ID NO: 8146737 - DNA, 22 bp, Homo sapiens
cacatggggcgctgcattggcc

SEQ ID NO: 8146738 - DNA, 22 bp, Homo sapiens
cacatgggcttagcaggcaggg

SEQ ID NO: 8146739 - DNA, 22 bp, Homo sapiens
cacatgggcttagcaggcaggg

SEQ ID NO: 8146740 - DNA, 22 bp, Homo sapiens
cacatgggcacagagaacttgg

SEQ ID NO: 8146741 - DNA, 22 bp, Homo sapiens
cacatgggcgtaatgtccatgg

SEQ ID NO: 8146742 - DNA, 22 bp, Homo sapiens
cacatgggcgtaatgtccatgg

SEQ ID NO: 8146743 - DNA, 22 bp, Homo sapiens
cacatggcctgtgtggccagac

SEQ ID NO: 8146744 - DNA, 22 bp, Homo sapiens
cacatggcctgtgtggccagac

SEQ ID NO: 8146745 - DNA, 22 bp, Homo sapiens
cacatggcctgtgtggccagac

SEQ ID NO: 8146746 - DNA, 22 bp, Homo sapiens
cacatggaagagatacagtgag

SEQ ID NO: 8146747 - DNA, 22 bp, Homo sapiens
cacatggcagaatcatgcatct

SEQ ID NO: 8146748 - DNA, 22 bp, Homo sapiens
cacatggcagaatcatgcatct

SEQ ID NO: 8146749 - DNA, 22 bp, Homo sapiens
cacatgcttagatttcagtgga

SEQ ID NO: 8146750 - DNA, 22 bp, Homo sapiens
cacatgcttcttttgattatga

SEQ ID NO: 8146751 - DNA, 22 bp, Homo sapiens
cacatgcttcttttgattatga

SEQ ID NO: 8146752 - DNA, 22 bp, Homo sapiens
cacatggaagagatacagtgag

SEQ ID NO: 8146753 - DNA, 22 bp, Homo sapiens
cacatgaagagagtctagtaat

SEQ ID NO: 8146754 - DNA, 22 bp, Homo sapiens
cacaggctctccagggcctgga

SEQ ID NO: 8146755 - DNA, 22 bp, Homo sapiens
cacaggctcttctcacttgatt

SEQ ID NO: 8146756 - DNA, 22 bp, Homo sapiens
cacaggctgcccgcagctggga

SEQ ID NO: 8146757 - DNA, 22 bp, Homo sapiens
cacaggctgcccgcagctggga

SEQ ID NO: 8146758 - DNA, 22 bp, Homo sapiens
cacatgaacatgctggaaaagc

SEQ ID NO: 8146759 - DNA, 22 bp, Homo sapiens
cacaggctgcccgcagctggga

SEQ ID NO: 8146760 - DNA, 22 bp, Homo sapiens
cacaggctgcccgcagctggga

SEQ ID NO: 8146761 - DNA, 22 bp, Homo sapiens
cacaggctgcccgcagctggga

SEQ ID NO: 8146762 - DNA, 18 bp, Homo sapiens
agcaggcgttgcctggga

SEQ ID NO: 8146763 - DNA, 22 bp, Homo sapiens
agcaggcctgccacctcggggt

SEQ ID NO: 8146764 - DNA, 20 bp, Homo sapiens
agcaggccttggggagagga

SEQ ID NO: 8146765 - DNA, 22 bp, Homo sapiens
agcaggctactcctgtgttcgt

SEQ ID NO: 8146766 - DNA, 22 bp, Homo sapiens
agcaggctactcctgtgttcgt

SEQ ID NO: 8146767 - DNA, 22 bp, Homo sapiens
agcaggctaagggacctgttta

SEQ ID NO: 8146768 - DNA, 22 bp, Homo sapiens
agcaggctaagggacctgttta

SEQ ID NO: 8146769 - DNA, 22 bp, Homo sapiens
agcaggcccaagctggggggaa

SEQ ID NO: 8146770 - DNA, 22 bp, Homo sapiens
agcaggcccaagctggggggaa

SEQ ID NO: 8146771 - DNA, 21 bp, Homo sapiens
agcaggcccaatggagggggc

SEQ ID NO: 8146772 - DNA, 19 bp, Homo sapiens
agcaggccaggcaggtggc

SEQ ID NO: 8146773 - DNA, 19 bp, Homo sapiens
agcaggccaggcaggtggc

SEQ ID NO: 8146774 - DNA, 19 bp, Homo sapiens
agcaggccaggcaggtggc

SEQ ID NO: 8146775 - DNA, 22 bp, Homo sapiens
agcaggcctgccacctcggggt

SEQ ID NO: 8146776 - DNA, 22 bp, Homo sapiens
agcaggcccagggcttctcagc

SEQ ID NO: 8146777 - DNA, 21 bp, Homo sapiens
agcaggcccaatggagggggc

SEQ ID NO: 8146778 - DNA, 19 bp, Homo sapiens
agcaggctaggctgcctct

SEQ ID NO: 8146779 - DNA, 22 bp, Homo sapiens
agcaggctaggaacctcactgc

SEQ ID NO: 8146780 - DNA, 22 bp, Homo sapiens
agcaggctaggaacctcactgc

SEQ ID NO: 8146781 - DNA, 22 bp, Homo sapiens
agcaggctactcctgtgttcgt

SEQ ID NO: 8146782 - DNA, 22 bp, Homo sapiens
agcaggctaggaacctcactgc

SEQ ID NO: 8146783 - DNA, 20 bp, Homo sapiens
cacaggctatatgagagcca

SEQ ID NO: 8146784 - DNA, 20 bp, Homo sapiens
cacaggctatatgagagcca

SEQ ID NO: 8146785 - DNA, 20 bp, Homo sapiens
cacaggctatatgagagcca

SEQ ID NO: 8146786 - DNA, 20 bp, Homo sapiens
cacaggctatatgagagcca

SEQ ID NO: 8146787 - DNA, 19 bp, Homo sapiens
agcaggctaggctgcctct

SEQ ID NO: 8146788 - DNA, 19 bp, Homo sapiens
agcaggctaggctgcctct

SEQ ID NO: 8146789 - DNA, 22 bp, Homo sapiens
cacaggctccggccttgcagcc

SEQ ID NO: 8146790 - DNA, 22 bp, Homo sapiens
cacaggctccggccttgcagcc

SEQ ID NO: 8146791 - DNA, 22 bp, Homo sapiens
cacaggctccggccttgcagcc

SEQ ID NO: 8146792 - DNA, 22 bp, Homo sapiens
cacaggctccggccttgcagcc

SEQ ID NO: 8146793 - DNA, 22 bp, Homo sapiens
cacaggctccggccttgcagcc

SEQ ID NO: 8146794 - DNA, 18 bp, Homo sapiens
cacaggctcccagtgagg

SEQ ID NO: 8146795 - DNA, 18 bp, Homo sapiens
cacaggctcccagtgagg

SEQ ID NO: 8146796 - DNA, 20 bp, Homo sapiens
cacaggctatatgagagcca

SEQ ID NO: 8146797 - DNA, 18 bp, Homo sapiens
cacaggctcccagtgagg

SEQ ID NO: 8146798 - DNA, 20 bp, Homo sapiens
cacaggctatatgagagcca

SEQ ID NO: 8146799 - DNA, 22 bp, Homo sapiens
cactaaatgtttcaatgtggga

SEQ ID NO: 8146800 - DNA, 22 bp, Homo sapiens
cacggtggcccacaggtgcaag

SEQ ID NO: 8146801 - DNA, 22 bp, Homo sapiens
cacgggcagtgagcacagcctg

SEQ ID NO: 8146802 - DNA, 22 bp, Homo sapiens
cacatttaagtgcttgttcaga

SEQ ID NO: 8146803 - DNA, 22 bp, Homo sapiens
cacatttaagtgcttgttcaga

SEQ ID NO: 8146804 - DNA, 22 bp, Homo sapiens
cacatttaagtgcttgttcaga

SEQ ID NO: 8146805 - DNA, 22 bp, Homo sapiens
cacatttaagtgcttgttcaga

SEQ ID NO: 8146806 - DNA, 22 bp, Homo sapiens
cacatttaagtgcttgttcaga

SEQ ID NO: 8146807 - DNA, 22 bp, Homo sapiens
cacatttaagtgcttgttcaga

SEQ ID NO: 8146808 - DNA, 22 bp, Homo sapiens
cacatttaagcagatgtggacc

SEQ ID NO: 8146809 - DNA, 22 bp, Homo sapiens
cacatttaagtgcttgttcaga

SEQ ID NO: 8146810 - DNA, 22 bp, Homo sapiens
cacatttaatcctttataagta

SEQ ID NO: 8146811 - DNA, 22 bp, Homo sapiens
cacctgagtgtcagtattctca

SEQ ID NO: 8146812 - DNA, 22 bp, Homo sapiens
cacatttaatcctttataagta

SEQ ID NO: 8146813 - DNA, 22 bp, Homo sapiens
cacatttaatcctttataagta

SEQ ID NO: 8146814 - DNA, 22 bp, Homo sapiens
cacggcctgtaaggacccagga

SEQ ID NO: 8146815 - DNA, 22 bp, Homo sapiens
cacgggagacgtgatcttggac

SEQ ID NO: 8146816 - DNA, 21 bp, Homo sapiens
cacattgaatacagagatgga

SEQ ID NO: 8146817 - DNA, 22 bp, Homo sapiens
cacattgataattaaggcctcc

SEQ ID NO: 8146818 - DNA, 22 bp, Homo sapiens
cacattgattcagtcctgtgtg

SEQ ID NO: 8146819 - DNA, 22 bp, Homo sapiens
cacattgataattaaggcctcc

SEQ ID NO: 8146820 - DNA, 22 bp, Homo sapiens
cacatttaaaggttgaagctga

SEQ ID NO: 8146821 - DNA, 22 bp, Homo sapiens
cacatttaaaggttgaagctga

SEQ ID NO: 8146822 - DNA, 22 bp, Homo sapiens
cacatttaaaaaatccacgatc

SEQ ID NO: 8146823 - DNA, 22 bp, Homo sapiens
cacatttaaaaaatccacgatc

SEQ ID NO: 8146824 - DNA, 22 bp, Homo sapiens
cacatttaaaggttgaagctga

SEQ ID NO: 8146825 - DNA, 22 bp, Homo sapiens
cacatttaagcagatgtggacc

SEQ ID NO: 8146826 - DNA, 22 bp, Homo sapiens
cacatttaagcagatgtggacc

SEQ ID NO: 8146827 - DNA, 22 bp, Homo sapiens
cacatttaagcagatgtggacc

SEQ ID NO: 8146828 - DNA, 19 bp, Homo sapiens
cactaagatgagatatagc

SEQ ID NO: 8146829 - DNA, 22 bp, Homo sapiens
cactaattaacacgtcgtctct

SEQ ID NO: 8146830 - DNA, 22 bp, Homo sapiens
cactaagtcaacagcctctctt

SEQ ID NO: 8146831 - DNA, 22 bp, Homo sapiens
cactacaggggtccacagctga

SEQ ID NO: 8146832 - DNA, 22 bp, Homo sapiens
cactaattccatctccttttcc

SEQ ID NO: 8146833 - DNA, 22 bp, Homo sapiens
cactacaggggtccacagctga

SEQ ID NO: 8146834 - DNA, 22 bp, Homo sapiens
cactacagaatcaaatacgggc

SEQ ID NO: 8146835 - DNA, 22 bp, Homo sapiens
cactagaaaggtacagattatg

SEQ ID NO: 8146836 - DNA, 22 bp, Homo sapiens
cactagagaaacgcccaggctc

SEQ ID NO: 8146837 - DNA, 22 bp, Homo sapiens
cactagagaaacgcccaggctc

SEQ ID NO: 8146838 - DNA, 22 bp, Homo sapiens
cactaggctggagtgcagtggc

SEQ ID NO: 8146839 - DNA, 22 bp, Homo sapiens
agcaggtggacagaggaagaaa

SEQ ID NO: 8146840 - DNA, 22 bp, Homo sapiens
agcaggtggatttagacgggag

SEQ ID NO: 8146841 - DNA, 22 bp, Homo sapiens
agcaggtgggcatgaaagctga

SEQ ID NO: 8146842 - DNA, 22 bp, Homo sapiens
agcaggtgggatcaagctggca

SEQ ID NO: 8146843 - DNA, 22 bp, Homo sapiens
agcaggtgggatcaagctggca

SEQ ID NO: 8146844 - DNA, 22 bp, Homo sapiens
cactgaaatcgaaaaatgtagg

SEQ ID NO: 8146845 - DNA, 22 bp, Homo sapiens
agcaggtgggatcaagctggca

SEQ ID NO: 8146846 - DNA, 22 bp, Homo sapiens
agcaggtgggatcaagctggca

SEQ ID NO: 8146847 - DNA, 18 bp, Homo sapiens
agcaggtggcgtctgcag

SEQ ID NO: 8146848 - DNA, 18 bp, Homo sapiens
agcaggtggcgtctgcag

SEQ ID NO: 8146849 - DNA, 22 bp, Homo sapiens
agcaggtggcctcctgtctgtc

SEQ ID NO: 8146850 - DNA, 18 bp, Homo sapiens
agcaggtggcgtctgcag

SEQ ID NO: 8146851 - DNA, 22 bp, Homo sapiens
agcaggtggatttagacgggag

SEQ ID NO: 8146852 - DNA, 22 bp, Homo sapiens
agcaggtggatttagacgggag

SEQ ID NO: 8146853 - DNA, 22 bp, Homo sapiens
agcaggtggatttagacgggag

SEQ ID NO: 8146854 - DNA, 22 bp, Homo sapiens
agcaggtggccacgaggaggag

SEQ ID NO: 8146855 - DNA, 18 bp, Homo sapiens
agcaggtggatttattgg

SEQ ID NO: 8146856 - DNA, 18 bp, Homo sapiens
agcaggtggatttattgg

SEQ ID NO: 8146857 - DNA, 22 bp, Homo sapiens
agcaggtggcctcctgtctgtc

SEQ ID NO: 8146858 - DNA, 22 bp, Homo sapiens
agcaggtggcctcctgtctgtc

SEQ ID NO: 8146859 - DNA, 22 bp, Homo sapiens
agcaggtggcctcctgtctgtc

SEQ ID NO: 8146860 - DNA, 22 bp, Homo sapiens
agcaggtggccacgaggaggag

SEQ ID NO: 8146861 - DNA, 22 bp, Homo sapiens
agcaggtggccacgaggaggag

SEQ ID NO: 8146862 - DNA, 22 bp, Homo sapiens
agcaggtggccacgaggaggag

SEQ ID NO: 8146863 - DNA, 20 bp, Homo sapiens
cagaaagaaggtagattttt

SEQ ID NO: 8146864 - DNA, 20 bp, Homo sapiens
cagaaagaaggtagattttt

SEQ ID NO: 8146865 - DNA, 22 bp, Homo sapiens
cagaaactttggccctcaagcc

SEQ ID NO: 8146866 - DNA, 22 bp, Homo sapiens
cagaaacttttgatgagtgtat

SEQ ID NO: 8146867 - DNA, 22 bp, Homo sapiens
cagaaactttctttactgagca

SEQ ID NO: 8146868 - DNA, 21 bp, Homo sapiens
cagaaacttgctttgccttct

SEQ ID NO: 8146869 - DNA, 22 bp, Homo sapiens
cagaaacttctggtgtcaaata

SEQ ID NO: 8146870 - DNA, 22 bp, Homo sapiens
cagaaactgtggattcattaaa

SEQ ID NO: 8146871 - DNA, 22 bp, Homo sapiens
cagaaactgtttgttaatattt

SEQ ID NO: 8146872 - DNA, 22 bp, Homo sapiens
cagaaactatgtaagaaagtga

SEQ ID NO: 8146873 - DNA, 22 bp, Homo sapiens
cagaaactgctcccctggtagg

SEQ ID NO: 8146874 - DNA, 22 bp, Homo sapiens
cagaaactgcttgtggtcatct

SEQ ID NO: 8146875 - DNA, 22 bp, Homo sapiens
cagaaactagatttagacacaa

SEQ ID NO: 8146876 - DNA, 22 bp, Homo sapiens
cagaaagacctgattggcagtt

SEQ ID NO: 8146877 - DNA, 22 bp, Homo sapiens
cagaaagacctgattggcagtt

SEQ ID NO: 8146878 - DNA, 22 bp, Homo sapiens
cagaaagacctgggctcaagag

SEQ ID NO: 8146879 - DNA, 22 bp, Homo sapiens
cagaaagacctgggctcaagag

SEQ ID NO: 8146880 - DNA, 22 bp, Homo sapiens
cagaaagacctgggctcaagag

SEQ ID NO: 8146881 - DNA, 22 bp, Homo sapiens
agccaaaggcaccagagacact

SEQ ID NO: 8146882 - DNA, 22 bp, Homo sapiens
agccaaagatcagtgtgcaagt

SEQ ID NO: 8146883 - DNA, 22 bp, Homo sapiens
agccaaagagaccccatatcca

SEQ ID NO: 8146884 - DNA, 22 bp, Homo sapiens
agccaaagatcagtgtgcaagt

SEQ ID NO: 8146885 - DNA, 20 bp, Homo sapiens
agccaaaggagaacagtgct

SEQ ID NO: 8146886 - DNA, 20 bp, Homo sapiens
agccaaaggagaacagtgct

SEQ ID NO: 8146887 - DNA, 22 bp, Homo sapiens
cactgggcgtgtcctgggtgag

SEQ ID NO: 8146888 - DNA, 22 bp, Homo sapiens
cactgggcgtgtcctgggtgag

SEQ ID NO: 8146889 - DNA, 23 bp, Homo sapiens
cactgggcccagggtgtggaggc

SEQ ID NO: 8146890 - DNA, 22 bp, Homo sapiens
cactgggctttgtagttagcat

SEQ ID NO: 8146891 - DNA, 22 bp, Homo sapiens
cactggggaaaacaggcttctt

SEQ ID NO: 8146892 - DNA, 22 bp, Homo sapiens
cactggggaaaacaggcttctt

SEQ ID NO: 8146893 - DNA, 20 bp, Homo sapiens
cactgggctggagtcagggc

SEQ ID NO: 8146894 - DNA, 22 bp, Homo sapiens
cactgggctgataccaggcttc

SEQ ID NO: 8146895 - DNA, 22 bp, Homo sapiens
cactgggcaattctgagcctaa

SEQ ID NO: 8146896 - DNA, 22 bp, Homo sapiens
agccaaaacatgtgagttttga

SEQ ID NO: 8146897 - DNA, 22 bp, Homo sapiens
agcattttctgagagtatagat

SEQ ID NO: 8146898 - DNA, 22 bp, Homo sapiens
agcattttctgagagtatagat

SEQ ID NO: 8146899 - DNA, 22 bp, Homo sapiens
cactgggtaaatttgaggctga

SEQ ID NO: 8146900 - DNA, 22 bp, Homo sapiens
cactgggtaaatttgaggctga

SEQ ID NO: 8146901 - DNA, 23 bp, Homo sapiens
cactgggggctgctacagagagg

SEQ ID NO: 8146902 - DNA, 23 bp, Homo sapiens
cactgggggctgctacagagagg

SEQ ID NO: 8146903 - DNA, 23 bp, Homo sapiens
cactgggggctgctacagagagg

SEQ ID NO: 8146904 - DNA, 22 bp, Homo sapiens
cactggggtgggcctggtagag

SEQ ID NO: 8146905 - DNA, 22 bp, Homo sapiens
cactggggtgggcctggtagag

SEQ ID NO: 8146906 - DNA, 22 bp, Homo sapiens
cactggggtgggcctggtagag

SEQ ID NO: 8146907 - DNA, 22 bp, Homo sapiens
cactggggtgggcctggtagag

SEQ ID NO: 8146908 - DNA, 22 bp, Homo sapiens
cactggggtgggcctggtagag

SEQ ID NO: 8146909 - DNA, 22 bp, Homo sapiens
cactttgatttgtgatgtgaga

SEQ ID NO: 8146910 - DNA, 20 bp, Homo sapiens
cactttggacctgatgtatc

SEQ ID NO: 8146911 - DNA, 19 bp, Homo sapiens
cactggtcttctatttagg

SEQ ID NO: 8146912 - DNA, 22 bp, Homo sapiens
cactttgaagagctttttgaca

SEQ ID NO: 8146913 - DNA, 22 bp, Homo sapiens
cactgcactccagcctcggtga

SEQ ID NO: 8146914 - DNA, 22 bp, Homo sapiens
cactgcactccagcccgggcaa

SEQ ID NO: 8146915 - DNA, 22 bp, Homo sapiens
cactgcactccagcccgggcaa

SEQ ID NO: 8146916 - DNA, 22 bp, Homo sapiens
cactgcactccagcccgggcaa

SEQ ID NO: 8146917 - DNA, 22 bp, Homo sapiens
cactgcactccatcctgggaaa

SEQ ID NO: 8146918 - DNA, 22 bp, Homo sapiens
cactgcactccatcctgggaaa

SEQ ID NO: 8146919 - DNA, 22 bp, Homo sapiens
cactgcactccatcctgggaaa

SEQ ID NO: 8146920 - DNA, 22 bp, Homo sapiens
cactgcactccatcctgggaaa

SEQ ID NO: 8146921 - DNA, 22 bp, Homo sapiens
cactgcactccatcctgggaaa

SEQ ID NO: 8146922 - DNA, 22 bp, Homo sapiens
cactgcactccagcactccagc

SEQ ID NO: 8146923 - DNA, 22 bp, Homo sapiens
cactgcactccagcccgggcaa

SEQ ID NO: 8146924 - DNA, 22 bp, Homo sapiens
cactgcactccagcccgggcaa

SEQ ID NO: 8146925 - DNA, 22 bp, Homo sapiens
cactgcactccagcactccagc

SEQ ID NO: 8146926 - DNA, 22 bp, Homo sapiens
cactgcactccagcactccagc

SEQ ID NO: 8146927 - DNA, 22 bp, Homo sapiens
cactgcacaggtgagatgtggg

SEQ ID NO: 8146928 - DNA, 22 bp, Homo sapiens
cactgcaatatctgcatcctgg

SEQ ID NO: 8146929 - DNA, 22 bp, Homo sapiens
cactgcaagctctgccacctgg

SEQ ID NO: 8146930 - DNA, 22 bp, Homo sapiens
cactgcaagcaagctccgcctc

SEQ ID NO: 8146931 - DNA, 22 bp, Homo sapiens
cactgcaagctccgcctcccgg

SEQ ID NO: 8146932 - DNA, 22 bp, Homo sapiens
cactgcaacctccgcctaccgg

SEQ ID NO: 8146933 - DNA, 22 bp, Homo sapiens
cactgcaacctctgccacctgg

SEQ ID NO: 8146934 - DNA, 22 bp, Homo sapiens
cactgcaacctccagctctcag

SEQ ID NO: 8146935 - DNA, 22 bp, Homo sapiens
cactgcaacctccagctctcag

SEQ ID NO: 8146936 - DNA, 22 bp, Homo sapiens
cactgcaacctccatcttctgg

SEQ ID NO: 8146937 - DNA, 22 bp, Homo sapiens
cactgcaacctccacctcctgg

SEQ ID NO: 8146938 - DNA, 22 bp, Homo sapiens
cactgcaacctccacctcctgg

SEQ ID NO: 8146939 - DNA, 22 bp, Homo sapiens
cactgcaacctccacctcctgg

SEQ ID NO: 8146940 - DNA, 22 bp, Homo sapiens
cactgcaacctccacctcctgg

SEQ ID NO: 8146941 - DNA, 22 bp, Homo sapiens
agcatttatttcttagaaattg

SEQ ID NO: 8146942 - DNA, 22 bp, Homo sapiens
agcatttattgagtgccctggg

SEQ ID NO: 8146943 - DNA, 22 bp, Homo sapiens
agcatttatttcttagaaattg

SEQ ID NO: 8146944 - DNA, 22 bp, Homo sapiens
agcatttatttcttagaaattg

SEQ ID NO: 8146945 - DNA, 22 bp, Homo sapiens
agcatttatgactaatgtaaaa

SEQ ID NO: 8146946 - DNA, 22 bp, Homo sapiens
agcatttattgagtgccctggg

SEQ ID NO: 8146947 - DNA, 22 bp, Homo sapiens
agcatttattgacctgctgctg

SEQ ID NO: 8146948 - DNA, 22 bp, Homo sapiens
agcatttattgacctgctgctg

SEQ ID NO: 8146949 - DNA, 22 bp, Homo sapiens
agcatttatgactaatgtaaaa

SEQ ID NO: 8146950 - DNA, 22 bp, Homo sapiens
agcatttatcttttgtttgagt

SEQ ID NO: 8146951 - DNA, 22 bp, Homo sapiens
agcatttatcttttgtttgagt

SEQ ID NO: 8146952 - DNA, 22 bp, Homo sapiens
agcatttatagataccctatgg

SEQ ID NO: 8146953 - DNA, 22 bp, Homo sapiens
agcatttatagcccctatcatc

SEQ ID NO: 8146954 - DNA, 22 bp, Homo sapiens
agcatttagtctttattgcagc

SEQ ID NO: 8146955 - DNA, 22 bp, Homo sapiens
agcatttaggagaatttgagaa

SEQ ID NO: 8146956 - DNA, 22 bp, Homo sapiens
agcatttagttagtaaatgttt

SEQ ID NO: 8146957 - DNA, 22 bp, Homo sapiens
agcatttagttagtaaatgttt

SEQ ID NO: 8146958 - DNA, 22 bp, Homo sapiens
agcatttagtctttattgcagc

SEQ ID NO: 8146959 - DNA, 22 bp, Homo sapiens
cactgcacttcagcctgggtga

SEQ ID NO: 8146960 - DNA, 22 bp, Homo sapiens
cactgcacttcagcctgggtga

SEQ ID NO: 8146961 - DNA, 22 bp, Homo sapiens
cactgcacttcagcctgggtga

SEQ ID NO: 8146962 - DNA, 22 bp, Homo sapiens
cactgcacttcagcctgggtga

SEQ ID NO: 8146963 - DNA, 22 bp, Homo sapiens
cactgcacttcagcctgggtga

SEQ ID NO: 8146964 - DNA, 22 bp, Homo sapiens
agcattatggtatagtcccata

SEQ ID NO: 8146965 - DNA, 22 bp, Homo sapiens
cactgcacttcagcctgggtga

SEQ ID NO: 8146966 - DNA, 20 bp, Homo sapiens
agcatttagcctttatccac

SEQ ID NO: 8146967 - DNA, 22 bp, Homo sapiens
agcatttaggagaatttgagaa

SEQ ID NO: 8146968 - DNA, 20 bp, Homo sapiens
agcatttagcctttatccac

SEQ ID NO: 8146969 - DNA, 22 bp, Homo sapiens
agcatttaggagaatttgagaa

SEQ ID NO: 8146970 - DNA, 22 bp, Homo sapiens
agcattatgtccatgctaaatt

SEQ ID NO: 8146971 - DNA, 22 bp, Homo sapiens
atgctgaattgatgcgagggag

SEQ ID NO: 8146972 - DNA, 22 bp, Homo sapiens
atgctgaagagtgcacaggcta

SEQ ID NO: 8146973 - DNA, 22 bp, Homo sapiens
atgcttaggttaaatttgtaat

SEQ ID NO: 8146974 - DNA, 18 bp, Homo sapiens
atgctgccctctgagggt

SEQ ID NO: 8146975 - DNA, 19 bp, Homo sapiens
atgctgcatatggttttct

SEQ ID NO: 8146976 - DNA, 22 bp, Homo sapiens
atgctgcagctgcaggatcaga

SEQ ID NO: 8146977 - DNA, 19 bp, Homo sapiens
atgctgcatatggttttct

SEQ ID NO: 8146978 - DNA, 22 bp, Homo sapiens
atgctgattttatagaataaag

SEQ ID NO: 8146979 - DNA, 22 bp, Homo sapiens
atgctgcacaagccacatgtag

SEQ ID NO: 8146980 - DNA, 22 bp, Homo sapiens
atgctgcagctgcaggatcaga

SEQ ID NO: 8146981 - DNA, 22 bp, Homo sapiens
atgctgagatcctcaggccaga

SEQ ID NO: 8146982 - DNA, 22 bp, Homo sapiens
atgctgaggacaaagagatcaa

SEQ ID NO: 8146983 - DNA, 22 bp, Homo sapiens
atgctgataactttcagtgaca

SEQ ID NO: 8146984 - DNA, 22 bp, Homo sapiens
atgctgaggtgtgtttaattta

SEQ ID NO: 8146985 - DNA, 22 bp, Homo sapiens
atgctgagactggagcagctgg

SEQ ID NO: 8146986 - DNA, 22 bp, Homo sapiens
atgctgagactggagcagctgg

SEQ ID NO: 8146987 - DNA, 22 bp, Homo sapiens
atgctgagataaggctttagtc

SEQ ID NO: 8146988 - DNA, 22 bp, Homo sapiens
atgctgagactggagcagctgg

SEQ ID NO: 8146989 - DNA, 22 bp, Homo sapiens
atgctgagatcctcaggccaga

SEQ ID NO: 8146990 - DNA, 22 bp, Homo sapiens
agagaacacgtgcatctgcaat

SEQ ID NO: 8146991 - DNA, 22 bp, Homo sapiens
agagaacagacagatgcaatga

SEQ ID NO: 8146992 - DNA, 22 bp, Homo sapiens
agagaacaaattaaaggtggtt

SEQ ID NO: 8146993 - DNA, 22 bp, Homo sapiens
agagaaacaggtcagctgggag

SEQ ID NO: 8146994 - DNA, 22 bp, Homo sapiens
atgcttcttgtatttggctgac

SEQ ID NO: 8146995 - DNA, 23 bp, Homo sapiens
atgcttccacagagcttgcagcc

SEQ ID NO: 8146996 - DNA, 22 bp, Homo sapiens
atgcttccactgttctgctctc

SEQ ID NO: 8146997 - DNA, 22 bp, Homo sapiens
atgcttccctttgctccacatg

SEQ ID NO: 8146998 - DNA, 22 bp, Homo sapiens
atgcttcctaaccatggccgtg

SEQ ID NO: 8146999 - DNA, 22 bp, Homo sapiens
atgcttccctcacatatcctgg

SEQ ID NO: 8147000 - DNA, 20 bp, Homo sapiens
atgcttccagggtgtgtctg

SEQ ID NO: 8147001 - DNA, 22 bp, Homo sapiens
atgcttcctcccttccactcaa

SEQ ID NO: 8147002 - DNA, 22 bp, Homo sapiens
atgcttcctctacggcctctga

SEQ ID NO: 8147003 - DNA, 22 bp, Homo sapiens
atgccacttcattccagcctcg

SEQ ID NO: 8147004 - DNA, 22 bp, Homo sapiens
atgccactgcactccagcctag

SEQ ID NO: 8147005 - DNA, 22 bp, Homo sapiens
atgccagaaggcagaatttatc

SEQ ID NO: 8147006 - DNA, 22 bp, Homo sapiens
atgccagaaggcagaatttatc

SEQ ID NO: 8147007 - DNA, 22 bp, Homo sapiens
atgccagaaaatgatggctgca

SEQ ID NO: 8147008 - DNA, 22 bp, Homo sapiens
atgccaggaacaaacagtggtg

SEQ ID NO: 8147009 - DNA, 22 bp, Homo sapiens
atgccaggagatggagcagagt

SEQ ID NO: 8147010 - DNA, 22 bp, Homo sapiens
atgccaggaacaaacagtggtg

SEQ ID NO: 8147011 - DNA, 22 bp, Homo sapiens
atgccaggaacaaacagtggtg

SEQ ID NO: 8147012 - DNA, 22 bp, Homo sapiens
atgccaggctgtttggcctcag

SEQ ID NO: 8147013 - DNA, 22 bp, Homo sapiens
atgcaaattgccataaagtggg

SEQ ID NO: 8147014 - DNA, 22 bp, Homo sapiens
atgcaacagagaaaatattgag

SEQ ID NO: 8147015 - DNA, 22 bp, Homo sapiens
agacatagataggcactgattg

SEQ ID NO: 8147016 - DNA, 22 bp, Homo sapiens
agacatagactttctactgtgt

SEQ ID NO: 8147017 - DNA, 22 bp, Homo sapiens
agacatagactttctactgtgt

SEQ ID NO: 8147018 - DNA, 22 bp, Homo sapiens
agacataagtgctatgacattg

SEQ ID NO: 8147019 - DNA, 22 bp, Homo sapiens
agacataagtgctatgacattg

SEQ ID NO: 8147020 - DNA, 22 bp, Homo sapiens
agacataagccagtcactcact

SEQ ID NO: 8147021 - DNA, 22 bp, Homo sapiens
agacagttgatatactataaaa

SEQ ID NO: 8147022 - DNA, 22 bp, Homo sapiens
agacagttgatatactataaaa

SEQ ID NO: 8147023 - DNA, 22 bp, Homo sapiens
agacagtgtgtgtatatatggt

SEQ ID NO: 8147024 - DNA, 22 bp, Homo sapiens
agacataaacttactgaaatac

SEQ ID NO: 8147025 - DNA, 22 bp, Homo sapiens
agacagtggatcgggatgcact

SEQ ID NO: 8147026 - DNA, 22 bp, Homo sapiens
agacagtgctatcccatctgtg

SEQ ID NO: 8147027 - DNA, 22 bp, Homo sapiens
atgccattgctttaaaattaag

SEQ ID NO: 8147028 - DNA, 22 bp, Homo sapiens
atgccagggtcatcccctgggt

SEQ ID NO: 8147029 - DNA, 22 bp, Homo sapiens
atgccagggtcccttcagagat

SEQ ID NO: 8147030 - DNA, 23 bp, Homo sapiens
atgccaggctgcctggccagcct

SEQ ID NO: 8147031 - DNA, 22 bp, Homo sapiens
atgccaggctgtttggcctcag

SEQ ID NO: 8147032 - DNA, 22 bp, Homo sapiens
atgccagggtcatcccctgggt

SEQ ID NO: 8147033 - DNA, 22 bp, Homo sapiens
atgccaggtacaggggtagggt

SEQ ID NO: 8147034 - DNA, 22 bp, Homo sapiens
atgactcagaagatattttcca

SEQ ID NO: 8147035 - DNA, 22 bp, Homo sapiens
atgacccttactgcatcataca

SEQ ID NO: 8147036 - DNA, 22 bp, Homo sapiens
atgaccagccgagataaacaga

SEQ ID NO: 8147037 - DNA, 22 bp, Homo sapiens
atgaccagccgagataaacaga

SEQ ID NO: 8147038 - DNA, 22 bp, Homo sapiens
atgaccagtgttgctggccccg

SEQ ID NO: 8147039 - DNA, 22 bp, Homo sapiens
atgacattgacagacctgctgc

SEQ ID NO: 8147040 - DNA, 22 bp, Homo sapiens
atgacatttatacagtgagctt

SEQ ID NO: 8147041 - DNA, 22 bp, Homo sapiens
atcttagaagtttgataaaatc

SEQ ID NO: 8147042 - DNA, 22 bp, Homo sapiens
atcttagagagtcgtgttttgt

SEQ ID NO: 8147043 - DNA, 22 bp, Homo sapiens
atgacaatacttcaataagctg

SEQ ID NO: 8147044 - DNA, 22 bp, Homo sapiens
atcttaaacagaggaatgactt

SEQ ID NO: 8147045 - DNA, 22 bp, Homo sapiens
atcttacaattacaagacactc

SEQ ID NO: 8147046 - DNA, 22 bp, Homo sapiens
atcttaatcgagtccatgaaaa

SEQ ID NO: 8147047 - DNA, 19 bp, Homo sapiens
atcttacagagcagagtac

SEQ ID NO: 8147048 - DNA, 22 bp, Homo sapiens
atcttacacgataactgttagt

SEQ ID NO: 8147049 - DNA, 22 bp, Homo sapiens
atctggggcctgggctagccat

SEQ ID NO: 8147050 - DNA, 22 bp, Homo sapiens
atctggggccccggaagttcct

SEQ ID NO: 8147051 - DNA, 22 bp, Homo sapiens
atctgggttcaccatgctcctg

SEQ ID NO: 8147052 - DNA, 23 bp, Homo sapiens
atctgttgtgcctcttatatgta

SEQ ID NO: 8147053 - DNA, 22 bp, Homo sapiens
atctgttgtttttcaccaccca

SEQ ID NO: 8147054 - DNA, 21 bp, Homo sapiens
atcttaaaaggtcttaacttt

SEQ ID NO: 8147055 - DNA, 22 bp, Homo sapiens
atcttaaacagaggaatgactt

SEQ ID NO: 8147056 - DNA, 22 bp, Homo sapiens
atctgggcgtataggtgcaagt

SEQ ID NO: 8147057 - DNA, 22 bp, Homo sapiens
atctgggagcggaggttgcagt

SEQ ID NO: 8147058 - DNA, 22 bp, Homo sapiens
atctgggagtcttggctctgct

SEQ ID NO: 8147059 - DNA, 22 bp, Homo sapiens
atctgggagacccttgcgggaa

SEQ ID NO: 8147060 - DNA, 22 bp, Homo sapiens
atctgggagacccttgcgggaa

SEQ ID NO: 8147061 - DNA, 22 bp, Homo sapiens
atctggcttgggtgtgggtagc

SEQ ID NO: 8147062 - DNA, 22 bp, Homo sapiens
atctggcttttaccccacggcc

SEQ ID NO: 8147063 - DNA, 22 bp, Homo sapiens
atgattgaaaatgacattgcca

SEQ ID NO: 8147064 - DNA, 22 bp, Homo sapiens
atgattgaaaatgacattgcca

SEQ ID NO: 8147065 - DNA, 22 bp, Homo sapiens
atgattctggcaaatttattat

SEQ ID NO: 8147066 - DNA, 20 bp, Homo sapiens
atgattctgggctacactgg

SEQ ID NO: 8147067 - DNA, 22 bp, Homo sapiens
atgattcagggagttttcagga

SEQ ID NO: 8147068 - DNA, 22 bp, Homo sapiens
atgatatatgtgttgagcttgc

SEQ ID NO: 8147069 - DNA, 22 bp, Homo sapiens
atgattctctgctactctaaat

SEQ ID NO: 8147070 - DNA, 22 bp, Homo sapiens
atgattctcattttataaactt

SEQ ID NO: 8147071 - DNA, 22 bp, Homo sapiens
atgattctcattttactgtgat

SEQ ID NO: 8147072 - DNA, 22 bp, Homo sapiens
atgcaaatgctagagaatgttg

SEQ ID NO: 8147073 - DNA, 22 bp, Homo sapiens
atgcaaattaacatatagtaga

SEQ ID NO: 8147074 - DNA, 22 bp, Homo sapiens
atgcaaatgtcaccacttctaa

SEQ ID NO: 8147075 - DNA, 22 bp, Homo sapiens
atgattgaccatctgctgggct

SEQ ID NO: 8147076 - DNA, 22 bp, Homo sapiens
atgatttccagttgttgctaag

SEQ ID NO: 8147077 - DNA, 22 bp, Homo sapiens
atgatttaaagtcattgtgaac

SEQ ID NO: 8147078 - DNA, 22 bp, Homo sapiens
atgatttaaagtcattgtgaac

SEQ ID NO: 8147079 - DNA, 22 bp, Homo sapiens
atgaggaagtctgataatggta

SEQ ID NO: 8147080 - DNA, 22 bp, Homo sapiens
atgagaaagagttgtatctaga

SEQ ID NO: 8147081 - DNA, 22 bp, Homo sapiens
atgaggagaccaaggcctgatg

SEQ ID NO: 8147082 - DNA, 22 bp, Homo sapiens
atgagaaaattcattccatcca

SEQ ID NO: 8147083 - DNA, 22 bp, Homo sapiens
atgacttcgttttctctctgca

SEQ ID NO: 8147084 - DNA, 22 bp, Homo sapiens
atgacttattacaagtcatatt

SEQ ID NO: 8147085 - DNA, 22 bp, Homo sapiens
atgacttctgctttacagagtt

SEQ ID NO: 8147086 - DNA, 22 bp, Homo sapiens
atgactttcctggcaaaagttg

SEQ ID NO: 8147087 - DNA, 22 bp, Homo sapiens
atgaggcaaaggtggaggtggg

SEQ ID NO: 8147088 - DNA, 22 bp, Homo sapiens
atgaggcaaaggtggaggtggg

SEQ ID NO: 8147089 - DNA, 22 bp, Homo sapiens
atgaggcaaggatcaggtaagg

SEQ ID NO: 8147090 - DNA, 22 bp, Homo sapiens
atgaggcaaggctggccgtgtt

SEQ ID NO: 8147091 - DNA, 22 bp, Homo sapiens
atgaggcaaggctggccgtgtt

SEQ ID NO: 8147092 - DNA, 22 bp, Homo sapiens
atgaggcacatcacagccaatg

SEQ ID NO: 8147093 - DNA, 22 bp, Homo sapiens
atgaggcacatcacagccaatg

SEQ ID NO: 8147094 - DNA, 22 bp, Homo sapiens
atgatatatgtgttgagcttgc

SEQ ID NO: 8147095 - DNA, 22 bp, Homo sapiens
atgatatagagagtagattaaa

SEQ ID NO: 8147096 - DNA, 22 bp, Homo sapiens
atgatatagagagtagattaaa

SEQ ID NO: 8147097 - DNA, 22 bp, Homo sapiens
atgatatagagagtagattaaa

SEQ ID NO: 8147098 - DNA, 22 bp, Homo sapiens
atgaggcacgtgttactggcct

SEQ ID NO: 8147099 - DNA, 22 bp, Homo sapiens
atgaggcaatagaatattgaat

SEQ ID NO: 8147100 - DNA, 22 bp, Homo sapiens
atgaggcaatcatggtccagtt

SEQ ID NO: 8147101 - DNA, 22 bp, Homo sapiens
atgaggcacagagatgttaatg

SEQ ID NO: 8147102 - DNA, 22 bp, Homo sapiens
atgaggcacagagatgttaatg

SEQ ID NO: 8147103 - DNA, 22 bp, Homo sapiens
atgaggcaatcatggtccagtt

SEQ ID NO: 8147104 - DNA, 22 bp, Homo sapiens
atgggctctatgtctaggagat

SEQ ID NO: 8147105 - DNA, 22 bp, Homo sapiens
atgggctcggcgctgctgggat

SEQ ID NO: 8147106 - DNA, 22 bp, Homo sapiens
atgggctcggcgctgctgggat

SEQ ID NO: 8147107 - DNA, 22 bp, Homo sapiens
agagactgtacgtggcaagtat

SEQ ID NO: 8147108 - DNA, 22 bp, Homo sapiens
agagactgtacgtggcaagtat

SEQ ID NO: 8147109 - DNA, 22 bp, Homo sapiens
agagactggcttctaaaatggc

SEQ ID NO: 8147110 - DNA, 22 bp, Homo sapiens
agagactggcttctaaaatggc

SEQ ID NO: 8147111 - DNA, 22 bp, Homo sapiens
agagactggagttacgagttca

SEQ ID NO: 8147112 - DNA, 21 bp, Homo sapiens
atgtagggtttgccttctcta

SEQ ID NO: 8147113 - DNA, 21 bp, Homo sapiens
atgtagggtttgccttctcta

SEQ ID NO: 8147114 - DNA, 22 bp, Homo sapiens
atgtacatagcatcatctagga

SEQ ID NO: 8147115 - DNA, 22 bp, Homo sapiens
atgtacatactgcattttcaaa

SEQ ID NO: 8147116 - DNA, 22 bp, Homo sapiens
atgtacatactgcattttcaaa

SEQ ID NO: 8147117 - DNA, 22 bp, Homo sapiens
atgtacatagcatcatctagga

SEQ ID NO: 8147118 - DNA, 22 bp, Homo sapiens
atgtacatagcatcatctagga

SEQ ID NO: 8147119 - DNA, 22 bp, Homo sapiens
atgtacatagcatcatctagga

SEQ ID NO: 8147120 - DNA, 22 bp, Homo sapiens
agagactgtgtccatcgtgcct

SEQ ID NO: 8147121 - DNA, 22 bp, Homo sapiens
atgtataagtacacagtcggaa

SEQ ID NO: 8147122 - DNA, 22 bp, Homo sapiens
atgtagtatttggaaatgtaaa

SEQ ID NO: 8147123 - DNA, 22 bp, Homo sapiens
atgtagtgccctttgtcatcta

SEQ ID NO: 8147124 - DNA, 22 bp, Homo sapiens
atgtagtatctatatttcatgg

SEQ ID NO: 8147125 - DNA, 22 bp, Homo sapiens
atgtagtactgggtatgtttct

SEQ ID NO: 8147126 - DNA, 22 bp, Homo sapiens
atgtagtagttcacattctgtt

SEQ ID NO: 8147127 - DNA, 22 bp, Homo sapiens
atgtagtactgggtatgtttct

SEQ ID NO: 8147128 - DNA, 22 bp, Homo sapiens
atgtatatgaagctagtatttt

SEQ ID NO: 8147129 - DNA, 22 bp, Homo sapiens
atgtatatacttacatgtgtgg

SEQ ID NO: 8147130 - DNA, 22 bp, Homo sapiens
atgtatatacttacatgtgtgg

SEQ ID NO: 8147131 - DNA, 22 bp, Homo sapiens
atgtatatgaagctagtatttt

SEQ ID NO: 8147132 - DNA, 22 bp, Homo sapiens
atgtatatgaagctagtatttt

SEQ ID NO: 8147133 - DNA, 22 bp, Homo sapiens
atgtataatgctaattagctag

SEQ ID NO: 8147134 - DNA, 22 bp, Homo sapiens
atgtataatgctaattagctag

SEQ ID NO: 8147135 - DNA, 22 bp, Homo sapiens
atgtataatgctaattagctag

SEQ ID NO: 8147136 - DNA, 22 bp, Homo sapiens
atgtataatgctaattagctag

SEQ ID NO: 8147137 - DNA, 22 bp, Homo sapiens
atgtatacgtgcaggtcacagg

SEQ ID NO: 8147138 - DNA, 22 bp, Homo sapiens
atgtatagtggtgatgattaca

SEQ ID NO: 8147139 - DNA, 22 bp, Homo sapiens
agagatgggcgggggcttctgc

SEQ ID NO: 8147140 - DNA, 22 bp, Homo sapiens
agagatgggcgggggcttctgc

SEQ ID NO: 8147141 - DNA, 20 bp, Homo sapiens
agagatggggtatcaccgta

SEQ ID NO: 8147142 - DNA, 22 bp, Homo sapiens
agagatggtagaacagtcataa

SEQ ID NO: 8147143 - DNA, 18 bp, Homo sapiens
agagatgggagttggaaa

SEQ ID NO: 8147144 - DNA, 18 bp, Homo sapiens
agagatgggagttggaaa

SEQ ID NO: 8147145 - DNA, 22 bp, Homo sapiens
agagatgggaaggcagacttca

SEQ ID NO: 8147146 - DNA, 22 bp, Homo sapiens
agagatgggaaggcagacttca

SEQ ID NO: 8147147 - DNA, 22 bp, Homo sapiens
agagatgggaaggcagacttca

SEQ ID NO: 8147148 - DNA, 22 bp, Homo sapiens
atgtatatgcatgcattcaaag

SEQ ID NO: 8147149 - DNA, 17 bp, Homo sapiens
atgtatattaactctga

SEQ ID NO: 8147150 - DNA, 22 bp, Homo sapiens
atgtatatgtgaaagatgttta

SEQ ID NO: 8147151 - DNA, 22 bp, Homo sapiens
atgtatatgtgtgcacgcacag

SEQ ID NO: 8147152 - DNA, 22 bp, Homo sapiens
atgtatatgtgaaagatgttta

SEQ ID NO: 8147153 - DNA, 22 bp, Homo sapiens
atgtatatgcatgcattcaaag

SEQ ID NO: 8147154 - DNA, 22 bp, Homo sapiens
atgtatatgcatgcattcaaag

SEQ ID NO: 8147155 - DNA, 22 bp, Homo sapiens
agagatggcgtctcagagcctg

SEQ ID NO: 8147156 - DNA, 22 bp, Homo sapiens
agagatggcgtctcagagcctg

SEQ ID NO: 8147157 - DNA, 22 bp, Homo sapiens
agagatggcgtctcagagcctg

SEQ ID NO: 8147158 - DNA, 22 bp, Homo sapiens
agagatggcgtctcagagcctg

SEQ ID NO: 8147159 - DNA, 20 bp, Homo sapiens
atgtatattactggctgtga

SEQ ID NO: 8147160 - DNA, 20 bp, Homo sapiens
atgtatattactggctgtga

SEQ ID NO: 8147161 - DNA, 17 bp, Homo sapiens
atgtatattaactctga

SEQ ID NO: 8147162 - DNA, 22 bp, Homo sapiens
atggacacatgagttacgattg

SEQ ID NO: 8147163 - DNA, 22 bp, Homo sapiens
atggaatttggagattaggcat

SEQ ID NO: 8147164 - DNA, 22 bp, Homo sapiens
atggacaaacagcaggttttgg

SEQ ID NO: 8147165 - DNA, 22 bp, Homo sapiens
atggaattgagcatcagttgtt

SEQ ID NO: 8147166 - DNA, 22 bp, Homo sapiens
atggaattaataggggaatact

SEQ ID NO: 8147167 - DNA, 22 bp, Homo sapiens
atggaattaaaagtcaagtaat

SEQ ID NO: 8147168 - DNA, 22 bp, Homo sapiens
atggacagcaactggaagcttc

SEQ ID NO: 8147169 - DNA, 22 bp, Homo sapiens
agagaacattagcaaaaacagc

SEQ ID NO: 8147170 - DNA, 22 bp, Homo sapiens
agagaacattagcaaaaacagc

SEQ ID NO: 8147171 - DNA, 22 bp, Homo sapiens
agagaacatgacgtaatagtgg

SEQ ID NO: 8147172 - DNA, 22 bp, Homo sapiens
agagaagacttacagccacagt

SEQ ID NO: 8147173 - DNA, 22 bp, Homo sapiens
agagaactgtttctggggtctt

SEQ ID NO: 8147174 - DNA, 22 bp, Homo sapiens
agagaacatattttgtatgatt

SEQ ID NO: 8147175 - DNA, 22 bp, Homo sapiens
agagaacagtgttttgaaggag

SEQ ID NO: 8147176 - DNA, 22 bp, Homo sapiens
agagaacatgacgtaatagtgg

SEQ ID NO: 8147177 - DNA, 22 bp, Homo sapiens
atgggcagttaggaggccagga

SEQ ID NO: 8147178 - DNA, 21 bp, Homo sapiens
atgggccagggatacagagag

SEQ ID NO: 8147179 - DNA, 16 bp, Homo sapiens
atgggcagtgaggaag

SEQ ID NO: 8147180 - DNA, 22 bp, Homo sapiens
atgggcagtgtattggaaggaa

SEQ ID NO: 8147181 - DNA, 22 bp, Homo sapiens
atgggcagttaggaggccagga

SEQ ID NO: 8147182 - DNA, 22 bp, Homo sapiens
atgggcagttaggaggccagga

SEQ ID NO: 8147183 - DNA, 22 bp, Homo sapiens
atggacaggtactgcagtgggt

SEQ ID NO: 8147184 - DNA, 22 bp, Homo sapiens
atggacaggtactgcagtgggt

SEQ ID NO: 8147185 - DNA, 22 bp, Homo sapiens
atgggcagtaacagtggcagtc

SEQ ID NO: 8147186 - DNA, 18 bp, Homo sapiens
atgggaggggccaagaga

SEQ ID NO: 8147187 - DNA, 18 bp, Homo sapiens
atgggaggggccaagaga

SEQ ID NO: 8147188 - DNA, 22 bp, Homo sapiens
atgggcagtaacagtggcagtc

SEQ ID NO: 8147189 - DNA, 22 bp, Homo sapiens
atggacaggtggataggtggat

SEQ ID NO: 8147190 - DNA, 22 bp, Homo sapiens
atggacaggtggataggtggat

SEQ ID NO: 8147191 - DNA, 22 bp, Homo sapiens
attaaggattatactctccttt

SEQ ID NO: 8147192 - DNA, 22 bp, Homo sapiens
attaaggaggtaaactatggtt

SEQ ID NO: 8147193 - DNA, 22 bp, Homo sapiens
attaaggagggctgggcatgat

SEQ ID NO: 8147194 - DNA, 18 bp, Homo sapiens
attaaggaattctttaga

SEQ ID NO: 8147195 - DNA, 22 bp, Homo sapiens
attaaggaagcctattctctcc

SEQ ID NO: 8147196 - DNA, 22 bp, Homo sapiens
attaaggaatgtaggcaagaag

SEQ ID NO: 8147197 - DNA, 22 bp, Homo sapiens
attaagtgactaaagtaatgct

SEQ ID NO: 8147198 - DNA, 22 bp, Homo sapiens
agagctcagtgtgttatggtta

SEQ ID NO: 8147199 - DNA, 22 bp, Homo sapiens
agagctcaagacgctcacagta

SEQ ID NO: 8147200 - DNA, 22 bp, Homo sapiens
agagctctcaatggtcaatgct

SEQ ID NO: 8147201 - DNA, 22 bp, Homo sapiens
attaaatactgcaggctaagca

SEQ ID NO: 8147202 - DNA, 22 bp, Homo sapiens
attaaatactgcaggctaagca

SEQ ID NO: 8147203 - DNA, 22 bp, Homo sapiens
attaaggaagcctattctctcc

SEQ ID NO: 8147204 - DNA, 22 bp, Homo sapiens
attaaggaacaaagccttttga

SEQ ID NO: 8147205 - DNA, 22 bp, Homo sapiens
attaagctggtccagacaagtt

SEQ ID NO: 8147206 - DNA, 22 bp, Homo sapiens
attaaatactgcaggctaagca

SEQ ID NO: 8147207 - DNA, 22 bp, Homo sapiens
agagctctgtgtctctttgggt

SEQ ID NO: 8147208 - DNA, 22 bp, Homo sapiens
agagctctgtgtctctttgggt

SEQ ID NO: 8147209 - DNA, 22 bp, Homo sapiens
agagctctcttcataacggcct

SEQ ID NO: 8147210 - DNA, 22 bp, Homo sapiens
agagctctgcagctggcctcag

SEQ ID NO: 8147211 - DNA, 22 bp, Homo sapiens
agagccttgcctggggccctgt

SEQ ID NO: 8147212 - DNA, 22 bp, Homo sapiens
agagctaagaaacagaattgct

SEQ ID NO: 8147213 - DNA, 22 bp, Homo sapiens
agagctaagaaacagaattgct

SEQ ID NO: 8147214 - DNA, 22 bp, Homo sapiens
atgttctacagatggaaagggg

SEQ ID NO: 8147215 - DNA, 22 bp, Homo sapiens
atgttctacagatggaaagggg

SEQ ID NO: 8147216 - DNA, 22 bp, Homo sapiens
agagcctgttttgtgggagatg

SEQ ID NO: 8147217 - DNA, 22 bp, Homo sapiens
atgttctatatcattattgtga

SEQ ID NO: 8147218 - DNA, 19 bp, Homo sapiens
atgttctatcctccaagtt

SEQ ID NO: 8147219 - DNA, 22 bp, Homo sapiens
atgttctatatcattattgtga

SEQ ID NO: 8147220 - DNA, 22 bp, Homo sapiens
atgttcatctacaaggcattgt

SEQ ID NO: 8147221 - DNA, 22 bp, Homo sapiens
atgttcattagtcaacatttct

SEQ ID NO: 8147222 - DNA, 22 bp, Homo sapiens
agagattctgtgtcaaaacgaa

SEQ ID NO: 8147223 - DNA, 22 bp, Homo sapiens
atgtcttgatattttactgttt

SEQ ID NO: 8147224 - DNA, 22 bp, Homo sapiens
atgtgagtgctatgatagacag

SEQ ID NO: 8147225 - DNA, 22 bp, Homo sapiens
atgtgatactccttctagtgga

SEQ ID NO: 8147226 - DNA, 22 bp, Homo sapiens
atgtgagtgtatacttacgtgt

SEQ ID NO: 8147227 - DNA, 21 bp, Homo sapiens
atgtgattatatgacttttac

SEQ ID NO: 8147228 - DNA, 22 bp, Homo sapiens
atgtgatcaagaatgtgggaga

SEQ ID NO: 8147229 - DNA, 22 bp, Homo sapiens
atgtgattcccactgaatcact

SEQ ID NO: 8147230 - DNA, 18 bp, Homo sapiens
agagatggtgtagagttt

SEQ ID NO: 8147231 - DNA, 18 bp, Homo sapiens
agagatggtgtagagttt

SEQ ID NO: 8147232 - DNA, 18 bp, Homo sapiens
agagatggtgtagagttt

SEQ ID NO: 8147233 - DNA, 22 bp, Homo sapiens
agagatggtagaacagtcataa

SEQ ID NO: 8147234 - DNA, 18 bp, Homo sapiens
agagatggtgtagagttt

SEQ ID NO: 8147235 - DNA, 22 bp, Homo sapiens
agagatgtcgccttgcccaggg

SEQ ID NO: 8147236 - DNA, 22 bp, Homo sapiens
agagatgttcattcagcatgtt

SEQ ID NO: 8147237 - DNA, 22 bp, Homo sapiens
atgtgcaaagtaaagtaatttt

SEQ ID NO: 8147238 - DNA, 22 bp, Homo sapiens
atgtgattcccactgaatcact

SEQ ID NO: 8147239 - DNA, 22 bp, Homo sapiens
atgtgcaaatccaatgtgaatg

SEQ ID NO: 8147240 - DNA, 23 bp, Homo sapiens
atgtgcaaagtgctacagtatag

SEQ ID NO: 8147241 - DNA, 18 bp, Homo sapiens
atgtgcaattttgtattt

SEQ ID NO: 8147242 - DNA, 22 bp, Homo sapiens
atgtgcacacagtgtcatgcaa

SEQ ID NO: 8147243 - DNA, 18 bp, Homo sapiens
atgtgcaattttgtattt

SEQ ID NO: 8147244 - DNA, 22 bp, Homo sapiens
atgtgcaattattaagaagaga

SEQ ID NO: 8147245 - DNA, 22 bp, Homo sapiens
atgtgcaacttttctgtctttt

SEQ ID NO: 8147246 - DNA, 22 bp, Homo sapiens
atgtgcaaggagtggctgttgt

SEQ ID NO: 8147247 - DNA, 22 bp, Homo sapiens
atgtgcatgcacctggactgtg

SEQ ID NO: 8147248 - DNA, 22 bp, Homo sapiens
atgtgcatgcacttacatgtgt

SEQ ID NO: 8147249 - DNA, 22 bp, Homo sapiens
atgtgcagttggtggccaggag

SEQ ID NO: 8147250 - DNA, 22 bp, Homo sapiens
atgtgcagttggtggccaggag

SEQ ID NO: 8147251 - DNA, 22 bp, Homo sapiens
atgtgcaggatccaggctccta

SEQ ID NO: 8147252 - DNA, 22 bp, Homo sapiens
atgtgcaggatccaggctccta

SEQ ID NO: 8147253 - DNA, 22 bp, Homo sapiens
atgtgcaggatccaggctccta

SEQ ID NO: 8147254 - DNA, 22 bp, Homo sapiens
atgtgcagacctgggttagaac

SEQ ID NO: 8147255 - DNA, 23 bp, Homo sapiens
atgtgcacatctccttgtccacc

SEQ ID NO: 8147256 - DNA, 21 bp, Homo sapiens
atgtgcagcaagcagcatgct

SEQ ID NO: 8147257 - DNA, 22 bp, Homo sapiens
atgtgcagcttttctagagaag

SEQ ID NO: 8147258 - DNA, 22 bp, Homo sapiens
atgttattttggaaaatacaaa

SEQ ID NO: 8147259 - DNA, 22 bp, Homo sapiens
atgttattttggaaaatacaaa

SEQ ID NO: 8147260 - DNA, 22 bp, Homo sapiens
atgttattttggaaaatacaaa

SEQ ID NO: 8147261 - DNA, 22 bp, Homo sapiens
atgttattttggaaaatacaaa

SEQ ID NO: 8147262 - DNA, 22 bp, Homo sapiens
agagccaggatgtcttctgggg

SEQ ID NO: 8147263 - DNA, 22 bp, Homo sapiens
agagccaggatgtcttctgggg

SEQ ID NO: 8147264 - DNA, 22 bp, Homo sapiens
agagccaggatgtcttctgggg

SEQ ID NO: 8147265 - DNA, 22 bp, Homo sapiens
agagccaggactgtgtctcact

SEQ ID NO: 8147266 - DNA, 22 bp, Homo sapiens
agagccaggactgtgtctcact

SEQ ID NO: 8147267 - DNA, 22 bp, Homo sapiens
agagccaggactgtgtctcact

SEQ ID NO: 8147268 - DNA, 22 bp, Homo sapiens
agagccaggactgtgtctcact

SEQ ID NO: 8147269 - DNA, 22 bp, Homo sapiens
agagccaggaagtggcgtgggg

SEQ ID NO: 8147270 - DNA, 22 bp, Homo sapiens
agagccaggaagtggcgtgggg

SEQ ID NO: 8147271 - DNA, 22 bp, Homo sapiens
agagccaggaagtggcgtgggg

SEQ ID NO: 8147272 - DNA, 22 bp, Homo sapiens
agagccaggatctgttttgggg

SEQ ID NO: 8147273 - DNA, 22 bp, Homo sapiens
agagccaggatgtcttctgggg

SEQ ID NO: 8147274 - DNA, 22 bp, Homo sapiens
agagccaggactgtgtctcact

SEQ ID NO: 8147275 - DNA, 22 bp, Homo sapiens
atgtgcatgcacttacatgtgt

SEQ ID NO: 8147276 - DNA, 22 bp, Homo sapiens
atgtgcatgtgcacacatgcgt

SEQ ID NO: 8147277 - DNA, 22 bp, Homo sapiens
atgtgcatgtgcacacatgcgt

SEQ ID NO: 8147278 - DNA, 19 bp, Homo sapiens
atgtgcatttgtgtgaggt

SEQ ID NO: 8147279 - DNA, 19 bp, Homo sapiens
atgtgcatttgtgtgaggt

SEQ ID NO: 8147280 - DNA, 22 bp, Homo sapiens
atgtgcattaaatgtcaatgtt

SEQ ID NO: 8147281 - DNA, 22 bp, Homo sapiens
atgtgcattaaatgtcaatgtt

SEQ ID NO: 8147282 - DNA, 19 bp, Homo sapiens
atgtgcatttgtgtgaggt

SEQ ID NO: 8147283 - DNA, 22 bp, Homo sapiens
agagccagcatttgacactggc

SEQ ID NO: 8147284 - DNA, 22 bp, Homo sapiens
agagccagcatttgacactggc

SEQ ID NO: 8147285 - DNA, 22 bp, Homo sapiens
agagccaggaagtggcgtgggg

SEQ ID NO: 8147286 - DNA, 22 bp, Homo sapiens
agagccaggaagtggcgtgggg

SEQ ID NO: 8147287 - DNA, 22 bp, Homo sapiens
agagccagccttctcagcttac

SEQ ID NO: 8147288 - DNA, 22 bp, Homo sapiens
agagccagccttctcagcttac

SEQ ID NO: 8147289 - DNA, 22 bp, Homo sapiens
agagccagccttctcagcttac

SEQ ID NO: 8147290 - DNA, 22 bp, Homo sapiens
agagccagccttctcagcttac

SEQ ID NO: 8147291 - DNA, 22 bp, Homo sapiens
agagccagccttctcagcttac

SEQ ID NO: 8147292 - DNA, 22 bp, Homo sapiens
agagccagcatttgggccctgc

SEQ ID NO: 8147293 - DNA, 22 bp, Homo sapiens
agagccagcatttgggccctgc

SEQ ID NO: 8147294 - DNA, 22 bp, Homo sapiens
agagccagcatttgggccctgc

SEQ ID NO: 8147295 - DNA, 21 bp, Homo sapiens
attttctgtgatagctgtctc

SEQ ID NO: 8147296 - DNA, 22 bp, Homo sapiens
attttctgtgtgcagataaata

SEQ ID NO: 8147297 - DNA, 22 bp, Homo sapiens
agatttcaatgtgagcattagt

SEQ ID NO: 8147298 - DNA, 22 bp, Homo sapiens
attttctgtaactatttctata

SEQ ID NO: 8147299 - DNA, 22 bp, Homo sapiens
attttctgtaactatttctata

SEQ ID NO: 8147300 - DNA, 21 bp, Homo sapiens
attttgtacatagaatttgtc

SEQ ID NO: 8147301 - DNA, 21 bp, Homo sapiens
attttgtacatagaatttgtc

SEQ ID NO: 8147302 - DNA, 21 bp, Homo sapiens
attttgtacatagaatttgtc

SEQ ID NO: 8147303 - DNA, 22 bp, Homo sapiens
agatttatgtggtcacactcag

SEQ ID NO: 8147304 - DNA, 22 bp, Homo sapiens
agatttatgtggtcacactcag

SEQ ID NO: 8147305 - DNA, 22 bp, Homo sapiens
agatttatgtggtcacactcag

SEQ ID NO: 8147306 - DNA, 22 bp, Homo sapiens
agatttatgtggtcacactcag

SEQ ID NO: 8147307 - DNA, 22 bp, Homo sapiens
agatttatgtggtcacactcag

SEQ ID NO: 8147308 - DNA, 22 bp, Homo sapiens
agatttatgtggtcacactcag

SEQ ID NO: 8147309 - DNA, 22 bp, Homo sapiens
agatttactcagctcctggaaa

SEQ ID NO: 8147310 - DNA, 22 bp, Homo sapiens
agatttactccctgcttccgcc

SEQ ID NO: 8147311 - DNA, 22 bp, Homo sapiens
agatttactggagtctttggtg

SEQ ID NO: 8147312 - DNA, 22 bp, Homo sapiens
agatttactgagaactgattac

SEQ ID NO: 8147313 - DNA, 22 bp, Homo sapiens
agatttactgagaactgattac

SEQ ID NO: 8147314 - DNA, 19 bp, Homo sapiens
agatttacctcatatagtt

SEQ ID NO: 8147315 - DNA, 20 bp, Homo sapiens
agatttacctttgagccttc

SEQ ID NO: 8147316 - DNA, 22 bp, Homo sapiens
agatttacaaaggatttgcttt

SEQ ID NO: 8147317 - DNA, 22 bp, Homo sapiens
agatttacaaaggatttgcttt

SEQ ID NO: 8147318 - DNA, 22 bp, Homo sapiens
agatttacaaaggatttgcttt

SEQ ID NO: 8147319 - DNA, 22 bp, Homo sapiens
agatttaaatttgctacaattc

SEQ ID NO: 8147320 - DNA, 22 bp, Homo sapiens
agatttaaatttgctacaattc

SEQ ID NO: 8147321 - DNA, 22 bp, Homo sapiens
agatttaaatttgctacaattc

SEQ ID NO: 8147322 - DNA, 18 bp, Homo sapiens
agattgtgtctacaaatc

SEQ ID NO: 8147323 - DNA, 23 bp, Homo sapiens
agattgttattcccagttcatgt

SEQ ID NO: 8147324 - DNA, 22 bp, Homo sapiens
agattgtcattgacgatgagca

SEQ ID NO: 8147325 - DNA, 22 bp, Homo sapiens
agattgtcattgacgatgagca

SEQ ID NO: 8147326 - DNA, 22 bp, Homo sapiens
agattctaaacttgattctgct

SEQ ID NO: 8147327 - DNA, 20 bp, Homo sapiens
agattccttggggatagtgc

SEQ ID NO: 8147328 - DNA, 22 bp, Homo sapiens
agattccttgagcaggttacaa

SEQ ID NO: 8147329 - DNA, 22 bp, Homo sapiens
agattcctaaagtaagatatca

SEQ ID NO: 8147330 - DNA, 22 bp, Homo sapiens
agattcctcagtcatgaagcct

SEQ ID NO: 8147331 - DNA, 22 bp, Homo sapiens
agattcctcagtcatgaagcct

SEQ ID NO: 8147332 - DNA, 22 bp, Homo sapiens
agattcctgttgtatggagggg

SEQ ID NO: 8147333 - DNA, 22 bp, Homo sapiens
agattcctgttgtatggagggg

SEQ ID NO: 8147334 - DNA, 22 bp, Homo sapiens
agattccttatctgtccaatgg

SEQ ID NO: 8147335 - DNA, 22 bp, Homo sapiens
agattgcaattccttacatgca

SEQ ID NO: 8147336 - DNA, 22 bp, Homo sapiens
agattggttgaactgatttgca

SEQ ID NO: 8147337 - DNA, 19 bp, Homo sapiens
agattggttccttttgagg

SEQ ID NO: 8147338 - DNA, 22 bp, Homo sapiens
agattggttccttgctttgaaa

SEQ ID NO: 8147339 - DNA, 22 bp, Homo sapiens
agatgtttgtgttatctccatt

SEQ ID NO: 8147340 - DNA, 22 bp, Homo sapiens
agatgattatgatagcactgtt

SEQ ID NO: 8147341 - DNA, 22 bp, Homo sapiens
agatgatgaccatgggaatgga

SEQ ID NO: 8147342 - DNA, 22 bp, Homo sapiens
agatgatggccatgtcctctcc

SEQ ID NO: 8147343 - DNA, 22 bp, Homo sapiens
agattcattgctttaggcattg

SEQ ID NO: 8147344 - DNA, 22 bp, Homo sapiens
agattcattatcttctttgtac

SEQ ID NO: 8147345 - DNA, 22 bp, Homo sapiens
agattcaggactggccacagcc

SEQ ID NO: 8147346 - DNA, 21 bp, Homo sapiens
agattcataatctgtaaaatg

SEQ ID NO: 8147347 - DNA, 22 bp, Homo sapiens
agattcatgggaaagctttagg

SEQ ID NO: 8147348 - DNA, 22 bp, Homo sapiens
atttgaaatcccttctactgta

SEQ ID NO: 8147349 - DNA, 22 bp, Homo sapiens
atttgaaatcccttctactgta

SEQ ID NO: 8147350 - DNA, 19 bp, Homo sapiens
atttgaaagctgtgcttgc

SEQ ID NO: 8147351 - DNA, 22 bp, Homo sapiens
atttgaagaaagttttctagat

SEQ ID NO: 8147352 - DNA, 22 bp, Homo sapiens
atttgaagtcttcatgatttct

SEQ ID NO: 8147353 - DNA, 22 bp, Homo sapiens
agatgacaagagcttgctgcag

SEQ ID NO: 8147354 - DNA, 22 bp, Homo sapiens
agatgacaatgaaggaaaatgt

SEQ ID NO: 8147355 - DNA, 22 bp, Homo sapiens
agatgacaatgaaggaaaatgt

SEQ ID NO: 8147356 - DNA, 22 bp, Homo sapiens
atttgaatggcttaacacaacg

SEQ ID NO: 8147357 - DNA, 22 bp, Homo sapiens
atttgaatggcttaacacaacg

SEQ ID NO: 8147358 - DNA, 21 bp, Homo sapiens
agatgaggatactgaggccta

SEQ ID NO: 8147359 - DNA, 22 bp, Homo sapiens
agatgagtaaatggagtcttcc

SEQ ID NO: 8147360 - DNA, 22 bp, Homo sapiens
agatgacatgggagcaagcact

SEQ ID NO: 8147361 - DNA, 22 bp, Homo sapiens
agatgactaacatagtattgct

SEQ ID NO: 8147362 - DNA, 22 bp, Homo sapiens
agatgagaatttttagagtgct

SEQ ID NO: 8147363 - DNA, 22 bp, Homo sapiens
agatgacaggtttttttggctt

SEQ ID NO: 8147364 - DNA, 22 bp, Homo sapiens
agatgacatgggagcaagcact

SEQ ID NO: 8147365 - DNA, 22 bp, Homo sapiens
agatgacaatgaaggaaaatgt

SEQ ID NO: 8147366 - DNA, 22 bp, Homo sapiens
agatgacagccaaggagatgaa

SEQ ID NO: 8147367 - DNA, 22 bp, Homo sapiens
atttcttttcaagagggtgctt

SEQ ID NO: 8147368 - DNA, 23 bp, Homo sapiens
atttgaaactttcttgtttccag

SEQ ID NO: 8147369 - DNA, 22 bp, Homo sapiens
atttctttctggccacggtttt

SEQ ID NO: 8147370 - DNA, 22 bp, Homo sapiens
atttctttctggccacggtttt

SEQ ID NO: 8147371 - DNA, 22 bp, Homo sapiens
atttcttttcaagagggtgctt

SEQ ID NO: 8147372 - DNA, 22 bp, Homo sapiens
atttcttttcaagagggtgctt

SEQ ID NO: 8147373 - DNA, 22 bp, Homo sapiens
atttcttgtgggaaatgcagca

SEQ ID NO: 8147374 - DNA, 22 bp, Homo sapiens
atttctttctggccacggtttt

SEQ ID NO: 8147375 - DNA, 22 bp, Homo sapiens
atttacaggtagaattttaagt

SEQ ID NO: 8147376 - DNA, 22 bp, Homo sapiens
atttacaggtagaattttaagt

SEQ ID NO: 8147377 - DNA, 22 bp, Homo sapiens
atttctcttagcaagacattac

SEQ ID NO: 8147378 - DNA, 22 bp, Homo sapiens
atttctcttagcaagacattac

SEQ ID NO: 8147379 - DNA, 22 bp, Homo sapiens
atttacaggtagaattttaagt

SEQ ID NO: 8147380 - DNA, 22 bp, Homo sapiens
atttacaggtagaattttaagt

SEQ ID NO: 8147381 - DNA, 22 bp, Homo sapiens
atttacaggtagaattttaagt

SEQ ID NO: 8147382 - DNA, 22 bp, Homo sapiens
atttacaggacagcttggcatt

SEQ ID NO: 8147383 - DNA, 22 bp, Homo sapiens
atttacaggacagcttggcatt

SEQ ID NO: 8147384 - DNA, 23 bp, Homo sapiens
atttacagctgtgtgagcaagtt

SEQ ID NO: 8147385 - DNA, 22 bp, Homo sapiens
atttacaggacagcttggcatt

SEQ ID NO: 8147386 - DNA, 22 bp, Homo sapiens
atttacaggacagcttggcatt

SEQ ID NO: 8147387 - DNA, 22 bp, Homo sapiens
atttacaggacagcttggcatt

SEQ ID NO: 8147388 - DNA, 23 bp, Homo sapiens
atttacagctgtgtgagcaagtt

SEQ ID NO: 8147389 - DNA, 23 bp, Homo sapiens
atttacagctgtgtgagcaagtt

SEQ ID NO: 8147390 - DNA, 23 bp, Homo sapiens
atttacagctgtgtgagcaagtt

SEQ ID NO: 8147391 - DNA, 22 bp, Homo sapiens
atttacagccttgccatctata

SEQ ID NO: 8147392 - DNA, 22 bp, Homo sapiens
atttacagccttgaaaacagca

SEQ ID NO: 8147393 - DNA, 22 bp, Homo sapiens
atttacagccttgaaaacagca

SEQ ID NO: 8147394 - DNA, 22 bp, Homo sapiens
atttacagccttgccatctata

SEQ ID NO: 8147395 - DNA, 22 bp, Homo sapiens
atttacagccttgccatctata

SEQ ID NO: 8147396 - DNA, 22 bp, Homo sapiens
atttacagccttgaaaacagca

SEQ ID NO: 8147397 - DNA, 22 bp, Homo sapiens
atttacagccttgaaaacagca

SEQ ID NO: 8147398 - DNA, 22 bp, Homo sapiens
atttacagatgatgctatttga

SEQ ID NO: 8147399 - DNA, 22 bp, Homo sapiens
atttacagatgatgctatttga

SEQ ID NO: 8147400 - DNA, 22 bp, Homo sapiens
atttacagatgatgctatttga

SEQ ID NO: 8147401 - DNA, 22 bp, Homo sapiens
caaagtttaaagtagatttcag

SEQ ID NO: 8147402 - DNA, 22 bp, Homo sapiens
caaagttgcagttatgtgatta

SEQ ID NO: 8147403 - DNA, 22 bp, Homo sapiens
caaagtggctggccgggagatc

SEQ ID NO: 8147404 - DNA, 22 bp, Homo sapiens
caaagtggaggctctggggcca

SEQ ID NO: 8147405 - DNA, 22 bp, Homo sapiens
caaagtttggctctcatgacat

SEQ ID NO: 8147406 - DNA, 22 bp, Homo sapiens
caaagttttagtaaacatatat

SEQ ID NO: 8147407 - DNA, 22 bp, Homo sapiens
caaataagaaccacaggggagt

SEQ ID NO: 8147408 - DNA, 22 bp, Homo sapiens
caaataagaaccacaggggagt

SEQ ID NO: 8147409 - DNA, 22 bp, Homo sapiens
caaataagcaattccattcttc

SEQ ID NO: 8147410 - DNA, 22 bp, Homo sapiens
caaataagcaattccattcttc

SEQ ID NO: 8147411 - DNA, 22 bp, Homo sapiens
caaataattactatcctcactt

SEQ ID NO: 8147412 - DNA, 22 bp, Homo sapiens
agcaatgtggaccagctcaggg

SEQ ID NO: 8147413 - DNA, 22 bp, Homo sapiens
agcaatgttggggttagaggac

SEQ ID NO: 8147414 - DNA, 22 bp, Homo sapiens
agcaatgtaaaccctgaagttg

SEQ ID NO: 8147415 - DNA, 22 bp, Homo sapiens
agcaatgtgacccctgacagca

SEQ ID NO: 8147416 - DNA, 22 bp, Homo sapiens
agcaatgtctttttggccatct

SEQ ID NO: 8147417 - DNA, 22 bp, Homo sapiens
caaaggtaaagatctgctgtgg

SEQ ID NO: 8147418 - DNA, 22 bp, Homo sapiens
caaaggtagtatatatattgtt

SEQ ID NO: 8147419 - DNA, 22 bp, Homo sapiens
caaaggtagtatatatattgtt

SEQ ID NO: 8147420 - DNA, 22 bp, Homo sapiens
caaaggtataagttaatataca

SEQ ID NO: 8147421 - DNA, 22 bp, Homo sapiens
caaaggtattctcattttggaa

SEQ ID NO: 8147422 - DNA, 22 bp, Homo sapiens
caaaggtataagttaatataca

SEQ ID NO: 8147423 - DNA, 22 bp, Homo sapiens
caaacattttgagtggtttctg

SEQ ID NO: 8147424 - DNA, 22 bp, Homo sapiens
caaacattttctacttccagga

SEQ ID NO: 8147425 - DNA, 22 bp, Homo sapiens
caaacattttaaataagggata

SEQ ID NO: 8147426 - DNA, 22 bp, Homo sapiens
caaacattttctacttccagga

SEQ ID NO: 8147427 - DNA, 22 bp, Homo sapiens
caaacattgctaccagaggttt

SEQ ID NO: 8147428 - DNA, 22 bp, Homo sapiens
caaacattgggggcttcaacac

SEQ ID NO: 8147429 - DNA, 22 bp, Homo sapiens
caaacattgctaccagaggttt

SEQ ID NO: 8147430 - DNA, 22 bp, Homo sapiens
caaacatttgacttctctcagg

SEQ ID NO: 8147431 - DNA, 22 bp, Homo sapiens
caaacatttgacttctctcagg

SEQ ID NO: 8147432 - DNA, 22 bp, Homo sapiens
agcaatagataaaacatttacc

SEQ ID NO: 8147433 - DNA, 22 bp, Homo sapiens
caaacattgctaccagaggttt

SEQ ID NO: 8147434 - DNA, 22 bp, Homo sapiens
attttgttgaggtaattgtcaa

SEQ ID NO: 8147435 - DNA, 22 bp, Homo sapiens
attttgttataggagctgaaat

SEQ ID NO: 8147436 - DNA, 22 bp, Homo sapiens
attttgttataggagctgaaat

SEQ ID NO: 8147437 - DNA, 22 bp, Homo sapiens
attttgttatagaactctgtga

SEQ ID NO: 8147438 - DNA, 22 bp, Homo sapiens
attttgttataggagctgaaat

SEQ ID NO: 8147439 - DNA, 22 bp, Homo sapiens
attttgtatcttacggggacta

SEQ ID NO: 8147440 - DNA, 22 bp, Homo sapiens
attttgttgatggtggagtagc

SEQ ID NO: 8147441 - DNA, 22 bp, Homo sapiens
attttgttgatggtggagtagc

SEQ ID NO: 8147442 - DNA, 22 bp, Homo sapiens
attttttagccaagactctgca

SEQ ID NO: 8147443 - DNA, 22 bp, Homo sapiens
attttttagccaagactctgca

SEQ ID NO: 8147444 - DNA, 22 bp, Homo sapiens
attttttagccaagactctgca

SEQ ID NO: 8147445 - DNA, 22 bp, Homo sapiens
attttttcagattgagtgttaa

SEQ ID NO: 8147446 - DNA, 22 bp, Homo sapiens
attttttcagattgagtgttaa

SEQ ID NO: 8147447 - DNA, 22 bp, Homo sapiens
attttttcagattgagtgttaa

SEQ ID NO: 8147448 - DNA, 22 bp, Homo sapiens
attttttatataccaaggtggg

SEQ ID NO: 8147449 - DNA, 22 bp, Homo sapiens
attttttagccaagactctgca

SEQ ID NO: 8147450 - DNA, 22 bp, Homo sapiens
attttttatataccaaggtggg

SEQ ID NO: 8147451 - DNA, 22 bp, Homo sapiens
attttttatataccaaggtggg

SEQ ID NO: 8147452 - DNA, 22 bp, Homo sapiens
attttttatataccaaggtggg

SEQ ID NO: 8147453 - DNA, 22 bp, Homo sapiens
attttttcccagttagccagga

SEQ ID NO: 8147454 - DNA, 22 bp, Homo sapiens
attttttctgtaaactggcctt

SEQ ID NO: 8147455 - DNA, 23 bp, Homo sapiens
attttttgtctttgtaactagat

SEQ ID NO: 8147456 - DNA, 23 bp, Homo sapiens
attttttgtctttgtaactagat

SEQ ID NO: 8147457 - DNA, 23 bp, Homo sapiens
attttttgtctttgtaactagat

SEQ ID NO: 8147458 - DNA, 23 bp, Homo sapiens
attttttgtctttgtaactagat

SEQ ID NO: 8147459 - DNA, 22 bp, Homo sapiens
attttttgttaactcaggatag

SEQ ID NO: 8147460 - DNA, 20 bp, Homo sapiens
agcaagagtgtacctggcca

SEQ ID NO: 8147461 - DNA, 22 bp, Homo sapiens
agcaaggctcggtcagggtgat

SEQ ID NO: 8147462 - DNA, 22 bp, Homo sapiens
agcaaggctcttaatgcccaaa

SEQ ID NO: 8147463 - DNA, 20 bp, Homo sapiens
agcaaggctaaatcatgatt

SEQ ID NO: 8147464 - DNA, 22 bp, Homo sapiens
agcaagtgtaagaatgcagaat

SEQ ID NO: 8147465 - DNA, 22 bp, Homo sapiens
agcaagtggaatcatggaaaag

SEQ ID NO: 8147466 - DNA, 22 bp, Homo sapiens
agcaaggctcttaatgcccaaa

SEQ ID NO: 8147467 - DNA, 22 bp, Homo sapiens
agcaaggctcttaatgcccaaa

SEQ ID NO: 8147468 - DNA, 22 bp, Homo sapiens
agcaaggcttcagagctgtctg

SEQ ID NO: 8147469 - DNA, 22 bp, Homo sapiens
agcaaggtggagaaggatgggt

SEQ ID NO: 8147470 - DNA, 22 bp, Homo sapiens
agcaaggtgacatcatgctgag

SEQ ID NO: 8147471 - DNA, 19 bp, Homo sapiens
agcaaggtgcctcctcccc

SEQ ID NO: 8147472 - DNA, 19 bp, Homo sapiens
agcaaggtgcctcctcccc

SEQ ID NO: 8147473 - DNA, 22 bp, Homo sapiens
agcaaggtctccctgcacctgg

SEQ ID NO: 8147474 - DNA, 22 bp, Homo sapiens
agcaaggtgacatcatgctgag

SEQ ID NO: 8147475 - DNA, 22 bp, Homo sapiens
attgaaagtcctatctaaggga

SEQ ID NO: 8147476 - DNA, 22 bp, Homo sapiens
attgaaatacataaaattgcca

SEQ ID NO: 8147477 - DNA, 22 bp, Homo sapiens
attgaaaggttttgagcagata

SEQ ID NO: 8147478 - DNA, 22 bp, Homo sapiens
attgaaaggcaaagtaggaagc

SEQ ID NO: 8147479 - DNA, 22 bp, Homo sapiens
attgaaagcatggatttggatt

SEQ ID NO: 8147480 - DNA, 22 bp, Homo sapiens
attgaaagattttgggctcatg

SEQ ID NO: 8147481 - DNA, 22 bp, Homo sapiens
attgaaagatatactgttctca

SEQ ID NO: 8147482 - DNA, 22 bp, Homo sapiens
attgagaagcttgcagattttt

SEQ ID NO: 8147483 - DNA, 22 bp, Homo sapiens
attgagaaaattcgagcaagtt

SEQ ID NO: 8147484 - DNA, 22 bp, Homo sapiens
attgaaattgatgaaattcttg

SEQ ID NO: 8147485 - DNA, 22 bp, Homo sapiens
attgagaaaggcttatgtttgc

SEQ ID NO: 8147486 - DNA, 22 bp, Homo sapiens
attgagaaaggcttatgtttgc

SEQ ID NO: 8147487 - DNA, 22 bp, Homo sapiens
attgaaaataaggccagaaaca

SEQ ID NO: 8147488 - DNA, 22 bp, Homo sapiens
attgaaaataaggccagaaaca

SEQ ID NO: 8147489 - DNA, 22 bp, Homo sapiens
attgaaaaattcacaattctgg

SEQ ID NO: 8147490 - DNA, 22 bp, Homo sapiens
attgaaaaattcacaattctgg

SEQ ID NO: 8147491 - DNA, 22 bp, Homo sapiens
attgaaaaattcacaattctgg

SEQ ID NO: 8147492 - DNA, 22 bp, Homo sapiens
attgaaaaattcacaattctgg

SEQ ID NO: 8147493 - DNA, 22 bp, Homo sapiens
attgaaaaattcacaattctgg

SEQ ID NO: 8147494 - DNA, 22 bp, Homo sapiens
attgaaaatgacatttgtgccc

SEQ ID NO: 8147495 - DNA, 22 bp, Homo sapiens
attgaaaatataattctaggag

SEQ ID NO: 8147496 - DNA, 22 bp, Homo sapiens
attgaaaatataattctaggag

SEQ ID NO: 8147497 - DNA, 22 bp, Homo sapiens
attgaaaatgacatttgtgccc

SEQ ID NO: 8147498 - DNA, 22 bp, Homo sapiens
attgaaaatgacatttgtgccc

SEQ ID NO: 8147499 - DNA, 22 bp, Homo sapiens
attgaaagataggctactgtgg

SEQ ID NO: 8147500 - DNA, 22 bp, Homo sapiens
attgaaagataggctactgtgg

SEQ ID NO: 8147501 - DNA, 22 bp, Homo sapiens
attgaaagagaatgtagctctt

SEQ ID NO: 8147502 - DNA, 22 bp, Homo sapiens
attgtataacagcatgtatttt

SEQ ID NO: 8147503 - DNA, 22 bp, Homo sapiens
attggtggtgaggacatgccag

SEQ ID NO: 8147504 - DNA, 22 bp, Homo sapiens
attggtggtgaggacatgccag

SEQ ID NO: 8147505 - DNA, 22 bp, Homo sapiens
attggtggtgaggacatgccag

SEQ ID NO: 8147506 - DNA, 22 bp, Homo sapiens
attgtataacagcatgtatttt

SEQ ID NO: 8147507 - DNA, 22 bp, Homo sapiens
attgtataacagcatgtatttt

SEQ ID NO: 8147508 - DNA, 22 bp, Homo sapiens
attgtataagtctatttacaat

SEQ ID NO: 8147509 - DNA, 22 bp, Homo sapiens
attgtataagtctatttacaat

SEQ ID NO: 8147510 - DNA, 22 bp, Homo sapiens
attgtatgcagcattaagcaat

SEQ ID NO: 8147511 - DNA, 22 bp, Homo sapiens
attgtatacaagcttaattgtt

SEQ ID NO: 8147512 - DNA, 22 bp, Homo sapiens
attgtataattgtattgccaaa

SEQ ID NO: 8147513 - DNA, 22 bp, Homo sapiens
attgtataagtctatttacaat

SEQ ID NO: 8147514 - DNA, 22 bp, Homo sapiens
attgtataatcagttactggaa

SEQ ID NO: 8147515 - DNA, 22 bp, Homo sapiens
attgtataagtctatttacaat

SEQ ID NO: 8147516 - DNA, 22 bp, Homo sapiens
attgaggagcagagatggggta

SEQ ID NO: 8147517 - DNA, 22 bp, Homo sapiens
attggtgcaattatgagggtgt

SEQ ID NO: 8147518 - DNA, 22 bp, Homo sapiens
attgagcacctacagtattacc

SEQ ID NO: 8147519 - DNA, 22 bp, Homo sapiens
attgagaattgtgagtttggag

SEQ ID NO: 8147520 - DNA, 22 bp, Homo sapiens
attgagaatccatttgagatga

SEQ ID NO: 8147521 - DNA, 23 bp, Homo sapiens
attgagaaggatacattgttctc

SEQ ID NO: 8147522 - DNA, 22 bp, Homo sapiens
attgagaatatgatttagtata

SEQ ID NO: 8147523 - DNA, 22 bp, Homo sapiens
attgagaatatgatttagtata

SEQ ID NO: 8147524 - DNA, 22 bp, Homo sapiens
attgttaaaaaggtggaaatgc

SEQ ID NO: 8147525 - DNA, 22 bp, Homo sapiens
attgttaaactgaagcattact

SEQ ID NO: 8147526 - DNA, 22 bp, Homo sapiens
attgttaaagtaataaccatgg

SEQ ID NO: 8147527 - DNA, 22 bp, Homo sapiens
attgtgtcctcattgaccttca

SEQ ID NO: 8147528 - DNA, 19 bp, Homo sapiens
attgtgtcaatggtgttca

SEQ ID NO: 8147529 - DNA, 22 bp, Homo sapiens
attgtgctttgcatcttgttcc

SEQ ID NO: 8147530 - DNA, 14 bp, Homo sapiens
attgtgcatgccat

SEQ ID NO: 8147531 - DNA, 22 bp, Homo sapiens
attgtattataattaggccaaa

SEQ ID NO: 8147532 - DNA, 22 bp, Homo sapiens
attgtatttaggagaaaagggt

SEQ ID NO: 8147533 - DNA, 22 bp, Homo sapiens
agatacaactgtttaaacatta

SEQ ID NO: 8147534 - DNA, 22 bp, Homo sapiens
agatacaagaggcctgacgtgt

SEQ ID NO: 8147535 - DNA, 22 bp, Homo sapiens
agatacaactgtttaaacatta

SEQ ID NO: 8147536 - DNA, 22 bp, Homo sapiens
agatacaaggcagagatgtgca

SEQ ID NO: 8147537 - DNA, 22 bp, Homo sapiens
agatacaagttaagagaaagga

SEQ ID NO: 8147538 - DNA, 22 bp, Homo sapiens
atttacagacgtggattagtgc

SEQ ID NO: 8147539 - DNA, 22 bp, Homo sapiens
atttacagacgtggattagtgc

SEQ ID NO: 8147540 - DNA, 22 bp, Homo sapiens
atttacagatgatgctatttga

SEQ ID NO: 8147541 - DNA, 22 bp, Homo sapiens
atttacagatgatgctatttga

SEQ ID NO: 8147542 - DNA, 22 bp, Homo sapiens
atttacagatgatgctatttga

SEQ ID NO: 8147543 - DNA, 22 bp, Homo sapiens
agatacagacctcttattaagg

SEQ ID NO: 8147544 - DNA, 22 bp, Homo sapiens
agatacacagaggtaaagatga

SEQ ID NO: 8147545 - DNA, 22 bp, Homo sapiens
agatacacagccctgccatcac

SEQ ID NO: 8147546 - DNA, 22 bp, Homo sapiens
attgttaataactattacattg

SEQ ID NO: 8147547 - DNA, 22 bp, Homo sapiens
agataattatttacttcaaagt

SEQ ID NO: 8147548 - DNA, 22 bp, Homo sapiens
agatacaaaaagggagaagatt

SEQ ID NO: 8147549 - DNA, 22 bp, Homo sapiens
agatacaactgtttaaacatta

SEQ ID NO: 8147550 - DNA, 22 bp, Homo sapiens
agatacaactcagaagtgtggt

SEQ ID NO: 8147551 - DNA, 22 bp, Homo sapiens
agatacaactcagaagtgtggt

SEQ ID NO: 8147552 - DNA, 22 bp, Homo sapiens
attaatacattatagggattgt

SEQ ID NO: 8147553 - DNA, 22 bp, Homo sapiens
attaatacattatagggattgt

SEQ ID NO: 8147554 - DNA, 22 bp, Homo sapiens
attaataaaataccactttgtt

SEQ ID NO: 8147555 - DNA, 22 bp, Homo sapiens
agagcttcactggagagcacat

SEQ ID NO: 8147556 - DNA, 22 bp, Homo sapiens
agagctttgggacatttgctag

SEQ ID NO: 8147557 - DNA, 22 bp, Homo sapiens
agagcttttgggaattcaggta

SEQ ID NO: 8147558 - DNA, 22 bp, Homo sapiens
agagcttttctgtaataacatc

SEQ ID NO: 8147559 - DNA, 22 bp, Homo sapiens
agagctttgtttgattgtcaga

SEQ ID NO: 8147560 - DNA, 22 bp, Homo sapiens
agaggaaatggataaagggtga

SEQ ID NO: 8147561 - DNA, 22 bp, Homo sapiens
agaggaaacataggtttttaaa

SEQ ID NO: 8147562 - DNA, 22 bp, Homo sapiens
agaggaaaatgagttccagaat

SEQ ID NO: 8147563 - DNA, 22 bp, Homo sapiens
attattttatgtgcggcctgat

SEQ ID NO: 8147564 - DNA, 22 bp, Homo sapiens
attattttatgtgcggcctgat

SEQ ID NO: 8147565 - DNA, 22 bp, Homo sapiens
attattttatgtgcggcctgat

SEQ ID NO: 8147566 - DNA, 22 bp, Homo sapiens
attattttatgtgcggcctgat

SEQ ID NO: 8147567 - DNA, 22 bp, Homo sapiens
agaggcctctttgcaagtaggt

SEQ ID NO: 8147568 - DNA, 22 bp, Homo sapiens
agaggcctctttgcaagtaggt

SEQ ID NO: 8147569 - DNA, 22 bp, Homo sapiens
agaggcctctgttgttcagacg

SEQ ID NO: 8147570 - DNA, 22 bp, Homo sapiens
agaggcctctagggcccctcag

SEQ ID NO: 8147571 - DNA, 22 bp, Homo sapiens
agaggcctctagggcccctcag

SEQ ID NO: 8147572 - DNA, 22 bp, Homo sapiens
agaggcctccgaaaggtgggct

SEQ ID NO: 8147573 - DNA, 22 bp, Homo sapiens
agaggcctccgaaaggtgggct

SEQ ID NO: 8147574 - DNA, 22 bp, Homo sapiens
attatttctcactcacataata

SEQ ID NO: 8147575 - DNA, 22 bp, Homo sapiens
agaggcctctttgcaagtaggt

SEQ ID NO: 8147576 - DNA, 22 bp, Homo sapiens
attatttctcactcacataata

SEQ ID NO: 8147577 - DNA, 22 bp, Homo sapiens
attatttctcactcacataata

SEQ ID NO: 8147578 - DNA, 22 bp, Homo sapiens
agaggccgggtgcctgctcaga

SEQ ID NO: 8147579 - DNA, 22 bp, Homo sapiens
agaggccggccgagcccatggg

SEQ ID NO: 8147580 - DNA, 22 bp, Homo sapiens
agaggccggccgagcccatggg

SEQ ID NO: 8147581 - DNA, 22 bp, Homo sapiens
agaggccggccgagcccatggg

SEQ ID NO: 8147582 - DNA, 22 bp, Homo sapiens
agaggcctccctcccagctggt

SEQ ID NO: 8147583 - DNA, 22 bp, Homo sapiens
agaggcctccctcccagctggt

SEQ ID NO: 8147584 - DNA, 22 bp, Homo sapiens
agaggcctccctcccagctggt

SEQ ID NO: 8147585 - DNA, 19 bp, Homo sapiens
agaggcctcagcagctggc

SEQ ID NO: 8147586 - DNA, 19 bp, Homo sapiens
agaggcctcagcagctggc

SEQ ID NO: 8147587 - DNA, 19 bp, Homo sapiens
agaggcctcagcagctggc

SEQ ID NO: 8147588 - DNA, 19 bp, Homo sapiens
agaggcctcagcagctggc

SEQ ID NO: 8147589 - DNA, 22 bp, Homo sapiens
agaggcctaattgctacccttt

SEQ ID NO: 8147590 - DNA, 22 bp, Homo sapiens
agaggcctcaaaccagacctga

SEQ ID NO: 8147591 - DNA, 22 bp, Homo sapiens
agaggcctaattgctacccttt

SEQ ID NO: 8147592 - DNA, 22 bp, Homo sapiens
agaggcctcaaaccagacctga

SEQ ID NO: 8147593 - DNA, 22 bp, Homo sapiens
agaggcctcaaaccagacctga

SEQ ID NO: 8147594 - DNA, 22 bp, Homo sapiens
attctccctgttcctcgacacc

SEQ ID NO: 8147595 - DNA, 20 bp, Homo sapiens
attctccctatactcacttt

SEQ ID NO: 8147596 - DNA, 19 bp, Homo sapiens
attctccctagaattttga

SEQ ID NO: 8147597 - DNA, 22 bp, Homo sapiens
attctctagtctcttccataaa

SEQ ID NO: 8147598 - DNA, 22 bp, Homo sapiens
attctctctagaagctgagatg

SEQ ID NO: 8147599 - DNA, 22 bp, Homo sapiens
attctctagtctcttccataaa

SEQ ID NO: 8147600 - DNA, 22 bp, Homo sapiens
attctctcatttatctgtccta

SEQ ID NO: 8147601 - DNA, 22 bp, Homo sapiens
attctccactgtaaggttatta

SEQ ID NO: 8147602 - DNA, 22 bp, Homo sapiens
attctccagctcactgtccata

SEQ ID NO: 8147603 - DNA, 19 bp, Homo sapiens
attctccctagaattttga

SEQ ID NO: 8147604 - DNA, 22 bp, Homo sapiens
attctccagctcactgtccata

SEQ ID NO: 8147605 - DNA, 20 bp, Homo sapiens
attctacaagaataagcatg

SEQ ID NO: 8147606 - DNA, 20 bp, Homo sapiens
attctacaagaataagcatg

SEQ ID NO: 8147607 - DNA, 22 bp, Homo sapiens
attctacaatcatgtagatcct

SEQ ID NO: 8147608 - DNA, 20 bp, Homo sapiens
attctacaagaataagcatg

SEQ ID NO: 8147609 - DNA, 22 bp, Homo sapiens
attctacaacccaataataatt

SEQ ID NO: 8147610 - DNA, 22 bp, Homo sapiens
attctacaacccaataataatt

SEQ ID NO: 8147611 - DNA, 22 bp, Homo sapiens
attgaaaaatgactattgctta

SEQ ID NO: 8147612 - DNA, 22 bp, Homo sapiens
attgaaaaatgactattgctta

SEQ ID NO: 8147613 - DNA, 22 bp, Homo sapiens
attgaaaaatgactattgctta

SEQ ID NO: 8147614 - DNA, 22 bp, Homo sapiens
attcttctgcctactttcatcc

SEQ ID NO: 8147615 - DNA, 22 bp, Homo sapiens
attctctgtctttttgaaaaca

SEQ ID NO: 8147616 - DNA, 22 bp, Homo sapiens
attctctgtagatggcttgaga

SEQ ID NO: 8147617 - DNA, 22 bp, Homo sapiens
attctctgtagatggcttgaga

SEQ ID NO: 8147618 - DNA, 22 bp, Homo sapiens
attctctgtgcagatttaagac

SEQ ID NO: 8147619 - DNA, 21 bp, Homo sapiens
attctctgtgatgggattagg

SEQ ID NO: 8147620 - DNA, 22 bp, Homo sapiens
attctctgtctttttgaaaaca

SEQ ID NO: 8147621 - DNA, 22 bp, Homo sapiens
attctctgaagtcaatggaaat

SEQ ID NO: 8147622 - DNA, 22 bp, Homo sapiens
attctctgaagtctttcagggc

SEQ ID NO: 8147623 - DNA, 22 bp, Homo sapiens
attctctgccattgcggtggat

SEQ ID NO: 8147624 - DNA, 20 bp, Homo sapiens
attctctgacaccgcccccg

SEQ ID NO: 8147625 - DNA, 22 bp, Homo sapiens
attctctgggttccagtaaatg

SEQ ID NO: 8147626 - DNA, 22 bp, Homo sapiens
attctctggtcattgagtataa

SEQ ID NO: 8147627 - DNA, 22 bp, Homo sapiens
attctctggtcattgagcatat

SEQ ID NO: 8147628 - DNA, 22 bp, Homo sapiens
attctctggtcattgagcatat

SEQ ID NO: 8147629 - DNA, 22 bp, Homo sapiens
attctctgtacagaaggtaccg

SEQ ID NO: 8147630 - DNA, 22 bp, Homo sapiens
attctaattagttctacatgtt

SEQ ID NO: 8147631 - DNA, 22 bp, Homo sapiens
attctacaaaagaactggatct

SEQ ID NO: 8147632 - DNA, 22 bp, Homo sapiens
attctacaaaagaactggatct

SEQ ID NO: 8147633 - DNA, 22 bp, Homo sapiens
attctacaacccaataataatt

SEQ ID NO: 8147634 - DNA, 22 bp, Homo sapiens
attcgctgacttgcacatttgg

SEQ ID NO: 8147635 - DNA, 20 bp, Homo sapiens
attctaaagctctgctcttt

SEQ ID NO: 8147636 - DNA, 22 bp, Homo sapiens
attcaaacctcatttattgttc

SEQ ID NO: 8147637 - DNA, 22 bp, Homo sapiens
attcaaacctcatttattgttc

SEQ ID NO: 8147638 - DNA, 22 bp, Homo sapiens
attcaaagaacctttagcattg

SEQ ID NO: 8147639 - DNA, 21 bp, Homo sapiens
attcaaagaagaggaaggccc

SEQ ID NO: 8147640 - DNA, 22 bp, Homo sapiens
attcccaggtaaaagtagagct

SEQ ID NO: 8147641 - DNA, 22 bp, Homo sapiens
attcccaggtaaaagtagagct

SEQ ID NO: 8147642 - DNA, 22 bp, Homo sapiens
attcctttggactcctccttgc

SEQ ID NO: 8147643 - DNA, 22 bp, Homo sapiens
attcaaaagaccatgcagactc

SEQ ID NO: 8147644 - DNA, 22 bp, Homo sapiens
aagtgtttacttaaagtcatgg

SEQ ID NO: 8147645 - DNA, 22 bp, Homo sapiens
aagtgtttaggtttgcagtcga

SEQ ID NO: 8147646 - DNA, 22 bp, Homo sapiens
aagtgtttatggttattgttaa

SEQ ID NO: 8147647 - DNA, 22 bp, Homo sapiens
aagtgtttattgattggtctag

SEQ ID NO: 8147648 - DNA, 22 bp, Homo sapiens
aagtgtttaaattatttgcagg

SEQ ID NO: 8147649 - DNA, 22 bp, Homo sapiens
actctttaacagactttgatct

SEQ ID NO: 8147650 - DNA, 22 bp, Homo sapiens
actctttaacagactttgatct

SEQ ID NO: 8147651 - DNA, 22 bp, Homo sapiens
actcttgtttgtagagcccacc

SEQ ID NO: 8147652 - DNA, 22 bp, Homo sapiens
actcttgtctcaacttttgtat

SEQ ID NO: 8147653 - DNA, 22 bp, Homo sapiens
actctttacttaaactctaagt

SEQ ID NO: 8147654 - DNA, 22 bp, Homo sapiens
actctttagaggtacatctctt

SEQ ID NO: 8147655 - DNA, 22 bp, Homo sapiens
actcttgattgatttagtcttt

SEQ ID NO: 8147656 - DNA, 22 bp, Homo sapiens
actcttcttgctgctcattaat

SEQ ID NO: 8147657 - DNA, 22 bp, Homo sapiens
actcttcttgctgctcattaat

SEQ ID NO: 8147658 - DNA, 22 bp, Homo sapiens
actctgggaatcctcaccttcc

SEQ ID NO: 8147659 - DNA, 22 bp, Homo sapiens
acctgcctcagtgcagctggat

SEQ ID NO: 8147660 - DNA, 19 bp, Homo sapiens
aagtgggtagcacattcac

SEQ ID NO: 8147661 - DNA, 22 bp, Homo sapiens
acctgcctctaagcagcaggtg

SEQ ID NO: 8147662 - DNA, 22 bp, Homo sapiens
acctgcctatggagccacatgg

SEQ ID NO: 8147663 - DNA, 22 bp, Homo sapiens
acctgcctatggagccacatgg

SEQ ID NO: 8147664 - DNA, 22 bp, Homo sapiens
acctgcctcagtgcagctggat

SEQ ID NO: 8147665 - DNA, 22 bp, Homo sapiens
aagtgggttggacaaatgaccc

SEQ ID NO: 8147666 - DNA, 22 bp, Homo sapiens
aagtgggttggacaaatgaccc

SEQ ID NO: 8147667 - DNA, 22 bp, Homo sapiens
aagtgtctgacacaaaatatgt

SEQ ID NO: 8147668 - DNA, 22 bp, Homo sapiens
aagtgggttcatgtggcattat

SEQ ID NO: 8147669 - DNA, 22 bp, Homo sapiens
aagtgggtgcactcaactttat

SEQ ID NO: 8147670 - DNA, 22 bp, Homo sapiens
aagtgggtcataaaaaattgca

SEQ ID NO: 8147671 - DNA, 22 bp, Homo sapiens
aagtgggtcagggacagatctt

SEQ ID NO: 8147672 - DNA, 22 bp, Homo sapiens
aagtgtctgcaaaatgacagag

SEQ ID NO: 8147673 - DNA, 22 bp, Homo sapiens
aagtgtctgatggagcgaaatg

SEQ ID NO: 8147674 - DNA, 22 bp, Homo sapiens
aagtgtcttctgatggggtgtg

SEQ ID NO: 8147675 - DNA, 22 bp, Homo sapiens
aagtgtcttaactccttttggg

SEQ ID NO: 8147676 - DNA, 22 bp, Homo sapiens
aagtgtctgctggctctaccct

SEQ ID NO: 8147677 - DNA, 22 bp, Homo sapiens
aagtgtctgctggctctaccct

SEQ ID NO: 8147678 - DNA, 22 bp, Homo sapiens
aagtgtgggaagtaggtggcga

SEQ ID NO: 8147679 - DNA, 22 bp, Homo sapiens
aagtgtgggactagggctccag

SEQ ID NO: 8147680 - DNA, 22 bp, Homo sapiens
aagtgtgggcagggcatttctg

SEQ ID NO: 8147681 - DNA, 22 bp, Homo sapiens
aagtgtgagacacacaaaatta

SEQ ID NO: 8147682 - DNA, 22 bp, Homo sapiens
aagtgtcttttagccactttta

SEQ ID NO: 8147683 - DNA, 22 bp, Homo sapiens
aagtgtctttatatttgagaaa

SEQ ID NO: 8147684 - DNA, 22 bp, Homo sapiens
aagtgtcttttagccactttta

SEQ ID NO: 8147685 - DNA, 22 bp, Homo sapiens
aagtgtgtattgtttatgctgc

SEQ ID NO: 8147686 - DNA, 22 bp, Homo sapiens
aagtgtggtttaggcatctttt

SEQ ID NO: 8147687 - DNA, 22 bp, Homo sapiens
aagtgtgtcttgggaagggagg

SEQ ID NO: 8147688 - DNA, 22 bp, Homo sapiens
aagtgtgtctggcggcccagtg

SEQ ID NO: 8147689 - DNA, 22 bp, Homo sapiens
aagtgtgtatttttcttcagtg

SEQ ID NO: 8147690 - DNA, 22 bp, Homo sapiens
aagtgtgtgggcaggcagtggt

SEQ ID NO: 8147691 - DNA, 22 bp, Homo sapiens
aagtgtgtgagcctgtcaggct

SEQ ID NO: 8147692 - DNA, 19 bp, Homo sapiens
aagtgtgttgagccaggat

SEQ ID NO: 8147693 - DNA, 22 bp, Homo sapiens
aagtgtgttgactgaattgggg

SEQ ID NO: 8147694 - DNA, 22 bp, Homo sapiens
actgcatgtaaggcaatatgtt

SEQ ID NO: 8147695 - DNA, 20 bp, Homo sapiens
aagttttctccaaatacagt

SEQ ID NO: 8147696 - DNA, 22 bp, Homo sapiens
actgcatgataataatagcaga

SEQ ID NO: 8147697 - DNA, 22 bp, Homo sapiens
actgcatctgaaacatgggtca

SEQ ID NO: 8147698 - DNA, 22 bp, Homo sapiens
actgcagggcatcctggccaag

SEQ ID NO: 8147699 - DNA, 22 bp, Homo sapiens
actgcaggtggatggcacttta

SEQ ID NO: 8147700 - DNA, 19 bp, Homo sapiens
actgcagggaggaggtgtg

SEQ ID NO: 8147701 - DNA, 22 bp, Homo sapiens
actgcagggcatcctggccaag

SEQ ID NO: 8147702 - DNA, 22 bp, Homo sapiens
actgcaggccttggtgccagca

SEQ ID NO: 8147703 - DNA, 22 bp, Homo sapiens
actgcaggccttggtgccagca

SEQ ID NO: 8147704 - DNA, 22 bp, Homo sapiens
actgcaggagacacagctgctg

SEQ ID NO: 8147705 - DNA, 22 bp, Homo sapiens
actgcaggagacacagctgctg

SEQ ID NO: 8147706 - DNA, 22 bp, Homo sapiens
actgcaggagacacagctgctg

SEQ ID NO: 8147707 - DNA, 22 bp, Homo sapiens
actgcaggagacacagctgctg

SEQ ID NO: 8147708 - DNA, 22 bp, Homo sapiens
actgcagcctttgggctcataa

SEQ ID NO: 8147709 - DNA, 18 bp, Homo sapiens
actgcaggagaggtgagg

SEQ ID NO: 8147710 - DNA, 18 bp, Homo sapiens
actgcaggagaggtgagg

SEQ ID NO: 8147711 - DNA, 22 bp, Homo sapiens
actgcaggatgtgctcctattg

SEQ ID NO: 8147712 - DNA, 22 bp, Homo sapiens
actgcaggccttggtgccagca

SEQ ID NO: 8147713 - DNA, 22 bp, Homo sapiens
actgcaggccttggtgccagca

SEQ ID NO: 8147714 - DNA, 22 bp, Homo sapiens
actgcactccagcctgggtgac

SEQ ID NO: 8147715 - DNA, 22 bp, Homo sapiens
actgcagccttgaactctgggc

SEQ ID NO: 8147716 - DNA, 22 bp, Homo sapiens
actgcagcctttgggctcataa

SEQ ID NO: 8147717 - DNA, 22 bp, Homo sapiens
aagttctaacatctacgtggaa

SEQ ID NO: 8147718 - DNA, 18 bp, Homo sapiens
actctttctgcccacagg

SEQ ID NO: 8147719 - DNA, 22 bp, Homo sapiens
actctttagaggtacatctctt

SEQ ID NO: 8147720 - DNA, 19 bp, Homo sapiens
actcttttccttttgaatc

SEQ ID NO: 8147721 - DNA, 22 bp, Homo sapiens
actgaaaaagacatcttggtaa

SEQ ID NO: 8147722 - DNA, 22 bp, Homo sapiens
actgaaaatgaattagaaacag

SEQ ID NO: 8147723 - DNA, 22 bp, Homo sapiens
actgaaaaagtatgattcactg

SEQ ID NO: 8147724 - DNA, 22 bp, Homo sapiens
aagttcaaggctctagagttcc

SEQ ID NO: 8147725 - DNA, 22 bp, Homo sapiens
aagttcaagtctgcatcttttt

SEQ ID NO: 8147726 - DNA, 22 bp, Homo sapiens
aagttcaagtgtaatctttatt

SEQ ID NO: 8147727 - DNA, 22 bp, Homo sapiens
aagttcaatcagatgaaaaagc

SEQ ID NO: 8147728 - DNA, 22 bp, Homo sapiens
aagttcatcaaagagtaaatat

SEQ ID NO: 8147729 - DNA, 22 bp, Homo sapiens
aagttcatggtaggttggaagg

SEQ ID NO: 8147730 - DNA, 22 bp, Homo sapiens
aagttcaatggaaaagctttag

SEQ ID NO: 8147731 - DNA, 18 bp, Homo sapiens
aagttccacaagagatct

SEQ ID NO: 8147732 - DNA, 22 bp, Homo sapiens
actgtacacagtggtgtactgt

SEQ ID NO: 8147733 - DNA, 22 bp, Homo sapiens
actgtacacacttctctgtctt

SEQ ID NO: 8147734 - DNA, 22 bp, Homo sapiens
actgtacacacttctctgtctt

SEQ ID NO: 8147735 - DNA, 22 bp, Homo sapiens
actgtacacacttctctgtctt

SEQ ID NO: 8147736 - DNA, 22 bp, Homo sapiens
actgtacaaatattgcaaaata

SEQ ID NO: 8147737 - DNA, 22 bp, Homo sapiens
actgtacaactgctgagcagaa

SEQ ID NO: 8147738 - DNA, 22 bp, Homo sapiens
actgtacacagtggtgtactgt

SEQ ID NO: 8147739 - DNA, 22 bp, Homo sapiens
actgtacacagtggtgtactgt

SEQ ID NO: 8147740 - DNA, 22 bp, Homo sapiens
actgtacacattcgtcaagact

SEQ ID NO: 8147741 - DNA, 22 bp, Homo sapiens
actgtacacgtgtcatttacag

SEQ ID NO: 8147742 - DNA, 22 bp, Homo sapiens
actgtacatatggattctaaga

SEQ ID NO: 8147743 - DNA, 22 bp, Homo sapiens
actgtacatatggattctaaga

SEQ ID NO: 8147744 - DNA, 22 bp, Homo sapiens
actgtcccatttatgtagacat

SEQ ID NO: 8147745 - DNA, 22 bp, Homo sapiens
actgtccattcactcatattca

SEQ ID NO: 8147746 - DNA, 22 bp, Homo sapiens
actgtccataatattggtgaac

SEQ ID NO: 8147747 - DNA, 22 bp, Homo sapiens
actgtccagaagatagaaatat

SEQ ID NO: 8147748 - DNA, 22 bp, Homo sapiens
actgtacatgcatcttgtctat

SEQ ID NO: 8147749 - DNA, 22 bp, Homo sapiens
actgtacatgcatcttgtctat

SEQ ID NO: 8147750 - DNA, 21 bp, Homo sapiens
actgtcatttgcttagggagg

SEQ ID NO: 8147751 - DNA, 22 bp, Homo sapiens
actgtccaagcatgcctggctt

SEQ ID NO: 8147752 - DNA, 22 bp, Homo sapiens
actgtcatgtgctaactgtcca

SEQ ID NO: 8147753 - DNA, 22 bp, Homo sapiens
aatagcaattacatttgcacca

SEQ ID NO: 8147754 - DNA, 22 bp, Homo sapiens
aatagcaattacatttgcacca

SEQ ID NO: 8147755 - DNA, 22 bp, Homo sapiens
aatagcaaagttatcaaattaa

SEQ ID NO: 8147756 - DNA, 22 bp, Homo sapiens
aatagcaaatgctcatttgaaa

SEQ ID NO: 8147757 - DNA, 22 bp, Homo sapiens
aatagcacttcctgaacacatt

SEQ ID NO: 8147758 - DNA, 22 bp, Homo sapiens
aatagcataagatgtcaaatag

SEQ ID NO: 8147759 - DNA, 22 bp, Homo sapiens
aatagcataagatgtcaaatag

SEQ ID NO: 8147760 - DNA, 22 bp, Homo sapiens
aatagcatagagttaaaatgca

SEQ ID NO: 8147761 - DNA, 22 bp, Homo sapiens
aatagcatcctaaaacatactt

SEQ ID NO: 8147762 - DNA, 22 bp, Homo sapiens
aatagcatcctaaaacatactt

SEQ ID NO: 8147763 - DNA, 22 bp, Homo sapiens
aatagcatagagttaaaatgca

SEQ ID NO: 8147764 - DNA, 22 bp, Homo sapiens
aatagcatcttccctggtaacc

SEQ ID NO: 8147765 - DNA, 22 bp, Homo sapiens
aatagcatcttctgagacaaag

SEQ ID NO: 8147766 - DNA, 22 bp, Homo sapiens
aatagcatcctgtatctcttcc

SEQ ID NO: 8147767 - DNA, 22 bp, Homo sapiens
aatagcatcctgtatctcttcc

SEQ ID NO: 8147768 - DNA, 22 bp, Homo sapiens
actgtcctcagatattcttctg

SEQ ID NO: 8147769 - DNA, 22 bp, Homo sapiens
actgtcctagaacctgcagctc

SEQ ID NO: 8147770 - DNA, 22 bp, Homo sapiens
actgtcctagaacctgcagctc

SEQ ID NO: 8147771 - DNA, 22 bp, Homo sapiens
actgtcctgaatactgcatgac

SEQ ID NO: 8147772 - DNA, 22 bp, Homo sapiens
actgtcctgaatactgcatgac

SEQ ID NO: 8147773 - DNA, 22 bp, Homo sapiens
actgtcctcgaagtacctgtgc

SEQ ID NO: 8147774 - DNA, 22 bp, Homo sapiens
actgtcctcgaagtacctgtgc

SEQ ID NO: 8147775 - DNA, 22 bp, Homo sapiens
actgtctaatcagattcacttg

SEQ ID NO: 8147776 - DNA, 22 bp, Homo sapiens
actgtctagttctcttttctaa

SEQ ID NO: 8147777 - DNA, 22 bp, Homo sapiens
actgtctcctcatcatgcctgg

SEQ ID NO: 8147778 - DNA, 22 bp, Homo sapiens
actgtccttttaatgcagccgt

SEQ ID NO: 8147779 - DNA, 22 bp, Homo sapiens
actgtcgattatgatgagtcag

SEQ ID NO: 8147780 - DNA, 22 bp, Homo sapiens
actgtcctggagctcacactct

SEQ ID NO: 8147781 - DNA, 22 bp, Homo sapiens
actgtcctgaatactgcatgac

SEQ ID NO: 8147782 - DNA, 22 bp, Homo sapiens
actgtcctggagctcacactct

SEQ ID NO: 8147783 - DNA, 22 bp, Homo sapiens
actgtcctgcaaaaatactctt

SEQ ID NO: 8147784 - DNA, 18 bp, Homo sapiens
actgtctctgagagtggt

SEQ ID NO: 8147785 - DNA, 22 bp, Homo sapiens
actgtctcctcatcatgcctgg

SEQ ID NO: 8147786 - DNA, 18 bp, Homo sapiens
actgtctctgagagtggt

SEQ ID NO: 8147787 - DNA, 22 bp, Homo sapiens
actgtctctctagcagttcagg

SEQ ID NO: 8147788 - DNA, 22 bp, Homo sapiens
aatagaatgtaatctaatacat

SEQ ID NO: 8147789 - DNA, 23 bp, Homo sapiens
actgtctgatatgttttccatca

SEQ ID NO: 8147790 - DNA, 22 bp, Homo sapiens
aataatacatgagattaatgtt

SEQ ID NO: 8147791 - DNA, 22 bp, Homo sapiens
aataataagatactaagggagt

SEQ ID NO: 8147792 - DNA, 22 bp, Homo sapiens
aataataagatactaagggagt

SEQ ID NO: 8147793 - DNA, 22 bp, Homo sapiens
aataatactgcatgtaaggtgc

SEQ ID NO: 8147794 - DNA, 19 bp, Homo sapiens
actgggcttgtcctcgtgg

SEQ ID NO: 8147795 - DNA, 22 bp, Homo sapiens
actggggagagtcatgccagca

SEQ ID NO: 8147796 - DNA, 22 bp, Homo sapiens
actggggagagtcatgccagca

SEQ ID NO: 8147797 - DNA, 22 bp, Homo sapiens
aataatagcagagtttacaatc

SEQ ID NO: 8147798 - DNA, 22 bp, Homo sapiens
actgggcaaggatatgatgggt

SEQ ID NO: 8147799 - DNA, 22 bp, Homo sapiens
actgggcaaggatatgatgggt

SEQ ID NO: 8147800 - DNA, 22 bp, Homo sapiens
actgggattacaggtgggagtc

SEQ ID NO: 8147801 - DNA, 22 bp, Homo sapiens
actgggagttctccatgtccct

SEQ ID NO: 8147802 - DNA, 22 bp, Homo sapiens
actgggagttctccatgtccct

SEQ ID NO: 8147803 - DNA, 22 bp, Homo sapiens
actgggattacaggtgggagtc

SEQ ID NO: 8147804 - DNA, 22 bp, Homo sapiens
actgggagttctccatgtccct

SEQ ID NO: 8147805 - DNA, 22 bp, Homo sapiens
actgggcaccatcatgagatgg

SEQ ID NO: 8147806 - DNA, 22 bp, Homo sapiens
actgggcaccatcatgagatag

SEQ ID NO: 8147807 - DNA, 22 bp, Homo sapiens
actgggcaaggatatgatgggt

SEQ ID NO: 8147808 - DNA, 22 bp, Homo sapiens
actgggcaataaattcagagaa

SEQ ID NO: 8147809 - DNA, 22 bp, Homo sapiens
aataagttgcctgttgaatcat

SEQ ID NO: 8147810 - DNA, 22 bp, Homo sapiens
aataaggtgtgggtgctaatat

SEQ ID NO: 8147811 - DNA, 22 bp, Homo sapiens
aataagcaagcctgtgtgcaag

SEQ ID NO: 8147812 - DNA, 22 bp, Homo sapiens
actggctgagtttatgttcaca

SEQ ID NO: 8147813 - DNA, 22 bp, Homo sapiens
actggctgatatggctaggaag

SEQ ID NO: 8147814 - DNA, 22 bp, Homo sapiens
actggctgagtttatgttcaca

SEQ ID NO: 8147815 - DNA, 22 bp, Homo sapiens
actggctgagttgcttcagcaa

SEQ ID NO: 8147816 - DNA, 22 bp, Homo sapiens
aataaaatggtcagttttctca

SEQ ID NO: 8147817 - DNA, 22 bp, Homo sapiens
actgggaggcatctggagctga

SEQ ID NO: 8147818 - DNA, 22 bp, Homo sapiens
actgggaggcatctggagctga

SEQ ID NO: 8147819 - DNA, 22 bp, Homo sapiens
actggctgatatggctaggaag

SEQ ID NO: 8147820 - DNA, 22 bp, Homo sapiens
actgggaggcaaagagcaagga

SEQ ID NO: 8147821 - DNA, 22 bp, Homo sapiens
actgggaggcaaagagcaagga

SEQ ID NO: 8147822 - DNA, 22 bp, Homo sapiens
actgggaggcaaagagcaagga

SEQ ID NO: 8147823 - DNA, 22 bp, Homo sapiens
actgggaggcaaagagcaagga

SEQ ID NO: 8147824 - DNA, 22 bp, Homo sapiens
actgggaggcatctggagctga

SEQ ID NO: 8147825 - DNA, 22 bp, Homo sapiens
actgggagggtcttgaagaggg

SEQ ID NO: 8147826 - DNA, 22 bp, Homo sapiens
actgggagggtcttgaagaggg

SEQ ID NO: 8147827 - DNA, 22 bp, Homo sapiens
actgggagtcatgaggaaggag

SEQ ID NO: 8147828 - DNA, 22 bp, Homo sapiens
actgggagggtcttgaagaggg

SEQ ID NO: 8147829 - DNA, 22 bp, Homo sapiens
actgggagggtcttgaagaggg

SEQ ID NO: 8147830 - DNA, 22 bp, Homo sapiens
actgggagtcatgaggaaggag

SEQ ID NO: 8147831 - DNA, 22 bp, Homo sapiens
actgggagtcatgaggaaggag

SEQ ID NO: 8147832 - DNA, 22 bp, Homo sapiens
actgggagtcatgaggaaggag

SEQ ID NO: 8147833 - DNA, 22 bp, Homo sapiens
actgggagtcatgaggaaggag

SEQ ID NO: 8147834 - DNA, 21 bp, Homo sapiens
aataaaacagttggtgtcaat

SEQ ID NO: 8147835 - DNA, 20 bp, Homo sapiens
aataaaagaagccttcaccc

SEQ ID NO: 8147836 - DNA, 22 bp, Homo sapiens
aataaaatgaactggtagagtt

SEQ ID NO: 8147837 - DNA, 22 bp, Homo sapiens
aataaaatgaactggtagagtt

SEQ ID NO: 8147838 - DNA, 22 bp, Homo sapiens
aataaaatgaactggtagagtt

SEQ ID NO: 8147839 - DNA, 22 bp, Homo sapiens
aataaaatgaactggtagagtt

SEQ ID NO: 8147840 - DNA, 21 bp, Homo sapiens
aataaaacagttggtgtcaat

SEQ ID NO: 8147841 - DNA, 22 bp, Homo sapiens
aagtttttggtagagaaaagta

SEQ ID NO: 8147842 - DNA, 22 bp, Homo sapiens
aagtttttgattctaagagaga

SEQ ID NO: 8147843 - DNA, 22 bp, Homo sapiens
aagtttttggtagagaaaagta

SEQ ID NO: 8147844 - DNA, 22 bp, Homo sapiens
aagtttttcacattgctgttgt

SEQ ID NO: 8147845 - DNA, 22 bp, Homo sapiens
aagtttttgattctaagagaga

SEQ ID NO: 8147846 - DNA, 22 bp, Homo sapiens
aatgaatgaaccacatataaca

SEQ ID NO: 8147847 - DNA, 22 bp, Homo sapiens
agaagccaccagctgaggaaga

SEQ ID NO: 8147848 - DNA, 22 bp, Homo sapiens
agaagcagctttcaaggtgatt

SEQ ID NO: 8147849 - DNA, 22 bp, Homo sapiens
agaagccagaatattcatggat

SEQ ID NO: 8147850 - DNA, 22 bp, Homo sapiens
agaagccactgctcccagtgag

SEQ ID NO: 8147851 - DNA, 18 bp, Homo sapiens
agaagccacgaggagtcc

SEQ ID NO: 8147852 - DNA, 22 bp, Homo sapiens
agaagccagaggcagtgggtac

SEQ ID NO: 8147853 - DNA, 22 bp, Homo sapiens
agaagccagaatattcatggat

SEQ ID NO: 8147854 - DNA, 22 bp, Homo sapiens
agaagccactggaggttgagat

SEQ ID NO: 8147855 - DNA, 18 bp, Homo sapiens
agaagccacgaggagtcc

SEQ ID NO: 8147856 - DNA, 18 bp, Homo sapiens
agaagccacgaggagtcc

SEQ ID NO: 8147857 - DNA, 22 bp, Homo sapiens
agaagccactggaggttgagat

SEQ ID NO: 8147858 - DNA, 22 bp, Homo sapiens
agaagccactgctcccagtgag

SEQ ID NO: 8147859 - DNA, 22 bp, Homo sapiens
agaagccactgctcccagtgag

SEQ ID NO: 8147860 - DNA, 22 bp, Homo sapiens
agaagccactgctcccagtgag

SEQ ID NO: 8147861 - DNA, 22 bp, Homo sapiens
aatgaataacaatcctctggag

SEQ ID NO: 8147862 - DNA, 22 bp, Homo sapiens
aatgaataccgtttcactcagt

SEQ ID NO: 8147863 - DNA, 20 bp, Homo sapiens
aatgaagttattaatgatgt

SEQ ID NO: 8147864 - DNA, 22 bp, Homo sapiens
aatgaagttctattcattttct

SEQ ID NO: 8147865 - DNA, 21 bp, Homo sapiens
aatgaagtggctattttgagg

SEQ ID NO: 8147866 - DNA, 22 bp, Homo sapiens
aatgaagtgttatttagtttca

SEQ ID NO: 8147867 - DNA, 21 bp, Homo sapiens
aatgaagtggctattttgagg

SEQ ID NO: 8147868 - DNA, 21 bp, Homo sapiens
aatgaagtggctattttgagg

SEQ ID NO: 8147869 - DNA, 20 bp, Homo sapiens
aatgaagttattaatgatgt

SEQ ID NO: 8147870 - DNA, 22 bp, Homo sapiens
aatgaagtgtttagaagtttta

SEQ ID NO: 8147871 - DNA, 22 bp, Homo sapiens
aatgaagccactgaagacaatc

SEQ ID NO: 8147872 - DNA, 22 bp, Homo sapiens
aatgaagataaaatgggatgga

SEQ ID NO: 8147873 - DNA, 22 bp, Homo sapiens
aatgaagattatggtgattaag

SEQ ID NO: 8147874 - DNA, 22 bp, Homo sapiens
aatctagtttcagactttgagt

SEQ ID NO: 8147875 - DNA, 22 bp, Homo sapiens
agaacacactgggggaaacaag

SEQ ID NO: 8147876 - DNA, 19 bp, Homo sapiens
agaactcagtatcttttct

SEQ ID NO: 8147877 - DNA, 22 bp, Homo sapiens
agaactatacattactcattga

SEQ ID NO: 8147878 - DNA, 19 bp, Homo sapiens
agaactgggtccatggctt

SEQ ID NO: 8147879 - DNA, 18 bp, Homo sapiens
agaactgcacctctcctg

SEQ ID NO: 8147880 - DNA, 22 bp, Homo sapiens
agaactggtggtgatcagttat

SEQ ID NO: 8147881 - DNA, 19 bp, Homo sapiens
agaactgggtccatggctt

SEQ ID NO: 8147882 - DNA, 17 bp, Homo sapiens
agaactgtagtagctcc

SEQ ID NO: 8147883 - DNA, 22 bp, Homo sapiens
aatgaagaaatggacatcttta

SEQ ID NO: 8147884 - DNA, 22 bp, Homo sapiens
aatgaagaaatggacatcttta

SEQ ID NO: 8147885 - DNA, 22 bp, Homo sapiens
aatgaagaaatggacatcttta

SEQ ID NO: 8147886 - DNA, 22 bp, Homo sapiens
agaagaaatgaggccgttctgc

SEQ ID NO: 8147887 - DNA, 22 bp, Homo sapiens
aatgaactggagaacaatgacc

SEQ ID NO: 8147888 - DNA, 22 bp, Homo sapiens
agaagaaactgtcggggatatt

SEQ ID NO: 8147889 - DNA, 22 bp, Homo sapiens
agaagaaagattgaaggttcct

SEQ ID NO: 8147890 - DNA, 22 bp, Homo sapiens
agaagaaagattgaaggttcct

SEQ ID NO: 8147891 - DNA, 22 bp, Homo sapiens
agaagaaagattgaaggttcct

SEQ ID NO: 8147892 - DNA, 22 bp, Homo sapiens
agaagaaactgtcggggatatt

SEQ ID NO: 8147893 - DNA, 22 bp, Homo sapiens
agaagaaactgtcggggatatt

SEQ ID NO: 8147894 - DNA, 22 bp, Homo sapiens
agaacttttggagacttttagt

SEQ ID NO: 8147895 - DNA, 22 bp, Homo sapiens
aatgcattctttcatggacctg

SEQ ID NO: 8147896 - DNA, 22 bp, Homo sapiens
aatgcattgattgctggaaata

SEQ ID NO: 8147897 - DNA, 22 bp, Homo sapiens
aatgcattctcggtttgtgtgt

SEQ ID NO: 8147898 - DNA, 21 bp, Homo sapiens
aatgcattaacataaagctga

SEQ ID NO: 8147899 - DNA, 23 bp, Homo sapiens
aatgcattaatttgggagagtac

SEQ ID NO: 8147900 - DNA, 22 bp, Homo sapiens
aatgcatgtttcctctcagcag

SEQ ID NO: 8147901 - DNA, 22 bp, Homo sapiens
aatgcattaaagttagagactt

SEQ ID NO: 8147902 - DNA, 22 bp, Homo sapiens
aatgcatatgtaggcaagcagt

SEQ ID NO: 8147903 - DNA, 19 bp, Homo sapiens
aatgcatggaagttggaga

SEQ ID NO: 8147904 - DNA, 22 bp, Homo sapiens
aatgcatgtattcattgtggaa

SEQ ID NO: 8147905 - DNA, 22 bp, Homo sapiens
aatgcctcgccttatttatttt

SEQ ID NO: 8147906 - DNA, 22 bp, Homo sapiens
aatgccttataggctgaaaatt

SEQ ID NO: 8147907 - DNA, 22 bp, Homo sapiens
aatgcctggcgattagtgtagc

SEQ ID NO: 8147908 - DNA, 18 bp, Homo sapiens
aatgcatttatggagatg

SEQ ID NO: 8147909 - DNA, 22 bp, Homo sapiens
aatgcattttattatatgtgac

SEQ ID NO: 8147910 - DNA, 22 bp, Homo sapiens
aatgccaatattcatttgtgtt

SEQ ID NO: 8147911 - DNA, 22 bp, Homo sapiens
agaaggaagccaggagggtgca

SEQ ID NO: 8147912 - DNA, 22 bp, Homo sapiens
agaaggaagccaggagggtgca

SEQ ID NO: 8147913 - DNA, 22 bp, Homo sapiens
agaaggaagccaggagggtgca

SEQ ID NO: 8147914 - DNA, 22 bp, Homo sapiens
agaaggaaggaagcattctgtt

SEQ ID NO: 8147915 - DNA, 22 bp, Homo sapiens
agaaggaaggaagcattctgtt

SEQ ID NO: 8147916 - DNA, 22 bp, Homo sapiens
agaaggaaggctgagtgctgat

SEQ ID NO: 8147917 - DNA, 22 bp, Homo sapiens
agaaggaaggataactgcatta

SEQ ID NO: 8147918 - DNA, 22 bp, Homo sapiens
agaaggaaggctgagtgctgat

SEQ ID NO: 8147919 - DNA, 18 bp, Homo sapiens
aatgcaatgtatttgcag

SEQ ID NO: 8147920 - DNA, 22 bp, Homo sapiens
agaagccagcttcagctgcccg

SEQ ID NO: 8147921 - DNA, 22 bp, Homo sapiens
agaagccagccttgcctccttt

SEQ ID NO: 8147922 - DNA, 22 bp, Homo sapiens
agaagccagcttcagctgcccg

SEQ ID NO: 8147923 - DNA, 22 bp, Homo sapiens
agaagccagtcgctctcccgca

SEQ ID NO: 8147924 - DNA, 22 bp, Homo sapiens
agaagccagcttcagctgcccg

SEQ ID NO: 8147925 - DNA, 22 bp, Homo sapiens
agaagccagcttcagctgcccg

SEQ ID NO: 8147926 - DNA, 22 bp, Homo sapiens
agaagccagcttcagctgcccg

SEQ ID NO: 8147927 - DNA, 22 bp, Homo sapiens
agaagccagattgtagtgggac

SEQ ID NO: 8147928 - DNA, 22 bp, Homo sapiens
agaagccagattgtagtgggac

SEQ ID NO: 8147929 - DNA, 22 bp, Homo sapiens
agaagccagaggcagtgggtac

SEQ ID NO: 8147930 - DNA, 22 bp, Homo sapiens
agaagccagccttgcctccttt

SEQ ID NO: 8147931 - DNA, 22 bp, Homo sapiens
agaagccagccttgcctccttt

SEQ ID NO: 8147932 - DNA, 22 bp, Homo sapiens
agaagccagccttgcctccttt

SEQ ID NO: 8147933 - DNA, 22 bp, Homo sapiens
agaagccagattgtagtgggac

SEQ ID NO: 8147934 - DNA, 22 bp, Homo sapiens
agaagcttcaagatatttggta

SEQ ID NO: 8147935 - DNA, 22 bp, Homo sapiens
agaagctgttgcattcctggcg

SEQ ID NO: 8147936 - DNA, 22 bp, Homo sapiens
agaagcttgaaggagcagtgac

SEQ ID NO: 8147937 - DNA, 22 bp, Homo sapiens
agaagcttgaaggagcagtgac

SEQ ID NO: 8147938 - DNA, 22 bp, Homo sapiens
aatctacatgcaatatttttag

SEQ ID NO: 8147939 - DNA, 22 bp, Homo sapiens
aatctagtttaatatgtttaaa

SEQ ID NO: 8147940 - DNA, 22 bp, Homo sapiens
aatctagtttaatatgtttaaa

SEQ ID NO: 8147941 - DNA, 22 bp, Homo sapiens
aatctagtttcagactttgagt

SEQ ID NO: 8147942 - DNA, 23 bp, Homo sapiens
aatctatacttaggctggtaata

SEQ ID NO: 8147943 - DNA, 22 bp, Homo sapiens
aatctagagtgctaggtctgtg

SEQ ID NO: 8147944 - DNA, 22 bp, Homo sapiens
agaaagggatgaggtagctgct

SEQ ID NO: 8147945 - DNA, 22 bp, Homo sapiens
agaaagggatgaggtagctgct

SEQ ID NO: 8147946 - DNA, 22 bp, Homo sapiens
aatcgcaattacttttgcacca

SEQ ID NO: 8147947 - DNA, 22 bp, Homo sapiens
aatcctgtgtgactctggggag

SEQ ID NO: 8147948 - DNA, 22 bp, Homo sapiens
agaaagggaccagttcttttga

SEQ ID NO: 8147949 - DNA, 22 bp, Homo sapiens
agaaagggagagccagcacacg

SEQ ID NO: 8147950 - DNA, 22 bp, Homo sapiens
agaaagggagcgtggatcaatt

SEQ ID NO: 8147951 - DNA, 22 bp, Homo sapiens
agaaagggagagccagcacacg

SEQ ID NO: 8147952 - DNA, 22 bp, Homo sapiens
agaaagggagcgtggatcaatt

SEQ ID NO: 8147953 - DNA, 22 bp, Homo sapiens
agaaagggatgaggtagctgct

SEQ ID NO: 8147954 - DNA, 22 bp, Homo sapiens
agaaagggagcgtggatcaatt

SEQ ID NO: 8147955 - DNA, 22 bp, Homo sapiens
agaaagggagcgtggatcaatt

SEQ ID NO: 8147956 - DNA, 22 bp, Homo sapiens
agaaagggaactggcaaagcca

SEQ ID NO: 8147957 - DNA, 22 bp, Homo sapiens
aatcacagagtccagcagatga

SEQ ID NO: 8147958 - DNA, 22 bp, Homo sapiens
aatcacaattacttttgcacca

SEQ ID NO: 8147959 - DNA, 22 bp, Homo sapiens
aatcacaaatttagacagagct

SEQ ID NO: 8147960 - DNA, 22 bp, Homo sapiens
aatcacaaatgcaagttgtcac

SEQ ID NO: 8147961 - DNA, 22 bp, Homo sapiens
aatcacaaatgcaagttgtcac

SEQ ID NO: 8147962 - DNA, 22 bp, Homo sapiens
aatcacaggcatagattgctcc

SEQ ID NO: 8147963 - DNA, 22 bp, Homo sapiens
aatcacagccagcttccgctat

SEQ ID NO: 8147964 - DNA, 22 bp, Homo sapiens
aatcacagagtccagcagatga

SEQ ID NO: 8147965 - DNA, 22 bp, Homo sapiens
aatcacagtgggtactagattg

SEQ ID NO: 8147966 - DNA, 22 bp, Homo sapiens
aatcacatcactgagaatgagg

SEQ ID NO: 8147967 - DNA, 22 bp, Homo sapiens
aatcacagtttcaagtaatgca

SEQ ID NO: 8147968 - DNA, 22 bp, Homo sapiens
agaaagcttatgaatgggcaag

SEQ ID NO: 8147969 - DNA, 22 bp, Homo sapiens
agaaagcttatgaatgggcaag

SEQ ID NO: 8147970 - DNA, 22 bp, Homo sapiens
agaaactgacaggaaatgaatt

SEQ ID NO: 8147971 - DNA, 22 bp, Homo sapiens
agaaagctggagtcaagcagag

SEQ ID NO: 8147972 - DNA, 22 bp, Homo sapiens
agaaaggagaccagctctgccc

SEQ ID NO: 8147973 - DNA, 22 bp, Homo sapiens
agaaaggacatctccctttaag

SEQ ID NO: 8147974 - DNA, 22 bp, Homo sapiens
agaaaggagaccagctctgccc

SEQ ID NO: 8147975 - DNA, 17 bp, Homo sapiens
aatagctgctcagagag

SEQ ID NO: 8147976 - DNA, 22 bp, Homo sapiens
aatagctcactgatttctcttt

SEQ ID NO: 8147977 - DNA, 23 bp, Homo sapiens
aatagctggtaatgatagcacaa

SEQ ID NO: 8147978 - DNA, 22 bp, Homo sapiens
aatagcttatgggatagatgtt

SEQ ID NO: 8147979 - DNA, 22 bp, Homo sapiens
aatagctcactgatttctcttt

SEQ ID NO: 8147980 - DNA, 22 bp, Homo sapiens
aatagccaaagtgcatttatga

SEQ ID NO: 8147981 - DNA, 22 bp, Homo sapiens
aatagcatgttcatgataaaat

SEQ ID NO: 8147982 - DNA, 22 bp, Homo sapiens
aatagcatgttcatgataaaat

SEQ ID NO: 8147983 - DNA, 22 bp, Homo sapiens
aatagcatgttcatgataaaat

SEQ ID NO: 8147984 - DNA, 22 bp, Homo sapiens
aatagcatgtaagtttaaaaga

SEQ ID NO: 8147985 - DNA, 22 bp, Homo sapiens
aatagcatgcatcctgcataga

SEQ ID NO: 8147986 - DNA, 22 bp, Homo sapiens
aatagcatcttctgagacaaag

SEQ ID NO: 8147987 - DNA, 22 bp, Homo sapiens
aatagcatgtaagtttaaaaga

SEQ ID NO: 8147988 - DNA, 22 bp, Homo sapiens
aatagcatgtaagtttaaaaga

SEQ ID NO: 8147989 - DNA, 22 bp, Homo sapiens
aatagtaaaagatacagctaat

SEQ ID NO: 8147990 - DNA, 22 bp, Homo sapiens
aataggcagttggatatgcaag

SEQ ID NO: 8147991 - DNA, 22 bp, Homo sapiens
aataggaagtcacatcaaggga

SEQ ID NO: 8147992 - DNA, 22 bp, Homo sapiens
aataggaagcaccaaattctcc

SEQ ID NO: 8147993 - DNA, 22 bp, Homo sapiens
aatagcttttgtatgatgaaat

SEQ ID NO: 8147994 - DNA, 22 bp, Homo sapiens
actttgttgaagaatatgttag

SEQ ID NO: 8147995 - DNA, 22 bp, Homo sapiens
actttgttctaatagtatctct

SEQ ID NO: 8147996 - DNA, 22 bp, Homo sapiens
actttgatctaagtttctttga

SEQ ID NO: 8147997 - DNA, 22 bp, Homo sapiens
actttgacagcattttaattat

SEQ ID NO: 8147998 - DNA, 22 bp, Homo sapiens
actttgttttatagcacataag

SEQ ID NO: 8147999 - DNA, 22 bp, Homo sapiens
actttgttgttccttgtctaaa

SEQ ID NO: 8148000 - DNA, 22 bp, Homo sapiens
actttgttgttccttgtctaaa

SEQ ID NO: 8148001 - DNA, 22 bp, Homo sapiens
acttttaaatgagtttcagttg

SEQ ID NO: 8148002 - DNA, 22 bp, Homo sapiens
acttttaaatgagtttcagttg

SEQ ID NO: 8148003 - DNA, 22 bp, Homo sapiens
acttttaaatgagtttcagttg

SEQ ID NO: 8148004 - DNA, 22 bp, Homo sapiens
acttttatgataatcaatgttc

SEQ ID NO: 8148005 - DNA, 22 bp, Homo sapiens
acttttatcaaggaagtgatct

SEQ ID NO: 8148006 - DNA, 22 bp, Homo sapiens
acttttatcaaggaagtgatct

SEQ ID NO: 8148007 - DNA, 22 bp, Homo sapiens
acttttatgataatcaatgttc

SEQ ID NO: 8148008 - DNA, 22 bp, Homo sapiens
acttttatcaaggaagtgatct

SEQ ID NO: 8148009 - DNA, 22 bp, Homo sapiens
acttttatcaaggaagtgatct

SEQ ID NO: 8148010 - DNA, 22 bp, Homo sapiens
aatcaagtcaaccatcatgtgc

SEQ ID NO: 8148011 - DNA, 22 bp, Homo sapiens
aatcaagagttgtgtaatattt

SEQ ID NO: 8148012 - DNA, 22 bp, Homo sapiens
acttttatgataatcaatgttc

SEQ ID NO: 8148013 - DNA, 22 bp, Homo sapiens
acttttatgataatcaatgttc

SEQ ID NO: 8148014 - DNA, 22 bp, Homo sapiens
acttttatgataatcaatgttc

SEQ ID NO: 8148015 - DNA, 22 bp, Homo sapiens
acttttcaaatgggaaactcag

SEQ ID NO: 8148016 - DNA, 20 bp, Homo sapiens
aagcttccttgggcgcccgg

SEQ ID NO: 8148017 - DNA, 22 bp, Homo sapiens
aagcttctttacaggagagatt

SEQ ID NO: 8148018 - DNA, 22 bp, Homo sapiens
aagcttgcagggcataatttgc

SEQ ID NO: 8148019 - DNA, 22 bp, Homo sapiens
aaggaagaagggaagttactta

SEQ ID NO: 8148020 - DNA, 22 bp, Homo sapiens
aagcttgtagagtttgacttcc

SEQ ID NO: 8148021 - DNA, 22 bp, Homo sapiens
aagcttgtagagtttgacttcc

SEQ ID NO: 8148022 - DNA, 22 bp, Homo sapiens
aaggaagaagggaagttactta

SEQ ID NO: 8148023 - DNA, 22 bp, Homo sapiens
aagctgttggcagatagctctg

SEQ ID NO: 8148024 - DNA, 22 bp, Homo sapiens
aagcttaatcagtctggttgca

SEQ ID NO: 8148025 - DNA, 22 bp, Homo sapiens
acagctggaggggctgcagagg

SEQ ID NO: 8148026 - DNA, 22 bp, Homo sapiens
acagctggaggggctgcagagg

SEQ ID NO: 8148027 - DNA, 22 bp, Homo sapiens
acagctggaggggctgcagagg

SEQ ID NO: 8148028 - DNA, 22 bp, Homo sapiens
acagctggagccctatggctgg

SEQ ID NO: 8148029 - DNA, 22 bp, Homo sapiens
acagctggagccctatggctgg

SEQ ID NO: 8148030 - DNA, 22 bp, Homo sapiens
acagctggaggccccattgtcc

SEQ ID NO: 8148031 - DNA, 22 bp, Homo sapiens
acagctggacaggggagagttt

SEQ ID NO: 8148032 - DNA, 22 bp, Homo sapiens
acagctggagtgttggtgaggt

SEQ ID NO: 8148033 - DNA, 22 bp, Homo sapiens
acagctggagtgaggatggagt

SEQ ID NO: 8148034 - DNA, 22 bp, Homo sapiens
acagctggagtgaggatggagt

SEQ ID NO: 8148035 - DNA, 22 bp, Homo sapiens
acagctggaggtctgtgagcac

SEQ ID NO: 8148036 - DNA, 22 bp, Homo sapiens
aagctgtgtattacagaatatt

SEQ ID NO: 8148037 - DNA, 22 bp, Homo sapiens
aagctgtgaaatctctagtgca

SEQ ID NO: 8148038 - DNA, 22 bp, Homo sapiens
aagctgtgaagagcaagtgagg

SEQ ID NO: 8148039 - DNA, 22 bp, Homo sapiens
aagctgtgaaatctctagtgca

SEQ ID NO: 8148040 - DNA, 22 bp, Homo sapiens
aagctgtgaagagcaagtgagg

SEQ ID NO: 8148041 - DNA, 22 bp, Homo sapiens
aagctgtggcttggaggaaaca

SEQ ID NO: 8148042 - DNA, 22 bp, Homo sapiens
aaggacaaagcagagctggatg

SEQ ID NO: 8148043 - DNA, 16 bp, Homo sapiens
aaggaatgtcattctg

SEQ ID NO: 8148044 - DNA, 17 bp, Homo sapiens
aaggaatgtcagaagtt

SEQ ID NO: 8148045 - DNA, 21 bp, Homo sapiens
aaggaatgaatggatggatga

SEQ ID NO: 8148046 - DNA, 22 bp, Homo sapiens
aaggaatgctctaggagggcag

SEQ ID NO: 8148047 - DNA, 22 bp, Homo sapiens
aaggaatgctctaggagggcag

SEQ ID NO: 8148048 - DNA, 19 bp, Homo sapiens
aaggaatggctttaagtag

SEQ ID NO: 8148049 - DNA, 22 bp, Homo sapiens
aaggaatgctctaggagggcag

SEQ ID NO: 8148050 - DNA, 19 bp, Homo sapiens
aaggaatggctttaagtag

SEQ ID NO: 8148051 - DNA, 17 bp, Homo sapiens
aaggaatgtcagaagtt

SEQ ID NO: 8148052 - DNA, 19 bp, Homo sapiens
aaggaatggctttaagtag

SEQ ID NO: 8148053 - DNA, 22 bp, Homo sapiens
aaggaaggttcatagtcaaaga

SEQ ID NO: 8148054 - DNA, 22 bp, Homo sapiens
aaggaaggttcatagtcaaaga

SEQ ID NO: 8148055 - DNA, 22 bp, Homo sapiens
aaggaaggtactcagtgattct

SEQ ID NO: 8148056 - DNA, 20 bp, Homo sapiens
aaggaatatttgtatctggg

SEQ ID NO: 8148057 - DNA, 22 bp, Homo sapiens
aaggaagttttcttggttccta

SEQ ID NO: 8148058 - DNA, 22 bp, Homo sapiens
aaggaagttaagtcttagaatg

SEQ ID NO: 8148059 - DNA, 22 bp, Homo sapiens
aaggaagtgattttcatgtcaa

SEQ ID NO: 8148060 - DNA, 21 bp, Homo sapiens
aaggaagtgactttagtggtt

SEQ ID NO: 8148061 - DNA, 22 bp, Homo sapiens
aaggaagggaaatagtgatgtc

SEQ ID NO: 8148062 - DNA, 22 bp, Homo sapiens
aaggaaggaattgatcatgcgc

SEQ ID NO: 8148063 - DNA, 22 bp, Homo sapiens
aaggaagggaaatagtgatgtc

SEQ ID NO: 8148064 - DNA, 22 bp, Homo sapiens
aaggaagggaaatagtgatgtc

SEQ ID NO: 8148065 - DNA, 22 bp, Homo sapiens
aaggaagcagccagagaccctc

SEQ ID NO: 8148066 - DNA, 22 bp, Homo sapiens
aaggaagcagcaatgcatgatt

SEQ ID NO: 8148067 - DNA, 22 bp, Homo sapiens
aaggaagatgaggtgctgctta

SEQ ID NO: 8148068 - DNA, 22 bp, Homo sapiens
aaggaagatgctggcctgggga

SEQ ID NO: 8148069 - DNA, 22 bp, Homo sapiens
aaggaagatgctggcctgggga

SEQ ID NO: 8148070 - DNA, 22 bp, Homo sapiens
aaggacagagagccattccaga

SEQ ID NO: 8148071 - DNA, 22 bp, Homo sapiens
aaggacagagagccattccaga

SEQ ID NO: 8148072 - DNA, 22 bp, Homo sapiens
aaggacaagtagtatttgcatc

SEQ ID NO: 8148073 - DNA, 22 bp, Homo sapiens
aaggacagaaacagattgctgg

SEQ ID NO: 8148074 - DNA, 22 bp, Homo sapiens
aaggagggaaagcagtgcttct

SEQ ID NO: 8148075 - DNA, 22 bp, Homo sapiens
aaggagggaaagcagtgcttct

SEQ ID NO: 8148076 - DNA, 22 bp, Homo sapiens
aaggatgattggtaatgacact

SEQ ID NO: 8148077 - DNA, 22 bp, Homo sapiens
aaggatgaacattaatacatca

SEQ ID NO: 8148078 - DNA, 22 bp, Homo sapiens
aaggcaaatgtgttcttttagt

SEQ ID NO: 8148079 - DNA, 22 bp, Homo sapiens
aaggatttttgctaggaagaca

SEQ ID NO: 8148080 - DNA, 22 bp, Homo sapiens
aaggatgtgactcagtcagcta

SEQ ID NO: 8148081 - DNA, 22 bp, Homo sapiens
aaggattccagttttacttgcc

SEQ ID NO: 8148082 - DNA, 22 bp, Homo sapiens
aaggattgtctggctatttatg

SEQ ID NO: 8148083 - DNA, 22 bp, Homo sapiens
aaggattcaagaaatggtgtag

SEQ ID NO: 8148084 - DNA, 22 bp, Homo sapiens
acatgcatggacatgtatatat

SEQ ID NO: 8148085 - DNA, 22 bp, Homo sapiens
acatgcatgctttggtgggtgt

SEQ ID NO: 8148086 - DNA, 22 bp, Homo sapiens
acatgcatggctgcttaaatta

SEQ ID NO: 8148087 - DNA, 22 bp, Homo sapiens
acatgcatggtgttgggttgga

SEQ ID NO: 8148088 - DNA, 22 bp, Homo sapiens
acatgcatgtctatgggcaggt

SEQ ID NO: 8148089 - DNA, 22 bp, Homo sapiens
acatgcatgtctatgggcaggt

SEQ ID NO: 8148090 - DNA, 22 bp, Homo sapiens
acatgcatactgctgccaacgc

SEQ ID NO: 8148091 - DNA, 22 bp, Homo sapiens
acatgcatatacttaaatatgt

SEQ ID NO: 8148092 - DNA, 22 bp, Homo sapiens
acatgcatatacttaaatatgt

SEQ ID NO: 8148093 - DNA, 19 bp, Homo sapiens
acatgcatatggacagttg

SEQ ID NO: 8148094 - DNA, 22 bp, Homo sapiens
acatgcatctctgggacacatg

SEQ ID NO: 8148095 - DNA, 22 bp, Homo sapiens
acatgacagtgcttagcaaact

SEQ ID NO: 8148096 - DNA, 22 bp, Homo sapiens
acatgacacctctggctgggtg

SEQ ID NO: 8148097 - DNA, 22 bp, Homo sapiens
acatgacacaggcctggccaat

SEQ ID NO: 8148098 - DNA, 22 bp, Homo sapiens
acatgacagtgcttagcaaact

SEQ ID NO: 8148099 - DNA, 22 bp, Homo sapiens
acatgcatacacgtacatacct

SEQ ID NO: 8148100 - DNA, 22 bp, Homo sapiens
acatgcatacgtgtgtttaaaa

SEQ ID NO: 8148101 - DNA, 22 bp, Homo sapiens
acatccctcagtcagactgtaa

SEQ ID NO: 8148102 - DNA, 22 bp, Homo sapiens
acatcctcccgatctactggct

SEQ ID NO: 8148103 - DNA, 22 bp, Homo sapiens
acatcctcccgatctactggct

SEQ ID NO: 8148104 - DNA, 22 bp, Homo sapiens
acatctcaaattccaggctcca

SEQ ID NO: 8148105 - DNA, 22 bp, Homo sapiens
acatctcacttctttgaaggct

SEQ ID NO: 8148106 - DNA, 22 bp, Homo sapiens
acatctcacttctttgaaggct

SEQ ID NO: 8148107 - DNA, 22 bp, Homo sapiens
acatctatgaacatttaagtag

SEQ ID NO: 8148108 - DNA, 22 bp, Homo sapiens
acatccttagggcagcagccag

SEQ ID NO: 8148109 - DNA, 22 bp, Homo sapiens
acatccttgattatgtaaggat

SEQ ID NO: 8148110 - DNA, 22 bp, Homo sapiens
acatcgatggtcagccgaggag

SEQ ID NO: 8148111 - DNA, 22 bp, Homo sapiens
acatcgatggatagagcttgct

SEQ ID NO: 8148112 - DNA, 20 bp, Homo sapiens
acatgaacagggctacagca

SEQ ID NO: 8148113 - DNA, 22 bp, Homo sapiens
acatgaaattctagctgaaccc

SEQ ID NO: 8148114 - DNA, 22 bp, Homo sapiens
acatctcagaactgagtaaccg

SEQ ID NO: 8148115 - DNA, 22 bp, Homo sapiens
acatctcagaactgagtaaccg

SEQ ID NO: 8148116 - DNA, 22 bp, Homo sapiens
acatctcagaactgagtaaccg

SEQ ID NO: 8148117 - DNA, 22 bp, Homo sapiens
acatgaagtggtcagatcaaac

SEQ ID NO: 8148118 - DNA, 22 bp, Homo sapiens
acatgaagtggtcagatcaaac

SEQ ID NO: 8148119 - DNA, 22 bp, Homo sapiens
acatgaagcaagaaagatgcta

SEQ ID NO: 8148120 - DNA, 22 bp, Homo sapiens
acatgaatatatgaagttcaac

SEQ ID NO: 8148121 - DNA, 22 bp, Homo sapiens
acatgaagtggtcagatcaaac

SEQ ID NO: 8148122 - DNA, 22 bp, Homo sapiens
acatgaatgcagccataacact

SEQ ID NO: 8148123 - DNA, 22 bp, Homo sapiens
acatgaatgaagactttacaat

SEQ ID NO: 8148124 - DNA, 22 bp, Homo sapiens
acatgaatatatgaagttcaac

SEQ ID NO: 8148125 - DNA, 22 bp, Homo sapiens
aaggcaatgactgatttagaat

SEQ ID NO: 8148126 - DNA, 22 bp, Homo sapiens
aaggcaactgtaaaacatgcac

SEQ ID NO: 8148127 - DNA, 22 bp, Homo sapiens
aaggcaaggttcaccgtgctat

SEQ ID NO: 8148128 - DNA, 22 bp, Homo sapiens
aaggcacagaggcagggcactt

SEQ ID NO: 8148129 - DNA, 22 bp, Homo sapiens
aaggcacagaggcagggcactt

SEQ ID NO: 8148130 - DNA, 22 bp, Homo sapiens
aaggcacacagttagatagagc

SEQ ID NO: 8148131 - DNA, 18 bp, Homo sapiens
aaggcacaggagaacatt

SEQ ID NO: 8148132 - DNA, 18 bp, Homo sapiens
aaggcacaggagaacatt

SEQ ID NO: 8148133 - DNA, 22 bp, Homo sapiens
aaggcacagccacttgatcatc

SEQ ID NO: 8148134 - DNA, 22 bp, Homo sapiens
aaggcacagccacttgatcatc

SEQ ID NO: 8148135 - DNA, 17 bp, Homo sapiens
aaggcacagggcactgg

SEQ ID NO: 8148136 - DNA, 22 bp, Homo sapiens
aaggcacatattgcagatcttg

SEQ ID NO: 8148137 - DNA, 22 bp, Homo sapiens
aaggccagagttgaactgctcc

SEQ ID NO: 8148138 - DNA, 22 bp, Homo sapiens
aaggccagagttgaactgctcc

SEQ ID NO: 8148139 - DNA, 22 bp, Homo sapiens
aaggccagagttgaactgctcc

SEQ ID NO: 8148140 - DNA, 22 bp, Homo sapiens
aaggccagattcactttacaat

SEQ ID NO: 8148141 - DNA, 22 bp, Homo sapiens
aaggccagagttgaactgctcc

SEQ ID NO: 8148142 - DNA, 22 bp, Homo sapiens
aaggccagattcactttacaat

SEQ ID NO: 8148143 - DNA, 22 bp, Homo sapiens
aaggccagcagtttgagaccag

SEQ ID NO: 8148144 - DNA, 22 bp, Homo sapiens
aaggccagattctctctagggg

SEQ ID NO: 8148145 - DNA, 22 bp, Homo sapiens
aaggccagcagtttgagaccag

SEQ ID NO: 8148146 - DNA, 22 bp, Homo sapiens
aaggccagcagtttgagaccag

SEQ ID NO: 8148147 - DNA, 22 bp, Homo sapiens
aaggccagattctctctagggg

SEQ ID NO: 8148148 - DNA, 22 bp, Homo sapiens
aaggccagattctctctagggg

SEQ ID NO: 8148149 - DNA, 22 bp, Homo sapiens
aaggccagccctaatgatgctc

SEQ ID NO: 8148150 - DNA, 22 bp, Homo sapiens
aaggccagccctaatgatgctc

SEQ ID NO: 8148151 - DNA, 22 bp, Homo sapiens
aaggccagccctaatgatgctc

SEQ ID NO: 8148152 - DNA, 22 bp, Homo sapiens
aaggccagccctaatgatgctc

SEQ ID NO: 8148153 - DNA, 22 bp, Homo sapiens
aaggccagcctgagagctaaca

SEQ ID NO: 8148154 - DNA, 22 bp, Homo sapiens
aaggccagcctgagagctaaca

SEQ ID NO: 8148155 - DNA, 22 bp, Homo sapiens
aaggccagcctgagagctaaca

SEQ ID NO: 8148156 - DNA, 22 bp, Homo sapiens
acatccatttgtcagctcttga

SEQ ID NO: 8148157 - DNA, 22 bp, Homo sapiens
acatccattttgttcaaaagca

SEQ ID NO: 8148158 - DNA, 22 bp, Homo sapiens
aaggccagccttggaaccctga

SEQ ID NO: 8148159 - DNA, 22 bp, Homo sapiens
aaggccagccttggaaccctga

SEQ ID NO: 8148160 - DNA, 22 bp, Homo sapiens
aaggccagccttggaaccctga

SEQ ID NO: 8148161 - DNA, 22 bp, Homo sapiens
aaggccagagcagactggagtt

SEQ ID NO: 8148162 - DNA, 22 bp, Homo sapiens
aaggccagagcagactggagtt

SEQ ID NO: 8148163 - DNA, 22 bp, Homo sapiens
aaggccagagcgtgtcctgcct

SEQ ID NO: 8148164 - DNA, 22 bp, Homo sapiens
aaggccagagcgtgtcctgcct

SEQ ID NO: 8148165 - DNA, 22 bp, Homo sapiens
aaggccagagcgtgtcctgcct

SEQ ID NO: 8148166 - DNA, 22 bp, Homo sapiens
aaggccagagtactagaggctg

SEQ ID NO: 8148167 - DNA, 22 bp, Homo sapiens
aaggccagagtactagaggctg

SEQ ID NO: 8148168 - DNA, 22 bp, Homo sapiens
aaggccagagtactagaggctg

SEQ ID NO: 8148169 - DNA, 22 bp, Homo sapiens
aaggccagagcgtgtcctgcct

SEQ ID NO: 8148170 - DNA, 22 bp, Homo sapiens
aaggccagagtactagaggctg

SEQ ID NO: 8148171 - DNA, 22 bp, Homo sapiens
aaggccagagcagactggagtt

SEQ ID NO: 8148172 - DNA, 22 bp, Homo sapiens
aaggccagagcagactggagtt

SEQ ID NO: 8148173 - DNA, 22 bp, Homo sapiens
aaggccagagcagactggagtt

SEQ ID NO: 8148174 - DNA, 22 bp, Homo sapiens
aaggccagagcagactggagtt

SEQ ID NO: 8148175 - DNA, 22 bp, Homo sapiens
aaggcatgtgtcctcagagaga

SEQ ID NO: 8148176 - DNA, 22 bp, Homo sapiens
aaggcatgtgtcctcagagaga

SEQ ID NO: 8148177 - DNA, 22 bp, Homo sapiens
aagggtggtgtaggagatcaaa

SEQ ID NO: 8148178 - DNA, 22 bp, Homo sapiens
aagggtgggccctggcagccat

SEQ ID NO: 8148179 - DNA, 22 bp, Homo sapiens
aagggtgggcaccgccaggtca

SEQ ID NO: 8148180 - DNA, 22 bp, Homo sapiens
aagggtgggccctggcagccat

SEQ ID NO: 8148181 - DNA, 22 bp, Homo sapiens
aagggtgggcaccgccaggtca

SEQ ID NO: 8148182 - DNA, 22 bp, Homo sapiens
aagggtgggcaccgccaggtca

SEQ ID NO: 8148183 - DNA, 22 bp, Homo sapiens
aagggtggatttctgagctcta

SEQ ID NO: 8148184 - DNA, 22 bp, Homo sapiens
aagggtggatttctgagctcta

SEQ ID NO: 8148185 - DNA, 22 bp, Homo sapiens
aaggggtgctgttggaaaccca

SEQ ID NO: 8148186 - DNA, 22 bp, Homo sapiens
aaggggtgggcattagagcagt

SEQ ID NO: 8148187 - DNA, 19 bp, Homo sapiens
aagggtcacaagcagcaga

SEQ ID NO: 8148188 - DNA, 22 bp, Homo sapiens
aaggggtgggcattagagcagt

SEQ ID NO: 8148189 - DNA, 19 bp, Homo sapiens
aagggtcacaagcagcaga

SEQ ID NO: 8148190 - DNA, 22 bp, Homo sapiens
aagggtgcattgcgcggggctg

SEQ ID NO: 8148191 - DNA, 22 bp, Homo sapiens
aagggtgcaaagcactctagct

SEQ ID NO: 8148192 - DNA, 22 bp, Homo sapiens
aagggtgctgctatcaggaagc

SEQ ID NO: 8148193 - DNA, 22 bp, Homo sapiens
aagggtgcgacctaggagtgag

SEQ ID NO: 8148194 - DNA, 22 bp, Homo sapiens
aagggtgaagggtggtggccta

SEQ ID NO: 8148195 - DNA, 22 bp, Homo sapiens
aagggttgaagataaataaggt

SEQ ID NO: 8148196 - DNA, 22 bp, Homo sapiens
aagggttgcaaggtcagaggaa

SEQ ID NO: 8148197 - DNA, 22 bp, Homo sapiens
aaggtacagaaattaacaagga

SEQ ID NO: 8148198 - DNA, 22 bp, Homo sapiens
acccaggcagcaggagctaaag

SEQ ID NO: 8148199 - DNA, 22 bp, Homo sapiens
aaggtacagttttaagaataag

SEQ ID NO: 8148200 - DNA, 19 bp, Homo sapiens
aaggggtgagggaagcaga

SEQ ID NO: 8148201 - DNA, 22 bp, Homo sapiens
aaggggggcacctgcatgcccg

SEQ ID NO: 8148202 - DNA, 22 bp, Homo sapiens
accagcacctgataggcagtaa

SEQ ID NO: 8148203 - DNA, 22 bp, Homo sapiens
aaggggaaaaagtgttaggagt

SEQ ID NO: 8148204 - DNA, 22 bp, Homo sapiens
aaggggaagagaccgcagagtc

SEQ ID NO: 8148205 - DNA, 22 bp, Homo sapiens
accagagtaatgtgtggaaatt

SEQ ID NO: 8148206 - DNA, 22 bp, Homo sapiens
accagagttggaataattttga

SEQ ID NO: 8148207 - DNA, 22 bp, Homo sapiens
accagagggcaaaccccagtgt

SEQ ID NO: 8148208 - DNA, 22 bp, Homo sapiens
accagagggagacttcctcttc

SEQ ID NO: 8148209 - DNA, 22 bp, Homo sapiens
accagaggctctgccacctcca

SEQ ID NO: 8148210 - DNA, 22 bp, Homo sapiens
accagaggaggaattaccttcc

SEQ ID NO: 8148211 - DNA, 22 bp, Homo sapiens
accagagctggctctgagcacc

SEQ ID NO: 8148212 - DNA, 22 bp, Homo sapiens
accagagctggctctgagcacc

SEQ ID NO: 8148213 - DNA, 22 bp, Homo sapiens
accagagctggctctgagcacc

SEQ ID NO: 8148214 - DNA, 22 bp, Homo sapiens
accagagcttacatgctagaaa

SEQ ID NO: 8148215 - DNA, 22 bp, Homo sapiens
accagagcttacatgctagaaa

SEQ ID NO: 8148216 - DNA, 22 bp, Homo sapiens
accagagcttacatgctagaaa

SEQ ID NO: 8148217 - DNA, 22 bp, Homo sapiens
aagggctggatctctctgagca

SEQ ID NO: 8148218 - DNA, 22 bp, Homo sapiens
aagggctggagaggaaaggttg

SEQ ID NO: 8148219 - DNA, 22 bp, Homo sapiens
aagggctggatctctctgagca

SEQ ID NO: 8148220 - DNA, 22 bp, Homo sapiens
aagggctggatctctctgagca

SEQ ID NO: 8148221 - DNA, 22 bp, Homo sapiens
aagggctggatctctctgagca

SEQ ID NO: 8148222 - DNA, 22 bp, Homo sapiens
aagggctggccacattctgggt

SEQ ID NO: 8148223 - DNA, 22 bp, Homo sapiens
aagggctggccacattctgggt

SEQ ID NO: 8148224 - DNA, 22 bp, Homo sapiens
aagggctggccacattctgggt

SEQ ID NO: 8148225 - DNA, 22 bp, Homo sapiens
aagggctggccacattctgggt

SEQ ID NO: 8148226 - DNA, 22 bp, Homo sapiens
aagggctggccctgggaagagt

SEQ ID NO: 8148227 - DNA, 22 bp, Homo sapiens
aagggctggccctgggaagagt

SEQ ID NO: 8148228 - DNA, 22 bp, Homo sapiens
aagggctggccctgggaagagt

SEQ ID NO: 8148229 - DNA, 18 bp, Homo sapiens
aagggctggcctttggag

SEQ ID NO: 8148230 - DNA, 18 bp, Homo sapiens
aagggctggcctttggag

SEQ ID NO: 8148231 - DNA, 22 bp, Homo sapiens
aagggctggccctgggaagagt

SEQ ID NO: 8148232 - DNA, 22 bp, Homo sapiens
aagggctgggtctggttaaccc

SEQ ID NO: 8148233 - DNA, 19 bp, Homo sapiens
aagggctgggcacctcact

SEQ ID NO: 8148234 - DNA, 19 bp, Homo sapiens
aagggctgggcacctcact

SEQ ID NO: 8148235 - DNA, 22 bp, Homo sapiens
aagggctgcaatccaaaacact

SEQ ID NO: 8148236 - DNA, 22 bp, Homo sapiens
aagggctggagactgggtcttc

SEQ ID NO: 8148237 - DNA, 22 bp, Homo sapiens
aagggctgcaatccaaaacact

SEQ ID NO: 8148238 - DNA, 22 bp, Homo sapiens
aagggctggagactgggtcttc

SEQ ID NO: 8148239 - DNA, 22 bp, Homo sapiens
aagggctggagaggaaaggttg

SEQ ID NO: 8148240 - DNA, 22 bp, Homo sapiens
aagggctggagaggaaaggttg

SEQ ID NO: 8148241 - DNA, 22 bp, Homo sapiens
acatttcagtgagctattgaag

SEQ ID NO: 8148242 - DNA, 22 bp, Homo sapiens
acatttcagtgagctattgaag

SEQ ID NO: 8148243 - DNA, 23 bp, Homo sapiens
acatttcatataaaagggatcag

SEQ ID NO: 8148244 - DNA, 22 bp, Homo sapiens
acatttcagattcatgaagtga

SEQ ID NO: 8148245 - DNA, 22 bp, Homo sapiens
acatttcagcgtgcatgacatg

SEQ ID NO: 8148246 - DNA, 22 bp, Homo sapiens
acatttcagattcatgaagtga

SEQ ID NO: 8148247 - DNA, 22 bp, Homo sapiens
acatttcagcgtgcatgacatg

SEQ ID NO: 8148248 - DNA, 22 bp, Homo sapiens
acatttcagcgtgcatgacatg

SEQ ID NO: 8148249 - DNA, 22 bp, Homo sapiens
acatttcagtaagtgttaattt

SEQ ID NO: 8148250 - DNA, 22 bp, Homo sapiens
acatttcagcgtgcatgacatg

SEQ ID NO: 8148251 - DNA, 22 bp, Homo sapiens
acatgcatgttgtgtagggggg

SEQ ID NO: 8148252 - DNA, 22 bp, Homo sapiens
acatgcatgtgaatatggacac

SEQ ID NO: 8148253 - DNA, 22 bp, Homo sapiens
acatgcatgtgaatatggacac

SEQ ID NO: 8148254 - DNA, 22 bp, Homo sapiens
aagggcagaatagagaagatgg

SEQ ID NO: 8148255 - DNA, 22 bp, Homo sapiens
aagggcagaatagagaagatgg

SEQ ID NO: 8148256 - DNA, 22 bp, Homo sapiens
aagggcagaatagagaagatgg

SEQ ID NO: 8148257 - DNA, 22 bp, Homo sapiens
aagggcagaaagggacgctttg

SEQ ID NO: 8148258 - DNA, 20 bp, Homo sapiens
aagggcagagggaacagact

SEQ ID NO: 8148259 - DNA, 22 bp, Homo sapiens
aagggcagaatagagaagatgg

SEQ ID NO: 8148260 - DNA, 20 bp, Homo sapiens
aagggcagagggaacagact

SEQ ID NO: 8148261 - DNA, 20 bp, Homo sapiens
aagggcagagggaacagact

SEQ ID NO: 8148262 - DNA, 20 bp, Homo sapiens
aagggcagagggaacagact

SEQ ID NO: 8148263 - DNA, 22 bp, Homo sapiens
aagggcagagggaatcccacat

SEQ ID NO: 8148264 - DNA, 22 bp, Homo sapiens
aagggcagagggaatcccacat

SEQ ID NO: 8148265 - DNA, 22 bp, Homo sapiens
acatttcagatgtaatgtgatg

SEQ ID NO: 8148266 - DNA, 22 bp, Homo sapiens
acatttcagatgtaatgtgatg

SEQ ID NO: 8148267 - DNA, 22 bp, Homo sapiens
acatttcagatgtaatgtgatg

SEQ ID NO: 8148268 - DNA, 22 bp, Homo sapiens
acatttcagattcatgaagtga

SEQ ID NO: 8148269 - DNA, 22 bp, Homo sapiens
acatttcagattcatgaagtga

SEQ ID NO: 8148270 - DNA, 22 bp, Homo sapiens
acatttcagattcatgaagtga

SEQ ID NO: 8148271 - DNA, 22 bp, Homo sapiens
acccagggctcaagcgtaggca

SEQ ID NO: 8148272 - DNA, 22 bp, Homo sapiens
acccagggcttaaggcggtgca

SEQ ID NO: 8148273 - DNA, 22 bp, Homo sapiens
acccaggggcagccttgctgtg

SEQ ID NO: 8148274 - DNA, 22 bp, Homo sapiens
acccaggccattggcaagagtc

SEQ ID NO: 8148275 - DNA, 22 bp, Homo sapiens
acccagggagtgctcctgttct

SEQ ID NO: 8148276 - DNA, 22 bp, Homo sapiens
acccagggctcaagcgtaggca

SEQ ID NO: 8148277 - DNA, 22 bp, Homo sapiens
acccaggggcgaagctggccac

SEQ ID NO: 8148278 - DNA, 22 bp, Homo sapiens
acccaggggcagccttgctgtg

SEQ ID NO: 8148279 - DNA, 22 bp, Homo sapiens
acccaggggcgaagctggccac

SEQ ID NO: 8148280 - DNA, 22 bp, Homo sapiens
acccagggtagaacctcagagc

SEQ ID NO: 8148281 - DNA, 22 bp, Homo sapiens
aaggtggtcttactgatggtat

SEQ ID NO: 8148282 - DNA, 22 bp, Homo sapiens
aaggtggtcttactgatggtat

SEQ ID NO: 8148283 - DNA, 22 bp, Homo sapiens
acccagggtagaacctcagagc

SEQ ID NO: 8148284 - DNA, 19 bp, Homo sapiens
acccaggggtttatgtgtg

SEQ ID NO: 8148285 - DNA, 22 bp, Homo sapiens
aaggtggtgagtacagttaggt

SEQ ID NO: 8148286 - DNA, 22 bp, Homo sapiens
aaggtggtgatcatcttgaagg

SEQ ID NO: 8148287 - DNA, 22 bp, Homo sapiens
aaggtggtgagtacagttaggt

SEQ ID NO: 8148288 - DNA, 22 bp, Homo sapiens
aaggtggttgcaattaccataa

SEQ ID NO: 8148289 - DNA, 22 bp, Homo sapiens
aaggtggttcgctggtacccag

SEQ ID NO: 8148290 - DNA, 22 bp, Homo sapiens
aaggtggtgcttctgctcctct

SEQ ID NO: 8148291 - DNA, 22 bp, Homo sapiens
aaggtggtgatcatcttgaagg

SEQ ID NO: 8148292 - DNA, 22 bp, Homo sapiens
aaggtggtgcttctgctcctct

SEQ ID NO: 8148293 - DNA, 22 bp, Homo sapiens
aaggtggtttgctaatcccaac

SEQ ID NO: 8148294 - DNA, 22 bp, Homo sapiens
aaggtggtttgcagacagaata

SEQ ID NO: 8148295 - DNA, 22 bp, Homo sapiens
aaggtggtttgattatcccact

SEQ ID NO: 8148296 - DNA, 22 bp, Homo sapiens
aaggtggtttgattatcccact

SEQ ID NO: 8148297 - DNA, 22 bp, Homo sapiens
aaggtggttgtaggctggtctg

SEQ ID NO: 8148298 - DNA, 22 bp, Homo sapiens
aaggtggttgtaggctggtctg

SEQ ID NO: 8148299 - DNA, 22 bp, Homo sapiens
aaggtggttgtaggctggtctg

SEQ ID NO: 8148300 - DNA, 22 bp, Homo sapiens
aaggtggttgcaattaccataa

SEQ ID NO: 8148301 - DNA, 22 bp, Homo sapiens
aaggtggttcgctggtacccag

SEQ ID NO: 8148302 - DNA, 22 bp, Homo sapiens
acctcaagaatgtataacacag

SEQ ID NO: 8148303 - DNA, 22 bp, Homo sapiens
acctagtttttcagcaaataca

SEQ ID NO: 8148304 - DNA, 20 bp, Homo sapiens
acctcctggaagcaggtgcc

SEQ ID NO: 8148305 - DNA, 20 bp, Homo sapiens
acctcctggaagcaggtgcc

SEQ ID NO: 8148306 - DNA, 21 bp, Homo sapiens
acctcctggcatcctgttccc

SEQ ID NO: 8148307 - DNA, 20 bp, Homo sapiens
acctcctggaagcaggtgcc

SEQ ID NO: 8148308 - DNA, 22 bp, Homo sapiens
aaggtgtcaccagattggcagg

SEQ ID NO: 8148309 - DNA, 22 bp, Homo sapiens
aaggtgtcaaactagaagatgt

SEQ ID NO: 8148310 - DNA, 19 bp, Homo sapiens
aaggtggtttgtctctgta

SEQ ID NO: 8148311 - DNA, 22 bp, Homo sapiens
aaggtggtttgcagacagaata

SEQ ID NO: 8148312 - DNA, 22 bp, Homo sapiens
aaggtggtttgctaatcccaac

SEQ ID NO: 8148313 - DNA, 19 bp, Homo sapiens
aaggtggtttgtctctgta

SEQ ID NO: 8148314 - DNA, 22 bp, Homo sapiens
acctatgtacagttttactagt

SEQ ID NO: 8148315 - DNA, 22 bp, Homo sapiens
aaggtgtcaccagattggcagg

SEQ ID NO: 8148316 - DNA, 22 bp, Homo sapiens
aaggtgtcaaactagaagatgt

SEQ ID NO: 8148317 - DNA, 22 bp, Homo sapiens
aaggtgtcaccagattggcagg

SEQ ID NO: 8148318 - DNA, 22 bp, Homo sapiens
acctcctggctgctcatggaac

SEQ ID NO: 8148319 - DNA, 22 bp, Homo sapiens
acctcctggcttatcatggaca

SEQ ID NO: 8148320 - DNA, 22 bp, Homo sapiens
acctcctggcttatcatggaca

SEQ ID NO: 8148321 - DNA, 22 bp, Homo sapiens
acctcctggtgcccaagtgttt

SEQ ID NO: 8148322 - DNA, 22 bp, Homo sapiens
acctcctggtgcccaagtgttt

SEQ ID NO: 8148323 - DNA, 22 bp, Homo sapiens
acctcctggctgctcatggaac

SEQ ID NO: 8148324 - DNA, 20 bp, Homo sapiens
acctcctggcgggcatcctc

SEQ ID NO: 8148325 - DNA, 20 bp, Homo sapiens
acctcctggcgggcatcctc

SEQ ID NO: 8148326 - DNA, 22 bp, Homo sapiens
acctcctggcctcaagcaatcc

SEQ ID NO: 8148327 - DNA, 22 bp, Homo sapiens
acctcctggcctcaagcaatcc

SEQ ID NO: 8148328 - DNA, 22 bp, Homo sapiens
acctcctggcctcaagcaatcc

SEQ ID NO: 8148329 - DNA, 22 bp, Homo sapiens
acctctcttgtagctgctggtg

SEQ ID NO: 8148330 - DNA, 22 bp, Homo sapiens
acctctctgggcctgcttcctg

SEQ ID NO: 8148331 - DNA, 22 bp, Homo sapiens
acctctgcaatgcaatgtcatg

SEQ ID NO: 8148332 - DNA, 22 bp, Homo sapiens
acctctgccactttctaactct

SEQ ID NO: 8148333 - DNA, 22 bp, Homo sapiens
acctctgccaagatgtgctccc

SEQ ID NO: 8148334 - DNA, 22 bp, Homo sapiens
acctctgcaatgcaatgtcatg

SEQ ID NO: 8148335 - DNA, 22 bp, Homo sapiens
acctctgcagtagggctgtgcc

SEQ ID NO: 8148336 - DNA, 19 bp, Homo sapiens
acctctgcagagatgttta

SEQ ID NO: 8148337 - DNA, 22 bp, Homo sapiens
acctctggacactgcatccttc

SEQ ID NO: 8148338 - DNA, 22 bp, Homo sapiens
acctctggcaccccctggcttg

SEQ ID NO: 8148339 - DNA, 22 bp, Homo sapiens
acctctggcaccccctggcttg

SEQ ID NO: 8148340 - DNA, 22 bp, Homo sapiens
acctctggacactgcatccttc

SEQ ID NO: 8148341 - DNA, 22 bp, Homo sapiens
aagtatatttagctgagcttgt

SEQ ID NO: 8148342 - DNA, 20 bp, Homo sapiens
aagtatatgtccgtgtactt

SEQ ID NO: 8148343 - DNA, 22 bp, Homo sapiens
aagtatatactaaatgttaatc

SEQ ID NO: 8148344 - DNA, 22 bp, Homo sapiens
aagtatcaaatggtagcatatg

SEQ ID NO: 8148345 - DNA, 22 bp, Homo sapiens
aagtatctcaaaaacagtaatc

SEQ ID NO: 8148346 - DNA, 22 bp, Homo sapiens
aagtccagtgctttagattcca

SEQ ID NO: 8148347 - DNA, 22 bp, Homo sapiens
aagtcatcactcctctgaactt

SEQ ID NO: 8148348 - DNA, 22 bp, Homo sapiens
aagtccattcttccagccagct

SEQ ID NO: 8148349 - DNA, 22 bp, Homo sapiens
aagtaggaatccgaatgagtag

SEQ ID NO: 8148350 - DNA, 22 bp, Homo sapiens
aagtagcattttcaaaatgtat

SEQ ID NO: 8148351 - DNA, 23 bp, Homo sapiens
aagtagatagctaaagttttgtt

SEQ ID NO: 8148352 - DNA, 23 bp, Homo sapiens
aagtagataacactgttctgaga

SEQ ID NO: 8148353 - DNA, 23 bp, Homo sapiens
aagtagataacactgttctgaga

SEQ ID NO: 8148354 - DNA, 22 bp, Homo sapiens
aagtagatagtgctacggagtt

SEQ ID NO: 8148355 - DNA, 22 bp, Homo sapiens
acctctggccaagactcgtgtt

SEQ ID NO: 8148356 - DNA, 22 bp, Homo sapiens
aagtatatactaaatgttaatc

SEQ ID NO: 8148357 - DNA, 22 bp, Homo sapiens
aagtatatactaaatgttaatc

SEQ ID NO: 8148358 - DNA, 22 bp, Homo sapiens
aagtataatcaaagcagggcta

SEQ ID NO: 8148359 - DNA, 22 bp, Homo sapiens
aagtataagctattcttcatga

SEQ ID NO: 8148360 - DNA, 22 bp, Homo sapiens
aagtaggaatccgaatgagtag

SEQ ID NO: 8148361 - DNA, 22 bp, Homo sapiens
aagtcctgaaacttctttctga

SEQ ID NO: 8148362 - DNA, 22 bp, Homo sapiens
aagtcctgtgctagagacacct

SEQ ID NO: 8148363 - DNA, 22 bp, Homo sapiens
aagtcctgccacctataagcct

SEQ ID NO: 8148364 - DNA, 22 bp, Homo sapiens
acctgcctatcagctgcctgct

SEQ ID NO: 8148365 - DNA, 22 bp, Homo sapiens
acctgcctatcagctgcctgct

SEQ ID NO: 8148366 - DNA, 22 bp, Homo sapiens
acctgcctatcagctgcctgct

SEQ ID NO: 8148367 - DNA, 22 bp, Homo sapiens
acctgcctatcagctgcctgct

SEQ ID NO: 8148368 - DNA, 22 bp, Homo sapiens
acctgcctagttggttctgccc

SEQ ID NO: 8148369 - DNA, 22 bp, Homo sapiens
aagtccttatgtggaggggcta

SEQ ID NO: 8148370 - DNA, 22 bp, Homo sapiens
acagaggtaggacatgagatat

SEQ ID NO: 8148371 - DNA, 22 bp, Homo sapiens
acagaggtaggacatgagatat

SEQ ID NO: 8148372 - DNA, 22 bp, Homo sapiens
acagaggtcacctttgtatctt

SEQ ID NO: 8148373 - DNA, 22 bp, Homo sapiens
acagagggtgtggaggaagacg

SEQ ID NO: 8148374 - DNA, 22 bp, Homo sapiens
acagagggtgtggaggaagacg

SEQ ID NO: 8148375 - DNA, 19 bp, Homo sapiens
acagagggcaactgagaaa

SEQ ID NO: 8148376 - DNA, 22 bp, Homo sapiens
acagagggggccttggagtgca

SEQ ID NO: 8148377 - DNA, 22 bp, Homo sapiens
acagagggtctgggcacaggac

SEQ ID NO: 8148378 - DNA, 22 bp, Homo sapiens
acagaggcctcgtaggtacaac

SEQ ID NO: 8148379 - DNA, 22 bp, Homo sapiens
acagaggccccgtgggagagcc

SEQ ID NO: 8148380 - DNA, 22 bp, Homo sapiens
acagaggccgcctctctcacgg

SEQ ID NO: 8148381 - DNA, 22 bp, Homo sapiens
acagaggccgcctctctcacgg

SEQ ID NO: 8148382 - DNA, 23 bp, Homo sapiens
acagaggcttaaatgagtggcag

SEQ ID NO: 8148383 - DNA, 23 bp, Homo sapiens
acagaggcttaaatgagtggcag

SEQ ID NO: 8148384 - DNA, 22 bp, Homo sapiens
agcgtgtgtgcgggtcttcttt

SEQ ID NO: 8148385 - DNA, 22 bp, Homo sapiens
agcgtggactgctgggcaaggt

SEQ ID NO: 8148386 - DNA, 22 bp, Homo sapiens
acagataattagcataaatgct

SEQ ID NO: 8148387 - DNA, 22 bp, Homo sapiens
acagataattagcataaatgct

SEQ ID NO: 8148388 - DNA, 22 bp, Homo sapiens
acagataattagcataaatgct

SEQ ID NO: 8148389 - DNA, 22 bp, Homo sapiens
agctaaatcctacttttgtatt

SEQ ID NO: 8148390 - DNA, 22 bp, Homo sapiens
agctaaatgttgcttaaaattt

SEQ ID NO: 8148391 - DNA, 22 bp, Homo sapiens
agcggtggtgtcggcagcggct

SEQ ID NO: 8148392 - DNA, 19 bp, Homo sapiens
agcggttctcaaagtcagg

SEQ ID NO: 8148393 - DNA, 20 bp, Homo sapiens
agcggctggcggaggacacg

SEQ ID NO: 8148394 - DNA, 22 bp, Homo sapiens
agcggctgtcggccagccggag

SEQ ID NO: 8148395 - DNA, 20 bp, Homo sapiens
agcggctggcggaggacacg

SEQ ID NO: 8148396 - DNA, 22 bp, Homo sapiens
agcggcgccggagggaggtgcg

SEQ ID NO: 8148397 - DNA, 22 bp, Homo sapiens
agcggctgctccgcaggctggc

SEQ ID NO: 8148398 - DNA, 22 bp, Homo sapiens
agcggcgccgagcttggccagg

SEQ ID NO: 8148399 - DNA, 22 bp, Homo sapiens
agcggctgctccgcaggctggc

SEQ ID NO: 8148400 - DNA, 22 bp, Homo sapiens
acagaggtcatggagagttctc

SEQ ID NO: 8148401 - DNA, 22 bp, Homo sapiens
acagaataactcttgcttgagt

SEQ ID NO: 8148402 - DNA, 22 bp, Homo sapiens
acagaagctcaagagagcagtg

SEQ ID NO: 8148403 - DNA, 22 bp, Homo sapiens
acagaagctcaagagagcagtg

SEQ ID NO: 8148404 - DNA, 22 bp, Homo sapiens
acagaagcctttggccatttga

SEQ ID NO: 8148405 - DNA, 21 bp, Homo sapiens
acagaagcggcgagtggcccc

SEQ ID NO: 8148406 - DNA, 23 bp, Homo sapiens
acagaagccaggagccgctgggc

SEQ ID NO: 8148407 - DNA, 22 bp, Homo sapiens
acagaagcctttggccatttga

SEQ ID NO: 8148408 - DNA, 19 bp, Homo sapiens
acagaagcatagaaaagga

SEQ ID NO: 8148409 - DNA, 19 bp, Homo sapiens
acagaagcatagaaaagga

SEQ ID NO: 8148410 - DNA, 22 bp, Homo sapiens
acagaatagagactgcctgctc

SEQ ID NO: 8148411 - DNA, 22 bp, Homo sapiens
acagaatactcataagaagggg

SEQ ID NO: 8148412 - DNA, 22 bp, Homo sapiens
acagaatagtagcttaaagtca

SEQ ID NO: 8148413 - DNA, 22 bp, Homo sapiens
acagaatagtcagctgtaggcc

SEQ ID NO: 8148414 - DNA, 22 bp, Homo sapiens
acagaatgcgtagtgcatgttg

SEQ ID NO: 8148415 - DNA, 22 bp, Homo sapiens
acagaatatttggcatgcgtct

SEQ ID NO: 8148416 - DNA, 22 bp, Homo sapiens
acagaatattgtaagtgccact

SEQ ID NO: 8148417 - DNA, 22 bp, Homo sapiens
acagaatattgtaagtgccact

SEQ ID NO: 8148418 - DNA, 22 bp, Homo sapiens
acagagctgtacatgtgccatg

SEQ ID NO: 8148419 - DNA, 22 bp, Homo sapiens
acagagctgtacatgtgccatg

SEQ ID NO: 8148420 - DNA, 22 bp, Homo sapiens
acagagctgtacatgtgccatg

SEQ ID NO: 8148421 - DNA, 17 bp, Homo sapiens
acagaggcaggagtgga

SEQ ID NO: 8148422 - DNA, 22 bp, Homo sapiens
acagaatgggatttgaatattt

SEQ ID NO: 8148423 - DNA, 22 bp, Homo sapiens
acagaggccatgagctgccacc

SEQ ID NO: 8148424 - DNA, 22 bp, Homo sapiens
acagaggccatgagctgccacc

SEQ ID NO: 8148425 - DNA, 22 bp, Homo sapiens
acagaggcagtgtgagatactg

SEQ ID NO: 8148426 - DNA, 22 bp, Homo sapiens
acagatactataatgtaaagtg

SEQ ID NO: 8148427 - DNA, 22 bp, Homo sapiens
acagatacaaatatacaaatac

SEQ ID NO: 8148428 - DNA, 22 bp, Homo sapiens
acagatagatttgagggaggct

SEQ ID NO: 8148429 - DNA, 22 bp, Homo sapiens
acagatagcactaagggatctg

SEQ ID NO: 8148430 - DNA, 23 bp, Homo sapiens
acagatagggaaggcagagtttc

SEQ ID NO: 8148431 - DNA, 17 bp, Homo sapiens
acagataggagccccat

SEQ ID NO: 8148432 - DNA, 19 bp, Homo sapiens
acagatagactccaaagca

SEQ ID NO: 8148433 - DNA, 22 bp, Homo sapiens
acagatagatgataatggcttt

SEQ ID NO: 8148434 - DNA, 22 bp, Homo sapiens
acagatatcctcagtctccaac

SEQ ID NO: 8148435 - DNA, 22 bp, Homo sapiens
acagatatatgattgtgtaaat

SEQ ID NO: 8148436 - DNA, 22 bp, Homo sapiens
acagatagtatgtaaattaagc

SEQ ID NO: 8148437 - DNA, 22 bp, Homo sapiens
acagatataaactatagtagtg

SEQ ID NO: 8148438 - DNA, 22 bp, Homo sapiens
acagatataaactatagtagtg

SEQ ID NO: 8148439 - DNA, 22 bp, Homo sapiens
acagatataaactatagtagtg

SEQ ID NO: 8148440 - DNA, 22 bp, Homo sapiens
acagcagagtgtgagatagcca

SEQ ID NO: 8148441 - DNA, 22 bp, Homo sapiens
acagcagagtgtgagatagcca

SEQ ID NO: 8148442 - DNA, 22 bp, Homo sapiens
acagcagagtgtgagatagcca

SEQ ID NO: 8148443 - DNA, 22 bp, Homo sapiens
acagcagagtgtgagatagcca

SEQ ID NO: 8148444 - DNA, 22 bp, Homo sapiens
acagcagatctggctacaggtt

SEQ ID NO: 8148445 - DNA, 22 bp, Homo sapiens
acagcagatctggctacaggtt

SEQ ID NO: 8148446 - DNA, 22 bp, Homo sapiens
acagcagatctggctacaggtt

SEQ ID NO: 8148447 - DNA, 20 bp, Homo sapiens
acagcagataccacaactat

SEQ ID NO: 8148448 - DNA, 20 bp, Homo sapiens
acagcagataccacaactat

SEQ ID NO: 8148449 - DNA, 22 bp, Homo sapiens
acagcagaccccagtgccatgg

SEQ ID NO: 8148450 - DNA, 22 bp, Homo sapiens
acagcagagtggagatgagcac

SEQ ID NO: 8148451 - DNA, 22 bp, Homo sapiens
acagcagagtgtgagatagcca

SEQ ID NO: 8148452 - DNA, 21 bp, Homo sapiens
acagatatttcattgaacatt

SEQ ID NO: 8148453 - DNA, 22 bp, Homo sapiens
acagcagaccactactagtagg

SEQ ID NO: 8148454 - DNA, 22 bp, Homo sapiens
acagcagaccactactagtagg

SEQ ID NO: 8148455 - DNA, 22 bp, Homo sapiens
acagcagatctggctacaggtt

SEQ ID NO: 8148456 - DNA, 22 bp, Homo sapiens
acagcagatctggctacaggtt

SEQ ID NO: 8148457 - DNA, 22 bp, Homo sapiens
acagcagatttccctgggctcc

SEQ ID NO: 8148458 - DNA, 22 bp, Homo sapiens
acagcagcaatagcagtgacat

SEQ ID NO: 8148459 - DNA, 22 bp, Homo sapiens
acagcagatttccctgggctcc

SEQ ID NO: 8148460 - DNA, 22 bp, Homo sapiens
acagcagcaatagcagtgacat

SEQ ID NO: 8148461 - DNA, 22 bp, Homo sapiens
acagcagcactattgacatttt

SEQ ID NO: 8148462 - DNA, 22 bp, Homo sapiens
acagcagcactattgacatttt

SEQ ID NO: 8148463 - DNA, 21 bp, Homo sapiens
acagcagcaatctgtctttcc

SEQ ID NO: 8148464 - DNA, 20 bp, Homo sapiens
acagcagccttgctagaaac

SEQ ID NO: 8148465 - DNA, 22 bp, Homo sapiens
acagcagccttgttggtttcga

SEQ ID NO: 8148466 - DNA, 22 bp, Homo sapiens
acagcagccttgttggtttcga

SEQ ID NO: 8148467 - DNA, 22 bp, Homo sapiens
acagcagccagccactgtgagc

SEQ ID NO: 8148468 - DNA, 22 bp, Homo sapiens
acagcagcctgcagccctgtgt

SEQ ID NO: 8148469 - DNA, 22 bp, Homo sapiens
acagcagcctgcagccctgtgt

SEQ ID NO: 8148470 - DNA, 22 bp, Homo sapiens
acagcagcatcctatttcactc

SEQ ID NO: 8148471 - DNA, 22 bp, Homo sapiens
acagcagccagccactgtgagc

SEQ ID NO: 8148472 - DNA, 22 bp, Homo sapiens
acagcagcataaactgactaag

SEQ ID NO: 8148473 - DNA, 22 bp, Homo sapiens
acagcagcagaccagcatatgt

SEQ ID NO: 8148474 - DNA, 22 bp, Homo sapiens
acagcaggttattgttatggca

SEQ ID NO: 8148475 - DNA, 22 bp, Homo sapiens
acagcaggttattgttatggca

SEQ ID NO: 8148476 - DNA, 18 bp, Homo sapiens
acagcaggtttcattctt

SEQ ID NO: 8148477 - DNA, 18 bp, Homo sapiens
acagcaggtttcattctt

SEQ ID NO: 8148478 - DNA, 21 bp, Homo sapiens
acagcagggctggcatgacag

SEQ ID NO: 8148479 - DNA, 21 bp, Homo sapiens
acagcagggctggcatgacag

SEQ ID NO: 8148480 - DNA, 19 bp, Homo sapiens
acagcagggatttttggag

SEQ ID NO: 8148481 - DNA, 21 bp, Homo sapiens
acagcagggctggcatgacag

SEQ ID NO: 8148482 - DNA, 21 bp, Homo sapiens
acagcagggctggcatgacag

SEQ ID NO: 8148483 - DNA, 21 bp, Homo sapiens
acagcagggctggcatgacag

SEQ ID NO: 8148484 - DNA, 22 bp, Homo sapiens
acagcaggttacagtggcacag

SEQ ID NO: 8148485 - DNA, 22 bp, Homo sapiens
acagcagtggattagaggatgg

SEQ ID NO: 8148486 - DNA, 22 bp, Homo sapiens
acagcagtgcacagagaaccct

SEQ ID NO: 8148487 - DNA, 22 bp, Homo sapiens
acagcagtgcacagagaaccct

SEQ ID NO: 8148488 - DNA, 22 bp, Homo sapiens
acagcaggttttaactttgaag

SEQ ID NO: 8148489 - DNA, 22 bp, Homo sapiens
acagcaggttttaactttgaag

SEQ ID NO: 8148490 - DNA, 22 bp, Homo sapiens
acagcaggttttaactttgaag

SEQ ID NO: 8148491 - DNA, 22 bp, Homo sapiens
acagcaggttttaactttgaag

SEQ ID NO: 8148492 - DNA, 22 bp, Homo sapiens
acagcaggttttaactttgaag

SEQ ID NO: 8148493 - DNA, 18 bp, Homo sapiens
acagcaggtttcattctt

SEQ ID NO: 8148494 - DNA, 17 bp, Homo sapiens
acagcagggaagtgttg

SEQ ID NO: 8148495 - DNA, 17 bp, Homo sapiens
acagcagggaagtgttg

SEQ ID NO: 8148496 - DNA, 22 bp, Homo sapiens
acagcagggaatatgggaattg

SEQ ID NO: 8148497 - DNA, 17 bp, Homo sapiens
acagcagggaagtgttg

SEQ ID NO: 8148498 - DNA, 17 bp, Homo sapiens
acagcagggaagtgttg

SEQ ID NO: 8148499 - DNA, 19 bp, Homo sapiens
acagcagggatttttggag

SEQ ID NO: 8148500 - DNA, 22 bp, Homo sapiens
acagcagggaatatgggaattg

SEQ ID NO: 8148501 - DNA, 22 bp, Homo sapiens
acagcagggaatatgggaattg

SEQ ID NO: 8148502 - DNA, 22 bp, Homo sapiens
acagcagggaatatgggaattg

SEQ ID NO: 8148503 - DNA, 22 bp, Homo sapiens
acagcaggcccatactggaagg

SEQ ID NO: 8148504 - DNA, 22 bp, Homo sapiens
acagcaggcccatactggaagg

SEQ ID NO: 8148505 - DNA, 22 bp, Homo sapiens
acagcaggcccatactggaagg

SEQ ID NO: 8148506 - DNA, 22 bp, Homo sapiens
acagcaggcccatactggaagg

SEQ ID NO: 8148507 - DNA, 17 bp, Homo sapiens
acagcaggcccggaggg

SEQ ID NO: 8148508 - DNA, 17 bp, Homo sapiens
acagcaggcccggaggg

SEQ ID NO: 8148509 - DNA, 17 bp, Homo sapiens
acagcaggcccggaggg

SEQ ID NO: 8148510 - DNA, 17 bp, Homo sapiens
acagcaggcccggaggg

SEQ ID NO: 8148511 - DNA, 17 bp, Homo sapiens
acagcaggcccggaggg

SEQ ID NO: 8148512 - DNA, 18 bp, Homo sapiens
agctgaggggactgaaga

SEQ ID NO: 8148513 - DNA, 18 bp, Homo sapiens
agctgaggggactgaaga

SEQ ID NO: 8148514 - DNA, 22 bp, Homo sapiens
agctgagggcaggatggggtga

SEQ ID NO: 8148515 - DNA, 22 bp, Homo sapiens
agctgagggcaggatggggtga

SEQ ID NO: 8148516 - DNA, 21 bp, Homo sapiens
agctgaggtaaggcaagagag

SEQ ID NO: 8148517 - DNA, 21 bp, Homo sapiens
agctgaggtaaggcaagagag

SEQ ID NO: 8148518 - DNA, 22 bp, Homo sapiens
agctgagggttcggtgtccaca

SEQ ID NO: 8148519 - DNA, 22 bp, Homo sapiens
agctgagggttcggtgtccaca

SEQ ID NO: 8148520 - DNA, 22 bp, Homo sapiens
agctgagggttcggtgtccaca

SEQ ID NO: 8148521 - DNA, 22 bp, Homo sapiens
agctgagggttcggtgtccaca

SEQ ID NO: 8148522 - DNA, 22 bp, Homo sapiens
agctgagcatttgatccacctc

SEQ ID NO: 8148523 - DNA, 22 bp, Homo sapiens
agctgagcacattcaaacaggt

SEQ ID NO: 8148524 - DNA, 22 bp, Homo sapiens
agctgagaggtggcaagctgta

SEQ ID NO: 8148525 - DNA, 23 bp, Homo sapiens
agctgaggtgcagatccaaagaa

SEQ ID NO: 8148526 - DNA, 22 bp, Homo sapiens
agctgaggttagtataaatgtg

SEQ ID NO: 8148527 - DNA, 23 bp, Homo sapiens
agctgaggtgcagatccaaagaa

SEQ ID NO: 8148528 - DNA, 21 bp, Homo sapiens
agctgaggtaaggcaagagag

SEQ ID NO: 8148529 - DNA, 21 bp, Homo sapiens
agctgaggtaaggcaagagag

SEQ ID NO: 8148530 - DNA, 21 bp, Homo sapiens
agctgaggtaaggcaagagag

SEQ ID NO: 8148531 - DNA, 21 bp, Homo sapiens
agctgaggtaaggcaagagag

SEQ ID NO: 8148532 - DNA, 22 bp, Homo sapiens
agctgatgccatgtggaacagt

SEQ ID NO: 8148533 - DNA, 22 bp, Homo sapiens
agctgataggtgtaggatacac

SEQ ID NO: 8148534 - DNA, 22 bp, Homo sapiens
agctgatgtgtccggagcagct

SEQ ID NO: 8148535 - DNA, 22 bp, Homo sapiens
agctgatgtgtccggagcagct

SEQ ID NO: 8148536 - DNA, 22 bp, Homo sapiens
acagcaggcatgaatgacactg

SEQ ID NO: 8148537 - DNA, 22 bp, Homo sapiens
acagcaggcatgaatgacactg

SEQ ID NO: 8148538 - DNA, 22 bp, Homo sapiens
agctgatacatttcttgtagcc

SEQ ID NO: 8148539 - DNA, 22 bp, Homo sapiens
agctgaggttgaagagtgaacg

SEQ ID NO: 8148540 - DNA, 22 bp, Homo sapiens
agctgaggttgaagagtgaacg

SEQ ID NO: 8148541 - DNA, 22 bp, Homo sapiens
acacagtttttcagacagagat

SEQ ID NO: 8148542 - DNA, 19 bp, Homo sapiens
agcaggccacagggccagc

SEQ ID NO: 8148543 - DNA, 22 bp, Homo sapiens
agcaggcttgttatgtctgaga

SEQ ID NO: 8148544 - DNA, 22 bp, Homo sapiens
agcaggcttgttatgtctgaga

SEQ ID NO: 8148545 - DNA, 22 bp, Homo sapiens
agcaggcttgttatgtctgaga

SEQ ID NO: 8148546 - DNA, 22 bp, Homo sapiens
agcaggcttggtccccagcctc

SEQ ID NO: 8148547 - DNA, 21 bp, Homo sapiens
agcaggctttggagtggggct

SEQ ID NO: 8148548 - DNA, 22 bp, Homo sapiens
agcagggaagcctccagaacct

SEQ ID NO: 8148549 - DNA, 22 bp, Homo sapiens
agcaggctttcaagagtcttct

SEQ ID NO: 8148550 - DNA, 22 bp, Homo sapiens
agcaggctttcaagagtcttct

SEQ ID NO: 8148551 - DNA, 22 bp, Homo sapiens
agcaggctttccacagaaggag

SEQ ID NO: 8148552 - DNA, 22 bp, Homo sapiens
agcaggctttccacagaaggag

SEQ ID NO: 8148553 - DNA, 22 bp, Homo sapiens
acacagttctttcactgttggt

SEQ ID NO: 8148554 - DNA, 22 bp, Homo sapiens
acacagttgattgtcactcagg

SEQ ID NO: 8148555 - DNA, 22 bp, Homo sapiens
acacagtttatggtattctgtt

SEQ ID NO: 8148556 - DNA, 22 bp, Homo sapiens
acacagtttatggtattctgtt

SEQ ID NO: 8148557 - DNA, 22 bp, Homo sapiens
acacagttcatgcatgaggtct

SEQ ID NO: 8148558 - DNA, 22 bp, Homo sapiens
acacagttcgtgcttttctatt

SEQ ID NO: 8148559 - DNA, 22 bp, Homo sapiens
acacagttcaggatcaaatagc

SEQ ID NO: 8148560 - DNA, 22 bp, Homo sapiens
acacagttcatgcatgaggtct

SEQ ID NO: 8148561 - DNA, 22 bp, Homo sapiens
acacagttcatgcatgaggtct

SEQ ID NO: 8148562 - DNA, 22 bp, Homo sapiens
acacagttcgtgcttttctatt

SEQ ID NO: 8148563 - DNA, 22 bp, Homo sapiens
acacagttcgttgttttctact

SEQ ID NO: 8148564 - DNA, 22 bp, Homo sapiens
acacagttcgttgttttctact

SEQ ID NO: 8148565 - DNA, 22 bp, Homo sapiens
acacatctatctctacacaagg

SEQ ID NO: 8148566 - DNA, 22 bp, Homo sapiens
acacatctatattgcatctgca

SEQ ID NO: 8148567 - DNA, 22 bp, Homo sapiens
acacatctatattgcatctgca

SEQ ID NO: 8148568 - DNA, 22 bp, Homo sapiens
acacatctccagaagtgggctg

SEQ ID NO: 8148569 - DNA, 22 bp, Homo sapiens
acacatctatctctacacaagg

SEQ ID NO: 8148570 - DNA, 22 bp, Homo sapiens
acacatctatctctacacaagg

SEQ ID NO: 8148571 - DNA, 22 bp, Homo sapiens
acacatctatctctacacaagg

SEQ ID NO: 8148572 - DNA, 22 bp, Homo sapiens
acacatcagaaatatgaatgag

SEQ ID NO: 8148573 - DNA, 22 bp, Homo sapiens
acacatcagaaatatgaatgag

SEQ ID NO: 8148574 - DNA, 22 bp, Homo sapiens
acacatcagaaatatgaatgag

SEQ ID NO: 8148575 - DNA, 22 bp, Homo sapiens
acacatattcatatgtacttac

SEQ ID NO: 8148576 - DNA, 22 bp, Homo sapiens
acacatatgtggcaactgtaga

SEQ ID NO: 8148577 - DNA, 22 bp, Homo sapiens
acacatattcatatgtacttac

SEQ ID NO: 8148578 - DNA, 22 bp, Homo sapiens
acacatatgtggcaactgtaga

SEQ ID NO: 8148579 - DNA, 22 bp, Homo sapiens
acacatatgtggcaactgtaga

SEQ ID NO: 8148580 - DNA, 22 bp, Homo sapiens
acacatatgtggcaactgtaga

SEQ ID NO: 8148581 - DNA, 22 bp, Homo sapiens
agcagggaatagcggaaagaat

SEQ ID NO: 8148582 - DNA, 19 bp, Homo sapiens
agcagggacatggaacttt

SEQ ID NO: 8148583 - DNA, 22 bp, Homo sapiens
agcagggacatggcatctctcc

SEQ ID NO: 8148584 - DNA, 22 bp, Homo sapiens
agcagggactacgtgaaagtga

SEQ ID NO: 8148585 - DNA, 22 bp, Homo sapiens
agcagggacatggcatctctcc

SEQ ID NO: 8148586 - DNA, 19 bp, Homo sapiens
agcagggacatggaacttt

SEQ ID NO: 8148587 - DNA, 22 bp, Homo sapiens
agcagggactgagccagtggga

SEQ ID NO: 8148588 - DNA, 22 bp, Homo sapiens
agcagggactgagccagtggga

SEQ ID NO: 8148589 - DNA, 22 bp, Homo sapiens
agcagggactacgtgaaagtga

SEQ ID NO: 8148590 - DNA, 22 bp, Homo sapiens
agcagggactgagccagtggga

SEQ ID NO: 8148591 - DNA, 22 bp, Homo sapiens
agcagggactacgtgaaagtga

SEQ ID NO: 8148592 - DNA, 22 bp, Homo sapiens
acacatatgtcattgaaaaatc

SEQ ID NO: 8148593 - DNA, 22 bp, Homo sapiens
acacatatgtcattgaaaaatc

SEQ ID NO: 8148594 - DNA, 22 bp, Homo sapiens
acacatatgtcattgaaaaatc

SEQ ID NO: 8148595 - DNA, 22 bp, Homo sapiens
agcagggagaccatctcttcct

SEQ ID NO: 8148596 - DNA, 22 bp, Homo sapiens
acacagttcaggatcaaatagc

SEQ ID NO: 8148597 - DNA, 22 bp, Homo sapiens
acacagtgtgtgcagtcggacg

SEQ ID NO: 8148598 - DNA, 22 bp, Homo sapiens
acacagtgtcttaggtagtgtc

SEQ ID NO: 8148599 - DNA, 22 bp, Homo sapiens
acacagtgtccttctacttgcc

SEQ ID NO: 8148600 - DNA, 22 bp, Homo sapiens
acacagtggtgtttacaaaatt

SEQ ID NO: 8148601 - DNA, 22 bp, Homo sapiens
acacagtggtgtttacaaaatt

SEQ ID NO: 8148602 - DNA, 22 bp, Homo sapiens
acacagtgtcagggcaggggcc

SEQ ID NO: 8148603 - DNA, 22 bp, Homo sapiens
acacagtattgtgactataact

SEQ ID NO: 8148604 - DNA, 22 bp, Homo sapiens
acacagtattgtgactataact

SEQ ID NO: 8148605 - DNA, 22 bp, Homo sapiens
acacagtggtgagtctggacct

SEQ ID NO: 8148606 - DNA, 22 bp, Homo sapiens
acacagtgccaaattgcagtta

SEQ ID NO: 8148607 - DNA, 22 bp, Homo sapiens
acacagggcggaaagcatgaga

SEQ ID NO: 8148608 - DNA, 19 bp, Homo sapiens
acacagggctagagttaca

SEQ ID NO: 8148609 - DNA, 18 bp, Homo sapiens
acacacacacctgtgtat

SEQ ID NO: 8148610 - DNA, 18 bp, Homo sapiens
acacacacacctgtgtat

SEQ ID NO: 8148611 - DNA, 18 bp, Homo sapiens
acacacacacctgtgtat

SEQ ID NO: 8148612 - DNA, 18 bp, Homo sapiens
acacacacacctgtgtat

SEQ ID NO: 8148613 - DNA, 18 bp, Homo sapiens
acacacacacctgtgtat

SEQ ID NO: 8148614 - DNA, 22 bp, Homo sapiens
acacacacaagcaggttgtgga

SEQ ID NO: 8148615 - DNA, 22 bp, Homo sapiens
acacacacaagcaggttgtgga

SEQ ID NO: 8148616 - DNA, 22 bp, Homo sapiens
acacacacaagcaggttgtgga

SEQ ID NO: 8148617 - DNA, 22 bp, Homo sapiens
acacacacaagcaggttgtgga

SEQ ID NO: 8148618 - DNA, 22 bp, Homo sapiens
acacagtatgcatctagaaatt

SEQ ID NO: 8148619 - DNA, 22 bp, Homo sapiens
acacagtatgacattggcagag

SEQ ID NO: 8148620 - DNA, 22 bp, Homo sapiens
acacagtatgcatctagaaatt

SEQ ID NO: 8148621 - DNA, 22 bp, Homo sapiens
acacagtattacaataggtgct

SEQ ID NO: 8148622 - DNA, 19 bp, Homo sapiens
acacagggctagagttaca

SEQ ID NO: 8148623 - DNA, 22 bp, Homo sapiens
acacagtatgaaaagtctagtt

SEQ ID NO: 8148624 - DNA, 22 bp, Homo sapiens
acacagtatgaaaagtctagtt

SEQ ID NO: 8148625 - DNA, 22 bp, Homo sapiens
acacaagattgtgtattgaatt

SEQ ID NO: 8148626 - DNA, 22 bp, Homo sapiens
acacaagattgtgtattgaatt

SEQ ID NO: 8148627 - DNA, 22 bp, Homo sapiens
acacaagattgtgtattgaatt

SEQ ID NO: 8148628 - DNA, 22 bp, Homo sapiens
acacaatacagggctcaaaata

SEQ ID NO: 8148629 - DNA, 23 bp, Homo sapiens
acacaatagagtactattcagcc

SEQ ID NO: 8148630 - DNA, 19 bp, Homo sapiens
acacaatgacacatatata

SEQ ID NO: 8148631 - DNA, 23 bp, Homo sapiens
acacaatagagtactattcagcc

SEQ ID NO: 8148632 - DNA, 19 bp, Homo sapiens
acacaatgacacatatata

SEQ ID NO: 8148633 - DNA, 19 bp, Homo sapiens
acacaatgacacatatata

SEQ ID NO: 8148634 - DNA, 22 bp, Homo sapiens
acacaatggcgtgtgccacaga

SEQ ID NO: 8148635 - DNA, 22 bp, Homo sapiens
acacaatgcatatttttccaga

SEQ ID NO: 8148636 - DNA, 22 bp, Homo sapiens
acacaattgactgttgtccctt

SEQ ID NO: 8148637 - DNA, 22 bp, Homo sapiens
acacaatttcataaacaccatg

SEQ ID NO: 8148638 - DNA, 21 bp, Homo sapiens
acacaattcttgcttggcctt

SEQ ID NO: 8148639 - DNA, 22 bp, Homo sapiens
acacaatgtcatcataatgtca

SEQ ID NO: 8148640 - DNA, 22 bp, Homo sapiens
acacaatgtcatcataatgtca

SEQ ID NO: 8148641 - DNA, 22 bp, Homo sapiens
acacaatgtaccatatctccaa

SEQ ID NO: 8148642 - DNA, 22 bp, Homo sapiens
acacacaactcattgtgtaata

SEQ ID NO: 8148643 - DNA, 22 bp, Homo sapiens
acacacacaagcaggttgtgga

SEQ ID NO: 8148644 - DNA, 22 bp, Homo sapiens
acacacaaatctattagtgaat

SEQ ID NO: 8148645 - DNA, 22 bp, Homo sapiens
acacaatttcctgtccatatgt

SEQ ID NO: 8148646 - DNA, 22 bp, Homo sapiens
agccagctgtactgcctgctca

SEQ ID NO: 8148647 - DNA, 22 bp, Homo sapiens
agccagctggtgggtcagctgg

SEQ ID NO: 8148648 - DNA, 22 bp, Homo sapiens
agccagctggtgggtcagctgg

SEQ ID NO: 8148649 - DNA, 22 bp, Homo sapiens
agccagctgtactgcctgctca

SEQ ID NO: 8148650 - DNA, 22 bp, Homo sapiens
agccagctgtgggctcaggcgg

SEQ ID NO: 8148651 - DNA, 22 bp, Homo sapiens
agccaggaagaaggtcacacca

SEQ ID NO: 8148652 - DNA, 22 bp, Homo sapiens
agccaggaagagaggcctcacc

SEQ ID NO: 8148653 - DNA, 22 bp, Homo sapiens
agccaggaagagaggcctcacc

SEQ ID NO: 8148654 - DNA, 22 bp, Homo sapiens
agccaggaaccagctacagtct

SEQ ID NO: 8148655 - DNA, 22 bp, Homo sapiens
agccagctgttctggggcagca

SEQ ID NO: 8148656 - DNA, 22 bp, Homo sapiens
agccagcttctttacggtggca

SEQ ID NO: 8148657 - DNA, 22 bp, Homo sapiens
agccagaggccagcctgcctca

SEQ ID NO: 8148658 - DNA, 22 bp, Homo sapiens
agccagagggatctttctaaga

SEQ ID NO: 8148659 - DNA, 22 bp, Homo sapiens
agccagaggccagcctgcctca

SEQ ID NO: 8148660 - DNA, 22 bp, Homo sapiens
agccagaggccagcctgcctca

SEQ ID NO: 8148661 - DNA, 22 bp, Homo sapiens
agccagaggtcatgagcacagg

SEQ ID NO: 8148662 - DNA, 22 bp, Homo sapiens
agccagaggtcatgagcacagg

SEQ ID NO: 8148663 - DNA, 22 bp, Homo sapiens
agccagaggtcatgagcacagg

SEQ ID NO: 8148664 - DNA, 22 bp, Homo sapiens
agccagagggatctttctaaga

SEQ ID NO: 8148665 - DNA, 22 bp, Homo sapiens
agccagctggtgggtcagctgg

SEQ ID NO: 8148666 - DNA, 22 bp, Homo sapiens
agccagctgcctttcacatctg

SEQ ID NO: 8148667 - DNA, 22 bp, Homo sapiens
agccagctggagaccactgttt

SEQ ID NO: 8148668 - DNA, 22 bp, Homo sapiens
agccagctgctcgggggaaaca

SEQ ID NO: 8148669 - DNA, 19 bp, Homo sapiens
agccagagtggcccagggg

SEQ ID NO: 8148670 - DNA, 22 bp, Homo sapiens
agccagaggtcatgagcacagg

SEQ ID NO: 8148671 - DNA, 19 bp, Homo sapiens
agccagagtggcccagggg

SEQ ID NO: 8148672 - DNA, 19 bp, Homo sapiens
agccagagtggcccagggg

SEQ ID NO: 8148673 - DNA, 19 bp, Homo sapiens
agccagagtggcccagggg

SEQ ID NO: 8148674 - DNA, 19 bp, Homo sapiens
agccagagtggcccagggg

SEQ ID NO: 8148675 - DNA, 22 bp, Homo sapiens
agccagctgcctttcacatctg

SEQ ID NO: 8148676 - DNA, 22 bp, Homo sapiens
agccagaggaagcctggccctc

SEQ ID NO: 8148677 - DNA, 22 bp, Homo sapiens
agccagaggaagcctggccctc

SEQ ID NO: 8148678 - DNA, 22 bp, Homo sapiens
agccagagctgatgtcattctc

SEQ ID NO: 8148679 - DNA, 22 bp, Homo sapiens
agccagagctgatgtcattctc

SEQ ID NO: 8148680 - DNA, 22 bp, Homo sapiens
agccagagattgagatgcaggc

SEQ ID NO: 8148681 - DNA, 22 bp, Homo sapiens
agccagagatccatccctagga

SEQ ID NO: 8148682 - DNA, 22 bp, Homo sapiens
agccagagattgagatgcaggc

SEQ ID NO: 8148683 - DNA, 22 bp, Homo sapiens
agccagagattgagatgcaggc

SEQ ID NO: 8148684 - DNA, 22 bp, Homo sapiens
agccagagattgagatgcaggc

SEQ ID NO: 8148685 - DNA, 22 bp, Homo sapiens
agccacagtctgtagccagctt

SEQ ID NO: 8148686 - DNA, 22 bp, Homo sapiens
agccacagtctgatgcctgaga

SEQ ID NO: 8148687 - DNA, 23 bp, Homo sapiens
acacttcacccattgtgatagga

SEQ ID NO: 8148688 - DNA, 22 bp, Homo sapiens
agccacagtctgatgcctgaga

SEQ ID NO: 8148689 - DNA, 22 bp, Homo sapiens
acacttaagcatgaagtataaa

SEQ ID NO: 8148690 - DNA, 22 bp, Homo sapiens
acacttaagcatgaagtataaa

SEQ ID NO: 8148691 - DNA, 22 bp, Homo sapiens
acacttagctgagggtgcagat

SEQ ID NO: 8148692 - DNA, 22 bp, Homo sapiens
acacttatttcttgtctaacca

SEQ ID NO: 8148693 - DNA, 22 bp, Homo sapiens
acacttatacaaagaatgtctg

SEQ ID NO: 8148694 - DNA, 22 bp, Homo sapiens
acacttatttttgtccacttcc

SEQ ID NO: 8148695 - DNA, 22 bp, Homo sapiens
acactgtgtggtctctctcgga

SEQ ID NO: 8148696 - DNA, 22 bp, Homo sapiens
acactgtgtttacatagagaat

SEQ ID NO: 8148697 - DNA, 22 bp, Homo sapiens
acactgttcctgaaattgttat

SEQ ID NO: 8148698 - DNA, 22 bp, Homo sapiens
acactgttccacactaagaagg

SEQ ID NO: 8148699 - DNA, 22 bp, Homo sapiens
acactgttccacactaagaagg

SEQ ID NO: 8148700 - DNA, 22 bp, Homo sapiens
acactgttcctgaaattgttat

SEQ ID NO: 8148701 - DNA, 22 bp, Homo sapiens
agccaatcatcctcagactctc

SEQ ID NO: 8148702 - DNA, 22 bp, Homo sapiens
agccaatctacaacaaaggata

SEQ ID NO: 8148703 - DNA, 22 bp, Homo sapiens
agccaaggtcgccccagggcaa

SEQ ID NO: 8148704 - DNA, 22 bp, Homo sapiens
agccaaggcagctagagctctg

SEQ ID NO: 8148705 - DNA, 22 bp, Homo sapiens
agccaagggtcagctgcacaga

SEQ ID NO: 8148706 - DNA, 22 bp, Homo sapiens
agccaaggagtgcaggtggctt

SEQ ID NO: 8148707 - DNA, 22 bp, Homo sapiens
agccaaggcagctagagctctg

SEQ ID NO: 8148708 - DNA, 22 bp, Homo sapiens
agccaaggagtgcaggtggctt

SEQ ID NO: 8148709 - DNA, 22 bp, Homo sapiens
acacccagcttttgaatgccct

SEQ ID NO: 8148710 - DNA, 22 bp, Homo sapiens
agcatttaattacagtttaatt

SEQ ID NO: 8148711 - DNA, 22 bp, Homo sapiens
agcatttacctcaatgcatctg

SEQ ID NO: 8148712 - DNA, 22 bp, Homo sapiens
agcatttacctcaatgcatctg

SEQ ID NO: 8148713 - DNA, 20 bp, Homo sapiens
agcatttacatcccttggtg

SEQ ID NO: 8148714 - DNA, 22 bp, Homo sapiens
agcatttacctcaatgcatctg

SEQ ID NO: 8148715 - DNA, 20 bp, Homo sapiens
agcatttagcctttatccac

SEQ ID NO: 8148716 - DNA, 22 bp, Homo sapiens
agccaaggacacggagcctcct

SEQ ID NO: 8148717 - DNA, 22 bp, Homo sapiens
agcaggtgtagggctctttgta

SEQ ID NO: 8148718 - DNA, 22 bp, Homo sapiens
agcaggtgtagggctctttgta

SEQ ID NO: 8148719 - DNA, 16 bp, Homo sapiens
agcaggtgtatagtgt

SEQ ID NO: 8148720 - DNA, 22 bp, Homo sapiens
agcaggtgtagggctctttgta

SEQ ID NO: 8148721 - DNA, 21 bp, Homo sapiens
agcaggtgtaaaggaggaaat

SEQ ID NO: 8148722 - DNA, 21 bp, Homo sapiens
agcaggtgtaaaggaggaaat

SEQ ID NO: 8148723 - DNA, 22 bp, Homo sapiens
agcaggtgtatcggtcacctac

SEQ ID NO: 8148724 - DNA, 22 bp, Homo sapiens
agcaggtgtatcggtcacctac

SEQ ID NO: 8148725 - DNA, 22 bp, Homo sapiens
agcaggtgtatataaggctgag

SEQ ID NO: 8148726 - DNA, 22 bp, Homo sapiens
agcaggtgtatataaggctgag

SEQ ID NO: 8148727 - DNA, 16 bp, Homo sapiens
agcaggtgtatagtgt

SEQ ID NO: 8148728 - DNA, 22 bp, Homo sapiens
agcaggtgtatataaggctgag

SEQ ID NO: 8148729 - DNA, 22 bp, Homo sapiens
agcaggtggtctgttgctgctg

SEQ ID NO: 8148730 - DNA, 22 bp, Homo sapiens
agcaggtggtaggcagtcagca

SEQ ID NO: 8148731 - DNA, 22 bp, Homo sapiens
agcaggtggtgggccagatttg

SEQ ID NO: 8148732 - DNA, 22 bp, Homo sapiens
agcaggtggtctgttgctgctg

SEQ ID NO: 8148733 - DNA, 21 bp, Homo sapiens
agcaggtgtaaaggaggaaat

SEQ ID NO: 8148734 - DNA, 22 bp, Homo sapiens
agcaggtggtgggccagatttg

SEQ ID NO: 8148735 - DNA, 22 bp, Homo sapiens
agcaggtggtaggcagtcagca

SEQ ID NO: 8148736 - DNA, 22 bp, Homo sapiens
agcaggtggtaggcagtcagca

SEQ ID NO: 8148737 - DNA, 22 bp, Homo sapiens
agcaggtggtaggcagtcagca

SEQ ID NO: 8148738 - DNA, 19 bp, Homo sapiens
agcaggtgggtaagaaaat

SEQ ID NO: 8148739 - DNA, 22 bp, Homo sapiens
agcaggtggtaggcagtcagca

SEQ ID NO: 8148740 - DNA, 22 bp, Homo sapiens
agcaggtgatcgcgtgtgctcc

SEQ ID NO: 8148741 - DNA, 22 bp, Homo sapiens
agcaggtgagcacagccaggct

SEQ ID NO: 8148742 - DNA, 22 bp, Homo sapiens
acaccagggatatgaggaagga

SEQ ID NO: 8148743 - DNA, 22 bp, Homo sapiens
acaccagggcctagccagggcg

SEQ ID NO: 8148744 - DNA, 22 bp, Homo sapiens
acaccagggcctagccagggcg

SEQ ID NO: 8148745 - DNA, 22 bp, Homo sapiens
acaccagggcctagccagggcg

SEQ ID NO: 8148746 - DNA, 22 bp, Homo sapiens
agcaggtgtcactttcactcca

SEQ ID NO: 8148747 - DNA, 22 bp, Homo sapiens
agcaggtgtcactttcactcca

SEQ ID NO: 8148748 - DNA, 22 bp, Homo sapiens
agcaggtgtatcggtcacctac

SEQ ID NO: 8148749 - DNA, 22 bp, Homo sapiens
acaccatgatgagtgatgtagc

SEQ ID NO: 8148750 - DNA, 22 bp, Homo sapiens
acaccatactcatgttggttcc

SEQ ID NO: 8148751 - DNA, 22 bp, Homo sapiens
acaccagggcctagccagggcg

SEQ ID NO: 8148752 - DNA, 22 bp, Homo sapiens
acaccagtcatttattcagtca

SEQ ID NO: 8148753 - DNA, 22 bp, Homo sapiens
acaccaggtcccgtctgtacct

SEQ ID NO: 8148754 - DNA, 22 bp, Homo sapiens
acaccatggttcccaaactgtg

SEQ ID NO: 8148755 - DNA, 22 bp, Homo sapiens
acaccatggttcccaaactgtg

SEQ ID NO: 8148756 - DNA, 22 bp, Homo sapiens
acacccagagcgccagtgccga

SEQ ID NO: 8148757 - DNA, 22 bp, Homo sapiens
acacccagagcgccagtgccga

SEQ ID NO: 8148758 - DNA, 22 bp, Homo sapiens
acacccagagcgccagtgccga

SEQ ID NO: 8148759 - DNA, 22 bp, Homo sapiens
acacccagagcgccagtgccga

SEQ ID NO: 8148760 - DNA, 22 bp, Homo sapiens
agagttaaggccactgtcagta

SEQ ID NO: 8148761 - DNA, 22 bp, Homo sapiens
agagtgtaccaaatatcctaca

SEQ ID NO: 8148762 - DNA, 22 bp, Homo sapiens
agagtgtggaacttgaggagct

SEQ ID NO: 8148763 - DNA, 22 bp, Homo sapiens
agagtgtggaacttgaggagct

SEQ ID NO: 8148764 - DNA, 20 bp, Homo sapiens
agagtgggtgtcacaggctg

SEQ ID NO: 8148765 - DNA, 20 bp, Homo sapiens
agagtgggtgtcacaggctg

SEQ ID NO: 8148766 - DNA, 22 bp, Homo sapiens
agagtgggttataggcagactt

SEQ ID NO: 8148767 - DNA, 22 bp, Homo sapiens
agagtgggttataggcagactt

SEQ ID NO: 8148768 - DNA, 22 bp, Homo sapiens
agagtgggttataggcagactt

SEQ ID NO: 8148769 - DNA, 22 bp, Homo sapiens
agagtggtcatttgtccaggat

SEQ ID NO: 8148770 - DNA, 22 bp, Homo sapiens
agagtgaaggttgacacttcac

SEQ ID NO: 8148771 - DNA, 22 bp, Homo sapiens
agagtgaagtaattgttaggat

SEQ ID NO: 8148772 - DNA, 22 bp, Homo sapiens
agagtgaagttcatcgtgcagc

SEQ ID NO: 8148773 - DNA, 22 bp, Homo sapiens
aatttgggcgaggagggaggca

SEQ ID NO: 8148774 - DNA, 22 bp, Homo sapiens
aatttggggaggttcagactct

SEQ ID NO: 8148775 - DNA, 22 bp, Homo sapiens
aatttgattcagcaaatgttca

SEQ ID NO: 8148776 - DNA, 22 bp, Homo sapiens
aatttgacagcaatagaagatt

SEQ ID NO: 8148777 - DNA, 22 bp, Homo sapiens
aatttgatgagtttgtaagtct

SEQ ID NO: 8148778 - DNA, 18 bp, Homo sapiens
aatttctttgacaactta

SEQ ID NO: 8148779 - DNA, 18 bp, Homo sapiens
aatttctttgacaactta

SEQ ID NO: 8148780 - DNA, 18 bp, Homo sapiens
aatttctttgacaactta

SEQ ID NO: 8148781 - DNA, 22 bp, Homo sapiens
aatttggcagtgtcttgaagta

SEQ ID NO: 8148782 - DNA, 22 bp, Homo sapiens
aatttgccttaccttcttccaa

SEQ ID NO: 8148783 - DNA, 22 bp, Homo sapiens
aatttgattccctgcacctgtt

SEQ ID NO: 8148784 - DNA, 22 bp, Homo sapiens
aatttctctctcatgcttcatg

SEQ ID NO: 8148785 - DNA, 22 bp, Homo sapiens
aatttcttcagctctaaaatgg

SEQ ID NO: 8148786 - DNA, 22 bp, Homo sapiens
aatttcttgggagctcagagaa

SEQ ID NO: 8148787 - DNA, 22 bp, Homo sapiens
aatttcttcagctctaaaatgg

SEQ ID NO: 8148788 - DNA, 22 bp, Homo sapiens
aatttcttcagctctaaaatgg

SEQ ID NO: 8148789 - DNA, 22 bp, Homo sapiens
aatttctcatggattcagttat

SEQ ID NO: 8148790 - DNA, 22 bp, Homo sapiens
aatttctccaagaatgcttaga

SEQ ID NO: 8148791 - DNA, 22 bp, Homo sapiens
aatttctcaattgttacaggtg

SEQ ID NO: 8148792 - DNA, 22 bp, Homo sapiens
aatttctcactctcttgatcac

SEQ ID NO: 8148793 - DNA, 22 bp, Homo sapiens
aatttctctctcatgcttcatg

SEQ ID NO: 8148794 - DNA, 22 bp, Homo sapiens
aatttctcggttttgatattgt

SEQ ID NO: 8148795 - DNA, 22 bp, Homo sapiens
aatttctcggttttgatattgt

SEQ ID NO: 8148796 - DNA, 22 bp, Homo sapiens
aatttctccagacagctgtgca

SEQ ID NO: 8148797 - DNA, 20 bp, Homo sapiens
aatttctcctgggtaacaga

SEQ ID NO: 8148798 - DNA, 22 bp, Homo sapiens
aatttctccaagaatgcttaga

SEQ ID NO: 8148799 - DNA, 22 bp, Homo sapiens
aatttctccaagaatgcttaga

SEQ ID NO: 8148800 - DNA, 22 bp, Homo sapiens
agatgcagacttggttcaggca

SEQ ID NO: 8148801 - DNA, 22 bp, Homo sapiens
agatgcagagtttgctgtggac

SEQ ID NO: 8148802 - DNA, 21 bp, Homo sapiens
agatgcagttatgagatgcag

SEQ ID NO: 8148803 - DNA, 21 bp, Homo sapiens
agatgcagtgacccactgggg

SEQ ID NO: 8148804 - DNA, 22 bp, Homo sapiens
agatgcatggaaatctcattac

SEQ ID NO: 8148805 - DNA, 22 bp, Homo sapiens
agatgcatgcttaattagcaca

SEQ ID NO: 8148806 - DNA, 21 bp, Homo sapiens
agatgcagtttgcaggtgggt

SEQ ID NO: 8148807 - DNA, 21 bp, Homo sapiens
agatgcagttatgagatgcag

SEQ ID NO: 8148808 - DNA, 21 bp, Homo sapiens
agatgcagtttgcaggtgggt

SEQ ID NO: 8148809 - DNA, 22 bp, Homo sapiens
agatgcatgtttatgtctttcc

SEQ ID NO: 8148810 - DNA, 22 bp, Homo sapiens
agatgcctaaatctgggcaagg

SEQ ID NO: 8148811 - DNA, 22 bp, Homo sapiens
agatgctgaattattgtgcttt

SEQ ID NO: 8148812 - DNA, 22 bp, Homo sapiens
agatgctgcctctcctcacaag

SEQ ID NO: 8148813 - DNA, 22 bp, Homo sapiens
agatgctgctccacaggccagg

SEQ ID NO: 8148814 - DNA, 22 bp, Homo sapiens
agatgctgccaggcccctcagt

SEQ ID NO: 8148815 - DNA, 22 bp, Homo sapiens
agatgctgcctctcctcacaag

SEQ ID NO: 8148816 - DNA, 22 bp, Homo sapiens
agatgctgccaggcccctcagt

SEQ ID NO: 8148817 - DNA, 22 bp, Homo sapiens
acaacagtaggaaaacatgtct

SEQ ID NO: 8148818 - DNA, 22 bp, Homo sapiens
acaacagggtaaggcaggccat

SEQ ID NO: 8148819 - DNA, 22 bp, Homo sapiens
acaacagtagcctttacaaggc

SEQ ID NO: 8148820 - DNA, 22 bp, Homo sapiens
acaacagggtaaggcaggccat

SEQ ID NO: 8148821 - DNA, 23 bp, Homo sapiens
acaacaggaaatcagacctgaac

SEQ ID NO: 8148822 - DNA, 22 bp, Homo sapiens
acaaagtgctgacattacaggc

SEQ ID NO: 8148823 - DNA, 22 bp, Homo sapiens
acaaagtgctgacattacaggc

SEQ ID NO: 8148824 - DNA, 22 bp, Homo sapiens
acaaagtgttttctgaaggcct

SEQ ID NO: 8148825 - DNA, 22 bp, Homo sapiens
acaaatagagattcaaataaag

SEQ ID NO: 8148826 - DNA, 22 bp, Homo sapiens
acaaatagagattcaaataaag

SEQ ID NO: 8148827 - DNA, 22 bp, Homo sapiens
acaaatagagattcaaataaag

SEQ ID NO: 8148828 - DNA, 22 bp, Homo sapiens
agatgcagaaaaactaagtgat

SEQ ID NO: 8148829 - DNA, 22 bp, Homo sapiens
acaaagtgcacaagatgagaac

SEQ ID NO: 8148830 - DNA, 19 bp, Homo sapiens
acaaagtgcgtgctctttt

SEQ ID NO: 8148831 - DNA, 22 bp, Homo sapiens
acaaagtgcacaagatgagaac

SEQ ID NO: 8148832 - DNA, 22 bp, Homo sapiens
acaaagtgctgacattacaggc

SEQ ID NO: 8148833 - DNA, 22 bp, Homo sapiens
acaaagtgctgacattacaggc

SEQ ID NO: 8148834 - DNA, 19 bp, Homo sapiens
acaaagtgcgtgctctttt

SEQ ID NO: 8148835 - DNA, 22 bp, Homo sapiens
agagttcagctactgcaaatgt

SEQ ID NO: 8148836 - DNA, 22 bp, Homo sapiens
acaaagtcacaataattaacct

SEQ ID NO: 8148837 - DNA, 22 bp, Homo sapiens
acaaagtatttttaggtttgta

SEQ ID NO: 8148838 - DNA, 22 bp, Homo sapiens
acaataatgtattgccaaaagt

SEQ ID NO: 8148839 - DNA, 22 bp, Homo sapiens
acaatagaaataattaagcaca

SEQ ID NO: 8148840 - DNA, 22 bp, Homo sapiens
acaatagaaataattaagcaca

SEQ ID NO: 8148841 - DNA, 22 bp, Homo sapiens
acaatagaaggaaactgacata

SEQ ID NO: 8148842 - DNA, 22 bp, Homo sapiens
acaatagaaataattaagcaca

SEQ ID NO: 8148843 - DNA, 22 bp, Homo sapiens
acaatagaaggaaactgacata

SEQ ID NO: 8148844 - DNA, 22 bp, Homo sapiens
agcaaatacttgaataaaaaga

SEQ ID NO: 8148845 - DNA, 19 bp, Homo sapiens
agcaaatataatagtgttc

SEQ ID NO: 8148846 - DNA, 22 bp, Homo sapiens
acaagtttcattgtttagaacc

SEQ ID NO: 8148847 - DNA, 22 bp, Homo sapiens
acaagtttcattgtttagaacc

SEQ ID NO: 8148848 - DNA, 18 bp, Homo sapiens
agcaaatattaagtgcat

SEQ ID NO: 8148849 - DNA, 22 bp, Homo sapiens
acaagttttggaagtcttaagg

SEQ ID NO: 8148850 - DNA, 19 bp, Homo sapiens
acaataactcattgattgc

SEQ ID NO: 8148851 - DNA, 22 bp, Homo sapiens
acaacattcttaaatacactga

SEQ ID NO: 8148852 - DNA, 18 bp, Homo sapiens
agattttgagaaatacaa

SEQ ID NO: 8148853 - DNA, 22 bp, Homo sapiens
agattttggctggctggagaga

SEQ ID NO: 8148854 - DNA, 18 bp, Homo sapiens
agattttgagaaatacaa

SEQ ID NO: 8148855 - DNA, 22 bp, Homo sapiens
agattttggctggctggagaga

SEQ ID NO: 8148856 - DNA, 22 bp, Homo sapiens
acaacattatacatagaaagct

SEQ ID NO: 8148857 - DNA, 22 bp, Homo sapiens
acaacattatacatagaaagct

SEQ ID NO: 8148858 - DNA, 22 bp, Homo sapiens
acaacattatacatagaaagct

SEQ ID NO: 8148859 - DNA, 22 bp, Homo sapiens
acaacatcagctgagaccttca

SEQ ID NO: 8148860 - DNA, 22 bp, Homo sapiens
acaacagtccagtatagactgt

SEQ ID NO: 8148861 - DNA, 22 bp, Homo sapiens
agcaaataaagacaattatgtc

SEQ ID NO: 8148862 - DNA, 23 bp, Homo sapiens
agcaaataatctgcttgcttttt

SEQ ID NO: 8148863 - DNA, 22 bp, Homo sapiens
agcaaataattgtctttgaggg

SEQ ID NO: 8148864 - DNA, 22 bp, Homo sapiens
agcaaataaagacaattatgtc

SEQ ID NO: 8148865 - DNA, 22 bp, Homo sapiens
agcaaataaagacaattatgtc

SEQ ID NO: 8148866 - DNA, 22 bp, Homo sapiens
agcaaagtcagtggaaccatcc

SEQ ID NO: 8148867 - DNA, 22 bp, Homo sapiens
agcaaagtatgtgctgggagct

SEQ ID NO: 8148868 - DNA, 22 bp, Homo sapiens
agcaaagtggctttccaaacca

SEQ ID NO: 8148869 - DNA, 22 bp, Homo sapiens
acaatttttcaaagaagcttat

SEQ ID NO: 8148870 - DNA, 22 bp, Homo sapiens
acaatttttcaaagaagcttat

SEQ ID NO: 8148871 - DNA, 22 bp, Homo sapiens
agcacaggtaatacagagtaac

SEQ ID NO: 8148872 - DNA, 22 bp, Homo sapiens
acacaagaagttaatgggcaaa

SEQ ID NO: 8148873 - DNA, 22 bp, Homo sapiens
acacaagaagttaatgggcaaa

SEQ ID NO: 8148874 - DNA, 21 bp, Homo sapiens
acacaacaggcagtcattttc

SEQ ID NO: 8148875 - DNA, 22 bp, Homo sapiens
acacaacagaagagcaattgca

SEQ ID NO: 8148876 - DNA, 22 bp, Homo sapiens
agcacaggctttggtgtgaggg

SEQ ID NO: 8148877 - DNA, 22 bp, Homo sapiens
agcacaggctttggtgtgaggg

SEQ ID NO: 8148878 - DNA, 22 bp, Homo sapiens
agcacaggacgtagagcttgga

SEQ ID NO: 8148879 - DNA, 22 bp, Homo sapiens
agcacaggacgtagagcttgga

SEQ ID NO: 8148880 - DNA, 22 bp, Homo sapiens
agcacagggcccagcctaggcc

SEQ ID NO: 8148881 - DNA, 22 bp, Homo sapiens
agcacagggcccagcctaggcc

SEQ ID NO: 8148882 - DNA, 22 bp, Homo sapiens
agcacagggacaatgccaggtg

SEQ ID NO: 8148883 - DNA, 22 bp, Homo sapiens
agcacagggacaatgccaggtg

SEQ ID NO: 8148884 - DNA, 22 bp, Homo sapiens
agcacagggacaatgccaggtg

SEQ ID NO: 8148885 - DNA, 22 bp, Homo sapiens
agcacaaatataaaaatgtctg

SEQ ID NO: 8148886 - DNA, 22 bp, Homo sapiens
agcacaagtttctggcagacag

SEQ ID NO: 8148887 - DNA, 22 bp, Homo sapiens
agcaaggccgagaggatgctat

SEQ ID NO: 8148888 - DNA, 22 bp, Homo sapiens
agcaaggcagtcagctggctgg

SEQ ID NO: 8148889 - DNA, 22 bp, Homo sapiens
agcacacagtattagccattgt

SEQ ID NO: 8148890 - DNA, 22 bp, Homo sapiens
agcacacaggccacctccactt

SEQ ID NO: 8148891 - DNA, 22 bp, Homo sapiens
agcacacaggccacctccactt

SEQ ID NO: 8148892 - DNA, 22 bp, Homo sapiens
agcacacaggacttgattcatg

SEQ ID NO: 8148893 - DNA, 22 bp, Homo sapiens
agcacacaggacttgattcatg

SEQ ID NO: 8148894 - DNA, 22 bp, Homo sapiens
agcacacatcacttctgctcat

SEQ ID NO: 8148895 - DNA, 22 bp, Homo sapiens
agcacagaatgaggtggaagtg

SEQ ID NO: 8148896 - DNA, 22 bp, Homo sapiens
agcacagaatgaggtggaagtg

SEQ ID NO: 8148897 - DNA, 23 bp, Homo sapiens
agcacacttgtacaatgccctag

SEQ ID NO: 8148898 - DNA, 22 bp, Homo sapiens
agcacagaatggcttggaagcc

SEQ ID NO: 8148899 - DNA, 19 bp, Homo sapiens
agcacagacaagaccagca

SEQ ID NO: 8148900 - DNA, 19 bp, Homo sapiens
agcacagacaagaccagca

SEQ ID NO: 8148901 - DNA, 22 bp, Homo sapiens
agcacaggaccaaggaagctgt

SEQ ID NO: 8148902 - DNA, 22 bp, Homo sapiens
agaggattgaaggatttgttga

SEQ ID NO: 8148903 - DNA, 22 bp, Homo sapiens
agaggattgttactgattagct

SEQ ID NO: 8148904 - DNA, 22 bp, Homo sapiens
agaggcaaaaatctatggcaac

SEQ ID NO: 8148905 - DNA, 22 bp, Homo sapiens
agaggattttaaaagcatatgt

SEQ ID NO: 8148906 - DNA, 22 bp, Homo sapiens
agaggattttaacttatgcaac

SEQ ID NO: 8148907 - DNA, 22 bp, Homo sapiens
agaggcaaaaatctatggcaac

SEQ ID NO: 8148908 - DNA, 22 bp, Homo sapiens
agaggattatattttcaacaag

SEQ ID NO: 8148909 - DNA, 22 bp, Homo sapiens
agaggattcactgcagaagaca

SEQ ID NO: 8148910 - DNA, 22 bp, Homo sapiens
agaggattgatcaaacactgca

SEQ ID NO: 8148911 - DNA, 22 bp, Homo sapiens
agaggattcttagaattctgag

SEQ ID NO: 8148912 - DNA, 22 bp, Homo sapiens
aatttcacagtgaactttgagg

SEQ ID NO: 8148913 - DNA, 20 bp, Homo sapiens
agaggatttatgtggatgtg

SEQ ID NO: 8148914 - DNA, 22 bp, Homo sapiens
aatttcacagctggtctatggg

SEQ ID NO: 8148915 - DNA, 22 bp, Homo sapiens
aatttccagatcagatgactca

SEQ ID NO: 8148916 - DNA, 22 bp, Homo sapiens
aatttccagatcagatgactca

SEQ ID NO: 8148917 - DNA, 18 bp, Homo sapiens
aatttccatatgaattgc

SEQ ID NO: 8148918 - DNA, 18 bp, Homo sapiens
aatttccatatgaattgc

SEQ ID NO: 8148919 - DNA, 23 bp, Homo sapiens
aatttcccctgtctctgatttgg

SEQ ID NO: 8148920 - DNA, 22 bp, Homo sapiens
aatttcctgggataaaaagcca

SEQ ID NO: 8148921 - DNA, 22 bp, Homo sapiens
aatttcctgggataaaaagcca

SEQ ID NO: 8148922 - DNA, 22 bp, Homo sapiens
aatttcggttcaaggcccagtt

SEQ ID NO: 8148923 - DNA, 22 bp, Homo sapiens
agaggaggtccttttctgatgt

SEQ ID NO: 8148924 - DNA, 22 bp, Homo sapiens
agaggacaaaatgagaagtgct

SEQ ID NO: 8148925 - DNA, 22 bp, Homo sapiens
agaggacaaaatgagaagtgct

SEQ ID NO: 8148926 - DNA, 22 bp, Homo sapiens
agaggaggtggtgatgctttaa

SEQ ID NO: 8148927 - DNA, 22 bp, Homo sapiens
agaggaggtggtgatgctttaa

SEQ ID NO: 8148928 - DNA, 22 bp, Homo sapiens
agaggaggtggtgatgctttaa

SEQ ID NO: 8148929 - DNA, 22 bp, Homo sapiens
agaggaggtggtgatgctttaa

SEQ ID NO: 8148930 - DNA, 22 bp, Homo sapiens
agaggagtgggaagcagtgcaa

SEQ ID NO: 8148931 - DNA, 22 bp, Homo sapiens
agaggagtattttctaagggaa

SEQ ID NO: 8148932 - DNA, 22 bp, Homo sapiens
agaggatcatctagtttgactc

SEQ ID NO: 8148933 - DNA, 22 bp, Homo sapiens
agaggatgattttaaggacact

SEQ ID NO: 8148934 - DNA, 22 bp, Homo sapiens
agaggatgattttaaggacact

SEQ ID NO: 8148935 - DNA, 22 bp, Homo sapiens
agaggatgattttaaggacact

SEQ ID NO: 8148936 - DNA, 22 bp, Homo sapiens
aattccaagagcttcctaagtg

SEQ ID NO: 8148937 - DNA, 22 bp, Homo sapiens
aattccagaccacaagtgattt

SEQ ID NO: 8148938 - DNA, 22 bp, Homo sapiens
aattccagaccacaagtgattt

SEQ ID NO: 8148939 - DNA, 22 bp, Homo sapiens
aattccagcctcagttctatta

SEQ ID NO: 8148940 - DNA, 22 bp, Homo sapiens
aattccagctacttggaaggtt

SEQ ID NO: 8148941 - DNA, 21 bp, Homo sapiens
agagctggtaggtaggtaggt

SEQ ID NO: 8148942 - DNA, 21 bp, Homo sapiens
agagctggtaggtaggtaggt

SEQ ID NO: 8148943 - DNA, 21 bp, Homo sapiens
agagctggtaggtaggtaggt

SEQ ID NO: 8148944 - DNA, 22 bp, Homo sapiens
agaggaagtaatcaggacctgc

SEQ ID NO: 8148945 - DNA, 22 bp, Homo sapiens
agaggaaggatgcatatccaaa

SEQ ID NO: 8148946 - DNA, 22 bp, Homo sapiens
aattccagctaggaaaagcttc

SEQ ID NO: 8148947 - DNA, 22 bp, Homo sapiens
aattccagctgattgactttcc

SEQ ID NO: 8148948 - DNA, 22 bp, Homo sapiens
aattccagctgattgactttcc

SEQ ID NO: 8148949 - DNA, 22 bp, Homo sapiens
aattccaggatgcaggaggtgc

SEQ ID NO: 8148950 - DNA, 22 bp, Homo sapiens
agagctgggtggtggtgactca

SEQ ID NO: 8148951 - DNA, 22 bp, Homo sapiens
agaggaagtaatcaggacctgc

SEQ ID NO: 8148952 - DNA, 22 bp, Homo sapiens
agaggaagtaatcaggacctgc

SEQ ID NO: 8148953 - DNA, 22 bp, Homo sapiens
agaggaagtaatcaggacctgc

SEQ ID NO: 8148954 - DNA, 22 bp, Homo sapiens
agaggaagtaatcaggacctgc

SEQ ID NO: 8148955 - DNA, 22 bp, Homo sapiens
agaggaagtaatcaggacctgc

SEQ ID NO: 8148956 - DNA, 22 bp, Homo sapiens
agaggaagtaatcaggacctgc

SEQ ID NO: 8148957 - DNA, 22 bp, Homo sapiens
agaggaagtaatcaggacctgc

SEQ ID NO: 8148958 - DNA, 22 bp, Homo sapiens
agaggaatatgggtgcactaga

SEQ ID NO: 8148959 - DNA, 21 bp, Homo sapiens
agaggaagtgattggtctggc

SEQ ID NO: 8148960 - DNA, 22 bp, Homo sapiens
agaggaataaatttctgtagtg

SEQ ID NO: 8148961 - DNA, 22 bp, Homo sapiens
agaggaatgtatttccctgcaa

SEQ ID NO: 8148962 - DNA, 22 bp, Homo sapiens
agaggaatctgtctagacacaa

SEQ ID NO: 8148963 - DNA, 22 bp, Homo sapiens
agaggaatctgtctagacacaa

SEQ ID NO: 8148964 - DNA, 22 bp, Homo sapiens
agaggaatttctggaaggaggc

SEQ ID NO: 8148965 - DNA, 22 bp, Homo sapiens
agagctgagcaccaagcatggt

SEQ ID NO: 8148966 - DNA, 22 bp, Homo sapiens
agagctgagaatgtggcttcct

SEQ ID NO: 8148967 - DNA, 22 bp, Homo sapiens
agagctgaatttgggtggtgga

SEQ ID NO: 8148968 - DNA, 22 bp, Homo sapiens
agagctgagcaccaagcatggt

SEQ ID NO: 8148969 - DNA, 22 bp, Homo sapiens
agagctgaggatccagctgagc

SEQ ID NO: 8148970 - DNA, 22 bp, Homo sapiens
agagctgaggatccagctgagc

SEQ ID NO: 8148971 - DNA, 22 bp, Homo sapiens
agagctgaggatccagctgagc

SEQ ID NO: 8148972 - DNA, 22 bp, Homo sapiens
agagctgcacctatgcagacct

SEQ ID NO: 8148973 - DNA, 22 bp, Homo sapiens
agagctgcaatttcatgtggtg

SEQ ID NO: 8148974 - DNA, 22 bp, Homo sapiens
agagctgcagggtggacccagg

SEQ ID NO: 8148975 - DNA, 22 bp, Homo sapiens
agagctgcccacacagcagatt

SEQ ID NO: 8148976 - DNA, 22 bp, Homo sapiens
agagctgccctgccagttctaa

SEQ ID NO: 8148977 - DNA, 22 bp, Homo sapiens
agagctggaatcagacctcagg

SEQ ID NO: 8148978 - DNA, 22 bp, Homo sapiens
aattcatactctatattgcttt

SEQ ID NO: 8148979 - DNA, 22 bp, Homo sapiens
agagctggaatcagacctcagg

SEQ ID NO: 8148980 - DNA, 22 bp, Homo sapiens
aattcatactctatattgcttt

SEQ ID NO: 8148981 - DNA, 22 bp, Homo sapiens
agagctgctcagatgtcactgc

SEQ ID NO: 8148982 - DNA, 22 bp, Homo sapiens
agagctggaaaagttgttttaa

SEQ ID NO: 8148983 - DNA, 22 bp, Homo sapiens
agagctggaagctgctcttaga

SEQ ID NO: 8148984 - DNA, 22 bp, Homo sapiens
aattccaaatgttttcaatcca

SEQ ID NO: 8148985 - DNA, 22 bp, Homo sapiens
aattcattgccagaatctatga

SEQ ID NO: 8148986 - DNA, 22 bp, Homo sapiens
aattcattgccagaatctatga

SEQ ID NO: 8148987 - DNA, 22 bp, Homo sapiens
aattcattgccagaatctatga

SEQ ID NO: 8148988 - DNA, 22 bp, Homo sapiens
aattcattgccagaatctatga

SEQ ID NO: 8148989 - DNA, 22 bp, Homo sapiens
aattcatcattttatagctagt

SEQ ID NO: 8148990 - DNA, 22 bp, Homo sapiens
aattcatatggatatgctagta

SEQ ID NO: 8148991 - DNA, 22 bp, Homo sapiens
aattcattaagaaagagctaaa

SEQ ID NO: 8148992 - DNA, 22 bp, Homo sapiens
aattcatgagtagaatctatat

SEQ ID NO: 8148993 - DNA, 22 bp, Homo sapiens
aattcatgagtagaatctatat

SEQ ID NO: 8148994 - DNA, 22 bp, Homo sapiens
aattcattaagaaagagctaaa

SEQ ID NO: 8148995 - DNA, 22 bp, Homo sapiens
aattaagtcacacacctaaacc

SEQ ID NO: 8148996 - DNA, 22 bp, Homo sapiens
aattaatggaaagtaaggaagg

SEQ ID NO: 8148997 - DNA, 22 bp, Homo sapiens
aattaactaatttggtacaaga

SEQ ID NO: 8148998 - DNA, 22 bp, Homo sapiens
agagcacagcagatctctgatg

SEQ ID NO: 8148999 - DNA, 22 bp, Homo sapiens
agagcacagccaccatttacaa

SEQ ID NO: 8149000 - DNA, 22 bp, Homo sapiens
agagcacactgacgtcagtctg

SEQ ID NO: 8149001 - DNA, 22 bp, Homo sapiens
agagcacagaagaataggtgct

SEQ ID NO: 8149002 - DNA, 22 bp, Homo sapiens
agagcacaaattagttggtctt

SEQ ID NO: 8149003 - DNA, 22 bp, Homo sapiens
agagcacaaattttaaggaggc

SEQ ID NO: 8149004 - DNA, 22 bp, Homo sapiens
agagcctggcaaaaggtcctgc

SEQ ID NO: 8149005 - DNA, 22 bp, Homo sapiens
aattacagtcggagcagcactg

SEQ ID NO: 8149006 - DNA, 22 bp, Homo sapiens
agagcctggctcccagctaccg

SEQ ID NO: 8149007 - DNA, 22 bp, Homo sapiens
agagcctggctcccagctaccg

SEQ ID NO: 8149008 - DNA, 22 bp, Homo sapiens
agagctgaattcaagtgctggc

SEQ ID NO: 8149009 - DNA, 21 bp, Homo sapiens
aattacagatggaattacaga

SEQ ID NO: 8149010 - DNA, 23 bp, Homo sapiens
aattacaaccaagaactggaagg

SEQ ID NO: 8149011 - DNA, 22 bp, Homo sapiens
aattacaaatgtagactctcat

SEQ ID NO: 8149012 - DNA, 22 bp, Homo sapiens
aattaattttgttcattcagtc

SEQ ID NO: 8149013 - DNA, 22 bp, Homo sapiens
agagatttctactgcactcttt

SEQ ID NO: 8149014 - DNA, 22 bp, Homo sapiens
agagatttgtcaatgatttcca

SEQ ID NO: 8149015 - DNA, 22 bp, Homo sapiens
agagatttgtcaatgatttcca

SEQ ID NO: 8149016 - DNA, 22 bp, Homo sapiens
agagcaaatagagaagccagct

SEQ ID NO: 8149017 - DNA, 22 bp, Homo sapiens
agagcaacgaggtgatactaga

SEQ ID NO: 8149018 - DNA, 22 bp, Homo sapiens
agagcaagtgacagaaacaggg

SEQ ID NO: 8149019 - DNA, 22 bp, Homo sapiens
agagcacaaattagttggtctt

SEQ ID NO: 8149020 - DNA, 22 bp, Homo sapiens
agagcacaaattagttggtctt

SEQ ID NO: 8149021 - DNA, 21 bp, Homo sapiens
agagcaagttaaggcattaat

SEQ ID NO: 8149022 - DNA, 22 bp, Homo sapiens
aatgtgtctatgtggttcacag

SEQ ID NO: 8149023 - DNA, 22 bp, Homo sapiens
aatgtgtgaacttcagagcatc

SEQ ID NO: 8149024 - DNA, 22 bp, Homo sapiens
aatgtgtgaattgagagaagag

SEQ ID NO: 8149025 - DNA, 22 bp, Homo sapiens
aatgtgtgttcggggcccagag

SEQ ID NO: 8149026 - DNA, 22 bp, Homo sapiens
aatgtgtgtatttctaggcgag

SEQ ID NO: 8149027 - DNA, 22 bp, Homo sapiens
agagatctgtggattcattgtc

SEQ ID NO: 8149028 - DNA, 22 bp, Homo sapiens
aatgtgtcccttatttcacagg

SEQ ID NO: 8149029 - DNA, 22 bp, Homo sapiens
aatgtgtcccttatttcacagg

SEQ ID NO: 8149030 - DNA, 22 bp, Homo sapiens
aatgtgtcatttcccacaggtg

SEQ ID NO: 8149031 - DNA, 22 bp, Homo sapiens
aatgtgtcatttcccacaggtg

SEQ ID NO: 8149032 - DNA, 22 bp, Homo sapiens
aatgtgtcagcttgtcgatctt

SEQ ID NO: 8149033 - DNA, 22 bp, Homo sapiens
aatgtgtcagcttgtcgatctt

SEQ ID NO: 8149034 - DNA, 22 bp, Homo sapiens
aatgtgtagtcattgatcaaga

SEQ ID NO: 8149035 - DNA, 22 bp, Homo sapiens
aatgtgtataagggagagctaa

SEQ ID NO: 8149036 - DNA, 22 bp, Homo sapiens
aatgtgtataagggagagctaa

SEQ ID NO: 8149037 - DNA, 22 bp, Homo sapiens
aatgtgtatatgaacatacagg

SEQ ID NO: 8149038 - DNA, 22 bp, Homo sapiens
aatgtgtatatgaacatacagg

SEQ ID NO: 8149039 - DNA, 22 bp, Homo sapiens
aatgtgtatactggcaattaag

SEQ ID NO: 8149040 - DNA, 22 bp, Homo sapiens
aatgtgtagcatttaatgcagt

SEQ ID NO: 8149041 - DNA, 22 bp, Homo sapiens
aatgtgtagatgttgcattcct

SEQ ID NO: 8149042 - DNA, 22 bp, Homo sapiens
agagaaggggtaaagagtcctg

SEQ ID NO: 8149043 - DNA, 22 bp, Homo sapiens
aatgtgtactttttcatgctca

SEQ ID NO: 8149044 - DNA, 22 bp, Homo sapiens
agagaaggggtaaagagtcctg

SEQ ID NO: 8149045 - DNA, 22 bp, Homo sapiens
agagaagggcctgtatgtaatc

SEQ ID NO: 8149046 - DNA, 22 bp, Homo sapiens
agagaagggggaaagatctcac

SEQ ID NO: 8149047 - DNA, 22 bp, Homo sapiens
agagaagggggaaagatctcac

SEQ ID NO: 8149048 - DNA, 21 bp, Homo sapiens
agagaagggattccaggccct

SEQ ID NO: 8149049 - DNA, 22 bp, Homo sapiens
agagaagggcctgtatgtaatc

SEQ ID NO: 8149050 - DNA, 22 bp, Homo sapiens
agagaaatgattcctgggcaga

SEQ ID NO: 8149051 - DNA, 22 bp, Homo sapiens
aatgtattcctcatgcaagagt

SEQ ID NO: 8149052 - DNA, 22 bp, Homo sapiens
agagaaattctcagtggaagat

SEQ ID NO: 8149053 - DNA, 22 bp, Homo sapiens
agacatttagacccctgtagtt

SEQ ID NO: 8149054 - DNA, 22 bp, Homo sapiens
agacatttagacccctgtagtt

SEQ ID NO: 8149055 - DNA, 22 bp, Homo sapiens
agacatttatgtttctctagga

SEQ ID NO: 8149056 - DNA, 22 bp, Homo sapiens
aatgtataatatttaatgcttt

SEQ ID NO: 8149057 - DNA, 22 bp, Homo sapiens
aatgtataatatttaatgcttt

SEQ ID NO: 8149058 - DNA, 22 bp, Homo sapiens
aatgtataatatttaatgcttt

SEQ ID NO: 8149059 - DNA, 22 bp, Homo sapiens
aatgtataaccataggaaattt

SEQ ID NO: 8149060 - DNA, 22 bp, Homo sapiens
agacatttattcacacatttat

SEQ ID NO: 8149061 - DNA, 22 bp, Homo sapiens
agacatggagaaggagccagtg

SEQ ID NO: 8149062 - DNA, 22 bp, Homo sapiens
agacatgtcaccaattcttact

SEQ ID NO: 8149063 - DNA, 21 bp, Homo sapiens
agacatgtgaactaaaggtga

SEQ ID NO: 8149064 - DNA, 22 bp, Homo sapiens
agacatgtccacaaagcattca

SEQ ID NO: 8149065 - DNA, 22 bp, Homo sapiens
agacatgtggtataatcagggg

SEQ ID NO: 8149066 - DNA, 22 bp, Homo sapiens
agacattatgctgagtgaaaga

SEQ ID NO: 8149067 - DNA, 23 bp, Homo sapiens
aatgtatgttagtatcttagaga

SEQ ID NO: 8149068 - DNA, 22 bp, Homo sapiens
aatgtatgtgcatcatttacat

SEQ ID NO: 8149069 - DNA, 22 bp, Homo sapiens
aatgtatgtgtatatcaaatca

SEQ ID NO: 8149070 - DNA, 22 bp, Homo sapiens
aatgtatgtgtatatcaaatca

SEQ ID NO: 8149071 - DNA, 22 bp, Homo sapiens
aatgtatgtgattattcctcta

SEQ ID NO: 8149072 - DNA, 22 bp, Homo sapiens
aatgtatgtgcatcatttacat

SEQ ID NO: 8149073 - DNA, 21 bp, Homo sapiens
aatgtatgtttatctcacagt

SEQ ID NO: 8149074 - DNA, 22 bp, Homo sapiens
aatgtattatacataatttgtg

SEQ ID NO: 8149075 - DNA, 22 bp, Homo sapiens
aatgtatgaaggttccagtttc

SEQ ID NO: 8149076 - DNA, 22 bp, Homo sapiens
aatgtatgacagttctagtggt

SEQ ID NO: 8149077 - DNA, 22 bp, Homo sapiens
aatgtatggattcatgtctgtg

SEQ ID NO: 8149078 - DNA, 22 bp, Homo sapiens
aatgtatggattcatgtctgtg

SEQ ID NO: 8149079 - DNA, 22 bp, Homo sapiens
aatgtatgctgtggtatcttct

SEQ ID NO: 8149080 - DNA, 20 bp, Homo sapiens
aatgtatatgtgaccccaaa

SEQ ID NO: 8149081 - DNA, 22 bp, Homo sapiens
aatgtataatatttaatgcttt

SEQ ID NO: 8149082 - DNA, 22 bp, Homo sapiens
aatgtatgaaggttccagtttc

SEQ ID NO: 8149083 - DNA, 22 bp, Homo sapiens
aatgctctgtctctgacagtgg

SEQ ID NO: 8149084 - DNA, 18 bp, Homo sapiens
aatgctattgttataggg

SEQ ID NO: 8149085 - DNA, 22 bp, Homo sapiens
aatgctattcattaagcctact

SEQ ID NO: 8149086 - DNA, 22 bp, Homo sapiens
aatgccttggagagcctagagg

SEQ ID NO: 8149087 - DNA, 22 bp, Homo sapiens
aatgccttggagagcctagagg

SEQ ID NO: 8149088 - DNA, 22 bp, Homo sapiens
aatgctaaaatggcactaaagt

SEQ ID NO: 8149089 - DNA, 22 bp, Homo sapiens
aatgccttggagagcctagagg

SEQ ID NO: 8149090 - DNA, 22 bp, Homo sapiens
aatgccttggagagcctagagg

SEQ ID NO: 8149091 - DNA, 22 bp, Homo sapiens
aatgccttggagagcctagagg

SEQ ID NO: 8149092 - DNA, 22 bp, Homo sapiens
agacatgcaataatgtgcactc

SEQ ID NO: 8149093 - DNA, 19 bp, Homo sapiens
agacatgagacacaggatg

SEQ ID NO: 8149094 - DNA, 22 bp, Homo sapiens
agacatgacagatagttgctag

SEQ ID NO: 8149095 - DNA, 20 bp, Homo sapiens
aatgctgcttctttttgcat

SEQ ID NO: 8149096 - DNA, 22 bp, Homo sapiens
agacaggtagcaggacagatat

SEQ ID NO: 8149097 - DNA, 22 bp, Homo sapiens
agacaggtaaatagagatgctg

SEQ ID NO: 8149098 - DNA, 22 bp, Homo sapiens
agacatcagcttgtgtgcaggg

SEQ ID NO: 8149099 - DNA, 19 bp, Homo sapiens
aatgctgcttctttttgca

SEQ ID NO: 8149100 - DNA, 22 bp, Homo sapiens
aaatgcaattcaggaagacaag

SEQ ID NO: 8149101 - DNA, 22 bp, Homo sapiens
aaatgcaattcaggaagacaag

SEQ ID NO: 8149102 - DNA, 22 bp, Homo sapiens
aaatgcaattgtatgtactcca

SEQ ID NO: 8149103 - DNA, 22 bp, Homo sapiens
aaatgccaaggagagactgtta

SEQ ID NO: 8149104 - DNA, 22 bp, Homo sapiens
aaatgattgtcaaagttctgtt

SEQ ID NO: 8149105 - DNA, 22 bp, Homo sapiens
aaatgattgtcaaagttctgtt

SEQ ID NO: 8149106 - DNA, 22 bp, Homo sapiens
aaatgcaaggccatgtgaagga

SEQ ID NO: 8149107 - DNA, 22 bp, Homo sapiens
aaatgcaaggccatgtgaagga

SEQ ID NO: 8149108 - DNA, 22 bp, Homo sapiens
aaatgcaaggcacattcctttt

SEQ ID NO: 8149109 - DNA, 20 bp, Homo sapiens
aaatgatgggaataatctat

SEQ ID NO: 8149110 - DNA, 22 bp, Homo sapiens
aaatgatggaaatgaggctgaa

SEQ ID NO: 8149111 - DNA, 22 bp, Homo sapiens
aaatgatgctacagttttccca

SEQ ID NO: 8149112 - DNA, 22 bp, Homo sapiens
aaatgatggtactcatgtttag

SEQ ID NO: 8149113 - DNA, 22 bp, Homo sapiens
aaatgatgtggagtgaaattgt

SEQ ID NO: 8149114 - DNA, 22 bp, Homo sapiens
aaatgatgttataagaccagga

SEQ ID NO: 8149115 - DNA, 22 bp, Homo sapiens
aaatgctgtgttttaacataga

SEQ ID NO: 8149116 - DNA, 22 bp, Homo sapiens
aaatgctgttcttttaggtaga

SEQ ID NO: 8149117 - DNA, 22 bp, Homo sapiens
aaatgctgtcagtgttattgga

SEQ ID NO: 8149118 - DNA, 20 bp, Homo sapiens
aaatgctgtgctgttgccat

SEQ ID NO: 8149119 - DNA, 20 bp, Homo sapiens
aaatgctgtgctgttgccat

SEQ ID NO: 8149120 - DNA, 22 bp, Homo sapiens
aaatgctgtgttttaacataga

SEQ ID NO: 8149121 - DNA, 22 bp, Homo sapiens
aaatgctgtgttttaacataga

SEQ ID NO: 8149122 - DNA, 22 bp, Homo sapiens
aaatgctgtaactgatattctg

SEQ ID NO: 8149123 - DNA, 18 bp, Homo sapiens
aaatgctgctcaaattcc

SEQ ID NO: 8149124 - DNA, 19 bp, Homo sapiens
aaatggaaaactttgggaa

SEQ ID NO: 8149125 - DNA, 21 bp, Homo sapiens
aaatgctttgtatatatctgt

SEQ ID NO: 8149126 - DNA, 22 bp, Homo sapiens
aaatggaactgggctactaggt

SEQ ID NO: 8149127 - DNA, 22 bp, Homo sapiens
aaatggaaaatgctgttttggt

SEQ ID NO: 8149128 - DNA, 22 bp, Homo sapiens
aaatggaactgttgtgcatttg

SEQ ID NO: 8149129 - DNA, 22 bp, Homo sapiens
aaatggaactgggctactaggt

SEQ ID NO: 8149130 - DNA, 22 bp, Homo sapiens
aaatgcttgctcttgattattt

SEQ ID NO: 8149131 - DNA, 22 bp, Homo sapiens
aaatgatagtatggaactagga

SEQ ID NO: 8149132 - DNA, 22 bp, Homo sapiens
aaatgagtttgcctctagatag

SEQ ID NO: 8149133 - DNA, 22 bp, Homo sapiens
aaatgagtagcgatgcacatta

SEQ ID NO: 8149134 - DNA, 22 bp, Homo sapiens
aaatgagtttcctcaatgtcct

SEQ ID NO: 8149135 - DNA, 22 bp, Homo sapiens
aaatgagtagcgatgcacatta

SEQ ID NO: 8149136 - DNA, 22 bp, Homo sapiens
aaatgaccagaatacaggcttc

SEQ ID NO: 8149137 - DNA, 22 bp, Homo sapiens
aaatgactaatgatcctgggca

SEQ ID NO: 8149138 - DNA, 22 bp, Homo sapiens
aaatgaggttaatacagtgctt

SEQ ID NO: 8149139 - DNA, 23 bp, Homo sapiens
aaatgacatatggtttctgaagg

SEQ ID NO: 8149140 - DNA, 22 bp, Homo sapiens
aaatgacattaggatcctgcat

SEQ ID NO: 8149141 - DNA, 22 bp, Homo sapiens
aaatgacattaggatcctgcat

SEQ ID NO: 8149142 - DNA, 22 bp, Homo sapiens
aaatcagacacagtgaaagtta

SEQ ID NO: 8149143 - DNA, 22 bp, Homo sapiens
aaatcagacttgaattttcatc

SEQ ID NO: 8149144 - DNA, 22 bp, Homo sapiens
aaatcagaggtcagctgtacca

SEQ ID NO: 8149145 - DNA, 22 bp, Homo sapiens
aaatcagagtctgattttaagg

SEQ ID NO: 8149146 - DNA, 23 bp, Homo sapiens
aaatgacatatggtttctgaagg

SEQ ID NO: 8149147 - DNA, 23 bp, Homo sapiens
aaatattcttttttagtaagtgc

SEQ ID NO: 8149148 - DNA, 23 bp, Homo sapiens
aaatattcttttttagtaagtgc

SEQ ID NO: 8149149 - DNA, 23 bp, Homo sapiens
aaatattcttttttagtaagtgc

SEQ ID NO: 8149150 - DNA, 22 bp, Homo sapiens
aaatattggtaggatgcttgtt

SEQ ID NO: 8149151 - DNA, 22 bp, Homo sapiens
aaatattgttttggtaagcttc

SEQ ID NO: 8149152 - DNA, 22 bp, Homo sapiens
aaatattggtaggatgcttgtt

SEQ ID NO: 8149153 - DNA, 22 bp, Homo sapiens
aaatattgttttggtaagcttc

SEQ ID NO: 8149154 - DNA, 22 bp, Homo sapiens
aaatcaaaagacatgtgtttta

SEQ ID NO: 8149155 - DNA, 22 bp, Homo sapiens
aaatcaaggagggattatattt

SEQ ID NO: 8149156 - DNA, 22 bp, Homo sapiens
aaatcaaaagacatgtgtttta

SEQ ID NO: 8149157 - DNA, 22 bp, Homo sapiens
aaatcaaaagacatgtgtttta

SEQ ID NO: 8149158 - DNA, 22 bp, Homo sapiens
aaatatttgtctgaggcggttg

SEQ ID NO: 8149159 - DNA, 22 bp, Homo sapiens
aaatatttgtctgaggcggttg

SEQ ID NO: 8149160 - DNA, 22 bp, Homo sapiens
aaatatttgtctgaggcggttg

SEQ ID NO: 8149161 - DNA, 22 bp, Homo sapiens
aaatatttgtctgaggcggttg

SEQ ID NO: 8149162 - DNA, 22 bp, Homo sapiens
aaatcactaagttatagtgtgg

SEQ ID NO: 8149163 - DNA, 22 bp, Homo sapiens
aaatcaaggagggattatattt

SEQ ID NO: 8149164 - DNA, 22 bp, Homo sapiens
aaatcaaggagggattatattt

SEQ ID NO: 8149165 - DNA, 22 bp, Homo sapiens
aaatcaaggagggattatattt

SEQ ID NO: 8149166 - DNA, 22 bp, Homo sapiens
aaatcaaggagggattatattt

SEQ ID NO: 8149167 - DNA, 22 bp, Homo sapiens
aaatcacagggtctctaagtat

SEQ ID NO: 8149168 - DNA, 22 bp, Homo sapiens
aaatcactgattaaagttagaa

SEQ ID NO: 8149169 - DNA, 22 bp, Homo sapiens
aaatcactgattaaagttagaa

SEQ ID NO: 8149170 - DNA, 19 bp, Homo sapiens
aaatcagaatctgcatttt

SEQ ID NO: 8149171 - DNA, 22 bp, Homo sapiens
aaatcagaaaatatggagagga

SEQ ID NO: 8149172 - DNA, 22 bp, Homo sapiens
aaatcactgttattgatcttaa

SEQ ID NO: 8149173 - DNA, 22 bp, Homo sapiens
aagagagaccatgggggacagg

SEQ ID NO: 8149174 - DNA, 22 bp, Homo sapiens
aagagagagtgcgctcacagaa

SEQ ID NO: 8149175 - DNA, 22 bp, Homo sapiens
aagagagagtgcgctcacagaa

SEQ ID NO: 8149176 - DNA, 22 bp, Homo sapiens
aagagagagtgcgctcacagaa

SEQ ID NO: 8149177 - DNA, 22 bp, Homo sapiens
aagagagacaataggtagcatt

SEQ ID NO: 8149178 - DNA, 22 bp, Homo sapiens
aagagagaccatgggggacagg

SEQ ID NO: 8149179 - DNA, 22 bp, Homo sapiens
aagagagaagtctctctggttc

SEQ ID NO: 8149180 - DNA, 22 bp, Homo sapiens
aagagagacaataggtagcatt

SEQ ID NO: 8149181 - DNA, 22 bp, Homo sapiens
aaatataccagttgcctgcatc

SEQ ID NO: 8149182 - DNA, 22 bp, Homo sapiens
aaatatacggtccctaacagtc

SEQ ID NO: 8149183 - DNA, 22 bp, Homo sapiens
aaatataccagttgcctgcatc

SEQ ID NO: 8149184 - DNA, 22 bp, Homo sapiens
aaatataatttctgcctcaata

SEQ ID NO: 8149185 - DNA, 22 bp, Homo sapiens
aaatataatttctgcctcaata

SEQ ID NO: 8149186 - DNA, 22 bp, Homo sapiens
aaatataatttctgcctcaata

SEQ ID NO: 8149187 - DNA, 22 bp, Homo sapiens
aaatatactagatgatgaccca

SEQ ID NO: 8149188 - DNA, 22 bp, Homo sapiens
aaatatacggtccctaacagtc

SEQ ID NO: 8149189 - DNA, 22 bp, Homo sapiens
aaatatacggtccctaacagtc

SEQ ID NO: 8149190 - DNA, 22 bp, Homo sapiens
aaatatacggtccctaacagtc

SEQ ID NO: 8149191 - DNA, 22 bp, Homo sapiens
aaatatagcaattatgcctact

SEQ ID NO: 8149192 - DNA, 22 bp, Homo sapiens
aaatatgagagtaggagtttgg

SEQ ID NO: 8149193 - DNA, 22 bp, Homo sapiens
aagataaactcttgatttctga

SEQ ID NO: 8149194 - DNA, 22 bp, Homo sapiens
aagagtttttaatgggtactgg

SEQ ID NO: 8149195 - DNA, 22 bp, Homo sapiens
aagagtttttggagtgtgagtt

SEQ ID NO: 8149196 - DNA, 22 bp, Homo sapiens
aagagttttctctgatggcatt

SEQ ID NO: 8149197 - DNA, 22 bp, Homo sapiens
aagagtttgtcagatctgcacg

SEQ ID NO: 8149198 - DNA, 22 bp, Homo sapiens
aagagtttgggcaagtcataaa

SEQ ID NO: 8149199 - DNA, 22 bp, Homo sapiens
aagagtttgacctgtgccatcc

SEQ ID NO: 8149200 - DNA, 22 bp, Homo sapiens
aagagttttagacaaactgatt

SEQ ID NO: 8149201 - DNA, 22 bp, Homo sapiens
aagagttttctataatcttggc

SEQ ID NO: 8149202 - DNA, 22 bp, Homo sapiens
aagagtttctgattcagtaggt

SEQ ID NO: 8149203 - DNA, 19 bp, Homo sapiens
aaatatcagagagatgata

SEQ ID NO: 8149204 - DNA, 19 bp, Homo sapiens
aaatatcagagagatgata

SEQ ID NO: 8149205 - DNA, 22 bp, Homo sapiens
aagagtttctttattaaccttt

SEQ ID NO: 8149206 - DNA, 22 bp, Homo sapiens
aagagtttctttattaaccttt

SEQ ID NO: 8149207 - DNA, 22 bp, Homo sapiens
aagagtttctgggtcaaggatt

SEQ ID NO: 8149208 - DNA, 22 bp, Homo sapiens
aagagtttcttactggcatcta

SEQ ID NO: 8149209 - DNA, 22 bp, Homo sapiens
aaatatagtgacacttatagtc

SEQ ID NO: 8149210 - DNA, 22 bp, Homo sapiens
aaatatagtgacacttatagtc

SEQ ID NO: 8149211 - DNA, 22 bp, Homo sapiens
aaatatagtgacacttatagtc

SEQ ID NO: 8149212 - DNA, 22 bp, Homo sapiens
aaatatagtgacacttatagtc

SEQ ID NO: 8149213 - DNA, 22 bp, Homo sapiens
aaatatagtgacacttatagtc

SEQ ID NO: 8149214 - DNA, 22 bp, Homo sapiens
aaatacagattcttgtgtctat

SEQ ID NO: 8149215 - DNA, 22 bp, Homo sapiens
aaatacagcagactcctgttgt

SEQ ID NO: 8149216 - DNA, 19 bp, Homo sapiens
aaatacagcagctgtttcc

SEQ ID NO: 8149217 - DNA, 22 bp, Homo sapiens
aagaaggtgtggaaagatgctc

SEQ ID NO: 8149218 - DNA, 22 bp, Homo sapiens
aaatacaaaaattagccaggca

SEQ ID NO: 8149219 - DNA, 22 bp, Homo sapiens
aaatacaaaaattagccaggca

SEQ ID NO: 8149220 - DNA, 22 bp, Homo sapiens
aagagagaactcccttcgccag

SEQ ID NO: 8149221 - DNA, 22 bp, Homo sapiens
aaatacatacactgtacgtggc

SEQ ID NO: 8149222 - DNA, 22 bp, Homo sapiens
aaatacatacactgtacgtggc

SEQ ID NO: 8149223 - DNA, 22 bp, Homo sapiens
aaatacatacactgtacgtggc

SEQ ID NO: 8149224 - DNA, 22 bp, Homo sapiens
aaatacagtgtgtgttctttga

SEQ ID NO: 8149225 - DNA, 22 bp, Homo sapiens
aaatacagtggcagcagataat

SEQ ID NO: 8149226 - DNA, 22 bp, Homo sapiens
aaatacagtggcagcagataat

SEQ ID NO: 8149227 - DNA, 22 bp, Homo sapiens
aaatacagtgtgtgttctttga

SEQ ID NO: 8149228 - DNA, 22 bp, Homo sapiens
aaatacataaaggttgtaccag

SEQ ID NO: 8149229 - DNA, 22 bp, Homo sapiens
aaatacataaaggttgtaccag

SEQ ID NO: 8149230 - DNA, 22 bp, Homo sapiens
aagaagcattctttcattggtt

SEQ ID NO: 8149231 - DNA, 22 bp, Homo sapiens
aagaagcattctttcattggtt

SEQ ID NO: 8149232 - DNA, 22 bp, Homo sapiens
aagaagcaggtcacagacaggg

SEQ ID NO: 8149233 - DNA, 22 bp, Homo sapiens
aagaaggcggaccagaagggag

SEQ ID NO: 8149234 - DNA, 22 bp, Homo sapiens
aagaaggcttcagagcccagga

SEQ ID NO: 8149235 - DNA, 20 bp, Homo sapiens
aagaaggcctgcccagacac

SEQ ID NO: 8149236 - DNA, 22 bp, Homo sapiens
aagaagctgtagggattaactc

SEQ ID NO: 8149237 - DNA, 22 bp, Homo sapiens
aagaaggcctctgccctggctt

SEQ ID NO: 8149238 - DNA, 22 bp, Homo sapiens
aagaagctatacataatttggg

SEQ ID NO: 8149239 - DNA, 22 bp, Homo sapiens
aaagttgagttttatgtgttac

SEQ ID NO: 8149240 - DNA, 22 bp, Homo sapiens
aaagttctttttctataaatcc

SEQ ID NO: 8149241 - DNA, 22 bp, Homo sapiens
aaagttgttcagtaagaaactc

SEQ ID NO: 8149242 - DNA, 22 bp, Homo sapiens
aagaagcagctgccaggccagt

SEQ ID NO: 8149243 - DNA, 22 bp, Homo sapiens
aaattggattgggagaatgtga

SEQ ID NO: 8149244 - DNA, 22 bp, Homo sapiens
aaattggatgcacatttagaaa

SEQ ID NO: 8149245 - DNA, 22 bp, Homo sapiens
aaattgcttataaagatgaatg

SEQ ID NO: 8149246 - DNA, 22 bp, Homo sapiens
aaattggagtctgaggagtaag

SEQ ID NO: 8149247 - DNA, 22 bp, Homo sapiens
aaattgcttgagattagtctcc

SEQ ID NO: 8149248 - DNA, 22 bp, Homo sapiens
aaattggattttaaactgttgg

SEQ ID NO: 8149249 - DNA, 22 bp, Homo sapiens
aaattggattttaaactgttgg

SEQ ID NO: 8149250 - DNA, 22 bp, Homo sapiens
aaattgtaatgacttcacttga

SEQ ID NO: 8149251 - DNA, 22 bp, Homo sapiens
aaattgtaatgacttcacttga

SEQ ID NO: 8149252 - DNA, 22 bp, Homo sapiens
aaattgtatattccatttgtat

SEQ ID NO: 8149253 - DNA, 22 bp, Homo sapiens
aaagcagcacatggatatcagt

SEQ ID NO: 8149254 - DNA, 22 bp, Homo sapiens
aaagcagtatgaaaggcaataa

SEQ ID NO: 8149255 - DNA, 22 bp, Homo sapiens
aaagcagtctcagacttaagca

SEQ ID NO: 8149256 - DNA, 22 bp, Homo sapiens
aaagcagtgcaccttaattgat

SEQ ID NO: 8149257 - DNA, 22 bp, Homo sapiens
aaagcagtatgaaaggcaataa

SEQ ID NO: 8149258 - DNA, 22 bp, Homo sapiens
aaagcaggttatgaccatggcc

SEQ ID NO: 8149259 - DNA, 22 bp, Homo sapiens
aaagcaggttgcaattacagtg

SEQ ID NO: 8149260 - DNA, 22 bp, Homo sapiens
aaattgctatatgtgaatgtga

SEQ ID NO: 8149261 - DNA, 22 bp, Homo sapiens
aaattgctctttaaaagtactg

SEQ ID NO: 8149262 - DNA, 22 bp, Homo sapiens
aaattgctgacacttgaccatt

SEQ ID NO: 8149263 - DNA, 22 bp, Homo sapiens
aaattgctctttaaaagtactg

SEQ ID NO: 8149264 - DNA, 22 bp, Homo sapiens
aaattgctgaccaagtatattc

SEQ ID NO: 8149265 - DNA, 22 bp, Homo sapiens
aaattgctgaccaagtatattc

SEQ ID NO: 8149266 - DNA, 22 bp, Homo sapiens
aaattgctgacacttgaccatt

SEQ ID NO: 8149267 - DNA, 22 bp, Homo sapiens
aaattgctgaccaagtatattc

SEQ ID NO: 8149268 - DNA, 22 bp, Homo sapiens
aaattgctggcagcctttattc

SEQ ID NO: 8149269 - DNA, 22 bp, Homo sapiens
aaattccagaaactcagtatat

SEQ ID NO: 8149270 - DNA, 22 bp, Homo sapiens
aaattccagaaactcagtatat

SEQ ID NO: 8149271 - DNA, 22 bp, Homo sapiens
aaattccagttcttttacctgc

SEQ ID NO: 8149272 - DNA, 22 bp, Homo sapiens
aaattccattaggaaacttcca

SEQ ID NO: 8149273 - DNA, 22 bp, Homo sapiens
aaattccattatgataatttcg

SEQ ID NO: 8149274 - DNA, 22 bp, Homo sapiens
aaattagaccagttcaggtcca

SEQ ID NO: 8149275 - DNA, 22 bp, Homo sapiens
aaattcagcagtgaaatgcccc

SEQ ID NO: 8149276 - DNA, 22 bp, Homo sapiens
aaattcagatggctttcttttc

SEQ ID NO: 8149277 - DNA, 23 bp, Homo sapiens
aaattcagtccttcaactctgag

SEQ ID NO: 8149278 - DNA, 22 bp, Homo sapiens
aaattccaccagaatcagtaat

SEQ ID NO: 8149279 - DNA, 22 bp, Homo sapiens
aaattcatttttcttagtgtgc

SEQ ID NO: 8149280 - DNA, 22 bp, Homo sapiens
aaattcagttttaataatcact

SEQ ID NO: 8149281 - DNA, 22 bp, Homo sapiens
aaattcatatgttgaaatgcta

SEQ ID NO: 8149282 - DNA, 22 bp, Homo sapiens
aaagcatttcatgtctagaaag

SEQ ID NO: 8149283 - DNA, 22 bp, Homo sapiens
aaagcatttcatgtctagaaag

SEQ ID NO: 8149284 - DNA, 22 bp, Homo sapiens
aaagcatttcatgtctagaaag

SEQ ID NO: 8149285 - DNA, 20 bp, Homo sapiens
aaagcatttacttgtgattg

SEQ ID NO: 8149286 - DNA, 22 bp, Homo sapiens
aaagcattattctgtggaaaaa

SEQ ID NO: 8149287 - DNA, 22 bp, Homo sapiens
aaagccaaatgaaagatggttc

SEQ ID NO: 8149288 - DNA, 22 bp, Homo sapiens
aaagccaaatgaaagatggttc

SEQ ID NO: 8149289 - DNA, 22 bp, Homo sapiens
aaagccaaatgaaagatggttc

SEQ ID NO: 8149290 - DNA, 22 bp, Homo sapiens
aaagccaaatgaaagatggttc

SEQ ID NO: 8149291 - DNA, 22 bp, Homo sapiens
aaagccaagctgggaaggcagg

SEQ ID NO: 8149292 - DNA, 22 bp, Homo sapiens
aaagccacagttctatgtctgc

SEQ ID NO: 8149293 - DNA, 23 bp, Homo sapiens
aaagccaagtcagtctactggaa

SEQ ID NO: 8149294 - DNA, 23 bp, Homo sapiens
aaagccaagtcagtctactggaa

SEQ ID NO: 8149295 - DNA, 22 bp, Homo sapiens
aaagcatgactcaagaattact

SEQ ID NO: 8149296 - DNA, 22 bp, Homo sapiens
aaagcagtgctgtgagaacact

SEQ ID NO: 8149297 - DNA, 22 bp, Homo sapiens
aaagcatgattagatagatgat

SEQ ID NO: 8149298 - DNA, 22 bp, Homo sapiens
aaagcatgctactttatatagg

SEQ ID NO: 8149299 - DNA, 22 bp, Homo sapiens
aaagcatggcatgaagaacatg

SEQ ID NO: 8149300 - DNA, 22 bp, Homo sapiens
aaagcatggttaaagacagtgg

SEQ ID NO: 8149301 - DNA, 22 bp, Homo sapiens
aaagcatgtgaatagaatatgg

SEQ ID NO: 8149302 - DNA, 22 bp, Homo sapiens
aacatgaaggtaggatggtttt

SEQ ID NO: 8149303 - DNA, 22 bp, Homo sapiens
aacatgaaagttgctaagtgca

SEQ ID NO: 8149304 - DNA, 22 bp, Homo sapiens
aacatgaagttttctatagtga

SEQ ID NO: 8149305 - DNA, 22 bp, Homo sapiens
aacatgaagttttctatagtga

SEQ ID NO: 8149306 - DNA, 22 bp, Homo sapiens
aacatgaaagttgctaagtgca

SEQ ID NO: 8149307 - DNA, 22 bp, Homo sapiens
aacatgaaagttgctaagtgca

SEQ ID NO: 8149308 - DNA, 22 bp, Homo sapiens
aaaggcactgatcttatccagt

SEQ ID NO: 8149309 - DNA, 22 bp, Homo sapiens
aaaggcagagtgctcagctggc

SEQ ID NO: 8149310 - DNA, 20 bp, Homo sapiens
aaaggcacagcaacagagct

SEQ ID NO: 8149311 - DNA, 20 bp, Homo sapiens
aaaggcacagcaacagagct

SEQ ID NO: 8149312 - DNA, 22 bp, Homo sapiens
aaaggattagagataccatgcc

SEQ ID NO: 8149313 - DNA, 22 bp, Homo sapiens
aaaggcacagaagggaaaccaa

SEQ ID NO: 8149314 - DNA, 22 bp, Homo sapiens
aaaggcacacactccttgttat

SEQ ID NO: 8149315 - DNA, 22 bp, Homo sapiens
aaaggaggccacatggctagga

SEQ ID NO: 8149316 - DNA, 22 bp, Homo sapiens
aaaggaggccacatggctagga

SEQ ID NO: 8149317 - DNA, 22 bp, Homo sapiens
aaaggataaggttatcaatttt

SEQ ID NO: 8149318 - DNA, 22 bp, Homo sapiens
aaaggagttactcataaagctt

SEQ ID NO: 8149319 - DNA, 22 bp, Homo sapiens
aaaggagttactcataaagctt

SEQ ID NO: 8149320 - DNA, 22 bp, Homo sapiens
aaaggattaaataaatgtgctg

SEQ ID NO: 8149321 - DNA, 22 bp, Homo sapiens
aaaggataaggttatcaatttt

SEQ ID NO: 8149322 - DNA, 22 bp, Homo sapiens
aaagggaggggcgataagccgg

SEQ ID NO: 8149323 - DNA, 22 bp, Homo sapiens
aaagggaggggcgataagccgg

SEQ ID NO: 8149324 - DNA, 22 bp, Homo sapiens
aaagggagcatggctgcaggga

SEQ ID NO: 8149325 - DNA, 22 bp, Homo sapiens
aaagggagcatggctgcaggga

SEQ ID NO: 8149326 - DNA, 22 bp, Homo sapiens
aaagggagcatggctgcaggga

SEQ ID NO: 8149327 - DNA, 22 bp, Homo sapiens
aaagggagcatggctgcaggga

SEQ ID NO: 8149328 - DNA, 22 bp, Homo sapiens
aaagggagcatggctgcaggga

SEQ ID NO: 8149329 - DNA, 22 bp, Homo sapiens
aaagggaatgtgtaggacatgt

SEQ ID NO: 8149330 - DNA, 22 bp, Homo sapiens
aaaggcttcagtgagtgggtat

SEQ ID NO: 8149331 - DNA, 22 bp, Homo sapiens
aaaggcttagacacagaactgt

SEQ ID NO: 8149332 - DNA, 22 bp, Homo sapiens
aaaggcttgtacagcagccttc

SEQ ID NO: 8149333 - DNA, 22 bp, Homo sapiens
aaaggctttaaaatgtacatat

SEQ ID NO: 8149334 - DNA, 22 bp, Homo sapiens
aaaggcttctttgctccatgtc

SEQ ID NO: 8149335 - DNA, 22 bp, Homo sapiens
aacatgagtgataaaattacct

SEQ ID NO: 8149336 - DNA, 21 bp, Homo sapiens
aacatgatatgtgtatggatt

SEQ ID NO: 8149337 - DNA, 22 bp, Homo sapiens
aacatgatgacaaaggtatatt

SEQ ID NO: 8149338 - DNA, 22 bp, Homo sapiens
aacatgatttagtataatgcag

SEQ ID NO: 8149339 - DNA, 22 bp, Homo sapiens
aacatgattggaaaatgctgtc

SEQ ID NO: 8149340 - DNA, 22 bp, Homo sapiens
aaaggcatgattaattctgtgt

SEQ ID NO: 8149341 - DNA, 22 bp, Homo sapiens
aaaggcatgcctccatttctat

SEQ ID NO: 8149342 - DNA, 22 bp, Homo sapiens
aaaggctgccaggtaaaatatt

SEQ ID NO: 8149343 - DNA, 22 bp, Homo sapiens
aaaggctgccaggtaaaatatt

SEQ ID NO: 8149344 - DNA, 22 bp, Homo sapiens
aaaggctggaaactgaagataa

SEQ ID NO: 8149345 - DNA, 18 bp, Homo sapiens
aaaggctgaatatagaag

SEQ ID NO: 8149346 - DNA, 22 bp, Homo sapiens
aaaggctcaacagctgtacttt

SEQ ID NO: 8149347 - DNA, 22 bp, Homo sapiens
aaagtccaattttgttcaggct

SEQ ID NO: 8149348 - DNA, 22 bp, Homo sapiens
aaagtccagagggcacactgaa

SEQ ID NO: 8149349 - DNA, 22 bp, Homo sapiens
aaagtcctagcgatccacagaa

SEQ ID NO: 8149350 - DNA, 22 bp, Homo sapiens
aaagtcctgttaactgttaaca

SEQ ID NO: 8149351 - DNA, 22 bp, Homo sapiens
aaagtcctgactgcaggggatg

SEQ ID NO: 8149352 - DNA, 22 bp, Homo sapiens
aaagtcctgttaactgttaaca

SEQ ID NO: 8149353 - DNA, 22 bp, Homo sapiens
aaagtcctttttgccatgcaag

SEQ ID NO: 8149354 - DNA, 20 bp, Homo sapiens
aaagtcttatggttaatttt

SEQ ID NO: 8149355 - DNA, 22 bp, Homo sapiens
aaagtcttcacggcactagtgt

SEQ ID NO: 8149356 - DNA, 22 bp, Homo sapiens
aaagtcttgcattgatcttgaa

SEQ ID NO: 8149357 - DNA, 22 bp, Homo sapiens
aaagtcttaatgtaagtttagt

SEQ ID NO: 8149358 - DNA, 22 bp, Homo sapiens
aacttccttctagttcatatgt

SEQ ID NO: 8149359 - DNA, 22 bp, Homo sapiens
aacttccaggccttgaattatt

SEQ ID NO: 8149360 - DNA, 22 bp, Homo sapiens
aacttccttctagttcatatgt

SEQ ID NO: 8149361 - DNA, 22 bp, Homo sapiens
aaagtctttattttgtatcttt

SEQ ID NO: 8149362 - DNA, 22 bp, Homo sapiens
aaagtcttgttacgttccattg

SEQ ID NO: 8149363 - DNA, 22 bp, Homo sapiens
aaagtctttctcattggccatg

SEQ ID NO: 8149364 - DNA, 22 bp, Homo sapiens
aaagtctttctcatagtcacgc

SEQ ID NO: 8149365 - DNA, 22 bp, Homo sapiens
aacttgaatgagaacttttgcc

SEQ ID NO: 8149366 - DNA, 22 bp, Homo sapiens
aacttgaactgatgagtgttag

SEQ ID NO: 8149367 - DNA, 22 bp, Homo sapiens
aacttgaaaacctcatgaattg

SEQ ID NO: 8149368 - DNA, 22 bp, Homo sapiens
aacttgaaactgttccagaaaa

SEQ ID NO: 8149369 - DNA, 22 bp, Homo sapiens
aacttgaaaacctcatgaattg

SEQ ID NO: 8149370 - DNA, 22 bp, Homo sapiens
aacttctttgagctccagtttt

SEQ ID NO: 8149371 - DNA, 22 bp, Homo sapiens
aacttctttgagctccagtttt

SEQ ID NO: 8149372 - DNA, 22 bp, Homo sapiens
aacttctcaactagcttagagt

SEQ ID NO: 8149373 - DNA, 22 bp, Homo sapiens
aacttctcatacaaagaacaag

SEQ ID NO: 8149374 - DNA, 22 bp, Homo sapiens
aacttctcagcctgcacctggc

SEQ ID NO: 8149375 - DNA, 22 bp, Homo sapiens
aacttctctgaagtgacctgtt

SEQ ID NO: 8149376 - DNA, 22 bp, Homo sapiens
aacttctgacctcaagaactgt

SEQ ID NO: 8149377 - DNA, 22 bp, Homo sapiens
aacttctgcagaaaagtgcatg

SEQ ID NO: 8149378 - DNA, 22 bp, Homo sapiens
aacttctgccaaacagctgtta

SEQ ID NO: 8149379 - DNA, 22 bp, Homo sapiens
aacttctgcttttacaggcagt

SEQ ID NO: 8149380 - DNA, 22 bp, Homo sapiens
aaagttctgggggagaagaacg

SEQ ID NO: 8149381 - DNA, 22 bp, Homo sapiens
aaagttctgggggagaagaacg

SEQ ID NO: 8149382 - DNA, 22 bp, Homo sapiens
aaagttctggagaaaataatga

SEQ ID NO: 8149383 - DNA, 22 bp, Homo sapiens
aaagttctgggggagaagaacg

SEQ ID NO: 8149384 - DNA, 22 bp, Homo sapiens
aaagttctctatggtgtaaaaa

SEQ ID NO: 8149385 - DNA, 22 bp, Homo sapiens
aaagttctctatggtgtaaaaa

SEQ ID NO: 8149386 - DNA, 22 bp, Homo sapiens
aaagttacacgactatttatgt

SEQ ID NO: 8149387 - DNA, 22 bp, Homo sapiens
aaagttacacgactatttatgt

SEQ ID NO: 8149388 - DNA, 22 bp, Homo sapiens
aaagttacacatctagtaagtg

SEQ ID NO: 8149389 - DNA, 22 bp, Homo sapiens
aaagttctatgtaatgtttttt

SEQ ID NO: 8149390 - DNA, 22 bp, Homo sapiens
aaaatggcttaataggcaataa

SEQ ID NO: 8149391 - DNA, 20 bp, Homo sapiens
aaaatggccttgtattaaaa

SEQ ID NO: 8149392 - DNA, 22 bp, Homo sapiens
aaaatgtaaagcttgagtgtag

SEQ ID NO: 8149393 - DNA, 18 bp, Homo sapiens
aaaatgcaggcgacatgg

SEQ ID NO: 8149394 - DNA, 18 bp, Homo sapiens
aaaatgcaggcgacatgg

SEQ ID NO: 8149395 - DNA, 18 bp, Homo sapiens
aaaatgcaggcgacatgg

SEQ ID NO: 8149396 - DNA, 18 bp, Homo sapiens
aaaatgcaggcgacatgg

SEQ ID NO: 8149397 - DNA, 18 bp, Homo sapiens
aaaatgcaggcgacatgg

SEQ ID NO: 8149398 - DNA, 22 bp, Homo sapiens
aaaatgcatgagaatgtgctcg

SEQ ID NO: 8149399 - DNA, 22 bp, Homo sapiens
aaaatgcatgagaatgtgctcg

SEQ ID NO: 8149400 - DNA, 22 bp, Homo sapiens
aaaatgcaaacctacctacata

SEQ ID NO: 8149401 - DNA, 22 bp, Homo sapiens
aaaatgcaaacctacctacata

SEQ ID NO: 8149402 - DNA, 20 bp, Homo sapiens
aaaatgatgggcagggcagg

SEQ ID NO: 8149403 - DNA, 22 bp, Homo sapiens
aaaatgatgctgtaatttggca

SEQ ID NO: 8149404 - DNA, 22 bp, Homo sapiens
aaaatgatgctgtaatttggca

SEQ ID NO: 8149405 - DNA, 22 bp, Homo sapiens
aaaatgatgctgtaatttggca

SEQ ID NO: 8149406 - DNA, 22 bp, Homo sapiens
aaaatgatatcctgacttttat

SEQ ID NO: 8149407 - DNA, 22 bp, Homo sapiens
aaaatgatatcctgacttttat

SEQ ID NO: 8149408 - DNA, 22 bp, Homo sapiens
aaaatgaggtcaatatcctttt

SEQ ID NO: 8149409 - DNA, 22 bp, Homo sapiens
aaaatgaggaacggatcatggc

SEQ ID NO: 8149410 - DNA, 22 bp, Homo sapiens
aaaatgaggtcaatatcctttt

SEQ ID NO: 8149411 - DNA, 22 bp, Homo sapiens
aaaatgaggtcaatatcctttt

SEQ ID NO: 8149412 - DNA, 22 bp, Homo sapiens
aaaatgaggaacggatcatggc

SEQ ID NO: 8149413 - DNA, 22 bp, Homo sapiens
aaagcagggtccaaggagatgt

SEQ ID NO: 8149414 - DNA, 22 bp, Homo sapiens
aaagcagggaaatctatttgca

SEQ ID NO: 8149415 - DNA, 22 bp, Homo sapiens
aaagcaggcagcaggctggatt

SEQ ID NO: 8149416 - DNA, 22 bp, Homo sapiens
aaagcagggatgaggctagagg

SEQ ID NO: 8149417 - DNA, 22 bp, Homo sapiens
aaagcagggatgaggctagagg

SEQ ID NO: 8149418 - DNA, 22 bp, Homo sapiens
aaagcagggtccaaggagatgt

SEQ ID NO: 8149419 - DNA, 22 bp, Homo sapiens
aaagcagggcgatgtcctcctc

SEQ ID NO: 8149420 - DNA, 22 bp, Homo sapiens
aaagcagcggtgtctttactgc

SEQ ID NO: 8149421 - DNA, 22 bp, Homo sapiens
aaagcagctgatagtctcatct

SEQ ID NO: 8149422 - DNA, 22 bp, Homo sapiens
aaagcagctgtttgactttcca

SEQ ID NO: 8149423 - DNA, 22 bp, Homo sapiens
aaagcagctgtttgactttcca

SEQ ID NO: 8149424 - DNA, 22 bp, Homo sapiens
aaagcaggcagcaggctggatt

SEQ ID NO: 8149425 - DNA, 21 bp, Homo sapiens
aaaatgtagacttttccctga

SEQ ID NO: 8149426 - DNA, 21 bp, Homo sapiens
aaaatgtagacttttccctga

SEQ ID NO: 8149427 - DNA, 22 bp, Homo sapiens
aaaatgtctgctgttggtttat

SEQ ID NO: 8149428 - DNA, 22 bp, Homo sapiens
aaaatgtatgatggaggtgcta

SEQ ID NO: 8149429 - DNA, 22 bp, Homo sapiens
aaagcagcagcacctgcatttc

SEQ ID NO: 8149430 - DNA, 22 bp, Homo sapiens
aaagcagcagcacgtggaagag

SEQ ID NO: 8149431 - DNA, 22 bp, Homo sapiens
aaagcagccactctctctgcct

SEQ ID NO: 8149432 - DNA, 18 bp, Homo sapiens
aaaataacaaagttggct

SEQ ID NO: 8149433 - DNA, 22 bp, Homo sapiens
aaaataacttctactatttgca

SEQ ID NO: 8149434 - DNA, 22 bp, Homo sapiens
aaaataacttctactatttgca

SEQ ID NO: 8149435 - DNA, 22 bp, Homo sapiens
aaaataacttctactatttgca

SEQ ID NO: 8149436 - DNA, 22 bp, Homo sapiens
aaaataacttctactatttgca

SEQ ID NO: 8149437 - DNA, 22 bp, Homo sapiens
aaaataacttctactatttgca

SEQ ID NO: 8149438 - DNA, 22 bp, Homo sapiens
aaaataagttggtcctgtcctt

SEQ ID NO: 8149439 - DNA, 22 bp, Homo sapiens
aaaatacacatactaggggaaa

SEQ ID NO: 8149440 - DNA, 22 bp, Homo sapiens
aaaatacacatactaggggaaa

SEQ ID NO: 8149441 - DNA, 22 bp, Homo sapiens
aaaatacacatactaggggaaa

SEQ ID NO: 8149442 - DNA, 22 bp, Homo sapiens
aaaatacacatactaggggaaa

SEQ ID NO: 8149443 - DNA, 22 bp, Homo sapiens
aaaatactactgtcttcttccc

SEQ ID NO: 8149444 - DNA, 22 bp, Homo sapiens
aaaatctgcttccttttacaga

SEQ ID NO: 8149445 - DNA, 22 bp, Homo sapiens
aaaatactgtggagtgttgaaa

SEQ ID NO: 8149446 - DNA, 22 bp, Homo sapiens
aaaatgagacacatgtgactcc

SEQ ID NO: 8149447 - DNA, 22 bp, Homo sapiens
aaaatgagacacatgtgactcc

SEQ ID NO: 8149448 - DNA, 22 bp, Homo sapiens
aaaatgagcatattgatccttt

SEQ ID NO: 8149449 - DNA, 22 bp, Homo sapiens
aaaatgagcatattgatccttt

SEQ ID NO: 8149450 - DNA, 22 bp, Homo sapiens
aaaatgagatacagtttgaaag

SEQ ID NO: 8149451 - DNA, 22 bp, Homo sapiens
aaaatgagacacatgtgactcc

SEQ ID NO: 8149452 - DNA, 22 bp, Homo sapiens
aaaatgagacacatgtgactcc

SEQ ID NO: 8149453 - DNA, 22 bp, Homo sapiens
aaaagctagtcaatgatgtatt

SEQ ID NO: 8149454 - DNA, 19 bp, Homo sapiens
aaaaggaatattctttggg

SEQ ID NO: 8149455 - DNA, 22 bp, Homo sapiens
aaaagtttaagactcattctag

SEQ ID NO: 8149456 - DNA, 22 bp, Homo sapiens
aaaagtttaagactcattctag

SEQ ID NO: 8149457 - DNA, 21 bp, Homo sapiens
aaaagtttgacaggaaaggga

SEQ ID NO: 8149458 - DNA, 20 bp, Homo sapiens
aaaaattgatatcgcttcct

SEQ ID NO: 8149459 - DNA, 22 bp, Homo sapiens
aaaaatttatggttcttctctg

SEQ ID NO: 8149460 - DNA, 22 bp, Homo sapiens
aaaaatttatggttcttctctg

SEQ ID NO: 8149461 - DNA, 22 bp, Homo sapiens
aaaaattgctgagaacggaatt

SEQ ID NO: 8149462 - DNA, 22 bp, Homo sapiens
aaaaatttatggttcttctctg

SEQ ID NO: 8149463 - DNA, 22 bp, Homo sapiens
aaaacacaagaagcagggtaca

SEQ ID NO: 8149464 - DNA, 22 bp, Homo sapiens
aaaaatgaaacggctggttggc

SEQ ID NO: 8149465 - DNA, 22 bp, Homo sapiens
aaaagcaagaggctggattaaa

SEQ ID NO: 8149466 - DNA, 22 bp, Homo sapiens
aaaagattgttagggagaatgt

SEQ ID NO: 8149467 - DNA, 22 bp, Homo sapiens
aaaagcaagttgcctaggttga

SEQ ID NO: 8149468 - DNA, 22 bp, Homo sapiens
aaaagcaaggcagtctgtctga

SEQ ID NO: 8149469 - DNA, 22 bp, Homo sapiens
aaaagcaaggcagtctgtctga

SEQ ID NO: 8149470 - DNA, 22 bp, Homo sapiens
aaaaccaagttttccttagtct

SEQ ID NO: 8149471 - DNA, 22 bp, Homo sapiens
aaaaccacttccttgctattgg

SEQ ID NO: 8149472 - DNA, 22 bp, Homo sapiens
aaaaccagacactgtttctggg

SEQ ID NO: 8149473 - DNA, 22 bp, Homo sapiens
aaaaccaggcttgctgtgctcg

SEQ ID NO: 8149474 - DNA, 22 bp, Homo sapiens
aaaagaggttaaccaggtgtgt

SEQ ID NO: 8149475 - DNA, 22 bp, Homo sapiens
aaaaccagacactgtttctggg

SEQ ID NO: 8149476 - DNA, 22 bp, Homo sapiens
aaaaccaggcgtttcctattat

SEQ ID NO: 8149477 - DNA, 22 bp, Homo sapiens
aaaagagtcttaggcagtcata

SEQ ID NO: 8149478 - DNA, 22 bp, Homo sapiens
aaaacatgtccatacagaaact

SEQ ID NO: 8149479 - DNA, 22 bp, Homo sapiens
aaaacatgtccatacagaaact

SEQ ID NO: 8149480 - DNA, 22 bp, Homo sapiens
aaaacattctgtgaactctcaa

SEQ ID NO: 8149481 - DNA, 22 bp, Homo sapiens
aaaacattgaattgcacactat

SEQ ID NO: 8149482 - DNA, 22 bp, Homo sapiens
aaaagcactacaatttcgcttc

SEQ ID NO: 8149483 - DNA, 22 bp, Homo sapiens
aaaagcaattgcgggttttgcc

SEQ ID NO: 8149484 - DNA, 22 bp, Homo sapiens
aaaagcagaccacgctttgtgg

SEQ ID NO: 8149485 - DNA, 22 bp, Homo sapiens
aaaagcagagactctggagcta

SEQ ID NO: 8149486 - DNA, 22 bp, Homo sapiens
aaaagcactacaatttcgcttc

SEQ ID NO: 8149487 - DNA, 22 bp, Homo sapiens
aaaagcagagactctggagcta

SEQ ID NO: 8149488 - DNA, 20 bp, Homo sapiens
aaaagcagccagagatggta

SEQ ID NO: 8149489 - DNA, 22 bp, Homo sapiens
aaaagcagatctccaaagtcta

SEQ ID NO: 8149490 - DNA, 22 bp, Homo sapiens
aaaagcagtttatagtcagttg

SEQ ID NO: 8149491 - DNA, 22 bp, Homo sapiens
aaaagcatctcaaaggagcttc

SEQ ID NO: 8149492 - DNA, 22 bp, Homo sapiens
aaaagcctggatactatcatta

SEQ ID NO: 8149493 - DNA, 22 bp, Homo sapiens
aaaagctagtcaatgatgtatt

SEQ ID NO: 8149494 - DNA, 22 bp, Homo sapiens
aaaagccatgcatacctaagag

SEQ ID NO: 8149495 - DNA, 22 bp, Homo sapiens
aaaagccatgcatacctaagag

SEQ ID NO: 8149496 - DNA, 22 bp, Homo sapiens
aaaagccaaggtcctcttcaga

SEQ ID NO: 8149497 - DNA, 22 bp, Homo sapiens
aaaagcaggtactcagcttggg

SEQ ID NO: 8149498 - DNA, 22 bp, Homo sapiens
aaaagcaggtactcagcttggg

SEQ ID NO: 8149499 - DNA, 22 bp, Homo sapiens
aaaagcaggtactcagcttggg

SEQ ID NO: 8149500 - DNA, 22 bp, Homo sapiens
aaaagcagtaaatgtatgacct

SEQ ID NO: 8149501 - DNA, 22 bp, Homo sapiens
aaaagcagttatctgggaggaa

SEQ ID NO: 8149502 - DNA, 22 bp, Homo sapiens
aaaacacaagaagcagggtaca

SEQ ID NO: 8149503 - DNA, 22 bp, Homo sapiens
aaaacacactggaccaatttaa

SEQ ID NO: 8149504 - DNA, 22 bp, Homo sapiens
aaaacactgcaaagctgattgg

SEQ ID NO: 8149505 - DNA, 22 bp, Homo sapiens
aaaacactgcctgcttgactga

SEQ ID NO: 8149506 - DNA, 23 bp, Homo sapiens
aaaacagcttcctccagtggctc

SEQ ID NO: 8149507 - DNA, 22 bp, Homo sapiens
aaaacagtttttgctaactgct

SEQ ID NO: 8149508 - DNA, 22 bp, Homo sapiens
aaaacagtttttgctaactgct

SEQ ID NO: 8149509 - DNA, 22 bp, Homo sapiens
aaaagagcttggttgattttgc

SEQ ID NO: 8149510 - DNA, 22 bp, Homo sapiens
aaaacaggagttttggtaggct

SEQ ID NO: 8149511 - DNA, 22 bp, Homo sapiens
aaaacagttataaacagagtca

SEQ ID NO: 8149512 - DNA, 22 bp, Homo sapiens
aaaacagttataaacagagtca

SEQ ID NO: 8149513 - DNA, 22 bp, Homo sapiens
aaaacagttataaacagagtca

SEQ ID NO: 8149514 - DNA, 22 bp, Homo sapiens
aaaacagttataaacagagtca

SEQ ID NO: 8149515 - DNA, 22 bp, Homo sapiens
aaatgtgagactgagttttcct

SEQ ID NO: 8149516 - DNA, 22 bp, Homo sapiens
aaagacacacagccagcaagtg

SEQ ID NO: 8149517 - DNA, 22 bp, Homo sapiens
aaagacacacagccagcaagtg

SEQ ID NO: 8149518 - DNA, 22 bp, Homo sapiens
aaagacacacagtgcttcagtt

SEQ ID NO: 8149519 - DNA, 22 bp, Homo sapiens
aaatgtgacagatgcagtacag

SEQ ID NO: 8149520 - DNA, 22 bp, Homo sapiens
aaatgtctttcaatagagaaat

SEQ ID NO: 8149521 - DNA, 22 bp, Homo sapiens
aaatgtctttcaatagagaaat

SEQ ID NO: 8149522 - DNA, 22 bp, Homo sapiens
aaatgtctttcaatagagaaat

SEQ ID NO: 8149523 - DNA, 22 bp, Homo sapiens
aaagacagatggcaaggatgat

SEQ ID NO: 8149524 - DNA, 22 bp, Homo sapiens
aaagacagatggcaaggatgat

SEQ ID NO: 8149525 - DNA, 22 bp, Homo sapiens
aaagacagatggcaaggatgat

SEQ ID NO: 8149526 - DNA, 22 bp, Homo sapiens
aaagacagatggcaaggatgat

SEQ ID NO: 8149527 - DNA, 22 bp, Homo sapiens
aaagacagagctgtaggggaaa

SEQ ID NO: 8149528 - DNA, 22 bp, Homo sapiens
aaagacacatatgcttaaccca

SEQ ID NO: 8149529 - DNA, 22 bp, Homo sapiens
aaagacacatgtctcttagatt

SEQ ID NO: 8149530 - DNA, 22 bp, Homo sapiens
aaacttagtagagttcatatta

SEQ ID NO: 8149531 - DNA, 22 bp, Homo sapiens
aaacttagttaagcatattatt

SEQ ID NO: 8149532 - DNA, 22 bp, Homo sapiens
aaacttcaaggatttgcaaatc

SEQ ID NO: 8149533 - DNA, 23 bp, Homo sapiens
aaacttcagtagtgtcatcagcc

SEQ ID NO: 8149534 - DNA, 22 bp, Homo sapiens
aaacttcagggaataaaagagt

SEQ ID NO: 8149535 - DNA, 22 bp, Homo sapiens
aaatggtgctactaggagtcag

SEQ ID NO: 8149536 - DNA, 22 bp, Homo sapiens
aaacttcatggataatataaag

SEQ ID NO: 8149537 - DNA, 22 bp, Homo sapiens
aaacttcagtgaatgacttatg

SEQ ID NO: 8149538 - DNA, 22 bp, Homo sapiens
aaatggtgtttctaatgctaga

SEQ ID NO: 8149539 - DNA, 22 bp, Homo sapiens
aaatggtgctactaggagtcag

SEQ ID NO: 8149540 - DNA, 22 bp, Homo sapiens
aaatggtggctcttttaaattg

SEQ ID NO: 8149541 - DNA, 22 bp, Homo sapiens
aaatgtctgagacttctgaact

SEQ ID NO: 8149542 - DNA, 22 bp, Homo sapiens
aaatgtctgtatgagaaagaga

SEQ ID NO: 8149543 - DNA, 22 bp, Homo sapiens
aaatgtctgtatgagaaagaga

SEQ ID NO: 8149544 - DNA, 22 bp, Homo sapiens
aaatgtctgtctcatgaggaaa

SEQ ID NO: 8149545 - DNA, 22 bp, Homo sapiens
aaatgtctgttagtcatatcat

SEQ ID NO: 8149546 - DNA, 22 bp, Homo sapiens
aaatgtctttatctcatgtaac

SEQ ID NO: 8149547 - DNA, 22 bp, Homo sapiens
aaatgacagagtaagctgttta

SEQ ID NO: 8149548 - DNA, 22 bp, Homo sapiens
aaatgacagagtaagctgttta

SEQ ID NO: 8149549 - DNA, 22 bp, Homo sapiens
aaatgacactcattcagtgtca

SEQ ID NO: 8149550 - DNA, 22 bp, Homo sapiens
aaatgacagagtaagctgttta

SEQ ID NO: 8149551 - DNA, 22 bp, Homo sapiens
aaactgtttccctccataacct

SEQ ID NO: 8149552 - DNA, 22 bp, Homo sapiens
aaatgacaataaaagtccatgc

SEQ ID NO: 8149553 - DNA, 22 bp, Homo sapiens
aaatgacaataaaagtccatgc

SEQ ID NO: 8149554 - DNA, 22 bp, Homo sapiens
aaatgacaataaaagtccatgc

SEQ ID NO: 8149555 - DNA, 22 bp, Homo sapiens
aaatgacactcattcagtgtca

SEQ ID NO: 8149556 - DNA, 21 bp, Homo sapiens
aaatgaatgtggtagtgcaag

SEQ ID NO: 8149557 - DNA, 21 bp, Homo sapiens
aaatgaatgtggtagtgcaag

SEQ ID NO: 8149558 - DNA, 21 bp, Homo sapiens
aaatgaatgtggtagtgcaag

SEQ ID NO: 8149559 - DNA, 20 bp, Homo sapiens
aaatccagtgtgtattttac

SEQ ID NO: 8149560 - DNA, 22 bp, Homo sapiens
aaatgaacatcaagaatagcct

SEQ ID NO: 8149561 - DNA, 22 bp, Homo sapiens
aaatacaatttcaggctgtaat

SEQ ID NO: 8149562 - DNA, 22 bp, Homo sapiens
aaatacaatttcaggctgtaat

SEQ ID NO: 8149563 - DNA, 22 bp, Homo sapiens
aaataacagtcagggacaacat

SEQ ID NO: 8149564 - DNA, 22 bp, Homo sapiens
aaatacacgtacatgtgtaaaa

SEQ ID NO: 8149565 - DNA, 22 bp, Homo sapiens
aaatacacgtacatgtgtaaaa

SEQ ID NO: 8149566 - DNA, 22 bp, Homo sapiens
aaatacacgtacatgtgtaaaa

SEQ ID NO: 8149567 - DNA, 22 bp, Homo sapiens
aaataacagtcagggacaacat

SEQ ID NO: 8149568 - DNA, 22 bp, Homo sapiens
aaataaaggtccactttagggc

SEQ ID NO: 8149569 - DNA, 22 bp, Homo sapiens
aaataaaggtccactttagggc

SEQ ID NO: 8149570 - DNA, 22 bp, Homo sapiens
aaataaaggtccactttagggc

SEQ ID NO: 8149571 - DNA, 22 bp, Homo sapiens
aaatacagagttgcttaaaagc

SEQ ID NO: 8149572 - DNA, 22 bp, Homo sapiens
aaatacagagttgcttaaaagc

SEQ ID NO: 8149573 - DNA, 22 bp, Homo sapiens
aaatacagagttgcttaaaagc

SEQ ID NO: 8149574 - DNA, 22 bp, Homo sapiens
aaatacagagttgcttaaaagc

SEQ ID NO: 8149575 - DNA, 21 bp, Homo sapiens
aaatacagatgcaaatctgtt

SEQ ID NO: 8149576 - DNA, 22 bp, Homo sapiens
aaagtcagttggccagatcact

SEQ ID NO: 8149577 - DNA, 22 bp, Homo sapiens
aaagtcaggctgtgtacctaac

SEQ ID NO: 8149578 - DNA, 22 bp, Homo sapiens
aaagtacatgcaattcttctga

SEQ ID NO: 8149579 - DNA, 22 bp, Homo sapiens
aaagtacatgtttggccatttg

SEQ ID NO: 8149580 - DNA, 22 bp, Homo sapiens
aaagtacagatggtgaggttgg

SEQ ID NO: 8149581 - DNA, 22 bp, Homo sapiens
aaagtacagatggtgaggttgg

SEQ ID NO: 8149582 - DNA, 22 bp, Homo sapiens
aaagtacaggaaagcctagcca

SEQ ID NO: 8149583 - DNA, 22 bp, Homo sapiens
aaagtacagccacatccaagta

SEQ ID NO: 8149584 - DNA, 22 bp, Homo sapiens
aaagtacaatattgagattgat

SEQ ID NO: 8149585 - DNA, 22 bp, Homo sapiens
aaagtacaatattgagattgat

SEQ ID NO: 8149586 - DNA, 22 bp, Homo sapiens
aaagtacacacagagccaagaa

SEQ ID NO: 8149587 - DNA, 22 bp, Homo sapiens
aaagtacacacagagccaagaa

SEQ ID NO: 8149588 - DNA, 22 bp, Homo sapiens
aaaggttagacagctctgcata

SEQ ID NO: 8149589 - DNA, 22 bp, Homo sapiens
aaagtacaaggaaaggatctga

SEQ ID NO: 8149590 - DNA, 22 bp, Homo sapiens
aaagtacaaggaaaggatctga

SEQ ID NO: 8149591 - DNA, 22 bp, Homo sapiens
aaagttttattcaagcattagt

SEQ ID NO: 8149592 - DNA, 22 bp, Homo sapiens
aaagttttattcaagcattagt

SEQ ID NO: 8149593 - DNA, 19 bp, Homo sapiens
aaagttttattctcatttg

SEQ ID NO: 8149594 - DNA, 22 bp, Homo sapiens
aaataaactgaagcacagagag

SEQ ID NO: 8149595 - DNA, 22 bp, Homo sapiens
aaagtttttaagcaagaccctt

SEQ ID NO: 8149596 - DNA, 22 bp, Homo sapiens
aaagttttgttgattgtggaat

SEQ ID NO: 8149597 - DNA, 22 bp, Homo sapiens
aaagttttctgccttcattaga

SEQ ID NO: 8149598 - DNA, 22 bp, Homo sapiens
aaagtcatccaaatttttatgt

SEQ ID NO: 8149599 - DNA, 22 bp, Homo sapiens
aaagtcatctgtcctaggctct

SEQ ID NO: 8149600 - DNA, 22 bp, Homo sapiens
aaaggacatgtcaatatcaggc

SEQ ID NO: 8149601 - DNA, 22 bp, Homo sapiens
aaagctcttaatgagattatcc

SEQ ID NO: 8149602 - DNA, 22 bp, Homo sapiens
aaagctcatcattaggaggcta

SEQ ID NO: 8149603 - DNA, 22 bp, Homo sapiens
aaaggagaaaacatacaggact

SEQ ID NO: 8149604 - DNA, 22 bp, Homo sapiens
aaaggagaaaacatacaggact

SEQ ID NO: 8149605 - DNA, 22 bp, Homo sapiens
aaaggagacttcagatctcctt

SEQ ID NO: 8149606 - DNA, 22 bp, Homo sapiens
aaaggagacagtcttacctgga

SEQ ID NO: 8149607 - DNA, 22 bp, Homo sapiens
aaaggagaaaacatacaggact

SEQ ID NO: 8149608 - DNA, 22 bp, Homo sapiens
aaaggagaaaacatacaggact

SEQ ID NO: 8149609 - DNA, 22 bp, Homo sapiens
aaaggagagtgagtcagatgcc

SEQ ID NO: 8149610 - DNA, 22 bp, Homo sapiens
aaaggagagtaggttactccat

SEQ ID NO: 8149611 - DNA, 22 bp, Homo sapiens
aaaggagataaagggcccttca

SEQ ID NO: 8149612 - DNA, 22 bp, Homo sapiens
aaaggagagtgagtcagatgcc

SEQ ID NO: 8149613 - DNA, 22 bp, Homo sapiens
aaaggaggaatggagagatgct

SEQ ID NO: 8149614 - DNA, 22 bp, Homo sapiens
aaaggttaaggtgttcaagaaa

SEQ ID NO: 8149615 - DNA, 22 bp, Homo sapiens
aaagccagggacagtgtgcatg

SEQ ID NO: 8149616 - DNA, 22 bp, Homo sapiens
aaagccagggacagtgtgcatg

SEQ ID NO: 8149617 - DNA, 22 bp, Homo sapiens
aaaattttgccctatccttcat

SEQ ID NO: 8149618 - DNA, 22 bp, Homo sapiens
aaagctagaaggaaattttatg

SEQ ID NO: 8149619 - DNA, 22 bp, Homo sapiens
aaagctagaaggaaattttatg

SEQ ID NO: 8149620 - DNA, 22 bp, Homo sapiens
aaagctagaaggaaattttatg

SEQ ID NO: 8149621 - DNA, 22 bp, Homo sapiens
aaagccaggggagggattccca

SEQ ID NO: 8149622 - DNA, 22 bp, Homo sapiens
aaagctatagggtcaagcattt

SEQ ID NO: 8149623 - DNA, 22 bp, Homo sapiens
aaagctagtaatattttaatcc

SEQ ID NO: 8149624 - DNA, 22 bp, Homo sapiens
aaagctagtaatattttaatcc

SEQ ID NO: 8149625 - DNA, 22 bp, Homo sapiens
aaagctagtaatattttaatcc

SEQ ID NO: 8149626 - DNA, 22 bp, Homo sapiens
aaagctagagaagctgctgtca

SEQ ID NO: 8149627 - DNA, 22 bp, Homo sapiens
aaagctatttgttatgagagaa

SEQ ID NO: 8149628 - DNA, 22 bp, Homo sapiens
aaagctatttgtgagttataga

SEQ ID NO: 8149629 - DNA, 22 bp, Homo sapiens
aaagctatttattacagagaat

SEQ ID NO: 8149630 - DNA, 22 bp, Homo sapiens
aaagctattcaacacgaacatg

SEQ ID NO: 8149631 - DNA, 22 bp, Homo sapiens
aaagctatttattacagagaat

SEQ ID NO: 8149632 - DNA, 22 bp, Homo sapiens
aaagctatgaggcatgcatttc

SEQ ID NO: 8149633 - DNA, 22 bp, Homo sapiens
aaagctatgaggcatgcatttc

SEQ ID NO: 8149634 - DNA, 22 bp, Homo sapiens
aaaatttccaccatctttgtgt

SEQ ID NO: 8149635 - DNA, 22 bp, Homo sapiens
aaaatttccaccatctttgtgt

SEQ ID NO: 8149636 - DNA, 22 bp, Homo sapiens
aaaattgtgaaggtttctgaaa

SEQ ID NO: 8149637 - DNA, 22 bp, Homo sapiens
aaaattgtaggaactgaatcaa

SEQ ID NO: 8149638 - DNA, 22 bp, Homo sapiens
aaaattgtcagaagttgatctt

SEQ ID NO: 8149639 - DNA, 22 bp, Homo sapiens
aaaattgtcgaacagtagtaac

SEQ ID NO: 8149640 - DNA, 22 bp, Homo sapiens
aaaattgtcgaacagtagtaac

SEQ ID NO: 8149641 - DNA, 22 bp, Homo sapiens
aaaattttactggtgtttcctt

SEQ ID NO: 8149642 - DNA, 22 bp, Homo sapiens
aaaatttccaccatctttgtgt

SEQ ID NO: 8149643 - DNA, 22 bp, Homo sapiens
aaaattttgccctatccttcat

SEQ ID NO: 8149644 - DNA, 22 bp, Homo sapiens
aaaattttcagcttgacttgat

SEQ ID NO: 8149645 - DNA, 22 bp, Homo sapiens
acacagagcaaatcatgacaga

SEQ ID NO: 8149646 - DNA, 22 bp, Homo sapiens
acacagagccaaaccatatcac

SEQ ID NO: 8149647 - DNA, 22 bp, Homo sapiens
acacagcaaggtctgactttgg

SEQ ID NO: 8149648 - DNA, 22 bp, Homo sapiens
acacagcaacttgcagtatgga

SEQ ID NO: 8149649 - DNA, 22 bp, Homo sapiens
acacagcaacttgcagtatgga

SEQ ID NO: 8149650 - DNA, 22 bp, Homo sapiens
acacacatgcctttcctaagta

SEQ ID NO: 8149651 - DNA, 22 bp, Homo sapiens
acacacatgcctttcctaagta

SEQ ID NO: 8149652 - DNA, 22 bp, Homo sapiens
acacacatgcctttcctaagta

SEQ ID NO: 8149653 - DNA, 22 bp, Homo sapiens
acaatgttctacatatacataa

SEQ ID NO: 8149654 - DNA, 22 bp, Homo sapiens
acacacatgcctttcctaagta

SEQ ID NO: 8149655 - DNA, 22 bp, Homo sapiens
acacagagatgtaaagttaggc

SEQ ID NO: 8149656 - DNA, 17 bp, Homo sapiens
acacagacaggcagaca

SEQ ID NO: 8149657 - DNA, 17 bp, Homo sapiens
acacagacaggcagaca

SEQ ID NO: 8149658 - DNA, 22 bp, Homo sapiens
aagagtttccatgctctgtgct

SEQ ID NO: 8149659 - DNA, 22 bp, Homo sapiens
aagagtttccagttgtggctca

SEQ ID NO: 8149660 - DNA, 22 bp, Homo sapiens
aagataacaggaggagtttgta

SEQ ID NO: 8149661 - DNA, 22 bp, Homo sapiens
aagatacaaatgtcaatattgg

SEQ ID NO: 8149662 - DNA, 22 bp, Homo sapiens
aagatacacggtcaactctcaa

SEQ ID NO: 8149663 - DNA, 22 bp, Homo sapiens
aagatacacggtcaactctcaa

SEQ ID NO: 8149664 - DNA, 22 bp, Homo sapiens
aagatacaaatgtcaatattgg

SEQ ID NO: 8149665 - DNA, 22 bp, Homo sapiens
aagatacaaatgtcaatattgg

SEQ ID NO: 8149666 - DNA, 22 bp, Homo sapiens
aagatacaaatgtcaatattgg

SEQ ID NO: 8149667 - DNA, 22 bp, Homo sapiens
aagatacaccaagagcctagta

SEQ ID NO: 8149668 - DNA, 22 bp, Homo sapiens
acacagccgtgaatctgcttct

SEQ ID NO: 8149669 - DNA, 22 bp, Homo sapiens
acacagccccacggtgagcaaa

SEQ ID NO: 8149670 - DNA, 22 bp, Homo sapiens
acacagctttcagtcattatct

SEQ ID NO: 8149671 - DNA, 22 bp, Homo sapiens
acacagctttcagtcattatct

SEQ ID NO: 8149672 - DNA, 22 bp, Homo sapiens
acacagcttcaaagtctaattc

SEQ ID NO: 8149673 - DNA, 22 bp, Homo sapiens
acacagctatggggtaggaaac

SEQ ID NO: 8149674 - DNA, 22 bp, Homo sapiens
acacagctagtgagtggcagag

SEQ ID NO: 8149675 - DNA, 22 bp, Homo sapiens
acacagctagtgagtggcagag

SEQ ID NO: 8149676 - DNA, 22 bp, Homo sapiens
acaatatagtccatgagcatgc

SEQ ID NO: 8149677 - DNA, 22 bp, Homo sapiens
acaatatagtccatgagcatgc

SEQ ID NO: 8149678 - DNA, 22 bp, Homo sapiens
acaatatagtccatgagcatgc

SEQ ID NO: 8149679 - DNA, 22 bp, Homo sapiens
acaatatacacatcctaatggg

SEQ ID NO: 8149680 - DNA, 22 bp, Homo sapiens
acaatatagtccatgagcatgc

SEQ ID NO: 8149681 - DNA, 22 bp, Homo sapiens
acaatatagtccatgagcatgc

SEQ ID NO: 8149682 - DNA, 20 bp, Homo sapiens
acaatatgtagatgaatagc

SEQ ID NO: 8149683 - DNA, 20 bp, Homo sapiens
acaatatgtagatgaatagc

SEQ ID NO: 8149684 - DNA, 22 bp, Homo sapiens
acaatattgtacccagaagttt

SEQ ID NO: 8149685 - DNA, 22 bp, Homo sapiens
acaatcacacatgcaattatac

SEQ ID NO: 8149686 - DNA, 22 bp, Homo sapiens
acaatgtagagtaaaatatgtt

SEQ ID NO: 8149687 - DNA, 22 bp, Homo sapiens
acaatgtagagtaaaatatgtt

SEQ ID NO: 8149688 - DNA, 22 bp, Homo sapiens
acaatatttgggggcagtttgt

SEQ ID NO: 8149689 - DNA, 22 bp, Homo sapiens
acaatgtgataatttaaagata

SEQ ID NO: 8149690 - DNA, 22 bp, Homo sapiens
acaatgtgacctgacagtgtta

SEQ ID NO: 8149691 - DNA, 22 bp, Homo sapiens
acaatgtgataatttaaagata

SEQ ID NO: 8149692 - DNA, 22 bp, Homo sapiens
acaatgtgtttttatacatttg

SEQ ID NO: 8149693 - DNA, 22 bp, Homo sapiens
acaatgtgggcatgagaaacca

SEQ ID NO: 8149694 - DNA, 22 bp, Homo sapiens
acaatgtgtttttatacatttg

SEQ ID NO: 8149695 - DNA, 23 bp, Homo sapiens
acaatgtctgttcataaaatacc

SEQ ID NO: 8149696 - DNA, 22 bp, Homo sapiens
acaatgtagttgtcatgagaca

SEQ ID NO: 8149697 - DNA, 22 bp, Homo sapiens
acaatgtaggatatgtacttgt

SEQ ID NO: 8149698 - DNA, 22 bp, Homo sapiens
acaatgtaggatatgtacttgt

SEQ ID NO: 8149699 - DNA, 22 bp, Homo sapiens
acaatgtaggctgaaaaagctt

SEQ ID NO: 8149700 - DNA, 22 bp, Homo sapiens
acaatgtagagtaaaatatgtt

SEQ ID NO: 8149701 - DNA, 22 bp, Homo sapiens
acaatgtagagtaaaatatgtt

SEQ ID NO: 8149702 - DNA, 22 bp, Homo sapiens
acaaatttggtgagagtaaata

SEQ ID NO: 8149703 - DNA, 22 bp, Homo sapiens
acaaatttcataggcaaatttt

SEQ ID NO: 8149704 - DNA, 22 bp, Homo sapiens
acaaattgttgcttcatgaatg

SEQ ID NO: 8149705 - DNA, 21 bp, Homo sapiens
acaaattgtttatataggaag

SEQ ID NO: 8149706 - DNA, 21 bp, Homo sapiens
acaaattgtttatataggaag

SEQ ID NO: 8149707 - DNA, 22 bp, Homo sapiens
acaatatacacatcctaatggg

SEQ ID NO: 8149708 - DNA, 22 bp, Homo sapiens
acaatagacccatgacacatac

SEQ ID NO: 8149709 - DNA, 22 bp, Homo sapiens
acaatagacccatgacacatac

SEQ ID NO: 8149710 - DNA, 20 bp, Homo sapiens
acaatagatttgagcaaagt

SEQ ID NO: 8149711 - DNA, 22 bp, Homo sapiens
acaatagatactgggcacatat

SEQ ID NO: 8149712 - DNA, 22 bp, Homo sapiens
acaatagagttctcataggaca

SEQ ID NO: 8149713 - DNA, 22 bp, Homo sapiens
acaacaaaatcactagtcttcc

SEQ ID NO: 8149714 - DNA, 22 bp, Homo sapiens
acaacaaaatcactagtcttcc

SEQ ID NO: 8149715 - DNA, 22 bp, Homo sapiens
acaaggcttatagttgcttttt

SEQ ID NO: 8149716 - DNA, 22 bp, Homo sapiens
acaatagacccatgacacatac

SEQ ID NO: 8149717 - DNA, 22 bp, Homo sapiens
acaaggctttggagggttctta

SEQ ID NO: 8149718 - DNA, 22 bp, Homo sapiens
acaaggcttcacacagtatgaa

SEQ ID NO: 8149719 - DNA, 22 bp, Homo sapiens
acaaggcttcatattcttttta

SEQ ID NO: 8149720 - DNA, 22 bp, Homo sapiens
acaaatgaatcatacataatgt

SEQ ID NO: 8149721 - DNA, 19 bp, Homo sapiens
acaaattgtcctcatcaag

SEQ ID NO: 8149722 - DNA, 22 bp, Homo sapiens
acaaattgggtatgagctaaga

SEQ ID NO: 8149723 - DNA, 20 bp, Homo sapiens
acaaattggcagaatgacaa

SEQ ID NO: 8149724 - DNA, 22 bp, Homo sapiens
acaaatgactatttggtacagg

SEQ ID NO: 8149725 - DNA, 22 bp, Homo sapiens
acaaatgaatcatacataatgt

SEQ ID NO: 8149726 - DNA, 22 bp, Homo sapiens
acaaatgaatcatacataatgt

SEQ ID NO: 8149727 - DNA, 22 bp, Homo sapiens
acaaatgaatcatacataatgt

SEQ ID NO: 8149728 - DNA, 22 bp, Homo sapiens
acaaatccagtgaactccagtg

SEQ ID NO: 8149729 - DNA, 22 bp, Homo sapiens
acaaatctgttttatagacttt

SEQ ID NO: 8149730 - DNA, 22 bp, Homo sapiens
acaaatgaacatataagcttga

SEQ ID NO: 8149731 - DNA, 22 bp, Homo sapiens
acaaatgaacctgaaatctcag

SEQ ID NO: 8149732 - DNA, 22 bp, Homo sapiens
acaaatgaacctgaaatctcag

SEQ ID NO: 8149733 - DNA, 22 bp, Homo sapiens
acaaatgaacatataagcttga

SEQ ID NO: 8149734 - DNA, 22 bp, Homo sapiens
aagaatcattgtaaagttctgt

SEQ ID NO: 8149735 - DNA, 22 bp, Homo sapiens
aagaatcattgtaaagttctgt

SEQ ID NO: 8149736 - DNA, 22 bp, Homo sapiens
acaaagctagagaagagaattg

SEQ ID NO: 8149737 - DNA, 22 bp, Homo sapiens
acaaatatttactgaatccact

SEQ ID NO: 8149738 - DNA, 22 bp, Homo sapiens
acaaatatttactgaatccact

SEQ ID NO: 8149739 - DNA, 22 bp, Homo sapiens
acaaatatttactgaatccact

SEQ ID NO: 8149740 - DNA, 22 bp, Homo sapiens
acaaatatttactgaatccact

SEQ ID NO: 8149741 - DNA, 22 bp, Homo sapiens
aagaatcatctgaactttgagg

SEQ ID NO: 8149742 - DNA, 17 bp, Homo sapiens
aagaatcattagagaag

SEQ ID NO: 8149743 - DNA, 22 bp, Homo sapiens
aagaatcatagagccactgata

SEQ ID NO: 8149744 - DNA, 22 bp, Homo sapiens
acaaaatagagttctcccctgg

SEQ ID NO: 8149745 - DNA, 22 bp, Homo sapiens
acaaaatagagttctcccctgg

SEQ ID NO: 8149746 - DNA, 22 bp, Homo sapiens
aagaatatctgttttatttagg

SEQ ID NO: 8149747 - DNA, 22 bp, Homo sapiens
aagaatatagattttttgaagt

SEQ ID NO: 8149748 - DNA, 22 bp, Homo sapiens
aagaatatagattttttgaagt

SEQ ID NO: 8149749 - DNA, 22 bp, Homo sapiens
aagaatatctgttttatttagg

SEQ ID NO: 8149750 - DNA, 22 bp, Homo sapiens
aagaatatctgttttatttagg

SEQ ID NO: 8149751 - DNA, 22 bp, Homo sapiens
aagaatatctgttttatttagg

SEQ ID NO: 8149752 - DNA, 22 bp, Homo sapiens
acaaaagtgtaggaattcctta

SEQ ID NO: 8149753 - DNA, 22 bp, Homo sapiens
acaaaagtgtaggaattcctta

SEQ ID NO: 8149754 - DNA, 22 bp, Homo sapiens
acaaaagtgagtgtgtctcaga

SEQ ID NO: 8149755 - DNA, 22 bp, Homo sapiens
acaaaagtgtaggaattcctta

SEQ ID NO: 8149756 - DNA, 22 bp, Homo sapiens
acaaaagtgtaggaattcctta

SEQ ID NO: 8149757 - DNA, 22 bp, Homo sapiens
acaaaagtgagtgtgtctcaga

SEQ ID NO: 8149758 - DNA, 22 bp, Homo sapiens
acaaaagtgagtgtgtctcaga

SEQ ID NO: 8149759 - DNA, 22 bp, Homo sapiens
acaaaacagtgttcctgcccct

SEQ ID NO: 8149760 - DNA, 22 bp, Homo sapiens
acaaaagaataagatgagtcat

SEQ ID NO: 8149761 - DNA, 22 bp, Homo sapiens
aattttatctctaagcaggctt

SEQ ID NO: 8149762 - DNA, 19 bp, Homo sapiens
aagaagcaataagctgtga

SEQ ID NO: 8149763 - DNA, 22 bp, Homo sapiens
aagaagatggttaactttcagt

SEQ ID NO: 8149764 - DNA, 22 bp, Homo sapiens
acaaaaagggagatgaggtaga

SEQ ID NO: 8149765 - DNA, 22 bp, Homo sapiens
aattttatctctaagcaggctt

SEQ ID NO: 8149766 - DNA, 22 bp, Homo sapiens
aattttatctctaagcaggctt

SEQ ID NO: 8149767 - DNA, 22 bp, Homo sapiens
acaaaaattagctgggcatggt

SEQ ID NO: 8149768 - DNA, 22 bp, Homo sapiens
acaaaaattagctgggcatggt

SEQ ID NO: 8149769 - DNA, 22 bp, Homo sapiens
acaaaaagggagatgaggtaga

SEQ ID NO: 8149770 - DNA, 22 bp, Homo sapiens
acaaaaattagctgggcatggt

SEQ ID NO: 8149771 - DNA, 22 bp, Homo sapiens
aagaagagaaatgtgctgctgg

SEQ ID NO: 8149772 - DNA, 22 bp, Homo sapiens
aagaagagaaatgtgctgctgg

SEQ ID NO: 8149773 - DNA, 22 bp, Homo sapiens
aagaagaagtgttatttttaga

SEQ ID NO: 8149774 - DNA, 22 bp, Homo sapiens
aagaagaattattccctaatca

SEQ ID NO: 8149775 - DNA, 22 bp, Homo sapiens
aagaactgtgctccaggctcca

SEQ ID NO: 8149776 - DNA, 22 bp, Homo sapiens
aagaactgtatcaagatgtagt

SEQ ID NO: 8149777 - DNA, 22 bp, Homo sapiens
aagaactttaaagcacttatga

SEQ ID NO: 8149778 - DNA, 22 bp, Homo sapiens
aagaacaggttctagaaccatt

SEQ ID NO: 8149779 - DNA, 22 bp, Homo sapiens
aatgtacaataagacaaagagg

SEQ ID NO: 8149780 - DNA, 22 bp, Homo sapiens
aatgtacaagggttccagtttt

SEQ ID NO: 8149781 - DNA, 22 bp, Homo sapiens
aatgtacaagggttccagtttt

SEQ ID NO: 8149782 - DNA, 22 bp, Homo sapiens
aatgtacaataagacaaagagg

SEQ ID NO: 8149783 - DNA, 22 bp, Homo sapiens
aatgtacaagggttccagtttt

SEQ ID NO: 8149784 - DNA, 22 bp, Homo sapiens
aagaacattcgaactattttct

SEQ ID NO: 8149785 - DNA, 22 bp, Homo sapiens
aagaacattcgaactattttct

SEQ ID NO: 8149786 - DNA, 22 bp, Homo sapiens
aagaacatgttaaaagattcac

SEQ ID NO: 8149787 - DNA, 22 bp, Homo sapiens
aagaacattgatattgtctatg

SEQ ID NO: 8149788 - DNA, 22 bp, Homo sapiens
aagaacattttgtagaatgaca

SEQ ID NO: 8149789 - DNA, 22 bp, Homo sapiens
aagaacattttgtagaatgaca

SEQ ID NO: 8149790 - DNA, 22 bp, Homo sapiens
aagaacattttgtagaatgaca

SEQ ID NO: 8149791 - DNA, 22 bp, Homo sapiens
aagaacattgatattgtctatg

SEQ ID NO: 8149792 - DNA, 22 bp, Homo sapiens
aagaactatctctggctgtagg

SEQ ID NO: 8149793 - DNA, 22 bp, Homo sapiens
aagcagggtttttccaccgcag

SEQ ID NO: 8149794 - DNA, 22 bp, Homo sapiens
aagcagggtcttcctcagttgg

SEQ ID NO: 8149795 - DNA, 22 bp, Homo sapiens
aagcagggtgtcttgacccatg

SEQ ID NO: 8149796 - DNA, 22 bp, Homo sapiens
aagcagggtgtcttgacccatg

SEQ ID NO: 8149797 - DNA, 22 bp, Homo sapiens
aagcagggtgtcttgacccatg

SEQ ID NO: 8149798 - DNA, 22 bp, Homo sapiens
aagcagggtgtcttgacccatg

SEQ ID NO: 8149799 - DNA, 22 bp, Homo sapiens
aagcagtatggtatttaagtca

SEQ ID NO: 8149800 - DNA, 22 bp, Homo sapiens
aagcagtagaatgcattgcttt

SEQ ID NO: 8149801 - DNA, 22 bp, Homo sapiens
aagcagtagggccaacttgcag

SEQ ID NO: 8149802 - DNA, 22 bp, Homo sapiens
aagcagtaatgaggtactattt

SEQ ID NO: 8149803 - DNA, 22 bp, Homo sapiens
aagcagggctttaagcggtttt

SEQ ID NO: 8149804 - DNA, 22 bp, Homo sapiens
aagcagggctttaagcggtttt

SEQ ID NO: 8149805 - DNA, 18 bp, Homo sapiens
aagcagggtccattgtgc

SEQ ID NO: 8149806 - DNA, 18 bp, Homo sapiens
aagcagggtccattgtgc

SEQ ID NO: 8149807 - DNA, 18 bp, Homo sapiens
aagcagggtccattgtgc

SEQ ID NO: 8149808 - DNA, 22 bp, Homo sapiens
aagcagggtcttcctcagttgg

SEQ ID NO: 8149809 - DNA, 22 bp, Homo sapiens
aagcagggctccctggggactc

SEQ ID NO: 8149810 - DNA, 22 bp, Homo sapiens
aagcagggctccctggggactc

SEQ ID NO: 8149811 - DNA, 22 bp, Homo sapiens
aagcagggctccctggggactc

SEQ ID NO: 8149812 - DNA, 22 bp, Homo sapiens
aagcagggctccctggggactc

SEQ ID NO: 8149813 - DNA, 22 bp, Homo sapiens
aagcagggctagaccaagaaga

SEQ ID NO: 8149814 - DNA, 22 bp, Homo sapiens
aagcagggctccctggggactc

SEQ ID NO: 8149815 - DNA, 22 bp, Homo sapiens
aagcagggctccctggggactc

SEQ ID NO: 8149816 - DNA, 22 bp, Homo sapiens
aagcagggagaaatttttcttc

SEQ ID NO: 8149817 - DNA, 21 bp, Homo sapiens
aagcagggactgcccaggtcc

SEQ ID NO: 8149818 - DNA, 23 bp, Homo sapiens
aagcagggagattcttagctgag

SEQ ID NO: 8149819 - DNA, 23 bp, Homo sapiens
aagcagggagattcttagctgag

SEQ ID NO: 8149820 - DNA, 23 bp, Homo sapiens
aagcagggagattcttagctgag

SEQ ID NO: 8149821 - DNA, 22 bp, Homo sapiens
aagcaggcttggtgtggccgct

SEQ ID NO: 8149822 - DNA, 22 bp, Homo sapiens
aagcaggcttggtgtggccgct

SEQ ID NO: 8149823 - DNA, 21 bp, Homo sapiens
aagcagggactgcccaggtcc

SEQ ID NO: 8149824 - DNA, 21 bp, Homo sapiens
aagcaggctgtaatcatgtgg

SEQ ID NO: 8149825 - DNA, 21 bp, Homo sapiens
aagcaggctgtaatcatgtgg

SEQ ID NO: 8149826 - DNA, 22 bp, Homo sapiens
aagcaggcttggtgtggccgct

SEQ ID NO: 8149827 - DNA, 22 bp, Homo sapiens
aagcaggctcacgccaggcagt

SEQ ID NO: 8149828 - DNA, 22 bp, Homo sapiens
aagcaggaaggagcccagggca

SEQ ID NO: 8149829 - DNA, 21 bp, Homo sapiens
aagcaggacatatgatgccct

SEQ ID NO: 8149830 - DNA, 22 bp, Homo sapiens
acagagcaattcttgggtgttt

SEQ ID NO: 8149831 - DNA, 22 bp, Homo sapiens
acagagcacagtcgggatggga

SEQ ID NO: 8149832 - DNA, 22 bp, Homo sapiens
aagcaggctcacgccaggcagt

SEQ ID NO: 8149833 - DNA, 22 bp, Homo sapiens
aagcaggctagattgaagggct

SEQ ID NO: 8149834 - DNA, 22 bp, Homo sapiens
aagcaggcgagggcctggagca

SEQ ID NO: 8149835 - DNA, 22 bp, Homo sapiens
aagcataaaacgttacaacatg

SEQ ID NO: 8149836 - DNA, 22 bp, Homo sapiens
aagcagtttttcaactgtttag

SEQ ID NO: 8149837 - DNA, 19 bp, Homo sapiens
aagcagtttatatatttgt

SEQ ID NO: 8149838 - DNA, 22 bp, Homo sapiens
acagcaggaagctggagggaaa

SEQ ID NO: 8149839 - DNA, 22 bp, Homo sapiens
acagcaggaagctggagggaaa

SEQ ID NO: 8149840 - DNA, 22 bp, Homo sapiens
aagcataacttgctgcacatag

SEQ ID NO: 8149841 - DNA, 22 bp, Homo sapiens
aagcataacttgctgcacatag

SEQ ID NO: 8149842 - DNA, 20 bp, Homo sapiens
aagcagtgaggtgaggagtg

SEQ ID NO: 8149843 - DNA, 20 bp, Homo sapiens
aagcagtgaggtgaggagtg

SEQ ID NO: 8149844 - DNA, 22 bp, Homo sapiens
aagcagtgttcccagctggccc

SEQ ID NO: 8149845 - DNA, 22 bp, Homo sapiens
aagcagtgcgctcatctaaggg

SEQ ID NO: 8149846 - DNA, 22 bp, Homo sapiens
aagcagtgttcccagctggccc

SEQ ID NO: 8149847 - DNA, 22 bp, Homo sapiens
aagcagtttagataggcaaagg

SEQ ID NO: 8149848 - DNA, 22 bp, Homo sapiens
aagcagttactatttactatta

SEQ ID NO: 8149849 - DNA, 22 bp, Homo sapiens
acagcagggggagctgttggac

SEQ ID NO: 8149850 - DNA, 22 bp, Homo sapiens
acagcagggggagctgttggac

SEQ ID NO: 8149851 - DNA, 21 bp, Homo sapiens
acagcagggctggcatgacag

SEQ ID NO: 8149852 - DNA, 21 bp, Homo sapiens
acagcagggctggcatgacag

SEQ ID NO: 8149853 - DNA, 21 bp, Homo sapiens
acagcagggctggcatgacag

SEQ ID NO: 8149854 - DNA, 22 bp, Homo sapiens
acagcagggggagctgttggac

SEQ ID NO: 8149855 - DNA, 22 bp, Homo sapiens
acagcagggggagctgttggac

SEQ ID NO: 8149856 - DNA, 22 bp, Homo sapiens
acagcagggggagctgttggac

SEQ ID NO: 8149857 - DNA, 22 bp, Homo sapiens
acagcagggtcacattccctct

SEQ ID NO: 8149858 - DNA, 22 bp, Homo sapiens
acagcagggtcacattccctct

SEQ ID NO: 8149859 - DNA, 22 bp, Homo sapiens
acagcagggtcacattccctct

SEQ ID NO: 8149860 - DNA, 22 bp, Homo sapiens
acagcaggggtggaataaacgt

SEQ ID NO: 8149861 - DNA, 22 bp, Homo sapiens
acagcaggggtggaataaacgt

SEQ ID NO: 8149862 - DNA, 22 bp, Homo sapiens
acagcaggtagctttgtgcctc

SEQ ID NO: 8149863 - DNA, 22 bp, Homo sapiens
acagcaggtagctttgtgcctc

SEQ ID NO: 8149864 - DNA, 19 bp, Homo sapiens
acagcaggtgtggggataa

SEQ ID NO: 8149865 - DNA, 19 bp, Homo sapiens
acagcaggtgtggggataa

SEQ ID NO: 8149866 - DNA, 19 bp, Homo sapiens
acagcaggtgtggggataa

SEQ ID NO: 8149867 - DNA, 19 bp, Homo sapiens
aagcccggctgctgagagg

SEQ ID NO: 8149868 - DNA, 22 bp, Homo sapiens
aagccctcatccccatgggcgt

SEQ ID NO: 8149869 - DNA, 21 bp, Homo sapiens
acagctggaaattacttgccc

SEQ ID NO: 8149870 - DNA, 22 bp, Homo sapiens
acagctggacaggggagagttt

SEQ ID NO: 8149871 - DNA, 21 bp, Homo sapiens
acagctggaaattacttgccc

SEQ ID NO: 8149872 - DNA, 22 bp, Homo sapiens
acagctgctctatatctcagcc

SEQ ID NO: 8149873 - DNA, 22 bp, Homo sapiens
acagctgctgcttctcactggg

SEQ ID NO: 8149874 - DNA, 19 bp, Homo sapiens
aagcccagtgtatgctctt

SEQ ID NO: 8149875 - DNA, 22 bp, Homo sapiens
aagcccagtaccttcagtgagg

SEQ ID NO: 8149876 - DNA, 22 bp, Homo sapiens
aagcccagtaccttcagtgagg

SEQ ID NO: 8149877 - DNA, 22 bp, Homo sapiens
aagcccagtttcacactgagac

SEQ ID NO: 8149878 - DNA, 22 bp, Homo sapiens
aagcccagggaatggtcgggag

SEQ ID NO: 8149879 - DNA, 22 bp, Homo sapiens
aagcccagctgaaagcattttt

SEQ ID NO: 8149880 - DNA, 22 bp, Homo sapiens
aagcccagctgaaagcattttt

SEQ ID NO: 8149881 - DNA, 22 bp, Homo sapiens
aagcccagctctgcctgctctg

SEQ ID NO: 8149882 - DNA, 22 bp, Homo sapiens
aagcccagctctgcctgctctg

SEQ ID NO: 8149883 - DNA, 22 bp, Homo sapiens
aagcccagctctgcctgctctg

SEQ ID NO: 8149884 - DNA, 22 bp, Homo sapiens
aagcccagcatccctgcaccag

SEQ ID NO: 8149885 - DNA, 22 bp, Homo sapiens
aagcccagcatccctgcaccag

SEQ ID NO: 8149886 - DNA, 22 bp, Homo sapiens
aagcccagcatccctgcaccag

SEQ ID NO: 8149887 - DNA, 22 bp, Homo sapiens
acagccaggaggaactcagtga

SEQ ID NO: 8149888 - DNA, 22 bp, Homo sapiens
acagccaggaggaactcagtga

SEQ ID NO: 8149889 - DNA, 22 bp, Homo sapiens
acagccaggcccagcacgcagg

SEQ ID NO: 8149890 - DNA, 23 bp, Homo sapiens
acagccaggatgggagcagaagc

SEQ ID NO: 8149891 - DNA, 22 bp, Homo sapiens
aagcccagcatccctgcaccag

SEQ ID NO: 8149892 - DNA, 22 bp, Homo sapiens
aagccaggttccatggaggagc

SEQ ID NO: 8149893 - DNA, 22 bp, Homo sapiens
aagccagtaagtttttgtcatt

SEQ ID NO: 8149894 - DNA, 22 bp, Homo sapiens
aagcccagatgtgagaactgag

SEQ ID NO: 8149895 - DNA, 22 bp, Homo sapiens
acagccagggacatacaatggt

SEQ ID NO: 8149896 - DNA, 22 bp, Homo sapiens
acagccagggacatacaatggt

SEQ ID NO: 8149897 - DNA, 22 bp, Homo sapiens
acagcaggttacagtggcacag

SEQ ID NO: 8149898 - DNA, 22 bp, Homo sapiens
acagcaggttacagtggcacag

SEQ ID NO: 8149899 - DNA, 22 bp, Homo sapiens
acagccagatctgagagatctt

SEQ ID NO: 8149900 - DNA, 22 bp, Homo sapiens
acagccagatctgagagatctt

SEQ ID NO: 8149901 - DNA, 22 bp, Homo sapiens
acagccagatctgagagatctt

SEQ ID NO: 8149902 - DNA, 19 bp, Homo sapiens
acagcaggtgtggggataa

SEQ ID NO: 8149903 - DNA, 22 bp, Homo sapiens
acagcaggttacagtggcacag

SEQ ID NO: 8149904 - DNA, 19 bp, Homo sapiens
acagcaggtgtggggataa

SEQ ID NO: 8149905 - DNA, 22 bp, Homo sapiens
acagcaggttacagtggcacag

SEQ ID NO: 8149906 - DNA, 22 bp, Homo sapiens
acagccaggagccatgggcagg

SEQ ID NO: 8149907 - DNA, 22 bp, Homo sapiens
acagccaggacttggccctctt

SEQ ID NO: 8149908 - DNA, 22 bp, Homo sapiens
acagccagcttgatgggatccg

SEQ ID NO: 8149909 - DNA, 22 bp, Homo sapiens
acagccagcagagctgtttcct

SEQ ID NO: 8149910 - DNA, 21 bp, Homo sapiens
acagccaggaacatgaggggc

SEQ ID NO: 8149911 - DNA, 22 bp, Homo sapiens
acagccaggaattctggagaag

SEQ ID NO: 8149912 - DNA, 22 bp, Homo sapiens
acagccaggaattctggagaag

SEQ ID NO: 8149913 - DNA, 22 bp, Homo sapiens
acagaaatattcgtggtgcttg

SEQ ID NO: 8149914 - DNA, 22 bp, Homo sapiens
acagaaatattcgtggtgcttg

SEQ ID NO: 8149915 - DNA, 23 bp, Homo sapiens
acagacaacactgatgagagaaa

SEQ ID NO: 8149916 - DNA, 22 bp, Homo sapiens
acagaaatgatgtttggcaata

SEQ ID NO: 8149917 - DNA, 22 bp, Homo sapiens
acagaaatgatgtttggcaata

SEQ ID NO: 8149918 - DNA, 23 bp, Homo sapiens
acagaaatcatttgtaaggtacc

SEQ ID NO: 8149919 - DNA, 18 bp, Homo sapiens
acagaaatagctgtgcct

SEQ ID NO: 8149920 - DNA, 18 bp, Homo sapiens
acagaaatagctgtgcct

SEQ ID NO: 8149921 - DNA, 18 bp, Homo sapiens
acagaaatagctgtgcct

SEQ ID NO: 8149922 - DNA, 23 bp, Homo sapiens
acagaaagttctgctggacagag

SEQ ID NO: 8149923 - DNA, 22 bp, Homo sapiens
acagaaataactttttatgttt

SEQ ID NO: 8149924 - DNA, 22 bp, Homo sapiens
acagaaataactttttatgttt

SEQ ID NO: 8149925 - DNA, 23 bp, Homo sapiens
acagacattccataatgtacacc

SEQ ID NO: 8149926 - DNA, 23 bp, Homo sapiens
acagacaacactgatgagagaaa

SEQ ID NO: 8149927 - DNA, 23 bp, Homo sapiens
acagacaacactgatgagagaaa

SEQ ID NO: 8149928 - DNA, 23 bp, Homo sapiens
acagacaacactgatgagagaaa

SEQ ID NO: 8149929 - DNA, 23 bp, Homo sapiens
acagacattccataatgtacacc

SEQ ID NO: 8149930 - DNA, 23 bp, Homo sapiens
acagacattccataatgtacacc

SEQ ID NO: 8149931 - DNA, 23 bp, Homo sapiens
acagacattccataatgtacacc

SEQ ID NO: 8149932 - DNA, 23 bp, Homo sapiens
acagacattccataatgtacacc

SEQ ID NO: 8149933 - DNA, 22 bp, Homo sapiens
acagacattttaagacacttta

SEQ ID NO: 8149934 - DNA, 22 bp, Homo sapiens
acagacattttaagacacttta

SEQ ID NO: 8149935 - DNA, 19 bp, Homo sapiens
acagacatttgcaattagc

SEQ ID NO: 8149936 - DNA, 22 bp, Homo sapiens
acagacatttaataaatgctga

SEQ ID NO: 8149937 - DNA, 22 bp, Homo sapiens
acagacatttaataaatgctga

SEQ ID NO: 8149938 - DNA, 22 bp, Homo sapiens
acagacatttaataaatgctga

SEQ ID NO: 8149939 - DNA, 22 bp, Homo sapiens
acagaccaaaaaaggatattgg

SEQ ID NO: 8149940 - DNA, 22 bp, Homo sapiens
acagaccaagtttccagcaggt

SEQ ID NO: 8149941 - DNA, 22 bp, Homo sapiens
acagacattttaagacacttta

SEQ ID NO: 8149942 - DNA, 22 bp, Homo sapiens
acagacattttaagacacttta

SEQ ID NO: 8149943 - DNA, 22 bp, Homo sapiens
acagagatgcaagtgtgtattt

SEQ ID NO: 8149944 - DNA, 22 bp, Homo sapiens
acagagatggcacagagaaggt

SEQ ID NO: 8149945 - DNA, 22 bp, Homo sapiens
acagagatggcttttcagaggc

SEQ ID NO: 8149946 - DNA, 22 bp, Homo sapiens
acagagatgtcagattggcagc

SEQ ID NO: 8149947 - DNA, 22 bp, Homo sapiens
acagagatgggaacattcaggt

SEQ ID NO: 8149948 - DNA, 22 bp, Homo sapiens
acagagatgtggatgagggatt

SEQ ID NO: 8149949 - DNA, 22 bp, Homo sapiens
acagagcaactttatttcatgg

SEQ ID NO: 8149950 - DNA, 22 bp, Homo sapiens
acagagcaacttgagtatcctc

SEQ ID NO: 8149951 - DNA, 22 bp, Homo sapiens
acagagcaactttatttcatgg

SEQ ID NO: 8149952 - DNA, 22 bp, Homo sapiens
acagagcaatgcgtgttctcta

SEQ ID NO: 8149953 - DNA, 22 bp, Homo sapiens
acagagcaatgcgtgttctcta

SEQ ID NO: 8149954 - DNA, 22 bp, Homo sapiens
acagagcaatgcgtgttctcta

SEQ ID NO: 8149955 - DNA, 22 bp, Homo sapiens
acagagcaataacagggagagg

SEQ ID NO: 8149956 - DNA, 22 bp, Homo sapiens
acagagcaataacagggagagg

SEQ ID NO: 8149957 - DNA, 22 bp, Homo sapiens
acagagatgaataatacaggtg

SEQ ID NO: 8149958 - DNA, 20 bp, Homo sapiens
acagagatcctctctttatc

SEQ ID NO: 8149959 - DNA, 20 bp, Homo sapiens
acagagatcctctctttatc

SEQ ID NO: 8149960 - DNA, 20 bp, Homo sapiens
acagagatcagctgatgggc

SEQ ID NO: 8149961 - DNA, 22 bp, Homo sapiens
acagactggcctgtctcgcacc

SEQ ID NO: 8149962 - DNA, 22 bp, Homo sapiens
acagactggagtgagagaaata

SEQ ID NO: 8149963 - DNA, 22 bp, Homo sapiens
acagactaaaattgcacagtgg

SEQ ID NO: 8149964 - DNA, 22 bp, Homo sapiens
acagacctgattcaagtcttga

SEQ ID NO: 8149965 - DNA, 22 bp, Homo sapiens
acagactgattcattgctcagg

SEQ ID NO: 8149966 - DNA, 22 bp, Homo sapiens
acactttaagcatttcacactg

SEQ ID NO: 8149967 - DNA, 22 bp, Homo sapiens
acagaaagatgatttgaaatgg

SEQ ID NO: 8149968 - DNA, 23 bp, Homo sapiens
acagaaagttctgctggacagag

SEQ ID NO: 8149969 - DNA, 20 bp, Homo sapiens
acagaaagctgccttgtccc

SEQ ID NO: 8149970 - DNA, 20 bp, Homo sapiens
acagaaagctgccttgtccc

SEQ ID NO: 8149971 - DNA, 20 bp, Homo sapiens
acagaaagctgccttgtccc

SEQ ID NO: 8149972 - DNA, 22 bp, Homo sapiens
acacttggagcaacacttatgg

SEQ ID NO: 8149973 - DNA, 22 bp, Homo sapiens
acacttggagcaacacttatgg

SEQ ID NO: 8149974 - DNA, 22 bp, Homo sapiens
acacttggagcaacacttatgg

SEQ ID NO: 8149975 - DNA, 22 bp, Homo sapiens
acacttctcatttgatactaac

SEQ ID NO: 8149976 - DNA, 18 bp, Homo sapiens
acacttcctggtggtgtg

SEQ ID NO: 8149977 - DNA, 18 bp, Homo sapiens
acacttcctggtggtgtg

SEQ ID NO: 8149978 - DNA, 22 bp, Homo sapiens
acacttcatagcaaggttggag

SEQ ID NO: 8149979 - DNA, 22 bp, Homo sapiens
acactggttgttaatagtaaca

SEQ ID NO: 8149980 - DNA, 22 bp, Homo sapiens
aagatacatatttgttctagtg

SEQ ID NO: 8149981 - DNA, 22 bp, Homo sapiens
aagatacatatttgttctagtg

SEQ ID NO: 8149982 - DNA, 22 bp, Homo sapiens
acacataagcctaatcatctcc

SEQ ID NO: 8149983 - DNA, 22 bp, Homo sapiens
aagatacatcaaagcaaattgg

SEQ ID NO: 8149984 - DNA, 22 bp, Homo sapiens
aagatacatcaaagcaaattgg

SEQ ID NO: 8149985 - DNA, 22 bp, Homo sapiens
aagatacacgttgtattgaata

SEQ ID NO: 8149986 - DNA, 22 bp, Homo sapiens
aagatacacgttgtattgaata

SEQ ID NO: 8149987 - DNA, 22 bp, Homo sapiens
aagatacacgttgtattgaata

SEQ ID NO: 8149988 - DNA, 22 bp, Homo sapiens
aagatacacgttgtattgaata

SEQ ID NO: 8149989 - DNA, 22 bp, Homo sapiens
aagatacacgttgtattgaata

SEQ ID NO: 8149990 - DNA, 22 bp, Homo sapiens
aagatacagacagagccaaaat

SEQ ID NO: 8149991 - DNA, 22 bp, Homo sapiens
aagatacagacagagccaaaat

SEQ ID NO: 8149992 - DNA, 20 bp, Homo sapiens
acacatatagcagcataaac

SEQ ID NO: 8149993 - DNA, 22 bp, Homo sapiens
acacatataccactgtaaatga

SEQ ID NO: 8149994 - DNA, 20 bp, Homo sapiens
acacatatagcagcataaac

SEQ ID NO: 8149995 - DNA, 20 bp, Homo sapiens
acacatatagcagcataaac

SEQ ID NO: 8149996 - DNA, 22 bp, Homo sapiens
acacatatatacatatttgtgc

SEQ ID NO: 8149997 - DNA, 22 bp, Homo sapiens
acacatatatacatatttgtgc

SEQ ID NO: 8149998 - DNA, 20 bp, Homo sapiens
acacatatagcagcataaac

SEQ ID NO: 8149999 - DNA, 22 bp, Homo sapiens
acactggtgtagttttctgcag

SEQ ID NO: 8150000 - DNA, 17 bp, Homo sapiens
acacatacatgggccat

SEQ ID NO: 8150001 - DNA, 22 bp, Homo sapiens
acacatacatggggaagatgag

SEQ ID NO: 8150002 - DNA, 22 bp, Homo sapiens
acacatagaaaataaatagtta

SEQ ID NO: 8150003 - DNA, 20 bp, Homo sapiens
acacatagataagaagctga

SEQ ID NO: 8150004 - DNA, 22 bp, Homo sapiens
acacatagaaaataaatagtta

SEQ ID NO: 8150005 - DNA, 22 bp, Homo sapiens
acacatataccactgtaaatga

SEQ ID NO: 8150006 - DNA, 22 bp, Homo sapiens
acacatataccactgtaaatga

SEQ ID NO: 8150007 - DNA, 22 bp, Homo sapiens
acacatataccactgtaaatga

SEQ ID NO: 8150008 - DNA, 22 bp, Homo sapiens
aacttcatttataatgtcatta

SEQ ID NO: 8150009 - DNA, 22 bp, Homo sapiens
aacttcattcctttttatgact

SEQ ID NO: 8150010 - DNA, 22 bp, Homo sapiens
aacttggtaccaccttctgaag

SEQ ID NO: 8150011 - DNA, 22 bp, Homo sapiens
aatgcttattattaatagaatg

SEQ ID NO: 8150012 - DNA, 22 bp, Homo sapiens
aatgcttattattaatagaatg

SEQ ID NO: 8150013 - DNA, 22 bp, Homo sapiens
aatgctgttctgagtctgcagg

SEQ ID NO: 8150014 - DNA, 22 bp, Homo sapiens
aatgctgttgagttgttcctgt

SEQ ID NO: 8150015 - DNA, 22 bp, Homo sapiens
aatgctgtgatttattaagtat

SEQ ID NO: 8150016 - DNA, 22 bp, Homo sapiens
aatgcagttgaatttgggtatg

SEQ ID NO: 8150017 - DNA, 22 bp, Homo sapiens
aatgcagtgagccattaaatgg

SEQ ID NO: 8150018 - DNA, 22 bp, Homo sapiens
aatgctgtcttagcatgaaagc

SEQ ID NO: 8150019 - DNA, 22 bp, Homo sapiens
aatgctgtcttagcatgaaagc

SEQ ID NO: 8150020 - DNA, 22 bp, Homo sapiens
aatgctgtccaataggaacata

SEQ ID NO: 8150021 - DNA, 23 bp, Homo sapiens
aactttactattttgaataatgc

SEQ ID NO: 8150022 - DNA, 23 bp, Homo sapiens
aactttactattttgaataatgc

SEQ ID NO: 8150023 - DNA, 22 bp, Homo sapiens
aactttaaagaggaggcttggg

SEQ ID NO: 8150024 - DNA, 22 bp, Homo sapiens
aactttaaggctataaattatg

SEQ ID NO: 8150025 - DNA, 20 bp, Homo sapiens
aacttgttttgttttctaat

SEQ ID NO: 8150026 - DNA, 22 bp, Homo sapiens
aacttgtttcttccattcaaca

SEQ ID NO: 8150027 - DNA, 22 bp, Homo sapiens
aactttaaaaaatatgtctgtt

SEQ ID NO: 8150028 - DNA, 22 bp, Homo sapiens
aatgtacaaaagtcagccaact

SEQ ID NO: 8150029 - DNA, 22 bp, Homo sapiens
aatgtacaaaagtcagccaact

SEQ ID NO: 8150030 - DNA, 22 bp, Homo sapiens
aatgtaaagttgggcacaaatg

SEQ ID NO: 8150031 - DNA, 22 bp, Homo sapiens
aatgtacaaaccttctttgtag

SEQ ID NO: 8150032 - DNA, 22 bp, Homo sapiens
aatgtacaaaccttctttgtag

SEQ ID NO: 8150033 - DNA, 22 bp, Homo sapiens
aatgtaaacagcaagagaaggg

SEQ ID NO: 8150034 - DNA, 22 bp, Homo sapiens
aactttacttgaaagaacatgt

SEQ ID NO: 8150035 - DNA, 22 bp, Homo sapiens
aactttacttgaaagaacatgt

SEQ ID NO: 8150036 - DNA, 22 bp, Homo sapiens
aatgtaaagttgggcacaaatg

SEQ ID NO: 8150037 - DNA, 22 bp, Homo sapiens
aatgtaaagttgggcacaaatg

SEQ ID NO: 8150038 - DNA, 22 bp, Homo sapiens
aatgaaatagttggctgtagag

SEQ ID NO: 8150039 - DNA, 22 bp, Homo sapiens
aatgaaatgaagatatgatcag

SEQ ID NO: 8150040 - DNA, 22 bp, Homo sapiens
aatgaaatctgctgggtaaaga

SEQ ID NO: 8150041 - DNA, 22 bp, Homo sapiens
aatgaaatctgctgggtaaaga

SEQ ID NO: 8150042 - DNA, 22 bp, Homo sapiens
aatgaaatctgctgggtaaaga

SEQ ID NO: 8150043 - DNA, 22 bp, Homo sapiens
aatgaaatagttggctgtagag

SEQ ID NO: 8150044 - DNA, 22 bp, Homo sapiens
aatgaaatagttggctgtagag

SEQ ID NO: 8150045 - DNA, 22 bp, Homo sapiens
aatgaaatagttggctgtagag

SEQ ID NO: 8150046 - DNA, 22 bp, Homo sapiens
aatctggctcagaagaagatga

SEQ ID NO: 8150047 - DNA, 22 bp, Homo sapiens
aatctggacacagttctcatgc

SEQ ID NO: 8150048 - DNA, 22 bp, Homo sapiens
aatctctctggggttcagtcct

SEQ ID NO: 8150049 - DNA, 22 bp, Homo sapiens
aatctcttcccagtaaaaatgg

SEQ ID NO: 8150050 - DNA, 22 bp, Homo sapiens
aatctgaagggagatacatgta

SEQ ID NO: 8150051 - DNA, 22 bp, Homo sapiens
aatctctttggctcaaggatcc

SEQ ID NO: 8150052 - DNA, 22 bp, Homo sapiens
aatctgagggaacttgaactcc

SEQ ID NO: 8150053 - DNA, 22 bp, Homo sapiens
aatctgacttataggctttgtg

SEQ ID NO: 8150054 - DNA, 22 bp, Homo sapiens
aatctgcacaattcagtttcag

SEQ ID NO: 8150055 - DNA, 21 bp, Homo sapiens
aatctgcttccctgtgacttg

SEQ ID NO: 8150056 - DNA, 22 bp, Homo sapiens
aatgcacctaccttgattctgc

SEQ ID NO: 8150057 - DNA, 22 bp, Homo sapiens
aatgcagaccagtatgaaaaac

SEQ ID NO: 8150058 - DNA, 22 bp, Homo sapiens
aatgcagagtaaatatttaatt

SEQ ID NO: 8150059 - DNA, 22 bp, Homo sapiens
aatgcagagtaaatatttaatt

SEQ ID NO: 8150060 - DNA, 22 bp, Homo sapiens
aatgaaatgtagcttatccata

SEQ ID NO: 8150061 - DNA, 22 bp, Homo sapiens
aatgatgacaggataaagaaca

SEQ ID NO: 8150062 - DNA, 22 bp, Homo sapiens
aatgatgacaggataaagaaca

SEQ ID NO: 8150063 - DNA, 18 bp, Homo sapiens
aatgcacacatttactcc

SEQ ID NO: 8150064 - DNA, 22 bp, Homo sapiens
aatgaaatgaagatatgatcag

SEQ ID NO: 8150065 - DNA, 22 bp, Homo sapiens
aatgaaatgaagatatgatcag

SEQ ID NO: 8150066 - DNA, 18 bp, Homo sapiens
aatgaaatgtacaccttt

SEQ ID NO: 8150067 - DNA, 18 bp, Homo sapiens
aatgaaatgtacaccttt

SEQ ID NO: 8150068 - DNA, 18 bp, Homo sapiens
aatgaaatgtacaccttt

SEQ ID NO: 8150069 - DNA, 18 bp, Homo sapiens
aatgaaatgtacaccttt

SEQ ID NO: 8150070 - DNA, 22 bp, Homo sapiens
aatgaaatgtagcttatccata

SEQ ID NO: 8150071 - DNA, 22 bp, Homo sapiens
aatattgagaaccagcatgttt

SEQ ID NO: 8150072 - DNA, 22 bp, Homo sapiens
aatatctgtggccatacaattt

SEQ ID NO: 8150073 - DNA, 22 bp, Homo sapiens
aatattgagaaccagcatgttt

SEQ ID NO: 8150074 - DNA, 22 bp, Homo sapiens
aatatctgtggccatacaattt

SEQ ID NO: 8150075 - DNA, 22 bp, Homo sapiens
aatatctgtggccatacaattt

SEQ ID NO: 8150076 - DNA, 22 bp, Homo sapiens
aatatctgttgttctaagccac

SEQ ID NO: 8150077 - DNA, 22 bp, Homo sapiens
aatatctgtctctaatgcatat

SEQ ID NO: 8150078 - DNA, 22 bp, Homo sapiens
aatatctggagatgctttttgt

SEQ ID NO: 8150079 - DNA, 22 bp, Homo sapiens
aatatctgtggccatacaattt

SEQ ID NO: 8150080 - DNA, 22 bp, Homo sapiens
aatatctgtctctaatgcatat

SEQ ID NO: 8150081 - DNA, 22 bp, Homo sapiens
aatatctgtggccatacaattt

SEQ ID NO: 8150082 - DNA, 22 bp, Homo sapiens
aatatttatgacaggaagtagc

SEQ ID NO: 8150083 - DNA, 22 bp, Homo sapiens
aatatttatgacaggaagtagc

SEQ ID NO: 8150084 - DNA, 22 bp, Homo sapiens
aatatttatatttctcttccct

SEQ ID NO: 8150085 - DNA, 22 bp, Homo sapiens
aatatttatatttctcttccct

SEQ ID NO: 8150086 - DNA, 22 bp, Homo sapiens
aatattgtttcaagatcacaga

SEQ ID NO: 8150087 - DNA, 22 bp, Homo sapiens
aatatttctgtagctatgttct

SEQ ID NO: 8150088 - DNA, 22 bp, Homo sapiens
aatctcaagctgtaaatacctc

SEQ ID NO: 8150089 - DNA, 22 bp, Homo sapiens
aatctcactcaaagaattctct

SEQ ID NO: 8150090 - DNA, 22 bp, Homo sapiens
aatatttctgcagaatggtttt

SEQ ID NO: 8150091 - DNA, 22 bp, Homo sapiens
aatatttctccttcgttatagc

SEQ ID NO: 8150092 - DNA, 22 bp, Homo sapiens
aatatttctgcagaatggtttt

SEQ ID NO: 8150093 - DNA, 22 bp, Homo sapiens
aatatttctccttcgttatagc

SEQ ID NO: 8150094 - DNA, 22 bp, Homo sapiens
aatatttcgttgcgtggctaga

SEQ ID NO: 8150095 - DNA, 20 bp, Homo sapiens
aatataattctctgaattta

SEQ ID NO: 8150096 - DNA, 20 bp, Homo sapiens
aatataattctctgaattta

SEQ ID NO: 8150097 - DNA, 22 bp, Homo sapiens
aatacatatggaattccatgtt

SEQ ID NO: 8150098 - DNA, 22 bp, Homo sapiens
aatacatatggaattccatgtt

SEQ ID NO: 8150099 - DNA, 19 bp, Homo sapiens
aatacagtgttatagaatt

SEQ ID NO: 8150100 - DNA, 22 bp, Homo sapiens
aatacatatggaattccatgtt

SEQ ID NO: 8150101 - DNA, 22 bp, Homo sapiens
aatacataataagttttgtctg

SEQ ID NO: 8150102 - DNA, 22 bp, Homo sapiens
aatacataataagttttgtctg

SEQ ID NO: 8150103 - DNA, 21 bp, Homo sapiens
aatacagtgaagaatttcttt

SEQ ID NO: 8150104 - DNA, 22 bp, Homo sapiens
aatacagtaggtaatagttcat

SEQ ID NO: 8150105 - DNA, 22 bp, Homo sapiens
aatacagtaattttgatgagtt

SEQ ID NO: 8150106 - DNA, 22 bp, Homo sapiens
aacagtttatgataaattctta

SEQ ID NO: 8150107 - DNA, 22 bp, Homo sapiens
aacagttgatgtagctttggag

SEQ ID NO: 8150108 - DNA, 22 bp, Homo sapiens
aagttacacagagttggaggct

SEQ ID NO: 8150109 - DNA, 22 bp, Homo sapiens
aagttacagttggaactgtgaa

SEQ ID NO: 8150110 - DNA, 22 bp, Homo sapiens
aagttacagttattatttaaaa

SEQ ID NO: 8150111 - DNA, 22 bp, Homo sapiens
aataagaacttgtctctggcag

SEQ ID NO: 8150112 - DNA, 22 bp, Homo sapiens
aagttacatattcttgggctat

SEQ ID NO: 8150113 - DNA, 22 bp, Homo sapiens
aagttacagttacagaatggag

SEQ ID NO: 8150114 - DNA, 22 bp, Homo sapiens
aagttacagtcagaggttaaca

SEQ ID NO: 8150115 - DNA, 22 bp, Homo sapiens
aagttacagtcagaggttaaca

SEQ ID NO: 8150116 - DNA, 18 bp, Homo sapiens
aataatgctgctgtgaac

SEQ ID NO: 8150117 - DNA, 18 bp, Homo sapiens
aataatgctgctgtgaac

SEQ ID NO: 8150118 - DNA, 22 bp, Homo sapiens
aataatgagcttgtctaattgt

SEQ ID NO: 8150119 - DNA, 22 bp, Homo sapiens
aataatgagacagcttatttaa

SEQ ID NO: 8150120 - DNA, 22 bp, Homo sapiens
aataatattcctctgtgtgcgt

SEQ ID NO: 8150121 - DNA, 22 bp, Homo sapiens
aataagaattgccagatttgaa

SEQ ID NO: 8150122 - DNA, 22 bp, Homo sapiens
aataatatttgaagcttcaaag

SEQ ID NO: 8150123 - DNA, 22 bp, Homo sapiens
aataatatttgaagcttcaaag

SEQ ID NO: 8150124 - DNA, 22 bp, Homo sapiens
aataatatttgaagcttcaaag

SEQ ID NO: 8150125 - DNA, 22 bp, Homo sapiens
aataatgtaggatgataaatga

SEQ ID NO: 8150126 - DNA, 22 bp, Homo sapiens
aataatgtacatacatatttcg

SEQ ID NO: 8150127 - DNA, 22 bp, Homo sapiens
aataatgtctgctattttaaaa

SEQ ID NO: 8150128 - DNA, 22 bp, Homo sapiens
aatacagatgagcttctgcctc

SEQ ID NO: 8150129 - DNA, 22 bp, Homo sapiens
aatacagatggcatgtgaagat

SEQ ID NO: 8150130 - DNA, 22 bp, Homo sapiens
aatacagatggcatgtgaagat

SEQ ID NO: 8150131 - DNA, 22 bp, Homo sapiens
aatacagaggggtcacaattca

SEQ ID NO: 8150132 - DNA, 22 bp, Homo sapiens
aatacagaggggtcacaattca

SEQ ID NO: 8150133 - DNA, 22 bp, Homo sapiens
aagtacaacgcatacagagaaa

SEQ ID NO: 8150134 - DNA, 22 bp, Homo sapiens
aagtctgagagaaactctctca

SEQ ID NO: 8150135 - DNA, 22 bp, Homo sapiens
aagtctgatcatttcttctata

SEQ ID NO: 8150136 - DNA, 22 bp, Homo sapiens
aagtctgagtgtcagtgcaagt

SEQ ID NO: 8150137 - DNA, 22 bp, Homo sapiens
aagtaatggttaaataattcta

SEQ ID NO: 8150138 - DNA, 23 bp, Homo sapiens
aaggtgttctgtatttaactcag

SEQ ID NO: 8150139 - DNA, 23 bp, Homo sapiens
aaggtgtttgatgggttgaggaa

SEQ ID NO: 8150140 - DNA, 23 bp, Homo sapiens
aaggtgtttgatgggttgaggaa

SEQ ID NO: 8150141 - DNA, 22 bp, Homo sapiens
aagtaacatctgaacatgatgt

SEQ ID NO: 8150142 - DNA, 22 bp, Homo sapiens
aagtaacatctgaacatgatgt

SEQ ID NO: 8150143 - DNA, 22 bp, Homo sapiens
aagtaacatctgaacatgatgt

SEQ ID NO: 8150144 - DNA, 22 bp, Homo sapiens
aagtaacatgggaacatctgaa

SEQ ID NO: 8150145 - DNA, 22 bp, Homo sapiens
aagtaacatctgaacatgatgt

SEQ ID NO: 8150146 - DNA, 22 bp, Homo sapiens
aagtaagtcttacattcacatt

SEQ ID NO: 8150147 - DNA, 23 bp, Homo sapiens
aaggtgtcattgatgggattcta

SEQ ID NO: 8150148 - DNA, 22 bp, Homo sapiens
aaggtgtcattgtttatggaga

SEQ ID NO: 8150149 - DNA, 23 bp, Homo sapiens
aaggtgtcattgatgggattcta

SEQ ID NO: 8150150 - DNA, 22 bp, Homo sapiens
aaggtgtcactgtttctggcct

SEQ ID NO: 8150151 - DNA, 22 bp, Homo sapiens
aaggtgtcactgtttctggcct

SEQ ID NO: 8150152 - DNA, 22 bp, Homo sapiens
aaggtgtcaggcttgggaaagt

SEQ ID NO: 8150153 - DNA, 22 bp, Homo sapiens
aaggtgtcatccaggatggtgg

SEQ ID NO: 8150154 - DNA, 22 bp, Homo sapiens
aaggtctgtattagagtttcat

SEQ ID NO: 8150155 - DNA, 22 bp, Homo sapiens
aaggtgtcatccaggatggtgg

SEQ ID NO: 8150156 - DNA, 22 bp, Homo sapiens
aaggtgtcaggcttgggaaagt

SEQ ID NO: 8150157 - DNA, 22 bp, Homo sapiens
aagggctggaatatctcttaga

SEQ ID NO: 8150158 - DNA, 22 bp, Homo sapiens
aagggctggaatatctcttaga

SEQ ID NO: 8150159 - DNA, 22 bp, Homo sapiens
aagggctggaatatctcttaga

SEQ ID NO: 8150160 - DNA, 21 bp, Homo sapiens
aaggtctgtaaagtgacagga

SEQ ID NO: 8150161 - DNA, 22 bp, Homo sapiens
aaggtgtcggcagagccgcttc

SEQ ID NO: 8150162 - DNA, 19 bp, Homo sapiens
aaggtgtcccaactgcgtt

SEQ ID NO: 8150163 - DNA, 22 bp, Homo sapiens
aaggtgtcgggttagctcagcc

SEQ ID NO: 8150164 - DNA, 22 bp, Homo sapiens
aaggtgtcggcagagccgcttc

SEQ ID NO: 8150165 - DNA, 22 bp, Homo sapiens
aaggtgtctctctgcttcttgg

SEQ ID NO: 8150166 - DNA, 22 bp, Homo sapiens
aaggtgtcgggttagctcagcc

SEQ ID NO: 8150167 - DNA, 22 bp, Homo sapiens
aaggtgtctctctgcttcttgg

SEQ ID NO: 8150168 - DNA, 22 bp, Homo sapiens
aaggtgtcgggttagctcagcc

SEQ ID NO: 8150169 - DNA, 22 bp, Homo sapiens
aaggtgtcggcagagccgcttc

SEQ ID NO: 8150170 - DNA, 22 bp, Homo sapiens
aaggtgtcattgtttatggaga

SEQ ID NO: 8150171 - DNA, 19 bp, Homo sapiens
aaggtgtcccaactgcgtt

SEQ ID NO: 8150172 - DNA, 22 bp, Homo sapiens
aaggtgtgaagagatgggaaga

SEQ ID NO: 8150173 - DNA, 22 bp, Homo sapiens
aaggtgtgaactgattcattgg

SEQ ID NO: 8150174 - DNA, 22 bp, Homo sapiens
aaggtgttatagctgaggaata

SEQ ID NO: 8150175 - DNA, 22 bp, Homo sapiens
aaggtgttcaggttttcccatt

SEQ ID NO: 8150176 - DNA, 22 bp, Homo sapiens
aaggtgttattggaggcatcag

SEQ ID NO: 8150177 - DNA, 22 bp, Homo sapiens
aaggtgttattggaggcatcag

SEQ ID NO: 8150178 - DNA, 22 bp, Homo sapiens
aagggctggaatatctcttaga

SEQ ID NO: 8150179 - DNA, 22 bp, Homo sapiens
aagggctgctgtagaagcagag

SEQ ID NO: 8150180 - DNA, 22 bp, Homo sapiens
aagggctgctgtagaagcagag

SEQ ID NO: 8150181 - DNA, 22 bp, Homo sapiens
aagggctgctgtagaagcagag

SEQ ID NO: 8150182 - DNA, 22 bp, Homo sapiens
aagggctgccagggggtgccag

SEQ ID NO: 8150183 - DNA, 22 bp, Homo sapiens
aagggctgccagggggtgccag

SEQ ID NO: 8150184 - DNA, 22 bp, Homo sapiens
aagggctgccagggggtgccag

SEQ ID NO: 8150185 - DNA, 22 bp, Homo sapiens
aagggctgccagggggtgccag

SEQ ID NO: 8150186 - DNA, 22 bp, Homo sapiens
aagggctgcatttgatgtgtca

SEQ ID NO: 8150187 - DNA, 22 bp, Homo sapiens
aagggctgcatttgatgtgtca

SEQ ID NO: 8150188 - DNA, 22 bp, Homo sapiens
aagggctgcatttgatgtgtca

SEQ ID NO: 8150189 - DNA, 22 bp, Homo sapiens
aagggctgcaatccaaaacact

SEQ ID NO: 8150190 - DNA, 22 bp, Homo sapiens
aagggcagggagtttgtgtcta

SEQ ID NO: 8150191 - DNA, 22 bp, Homo sapiens
aagggcaggtgggcatttctgg

SEQ ID NO: 8150192 - DNA, 22 bp, Homo sapiens
aacagtgcttcattcacacatt

SEQ ID NO: 8150193 - DNA, 22 bp, Homo sapiens
aacagtgctgttataaatgtac

SEQ ID NO: 8150194 - DNA, 22 bp, Homo sapiens
aacagtgtcaggattacagata

SEQ ID NO: 8150195 - DNA, 22 bp, Homo sapiens
aacagtggggaaaagagttggt

SEQ ID NO: 8150196 - DNA, 22 bp, Homo sapiens
aacagtgttctagggtgtggct

SEQ ID NO: 8150197 - DNA, 22 bp, Homo sapiens
aacagtgttttgctctttgccc

SEQ ID NO: 8150198 - DNA, 22 bp, Homo sapiens
aacagtgtttttcttcagcact

SEQ ID NO: 8150199 - DNA, 22 bp, Homo sapiens
aagtgcttaggtcaaaggacat

SEQ ID NO: 8150200 - DNA, 22 bp, Homo sapiens
aagtgcttcaactagtgtggtc

SEQ ID NO: 8150201 - DNA, 22 bp, Homo sapiens
aacagtgctgcattcattgagc

SEQ ID NO: 8150202 - DNA, 22 bp, Homo sapiens
aagtgctgggattataggcatg

SEQ ID NO: 8150203 - DNA, 22 bp, Homo sapiens
aagtgctgggattataggcatg

SEQ ID NO: 8150204 - DNA, 22 bp, Homo sapiens
aagtgctgtttctgatgaatgc

SEQ ID NO: 8150205 - DNA, 22 bp, Homo sapiens
aagtgctgtttctgatgaatgc

SEQ ID NO: 8150206 - DNA, 22 bp, Homo sapiens
aagtgctgggattacaggggtg

SEQ ID NO: 8150207 - DNA, 22 bp, Homo sapiens
aagtgctgggattacaggtgtc

SEQ ID NO: 8150208 - DNA, 22 bp, Homo sapiens
aagtgctgggattacaggtgtg

SEQ ID NO: 8150209 - DNA, 22 bp, Homo sapiens
aagtgctgggattacaggtgtc

SEQ ID NO: 8150210 - DNA, 22 bp, Homo sapiens
aagtgctgggattacaggtgtg

SEQ ID NO: 8150211 - DNA, 22 bp, Homo sapiens
aagtgctgagactacaggcatg

SEQ ID NO: 8150212 - DNA, 22 bp, Homo sapiens
aagtgctgggattacaggcatg

SEQ ID NO: 8150213 - DNA, 22 bp, Homo sapiens
aagtgctgaatgaagacacaaa

SEQ ID NO: 8150214 - DNA, 23 bp, Homo sapiens
aagtgctcagtggacagcattgc

SEQ ID NO: 8150215 - DNA, 22 bp, Homo sapiens
aagtgccatcatagcatggctg

SEQ ID NO: 8150216 - DNA, 22 bp, Homo sapiens
aagtgcattagatagaatgatg

SEQ ID NO: 8150217 - DNA, 23 bp, Homo sapiens
aagtgctatgtttataagagctg

SEQ ID NO: 8150218 - DNA, 22 bp, Homo sapiens
aagtgcctgggcaacatagcaa

SEQ ID NO: 8150219 - DNA, 22 bp, Homo sapiens
aagtgcctgacctagcctggag

SEQ ID NO: 8150220 - DNA, 22 bp, Homo sapiens
aagtgcctgggcaacatagcaa

SEQ ID NO: 8150221 - DNA, 22 bp, Homo sapiens
aagtgcatatttttgttgtaga

SEQ ID NO: 8150222 - DNA, 22 bp, Homo sapiens
aagtctttttgaatctataact

SEQ ID NO: 8150223 - DNA, 22 bp, Homo sapiens
aagtctttttgaatctataact

SEQ ID NO: 8150224 - DNA, 22 bp, Homo sapiens
aagtcttaggaaatagcaaaga

SEQ ID NO: 8150225 - DNA, 22 bp, Homo sapiens
aagtcttacagacaagctgaag

SEQ ID NO: 8150226 - DNA, 22 bp, Homo sapiens
aagtcttaggcattttatttct

SEQ ID NO: 8150227 - DNA, 22 bp, Homo sapiens
aagtcttacataaacaggaaat

SEQ ID NO: 8150228 - DNA, 18 bp, Homo sapiens
aagtcttggaatttccac

SEQ ID NO: 8150229 - DNA, 18 bp, Homo sapiens
aagtcttggaatttccac

SEQ ID NO: 8150230 - DNA, 22 bp, Homo sapiens
aagtcttaaccaaataaatgtt

SEQ ID NO: 8150231 - DNA, 22 bp, Homo sapiens
aagtctggtgctgtcctcaccc

SEQ ID NO: 8150232 - DNA, 21 bp, Homo sapiens
aagtctggttgattcctttgc

SEQ ID NO: 8150233 - DNA, 18 bp, Homo sapiens
aagtctggcagctttccc

SEQ ID NO: 8150234 - DNA, 22 bp, Homo sapiens
aagtctgcctaaccttcatgtt

SEQ ID NO: 8150235 - DNA, 22 bp, Homo sapiens
aagtctgggcctccttcccaga

SEQ ID NO: 8150236 - DNA, 22 bp, Homo sapiens
aaggcactgaacttaaattctg

SEQ ID NO: 8150237 - DNA, 22 bp, Homo sapiens
aaggcactgactgtgcagggga

SEQ ID NO: 8150238 - DNA, 22 bp, Homo sapiens
aaggcactgaaaaattgtgtgt

SEQ ID NO: 8150239 - DNA, 22 bp, Homo sapiens
aaggcactgaacttaaattctg

SEQ ID NO: 8150240 - DNA, 22 bp, Homo sapiens
aaggatcatagtaaacattgat

SEQ ID NO: 8150241 - DNA, 22 bp, Homo sapiens
aaggatcaagtggattttctta

SEQ ID NO: 8150242 - DNA, 17 bp, Homo sapiens
aaggatattatagttct

SEQ ID NO: 8150243 - DNA, 22 bp, Homo sapiens
aaggcactagcagaattagtga

SEQ ID NO: 8150244 - DNA, 22 bp, Homo sapiens
aaggagggttcccaggtcctgg

SEQ ID NO: 8150245 - DNA, 22 bp, Homo sapiens
aaggagggttcccaggtcctgg

SEQ ID NO: 8150246 - DNA, 22 bp, Homo sapiens
aaggagtctgggccattcagag

SEQ ID NO: 8150247 - DNA, 22 bp, Homo sapiens
aaggagtctcagctgggcctga

SEQ ID NO: 8150248 - DNA, 22 bp, Homo sapiens
aaggaggttatcccagtggact

SEQ ID NO: 8150249 - DNA, 22 bp, Homo sapiens
aaggaggttatcccagtggact

SEQ ID NO: 8150250 - DNA, 22 bp, Homo sapiens
aaggagtctgggccattcagag

SEQ ID NO: 8150251 - DNA, 22 bp, Homo sapiens
aaggagtctgggccattcagag

SEQ ID NO: 8150252 - DNA, 22 bp, Homo sapiens
aaggagtctgggccattcagag

SEQ ID NO: 8150253 - DNA, 22 bp, Homo sapiens
aaggagtctgggccattcagag

SEQ ID NO: 8150254 - DNA, 22 bp, Homo sapiens
aaggagtctgggccattcagag

SEQ ID NO: 8150255 - DNA, 22 bp, Homo sapiens
aaggatatgggtagtatgatgt

SEQ ID NO: 8150256 - DNA, 22 bp, Homo sapiens
aaggataagaatggaaggaaca

SEQ ID NO: 8150257 - DNA, 22 bp, Homo sapiens
aaggagtgcatgactcagagta

SEQ ID NO: 8150258 - DNA, 22 bp, Homo sapiens
aaggagtgatatatgggtgcta

SEQ ID NO: 8150259 - DNA, 22 bp, Homo sapiens
aaatggatctgtggaatacatt

SEQ ID NO: 8150260 - DNA, 22 bp, Homo sapiens
aaatggatctttttataatgca

SEQ ID NO: 8150261 - DNA, 22 bp, Homo sapiens
aaatggaagaagtgcaatactg

SEQ ID NO: 8150262 - DNA, 16 bp, Homo sapiens
aaggagggaagagaat

SEQ ID NO: 8150263 - DNA, 16 bp, Homo sapiens
aaggagggaagagaat

SEQ ID NO: 8150264 - DNA, 22 bp, Homo sapiens
aaggagggttcccaggtcctgg

SEQ ID NO: 8150265 - DNA, 22 bp, Homo sapiens
aaggagggttcccaggtcctgg

SEQ ID NO: 8150266 - DNA, 22 bp, Homo sapiens
aaggagggaaagcagtgcttct

SEQ ID NO: 8150267 - DNA, 22 bp, Homo sapiens
aaggagggaaagcagtgcttct

SEQ ID NO: 8150268 - DNA, 18 bp, Homo sapiens
aaatggcagaatggatag

SEQ ID NO: 8150269 - DNA, 22 bp, Homo sapiens
aaatggatgttgagttaaatgt

SEQ ID NO: 8150270 - DNA, 22 bp, Homo sapiens
aaatggcaatcagcagaagcta

SEQ ID NO: 8150271 - DNA, 22 bp, Homo sapiens
aaggccagtggataaaacctct

SEQ ID NO: 8150272 - DNA, 22 bp, Homo sapiens
aaggccagtggataaaacctct

SEQ ID NO: 8150273 - DNA, 22 bp, Homo sapiens
aaggccatgaccacttgctgtg

SEQ ID NO: 8150274 - DNA, 22 bp, Homo sapiens
aaggcccagcctggagcttgtt

SEQ ID NO: 8150275 - DNA, 22 bp, Homo sapiens
aaggcccagccaatgggggcag

SEQ ID NO: 8150276 - DNA, 22 bp, Homo sapiens
aaggcccacagaactgtctcca

SEQ ID NO: 8150277 - DNA, 22 bp, Homo sapiens
aaggcccacagaactgtctcca

SEQ ID NO: 8150278 - DNA, 22 bp, Homo sapiens
aaggccaggtccctgcagtgca

SEQ ID NO: 8150279 - DNA, 23 bp, Homo sapiens
aaggccagagagaggctagtgtc

SEQ ID NO: 8150280 - DNA, 23 bp, Homo sapiens
aaggccagagagaggctagtgtc

SEQ ID NO: 8150281 - DNA, 23 bp, Homo sapiens
aaggccagagagaggctagtgtc

SEQ ID NO: 8150282 - DNA, 23 bp, Homo sapiens
aaggccagagagaggctagtgtc

SEQ ID NO: 8150283 - DNA, 22 bp, Homo sapiens
aaggccaggtccctgcagtgca

SEQ ID NO: 8150284 - DNA, 22 bp, Homo sapiens
aaggccaggtccctgcagtgca

SEQ ID NO: 8150285 - DNA, 22 bp, Homo sapiens
aaggccaggtccctgcagtgca

SEQ ID NO: 8150286 - DNA, 22 bp, Homo sapiens
aaggccaggtccctgcagtgca

SEQ ID NO: 8150287 - DNA, 22 bp, Homo sapiens
aaggctgaattcaagggtaggc

SEQ ID NO: 8150288 - DNA, 22 bp, Homo sapiens
aaggctgaaagaccttgaacct

SEQ ID NO: 8150289 - DNA, 22 bp, Homo sapiens
aaggcccttccaccagtcctcg

SEQ ID NO: 8150290 - DNA, 22 bp, Homo sapiens
aaggcccttcggcttcctcagc

SEQ ID NO: 8150291 - DNA, 22 bp, Homo sapiens
aaggcccaggggctctagggca

SEQ ID NO: 8150292 - DNA, 22 bp, Homo sapiens
aaggccctaatagagcacatat

SEQ ID NO: 8150293 - DNA, 22 bp, Homo sapiens
aaggcccagcgtgacctcagtg

SEQ ID NO: 8150294 - DNA, 22 bp, Homo sapiens
aaggcccagcctggagcttgtt

SEQ ID NO: 8150295 - DNA, 22 bp, Homo sapiens
aaggcccagcgtgacctcagtg

SEQ ID NO: 8150296 - DNA, 22 bp, Homo sapiens
aaggcccagggattggaggtca

SEQ ID NO: 8150297 - DNA, 22 bp, Homo sapiens
aaggcccagggattggaggtca

SEQ ID NO: 8150298 - DNA, 22 bp, Homo sapiens
aaggcccaggctgccctgggca

SEQ ID NO: 8150299 - DNA, 22 bp, Homo sapiens
aaggcccaggctgccctgggca

SEQ ID NO: 8150300 - DNA, 22 bp, Homo sapiens
aagggcaggagaagacggatat

SEQ ID NO: 8150301 - DNA, 22 bp, Homo sapiens
aagggcaggagaagacggatat

SEQ ID NO: 8150302 - DNA, 22 bp, Homo sapiens
aagggcaggagaagacggatat

SEQ ID NO: 8150303 - DNA, 22 bp, Homo sapiens
aagggcaggaaaagatggatgt

SEQ ID NO: 8150304 - DNA, 22 bp, Homo sapiens
aagggcagggagtttgtgtcta

SEQ ID NO: 8150305 - DNA, 22 bp, Homo sapiens
aagggcaggcagagatcatata

SEQ ID NO: 8150306 - DNA, 22 bp, Homo sapiens
aagggcaggcacccaccctcac

SEQ ID NO: 8150307 - DNA, 22 bp, Homo sapiens
aagggcaggcacccaccctcac

SEQ ID NO: 8150308 - DNA, 22 bp, Homo sapiens
aagggcaggcacccaccctcac

SEQ ID NO: 8150309 - DNA, 22 bp, Homo sapiens
aagggaggccagaggttttgca

SEQ ID NO: 8150310 - DNA, 22 bp, Homo sapiens
aaggctgagagtcacagtccta

SEQ ID NO: 8150311 - DNA, 21 bp, Homo sapiens
aaggctgagacaactcaggag

SEQ ID NO: 8150312 - DNA, 22 bp, Homo sapiens
aaggctgagacagcacaggtcc

SEQ ID NO: 8150313 - DNA, 22 bp, Homo sapiens
aaggctgagacagcacaggtcc

SEQ ID NO: 8150314 - DNA, 22 bp, Homo sapiens
aaggctgagagtcacagtccta

SEQ ID NO: 8150315 - DNA, 22 bp, Homo sapiens
aaggctgagacagcacaggtcc

SEQ ID NO: 8150316 - DNA, 22 bp, Homo sapiens
aaggctgaattcaagggtaggc

SEQ ID NO: 8150317 - DNA, 22 bp, Homo sapiens
aaggctgaccagtttacacttt

SEQ ID NO: 8150318 - DNA, 22 bp, Homo sapiens
aaggctgaccagtttacacttt

SEQ ID NO: 8150319 - DNA, 22 bp, Homo sapiens
aaggctgaccagtttacacttt

SEQ ID NO: 8150320 - DNA, 22 bp, Homo sapiens
aaggctgacgtttgtgtttatt

SEQ ID NO: 8150321 - DNA, 22 bp, Homo sapiens
aaggctgactcaacagggggcc

SEQ ID NO: 8150322 - DNA, 22 bp, Homo sapiens
aaggctgacgtttgtgtttatt

SEQ ID NO: 8150323 - DNA, 22 bp, Homo sapiens
tcagggacagggtgctgctgcg

SEQ ID NO: 8150324 - DNA, 22 bp, Homo sapiens
tcagggaccaccactcacccag

SEQ ID NO: 8150325 - DNA, 22 bp, Homo sapiens
tcagggaatgtgatacaggaag

SEQ ID NO: 8150326 - DNA, 22 bp, Homo sapiens
tcagggaatgatgcacacagtt

SEQ ID NO: 8150327 - DNA, 21 bp, Homo sapiens
tcaggtggcagagtgtttatg

SEQ ID NO: 8150328 - DNA, 22 bp, Homo sapiens
tcaggtggccaaatgggagcgc

SEQ ID NO: 8150329 - DNA, 22 bp, Homo sapiens
tcagggacccctctgagtggag

SEQ ID NO: 8150330 - DNA, 22 bp, Homo sapiens
tcaggtggccaaatgggagcgc

SEQ ID NO: 8150331 - DNA, 22 bp, Homo sapiens
tcaggtggccaaatgggagcgc

SEQ ID NO: 8150332 - DNA, 21 bp, Homo sapiens
tcaggtggcagagtgtttatg

SEQ ID NO: 8150333 - DNA, 22 bp, Homo sapiens
tcaggtggccaaatgggagcgc

SEQ ID NO: 8150334 - DNA, 22 bp, Homo sapiens
tcaggtggagacctccttggcc

SEQ ID NO: 8150335 - DNA, 22 bp, Homo sapiens
tcaggtggctggttgctggcta

SEQ ID NO: 8150336 - DNA, 22 bp, Homo sapiens
tcaggtgtattgatgtctgtga

SEQ ID NO: 8150337 - DNA, 22 bp, Homo sapiens
tcaggtgtcaagcagggagctg

SEQ ID NO: 8150338 - DNA, 22 bp, Homo sapiens
tcaggtgtattgatgtctgtga

SEQ ID NO: 8150339 - DNA, 22 bp, Homo sapiens
tcagggaagacttcttagagga

SEQ ID NO: 8150340 - DNA, 22 bp, Homo sapiens
tcagggaagacttcttagagga

SEQ ID NO: 8150341 - DNA, 17 bp, Homo sapiens
tcagggaatgaggttgt

SEQ ID NO: 8150342 - DNA, 17 bp, Homo sapiens
tcagggaatgaggttgt

SEQ ID NO: 8150343 - DNA, 17 bp, Homo sapiens
tcagggaatgaggttgt

SEQ ID NO: 8150344 - DNA, 22 bp, Homo sapiens
tcagggaatcagactctgcagc

SEQ ID NO: 8150345 - DNA, 22 bp, Homo sapiens
tcagggaataagtagatgagtg

SEQ ID NO: 8150346 - DNA, 22 bp, Homo sapiens
tcagggaataagtagatgagtg

SEQ ID NO: 8150347 - DNA, 17 bp, Homo sapiens
tcagtctctgtcctgga

SEQ ID NO: 8150348 - DNA, 22 bp, Homo sapiens
tcagtcttccctccagtgcaac

SEQ ID NO: 8150349 - DNA, 23 bp, Homo sapiens
tcagtcttccctgtcagtaatag

SEQ ID NO: 8150350 - DNA, 23 bp, Homo sapiens
tcagtcttggcttctgattttcc

SEQ ID NO: 8150351 - DNA, 22 bp, Homo sapiens
tcagtcttgaacagccccctgt

SEQ ID NO: 8150352 - DNA, 22 bp, Homo sapiens
tcagtcttgcttctcttgggtc

SEQ ID NO: 8150353 - DNA, 22 bp, Homo sapiens
tcagtcttctaaagggatgcaa

SEQ ID NO: 8150354 - DNA, 22 bp, Homo sapiens
tcagtcttctagcaaatccagg

SEQ ID NO: 8150355 - DNA, 22 bp, Homo sapiens
tcaggtttttctcaaatcaggt

SEQ ID NO: 8150356 - DNA, 22 bp, Homo sapiens
tcaggttctggtgagggccctt

SEQ ID NO: 8150357 - DNA, 22 bp, Homo sapiens
tcagtctcctttcctctagaca

SEQ ID NO: 8150358 - DNA, 17 bp, Homo sapiens
tcagtctctgtcctgga

SEQ ID NO: 8150359 - DNA, 17 bp, Homo sapiens
tcagtctctgtcctgga

SEQ ID NO: 8150360 - DNA, 22 bp, Homo sapiens
tcagtctctggggcttctgttt

SEQ ID NO: 8150361 - DNA, 22 bp, Homo sapiens
tcagtctctggctgtgtctgac

SEQ ID NO: 8150362 - DNA, 18 bp, Homo sapiens
tcaggtgttttctgtata

SEQ ID NO: 8150363 - DNA, 22 bp, Homo sapiens
tcaggtgtttctggagaagtaa

SEQ ID NO: 8150364 - DNA, 22 bp, Homo sapiens
tcaggtgtttaaggatagtgat

SEQ ID NO: 8150365 - DNA, 22 bp, Homo sapiens
tcaggtgtttctggagaagtaa

SEQ ID NO: 8150366 - DNA, 22 bp, Homo sapiens
tcaggtgtttaaggatagtgat

SEQ ID NO: 8150367 - DNA, 22 bp, Homo sapiens
tcaggttcagactagtcccagt

SEQ ID NO: 8150368 - DNA, 22 bp, Homo sapiens
tcaggttcagactagtcccagt

SEQ ID NO: 8150369 - DNA, 18 bp, Homo sapiens
tcaggtgttttctgtata

SEQ ID NO: 8150370 - DNA, 18 bp, Homo sapiens
tcaggtgttttctgtata

SEQ ID NO: 8150371 - DNA, 22 bp, Homo sapiens
tcaggtgtttctggagaagtaa

SEQ ID NO: 8150372 - DNA, 22 bp, Homo sapiens
tcaggtgttagaagaaatttca

SEQ ID NO: 8150373 - DNA, 22 bp, Homo sapiens
tcaggtgtgttgtattttacca

SEQ ID NO: 8150374 - DNA, 22 bp, Homo sapiens
tcaggtgtgttgtattttacca

SEQ ID NO: 8150375 - DNA, 22 bp, Homo sapiens
tcaggtgtgttgtattttacca

SEQ ID NO: 8150376 - DNA, 22 bp, Homo sapiens
tcaggtgttctccactcagttt

SEQ ID NO: 8150377 - DNA, 22 bp, Homo sapiens
tcaggtgttagaagaaatttca

SEQ ID NO: 8150378 - DNA, 22 bp, Homo sapiens
tcaggtgttagaagaaatttca

SEQ ID NO: 8150379 - DNA, 22 bp, Homo sapiens
tcaggtgtttaaggatagtgat

SEQ ID NO: 8150380 - DNA, 22 bp, Homo sapiens
tcaggtgttctccactcagttt

SEQ ID NO: 8150381 - DNA, 22 bp, Homo sapiens
tcaggtgttctccactcagttt

SEQ ID NO: 8150382 - DNA, 22 bp, Homo sapiens
tcaggtgtgtggtggaaggcag

SEQ ID NO: 8150383 - DNA, 22 bp, Homo sapiens
tcaggtgtgtggtggaaggcag

SEQ ID NO: 8150384 - DNA, 22 bp, Homo sapiens
tcaggtgtgtggtggaaggcag

SEQ ID NO: 8150385 - DNA, 22 bp, Homo sapiens
tcaggtgtgtggctctggacca

SEQ ID NO: 8150386 - DNA, 22 bp, Homo sapiens
tcaggtgtgtggctctggacca

SEQ ID NO: 8150387 - DNA, 22 bp, Homo sapiens
tcaggtgtgtggctctggacca

SEQ ID NO: 8150388 - DNA, 22 bp, Homo sapiens
tcaggtgtggtcaccacagggt

SEQ ID NO: 8150389 - DNA, 22 bp, Homo sapiens
tcaggtgtggtcaccacagggt

SEQ ID NO: 8150390 - DNA, 22 bp, Homo sapiens
tcaggtgtggtcaccacagggt

SEQ ID NO: 8150391 - DNA, 22 bp, Homo sapiens
tcaggtgtggaccgaggtcaga

SEQ ID NO: 8150392 - DNA, 22 bp, Homo sapiens
tcaggtgtgggcagagaaacca

SEQ ID NO: 8150393 - DNA, 22 bp, Homo sapiens
tcaggtgtgggcagagaaacca

SEQ ID NO: 8150394 - DNA, 22 bp, Homo sapiens
tcaggtgtctgcctctttgagt

SEQ ID NO: 8150395 - DNA, 22 bp, Homo sapiens
tcaggtgtctatctaacctggt

SEQ ID NO: 8150396 - DNA, 22 bp, Homo sapiens
tcaggtgtctatctaacctggt

SEQ ID NO: 8150397 - DNA, 22 bp, Homo sapiens
tcaggtgtctatctaacctggt

SEQ ID NO: 8150398 - DNA, 22 bp, Homo sapiens
tcaggtgtcaagcagggagctg

SEQ ID NO: 8150399 - DNA, 22 bp, Homo sapiens
tcaggtgtcaagcagggagctg

SEQ ID NO: 8150400 - DNA, 22 bp, Homo sapiens
tcaggtgtgaactatttggaaa

SEQ ID NO: 8150401 - DNA, 22 bp, Homo sapiens
tcaggtgtcttgtgggatttta

SEQ ID NO: 8150402 - DNA, 22 bp, Homo sapiens
tcaggtgtcttgtgggatttta

SEQ ID NO: 8150403 - DNA, 22 bp, Homo sapiens
tcaggtgtcttgtgggatttta

SEQ ID NO: 8150404 - DNA, 22 bp, Homo sapiens
tcaggtgtctgcctctttgagt

SEQ ID NO: 8150405 - DNA, 22 bp, Homo sapiens
tcaggtgtctgcctctttgagt

SEQ ID NO: 8150406 - DNA, 23 bp, Homo sapiens
tcaggtgtgcggactgctgagtc

SEQ ID NO: 8150407 - DNA, 16 bp, Homo sapiens
tcaggtgtgacttttt

SEQ ID NO: 8150408 - DNA, 16 bp, Homo sapiens
tcaggtgtgacttttt

SEQ ID NO: 8150409 - DNA, 16 bp, Homo sapiens
tcaggtgtgacttttt

SEQ ID NO: 8150410 - DNA, 22 bp, Homo sapiens
tcaggtgtgaactatttggaaa

SEQ ID NO: 8150411 - DNA, 22 bp, Homo sapiens
tcaggtgtgaactatttggaaa

SEQ ID NO: 8150412 - DNA, 22 bp, Homo sapiens
tcaggtgtggaccgaggtcaga

SEQ ID NO: 8150413 - DNA, 23 bp, Homo sapiens
tcaggtgtgcggactgctgagtc

SEQ ID NO: 8150414 - DNA, 22 bp, Homo sapiens
tcaggtgtgggcagagaaacca

SEQ ID NO: 8150415 - DNA, 22 bp, Homo sapiens
tcaggtgtggaccgaggtcaga

SEQ ID NO: 8150416 - DNA, 23 bp, Homo sapiens
tcaggtgtgcggactgctgagtc

SEQ ID NO: 8150417 - DNA, 22 bp, Homo sapiens
tcagtgcaaaaaatgggctaga

SEQ ID NO: 8150418 - DNA, 22 bp, Homo sapiens
tcagtgcacagagatttttgtt

SEQ ID NO: 8150419 - DNA, 22 bp, Homo sapiens
tcagtgcacaatgacggtggct

SEQ ID NO: 8150420 - DNA, 21 bp, Homo sapiens
tcagtgcaattctatggggaa

SEQ ID NO: 8150421 - DNA, 22 bp, Homo sapiens
tcagtgcaatcaaggtatgttt

SEQ ID NO: 8150422 - DNA, 22 bp, Homo sapiens
tcagtgcagcggcagcagctct

SEQ ID NO: 8150423 - DNA, 22 bp, Homo sapiens
tcagtgcagaatagtgatgcat

SEQ ID NO: 8150424 - DNA, 22 bp, Homo sapiens
tcagtgcagaatagtgatgcat

SEQ ID NO: 8150425 - DNA, 22 bp, Homo sapiens
tcagtgcagactgtaagttgga

SEQ ID NO: 8150426 - DNA, 22 bp, Homo sapiens
tcagtgatttctggggtgaggg

SEQ ID NO: 8150427 - DNA, 22 bp, Homo sapiens
tcagtgatttctggggtgaggg

SEQ ID NO: 8150428 - DNA, 22 bp, Homo sapiens
tcagtgattggtggactgccta

SEQ ID NO: 8150429 - DNA, 22 bp, Homo sapiens
tcagtgatgaggtggctttcaa

SEQ ID NO: 8150430 - DNA, 23 bp, Homo sapiens
tcagtgatgttgaacctagcagt

SEQ ID NO: 8150431 - DNA, 22 bp, Homo sapiens
tcagtgactgggtattaaatca

SEQ ID NO: 8150432 - DNA, 22 bp, Homo sapiens
tcagtctttgcttatgacaata

SEQ ID NO: 8150433 - DNA, 22 bp, Homo sapiens
tcagtctttaaaagctcaggaa

SEQ ID NO: 8150434 - DNA, 22 bp, Homo sapiens
tcagtgtctcatatgaggtttc

SEQ ID NO: 8150435 - DNA, 22 bp, Homo sapiens
tcagtgtctcatatgaggtttc

SEQ ID NO: 8150436 - DNA, 22 bp, Homo sapiens
tcagtgtctatagataaggttt

SEQ ID NO: 8150437 - DNA, 22 bp, Homo sapiens
tcagtgtctatagataaggttt

SEQ ID NO: 8150438 - DNA, 22 bp, Homo sapiens
tcagtgtgttactttctcctat

SEQ ID NO: 8150439 - DNA, 22 bp, Homo sapiens
tcagtgttacattatatagaac

SEQ ID NO: 8150440 - DNA, 22 bp, Homo sapiens
tcagtgttagacaagtttggaa

SEQ ID NO: 8150441 - DNA, 22 bp, Homo sapiens
tcagtgttaatcagtggtacct

SEQ ID NO: 8150442 - DNA, 22 bp, Homo sapiens
tcagtgtccggagcctgagtgc

SEQ ID NO: 8150443 - DNA, 22 bp, Homo sapiens
tcagtgtcctgtgcggtgcagc

SEQ ID NO: 8150444 - DNA, 22 bp, Homo sapiens
tcagtgtccttcgttcttgttg

SEQ ID NO: 8150445 - DNA, 23 bp, Homo sapiens
tcagtgtctagttgtggaattga

SEQ ID NO: 8150446 - DNA, 22 bp, Homo sapiens
tcagtgtctagggacagtaatc

SEQ ID NO: 8150447 - DNA, 22 bp, Homo sapiens
tcagtgtccataaataaagttt

SEQ ID NO: 8150448 - DNA, 22 bp, Homo sapiens
tcagtgtccaaaaagaggcaag

SEQ ID NO: 8150449 - DNA, 22 bp, Homo sapiens
tcagtgtccaaaaagaggcaag

SEQ ID NO: 8150450 - DNA, 22 bp, Homo sapiens
tcagtgtccggagcctgagtgc

SEQ ID NO: 8150451 - DNA, 22 bp, Homo sapiens
tcagtgtccggagcctgagtgc

SEQ ID NO: 8150452 - DNA, 19 bp, Homo sapiens
tcagtgtccctgttaatat

SEQ ID NO: 8150453 - DNA, 22 bp, Homo sapiens
tcagtgtcccgtctcttaactc

SEQ ID NO: 8150454 - DNA, 22 bp, Homo sapiens
tcagtgtcacaggatgctatgc

SEQ ID NO: 8150455 - DNA, 22 bp, Homo sapiens
tcagtgtcacaggatgctatgc

SEQ ID NO: 8150456 - DNA, 16 bp, Homo sapiens
tcagtgtcagctcctg

SEQ ID NO: 8150457 - DNA, 22 bp, Homo sapiens
tcagtgtcagtcttttagatat

SEQ ID NO: 8150458 - DNA, 20 bp, Homo sapiens
tcagtgtcagtagccactac

SEQ ID NO: 8150459 - DNA, 22 bp, Homo sapiens
tcagtgtcatatcaagaagatg

SEQ ID NO: 8150460 - DNA, 22 bp, Homo sapiens
tcagtgtcatatcaagaagatg

SEQ ID NO: 8150461 - DNA, 22 bp, Homo sapiens
tcagtgtcatcacttaatataa

SEQ ID NO: 8150462 - DNA, 22 bp, Homo sapiens
tcagtgtcatcacttaatataa

SEQ ID NO: 8150463 - DNA, 22 bp, Homo sapiens
tcagtgtaagttatgtagatgt

SEQ ID NO: 8150464 - DNA, 22 bp, Homo sapiens
tcagtggttggatgatggtcgc

SEQ ID NO: 8150465 - DNA, 22 bp, Homo sapiens
tcagtgtagcagacttgtagcc

SEQ ID NO: 8150466 - DNA, 22 bp, Homo sapiens
tcagtgcagggtgggagagaga

SEQ ID NO: 8150467 - DNA, 22 bp, Homo sapiens
tcagtgcagggtgggagagaga

SEQ ID NO: 8150468 - DNA, 22 bp, Homo sapiens
tcattatttgctttagttatgt

SEQ ID NO: 8150469 - DNA, 22 bp, Homo sapiens
tcattatcctagtatcttgaat

SEQ ID NO: 8150470 - DNA, 22 bp, Homo sapiens
tcattacagagatataatctac

SEQ ID NO: 8150471 - DNA, 22 bp, Homo sapiens
tcattacagtgtttatatgtct

SEQ ID NO: 8150472 - DNA, 22 bp, Homo sapiens
tcattacatcttggccaaaact

SEQ ID NO: 8150473 - DNA, 22 bp, Homo sapiens
tcattcataaaaattagttggc

SEQ ID NO: 8150474 - DNA, 22 bp, Homo sapiens
tcattcatactcttttctatta

SEQ ID NO: 8150475 - DNA, 22 bp, Homo sapiens
tcattcactttgaaataaacga

SEQ ID NO: 8150476 - DNA, 23 bp, Homo sapiens
tcattcaaggctggtatctttca

SEQ ID NO: 8150477 - DNA, 22 bp, Homo sapiens
tcattcaagatttcaatagatt

SEQ ID NO: 8150478 - DNA, 23 bp, Homo sapiens
tcattcaaggctggtatctttca

SEQ ID NO: 8150479 - DNA, 22 bp, Homo sapiens
tcattcaatgtaagcatatata

SEQ ID NO: 8150480 - DNA, 22 bp, Homo sapiens
tcattattttggactggagtgt

SEQ ID NO: 8150481 - DNA, 18 bp, Homo sapiens
tcattcaaagtctactga

SEQ ID NO: 8150482 - DNA, 22 bp, Homo sapiens
tcatggcagtttaataagtggt

SEQ ID NO: 8150483 - DNA, 20 bp, Homo sapiens
tcatggcagccacccacagg

SEQ ID NO: 8150484 - DNA, 22 bp, Homo sapiens
tcatggccaaagtcaggagtgt

SEQ ID NO: 8150485 - DNA, 22 bp, Homo sapiens
tcatggcattgttaagggtttt

SEQ ID NO: 8150486 - DNA, 21 bp, Homo sapiens
tcatggccagcaagtggcaga

SEQ ID NO: 8150487 - DNA, 22 bp, Homo sapiens
tcatggcacatgccctccaggg

SEQ ID NO: 8150488 - DNA, 22 bp, Homo sapiens
tcatggattaaattattaagtt

SEQ ID NO: 8150489 - DNA, 22 bp, Homo sapiens
tcatggagactttgagcctgtt

SEQ ID NO: 8150490 - DNA, 22 bp, Homo sapiens
tcatggagactttgagcctgtt

SEQ ID NO: 8150491 - DNA, 22 bp, Homo sapiens
tcatggaagaaaggtttgtttc

SEQ ID NO: 8150492 - DNA, 23 bp, Homo sapiens
tcatggaactgggcaatcttgaa

SEQ ID NO: 8150493 - DNA, 20 bp, Homo sapiens
tcatggaatctcactctagt

SEQ ID NO: 8150494 - DNA, 20 bp, Homo sapiens
tcatggaatctcactctagt

SEQ ID NO: 8150495 - DNA, 22 bp, Homo sapiens
tcatggaatagagcagtggcaa

SEQ ID NO: 8150496 - DNA, 22 bp, Homo sapiens
tcatggaaggagtggccaagtg

SEQ ID NO: 8150497 - DNA, 22 bp, Homo sapiens
tcatgctgtgaactgtatacat

SEQ ID NO: 8150498 - DNA, 22 bp, Homo sapiens
tcatgctgtgaactgtatacat

SEQ ID NO: 8150499 - DNA, 22 bp, Homo sapiens
tcatgcttaaaagacacttgag

SEQ ID NO: 8150500 - DNA, 22 bp, Homo sapiens
tcatgcttaaaagacacttgag

SEQ ID NO: 8150501 - DNA, 22 bp, Homo sapiens
tcatgcttattgcatatttgga

SEQ ID NO: 8150502 - DNA, 22 bp, Homo sapiens
tcatgcttagtttaatgctctg

SEQ ID NO: 8150503 - DNA, 22 bp, Homo sapiens
tcatggaaacagcaatgctaat

SEQ ID NO: 8150504 - DNA, 22 bp, Homo sapiens
tcatgctttggttgctgtcctt

SEQ ID NO: 8150505 - DNA, 22 bp, Homo sapiens
tcatgctttgggttagaaacct

SEQ ID NO: 8150506 - DNA, 22 bp, Homo sapiens
tcatgctttggttgctgtcctt

SEQ ID NO: 8150507 - DNA, 22 bp, Homo sapiens
tcatgctttgttaatgtggcac

SEQ ID NO: 8150508 - DNA, 22 bp, Homo sapiens
tcatatttaggcctttaattca

SEQ ID NO: 8150509 - DNA, 22 bp, Homo sapiens
tcatatttaggcctttaattca

SEQ ID NO: 8150510 - DNA, 22 bp, Homo sapiens
tcatatttaggcctttaattca

SEQ ID NO: 8150511 - DNA, 22 bp, Homo sapiens
tcatatttaggcctttaattca

SEQ ID NO: 8150512 - DNA, 22 bp, Homo sapiens
tcatattagggtaatgataaga

SEQ ID NO: 8150513 - DNA, 22 bp, Homo sapiens
tcatattagggtaatgataaga

SEQ ID NO: 8150514 - DNA, 22 bp, Homo sapiens
tcatattagggtaatgataaga

SEQ ID NO: 8150515 - DNA, 20 bp, Homo sapiens
tcatatgtggttgtatacaa

SEQ ID NO: 8150516 - DNA, 22 bp, Homo sapiens
tcatattagggtaatgataaga

SEQ ID NO: 8150517 - DNA, 21 bp, Homo sapiens
tcatatttctcttgctattgt

SEQ ID NO: 8150518 - DNA, 21 bp, Homo sapiens
tcatatttctcttgctattgt

SEQ ID NO: 8150519 - DNA, 21 bp, Homo sapiens
tcatatttctcttgctattgt

SEQ ID NO: 8150520 - DNA, 22 bp, Homo sapiens
tcatatttcaaaatggctggag

SEQ ID NO: 8150521 - DNA, 22 bp, Homo sapiens
tcatatttcaaaatggctggag

SEQ ID NO: 8150522 - DNA, 22 bp, Homo sapiens
tcatatttatatgttggcacag

SEQ ID NO: 8150523 - DNA, 22 bp, Homo sapiens
tcatatttaggcctttaattca

SEQ ID NO: 8150524 - DNA, 22 bp, Homo sapiens
tcatatttagttcacgctcaat

SEQ ID NO: 8150525 - DNA, 22 bp, Homo sapiens
tcatatttatatgttggcacag

SEQ ID NO: 8150526 - DNA, 22 bp, Homo sapiens
tcatgcattggaatcttcctag

SEQ ID NO: 8150527 - DNA, 22 bp, Homo sapiens
tcatgcattgcagcacattcag

SEQ ID NO: 8150528 - DNA, 22 bp, Homo sapiens
tcatgcattaacacttcatttt

SEQ ID NO: 8150529 - DNA, 21 bp, Homo sapiens
tcatgcatgagtttatatata

SEQ ID NO: 8150530 - DNA, 22 bp, Homo sapiens
tcatgccacttacaaaataatg

SEQ ID NO: 8150531 - DNA, 22 bp, Homo sapiens
tcatgctagttaagaacacaat

SEQ ID NO: 8150532 - DNA, 23 bp, Homo sapiens
tcatgcccaggctccagatgtca

SEQ ID NO: 8150533 - DNA, 22 bp, Homo sapiens
tcatgcctgattatgttactca

SEQ ID NO: 8150534 - DNA, 22 bp, Homo sapiens
tcatgcctgattatgttactca

SEQ ID NO: 8150535 - DNA, 22 bp, Homo sapiens
tcatgctgcaggcccaggcagg

SEQ ID NO: 8150536 - DNA, 22 bp, Homo sapiens
tcatgctgaggggattttaaat

SEQ ID NO: 8150537 - DNA, 22 bp, Homo sapiens
tcatgctgaggatgctgtgaag

SEQ ID NO: 8150538 - DNA, 22 bp, Homo sapiens
tcatgctcatcattagagtgac

SEQ ID NO: 8150539 - DNA, 22 bp, Homo sapiens
tcatatattttggcagtgatca

SEQ ID NO: 8150540 - DNA, 22 bp, Homo sapiens
tcatatattttggcagtgatca

SEQ ID NO: 8150541 - DNA, 22 bp, Homo sapiens
tcatatatttagttgtgcaaca

SEQ ID NO: 8150542 - DNA, 21 bp, Homo sapiens
tcatatattccagctgcagct

SEQ ID NO: 8150543 - DNA, 22 bp, Homo sapiens
tcatatatttagttgtgcaaca

SEQ ID NO: 8150544 - DNA, 22 bp, Homo sapiens
tcatatatctgcaaagcagtat

SEQ ID NO: 8150545 - DNA, 22 bp, Homo sapiens
tcatatctttgtctaccaggaa

SEQ ID NO: 8150546 - DNA, 22 bp, Homo sapiens
tcatattaacaatgaaactcag

SEQ ID NO: 8150547 - DNA, 20 bp, Homo sapiens
tcatatgtggttgtatacaa

SEQ ID NO: 8150548 - DNA, 22 bp, Homo sapiens
tcatatgtcactcatgggcata

SEQ ID NO: 8150549 - DNA, 22 bp, Homo sapiens
tcatataccagagagtttatat

SEQ ID NO: 8150550 - DNA, 22 bp, Homo sapiens
tcatatacctgcatgtgcatgt

SEQ ID NO: 8150551 - DNA, 22 bp, Homo sapiens
tcatatacctgcatgtgcatgt

SEQ ID NO: 8150552 - DNA, 22 bp, Homo sapiens
tcatatactgccttgtagatta

SEQ ID NO: 8150553 - DNA, 22 bp, Homo sapiens
tcatatactgccttgtagatta

SEQ ID NO: 8150554 - DNA, 22 bp, Homo sapiens
tcatatagagggcatacaaatg

SEQ ID NO: 8150555 - DNA, 22 bp, Homo sapiens
tcatatatctgcaaagcagtat

SEQ ID NO: 8150556 - DNA, 22 bp, Homo sapiens
tcatatatcgaatgggcatcat

SEQ ID NO: 8150557 - DNA, 22 bp, Homo sapiens
tcatataagtttaaaactatct

SEQ ID NO: 8150558 - DNA, 22 bp, Homo sapiens
tcatataagtttaaaactatct

SEQ ID NO: 8150559 - DNA, 22 bp, Homo sapiens
tcatataagtttaaaactatct

SEQ ID NO: 8150560 - DNA, 22 bp, Homo sapiens
tcatagctaagctccagagtgc

SEQ ID NO: 8150561 - DNA, 22 bp, Homo sapiens
tcagtgttcgctcagggactcc

SEQ ID NO: 8150562 - DNA, 22 bp, Homo sapiens
tcagtgttcgctcagggactcc

SEQ ID NO: 8150563 - DNA, 22 bp, Homo sapiens
tcagtgttagacaagtttggaa

SEQ ID NO: 8150564 - DNA, 22 bp, Homo sapiens
tcagtgttattagatgaggttt

SEQ ID NO: 8150565 - DNA, 22 bp, Homo sapiens
tcagtgttattagatgaggttt

SEQ ID NO: 8150566 - DNA, 22 bp, Homo sapiens
tcagtgttcagcggtgtgtgca

SEQ ID NO: 8150567 - DNA, 16 bp, Homo sapiens
tcagtgttccagaata

SEQ ID NO: 8150568 - DNA, 22 bp, Homo sapiens
tcagtgttcagggaccaggtcc

SEQ ID NO: 8150569 - DNA, 22 bp, Homo sapiens
tcaggccaaggtagacatgact

SEQ ID NO: 8150570 - DNA, 22 bp, Homo sapiens
tcaggccaaggtagacatgact

SEQ ID NO: 8150571 - DNA, 19 bp, Homo sapiens
tcaggcagttattcacaaa

SEQ ID NO: 8150572 - DNA, 19 bp, Homo sapiens
tcaggcagttattcacaaa

SEQ ID NO: 8150573 - DNA, 20 bp, Homo sapiens
tcaggcagtggggaaaggca

SEQ ID NO: 8150574 - DNA, 20 bp, Homo sapiens
tcaggcagtggggaaaggca

SEQ ID NO: 8150575 - DNA, 19 bp, Homo sapiens
tcaggcagttattcacaaa

SEQ ID NO: 8150576 - DNA, 22 bp, Homo sapiens
tcaggcagtggtaaatgagtta

SEQ ID NO: 8150577 - DNA, 19 bp, Homo sapiens
tcaggcagttattcacaaa

SEQ ID NO: 8150578 - DNA, 22 bp, Homo sapiens
tcaggccacttcacaggtgatt

SEQ ID NO: 8150579 - DNA, 22 bp, Homo sapiens
tcaggccacggctcactgagac

SEQ ID NO: 8150580 - DNA, 22 bp, Homo sapiens
tcaggccacttcacaggtgatt

SEQ ID NO: 8150581 - DNA, 22 bp, Homo sapiens
tcaggcctgcaaatgaatggta

SEQ ID NO: 8150582 - DNA, 22 bp, Homo sapiens
tcaggcctgcaaatgaatggta

SEQ ID NO: 8150583 - DNA, 22 bp, Homo sapiens
tcaggcctgcaggcttcctgga

SEQ ID NO: 8150584 - DNA, 22 bp, Homo sapiens
tcaggcctgcaggcttcctgga

SEQ ID NO: 8150585 - DNA, 22 bp, Homo sapiens
tcaggcctgccctgaaagcaca

SEQ ID NO: 8150586 - DNA, 22 bp, Homo sapiens
tcaggcctgctgtatgatggat

SEQ ID NO: 8150587 - DNA, 22 bp, Homo sapiens
tcaggcctgccctgaaagcaca

SEQ ID NO: 8150588 - DNA, 22 bp, Homo sapiens
tcaggcctgcagtgccaaccca

SEQ ID NO: 8150589 - DNA, 22 bp, Homo sapiens
tcaggcctgcagtgccaaccca

SEQ ID NO: 8150590 - DNA, 18 bp, Homo sapiens
tcaggagtttgtggatgg

SEQ ID NO: 8150591 - DNA, 22 bp, Homo sapiens
tcaggatccatagactcccaaa

SEQ ID NO: 8150592 - DNA, 22 bp, Homo sapiens
tcaggatgaagtcagaggggtc

SEQ ID NO: 8150593 - DNA, 22 bp, Homo sapiens
tcaggatgaagtcagaggggtc

SEQ ID NO: 8150594 - DNA, 22 bp, Homo sapiens
tcaggatgacttcaaggaggaa

SEQ ID NO: 8150595 - DNA, 22 bp, Homo sapiens
tcaggatgacttcaaggaggaa

SEQ ID NO: 8150596 - DNA, 22 bp, Homo sapiens
tcaggagtgataccatttgtca

SEQ ID NO: 8150597 - DNA, 22 bp, Homo sapiens
tcaggagtgataccatttgtca

SEQ ID NO: 8150598 - DNA, 21 bp, Homo sapiens
tcaggagtggagagaattggt

SEQ ID NO: 8150599 - DNA, 22 bp, Homo sapiens
tcaggagtgccagtaccttttg

SEQ ID NO: 8150600 - DNA, 22 bp, Homo sapiens
tcaggagtgcagcagtttggag

SEQ ID NO: 8150601 - DNA, 19 bp, Homo sapiens
tcaggagttagttgtgctc

SEQ ID NO: 8150602 - DNA, 22 bp, Homo sapiens
tcaggagttgaaggggatcctg

SEQ ID NO: 8150603 - DNA, 22 bp, Homo sapiens
tcaggagtttggcctacagagg

SEQ ID NO: 8150604 - DNA, 22 bp, Homo sapiens
tcaggagtttggcctacagagg

SEQ ID NO: 8150605 - DNA, 22 bp, Homo sapiens
tcaggagtttcaggtgtaagtg

SEQ ID NO: 8150606 - DNA, 22 bp, Homo sapiens
tcaggcagtctgactccggagg

SEQ ID NO: 8150607 - DNA, 21 bp, Homo sapiens
tcaggcagtgcaaatacatgg

SEQ ID NO: 8150608 - DNA, 21 bp, Homo sapiens
tcaggcagtgcaaatacatgg

SEQ ID NO: 8150609 - DNA, 21 bp, Homo sapiens
tcaggcagtgcaaatacatgg

SEQ ID NO: 8150610 - DNA, 22 bp, Homo sapiens
tcaggatgttaatatagcatta

SEQ ID NO: 8150611 - DNA, 17 bp, Homo sapiens
tcaggatgtagcagtag

SEQ ID NO: 8150612 - DNA, 22 bp, Homo sapiens
tcaggatgtccaaaatccagcc

SEQ ID NO: 8150613 - DNA, 22 bp, Homo sapiens
tcaggatggcttctgcatcaaa

SEQ ID NO: 8150614 - DNA, 22 bp, Homo sapiens
tcaggatgacttcaaggaggaa

SEQ ID NO: 8150615 - DNA, 22 bp, Homo sapiens
tcaggatgagtcatcaagctgc

SEQ ID NO: 8150616 - DNA, 22 bp, Homo sapiens
tcaggatggagtctatccagtg

SEQ ID NO: 8150617 - DNA, 22 bp, Homo sapiens
tcaggctggaatgcagtggggc

SEQ ID NO: 8150618 - DNA, 22 bp, Homo sapiens
tcaggctggaatgcagtggggc

SEQ ID NO: 8150619 - DNA, 22 bp, Homo sapiens
tcaggctggaatgcagtggggc

SEQ ID NO: 8150620 - DNA, 22 bp, Homo sapiens
tcaggctggagtgcagtggcgc

SEQ ID NO: 8150621 - DNA, 22 bp, Homo sapiens
tcaggctggagtgcagtggcgc

SEQ ID NO: 8150622 - DNA, 22 bp, Homo sapiens
tcaggctggagtgcagtggcgc

SEQ ID NO: 8150623 - DNA, 22 bp, Homo sapiens
tcaggctggagtgcagtggcgc

SEQ ID NO: 8150624 - DNA, 22 bp, Homo sapiens
tcaggctggagtgcagtggcgc

SEQ ID NO: 8150625 - DNA, 22 bp, Homo sapiens
tcaggctggaatgcagtggggc

SEQ ID NO: 8150626 - DNA, 22 bp, Homo sapiens
tcaggctgctttcatgcttaga

SEQ ID NO: 8150627 - DNA, 22 bp, Homo sapiens
tcaggctgctttcatgcttaga

SEQ ID NO: 8150628 - DNA, 22 bp, Homo sapiens
tcaggctgctgtactgtgaatg

SEQ ID NO: 8150629 - DNA, 22 bp, Homo sapiens
tcaggctgctgtactgtgaatg

SEQ ID NO: 8150630 - DNA, 22 bp, Homo sapiens
tcaggctgctgtactgtgaatg

SEQ ID NO: 8150631 - DNA, 22 bp, Homo sapiens
tcaggctgctgtactgtgaatg

SEQ ID NO: 8150632 - DNA, 18 bp, Homo sapiens
tcaggctggaagtttgcc

SEQ ID NO: 8150633 - DNA, 18 bp, Homo sapiens
tcaggctggaagtttgcc

SEQ ID NO: 8150634 - DNA, 22 bp, Homo sapiens
tcaggctgctttcatgcttaga

SEQ ID NO: 8150635 - DNA, 22 bp, Homo sapiens
tcaggctgctttcatgcttaga

SEQ ID NO: 8150636 - DNA, 22 bp, Homo sapiens
tcaggctgctggccagcaggct

SEQ ID NO: 8150637 - DNA, 21 bp, Homo sapiens
tcaggctgatgtcgatgttag

SEQ ID NO: 8150638 - DNA, 22 bp, Homo sapiens
tcaggctgataggaggaactga

SEQ ID NO: 8150639 - DNA, 22 bp, Homo sapiens
tcaggctgataggaggaactga

SEQ ID NO: 8150640 - DNA, 22 bp, Homo sapiens
tcaggctgataggaggaactga

SEQ ID NO: 8150641 - DNA, 22 bp, Homo sapiens
tcaggctgctggccagcaggct

SEQ ID NO: 8150642 - DNA, 22 bp, Homo sapiens
tcaggctgctggccagcaggct

SEQ ID NO: 8150643 - DNA, 22 bp, Homo sapiens
tcaggctgctggccagcaggct

SEQ ID NO: 8150644 - DNA, 22 bp, Homo sapiens
tcaggctgctggccagcaggct

SEQ ID NO: 8150645 - DNA, 22 bp, Homo sapiens
tcaggctgaggtcatctgcatc

SEQ ID NO: 8150646 - DNA, 22 bp, Homo sapiens
tcaggctgaggtcatctgcatc

SEQ ID NO: 8150647 - DNA, 22 bp, Homo sapiens
tcaggcctgtgctggaggagat

SEQ ID NO: 8150648 - DNA, 22 bp, Homo sapiens
tcaggcctgtgctggaggagat

SEQ ID NO: 8150649 - DNA, 16 bp, Homo sapiens
tcaggcctggacgagc

SEQ ID NO: 8150650 - DNA, 22 bp, Homo sapiens
tcaggcctggagaaaggaatga

SEQ ID NO: 8150651 - DNA, 17 bp, Homo sapiens
tcaggctgggtgcagtg

SEQ ID NO: 8150652 - DNA, 22 bp, Homo sapiens
tcaggctttttctcaacctctt

SEQ ID NO: 8150653 - DNA, 22 bp, Homo sapiens
tcaggctttttctcaacctctt

SEQ ID NO: 8150654 - DNA, 22 bp, Homo sapiens
tcaggctggggtgctaaggtgt

SEQ ID NO: 8150655 - DNA, 22 bp, Homo sapiens
tcaggctggggtgctaaggtgt

SEQ ID NO: 8150656 - DNA, 22 bp, Homo sapiens
tcaggctgggctcctctcccca

SEQ ID NO: 8150657 - DNA, 22 bp, Homo sapiens
tcaggctggggtgctaaggtgt

SEQ ID NO: 8150658 - DNA, 22 bp, Homo sapiens
tcaggctgggctcctctcccca

SEQ ID NO: 8150659 - DNA, 22 bp, Homo sapiens
tcaggctgggctcctctcccca

SEQ ID NO: 8150660 - DNA, 22 bp, Homo sapiens
tcaggctgggctcctctcccca

SEQ ID NO: 8150661 - DNA, 22 bp, Homo sapiens
tcaggctgggagacaatcactg

SEQ ID NO: 8150662 - DNA, 22 bp, Homo sapiens
tcaggctgggagacaatcactg

SEQ ID NO: 8150663 - DNA, 22 bp, Homo sapiens
tcaggctgggagacaatcactg

SEQ ID NO: 8150664 - DNA, 22 bp, Homo sapiens
tcaggctggagtgcagtggcgc

SEQ ID NO: 8150665 - DNA, 22 bp, Homo sapiens
tcaggctggagtgcagtggcgc

SEQ ID NO: 8150666 - DNA, 18 bp, Homo sapiens
tcaggctgggcctccttc

SEQ ID NO: 8150667 - DNA, 22 bp, Homo sapiens
tcaggctgggctcctctcccca

SEQ ID NO: 8150668 - DNA, 18 bp, Homo sapiens
tcaggctgggcctccttc

SEQ ID NO: 8150669 - DNA, 18 bp, Homo sapiens
tcaggctgggcctccttc

SEQ ID NO: 8150670 - DNA, 18 bp, Homo sapiens
tcaggctgggcctccttc

SEQ ID NO: 8150671 - DNA, 18 bp, Homo sapiens
tcaggctgggcctccttc

SEQ ID NO: 8150672 - DNA, 18 bp, Homo sapiens
tcaggctgggcctccttc

SEQ ID NO: 8150673 - DNA, 22 bp, Homo sapiens
tcaggctgggagacaatcactg

SEQ ID NO: 8150674 - DNA, 22 bp, Homo sapiens
tcagggaaatttccatgtgttt

SEQ ID NO: 8150675 - DNA, 22 bp, Homo sapiens
tcagggaacaatgttatggctt

SEQ ID NO: 8150676 - DNA, 22 bp, Homo sapiens
tcagggaaatagcagggctgaa

SEQ ID NO: 8150677 - DNA, 22 bp, Homo sapiens
tcagggaaatagcagggctgaa

SEQ ID NO: 8150678 - DNA, 22 bp, Homo sapiens
tcagggaaattcaagggagatt

SEQ ID NO: 8150679 - DNA, 22 bp, Homo sapiens
tcagggaaatttccatgtgttt

SEQ ID NO: 8150680 - DNA, 22 bp, Homo sapiens
tcagggaaattcaagggagatt

SEQ ID NO: 8150681 - DNA, 22 bp, Homo sapiens
tcagggaaattcaagggagatt

SEQ ID NO: 8150682 - DNA, 22 bp, Homo sapiens
tcagggaaaggggagagtcatt

SEQ ID NO: 8150683 - DNA, 22 bp, Homo sapiens
tcagggaaatagcagggctgaa

SEQ ID NO: 8150684 - DNA, 22 bp, Homo sapiens
tcagggaaacctaaggaagcca

SEQ ID NO: 8150685 - DNA, 22 bp, Homo sapiens
tcagggaaaagtcacactgggt

SEQ ID NO: 8150686 - DNA, 22 bp, Homo sapiens
tcagggaaaagtcacactgggt

SEQ ID NO: 8150687 - DNA, 22 bp, Homo sapiens
tcagctccacagctcctctgcc

SEQ ID NO: 8150688 - DNA, 22 bp, Homo sapiens
tcagctcatctgagtgtcagcg

SEQ ID NO: 8150689 - DNA, 22 bp, Homo sapiens
tcagctcactctgcttcctggg

SEQ ID NO: 8150690 - DNA, 22 bp, Homo sapiens
tcagccttgtggccctgctcca

SEQ ID NO: 8150691 - DNA, 23 bp, Homo sapiens
tcagcggattggctcagacaggc

SEQ ID NO: 8150692 - DNA, 22 bp, Homo sapiens
tcagccttctgaggacctggga

SEQ ID NO: 8150693 - DNA, 18 bp, Homo sapiens
tcagcctgttgtctgcct

SEQ ID NO: 8150694 - DNA, 22 bp, Homo sapiens
tcagcctggcaggatggcctgg

SEQ ID NO: 8150695 - DNA, 22 bp, Homo sapiens
tcagcctggtgattcctctgtc

SEQ ID NO: 8150696 - DNA, 22 bp, Homo sapiens
tcagcctggtgattcctctgtc

SEQ ID NO: 8150697 - DNA, 22 bp, Homo sapiens
tcagctcctcatgcaggggata

SEQ ID NO: 8150698 - DNA, 22 bp, Homo sapiens
tcagctcctcatgcaggggata

SEQ ID NO: 8150699 - DNA, 22 bp, Homo sapiens
tcagctcctcatgcaggggata

SEQ ID NO: 8150700 - DNA, 22 bp, Homo sapiens
tcagctcctcagagcctcagtt

SEQ ID NO: 8150701 - DNA, 22 bp, Homo sapiens
tcagctccagagttgcacagtg

SEQ ID NO: 8150702 - DNA, 22 bp, Homo sapiens
tcagctccagagttgcacagtg

SEQ ID NO: 8150703 - DNA, 22 bp, Homo sapiens
tcagctccagagttgcacagtg

SEQ ID NO: 8150704 - DNA, 22 bp, Homo sapiens
tcagctcctcagagcctcagtt

SEQ ID NO: 8150705 - DNA, 22 bp, Homo sapiens
tcagctcctcagagcctcagtt

SEQ ID NO: 8150706 - DNA, 22 bp, Homo sapiens
tcagctcctatactttgtcctg

SEQ ID NO: 8150707 - DNA, 22 bp, Homo sapiens
tcagctctctgggctcgaacct

SEQ ID NO: 8150708 - DNA, 22 bp, Homo sapiens
tcagctctgcaaggtcacctcc

SEQ ID NO: 8150709 - DNA, 22 bp, Homo sapiens
tcagctctcacagatctcaacc

SEQ ID NO: 8150710 - DNA, 22 bp, Homo sapiens
tcagctctacacacacctgtgt

SEQ ID NO: 8150711 - DNA, 22 bp, Homo sapiens
tcagctctacctgggagctgtc

SEQ ID NO: 8150712 - DNA, 22 bp, Homo sapiens
tcagctctacacacacctgtgt

SEQ ID NO: 8150713 - DNA, 22 bp, Homo sapiens
tcagcactttgaagcagaagga

SEQ ID NO: 8150714 - DNA, 21 bp, Homo sapiens
tcagcagcttttgcagtccct

SEQ ID NO: 8150715 - DNA, 22 bp, Homo sapiens
tcagcagaagtatagaggccat

SEQ ID NO: 8150716 - DNA, 22 bp, Homo sapiens
tcagcagaagtatagaggccat

SEQ ID NO: 8150717 - DNA, 22 bp, Homo sapiens
tcagcaggcacaccaaaaactg

SEQ ID NO: 8150718 - DNA, 21 bp, Homo sapiens
tcagcagcttttgcagtccct

SEQ ID NO: 8150719 - DNA, 21 bp, Homo sapiens
tcagcagcttttgcagtccct

SEQ ID NO: 8150720 - DNA, 21 bp, Homo sapiens
tcagcagcttttgcagtccct

SEQ ID NO: 8150721 - DNA, 21 bp, Homo sapiens
tcagcagcttttgcagtccct

SEQ ID NO: 8150722 - DNA, 22 bp, Homo sapiens
tcagcaggcacaccaaaaactg

SEQ ID NO: 8150723 - DNA, 21 bp, Homo sapiens
tcagcaggcaccagaaggctg

SEQ ID NO: 8150724 - DNA, 21 bp, Homo sapiens
tcagcaggcaccagaaggctg

SEQ ID NO: 8150725 - DNA, 22 bp, Homo sapiens
tcagcaggcacggacaggctgc

SEQ ID NO: 8150726 - DNA, 22 bp, Homo sapiens
tcagcaggcacggacaggctgc

SEQ ID NO: 8150727 - DNA, 22 bp, Homo sapiens
tcagcaggcaccggaagtgttt

SEQ ID NO: 8150728 - DNA, 22 bp, Homo sapiens
tcagcaggcaccggaagtgttt

SEQ ID NO: 8150729 - DNA, 22 bp, Homo sapiens
tcagcaggcaccggaagtgttt

SEQ ID NO: 8150730 - DNA, 22 bp, Homo sapiens
tcagcaggcacggacaggctgc

SEQ ID NO: 8150731 - DNA, 22 bp, Homo sapiens
tcagcaggcagaaatctgcaga

SEQ ID NO: 8150732 - DNA, 22 bp, Homo sapiens
tcagcaggcagaaatctgcaga

SEQ ID NO: 8150733 - DNA, 22 bp, Homo sapiens
tcagcctgctccaagtgctgcc

SEQ ID NO: 8150734 - DNA, 22 bp, Homo sapiens
tcagcctgctccaagtgctgcc

SEQ ID NO: 8150735 - DNA, 22 bp, Homo sapiens
tcagcctgctccaagtgctgcc

SEQ ID NO: 8150736 - DNA, 22 bp, Homo sapiens
tcaggagtcctgcctgcagcct

SEQ ID NO: 8150737 - DNA, 22 bp, Homo sapiens
tcaggagtactggtgtctacag

SEQ ID NO: 8150738 - DNA, 22 bp, Homo sapiens
tcaggagtaagttataagtatt

SEQ ID NO: 8150739 - DNA, 22 bp, Homo sapiens
tcaggagtcctgcctgcagcct

SEQ ID NO: 8150740 - DNA, 22 bp, Homo sapiens
tcaggagtctgtgcagttccac

SEQ ID NO: 8150741 - DNA, 22 bp, Homo sapiens
tcaggaggtttggattcagtta

SEQ ID NO: 8150742 - DNA, 22 bp, Homo sapiens
tcaggaggtttggattcagtta

SEQ ID NO: 8150743 - DNA, 22 bp, Homo sapiens
tcaggagtaaagaagacttgac

SEQ ID NO: 8150744 - DNA, 22 bp, Homo sapiens
tcaggagtaagggtaacccaga

SEQ ID NO: 8150745 - DNA, 22 bp, Homo sapiens
tcaggagtaaagacagagttcc

SEQ ID NO: 8150746 - DNA, 22 bp, Homo sapiens
tcaggaggttgaccacggggca

SEQ ID NO: 8150747 - DNA, 22 bp, Homo sapiens
tcaggaagggctcagtctgtgc

SEQ ID NO: 8150748 - DNA, 22 bp, Homo sapiens
tcaggaggtgtaggtcaagtga

SEQ ID NO: 8150749 - DNA, 22 bp, Homo sapiens
tcaggaagggctcagtctgtgc

SEQ ID NO: 8150750 - DNA, 17 bp, Homo sapiens
tcaggaggtgtttctag

SEQ ID NO: 8150751 - DNA, 22 bp, Homo sapiens
tcaggaagctgaattacaaaaa

SEQ ID NO: 8150752 - DNA, 22 bp, Homo sapiens
tcaggaagctgaattacaaaaa

SEQ ID NO: 8150753 - DNA, 22 bp, Homo sapiens
tcaggaagctgctctgggtggt

SEQ ID NO: 8150754 - DNA, 22 bp, Homo sapiens
tcaggaagctgctctgggtggt

SEQ ID NO: 8150755 - DNA, 22 bp, Homo sapiens
tcaggaagctgctctgggtggt

SEQ ID NO: 8150756 - DNA, 22 bp, Homo sapiens
tcaggaagctgctctgggtggt

SEQ ID NO: 8150757 - DNA, 22 bp, Homo sapiens
tcaggaaggagctggcctgcca

SEQ ID NO: 8150758 - DNA, 22 bp, Homo sapiens
tcaggaaggagctggcctgcca

SEQ ID NO: 8150759 - DNA, 22 bp, Homo sapiens
tcaggaaggagctggcctgcca

SEQ ID NO: 8150760 - DNA, 22 bp, Homo sapiens
tcaggaaggcaaattgcatgat

SEQ ID NO: 8150761 - DNA, 22 bp, Homo sapiens
tcaggaaggcaaattgcatgat

SEQ ID NO: 8150762 - DNA, 22 bp, Homo sapiens
tcaggaaggcacttggtgtgtt

SEQ ID NO: 8150763 - DNA, 22 bp, Homo sapiens
tcaggaaggcacttggtgtgtt

SEQ ID NO: 8150764 - DNA, 22 bp, Homo sapiens
tcaggaaggcaaattgcatgat

SEQ ID NO: 8150765 - DNA, 22 bp, Homo sapiens
tcaggaaggcacttggtgtgtt

SEQ ID NO: 8150766 - DNA, 22 bp, Homo sapiens
tcaggaaggcgccccatcagga

SEQ ID NO: 8150767 - DNA, 22 bp, Homo sapiens
tcaggaaggcgccccatcagga

SEQ ID NO: 8150768 - DNA, 22 bp, Homo sapiens
tcaggaaggcgccccatcagga

SEQ ID NO: 8150769 - DNA, 22 bp, Homo sapiens
tcaggaaggcgccccatcagga

SEQ ID NO: 8150770 - DNA, 22 bp, Homo sapiens
tcaggaaggcttcacacgagtg

SEQ ID NO: 8150771 - DNA, 22 bp, Homo sapiens
tcaggaaggcttcacacgagtg

SEQ ID NO: 8150772 - DNA, 22 bp, Homo sapiens
tcagctctgcaaggtcacctcc

SEQ ID NO: 8150773 - DNA, 22 bp, Homo sapiens
tcagctctgcactccactgtgg

SEQ ID NO: 8150774 - DNA, 22 bp, Homo sapiens
tcaggaagaaattctgtatctt

SEQ ID NO: 8150775 - DNA, 22 bp, Homo sapiens
tcaggaagaaattctgtatctt

SEQ ID NO: 8150776 - DNA, 22 bp, Homo sapiens
tcaggaagaaagaagggagtgt

SEQ ID NO: 8150777 - DNA, 22 bp, Homo sapiens
tcaggaagaaagaagggagtgt

SEQ ID NO: 8150778 - DNA, 22 bp, Homo sapiens
tcaggaagacaatctttggctc

SEQ ID NO: 8150779 - DNA, 22 bp, Homo sapiens
tcaggaagacaatctttggctc

SEQ ID NO: 8150780 - DNA, 22 bp, Homo sapiens
tcaggaagaagacggggcagga

SEQ ID NO: 8150781 - DNA, 22 bp, Homo sapiens
tcaggaagacaatctttggctc

SEQ ID NO: 8150782 - DNA, 22 bp, Homo sapiens
tcaggaagaagacggggcagga

SEQ ID NO: 8150783 - DNA, 22 bp, Homo sapiens
tcaggaagaagacggggcagga

SEQ ID NO: 8150784 - DNA, 22 bp, Homo sapiens
tcaggaagaagacggggcagga

SEQ ID NO: 8150785 - DNA, 22 bp, Homo sapiens
tcaggaagctactgccagcagc

SEQ ID NO: 8150786 - DNA, 22 bp, Homo sapiens
tcaggaagctactgccagcagc

SEQ ID NO: 8150787 - DNA, 22 bp, Homo sapiens
tcaggaagctactgccagcagc

SEQ ID NO: 8150788 - DNA, 22 bp, Homo sapiens
tcaggaagctcttgctgattct

SEQ ID NO: 8150789 - DNA, 22 bp, Homo sapiens
tcaggaagctcttgctgattct

SEQ ID NO: 8150790 - DNA, 22 bp, Homo sapiens
tcaggaagccactccacagaga

SEQ ID NO: 8150791 - DNA, 22 bp, Homo sapiens
tcaggaagccactccacagaga

SEQ ID NO: 8150792 - DNA, 22 bp, Homo sapiens
tcaggaagcatcctgaggtgtc

SEQ ID NO: 8150793 - DNA, 22 bp, Homo sapiens
tcaggaagccggttaaatagat

SEQ ID NO: 8150794 - DNA, 22 bp, Homo sapiens
tcaggaagccggttaaatagat

SEQ ID NO: 8150795 - DNA, 22 bp, Homo sapiens
tcaggaagattagtttcctacc

SEQ ID NO: 8150796 - DNA, 22 bp, Homo sapiens
tcaggaagattagtttcctacc

SEQ ID NO: 8150797 - DNA, 22 bp, Homo sapiens
tcaggaagcatcctgaggtgtc

SEQ ID NO: 8150798 - DNA, 22 bp, Homo sapiens
tcaggaagcatcctgaggtgtc

SEQ ID NO: 8150799 - DNA, 21 bp, Homo sapiens
tcaggaagagccagttcatgc

SEQ ID NO: 8150800 - DNA, 21 bp, Homo sapiens
tcaggaagagccagttcatgc

SEQ ID NO: 8150801 - DNA, 21 bp, Homo sapiens
tcaggaagagcttctcccact

SEQ ID NO: 8150802 - DNA, 21 bp, Homo sapiens
tcaggaagagcttctcccact

SEQ ID NO: 8150803 - DNA, 22 bp, Homo sapiens
tcactgttaataaatagcaaag

SEQ ID NO: 8150804 - DNA, 22 bp, Homo sapiens
tcactgtgtcctttctgcgtag

SEQ ID NO: 8150805 - DNA, 22 bp, Homo sapiens
tcactgtgtcctttctgcgtag

SEQ ID NO: 8150806 - DNA, 19 bp, Homo sapiens
tcacttctgttagcatgga

SEQ ID NO: 8150807 - DNA, 22 bp, Homo sapiens
tcactgttagagcaaacgtatg

SEQ ID NO: 8150808 - DNA, 22 bp, Homo sapiens
tcactttgatgacattgtagct

SEQ ID NO: 8150809 - DNA, 22 bp, Homo sapiens
tcactttgatgacattgtagct

SEQ ID NO: 8150810 - DNA, 23 bp, Homo sapiens
tcactttgatgtaattgaaaagc

SEQ ID NO: 8150811 - DNA, 23 bp, Homo sapiens
tcactttgatgtaattgaaaagc

SEQ ID NO: 8150812 - DNA, 22 bp, Homo sapiens
tcactttggattatgtaatttc

SEQ ID NO: 8150813 - DNA, 22 bp, Homo sapiens
tcactttggattatgtaatttc

SEQ ID NO: 8150814 - DNA, 22 bp, Homo sapiens
tcactttaatgatttgtagaat

SEQ ID NO: 8150815 - DNA, 22 bp, Homo sapiens
tcactttaatgatttgtagaat

SEQ ID NO: 8150816 - DNA, 22 bp, Homo sapiens
tcactttaaactactgtggtct

SEQ ID NO: 8150817 - DNA, 22 bp, Homo sapiens
tcactttactttgttaatctgg

SEQ ID NO: 8150818 - DNA, 22 bp, Homo sapiens
tcactttagaggaaacattgag

SEQ ID NO: 8150819 - DNA, 22 bp, Homo sapiens
tcactgaaggaagacactgtca

SEQ ID NO: 8150820 - DNA, 21 bp, Homo sapiens
tcactgaagcctaagatgttt

SEQ ID NO: 8150821 - DNA, 21 bp, Homo sapiens
tcactgaagcctaagatgttt

SEQ ID NO: 8150822 - DNA, 21 bp, Homo sapiens
tcactgaagcctaagatgttt

SEQ ID NO: 8150823 - DNA, 21 bp, Homo sapiens
tcactgaagcctaagatgttt

SEQ ID NO: 8150824 - DNA, 22 bp, Homo sapiens
tcactgaagactgggctctaaa

SEQ ID NO: 8150825 - DNA, 22 bp, Homo sapiens
tcactgaagtcttcaagtagga

SEQ ID NO: 8150826 - DNA, 22 bp, Homo sapiens
tcactgaatacttgtctcatcc

SEQ ID NO: 8150827 - DNA, 22 bp, Homo sapiens
tcactgaatgcagatacgtgac

SEQ ID NO: 8150828 - DNA, 21 bp, Homo sapiens
tcactgaggttaaatagggtt

SEQ ID NO: 8150829 - DNA, 19 bp, Homo sapiens
tcactgaggctttgttggc

SEQ ID NO: 8150830 - DNA, 22 bp, Homo sapiens
tcactgatgcttatgaaagtgt

SEQ ID NO: 8150831 - DNA, 22 bp, Homo sapiens
tcactgtgctctctagataggc

SEQ ID NO: 8150832 - DNA, 18 bp, Homo sapiens
tcactgagccgcctctct

SEQ ID NO: 8150833 - DNA, 22 bp, Homo sapiens
tcactgagaagagtaacagcag

SEQ ID NO: 8150834 - DNA, 22 bp, Homo sapiens
tcactgaatttcaagctagtgg

SEQ ID NO: 8150835 - DNA, 22 bp, Homo sapiens
tcactgaatttcaagctagtgg

SEQ ID NO: 8150836 - DNA, 22 bp, Homo sapiens
tcactgaaagtaattctagtga

SEQ ID NO: 8150837 - DNA, 22 bp, Homo sapiens
tcactgaaagaatgacattatg

SEQ ID NO: 8150838 - DNA, 22 bp, Homo sapiens
tcactgaaccagggatctctag

SEQ ID NO: 8150839 - DNA, 22 bp, Homo sapiens
tcactgaactctcatagagaaa

SEQ ID NO: 8150840 - DNA, 22 bp, Homo sapiens
tcactgaactctcatagagaaa

SEQ ID NO: 8150841 - DNA, 22 bp, Homo sapiens
tcactgaaccagggatctctag

SEQ ID NO: 8150842 - DNA, 22 bp, Homo sapiens
tcactgaaaaccatacttcttt

SEQ ID NO: 8150843 - DNA, 22 bp, Homo sapiens
tcactctgttttactcactgtt

SEQ ID NO: 8150844 - DNA, 22 bp, Homo sapiens
tcactctgttttactcactgtt

SEQ ID NO: 8150845 - DNA, 22 bp, Homo sapiens
tcactctgtggcccaggcagtg

SEQ ID NO: 8150846 - DNA, 22 bp, Homo sapiens
tcactctgggccctactgggct

SEQ ID NO: 8150847 - DNA, 22 bp, Homo sapiens
tcactctggtccatccgagagc

SEQ ID NO: 8150848 - DNA, 22 bp, Homo sapiens
tcactctgtcccccattgagat

SEQ ID NO: 8150849 - DNA, 22 bp, Homo sapiens
tcactctgggccagcgcaggta

SEQ ID NO: 8150850 - DNA, 22 bp, Homo sapiens
tcactctggcctctgcagcagt

SEQ ID NO: 8150851 - DNA, 22 bp, Homo sapiens
tcactctggcctctgcagcagt

SEQ ID NO: 8150852 - DNA, 22 bp, Homo sapiens
tcactctgttagaggaaagtgc

SEQ ID NO: 8150853 - DNA, 22 bp, Homo sapiens
tcactctgttagaggaaagtgc

SEQ ID NO: 8150854 - DNA, 22 bp, Homo sapiens
tcactctgtgtttgaactcaag

SEQ ID NO: 8150855 - DNA, 22 bp, Homo sapiens
tcactctgtggcccaggcagtg

SEQ ID NO: 8150856 - DNA, 22 bp, Homo sapiens
tcactctgtgtttccctgggac

SEQ ID NO: 8150857 - DNA, 22 bp, Homo sapiens
tcactctgtgtttccctgggac

SEQ ID NO: 8150858 - DNA, 22 bp, Homo sapiens
tcactctgcaggaaggagcagc

SEQ ID NO: 8150859 - DNA, 22 bp, Homo sapiens
tcactctgcctccatattacta

SEQ ID NO: 8150860 - DNA, 22 bp, Homo sapiens
tcactctgcctccatattacta

SEQ ID NO: 8150861 - DNA, 22 bp, Homo sapiens
tcactctggcctctgcagcagt

SEQ ID NO: 8150862 - DNA, 22 bp, Homo sapiens
tcactctggagtccgctaccag

SEQ ID NO: 8150863 - DNA, 15 bp, Homo sapiens
tcactctggaaggga

SEQ ID NO: 8150864 - DNA, 22 bp, Homo sapiens
tcactctgctgcccgagggctg

SEQ ID NO: 8150865 - DNA, 22 bp, Homo sapiens
tcactctgagaggtcactggaa

SEQ ID NO: 8150866 - DNA, 22 bp, Homo sapiens
tcactctgagaggtcactggaa

SEQ ID NO: 8150867 - DNA, 22 bp, Homo sapiens
tcactctgatagataagctaac

SEQ ID NO: 8150868 - DNA, 22 bp, Homo sapiens
tcactctgatagataagctaac

SEQ ID NO: 8150869 - DNA, 20 bp, Homo sapiens
tcactctgatgctagggtgg

SEQ ID NO: 8150870 - DNA, 20 bp, Homo sapiens
tcactctgatgctagggtgg

SEQ ID NO: 8150871 - DNA, 21 bp, Homo sapiens
tcactctgattaggtgtctct

SEQ ID NO: 8150872 - DNA, 22 bp, Homo sapiens
tcactagcattgttgaaggact

SEQ ID NO: 8150873 - DNA, 22 bp, Homo sapiens
tcactacacaatatatttcaga

SEQ ID NO: 8150874 - DNA, 22 bp, Homo sapiens
tcactacaacctccgcctcctg

SEQ ID NO: 8150875 - DNA, 22 bp, Homo sapiens
tcactacaacctccgcctcctg

SEQ ID NO: 8150876 - DNA, 22 bp, Homo sapiens
tcactctgacttggcctccaac

SEQ ID NO: 8150877 - DNA, 22 bp, Homo sapiens
tcacccaggctggagtgcagtg

SEQ ID NO: 8150878 - DNA, 22 bp, Homo sapiens
tcacccaggctggactgcagtg

SEQ ID NO: 8150879 - DNA, 22 bp, Homo sapiens
tcacccaggctggactgcagtg

SEQ ID NO: 8150880 - DNA, 22 bp, Homo sapiens
tcacattttttactggacttaa

SEQ ID NO: 8150881 - DNA, 22 bp, Homo sapiens
tcacattttttactggacttaa

SEQ ID NO: 8150882 - DNA, 22 bp, Homo sapiens
tcaccaggctagagtgcagtgg

SEQ ID NO: 8150883 - DNA, 22 bp, Homo sapiens
tcacccagcagctgcttctgct

SEQ ID NO: 8150884 - DNA, 22 bp, Homo sapiens
tcaccaggcaactatgtactcc

SEQ ID NO: 8150885 - DNA, 22 bp, Homo sapiens
tcaccaggattgggctgtaggc

SEQ ID NO: 8150886 - DNA, 22 bp, Homo sapiens
tcaccaggattgggctgtaggc

SEQ ID NO: 8150887 - DNA, 22 bp, Homo sapiens
tcaccaggattcctatcagtag

SEQ ID NO: 8150888 - DNA, 22 bp, Homo sapiens
tcaccaggactgagaccttggg

SEQ ID NO: 8150889 - DNA, 22 bp, Homo sapiens
tcacagtagttgttctctgttt

SEQ ID NO: 8150890 - DNA, 22 bp, Homo sapiens
tcacagtataacctcatatagg

SEQ ID NO: 8150891 - DNA, 22 bp, Homo sapiens
tcacattttcaaaagctggtgc

SEQ ID NO: 8150892 - DNA, 22 bp, Homo sapiens
tcacattttatctgagattgac

SEQ ID NO: 8150893 - DNA, 22 bp, Homo sapiens
tcacattttcatattctctgag

SEQ ID NO: 8150894 - DNA, 22 bp, Homo sapiens
tcacattttccttggtatctgt

SEQ ID NO: 8150895 - DNA, 22 bp, Homo sapiens
tcacattttctactactgtacg

SEQ ID NO: 8150896 - DNA, 22 bp, Homo sapiens
tcacattttctactactgtacg

SEQ ID NO: 8150897 - DNA, 22 bp, Homo sapiens
tcacattttccttggtatctgt

SEQ ID NO: 8150898 - DNA, 22 bp, Homo sapiens
tcacattttgttcaaggctagt

SEQ ID NO: 8150899 - DNA, 22 bp, Homo sapiens
tcacattttcttaggaaactta

SEQ ID NO: 8150900 - DNA, 22 bp, Homo sapiens
tcacattttctactactgtacg

SEQ ID NO: 8150901 - DNA, 22 bp, Homo sapiens
tcacattttcttaggaaactta

SEQ ID NO: 8150902 - DNA, 22 bp, Homo sapiens
tcagaggaacactgtttcatgc

SEQ ID NO: 8150903 - DNA, 22 bp, Homo sapiens
tcagaggaaaggtcagatggct

SEQ ID NO: 8150904 - DNA, 22 bp, Homo sapiens
tcagaggaaaggtcagatggct

SEQ ID NO: 8150905 - DNA, 22 bp, Homo sapiens
tcagaggaaagggaacatagtc

SEQ ID NO: 8150906 - DNA, 22 bp, Homo sapiens
tcagaggaaagggaacatagtc

SEQ ID NO: 8150907 - DNA, 22 bp, Homo sapiens
tcagaggaaaggtcagatggct

SEQ ID NO: 8150908 - DNA, 22 bp, Homo sapiens
tcagcaagcagggggatgttca

SEQ ID NO: 8150909 - DNA, 22 bp, Homo sapiens
tcagcaagcagggggatgttca

SEQ ID NO: 8150910 - DNA, 22 bp, Homo sapiens
tcagcaaggcagaagggaggta

SEQ ID NO: 8150911 - DNA, 22 bp, Homo sapiens
tcagcaaggctgcattctcatc

SEQ ID NO: 8150912 - DNA, 22 bp, Homo sapiens
tcagcaagtattttctgaatgc

SEQ ID NO: 8150913 - DNA, 22 bp, Homo sapiens
tcagcacaggtcttgcaaaaca

SEQ ID NO: 8150914 - DNA, 22 bp, Homo sapiens
tcagcaagtggaccatcctggg

SEQ ID NO: 8150915 - DNA, 22 bp, Homo sapiens
tcagcaatgtgatactgtgcaa

SEQ ID NO: 8150916 - DNA, 22 bp, Homo sapiens
tcagcaatgtgatactgtgcaa

SEQ ID NO: 8150917 - DNA, 22 bp, Homo sapiens
tcagcactgaatctggatttgc

SEQ ID NO: 8150918 - DNA, 22 bp, Homo sapiens
tcagcactgtgtccagtctccc

SEQ ID NO: 8150919 - DNA, 22 bp, Homo sapiens
tcagagcactggtgctaccttg

SEQ ID NO: 8150920 - DNA, 22 bp, Homo sapiens
tcagagcactggtgctaccttg

SEQ ID NO: 8150921 - DNA, 22 bp, Homo sapiens
tcagagcacttggctcatggca

SEQ ID NO: 8150922 - DNA, 20 bp, Homo sapiens
tcagagcagttggcttgtct

SEQ ID NO: 8150923 - DNA, 20 bp, Homo sapiens
tcagagcagttggcttgtct

SEQ ID NO: 8150924 - DNA, 22 bp, Homo sapiens
tcagagcattcgggtgacaaat

SEQ ID NO: 8150925 - DNA, 22 bp, Homo sapiens
tcagagcattagaggtttgtat

SEQ ID NO: 8150926 - DNA, 22 bp, Homo sapiens
tcagagcattagaggtttgtat

SEQ ID NO: 8150927 - DNA, 22 bp, Homo sapiens
tcagagccaatcatggtgcatt

SEQ ID NO: 8150928 - DNA, 22 bp, Homo sapiens
tcagagcccctccgctgtccca

SEQ ID NO: 8150929 - DNA, 20 bp, Homo sapiens
tcagagctgcaggagagaaa

SEQ ID NO: 8150930 - DNA, 22 bp, Homo sapiens
tcagagctcctaagggctgatt

SEQ ID NO: 8150931 - DNA, 22 bp, Homo sapiens
tcagagctcatgagcagagcca

SEQ ID NO: 8150932 - DNA, 22 bp, Homo sapiens
tcagagctaaggggagagcaaa

SEQ ID NO: 8150933 - DNA, 22 bp, Homo sapiens
tcagagctaaggggagagcaaa

SEQ ID NO: 8150934 - DNA, 22 bp, Homo sapiens
tcagagcttcacctgttacatt

SEQ ID NO: 8150935 - DNA, 22 bp, Homo sapiens
tcagagcttatctcttgctgga

SEQ ID NO: 8150936 - DNA, 22 bp, Homo sapiens
tcagagcttatctcttgctgga

SEQ ID NO: 8150937 - DNA, 22 bp, Homo sapiens
tcagagctttggagaccaggaa

SEQ ID NO: 8150938 - DNA, 22 bp, Homo sapiens
tcagagctttggagaccaggaa

SEQ ID NO: 8150939 - DNA, 20 bp, Homo sapiens
tcagagctgcaggagagaaa

SEQ ID NO: 8150940 - DNA, 22 bp, Homo sapiens
tcagagctgcccatgcaagggg

SEQ ID NO: 8150941 - DNA, 22 bp, Homo sapiens
tcagagctgggtgcttcttcct

SEQ ID NO: 8150942 - DNA, 22 bp, Homo sapiens
tcagagctgggtgcttcttcct

SEQ ID NO: 8150943 - DNA, 22 bp, Homo sapiens
tcagagctgtgcttcaggaaag

SEQ ID NO: 8150944 - DNA, 22 bp, Homo sapiens
tcagagcttatctcttgctgga

SEQ ID NO: 8150945 - DNA, 22 bp, Homo sapiens
tcagagctgtgcttcaggaaag

SEQ ID NO: 8150946 - DNA, 22 bp, Homo sapiens
tcagagcttatctcttgctgga

SEQ ID NO: 8150947 - DNA, 22 bp, Homo sapiens
tcactttttgatatcattctgc

SEQ ID NO: 8150948 - DNA, 22 bp, Homo sapiens
tcactttttgatatcattctgc

SEQ ID NO: 8150949 - DNA, 22 bp, Homo sapiens
tcacttttgatccctatgcagt

SEQ ID NO: 8150950 - DNA, 22 bp, Homo sapiens
tcacttttgatccctatgcagt

SEQ ID NO: 8150951 - DNA, 22 bp, Homo sapiens
tcacttttgggtttccagtaga

SEQ ID NO: 8150952 - DNA, 22 bp, Homo sapiens
tcacttttgatccctatgcagt

SEQ ID NO: 8150953 - DNA, 22 bp, Homo sapiens
tcacttttgatccctatgcagt

SEQ ID NO: 8150954 - DNA, 22 bp, Homo sapiens
tcagaaaagagaaaatcttata

SEQ ID NO: 8150955 - DNA, 22 bp, Homo sapiens
tcagaaaagagaaaatcttata

SEQ ID NO: 8150956 - DNA, 22 bp, Homo sapiens
tcagacaggctggacagcttgc

SEQ ID NO: 8150957 - DNA, 22 bp, Homo sapiens
tcagacaggcttctttctccct

SEQ ID NO: 8150958 - DNA, 22 bp, Homo sapiens
tcagacagggagtcagaaaata

SEQ ID NO: 8150959 - DNA, 22 bp, Homo sapiens
tcagacagggagtcagaaaata

SEQ ID NO: 8150960 - DNA, 22 bp, Homo sapiens
tcagacagggcttctcaaactt

SEQ ID NO: 8150961 - DNA, 22 bp, Homo sapiens
tcagacagtcatcagagcttgt

SEQ ID NO: 8150962 - DNA, 22 bp, Homo sapiens
tcagacagtcatcagagcttgt

SEQ ID NO: 8150963 - DNA, 20 bp, Homo sapiens
tcagacagtcgcagttctgg

SEQ ID NO: 8150964 - DNA, 22 bp, Homo sapiens
tcagacagtcatcagagcttgt

SEQ ID NO: 8150965 - DNA, 22 bp, Homo sapiens
tcagaaaaggtagctgtgacaa

SEQ ID NO: 8150966 - DNA, 22 bp, Homo sapiens
tcagacagcttgcagggaggtg

SEQ ID NO: 8150967 - DNA, 22 bp, Homo sapiens
tcagacaggctggacagcttgc

SEQ ID NO: 8150968 - DNA, 22 bp, Homo sapiens
tcagacaggcctctccagcctc

SEQ ID NO: 8150969 - DNA, 22 bp, Homo sapiens
tcagacagcttgggataactga

SEQ ID NO: 8150970 - DNA, 22 bp, Homo sapiens
tcagagaaggcaattttatggt

SEQ ID NO: 8150971 - DNA, 22 bp, Homo sapiens
tcagagaaggctgagtcacggc

SEQ ID NO: 8150972 - DNA, 20 bp, Homo sapiens
tcagagaagggactgagatt

SEQ ID NO: 8150973 - DNA, 22 bp, Homo sapiens
tcagagaactggcatgtttaga

SEQ ID NO: 8150974 - DNA, 22 bp, Homo sapiens
tcagagaactgcagcccttcct

SEQ ID NO: 8150975 - DNA, 22 bp, Homo sapiens
tcagagaagacatcattgtgaa

SEQ ID NO: 8150976 - DNA, 20 bp, Homo sapiens
tcagacccagattagcaggt

SEQ ID NO: 8150977 - DNA, 22 bp, Homo sapiens
tcagacctctgaccttgccaaa

SEQ ID NO: 8150978 - DNA, 22 bp, Homo sapiens
tcagacctctgaccttgccaaa

SEQ ID NO: 8150979 - DNA, 22 bp, Homo sapiens
tcagacctctgaccttgccaaa

SEQ ID NO: 8150980 - DNA, 22 bp, Homo sapiens
tcagacattattttcaagataa

SEQ ID NO: 8150981 - DNA, 22 bp, Homo sapiens
tcagaccatcctgctgttagtg

SEQ ID NO: 8150982 - DNA, 22 bp, Homo sapiens
tcagacatgggatatgaagctc

SEQ ID NO: 8150983 - DNA, 22 bp, Homo sapiens
tcagacagtttgcagtgtgcct

SEQ ID NO: 8150984 - DNA, 22 bp, Homo sapiens
tcagacagtgtgatcagtctct

SEQ ID NO: 8150985 - DNA, 22 bp, Homo sapiens
tcagacagtttgcagtgtgcct

SEQ ID NO: 8150986 - DNA, 22 bp, Homo sapiens
tcagacagtgtgatcagtctct

SEQ ID NO: 8150987 - DNA, 22 bp, Homo sapiens
tcagacagtgtgatcagtctct

SEQ ID NO: 8150988 - DNA, 22 bp, Homo sapiens
tcacagggtgtacatcacctat

SEQ ID NO: 8150989 - DNA, 23 bp, Homo sapiens
tcacaggggccagcgctctgtgg

SEQ ID NO: 8150990 - DNA, 23 bp, Homo sapiens
tcacaggggccagcgctctgtgg

SEQ ID NO: 8150991 - DNA, 22 bp, Homo sapiens
tcacaggctccagggcctggat

SEQ ID NO: 8150992 - DNA, 22 bp, Homo sapiens
tcacaggctctccaccatgagg

SEQ ID NO: 8150993 - DNA, 22 bp, Homo sapiens
tcacagggatggaatagaaata

SEQ ID NO: 8150994 - DNA, 22 bp, Homo sapiens
tcacagggcattatggctccag

SEQ ID NO: 8150995 - DNA, 22 bp, Homo sapiens
tcacagggcattatggctccag

SEQ ID NO: 8150996 - DNA, 22 bp, Homo sapiens
tcacagaagttgaatttgcatg

SEQ ID NO: 8150997 - DNA, 22 bp, Homo sapiens
tcacagaagtgtagtgaggaaa

SEQ ID NO: 8150998 - DNA, 22 bp, Homo sapiens
tcacagaagggaaagatgccaa

SEQ ID NO: 8150999 - DNA, 22 bp, Homo sapiens
tcacagaagtgtagtgaggaaa

SEQ ID NO: 8151000 - DNA, 22 bp, Homo sapiens
tcacagaaggtggccatagctg

SEQ ID NO: 8151001 - DNA, 22 bp, Homo sapiens
tcacagaagatgctggatgttg

SEQ ID NO: 8151002 - DNA, 22 bp, Homo sapiens
tcacagaaggagggaagctagt

SEQ ID NO: 8151003 - DNA, 22 bp, Homo sapiens
tcacagaaggaccttgtttcat

SEQ ID NO: 8151004 - DNA, 22 bp, Homo sapiens
tcacagaaggcatcacagaaga

SEQ ID NO: 8151005 - DNA, 22 bp, Homo sapiens
tcacagaaggcatcacagaaga

SEQ ID NO: 8151006 - DNA, 22 bp, Homo sapiens
tcacaggataaggtggcatcac

SEQ ID NO: 8151007 - DNA, 22 bp, Homo sapiens
tcacaggagtcataattacagt

SEQ ID NO: 8151008 - DNA, 22 bp, Homo sapiens
tcacaggcaaagaagattggtg

SEQ ID NO: 8151009 - DNA, 22 bp, Homo sapiens
tcacagaataaatgtactggcc

SEQ ID NO: 8151010 - DNA, 22 bp, Homo sapiens
tcacagaataaatgtactggcc

SEQ ID NO: 8151011 - DNA, 22 bp, Homo sapiens
tcacagaataaattgagaagac

SEQ ID NO: 8151012 - DNA, 22 bp, Homo sapiens
tcacagaataaattgagaagac

SEQ ID NO: 8151013 - DNA, 22 bp, Homo sapiens
tcacagctcactgtagcctcga

SEQ ID NO: 8151014 - DNA, 22 bp, Homo sapiens
tcacagctcactgtagcctcga

SEQ ID NO: 8151015 - DNA, 22 bp, Homo sapiens
tcacaaagctttgataagcaga

SEQ ID NO: 8151016 - DNA, 22 bp, Homo sapiens
tcacaaaaggccatgtggcttc

SEQ ID NO: 8151017 - DNA, 22 bp, Homo sapiens
tcacaaaaggccatgtggcttc

SEQ ID NO: 8151018 - DNA, 22 bp, Homo sapiens
tcacaaagctttgataagcaga

SEQ ID NO: 8151019 - DNA, 22 bp, Homo sapiens
tcacaaaagcttttgaatttgg

SEQ ID NO: 8151020 - DNA, 22 bp, Homo sapiens
tcacaaaagcttttgaatttgg

SEQ ID NO: 8151021 - DNA, 22 bp, Homo sapiens
tcacaaaagcttttgaatttgg

SEQ ID NO: 8151022 - DNA, 20 bp, Homo sapiens
tcaattttctacaacatttg

SEQ ID NO: 8151023 - DNA, 22 bp, Homo sapiens
tcacaatactcactcaatggct

SEQ ID NO: 8151024 - DNA, 22 bp, Homo sapiens
tcacaagtttctcttgcatgcg

SEQ ID NO: 8151025 - DNA, 22 bp, Homo sapiens
tcacaagatggctgctgcagcc

SEQ ID NO: 8151026 - DNA, 22 bp, Homo sapiens
tcacaagatacagttagaagca

SEQ ID NO: 8151027 - DNA, 22 bp, Homo sapiens
tcacaagataaacatagctcca

SEQ ID NO: 8151028 - DNA, 22 bp, Homo sapiens
tcacaagataaacatagctcca

SEQ ID NO: 8151029 - DNA, 22 bp, Homo sapiens
tcacaagatatttcagtccttt

SEQ ID NO: 8151030 - DNA, 22 bp, Homo sapiens
tcacaagatatttcagtccttt

SEQ ID NO: 8151031 - DNA, 22 bp, Homo sapiens
tcacaaagggagggatagctgg

SEQ ID NO: 8151032 - DNA, 22 bp, Homo sapiens
tcacaaatagctatattaagga

SEQ ID NO: 8151033 - DNA, 22 bp, Homo sapiens
tcacaagagtaagttcatgcct

SEQ ID NO: 8151034 - DNA, 22 bp, Homo sapiens
tcacaagagtaagttcatgcct

SEQ ID NO: 8151035 - DNA, 22 bp, Homo sapiens
tcacaagagtaagttcatgcct

SEQ ID NO: 8151036 - DNA, 18 bp, Homo sapiens
tcacaattatggttcgtg

SEQ ID NO: 8151037 - DNA, 22 bp, Homo sapiens
tcacacatgagtaaatacaggg

SEQ ID NO: 8151038 - DNA, 22 bp, Homo sapiens
tcacaatatgggtgtgggaact

SEQ ID NO: 8151039 - DNA, 22 bp, Homo sapiens
tcacaatatttatcttccaatt

SEQ ID NO: 8151040 - DNA, 20 bp, Homo sapiens
tcacaatatgagctcataca

SEQ ID NO: 8151041 - DNA, 20 bp, Homo sapiens
tcacaatatgagctcataca

SEQ ID NO: 8151042 - DNA, 20 bp, Homo sapiens
tcacaatatgagctcataca

SEQ ID NO: 8151043 - DNA, 20 bp, Homo sapiens
tcacacatggtaagctatga

SEQ ID NO: 8151044 - DNA, 20 bp, Homo sapiens
tcacacatggtaagctatga

SEQ ID NO: 8151045 - DNA, 22 bp, Homo sapiens
tcacacatgctaagccagagat

SEQ ID NO: 8151046 - DNA, 22 bp, Homo sapiens
tcacacatgctaagccagagat

SEQ ID NO: 8151047 - DNA, 22 bp, Homo sapiens
tcacagaaacagaatggcacag

SEQ ID NO: 8151048 - DNA, 20 bp, Homo sapiens
tcacagaaacaaatagagaa

SEQ ID NO: 8151049 - DNA, 22 bp, Homo sapiens
tcacagaacaatgtttagttct

SEQ ID NO: 8151050 - DNA, 22 bp, Homo sapiens
tcacagaagaagtagattgcat

SEQ ID NO: 8151051 - DNA, 22 bp, Homo sapiens
tcacagaagaagtagattgcat

SEQ ID NO: 8151052 - DNA, 22 bp, Homo sapiens
tcacagaagagcattaagatga

SEQ ID NO: 8151053 - DNA, 22 bp, Homo sapiens
tcacagaagagcattaagatga

SEQ ID NO: 8151054 - DNA, 22 bp, Homo sapiens
tcacagaagagatattgacaga

SEQ ID NO: 8151055 - DNA, 22 bp, Homo sapiens
tcacagaaagctgtgtcctgac

SEQ ID NO: 8151056 - DNA, 22 bp, Homo sapiens
tcacagaaataagatagttatt

SEQ ID NO: 8151057 - DNA, 22 bp, Homo sapiens
tcacagaaataagatagttatt

SEQ ID NO: 8151058 - DNA, 22 bp, Homo sapiens
tcacagaacaagcctggtggag

SEQ ID NO: 8151059 - DNA, 22 bp, Homo sapiens
tcaatacagaaaggatattttg

SEQ ID NO: 8151060 - DNA, 22 bp, Homo sapiens
tcaatttatgtggctattcatt

SEQ ID NO: 8151061 - DNA, 22 bp, Homo sapiens
tcaataatggcaggataaattt

SEQ ID NO: 8151062 - DNA, 22 bp, Homo sapiens
tcaataatggcaggataaattt

SEQ ID NO: 8151063 - DNA, 22 bp, Homo sapiens
tcaataatggcaggataaattt

SEQ ID NO: 8151064 - DNA, 20 bp, Homo sapiens
tcaatttcaggtagcatagt

SEQ ID NO: 8151065 - DNA, 22 bp, Homo sapiens
tcaatttcattctattagttaa

SEQ ID NO: 8151066 - DNA, 22 bp, Homo sapiens
tcaatttcttggtttgataata

SEQ ID NO: 8151067 - DNA, 18 bp, Homo sapiens
tcaagtgattctcctgcc

SEQ ID NO: 8151068 - DNA, 22 bp, Homo sapiens
tcaagtgagcgtagctgaatgg

SEQ ID NO: 8151069 - DNA, 22 bp, Homo sapiens
tcaagtgagcgtagctgaatgg

SEQ ID NO: 8151070 - DNA, 22 bp, Homo sapiens
tcaagtgcttgtgaggtatttg

SEQ ID NO: 8151071 - DNA, 22 bp, Homo sapiens
tcaagtgtagtggtgtcaggtc

SEQ ID NO: 8151072 - DNA, 22 bp, Homo sapiens
tcaagttaggtggttgttagga

SEQ ID NO: 8151073 - DNA, 20 bp, Homo sapiens
tcaagttttgcttgacaaga

SEQ ID NO: 8151074 - DNA, 20 bp, Homo sapiens
tcaagttttgcttgacaaga

SEQ ID NO: 8151075 - DNA, 22 bp, Homo sapiens
tcaagtttctctcagattatgg

SEQ ID NO: 8151076 - DNA, 22 bp, Homo sapiens
tcaataaatccctctgaccctg

SEQ ID NO: 8151077 - DNA, 22 bp, Homo sapiens
tcaataaatagcttggctcagc

SEQ ID NO: 8151078 - DNA, 22 bp, Homo sapiens
tcaataaaattgttttcctatc

SEQ ID NO: 8151079 - DNA, 22 bp, Homo sapiens
tcaagtctcaatgtattatggt

SEQ ID NO: 8151080 - DNA, 22 bp, Homo sapiens
tcaagtctggagatctggaact

SEQ ID NO: 8151081 - DNA, 22 bp, Homo sapiens
tcaagtcccagctcttcactta

SEQ ID NO: 8151082 - DNA, 22 bp, Homo sapiens
tcaagtcctgctgtggaccaca

SEQ ID NO: 8151083 - DNA, 22 bp, Homo sapiens
tcaaggttgttgaggcctgact

SEQ ID NO: 8151084 - DNA, 22 bp, Homo sapiens
tcaaggtttgtctgctcagcat

SEQ ID NO: 8151085 - DNA, 22 bp, Homo sapiens
tcaaggttttatcctagatcac

SEQ ID NO: 8151086 - DNA, 22 bp, Homo sapiens
tcaaggtgctgtgctgtgctag

SEQ ID NO: 8151087 - DNA, 22 bp, Homo sapiens
tcaagggaggagacacagccct

SEQ ID NO: 8151088 - DNA, 22 bp, Homo sapiens
tcaaggttaagccagggcctca

SEQ ID NO: 8151089 - DNA, 22 bp, Homo sapiens
tcaaggttgagtaaattgttgg

SEQ ID NO: 8151090 - DNA, 22 bp, Homo sapiens
tcaaggttgccaggaaggaaga

SEQ ID NO: 8151091 - DNA, 22 bp, Homo sapiens
tcaaggttcaaggctggcttct

SEQ ID NO: 8151092 - DNA, 22 bp, Homo sapiens
tcaaggttgcggggaggcacga

SEQ ID NO: 8151093 - DNA, 22 bp, Homo sapiens
tcaaggaggtgcttggcttcac

SEQ ID NO: 8151094 - DNA, 22 bp, Homo sapiens
tcaaggccacagtgagcagagt

SEQ ID NO: 8151095 - DNA, 22 bp, Homo sapiens
tcaaggccacagtgagcagagt

SEQ ID NO: 8151096 - DNA, 22 bp, Homo sapiens
tcaaggcatacatttagaagag

SEQ ID NO: 8151097 - DNA, 22 bp, Homo sapiens
tcaaggcctatcctcatttgta

SEQ ID NO: 8151098 - DNA, 22 bp, Homo sapiens
tcaaggccagggaatgtagggg

SEQ ID NO: 8151099 - DNA, 21 bp, Homo sapiens
tcaaggccagcctgggcagcc

SEQ ID NO: 8151100 - DNA, 22 bp, Homo sapiens
tcaagggaggagacacagccct

SEQ ID NO: 8151101 - DNA, 22 bp, Homo sapiens
tcaaggcttttggttttccata

SEQ ID NO: 8151102 - DNA, 22 bp, Homo sapiens
tcaaggccacagtgagcagagt

SEQ ID NO: 8151103 - DNA, 19 bp, Homo sapiens
tcaaggctccctgagggat

SEQ ID NO: 8151104 - DNA, 22 bp, Homo sapiens
tcaaggctattaattctgtgag

SEQ ID NO: 8151105 - DNA, 22 bp, Homo sapiens
tcaaggctaaactttcagagta

SEQ ID NO: 8151106 - DNA, 22 bp, Homo sapiens
tcaaggctattaattctgtgag

SEQ ID NO: 8151107 - DNA, 22 bp, Homo sapiens
tatttctgggagttcagaaatt

SEQ ID NO: 8151108 - DNA, 20 bp, Homo sapiens
tatttctgggcaaccattta

SEQ ID NO: 8151109 - DNA, 22 bp, Homo sapiens
tatttctgggagttcagaaatt

SEQ ID NO: 8151110 - DNA, 22 bp, Homo sapiens
tatttctgaggcccaggaagtg

SEQ ID NO: 8151111 - DNA, 22 bp, Homo sapiens
tatttctgattgctcatgaggc

SEQ ID NO: 8151112 - DNA, 20 bp, Homo sapiens
tatttctgggcaaccattta

SEQ ID NO: 8151113 - DNA, 22 bp, Homo sapiens
tatttctgtatgcataaaagga

SEQ ID NO: 8151114 - DNA, 22 bp, Homo sapiens
tatttctgtcagccagatatgg

SEQ ID NO: 8151115 - DNA, 22 bp, Homo sapiens
tatttctgtatgcataaaagga

SEQ ID NO: 8151116 - DNA, 22 bp, Homo sapiens
tatttctgtttatttgtacatc

SEQ ID NO: 8151117 - DNA, 22 bp, Homo sapiens
tatttcttcgggattcaagcta

SEQ ID NO: 8151118 - DNA, 22 bp, Homo sapiens
tatttctgtttatttgtacatc

SEQ ID NO: 8151119 - DNA, 22 bp, Homo sapiens
tatttctgtttatttgtacatc

SEQ ID NO: 8151120 - DNA, 22 bp, Homo sapiens
tatttctgtttatttgtacatc

SEQ ID NO: 8151121 - DNA, 22 bp, Homo sapiens
tatttcttcgggattcaagcta

SEQ ID NO: 8151122 - DNA, 22 bp, Homo sapiens
tatttcttcgggattcaagcta

SEQ ID NO: 8151123 - DNA, 22 bp, Homo sapiens
tatttcttcgggattcaagcta

SEQ ID NO: 8151124 - DNA, 22 bp, Homo sapiens
tatttctgtttatttgtacatc

SEQ ID NO: 8151125 - DNA, 22 bp, Homo sapiens
tatttcttgagactcgtcttcc

SEQ ID NO: 8151126 - DNA, 22 bp, Homo sapiens
tatttcttgagactcgtcttcc

SEQ ID NO: 8151127 - DNA, 22 bp, Homo sapiens
tatttcttgagactcgtcttcc

SEQ ID NO: 8151128 - DNA, 22 bp, Homo sapiens
tatttcttgagtggtcagtttc

SEQ ID NO: 8151129 - DNA, 22 bp, Homo sapiens
tatttcttgagtggtcagtttc

SEQ ID NO: 8151130 - DNA, 20 bp, Homo sapiens
tcaagacagacatggagttt

SEQ ID NO: 8151131 - DNA, 22 bp, Homo sapiens
tcaagaatttggataagaaatg

SEQ ID NO: 8151132 - DNA, 22 bp, Homo sapiens
tcaagaatttggataagaaatg

SEQ ID NO: 8151133 - DNA, 22 bp, Homo sapiens
tcaagaatagctgcaaacaggg

SEQ ID NO: 8151134 - DNA, 22 bp, Homo sapiens
tcaagaagtctgtaccatttga

SEQ ID NO: 8151135 - DNA, 22 bp, Homo sapiens
tcaagctggctgttgctatttc

SEQ ID NO: 8151136 - DNA, 22 bp, Homo sapiens
tcaaggaagatagctattatga

SEQ ID NO: 8151137 - DNA, 22 bp, Homo sapiens
tcaagataagtcagtatatcaa

SEQ ID NO: 8151138 - DNA, 22 bp, Homo sapiens
tcaaggaagggatattcttgaa

SEQ ID NO: 8151139 - DNA, 22 bp, Homo sapiens
tcaaggaaggtctgttgctcca

SEQ ID NO: 8151140 - DNA, 22 bp, Homo sapiens
tcaaggaaggtctgttgctcca

SEQ ID NO: 8151141 - DNA, 22 bp, Homo sapiens
tcaaggaagtcttattgcacag

SEQ ID NO: 8151142 - DNA, 22 bp, Homo sapiens
tcaaggaatttagtttagtaaa

SEQ ID NO: 8151143 - DNA, 22 bp, Homo sapiens
tcaaggagacagaaagcaatgg

SEQ ID NO: 8151144 - DNA, 20 bp, Homo sapiens
tcaaggactccctgggaaga

SEQ ID NO: 8151145 - DNA, 20 bp, Homo sapiens
tcaaggaatgtcattttgtt

SEQ ID NO: 8151146 - DNA, 22 bp, Homo sapiens
tcaaggaatgactatatgagga

SEQ ID NO: 8151147 - DNA, 22 bp, Homo sapiens
tcaagacatattaaatgtgcga

SEQ ID NO: 8151148 - DNA, 22 bp, Homo sapiens
tcaagagaagtgctccacagta

SEQ ID NO: 8151149 - DNA, 22 bp, Homo sapiens
tcaagagattgaataataactg

SEQ ID NO: 8151150 - DNA, 22 bp, Homo sapiens
tcaagagcatgtatctccctaa

SEQ ID NO: 8151151 - DNA, 18 bp, Homo sapiens
tccagcaggtctgaggtg

SEQ ID NO: 8151152 - DNA, 22 bp, Homo sapiens
tccagcaggtccgagacaagtt

SEQ ID NO: 8151153 - DNA, 18 bp, Homo sapiens
tccagcaggtctgaggtg

SEQ ID NO: 8151154 - DNA, 22 bp, Homo sapiens
tccagcagcccgaaggcccatc

SEQ ID NO: 8151155 - DNA, 22 bp, Homo sapiens
tccagcagccacacctctggac

SEQ ID NO: 8151156 - DNA, 22 bp, Homo sapiens
tccagcagccacacctctggac

SEQ ID NO: 8151157 - DNA, 22 bp, Homo sapiens
tccagcagggaattagtagtct

SEQ ID NO: 8151158 - DNA, 22 bp, Homo sapiens
tccagcagcccgaaggcccatc

SEQ ID NO: 8151159 - DNA, 22 bp, Homo sapiens
tccagcagcccgaaggcccatc

SEQ ID NO: 8151160 - DNA, 23 bp, Homo sapiens
tccagcagagccttccaggaggg

SEQ ID NO: 8151161 - DNA, 23 bp, Homo sapiens
tccagcagagccttccaggaggg

SEQ ID NO: 8151162 - DNA, 22 bp, Homo sapiens
tccagcagaccatcaaggctca

SEQ ID NO: 8151163 - DNA, 22 bp, Homo sapiens
tccagcagaccatcaaggctca

SEQ ID NO: 8151164 - DNA, 23 bp, Homo sapiens
tccagcagccaagaagggtagaa

SEQ ID NO: 8151165 - DNA, 23 bp, Homo sapiens
tccagcagccaagaagggtagaa

SEQ ID NO: 8151166 - DNA, 22 bp, Homo sapiens
tccagcagagtctctgaggggg

SEQ ID NO: 8151167 - DNA, 22 bp, Homo sapiens
tccagagctctgggcatagctg

SEQ ID NO: 8151168 - DNA, 23 bp, Homo sapiens
tccagagctcatgctctcaacca

SEQ ID NO: 8151169 - DNA, 22 bp, Homo sapiens
tccagagctctgggcatagctg

SEQ ID NO: 8151170 - DNA, 22 bp, Homo sapiens
tccagagctctgggcatagctg

SEQ ID NO: 8151171 - DNA, 22 bp, Homo sapiens
tccagagctgagcagtcattct

SEQ ID NO: 8151172 - DNA, 22 bp, Homo sapiens
tccagagctgagcagtcattct

SEQ ID NO: 8151173 - DNA, 22 bp, Homo sapiens
tccagagctgggtctgtgctca

SEQ ID NO: 8151174 - DNA, 22 bp, Homo sapiens
tccagagctgggtctgtgctca

SEQ ID NO: 8151175 - DNA, 22 bp, Homo sapiens
tccagagctgagggtcagtaga

SEQ ID NO: 8151176 - DNA, 22 bp, Homo sapiens
tccagagctgagggtcagtaga

SEQ ID NO: 8151177 - DNA, 22 bp, Homo sapiens
tccagagctgggtctgtgctca

SEQ ID NO: 8151178 - DNA, 22 bp, Homo sapiens
tccagagctgggtctgtgctca

SEQ ID NO: 8151179 - DNA, 18 bp, Homo sapiens
tccagagctggtgcttct

SEQ ID NO: 8151180 - DNA, 22 bp, Homo sapiens
tccagagctgtatgattttttt

SEQ ID NO: 8151181 - DNA, 22 bp, Homo sapiens
tccagagctgtatgattttttt

SEQ ID NO: 8151182 - DNA, 22 bp, Homo sapiens
tccagagctgtcctactgtgag

SEQ ID NO: 8151183 - DNA, 22 bp, Homo sapiens
tccagagctgtcctactgtgag

SEQ ID NO: 8151184 - DNA, 22 bp, Homo sapiens
tccagagctgtcctactgtgag

SEQ ID NO: 8151185 - DNA, 22 bp, Homo sapiens
tccagaggcaaaaaggtatgga

SEQ ID NO: 8151186 - DNA, 21 bp, Homo sapiens
tccagaggaggacagactcag

SEQ ID NO: 8151187 - DNA, 14 bp, Homo sapiens
tccagagctttccg

SEQ ID NO: 8151188 - DNA, 21 bp, Homo sapiens
tccagaggaggacagactcag

SEQ ID NO: 8151189 - DNA, 21 bp, Homo sapiens
tccagaggaggacagactcag

SEQ ID NO: 8151190 - DNA, 22 bp, Homo sapiens
tccagagggcgatggctggggg

SEQ ID NO: 8151191 - DNA, 22 bp, Homo sapiens
tccagagggcgatggctggggg

SEQ ID NO: 8151192 - DNA, 22 bp, Homo sapiens
tccagaggggcagccctgtgct

SEQ ID NO: 8151193 - DNA, 22 bp, Homo sapiens
tccagaggtatgtagagagtat

SEQ ID NO: 8151194 - DNA, 22 bp, Homo sapiens
tccagaggggcagccctgtgct

SEQ ID NO: 8151195 - DNA, 22 bp, Homo sapiens
tccagaggtatgtagagagtat

SEQ ID NO: 8151196 - DNA, 20 bp, Homo sapiens
tccagaggccacatccagtg

SEQ ID NO: 8151197 - DNA, 20 bp, Homo sapiens
tccagaggccacatccagtg

SEQ ID NO: 8151198 - DNA, 22 bp, Homo sapiens
tccagaggctccaaagggagat

SEQ ID NO: 8151199 - DNA, 22 bp, Homo sapiens
tccagaggcagctgcggtcagg

SEQ ID NO: 8151200 - DNA, 22 bp, Homo sapiens
tccagaggctccaaagggagat

SEQ ID NO: 8151201 - DNA, 22 bp, Homo sapiens
tccagaggctctgagggagagt

SEQ ID NO: 8151202 - DNA, 22 bp, Homo sapiens
tcattgcagaaataaaggtgaa

SEQ ID NO: 8151203 - DNA, 22 bp, Homo sapiens
tcattgcagcttcaggtgttca

SEQ ID NO: 8151204 - DNA, 19 bp, Homo sapiens
tccagaagtccctgagcgg

SEQ ID NO: 8151205 - DNA, 20 bp, Homo sapiens
tccagagagtggcaaagctc

SEQ ID NO: 8151206 - DNA, 22 bp, Homo sapiens
tccagagaggtttctccatgct

SEQ ID NO: 8151207 - DNA, 22 bp, Homo sapiens
tccagagaggtttctccatgct

SEQ ID NO: 8151208 - DNA, 22 bp, Homo sapiens
tccagacattttatagcagtct

SEQ ID NO: 8151209 - DNA, 22 bp, Homo sapiens
tcattgatggcttctttcttgc

SEQ ID NO: 8151210 - DNA, 23 bp, Homo sapiens
tcattgatcttgtcagagcattt

SEQ ID NO: 8151211 - DNA, 22 bp, Homo sapiens
tcattgagttgcacttttacta

SEQ ID NO: 8151212 - DNA, 22 bp, Homo sapiens
tcattgataaagtactgctttt

SEQ ID NO: 8151213 - DNA, 22 bp, Homo sapiens
tcattgaatgagatgcaataga

SEQ ID NO: 8151214 - DNA, 22 bp, Homo sapiens
tcattgaagcattttgtgtatt

SEQ ID NO: 8151215 - DNA, 22 bp, Homo sapiens
tccagagcctttccacccactt

SEQ ID NO: 8151216 - DNA, 22 bp, Homo sapiens
tccagagcctttctgcttgaca

SEQ ID NO: 8151217 - DNA, 22 bp, Homo sapiens
tccagagcctttctgcttgaca

SEQ ID NO: 8151218 - DNA, 22 bp, Homo sapiens
tccagagcctggggtttgtaac

SEQ ID NO: 8151219 - DNA, 22 bp, Homo sapiens
tccagagcctggggtttgtaac

SEQ ID NO: 8151220 - DNA, 22 bp, Homo sapiens
tccagagcctgcgcactggctg

SEQ ID NO: 8151221 - DNA, 22 bp, Homo sapiens
tccagagccttcgataagaaga

SEQ ID NO: 8151222 - DNA, 22 bp, Homo sapiens
tccagagcctggggtttgtaac

SEQ ID NO: 8151223 - DNA, 22 bp, Homo sapiens
tccagagcctgcgcactggctg

SEQ ID NO: 8151224 - DNA, 22 bp, Homo sapiens
tccagagcctgcgcactggctg

SEQ ID NO: 8151225 - DNA, 22 bp, Homo sapiens
tccagagcctatatgttcaact

SEQ ID NO: 8151226 - DNA, 22 bp, Homo sapiens
tccagagctacttgctcaactt

SEQ ID NO: 8151227 - DNA, 23 bp, Homo sapiens
tccagagctcatgctctcaacca

SEQ ID NO: 8151228 - DNA, 23 bp, Homo sapiens
tccagagctcatgctctcaacca

SEQ ID NO: 8151229 - DNA, 18 bp, Homo sapiens
tccagagctactgtggtg

SEQ ID NO: 8151230 - DNA, 22 bp, Homo sapiens
tccagagctacttgctcaactt

SEQ ID NO: 8151231 - DNA, 18 bp, Homo sapiens
tccagagctactgtggtg

SEQ ID NO: 8151232 - DNA, 18 bp, Homo sapiens
tccagagctactgtggtg

SEQ ID NO: 8151233 - DNA, 22 bp, Homo sapiens
tccagagctaattcagcagctg

SEQ ID NO: 8151234 - DNA, 22 bp, Homo sapiens
tccagagctaattcagcagctg

SEQ ID NO: 8151235 - DNA, 18 bp, Homo sapiens
tccagagcagtctttggc

SEQ ID NO: 8151236 - DNA, 18 bp, Homo sapiens
tccagagcagtctttggc

SEQ ID NO: 8151237 - DNA, 22 bp, Homo sapiens
tccagagcaggtgtctacacag

SEQ ID NO: 8151238 - DNA, 22 bp, Homo sapiens
tccagagcaggtggtcagaagg

SEQ ID NO: 8151239 - DNA, 22 bp, Homo sapiens
tccagagcaggtggtcagaagg

SEQ ID NO: 8151240 - DNA, 22 bp, Homo sapiens
tccagagccccagtctagtggg

SEQ ID NO: 8151241 - DNA, 22 bp, Homo sapiens
tccagagccccagtctagtggg

SEQ ID NO: 8151242 - DNA, 22 bp, Homo sapiens
tccagagccccaattcacctct

SEQ ID NO: 8151243 - DNA, 22 bp, Homo sapiens
tccagagccccaattcacctct

SEQ ID NO: 8151244 - DNA, 22 bp, Homo sapiens
tccagagcatgcagatcatcaa

SEQ ID NO: 8151245 - DNA, 17 bp, Homo sapiens
tccagagcacagagctc

SEQ ID NO: 8151246 - DNA, 17 bp, Homo sapiens
tccagagcacagagctc

SEQ ID NO: 8151247 - DNA, 17 bp, Homo sapiens
tccagagcacagagctc

SEQ ID NO: 8151248 - DNA, 22 bp, Homo sapiens
tccagagcaaagtttgctaaca

SEQ ID NO: 8151249 - DNA, 22 bp, Homo sapiens
tccagcaggttggtcaggtgca

SEQ ID NO: 8151250 - DNA, 22 bp, Homo sapiens
tccagcaggttggtcaggtgca

SEQ ID NO: 8151251 - DNA, 22 bp, Homo sapiens
tccagcaggttggtcaggtgca

SEQ ID NO: 8151252 - DNA, 22 bp, Homo sapiens
tccagcagtccatgtgagacac

SEQ ID NO: 8151253 - DNA, 22 bp, Homo sapiens
tccagcagtgctctagagcgtg

SEQ ID NO: 8151254 - DNA, 22 bp, Homo sapiens
tccagcagtgctctagagcgtg

SEQ ID NO: 8151255 - DNA, 21 bp, Homo sapiens
tccagcctttccctcacttcc

SEQ ID NO: 8151256 - DNA, 22 bp, Homo sapiens
tccagcctttctactcactgag

SEQ ID NO: 8151257 - DNA, 22 bp, Homo sapiens
tccagccaatcagagctgaggc

SEQ ID NO: 8151258 - DNA, 22 bp, Homo sapiens
tccagccaagggaggttactag

SEQ ID NO: 8151259 - DNA, 22 bp, Homo sapiens
tccagccaagccttggtagctg

SEQ ID NO: 8151260 - DNA, 22 bp, Homo sapiens
tccagccaagccttggtagctg

SEQ ID NO: 8151261 - DNA, 22 bp, Homo sapiens
tccagcattttgatacttgaaa

SEQ ID NO: 8151262 - DNA, 22 bp, Homo sapiens
tccagcattttgatacttgaaa

SEQ ID NO: 8151263 - DNA, 22 bp, Homo sapiens
tccagccaactgcctagggagc

SEQ ID NO: 8151264 - DNA, 22 bp, Homo sapiens
tccagcattcttagacctctat

SEQ ID NO: 8151265 - DNA, 22 bp, Homo sapiens
tccagcattttgatacttgaaa

SEQ ID NO: 8151266 - DNA, 22 bp, Homo sapiens
tccagctcatctgtctccatta

SEQ ID NO: 8151267 - DNA, 22 bp, Homo sapiens
tccagctcccactctcactgct

SEQ ID NO: 8151268 - DNA, 22 bp, Homo sapiens
tccagcctttctactcactgag

SEQ ID NO: 8151269 - DNA, 18 bp, Homo sapiens
tccagcgtgctccagggc

SEQ ID NO: 8151270 - DNA, 22 bp, Homo sapiens
tccagctcaaattcagcttcca

SEQ ID NO: 8151271 - DNA, 22 bp, Homo sapiens
tccagctcaaattcagcttcca

SEQ ID NO: 8151272 - DNA, 22 bp, Homo sapiens
tccagctcagggttggctcaag

SEQ ID NO: 8151273 - DNA, 22 bp, Homo sapiens
tccagctcagggttggctcaag

SEQ ID NO: 8151274 - DNA, 22 bp, Homo sapiens
tccagctgtactttgtcctggc

SEQ ID NO: 8151275 - DNA, 22 bp, Homo sapiens
tccagctgtagtggatttgaga

SEQ ID NO: 8151276 - DNA, 22 bp, Homo sapiens
tccagctgtactttgtcctggc

SEQ ID NO: 8151277 - DNA, 22 bp, Homo sapiens
tccagctgtactttgtcctggc

SEQ ID NO: 8151278 - DNA, 19 bp, Homo sapiens
tccagctggtatgcccaga

SEQ ID NO: 8151279 - DNA, 19 bp, Homo sapiens
tccagctggtatgcccaga

SEQ ID NO: 8151280 - DNA, 22 bp, Homo sapiens
tccagctggggccgaagtggat

SEQ ID NO: 8151281 - DNA, 22 bp, Homo sapiens
tccagctggggccgaagtggat

SEQ ID NO: 8151282 - DNA, 22 bp, Homo sapiens
tccagctgtgctccaggaggtg

SEQ ID NO: 8151283 - DNA, 22 bp, Homo sapiens
tccagctgtgctccaggaggtg

SEQ ID NO: 8151284 - DNA, 20 bp, Homo sapiens
tccagctgtctttcagagac

SEQ ID NO: 8151285 - DNA, 21 bp, Homo sapiens
tccagctgtgattatgaatgt

SEQ ID NO: 8151286 - DNA, 21 bp, Homo sapiens
tccagctgtgattatgaatgt

SEQ ID NO: 8151287 - DNA, 20 bp, Homo sapiens
tccagctgtctttcagagac

SEQ ID NO: 8151288 - DNA, 21 bp, Homo sapiens
tccagctcttatgttcatgaa

SEQ ID NO: 8151289 - DNA, 22 bp, Homo sapiens
tccagctctggcttggctagct

SEQ ID NO: 8151290 - DNA, 22 bp, Homo sapiens
tccagctggggcagtggctggg

SEQ ID NO: 8151291 - DNA, 22 bp, Homo sapiens
tccagctggggcagtggctggg

SEQ ID NO: 8151292 - DNA, 22 bp, Homo sapiens
tccagctggggacatgggcttc

SEQ ID NO: 8151293 - DNA, 22 bp, Homo sapiens
tccagctcctgagttcactgct

SEQ ID NO: 8151294 - DNA, 22 bp, Homo sapiens
tccagctcctgagttcactgct

SEQ ID NO: 8151295 - DNA, 21 bp, Homo sapiens
tccagctcctgccactcctta

SEQ ID NO: 8151296 - DNA, 22 bp, Homo sapiens
tccagctctaacatgctgggcc

SEQ ID NO: 8151297 - DNA, 22 bp, Homo sapiens
tccagctctgcttcacagtctc

SEQ ID NO: 8151298 - DNA, 22 bp, Homo sapiens
tccagctctgattctcactagc

SEQ ID NO: 8151299 - DNA, 22 bp, Homo sapiens
tccagctttgagattttatgga

SEQ ID NO: 8151300 - DNA, 22 bp, Homo sapiens
tccagctttgagattttatgga

SEQ ID NO: 8151301 - DNA, 20 bp, Homo sapiens
tccagctttgcctctaactg

SEQ ID NO: 8151302 - DNA, 22 bp, Homo sapiens
tccagctttgcctgatcatata

SEQ ID NO: 8151303 - DNA, 22 bp, Homo sapiens
tccagcttttaccaaatgagca

SEQ ID NO: 8151304 - DNA, 22 bp, Homo sapiens
tccagcttttattggatgagga

SEQ ID NO: 8151305 - DNA, 22 bp, Homo sapiens
tccagctttggctctagctaca

SEQ ID NO: 8151306 - DNA, 22 bp, Homo sapiens
tccaggaaaaggcttgcagggg

SEQ ID NO: 8151307 - DNA, 22 bp, Homo sapiens
tccaggaaacactcaagccatg

SEQ ID NO: 8151308 - DNA, 19 bp, Homo sapiens
tccaggaggctgccattga

SEQ ID NO: 8151309 - DNA, 22 bp, Homo sapiens
tccaggaggctctggttgacgt

SEQ ID NO: 8151310 - DNA, 22 bp, Homo sapiens
tccaggaggctctggttgacgt

SEQ ID NO: 8151311 - DNA, 22 bp, Homo sapiens
tccaggaaagcactgggctggg

SEQ ID NO: 8151312 - DNA, 22 bp, Homo sapiens
tccaggaaagcactgggctggg

SEQ ID NO: 8151313 - DNA, 22 bp, Homo sapiens
tccagcttcagctcttggatag

SEQ ID NO: 8151314 - DNA, 22 bp, Homo sapiens
tccagcttccagtggctggctg

SEQ ID NO: 8151315 - DNA, 19 bp, Homo sapiens
tccagctgttttgagtcac

SEQ ID NO: 8151316 - DNA, 22 bp, Homo sapiens
tccagcttataggtagatttaa

SEQ ID NO: 8151317 - DNA, 22 bp, Homo sapiens
tccagcttataggtagatttaa

SEQ ID NO: 8151318 - DNA, 19 bp, Homo sapiens
tccagctgttttgagtcac

SEQ ID NO: 8151319 - DNA, 20 bp, Homo sapiens
tccagctgttgagatctgag

SEQ ID NO: 8151320 - DNA, 20 bp, Homo sapiens
tccagctgttgagatctgag

SEQ ID NO: 8151321 - DNA, 22 bp, Homo sapiens
tccagctgttccatcagctctt

SEQ ID NO: 8151322 - DNA, 22 bp, Homo sapiens
tccagctgttgatattctaggt

SEQ ID NO: 8151323 - DNA, 22 bp, Homo sapiens
tccagctgttgttttatctcag

SEQ ID NO: 8151324 - DNA, 22 bp, Homo sapiens
tccagcttgacaaatgatttta

SEQ ID NO: 8151325 - DNA, 22 bp, Homo sapiens
tccagcttcttgacttggtggt

SEQ ID NO: 8151326 - DNA, 22 bp, Homo sapiens
tccagcttgcctggtcttttgg

SEQ ID NO: 8151327 - DNA, 18 bp, Homo sapiens
tccagcttgcacttaaat

SEQ ID NO: 8151328 - DNA, 18 bp, Homo sapiens
tccagcttgcacttaaat

SEQ ID NO: 8151329 - DNA, 22 bp, Homo sapiens
tccagcttgacaaatgatttta

SEQ ID NO: 8151330 - DNA, 22 bp, Homo sapiens
tccagcttgggtgggaggaggt

SEQ ID NO: 8151331 - DNA, 22 bp, Homo sapiens
tccagctttcacgctcctgcct

SEQ ID NO: 8151332 - DNA, 22 bp, Homo sapiens
tccagcttgcttcaggatggtc

SEQ ID NO: 8151333 - DNA, 22 bp, Homo sapiens
tccagcttggagagaagtttct

SEQ ID NO: 8151334 - DNA, 22 bp, Homo sapiens
tccagcttggcagagctacctg

SEQ ID NO: 8151335 - DNA, 22 bp, Homo sapiens
tccagcttggcagagctacctg

SEQ ID NO: 8151336 - DNA, 22 bp, Homo sapiens
tccagcttggagagaagtttct

SEQ ID NO: 8151337 - DNA, 22 bp, Homo sapiens
tccatccattttctttgctgtt

SEQ ID NO: 8151338 - DNA, 22 bp, Homo sapiens
tccatccctgactcctcctgga

SEQ ID NO: 8151339 - DNA, 22 bp, Homo sapiens
tccatccctgactcctcctgga

SEQ ID NO: 8151340 - DNA, 18 bp, Homo sapiens
tccatcctctgctcttca

SEQ ID NO: 8151341 - DNA, 18 bp, Homo sapiens
tccatcctctgctcttca

SEQ ID NO: 8151342 - DNA, 22 bp, Homo sapiens
tccatctcacctgcactctgcg

SEQ ID NO: 8151343 - DNA, 22 bp, Homo sapiens
tccatccatgtaggaagatggt

SEQ ID NO: 8151344 - DNA, 21 bp, Homo sapiens
tccatccatcagtccagccag

SEQ ID NO: 8151345 - DNA, 22 bp, Homo sapiens
tccatccataccacttggagac

SEQ ID NO: 8151346 - DNA, 22 bp, Homo sapiens
tccatccaggccagcagtaatc

SEQ ID NO: 8151347 - DNA, 20 bp, Homo sapiens
tccatctggtataagctgat

SEQ ID NO: 8151348 - DNA, 22 bp, Homo sapiens
tccatctggagacttcctggtc

SEQ ID NO: 8151349 - DNA, 22 bp, Homo sapiens
tccatctgcatttggtttctgt

SEQ ID NO: 8151350 - DNA, 22 bp, Homo sapiens
tccatgagaggtaactttacaa

SEQ ID NO: 8151351 - DNA, 22 bp, Homo sapiens
tccatgagaacccttggagata

SEQ ID NO: 8151352 - DNA, 22 bp, Homo sapiens
tccatgacagcgtgagagtttg

SEQ ID NO: 8151353 - DNA, 22 bp, Homo sapiens
tccatgaggcagggaggctggc

SEQ ID NO: 8151354 - DNA, 23 bp, Homo sapiens
tccatgagatgtgggcttctagt

SEQ ID NO: 8151355 - DNA, 18 bp, Homo sapiens
tccatgcacatagccccc

SEQ ID NO: 8151356 - DNA, 22 bp, Homo sapiens
tccatgcagagaactgaagtac

SEQ ID NO: 8151357 - DNA, 22 bp, Homo sapiens
tccatgagggacactggatgct

SEQ ID NO: 8151358 - DNA, 22 bp, Homo sapiens
tccatgagggacactggatgct

SEQ ID NO: 8151359 - DNA, 22 bp, Homo sapiens
tccatgagtttgaggaaaagag

SEQ ID NO: 8151360 - DNA, 22 bp, Homo sapiens
tcccacacctgtctattcctag

SEQ ID NO: 8151361 - DNA, 23 bp, Homo sapiens
tcccaatagcactgtcatgtttc

SEQ ID NO: 8151362 - DNA, 22 bp, Homo sapiens
tcccaatagcctaagagcctgg

SEQ ID NO: 8151363 - DNA, 22 bp, Homo sapiens
tcccaattaacaggtatcaggc

SEQ ID NO: 8151364 - DNA, 22 bp, Homo sapiens
tcccaatttcgagagttttaga

SEQ ID NO: 8151365 - DNA, 22 bp, Homo sapiens
tcccaattaacaggtatcaggc

SEQ ID NO: 8151366 - DNA, 22 bp, Homo sapiens
tcccacagatgctgtccagagt

SEQ ID NO: 8151367 - DNA, 21 bp, Homo sapiens
tcccacagcgccagctcctgt

SEQ ID NO: 8151368 - DNA, 21 bp, Homo sapiens
tcccacagcgccagctcctgt

SEQ ID NO: 8151369 - DNA, 21 bp, Homo sapiens
tcccacagcgccagctcctgt

SEQ ID NO: 8151370 - DNA, 22 bp, Homo sapiens
tcccacagagtggctcacctag

SEQ ID NO: 8151371 - DNA, 22 bp, Homo sapiens
tcccacagatgctgtccagagt

SEQ ID NO: 8151372 - DNA, 21 bp, Homo sapiens
tcccacagaaactgcgaaatt

SEQ ID NO: 8151373 - DNA, 22 bp, Homo sapiens
tccatgccaggcagtcgatgca

SEQ ID NO: 8151374 - DNA, 22 bp, Homo sapiens
tccatgcagagtccaggcctca

SEQ ID NO: 8151375 - DNA, 22 bp, Homo sapiens
tcccaagcttagggctctcagt

SEQ ID NO: 8151376 - DNA, 22 bp, Homo sapiens
tcccaagcttagggctctcagt

SEQ ID NO: 8151377 - DNA, 22 bp, Homo sapiens
tcccaaggataagagagtctga

SEQ ID NO: 8151378 - DNA, 20 bp, Homo sapiens
tcccaagggctgagaggatc

SEQ ID NO: 8151379 - DNA, 22 bp, Homo sapiens
tcccaaggtgctcggcaacagg

SEQ ID NO: 8151380 - DNA, 22 bp, Homo sapiens
tcccaaggccaggcatctagaa

SEQ ID NO: 8151381 - DNA, 22 bp, Homo sapiens
tcccaaggcacagggcagggac

SEQ ID NO: 8151382 - DNA, 22 bp, Homo sapiens
tcccaaggccaggcatctagaa

SEQ ID NO: 8151383 - DNA, 22 bp, Homo sapiens
tcccaaggccaggcatctagaa

SEQ ID NO: 8151384 - DNA, 22 bp, Homo sapiens
tcccaaggcacagggcagggac

SEQ ID NO: 8151385 - DNA, 20 bp, Homo sapiens
tcccaaggatgcctgggtgt

SEQ ID NO: 8151386 - DNA, 22 bp, Homo sapiens
tccaggctgcagtcttgccctc

SEQ ID NO: 8151387 - DNA, 22 bp, Homo sapiens
tccaggctgcagtcttgccctc

SEQ ID NO: 8151388 - DNA, 22 bp, Homo sapiens
tccaggctgcagtcttgccctc

SEQ ID NO: 8151389 - DNA, 22 bp, Homo sapiens
tccaggctgcagtcttgccctc

SEQ ID NO: 8151390 - DNA, 22 bp, Homo sapiens
tccaggctgccacagtgcaacg

SEQ ID NO: 8151391 - DNA, 22 bp, Homo sapiens
tccaggctgccacagtgcaacg

SEQ ID NO: 8151392 - DNA, 22 bp, Homo sapiens
tccaggctggaaatgtcaaact

SEQ ID NO: 8151393 - DNA, 22 bp, Homo sapiens
tccaggctggaaatgtcaaact

SEQ ID NO: 8151394 - DNA, 21 bp, Homo sapiens
tccaggctggaaggggcgttg

SEQ ID NO: 8151395 - DNA, 22 bp, Homo sapiens
tccaggctggaaatgtcaaact

SEQ ID NO: 8151396 - DNA, 19 bp, Homo sapiens
tccagggcaggaacatgta

SEQ ID NO: 8151397 - DNA, 22 bp, Homo sapiens
tccagggcagggtgcgcatggg

SEQ ID NO: 8151398 - DNA, 22 bp, Homo sapiens
tccagggccacagaggatgcta

SEQ ID NO: 8151399 - DNA, 19 bp, Homo sapiens
tccagggcaggaacatgta

SEQ ID NO: 8151400 - DNA, 22 bp, Homo sapiens
tccagggcagccgcgggtgcgc

SEQ ID NO: 8151401 - DNA, 22 bp, Homo sapiens
tccagggcagccgcgggtgcgc

SEQ ID NO: 8151402 - DNA, 19 bp, Homo sapiens
tccagggcaggaacatgta

SEQ ID NO: 8151403 - DNA, 19 bp, Homo sapiens
tccagggcaggaacatgta

SEQ ID NO: 8151404 - DNA, 20 bp, Homo sapiens
tccagggccctggctcctct

SEQ ID NO: 8151405 - DNA, 20 bp, Homo sapiens
tccagggccctggctcctct

SEQ ID NO: 8151406 - DNA, 20 bp, Homo sapiens
tccagggccctggctcctct

SEQ ID NO: 8151407 - DNA, 22 bp, Homo sapiens
tccagggccccccagttgcacg

SEQ ID NO: 8151408 - DNA, 22 bp, Homo sapiens
tccagggccatgaagttgcaca

SEQ ID NO: 8151409 - DNA, 22 bp, Homo sapiens
tccagggccacagaggatgcta

SEQ ID NO: 8151410 - DNA, 22 bp, Homo sapiens
tccagggccacagaggatgcta

SEQ ID NO: 8151411 - DNA, 22 bp, Homo sapiens
tccagggccacagaggatgcta

SEQ ID NO: 8151412 - DNA, 22 bp, Homo sapiens
tccagggccacagaggatgcta

SEQ ID NO: 8151413 - DNA, 22 bp, Homo sapiens
tccagggccatctccatgaggc

SEQ ID NO: 8151414 - DNA, 22 bp, Homo sapiens
tccagggccatctccatgaggc

SEQ ID NO: 8151415 - DNA, 22 bp, Homo sapiens
tccagggccagtccttgtctgt

SEQ ID NO: 8151416 - DNA, 22 bp, Homo sapiens
tccagggccatctccatgaggc

SEQ ID NO: 8151417 - DNA, 22 bp, Homo sapiens
tccatcaccatttctgcgagct

SEQ ID NO: 8151418 - DNA, 22 bp, Homo sapiens
tccagtttatttttggcagggt

SEQ ID NO: 8151419 - DNA, 22 bp, Homo sapiens
tccatccacattaacagatacg

SEQ ID NO: 8151420 - DNA, 22 bp, Homo sapiens
tccatccaccctgcattatatt

SEQ ID NO: 8151421 - DNA, 22 bp, Homo sapiens
tccatcatggcagcagcagtga

SEQ ID NO: 8151422 - DNA, 22 bp, Homo sapiens
tccatcatgttcacagctatat

SEQ ID NO: 8151423 - DNA, 22 bp, Homo sapiens
tccagttgcccatctctcttct

SEQ ID NO: 8151424 - DNA, 22 bp, Homo sapiens
tccagttgcctgtctctgatta

SEQ ID NO: 8151425 - DNA, 22 bp, Homo sapiens
tccagttgtttgtattaactct

SEQ ID NO: 8151426 - DNA, 22 bp, Homo sapiens
tccagggctcattccctctgca

SEQ ID NO: 8151427 - DNA, 22 bp, Homo sapiens
tccagggctcattccctctgca

SEQ ID NO: 8151428 - DNA, 22 bp, Homo sapiens
tccagggctcattccctctgca

SEQ ID NO: 8151429 - DNA, 20 bp, Homo sapiens
tccagggctagggagctcat

SEQ ID NO: 8151430 - DNA, 20 bp, Homo sapiens
tccagggctagggagctcat

SEQ ID NO: 8151431 - DNA, 22 bp, Homo sapiens
tccagggctacaaggcaccaga

SEQ ID NO: 8151432 - DNA, 22 bp, Homo sapiens
tccagggctacaaggcaccaga

SEQ ID NO: 8151433 - DNA, 22 bp, Homo sapiens
tccagggctacaaggcaccaga

SEQ ID NO: 8151434 - DNA, 22 bp, Homo sapiens
tccagggctacaaggcaccaga

SEQ ID NO: 8151435 - DNA, 22 bp, Homo sapiens
tccagggctacaaggcaccaga

SEQ ID NO: 8151436 - DNA, 22 bp, Homo sapiens
tccagggctacaaggcaccaga

SEQ ID NO: 8151437 - DNA, 22 bp, Homo sapiens
tccagggcctgaggttgaagtg

SEQ ID NO: 8151438 - DNA, 20 bp, Homo sapiens
tccagggccctggctcctct

SEQ ID NO: 8151439 - DNA, 22 bp, Homo sapiens
tccagggcgtgtgtgaaggaaa

SEQ ID NO: 8151440 - DNA, 21 bp, Homo sapiens
tccagggcgggcgcacggaga

SEQ ID NO: 8151441 - DNA, 21 bp, Homo sapiens
tccagggcgggcgcacggaga

SEQ ID NO: 8151442 - DNA, 22 bp, Homo sapiens
tccaggccacgacctcctggat

SEQ ID NO: 8151443 - DNA, 22 bp, Homo sapiens
tccaggccacgacctcctggat

SEQ ID NO: 8151444 - DNA, 22 bp, Homo sapiens
tccaggccaatgtagcaggccc

SEQ ID NO: 8151445 - DNA, 22 bp, Homo sapiens
tccaggccacatggatggcgat

SEQ ID NO: 8151446 - DNA, 22 bp, Homo sapiens
tccaggccacatggatggcgat

SEQ ID NO: 8151447 - DNA, 22 bp, Homo sapiens
tccaggccacatggatggcgat

SEQ ID NO: 8151448 - DNA, 22 bp, Homo sapiens
tccaggccaatgtagcaggccc

SEQ ID NO: 8151449 - DNA, 22 bp, Homo sapiens
tccaggccaatgtagcaggccc

SEQ ID NO: 8151450 - DNA, 22 bp, Homo sapiens
tccaggcattccagccattcca

SEQ ID NO: 8151451 - DNA, 22 bp, Homo sapiens
tccaggcattccagccattcca

SEQ ID NO: 8151452 - DNA, 22 bp, Homo sapiens
tccaggcatcccccaggacaga

SEQ ID NO: 8151453 - DNA, 19 bp, Homo sapiens
tccaggcatccttcaggct

SEQ ID NO: 8151454 - DNA, 19 bp, Homo sapiens
tccaggcatccttcaggct

SEQ ID NO: 8151455 - DNA, 22 bp, Homo sapiens
tccaggcatctgtattttttaa

SEQ ID NO: 8151456 - DNA, 22 bp, Homo sapiens
tccaggcatcccccaggacaga

SEQ ID NO: 8151457 - DNA, 17 bp, Homo sapiens
tccaggcatatctccta

SEQ ID NO: 8151458 - DNA, 22 bp, Homo sapiens
tccaggcatagaaggcacgcac

SEQ ID NO: 8151459 - DNA, 22 bp, Homo sapiens
tccaggcatgtggccagtactc

SEQ ID NO: 8151460 - DNA, 22 bp, Homo sapiens
tccaggcatgtctgagtccttc

SEQ ID NO: 8151461 - DNA, 22 bp, Homo sapiens
tccaggcatgtctgagtccttc

SEQ ID NO: 8151462 - DNA, 22 bp, Homo sapiens
tccaggcatgtctgagtccttc

SEQ ID NO: 8151463 - DNA, 23 bp, Homo sapiens
tccaggcatgagctctggatgga

SEQ ID NO: 8151464 - DNA, 23 bp, Homo sapiens
tccaggcatgagctctggatgga

SEQ ID NO: 8151465 - DNA, 23 bp, Homo sapiens
tccaggcatgagctctggatgga

SEQ ID NO: 8151466 - DNA, 22 bp, Homo sapiens
tccaggcatggtgtaattttgc

SEQ ID NO: 8151467 - DNA, 22 bp, Homo sapiens
tccaggctctaggctgctctcc

SEQ ID NO: 8151468 - DNA, 22 bp, Homo sapiens
tccaggctctaggctgctctcc

SEQ ID NO: 8151469 - DNA, 22 bp, Homo sapiens
tccaggctctaggctgctctcc

SEQ ID NO: 8151470 - DNA, 22 bp, Homo sapiens
tccaggctctcaggtgtcagca

SEQ ID NO: 8151471 - DNA, 22 bp, Homo sapiens
tccaggctctaggctgctctcc

SEQ ID NO: 8151472 - DNA, 22 bp, Homo sapiens
tccaggctctcaggtgtcagca

SEQ ID NO: 8151473 - DNA, 22 bp, Homo sapiens
tccaggctctcaggtgtcagca

SEQ ID NO: 8151474 - DNA, 22 bp, Homo sapiens
tccaggctctcaggtgtcagca

SEQ ID NO: 8151475 - DNA, 22 bp, Homo sapiens
tccaggctaggtttacaggaca

SEQ ID NO: 8151476 - DNA, 22 bp, Homo sapiens
tccaggctaggtttacaggaca

SEQ ID NO: 8151477 - DNA, 22 bp, Homo sapiens
tccaggctcagcacttgctact

SEQ ID NO: 8151478 - DNA, 22 bp, Homo sapiens
tccaggctcagcacttgctact

SEQ ID NO: 8151479 - DNA, 22 bp, Homo sapiens
tccaggccactgcagaggctct

SEQ ID NO: 8151480 - DNA, 22 bp, Homo sapiens
tccaggccactgcagaggctct

SEQ ID NO: 8151481 - DNA, 22 bp, Homo sapiens
tccaggccactgcagaggctct

SEQ ID NO: 8151482 - DNA, 22 bp, Homo sapiens
tccaggccactgcagaggctct

SEQ ID NO: 8151483 - DNA, 22 bp, Homo sapiens
tccaggctaggtttacaggaca

SEQ ID NO: 8151484 - DNA, 19 bp, Homo sapiens
tccaggctgagagtcagct

SEQ ID NO: 8151485 - DNA, 22 bp, Homo sapiens
tccaggctgacgcagctattta

SEQ ID NO: 8151486 - DNA, 22 bp, Homo sapiens
tccaggctgacgcagctattta

SEQ ID NO: 8151487 - DNA, 19 bp, Homo sapiens
tccaggctgagagtcagct

SEQ ID NO: 8151488 - DNA, 19 bp, Homo sapiens
tccaggctgagagtcagct

SEQ ID NO: 8151489 - DNA, 22 bp, Homo sapiens
tccaggctctcaggtgtcagca

SEQ ID NO: 8151490 - DNA, 23 bp, Homo sapiens
tccaggctgaaggagcagatttt

SEQ ID NO: 8151491 - DNA, 23 bp, Homo sapiens
tccaggctgaaggagcagatttt

SEQ ID NO: 8151492 - DNA, 22 bp, Homo sapiens
tccaggctgacgcagctattta

SEQ ID NO: 8151493 - DNA, 23 bp, Homo sapiens
tccaggctgaaggagcagatttt

SEQ ID NO: 8151494 - DNA, 22 bp, Homo sapiens
tccaggctgcaaggccacaggg

SEQ ID NO: 8151495 - DNA, 22 bp, Homo sapiens
tccaggctgcaaggccacaggg

SEQ ID NO: 8151496 - DNA, 21 bp, Homo sapiens
tccaggctgatgatgtcaact

SEQ ID NO: 8151497 - DNA, 22 bp, Homo sapiens
tccaggctgcaaggccacaggg

SEQ ID NO: 8151498 - DNA, 22 bp, Homo sapiens
tccaggctgcaaggccacaggg

SEQ ID NO: 8151499 - DNA, 21 bp, Homo sapiens
tccaggctgatgatgtcaact

SEQ ID NO: 8151500 - DNA, 22 bp, Homo sapiens
tccaggctgatccatgaagaat

SEQ ID NO: 8151501 - DNA, 22 bp, Homo sapiens
tccaggctgatccatgaagaat

SEQ ID NO: 8151502 - DNA, 22 bp, Homo sapiens
tccaggctgatccatgaagaat

SEQ ID NO: 8151503 - DNA, 19 bp, Homo sapiens
tccaggctgagagtcagct

SEQ ID NO: 8151504 - DNA, 20 bp, Homo sapiens
tccaggcagctcagagtgtc

SEQ ID NO: 8151505 - DNA, 22 bp, Homo sapiens
tccaggcagggcagccatcaag

SEQ ID NO: 8151506 - DNA, 22 bp, Homo sapiens
tccaggcagggcagccatcaag

SEQ ID NO: 8151507 - DNA, 22 bp, Homo sapiens
tccaggcatagaaggcacgcac

SEQ ID NO: 8151508 - DNA, 22 bp, Homo sapiens
tccaggcataagccttgagtgt

SEQ ID NO: 8151509 - DNA, 22 bp, Homo sapiens
tccaggcagggttaagggtcct

SEQ ID NO: 8151510 - DNA, 22 bp, Homo sapiens
tccaggcagttttccaggttgt

SEQ ID NO: 8151511 - DNA, 22 bp, Homo sapiens
tccaggcagttttccaggttgt

SEQ ID NO: 8151512 - DNA, 22 bp, Homo sapiens
tccaggagtgtgtgctaatggg

SEQ ID NO: 8151513 - DNA, 22 bp, Homo sapiens
tccaggagtggggcagaggtct

SEQ ID NO: 8151514 - DNA, 22 bp, Homo sapiens
tccaggagtttgagactgcagt

SEQ ID NO: 8151515 - DNA, 22 bp, Homo sapiens
tccaggagtttgagactgcagt

SEQ ID NO: 8151516 - DNA, 22 bp, Homo sapiens
tccaggagtttgagactgcagt

SEQ ID NO: 8151517 - DNA, 21 bp, Homo sapiens
tccaggagtggctgggcaggg

SEQ ID NO: 8151518 - DNA, 21 bp, Homo sapiens
tccaggagtggctgggcaggg

SEQ ID NO: 8151519 - DNA, 21 bp, Homo sapiens
tccaggagtggctgggcaggg

SEQ ID NO: 8151520 - DNA, 22 bp, Homo sapiens
tccaggagtgataaggccactg

SEQ ID NO: 8151521 - DNA, 21 bp, Homo sapiens
tccaggagtggctgggcaggg

SEQ ID NO: 8151522 - DNA, 22 bp, Homo sapiens
tccaggagtgataaggccactg
